United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 201

SEQ ID NO: 8352394 - DNA, 22 bp, Homo sapiens
ttattctttaaacatatatgtt

SEQ ID NO: 8352395 - DNA, 22 bp, Homo sapiens
ttattatgtgctagagaatgta

SEQ ID NO: 8352396 - DNA, 22 bp, Homo sapiens
ttattatggcagttttctaggt

SEQ ID NO: 8352397 - DNA, 22 bp, Homo sapiens
ttcaaactagttaaaagtcaga

SEQ ID NO: 8352398 - DNA, 22 bp, Homo sapiens
ttcaaactcttgctctgctagt

SEQ ID NO: 8352399 - DNA, 22 bp, Homo sapiens
ttcaaactcttgctctgctagt

SEQ ID NO: 8352400 - DNA, 22 bp, Homo sapiens
ttattgtgggtaggttgtgaaa

SEQ ID NO: 8352401 - DNA, 22 bp, Homo sapiens
ttaggaaaggaacattgaaacg

SEQ ID NO: 8352402 - DNA, 22 bp, Homo sapiens
ttaggaaagttcttcagacatg

SEQ ID NO: 8352403 - DNA, 22 bp, Homo sapiens
ttatacatgtgttttgagatga

SEQ ID NO: 8352404 - DNA, 22 bp, Homo sapiens
ttaggaaagaagcagctaggag

SEQ ID NO: 8352405 - DNA, 22 bp, Homo sapiens
ttaggaaaatgaaattacctgt

SEQ ID NO: 8352406 - DNA, 22 bp, Homo sapiens
ttatagaacagcctcctctaga

SEQ ID NO: 8352407 - DNA, 22 bp, Homo sapiens
ttatagaacggttctgtgcaaa

SEQ ID NO: 8352408 - DNA, 22 bp, Homo sapiens
ttatagaaggagcattcactta

SEQ ID NO: 8352409 - DNA, 22 bp, Homo sapiens
ttatagaaggagcattcactta

SEQ ID NO: 8352410 - DNA, 22 bp, Homo sapiens
ttatagaatggtggattttctg

SEQ ID NO: 8352411 - DNA, 22 bp, Homo sapiens
ttatagatctaaatgtgaaggg

SEQ ID NO: 8352412 - DNA, 22 bp, Homo sapiens
ttatagtattaggtactcaaca

SEQ ID NO: 8352413 - DNA, 22 bp, Homo sapiens
ttatataaagataacttttctt

SEQ ID NO: 8352414 - DNA, 22 bp, Homo sapiens
ttatagttatgaaagactgagg

SEQ ID NO: 8352415 - DNA, 22 bp, Homo sapiens
ttggagatatcacaccttcaca

SEQ ID NO: 8352416 - DNA, 22 bp, Homo sapiens
ttggagatatcacaccttcaca

SEQ ID NO: 8352417 - DNA, 22 bp, Homo sapiens
ttggagagttaattgacagtta

SEQ ID NO: 8352418 - DNA, 22 bp, Homo sapiens
ttggagatgtaaaattcagaga

SEQ ID NO: 8352419 - DNA, 22 bp, Homo sapiens
ttggacttaacaaagggtgatg

SEQ ID NO: 8352420 - DNA, 21 bp, Homo sapiens
ttggacttttgcgtgattgag

SEQ ID NO: 8352421 - DNA, 22 bp, Homo sapiens
ttggacataggtggtaatagtg

SEQ ID NO: 8352422 - DNA, 22 bp, Homo sapiens
ttggacatttattgagtgtggt

SEQ ID NO: 8352423 - DNA, 22 bp, Homo sapiens
ttggcagtcagtcttggtgctt

SEQ ID NO: 8352424 - DNA, 22 bp, Homo sapiens
ttggcagtcaccatcgtgtaga

SEQ ID NO: 8352425 - DNA, 22 bp, Homo sapiens
ttggcagtctcagtcagatggc

SEQ ID NO: 8352426 - DNA, 22 bp, Homo sapiens
ttggcagtgtcactagggagcc

SEQ ID NO: 8352427 - DNA, 22 bp, Homo sapiens
ttggcagcccagcttactagca

SEQ ID NO: 8352428 - DNA, 22 bp, Homo sapiens
ttgggcaggtgtggctctcctt

SEQ ID NO: 8352429 - DNA, 22 bp, Homo sapiens
ttgggcaggtgaagagagggct

SEQ ID NO: 8352430 - DNA, 22 bp, Homo sapiens
ttgggcagggaaaggacaggca

SEQ ID NO: 8352431 - DNA, 22 bp, Homo sapiens
ttgggcagtctggctgcagagt

SEQ ID NO: 8352432 - DNA, 22 bp, Homo sapiens
ttgggcagtagcctcttggtgt

SEQ ID NO: 8352433 - DNA, 22 bp, Homo sapiens
ttgggcagtgattagttcatga

SEQ ID NO: 8352434 - DNA, 22 bp, Homo sapiens
ttgtccagcagctcagtctacg

SEQ ID NO: 8352435 - DNA, 22 bp, Homo sapiens
ttgtcctgaggactgttatcag

SEQ ID NO: 8352436 - DNA, 22 bp, Homo sapiens
ttgtgtctgggggagtgacatc

SEQ ID NO: 8352437 - DNA, 22 bp, Homo sapiens
ttgtaatgagtggatcttaggg

SEQ ID NO: 8352438 - DNA, 22 bp, Homo sapiens
ttgtaactgtgggttgattaga

SEQ ID NO: 8352439 - DNA, 22 bp, Homo sapiens
ttgtaacttaagttttgcatat

SEQ ID NO: 8352440 - DNA, 22 bp, Homo sapiens
ttgtaacttgtgattataatct

SEQ ID NO: 8352441 - DNA, 22 bp, Homo sapiens
ttgtaaatagtagtaagatgcc

SEQ ID NO: 8352442 - DNA, 22 bp, Homo sapiens
ttggaaacgtcaccttttcctt

SEQ ID NO: 8352443 - DNA, 22 bp, Homo sapiens
ttggaaagtgacgttcaactgt

SEQ ID NO: 8352444 - DNA, 22 bp, Homo sapiens
ttggaaagggatatctgtactt

SEQ ID NO: 8352445 - DNA, 22 bp, Homo sapiens
ttggaaagggaggaatgtagac

SEQ ID NO: 8352446 - DNA, 22 bp, Homo sapiens
ttggaaaggagtttttagctat

SEQ ID NO: 8352447 - DNA, 22 bp, Homo sapiens
ttggaaagcaagctggacatac

SEQ ID NO: 8352448 - DNA, 22 bp, Homo sapiens
ttggaaagcaacttttgagagt

SEQ ID NO: 8352449 - DNA, 21 bp, Homo sapiens
ttggaacaagcagcagtttgc

SEQ ID NO: 8352450 - DNA, 22 bp, Homo sapiens
ttggaaatggctgtagttatga

SEQ ID NO: 8352451 - DNA, 22 bp, Homo sapiens
ttggaaatgtagaaaagcagat

SEQ ID NO: 8352452 - DNA, 23 bp, Homo sapiens
ttggaaatggggagaacagattc

SEQ ID NO: 8352453 - DNA, 22 bp, Homo sapiens
ttggaaatacagcagttacttt

SEQ ID NO: 8352454 - DNA, 22 bp, Homo sapiens
ttggaaatacgagtagtatcat

SEQ ID NO: 8352455 - DNA, 22 bp, Homo sapiens
ttggaaatgcaaatatattgaa

SEQ ID NO: 8352456 - DNA, 22 bp, Homo sapiens
ttggaaatgatttctattatta

SEQ ID NO: 8352457 - DNA, 22 bp, Homo sapiens
ttggaaatacgagtagtatcat

SEQ ID NO: 8352458 - DNA, 22 bp, Homo sapiens
ttggacacactgattggccagg

SEQ ID NO: 8352459 - DNA, 22 bp, Homo sapiens
ttggaacacaatgtttctttca

SEQ ID NO: 8352460 - DNA, 22 bp, Homo sapiens
ttgctgaaaggtagctgtgtgg

SEQ ID NO: 8352461 - DNA, 22 bp, Homo sapiens
ttgctgaattgaatcctttggt

SEQ ID NO: 8352462 - DNA, 22 bp, Homo sapiens
ttgcattccagtccccactgtg

SEQ ID NO: 8352463 - DNA, 22 bp, Homo sapiens
ttgcattccatggttttccttc

SEQ ID NO: 8352464 - DNA, 22 bp, Homo sapiens
ttgcattgatgtctatacgctg

SEQ ID NO: 8352465 - DNA, 22 bp, Homo sapiens
ttgcattgatcccagcttgggc

SEQ ID NO: 8352466 - DNA, 22 bp, Homo sapiens
ttgcattgatgttccttcttgc

SEQ ID NO: 8352467 - DNA, 22 bp, Homo sapiens
ttgcattgcttggtcttcaaga

SEQ ID NO: 8352468 - DNA, 22 bp, Homo sapiens
ttgcattctggtgaggttgcct

SEQ ID NO: 8352469 - DNA, 21 bp, Homo sapiens
ttgcattcctgttagtataag

SEQ ID NO: 8352470 - DNA, 22 bp, Homo sapiens
ttgcattcccagccaagttagt

SEQ ID NO: 8352471 - DNA, 22 bp, Homo sapiens
ttgcattgaaaatatattttaa

SEQ ID NO: 8352472 - DNA, 22 bp, Homo sapiens
ttgcattctgttaaaatgtatt

SEQ ID NO: 8352473 - DNA, 22 bp, Homo sapiens
ttgcattgaatgcacattttta

SEQ ID NO: 8352474 - DNA, 19 bp, Homo sapiens
ttgcattgtagttggactg

SEQ ID NO: 8352475 - DNA, 22 bp, Homo sapiens
ttgcattgtaggatgttagaag

SEQ ID NO: 8352476 - DNA, 20 bp, Homo sapiens
ttgcattggatgtgcaggtg

SEQ ID NO: 8352477 - DNA, 22 bp, Homo sapiens
ttgcattgggagtgaggagacc

SEQ ID NO: 8352478 - DNA, 22 bp, Homo sapiens
ttgcattgttgcaatgaagtat

SEQ ID NO: 8352479 - DNA, 22 bp, Homo sapiens
ttgcattgtgattacagaggtg

SEQ ID NO: 8352480 - DNA, 22 bp, Homo sapiens
ttgcatttactgcaccgtgagt

SEQ ID NO: 8352481 - DNA, 22 bp, Homo sapiens
ttgcatttcaattgctcaggaa

SEQ ID NO: 8352482 - DNA, 18 bp, Homo sapiens
ttgctcttctatgtcaat

SEQ ID NO: 8352483 - DNA, 22 bp, Homo sapiens
ttgcagctgttgcaaagtctct

SEQ ID NO: 8352484 - DNA, 22 bp, Homo sapiens
ttgacacaggaaagttgtaact

SEQ ID NO: 8352485 - DNA, 22 bp, Homo sapiens
ttgacaatgtcctttgaatttc

SEQ ID NO: 8352486 - DNA, 22 bp, Homo sapiens
ttgacaattgggagatataaag

SEQ ID NO: 8352487 - DNA, 22 bp, Homo sapiens
ttgacaagaatcgttgccttgg

SEQ ID NO: 8352488 - DNA, 22 bp, Homo sapiens
ttgacagcaaagattgtgccta

SEQ ID NO: 8352489 - DNA, 22 bp, Homo sapiens
ttgacacattagagcttgtaaa

SEQ ID NO: 8352490 - DNA, 22 bp, Homo sapiens
ttgacagaaatgtatttgcatg

SEQ ID NO: 8352491 - DNA, 22 bp, Homo sapiens
ttgacagctattttgctttgat

SEQ ID NO: 8352492 - DNA, 22 bp, Homo sapiens
ttgcaattgctatggagagcgt

SEQ ID NO: 8352493 - DNA, 22 bp, Homo sapiens
ttgcagagatcagcaggtttga

SEQ ID NO: 8352494 - DNA, 22 bp, Homo sapiens
ttgcagaatacttattctgtat

SEQ ID NO: 8352495 - DNA, 22 bp, Homo sapiens
ttgcagaagggcacagtgatca

SEQ ID NO: 8352496 - DNA, 23 bp, Homo sapiens
ttgcagaagcagacgaccataat

SEQ ID NO: 8352497 - DNA, 22 bp, Homo sapiens
ttgcagaattaagcagagagcc

SEQ ID NO: 8352498 - DNA, 22 bp, Homo sapiens
ttgcagacattccagagctttt

SEQ ID NO: 8352499 - DNA, 22 bp, Homo sapiens
tttcagaaagctgaacatatga

SEQ ID NO: 8352500 - DNA, 22 bp, Homo sapiens
tttcagaaagctgaacatatga

SEQ ID NO: 8352501 - DNA, 22 bp, Homo sapiens
tttcacagctgggtggcagagt

SEQ ID NO: 8352502 - DNA, 18 bp, Homo sapiens
tttcacagattcatgact

SEQ ID NO: 8352503 - DNA, 20 bp, Homo sapiens
tttcactggcttgataaggt

SEQ ID NO: 8352504 - DNA, 22 bp, Homo sapiens
tttcccctcagtactaaacata

SEQ ID NO: 8352505 - DNA, 22 bp, Homo sapiens
tttcccatcttagcagattaaa

SEQ ID NO: 8352506 - DNA, 22 bp, Homo sapiens
tttcagagctcagcagctagag

SEQ ID NO: 8352507 - DNA, 22 bp, Homo sapiens
tttcatgaggggcaaaatctca

SEQ ID NO: 8352508 - DNA, 22 bp, Homo sapiens
tttcatgctcatggaacacagc

SEQ ID NO: 8352509 - DNA, 22 bp, Homo sapiens
tttcatgtacttttttgataga

SEQ ID NO: 8352510 - DNA, 22 bp, Homo sapiens
tttcacacgcatctgtctgccc

SEQ ID NO: 8352511 - DNA, 22 bp, Homo sapiens
tttcacaatgcaatcctacttc

SEQ ID NO: 8352512 - DNA, 23 bp, Homo sapiens
tttcacaatgagcattacagaat

SEQ ID NO: 8352513 - DNA, 22 bp, Homo sapiens
tttcacacttgatttgcagtta

SEQ ID NO: 8352514 - DNA, 22 bp, Homo sapiens
tttcacagagaatattgccttg

SEQ ID NO: 8352515 - DNA, 22 bp, Homo sapiens
tttattgagtatctactatgtg

SEQ ID NO: 8352516 - DNA, 23 bp, Homo sapiens
tttcaaattactctgcagatgac

SEQ ID NO: 8352517 - DNA, 23 bp, Homo sapiens
tttcaacaatgcttagagaaaac

SEQ ID NO: 8352518 - DNA, 22 bp, Homo sapiens
tttattctgtgctacatgaaga

SEQ ID NO: 8352519 - DNA, 22 bp, Homo sapiens
tttattcaagatgaggttcatg

SEQ ID NO: 8352520 - DNA, 20 bp, Homo sapiens
tttattcacagagaagagtt

SEQ ID NO: 8352521 - DNA, 21 bp, Homo sapiens
tttattctcagatacagggag

SEQ ID NO: 8352522 - DNA, 22 bp, Homo sapiens
tttaaactgttgattttatgaa

SEQ ID NO: 8352523 - DNA, 22 bp, Homo sapiens
ttgtgtcttaaagattaaatgg

SEQ ID NO: 8352524 - DNA, 22 bp, Homo sapiens
tttaagatggtattttataaag

SEQ ID NO: 8352525 - DNA, 22 bp, Homo sapiens
tttaaatgtttaaaactcgtga

SEQ ID NO: 8352526 - DNA, 22 bp, Homo sapiens
tttaaatgtgttcttagtagct

SEQ ID NO: 8352527 - DNA, 22 bp, Homo sapiens
tttaaatgcagacgttgattca

SEQ ID NO: 8352528 - DNA, 22 bp, Homo sapiens
tttaaataggactcctgggggt

SEQ ID NO: 8352529 - DNA, 19 bp, Homo sapiens
tttaagcaatagtatcttg

SEQ ID NO: 8352530 - DNA, 22 bp, Homo sapiens
tttaagcagagaaatgatgtat

SEQ ID NO: 8352531 - DNA, 22 bp, Homo sapiens
tttattcaagatgaggttcatg

SEQ ID NO: 8352532 - DNA, 22 bp, Homo sapiens
tttatatttcccaggattggcc

SEQ ID NO: 8352533 - DNA, 22 bp, Homo sapiens
tttatattgtaaaaatggttct

SEQ ID NO: 8352534 - DNA, 22 bp, Homo sapiens
tttatattgggagtcgttttga

SEQ ID NO: 8352535 - DNA, 22 bp, Homo sapiens
tttatatatggctggtctggat

SEQ ID NO: 8352536 - DNA, 22 bp, Homo sapiens
tttatatagagatttgtgcatg

SEQ ID NO: 8352537 - DNA, 22 bp, Homo sapiens
tttagcagaatttctctagaag

SEQ ID NO: 8352538 - DNA, 22 bp, Homo sapiens
tttagcaggcagggatgggtgt

SEQ ID NO: 8352539 - DNA, 22 bp, Homo sapiens
tttagcagctggtgttaccata

SEQ ID NO: 8352540 - DNA, 22 bp, Homo sapiens
tttagcagatctatgtatgtga

SEQ ID NO: 8352541 - DNA, 22 bp, Homo sapiens
tttagagagcactgtagacact

SEQ ID NO: 8352542 - DNA, 22 bp, Homo sapiens
tttagagaggctctgtaaaatg

SEQ ID NO: 8352543 - DNA, 22 bp, Homo sapiens
tttagagagtgtaaaaatatat

SEQ ID NO: 8352544 - DNA, 22 bp, Homo sapiens
tttagagagaattttcaaagtg

SEQ ID NO: 8352545 - DNA, 22 bp, Homo sapiens
tttagagaattagaacagtact

SEQ ID NO: 8352546 - DNA, 22 bp, Homo sapiens
tttagagaattagaacagtact

SEQ ID NO: 8352547 - DNA, 20 bp, Homo sapiens
tttacattttgaaacagtga

SEQ ID NO: 8352548 - DNA, 20 bp, Homo sapiens
tttacattttgaaacagtga

SEQ ID NO: 8352549 - DNA, 22 bp, Homo sapiens
tttaccaaatgagactattgtt

SEQ ID NO: 8352550 - DNA, 17 bp, Homo sapiens
tttagaatacaatgttt

SEQ ID NO: 8352551 - DNA, 22 bp, Homo sapiens
tttgaaaggaattaggatgaca

SEQ ID NO: 8352552 - DNA, 22 bp, Homo sapiens
tttgaaaggtgtcgagatgtgt

SEQ ID NO: 8352553 - DNA, 22 bp, Homo sapiens
tttgaaaggaagttaatacttt

SEQ ID NO: 8352554 - DNA, 21 bp, Homo sapiens
tttgaaagctacatctatagc

SEQ ID NO: 8352555 - DNA, 21 bp, Homo sapiens
tttgaaagctacatctatagc

SEQ ID NO: 8352556 - DNA, 22 bp, Homo sapiens
tttgaaaggagctttatccaga

SEQ ID NO: 8352557 - DNA, 17 bp, Homo sapiens
tttgaaaggatgtcagt

SEQ ID NO: 8352558 - DNA, 22 bp, Homo sapiens
tttgaaaggaattaggatgaca

SEQ ID NO: 8352559 - DNA, 22 bp, Homo sapiens
tttgaaagggaaataaactcct

SEQ ID NO: 8352560 - DNA, 20 bp, Homo sapiens
tttgaatgtaaagcatgtca

SEQ ID NO: 8352561 - DNA, 22 bp, Homo sapiens
tttgacaaaggaaaaatgcaca

SEQ ID NO: 8352562 - DNA, 22 bp, Homo sapiens
tttgacaacacgttatttgcct

SEQ ID NO: 8352563 - DNA, 22 bp, Homo sapiens
tttgacaaatatttattggcac

SEQ ID NO: 8352564 - DNA, 22 bp, Homo sapiens
tttgacagacatttactacatt

SEQ ID NO: 8352565 - DNA, 22 bp, Homo sapiens
tttgacagatccttaactcagc

SEQ ID NO: 8352566 - DNA, 22 bp, Homo sapiens
tttgacagacatttactacatt

SEQ ID NO: 8352567 - DNA, 22 bp, Homo sapiens
tttgacaacagcaaatgtcaca

SEQ ID NO: 8352568 - DNA, 22 bp, Homo sapiens
tttgacaattaggtagaaaaag

SEQ ID NO: 8352569 - DNA, 22 bp, Homo sapiens
tttgacaagagcaaatgttctt

SEQ ID NO: 8352570 - DNA, 22 bp, Homo sapiens
tttcttttccaatatccctact

SEQ ID NO: 8352571 - DNA, 22 bp, Homo sapiens
tttcttttgccctgtgggttag

SEQ ID NO: 8352572 - DNA, 22 bp, Homo sapiens
tttcttttacagtgtggctatt

SEQ ID NO: 8352573 - DNA, 22 bp, Homo sapiens
tttcctctccaccaggaggtct

SEQ ID NO: 8352574 - DNA, 22 bp, Homo sapiens
tttcctctccggggcctccagg

SEQ ID NO: 8352575 - DNA, 22 bp, Homo sapiens
tttcctctgagtgagctgggag

SEQ ID NO: 8352576 - DNA, 22 bp, Homo sapiens
tttcctctgatgctgacttgga

SEQ ID NO: 8352577 - DNA, 22 bp, Homo sapiens
tttcctctgactgctcccctgc

SEQ ID NO: 8352578 - DNA, 22 bp, Homo sapiens
tttcctctaaacgcatttgctt

SEQ ID NO: 8352579 - DNA, 22 bp, Homo sapiens
tttcctctaaacgcatttgctt

SEQ ID NO: 8352580 - DNA, 22 bp, Homo sapiens
tttcccttgttccttcctctga

SEQ ID NO: 8352581 - DNA, 22 bp, Homo sapiens
tttccctgaggcctggacatta

SEQ ID NO: 8352582 - DNA, 22 bp, Homo sapiens
tttggtattgcacactgtcttc

SEQ ID NO: 8352583 - DNA, 22 bp, Homo sapiens
tttggttgtatcattctatgaa

SEQ ID NO: 8352584 - DNA, 22 bp, Homo sapiens
tttggtttttaatacaaagtac

SEQ ID NO: 8352585 - DNA, 22 bp, Homo sapiens
tttggtttttacctgctgagag

SEQ ID NO: 8352586 - DNA, 22 bp, Homo sapiens
tttgtaaaagcccaagctgtag

SEQ ID NO: 8352587 - DNA, 22 bp, Homo sapiens
tttggaaacacggtcatcttcc

SEQ ID NO: 8352588 - DNA, 22 bp, Homo sapiens
tttggaaacatctcagaaaata

SEQ ID NO: 8352589 - DNA, 22 bp, Homo sapiens
tttggaaactgatggtacattc

SEQ ID NO: 8352590 - DNA, 22 bp, Homo sapiens
tttggaaaaagacagcttatga

SEQ ID NO: 8352591 - DNA, 22 bp, Homo sapiens
tttggaaatttcatcaatagcc

SEQ ID NO: 8352592 - DNA, 22 bp, Homo sapiens
tttggaaatgagaagccacctt

SEQ ID NO: 8352593 - DNA, 22 bp, Homo sapiens
tttggaaagacacacagtttta

SEQ ID NO: 8352594 - DNA, 22 bp, Homo sapiens
tttggaaagtgtacaaatttga

SEQ ID NO: 8352595 - DNA, 22 bp, Homo sapiens
tttgatttactggatattctca

SEQ ID NO: 8352596 - DNA, 22 bp, Homo sapiens
tttgatttactataagcagcac

SEQ ID NO: 8352597 - DNA, 18 bp, Homo sapiens
tttgattgctgtcatcca

SEQ ID NO: 8352598 - DNA, 22 bp, Homo sapiens
tttgattctgtaaaataacagg

SEQ ID NO: 8352599 - DNA, 22 bp, Homo sapiens
tttgattcaatgtttatataaa

SEQ ID NO: 8352600 - DNA, 22 bp, Homo sapiens
tttgattctaagttctgtcaac

SEQ ID NO: 8352601 - DNA, 22 bp, Homo sapiens
tttgatgacctgtatctttttc

SEQ ID NO: 8352602 - DNA, 22 bp, Homo sapiens
tttgatgaacctatataatttg

SEQ ID NO: 8352603 - DNA, 22 bp, Homo sapiens
tttgatgaaagctactatttac

SEQ ID NO: 8352604 - DNA, 22 bp, Homo sapiens
tttgaggttagctagcagatca

SEQ ID NO: 8352605 - DNA, 22 bp, Homo sapiens
tttgataacagtgaatatcatg

SEQ ID NO: 8352606 - DNA, 22 bp, Homo sapiens
ttttcttatagagcttaaagtt

SEQ ID NO: 8352607 - DNA, 22 bp, Homo sapiens
ttttcttatggtgaagcacaaa

SEQ ID NO: 8352608 - DNA, 22 bp, Homo sapiens
ttttcttatgtgcagctatatg

SEQ ID NO: 8352609 - DNA, 22 bp, Homo sapiens
ttttccaccttctagagattgt

SEQ ID NO: 8352610 - DNA, 22 bp, Homo sapiens
ttttcatttttgtagatgcaag

SEQ ID NO: 8352611 - DNA, 22 bp, Homo sapiens
ttttcatttacattagggaaga

SEQ ID NO: 8352612 - DNA, 22 bp, Homo sapiens
ttttcatttacattagggaaga

SEQ ID NO: 8352613 - DNA, 22 bp, Homo sapiens
ttttctgaagtttaagacattt

SEQ ID NO: 8352614 - DNA, 22 bp, Homo sapiens
ttttctgacctatctacattta

SEQ ID NO: 8352615 - DNA, 22 bp, Homo sapiens
ttttctgacctatctacattta

SEQ ID NO: 8352616 - DNA, 22 bp, Homo sapiens
ttttattgcaataaagtgtgta

SEQ ID NO: 8352617 - DNA, 22 bp, Homo sapiens
ttttatgtgtgaaatgctgtct

SEQ ID NO: 8352618 - DNA, 22 bp, Homo sapiens
ttttatgttgctataataggta

SEQ ID NO: 8352619 - DNA, 22 bp, Homo sapiens
ttttatgttcctgaagctatct

SEQ ID NO: 8352620 - DNA, 22 bp, Homo sapiens
ttttattagtggctagatgggg

SEQ ID NO: 8352621 - DNA, 22 bp, Homo sapiens
ttttcattgttactatgagcta

SEQ ID NO: 8352622 - DNA, 22 bp, Homo sapiens
ttttcattgttcctcgagcatt

SEQ ID NO: 8352623 - DNA, 22 bp, Homo sapiens
ttttcattagaatgactgagaa

SEQ ID NO: 8352624 - DNA, 22 bp, Homo sapiens
ttttcattgtaaatcaggaaac

SEQ ID NO: 8352625 - DNA, 22 bp, Homo sapiens
ttttcacattgtcccagcacta

SEQ ID NO: 8352626 - DNA, 22 bp, Homo sapiens
ttttcagttttccaggtagccg

SEQ ID NO: 8352627 - DNA, 22 bp, Homo sapiens
ttttcacacaaggtgataagtt

SEQ ID NO: 8352628 - DNA, 22 bp, Homo sapiens
ttttcatagtaatggtgcatgt

SEQ ID NO: 8352629 - DNA, 22 bp, Homo sapiens
ttttatgtaataaactgtacac

SEQ ID NO: 8352630 - DNA, 22 bp, Homo sapiens
ttttatgtaatccttactgtcg

SEQ ID NO: 8352631 - DNA, 22 bp, Homo sapiens
ttttatgattgagctggctaca

SEQ ID NO: 8352632 - DNA, 22 bp, Homo sapiens
ttttaattcaaagtgaatagtg

SEQ ID NO: 8352633 - DNA, 22 bp, Homo sapiens
ttttaaagagatgctgtgcata

SEQ ID NO: 8352634 - DNA, 22 bp, Homo sapiens
ttttaaaggcagattatggctt

SEQ ID NO: 8352635 - DNA, 21 bp, Homo sapiens
ttttaacaaggatttccctag

SEQ ID NO: 8352636 - DNA, 22 bp, Homo sapiens
ttttaaaggctgtatgaccaag

SEQ ID NO: 8352637 - DNA, 22 bp, Homo sapiens
ttttaacactcagcactatctc

SEQ ID NO: 8352638 - DNA, 21 bp, Homo sapiens
tttgtgtgtcacgtgcacagg

SEQ ID NO: 8352639 - DNA, 22 bp, Homo sapiens
tttgtgtgtgctcacatagatg

SEQ ID NO: 8352640 - DNA, 22 bp, Homo sapiens
tttgtgtgtgtataggaaagga

SEQ ID NO: 8352641 - DNA, 22 bp, Homo sapiens
tttgtgtgtgctcacatagatg

SEQ ID NO: 8352642 - DNA, 22 bp, Homo sapiens
tttgtaagtggtagatctaaga

SEQ ID NO: 8352643 - DNA, 22 bp, Homo sapiens
tttgtaagcaaaaagtccattc

SEQ ID NO: 8352644 - DNA, 22 bp, Homo sapiens
tttgtaaaaggaggaagcatgg

SEQ ID NO: 8352645 - DNA, 22 bp, Homo sapiens
tttttataccacctctcactta

SEQ ID NO: 8352646 - DNA, 22 bp, Homo sapiens
tttttataccacctctcactta

SEQ ID NO: 8352647 - DNA, 22 bp, Homo sapiens
tttttataactcttttgtgaca

SEQ ID NO: 8352648 - DNA, 22 bp, Homo sapiens
tttttagaattggctgagaatt

SEQ ID NO: 8352649 - DNA, 22 bp, Homo sapiens
tttttagtagaggtgggtttca

SEQ ID NO: 8352650 - DNA, 22 bp, Homo sapiens
ttttgttggcttaagaaataca

SEQ ID NO: 8352651 - DNA, 22 bp, Homo sapiens
tttttcacacatgtggcttgat

SEQ ID NO: 8352652 - DNA, 22 bp, Homo sapiens
actgcagtggcaggaacttatc

SEQ ID NO: 8352653 - DNA, 22 bp, Homo sapiens
actgcagttggtgacaataacc

SEQ ID NO: 8352654 - DNA, 21 bp, Homo sapiens
actgcatctgaagtcccagga

SEQ ID NO: 8352655 - DNA, 22 bp, Homo sapiens
aagttcaatggaaaagctttag

SEQ ID NO: 8352656 - DNA, 22 bp, Homo sapiens
aagttcatcaaagagtaaatat

SEQ ID NO: 8352657 - DNA, 22 bp, Homo sapiens
actgaaaatgaattagaaacag

SEQ ID NO: 8352658 - DNA, 22 bp, Homo sapiens
actcttcttgctgctcattaat

SEQ ID NO: 8352659 - DNA, 22 bp, Homo sapiens
aagtgtgaattttagagtcagg

SEQ ID NO: 8352660 - DNA, 22 bp, Homo sapiens
aagtgtgagacacacaaaatta

SEQ ID NO: 8352661 - DNA, 22 bp, Homo sapiens
acctgcctctaagcagcaggtg

SEQ ID NO: 8352662 - DNA, 22 bp, Homo sapiens
acctgcctcagtgcagctggat

SEQ ID NO: 8352663 - DNA, 22 bp, Homo sapiens
actgtacacagtggtgtactgt

SEQ ID NO: 8352664 - DNA, 22 bp, Homo sapiens
actgtacacacttctctgtctt

SEQ ID NO: 8352665 - DNA, 22 bp, Homo sapiens
actgtacaactgctgagcagaa

SEQ ID NO: 8352666 - DNA, 22 bp, Homo sapiens
actgtacacgtgtcatttacag

SEQ ID NO: 8352667 - DNA, 22 bp, Homo sapiens
actgtacacagtggtgtactgt

SEQ ID NO: 8352668 - DNA, 22 bp, Homo sapiens
aatagcaattacatttgcacca

SEQ ID NO: 8352669 - DNA, 22 bp, Homo sapiens
aatagcaattacatttgcacca

SEQ ID NO: 8352670 - DNA, 22 bp, Homo sapiens
aatagcaaatgctcatttgaaa

SEQ ID NO: 8352671 - DNA, 22 bp, Homo sapiens
aatagcaaacagacatgcacaa

SEQ ID NO: 8352672 - DNA, 22 bp, Homo sapiens
aatagcaaacagacatgcacaa

SEQ ID NO: 8352673 - DNA, 22 bp, Homo sapiens
aatagcatcctaaaacatactt

SEQ ID NO: 8352674 - DNA, 22 bp, Homo sapiens
aatagcagaagactagtagaca

SEQ ID NO: 8352675 - DNA, 20 bp, Homo sapiens
aataaaagaagccttcaccc

SEQ ID NO: 8352676 - DNA, 21 bp, Homo sapiens
aataaaacagttggtgtcaat

SEQ ID NO: 8352677 - DNA, 21 bp, Homo sapiens
aataaaacagttggtgtcaat

SEQ ID NO: 8352678 - DNA, 22 bp, Homo sapiens
actgggaggcatctggagctga

SEQ ID NO: 8352679 - DNA, 22 bp, Homo sapiens
actggggaatggaactgggaat

SEQ ID NO: 8352680 - DNA, 22 bp, Homo sapiens
aataatagcagagtttacaatc

SEQ ID NO: 8352681 - DNA, 22 bp, Homo sapiens
actgggcaccatcatgagatgg

SEQ ID NO: 8352682 - DNA, 22 bp, Homo sapiens
actgggcaccatcatgagatag

SEQ ID NO: 8352683 - DNA, 22 bp, Homo sapiens
aatcacaaacgaattgatggaa

SEQ ID NO: 8352684 - DNA, 22 bp, Homo sapiens
aatcaagagttgtgtaatattt

SEQ ID NO: 8352685 - DNA, 22 bp, Homo sapiens
acttttaaggggccttgattta

SEQ ID NO: 8352686 - DNA, 22 bp, Homo sapiens
actttgttctaatagtatctct

SEQ ID NO: 8352687 - DNA, 22 bp, Homo sapiens
actttgttttatagcacataag

SEQ ID NO: 8352688 - DNA, 22 bp, Homo sapiens
acttttaaatgagtttcagttg

SEQ ID NO: 8352689 - DNA, 22 bp, Homo sapiens
aataggaagcaccaaattctcc

SEQ ID NO: 8352690 - DNA, 22 bp, Homo sapiens
aatagcatgttcatgataaaat

SEQ ID NO: 8352691 - DNA, 22 bp, Homo sapiens
aatagcatttttaagggaatca

SEQ ID NO: 8352692 - DNA, 22 bp, Homo sapiens
aatagcatgcatcctgcataga

SEQ ID NO: 8352693 - DNA, 22 bp, Homo sapiens
aatagcatcttctgagacaaag

SEQ ID NO: 8352694 - DNA, 22 bp, Homo sapiens
aatagcatgtaagtttaaaaga

SEQ ID NO: 8352695 - DNA, 22 bp, Homo sapiens
aatctagagttcccagcataaa

SEQ ID NO: 8352696 - DNA, 19 bp, Homo sapiens
aatctagaaatatgtgttc

SEQ ID NO: 8352697 - DNA, 22 bp, Homo sapiens
agaaagggaccagttcttttga

SEQ ID NO: 8352698 - DNA, 22 bp, Homo sapiens
aatcacagtttcaagtaatgca

SEQ ID NO: 8352699 - DNA, 22 bp, Homo sapiens
aatcacagtttcaagtaatgca

SEQ ID NO: 8352700 - DNA, 22 bp, Homo sapiens
aatcacagtttcaagtaatgca

SEQ ID NO: 8352701 - DNA, 22 bp, Homo sapiens
aatcacagttagtaagggagaa

SEQ ID NO: 8352702 - DNA, 20 bp, Homo sapiens
aatcacagttaactctttct

SEQ ID NO: 8352703 - DNA, 22 bp, Homo sapiens
aatcacaggcatagattgctcc

SEQ ID NO: 8352704 - DNA, 22 bp, Homo sapiens
aatcacaggcatagattgctcc

SEQ ID NO: 8352705 - DNA, 22 bp, Homo sapiens
aatcacagtgggtactagattg

SEQ ID NO: 8352706 - DNA, 22 bp, Homo sapiens
aatcacagagtccagcagatga

SEQ ID NO: 8352707 - DNA, 22 bp, Homo sapiens
aatcacaaatttagacagagct

SEQ ID NO: 8352708 - DNA, 22 bp, Homo sapiens
aatgcattttattatatgtgac

SEQ ID NO: 8352709 - DNA, 22 bp, Homo sapiens
aatgccattgatttatatactt

SEQ ID NO: 8352710 - DNA, 22 bp, Homo sapiens
aatgcattagctacatatgtct

SEQ ID NO: 8352711 - DNA, 23 bp, Homo sapiens
aatgcattaatttgggagagtac

SEQ ID NO: 8352712 - DNA, 22 bp, Homo sapiens
aatgcattgttgatttggagtg

SEQ ID NO: 8352713 - DNA, 22 bp, Homo sapiens
agaagccagtcgctctcccgca

SEQ ID NO: 8352714 - DNA, 22 bp, Homo sapiens
agaagccagccttgcctccttt

SEQ ID NO: 8352715 - DNA, 22 bp, Homo sapiens
agaaggaaacagctgtgctttg

SEQ ID NO: 8352716 - DNA, 22 bp, Homo sapiens
agaaggaaaacctgtcttatgt

SEQ ID NO: 8352717 - DNA, 22 bp, Homo sapiens
aatctatatgcttttcacatac

SEQ ID NO: 8352718 - DNA, 22 bp, Homo sapiens
agaacacactgggggaaacaag

SEQ ID NO: 8352719 - DNA, 22 bp, Homo sapiens
agaactatacattactcattga

SEQ ID NO: 8352720 - DNA, 22 bp, Homo sapiens
agaagcagctttcaaggtgatt

SEQ ID NO: 8352721 - DNA, 22 bp, Homo sapiens
aatgaatgaaccacatataaca

SEQ ID NO: 8352722 - DNA, 22 bp, Homo sapiens
acctgccctggaggaagatatt

SEQ ID NO: 8352723 - DNA, 22 bp, Homo sapiens
acctgcccttaacactgtgtgc

SEQ ID NO: 8352724 - DNA, 22 bp, Homo sapiens
acctgcctatcagctgcctgct

SEQ ID NO: 8352725 - DNA, 22 bp, Homo sapiens
aagtcctcaattttctctgcta

SEQ ID NO: 8352726 - DNA, 22 bp, Homo sapiens
aagtagttggaaataagacaga

SEQ ID NO: 8352727 - DNA, 19 bp, Homo sapiens
aagtatagtcagccttcta

SEQ ID NO: 8352728 - DNA, 22 bp, Homo sapiens
acccagggcttaaggcggtgca

SEQ ID NO: 8352729 - DNA, 22 bp, Homo sapiens
acccaggggcagccttgctgtg

SEQ ID NO: 8352730 - DNA, 22 bp, Homo sapiens
acccagggctcaagcgtaggca

SEQ ID NO: 8352731 - DNA, 20 bp, Homo sapiens
acctcctggaagcaggtgcc

SEQ ID NO: 8352732 - DNA, 17 bp, Homo sapiens
acctattgatctgtcac

SEQ ID NO: 8352733 - DNA, 21 bp, Homo sapiens
acctcctggcatcctgttccc

SEQ ID NO: 8352734 - DNA, 22 bp, Homo sapiens
acctctggacactgcatccttc

SEQ ID NO: 8352735 - DNA, 22 bp, Homo sapiens
acctctggcaccccctggcttg

SEQ ID NO: 8352736 - DNA, 19 bp, Homo sapiens
acctctgagaatgccagtc

SEQ ID NO: 8352737 - DNA, 22 bp, Homo sapiens
acctctgaagggccaagcaatg

SEQ ID NO: 8352738 - DNA, 17 bp, Homo sapiens
accagagttttccatgc

SEQ ID NO: 8352739 - DNA, 22 bp, Homo sapiens
accagaggctctgccacctcca

SEQ ID NO: 8352740 - DNA, 22 bp, Homo sapiens
aagggtggtgtaggagatcaaa

SEQ ID NO: 8352741 - DNA, 22 bp, Homo sapiens
aagggtggtgtaggagatcaaa

SEQ ID NO: 8352742 - DNA, 22 bp, Homo sapiens
aagggtgggccctggcagccat

SEQ ID NO: 8352743 - DNA, 22 bp, Homo sapiens
aagggtgggcaccgccaggtca

SEQ ID NO: 8352744 - DNA, 22 bp, Homo sapiens
aagggtgggcaccgccaggtca

SEQ ID NO: 8352745 - DNA, 22 bp, Homo sapiens
acatttcagtgagctattgaag

SEQ ID NO: 8352746 - DNA, 22 bp, Homo sapiens
aagggctggagaggaaaggttg

SEQ ID NO: 8352747 - DNA, 22 bp, Homo sapiens
aaggaagcagcaatgcatgatt

SEQ ID NO: 8352748 - DNA, 22 bp, Homo sapiens
aaggaagccttgcctgaataca

SEQ ID NO: 8352749 - DNA, 22 bp, Homo sapiens
aaggaagaatcatcacgttggg

SEQ ID NO: 8352750 - DNA, 22 bp, Homo sapiens
aaggaggccctctccttctgga

SEQ ID NO: 8352751 - DNA, 22 bp, Homo sapiens
aagctgtggcttggaggaaaca

SEQ ID NO: 8352752 - DNA, 22 bp, Homo sapiens
aaggcacatattgcagatcttg

SEQ ID NO: 8352753 - DNA, 22 bp, Homo sapiens
aaggcaaggttcaccgtgctat

SEQ ID NO: 8352754 - DNA, 22 bp, Homo sapiens
acatgaatgaagactttacaat

SEQ ID NO: 8352755 - DNA, 22 bp, Homo sapiens
acatgaagtggtcagatcaaac

SEQ ID NO: 8352756 - DNA, 22 bp, Homo sapiens
acatgcatgtctatgggcaggt

SEQ ID NO: 8352757 - DNA, 22 bp, Homo sapiens
acatgacatagtagaaaagccc

SEQ ID NO: 8352758 - DNA, 22 bp, Homo sapiens
acatgacagtgcttagcaaact

SEQ ID NO: 8352759 - DNA, 22 bp, Homo sapiens
aatttcaattacttttgcacca

SEQ ID NO: 8352760 - DNA, 22 bp, Homo sapiens
agaggatgttctaggcactcat

SEQ ID NO: 8352761 - DNA, 22 bp, Homo sapiens
agaggatgattttaaggacact

SEQ ID NO: 8352762 - DNA, 23 bp, Homo sapiens
aatttcccctgtctctgatttgg

SEQ ID NO: 8352763 - DNA, 22 bp, Homo sapiens
aatttcctgggataaaaagcca

SEQ ID NO: 8352764 - DNA, 22 bp, Homo sapiens
aatttccagatcagatgactca

SEQ ID NO: 8352765 - DNA, 22 bp, Homo sapiens
agaggagtgggaagcagtgcaa

SEQ ID NO: 8352766 - DNA, 22 bp, Homo sapiens
agaggatggttgaggaagacct

SEQ ID NO: 8352767 - DNA, 22 bp, Homo sapiens
agaggatggttgaggaagacct

SEQ ID NO: 8352768 - DNA, 22 bp, Homo sapiens
agaggaggtggtgatgctttaa

SEQ ID NO: 8352769 - DNA, 22 bp, Homo sapiens
agaggaggtggtgatgctttaa

SEQ ID NO: 8352770 - DNA, 22 bp, Homo sapiens
agaggaggtccttttctgatgt

SEQ ID NO: 8352771 - DNA, 22 bp, Homo sapiens
aattccaggatgcaggaggtgc

SEQ ID NO: 8352772 - DNA, 21 bp, Homo sapiens
agagctggtaggtaggtaggt

SEQ ID NO: 8352773 - DNA, 21 bp, Homo sapiens
agagctggtaggtaggtaggt

SEQ ID NO: 8352774 - DNA, 22 bp, Homo sapiens
aattccacagatgtctatctgt

SEQ ID NO: 8352775 - DNA, 21 bp, Homo sapiens
agaggaagtgattggtctggc

SEQ ID NO: 8352776 - DNA, 22 bp, Homo sapiens
aattcattgccagaatctatga

SEQ ID NO: 8352777 - DNA, 22 bp, Homo sapiens
aattcatccatgaacaattcca

SEQ ID NO: 8352778 - DNA, 22 bp, Homo sapiens
aattcattaagaaagagctaaa

SEQ ID NO: 8352779 - DNA, 22 bp, Homo sapiens
agagctgagcaccaagcatggt

SEQ ID NO: 8352780 - DNA, 22 bp, Homo sapiens
agagctgccctgccagttctaa

SEQ ID NO: 8352781 - DNA, 22 bp, Homo sapiens
aattaatggaaagtaaggaagg

SEQ ID NO: 8352782 - DNA, 22 bp, Homo sapiens
aattaagtcacacacctaaacc

SEQ ID NO: 8352783 - DNA, 21 bp, Homo sapiens
aattacagatggaattacaga

SEQ ID NO: 8352784 - DNA, 22 bp, Homo sapiens
agacatggagaaggagccagtg

SEQ ID NO: 8352785 - DNA, 22 bp, Homo sapiens
agacatgtcaccaattcttact

SEQ ID NO: 8352786 - DNA, 22 bp, Homo sapiens
agacatttattcacacatttat

SEQ ID NO: 8352787 - DNA, 22 bp, Homo sapiens
agacatttattcacacatttat

SEQ ID NO: 8352788 - DNA, 22 bp, Homo sapiens
aatgtattatacataatttgtg

SEQ ID NO: 8352789 - DNA, 22 bp, Homo sapiens
agagaaatggggtaatctttca

SEQ ID NO: 8352790 - DNA, 22 bp, Homo sapiens
agagaaatggggtaatctttca

SEQ ID NO: 8352791 - DNA, 22 bp, Homo sapiens
aatgtattcctcatgcaagagt

SEQ ID NO: 8352792 - DNA, 22 bp, Homo sapiens
agagcaagtgacagaaacaggg

SEQ ID NO: 8352793 - DNA, 22 bp, Homo sapiens
agagcaacgaggtgatactaga

SEQ ID NO: 8352794 - DNA, 22 bp, Homo sapiens
agagatctgtggattcattgtc

SEQ ID NO: 8352795 - DNA, 22 bp, Homo sapiens
agagatgaaaagggtactgagg

SEQ ID NO: 8352796 - DNA, 22 bp, Homo sapiens
agagatgaaaagggtactgagg

SEQ ID NO: 8352797 - DNA, 22 bp, Homo sapiens
agcacaatagagcagttaaaaa

SEQ ID NO: 8352798 - DNA, 22 bp, Homo sapiens
agcacaggaacatggagatggg

SEQ ID NO: 8352799 - DNA, 22 bp, Homo sapiens
agcacagaaagcacatttgaaa

SEQ ID NO: 8352800 - DNA, 22 bp, Homo sapiens
agcacaggtaatacagagtaac

SEQ ID NO: 8352801 - DNA, 22 bp, Homo sapiens
agcacagggacaatgccaggtg

SEQ ID NO: 8352802 - DNA, 22 bp, Homo sapiens
agcacaggctttggtgtgaggg

SEQ ID NO: 8352803 - DNA, 22 bp, Homo sapiens
agcacagggcccagcctaggcc

SEQ ID NO: 8352804 - DNA, 22 bp, Homo sapiens
agcacaggaccaaggaagctgt

SEQ ID NO: 8352805 - DNA, 22 bp, Homo sapiens
agcacaggacgtagagcttgga

SEQ ID NO: 8352806 - DNA, 19 bp, Homo sapiens
agcaaatacatcaaaattg

SEQ ID NO: 8352807 - DNA, 22 bp, Homo sapiens
agcaaataattgtctttgaggg

SEQ ID NO: 8352808 - DNA, 23 bp, Homo sapiens
agcaaataatctgcttgcttttt

SEQ ID NO: 8352809 - DNA, 22 bp, Homo sapiens
agcaaataaagacaattatgtc

SEQ ID NO: 8352810 - DNA, 22 bp, Homo sapiens
acaacattatacatagaaagct

SEQ ID NO: 8352811 - DNA, 22 bp, Homo sapiens
acaacagtccagtatagactgt

SEQ ID NO: 8352812 - DNA, 22 bp, Homo sapiens
acaacagtccagtatagactgt

SEQ ID NO: 8352813 - DNA, 22 bp, Homo sapiens
acaacagtccagtatagactgt

SEQ ID NO: 8352814 - DNA, 22 bp, Homo sapiens
acaacagtgtggtggaaggagc

SEQ ID NO: 8352815 - DNA, 22 bp, Homo sapiens
agattttggctggctggagaga

SEQ ID NO: 8352816 - DNA, 22 bp, Homo sapiens
acaacattcttaaatacactga

SEQ ID NO: 8352817 - DNA, 20 bp, Homo sapiens
acaatacaggttgtgtctga

SEQ ID NO: 8352818 - DNA, 22 bp, Homo sapiens
agcaaatacttgaataaaaaga

SEQ ID NO: 8352819 - DNA, 19 bp, Homo sapiens
agcaaatataatagtgttc

SEQ ID NO: 8352820 - DNA, 19 bp, Homo sapiens
agcaaatataatagtgttc

SEQ ID NO: 8352821 - DNA, 22 bp, Homo sapiens
agcaaatacatttttagcataa

SEQ ID NO: 8352822 - DNA, 22 bp, Homo sapiens
agagtgaagtttttgaaagtga

SEQ ID NO: 8352823 - DNA, 22 bp, Homo sapiens
agagtgtaataagggcaagggc

SEQ ID NO: 8352824 - DNA, 22 bp, Homo sapiens
agagtggtggccgtggtgtcac

SEQ ID NO: 8352825 - DNA, 22 bp, Homo sapiens
aatttggcagtgtcttgaagta

SEQ ID NO: 8352826 - DNA, 22 bp, Homo sapiens
agagtgaagtaattgttaggat

SEQ ID NO: 8352827 - DNA, 22 bp, Homo sapiens
agagtgaagttcatcgtgcagc

SEQ ID NO: 8352828 - DNA, 22 bp, Homo sapiens
agagtgtttttctgtcaaggac

SEQ ID NO: 8352829 - DNA, 22 bp, Homo sapiens
agagtgtttcagtcttcctaga

SEQ ID NO: 8352830 - DNA, 18 bp, Homo sapiens
agagtgttctcagtgaaa

SEQ ID NO: 8352831 - DNA, 22 bp, Homo sapiens
agagtgttatttgctctgtatt

SEQ ID NO: 8352832 - DNA, 22 bp, Homo sapiens
aatttctctctcatgcttcatg

SEQ ID NO: 8352833 - DNA, 22 bp, Homo sapiens
aatttctcactctcttgatcac

SEQ ID NO: 8352834 - DNA, 22 bp, Homo sapiens
aatttctcatggattcagttat

SEQ ID NO: 8352835 - DNA, 18 bp, Homo sapiens
aatttccatatgaattgc

SEQ ID NO: 8352836 - DNA, 22 bp, Homo sapiens
aatttctccaagaatgcttaga

SEQ ID NO: 8352837 - DNA, 22 bp, Homo sapiens
aatttgatgagtttgtaagtct

SEQ ID NO: 8352838 - DNA, 22 bp, Homo sapiens
aatttcttgggagctcagagaa

SEQ ID NO: 8352839 - DNA, 22 bp, Homo sapiens
aatttggagagagattaatgtt

SEQ ID NO: 8352840 - DNA, 22 bp, Homo sapiens
aatttggagagaaacaagtagg

SEQ ID NO: 8352841 - DNA, 22 bp, Homo sapiens
acaaagtcttttacaacagtca

SEQ ID NO: 8352842 - DNA, 20 bp, Homo sapiens
acaaagtattgaggacaagt

SEQ ID NO: 8352843 - DNA, 22 bp, Homo sapiens
acaaatagagattcaaataaag

SEQ ID NO: 8352844 - DNA, 22 bp, Homo sapiens
acaaataggtagatttgcaaca

SEQ ID NO: 8352845 - DNA, 22 bp, Homo sapiens
acaaatagagattcaaataaag

SEQ ID NO: 8352846 - DNA, 22 bp, Homo sapiens
acaacagtaggaaaacatgtct

SEQ ID NO: 8352847 - DNA, 22 bp, Homo sapiens
acaacagtagcctttacaaggc

SEQ ID NO: 8352848 - DNA, 22 bp, Homo sapiens
acaacagtagcctttacaaggc

SEQ ID NO: 8352849 - DNA, 22 bp, Homo sapiens
acaacagtagcctttacaaggc

SEQ ID NO: 8352850 - DNA, 22 bp, Homo sapiens
acagaagtttcaagtaagaagt

SEQ ID NO: 8352851 - DNA, 22 bp, Homo sapiens
acagaataactcttgcttgagt

SEQ ID NO: 8352852 - DNA, 22 bp, Homo sapiens
acagaataactcttgcttgagt

SEQ ID NO: 8352853 - DNA, 22 bp, Homo sapiens
acagaatactacagactggtta

SEQ ID NO: 8352854 - DNA, 22 bp, Homo sapiens
acagaatactcataagaagggg

SEQ ID NO: 8352855 - DNA, 22 bp, Homo sapiens
acagaagttggaattagatact

SEQ ID NO: 8352856 - DNA, 22 bp, Homo sapiens
acagaagctcaagagagcagtg

SEQ ID NO: 8352857 - DNA, 22 bp, Homo sapiens
acagaaggcggggacaaggcgg

SEQ ID NO: 8352858 - DNA, 22 bp, Homo sapiens
acagaacttggaacttttcaca

SEQ ID NO: 8352859 - DNA, 19 bp, Homo sapiens
acagaagcatagaaaagga

SEQ ID NO: 8352860 - DNA, 21 bp, Homo sapiens
acagaagcggcgagtggcccc

SEQ ID NO: 8352861 - DNA, 22 bp, Homo sapiens
acagaatgggatttgaatattt

SEQ ID NO: 8352862 - DNA, 22 bp, Homo sapiens
acagaattaacatttgatgaat

SEQ ID NO: 8352863 - DNA, 17 bp, Homo sapiens
acagaggcaggagtgga

SEQ ID NO: 8352864 - DNA, 22 bp, Homo sapiens
acagaggcagtgtgagatactg

SEQ ID NO: 8352865 - DNA, 21 bp, Homo sapiens
acagaggcatacagcttaagg

SEQ ID NO: 8352866 - DNA, 22 bp, Homo sapiens
acagaggccatgagctgccacc

SEQ ID NO: 8352867 - DNA, 23 bp, Homo sapiens
acagaggcttaaatgagtggcag

SEQ ID NO: 8352868 - DNA, 22 bp, Homo sapiens
acagagggggccttggagtgca

SEQ ID NO: 8352869 - DNA, 19 bp, Homo sapiens
acagagggcaactgagaaa

SEQ ID NO: 8352870 - DNA, 22 bp, Homo sapiens
acagaggtaggacatgagatat

SEQ ID NO: 8352871 - DNA, 22 bp, Homo sapiens
acagaggcctcgtaggtacaac

SEQ ID NO: 8352872 - DNA, 22 bp, Homo sapiens
acagaggcctcggcctgcccag

SEQ ID NO: 8352873 - DNA, 22 bp, Homo sapiens
acagaggcctcgtaggtacaac

SEQ ID NO: 8352874 - DNA, 22 bp, Homo sapiens
agcgtgggtccaaggctctggt

SEQ ID NO: 8352875 - DNA, 22 bp, Homo sapiens
agcgggcaccctttgagggttt

SEQ ID NO: 8352876 - DNA, 22 bp, Homo sapiens
agcggtggtgtcggcagcggct

SEQ ID NO: 8352877 - DNA, 22 bp, Homo sapiens
agcgggctcaagtggccagcag

SEQ ID NO: 8352878 - DNA, 22 bp, Homo sapiens
acagcagaccccagtgccatgg

SEQ ID NO: 8352879 - DNA, 22 bp, Homo sapiens
acagcagaccactactagtagg

SEQ ID NO: 8352880 - DNA, 22 bp, Homo sapiens
acagcagaccactactagtagg

SEQ ID NO: 8352881 - DNA, 21 bp, Homo sapiens
acagatatttcattgaacatt

SEQ ID NO: 8352882 - DNA, 22 bp, Homo sapiens
acagcagatctggctacaggtt

SEQ ID NO: 8352883 - DNA, 20 bp, Homo sapiens
acagcagataccacaactat

SEQ ID NO: 8352884 - DNA, 22 bp, Homo sapiens
acagcagagtgtgagatagcca

SEQ ID NO: 8352885 - DNA, 22 bp, Homo sapiens
acagcagagttgagtagttgca

SEQ ID NO: 8352886 - DNA, 22 bp, Homo sapiens
acagatatatgattgtgtaaat

SEQ ID NO: 8352887 - DNA, 22 bp, Homo sapiens
acagatatcctcagtctccaac

SEQ ID NO: 8352888 - DNA, 22 bp, Homo sapiens
acagatataaactatagtagtg

SEQ ID NO: 8352889 - DNA, 22 bp, Homo sapiens
acagatataaactatagtagtg

SEQ ID NO: 8352890 - DNA, 22 bp, Homo sapiens
acagatacaaatatacaaatac

SEQ ID NO: 8352891 - DNA, 22 bp, Homo sapiens
acagatagtatgtaaattaagc

SEQ ID NO: 8352892 - DNA, 22 bp, Homo sapiens
acagcagatctggctacaggtt

SEQ ID NO: 8352893 - DNA, 22 bp, Homo sapiens
acagcagatctgtggagcttat

SEQ ID NO: 8352894 - DNA, 22 bp, Homo sapiens
acagcagatctgtggagcttat

SEQ ID NO: 8352895 - DNA, 22 bp, Homo sapiens
acagcagattacattctgctat

SEQ ID NO: 8352896 - DNA, 22 bp, Homo sapiens
acagcagattacattctgctat

SEQ ID NO: 8352897 - DNA, 22 bp, Homo sapiens
acagcagatttccctgggctcc

SEQ ID NO: 8352898 - DNA, 22 bp, Homo sapiens
acagcagcaatagcagtgacat

SEQ ID NO: 8352899 - DNA, 22 bp, Homo sapiens
acagcagcactattgacatttt

SEQ ID NO: 8352900 - DNA, 22 bp, Homo sapiens
acagcagcactattgacatttt

SEQ ID NO: 8352901 - DNA, 22 bp, Homo sapiens
acagcagcctgcagccctgtgt

SEQ ID NO: 8352902 - DNA, 22 bp, Homo sapiens
acagcagcctgcagccctgtgt

SEQ ID NO: 8352903 - DNA, 22 bp, Homo sapiens
acagcaggttattgttatggca

SEQ ID NO: 8352904 - DNA, 18 bp, Homo sapiens
acagcaggtttcattctt

SEQ ID NO: 8352905 - DNA, 22 bp, Homo sapiens
acagcagtcagtgaatatttaa

SEQ ID NO: 8352906 - DNA, 17 bp, Homo sapiens
acagcaggcccggaggg

SEQ ID NO: 8352907 - DNA, 22 bp, Homo sapiens
acagcaggcccatactggaagg

SEQ ID NO: 8352908 - DNA, 22 bp, Homo sapiens
agctgagattatgctcttctca

SEQ ID NO: 8352909 - DNA, 19 bp, Homo sapiens
acacaatgacacatatata

SEQ ID NO: 8352910 - DNA, 22 bp, Homo sapiens
acacaataaatttatcctttga

SEQ ID NO: 8352911 - DNA, 22 bp, Homo sapiens
acacaagattgtgtattgaatt

SEQ ID NO: 8352912 - DNA, 21 bp, Homo sapiens
acacaagcactcgtacatacg

SEQ ID NO: 8352913 - DNA, 17 bp, Homo sapiens
acacaagcaccttgagg

SEQ ID NO: 8352914 - DNA, 22 bp, Homo sapiens
acacacaactcattgtgtaata

SEQ ID NO: 8352915 - DNA, 22 bp, Homo sapiens
acacaatttcctgtccatatgt

SEQ ID NO: 8352916 - DNA, 22 bp, Homo sapiens
acacagtggtgagtctggacct

SEQ ID NO: 8352917 - DNA, 19 bp, Homo sapiens
acacagggctagagttaca

SEQ ID NO: 8352918 - DNA, 22 bp, Homo sapiens
acacagtatgcatctagaaatt

SEQ ID NO: 8352919 - DNA, 22 bp, Homo sapiens
acacagtatgcatctagaaatt

SEQ ID NO: 8352920 - DNA, 22 bp, Homo sapiens
acacatcatgccaagtttcacc

SEQ ID NO: 8352921 - DNA, 22 bp, Homo sapiens
acacagttctttcactgttggt

SEQ ID NO: 8352922 - DNA, 22 bp, Homo sapiens
acacagtttaaacgattagtac

SEQ ID NO: 8352923 - DNA, 22 bp, Homo sapiens
acacagtttatggtattctgtt

SEQ ID NO: 8352924 - DNA, 22 bp, Homo sapiens
acacagttcatgcatgaggtct

SEQ ID NO: 8352925 - DNA, 22 bp, Homo sapiens
acacagttcgtgcttttctatt

SEQ ID NO: 8352926 - DNA, 22 bp, Homo sapiens
acacagttcgttgttttctact

SEQ ID NO: 8352927 - DNA, 22 bp, Homo sapiens
acacagttcgtgcttttctatt

SEQ ID NO: 8352928 - DNA, 22 bp, Homo sapiens
acacagttcgttgttttctact

SEQ ID NO: 8352929 - DNA, 20 bp, Homo sapiens
agcatttagcctttatccac

SEQ ID NO: 8352930 - DNA, 22 bp, Homo sapiens
agcatttaattacagtttaatt

SEQ ID NO: 8352931 - DNA, 20 bp, Homo sapiens
agcatttacatcccttggtg

SEQ ID NO: 8352932 - DNA, 22 bp, Homo sapiens
agcatttacctcaatgcatctg

SEQ ID NO: 8352933 - DNA, 22 bp, Homo sapiens
agccagagattgagatgcaggc

SEQ ID NO: 8352934 - DNA, 22 bp, Homo sapiens
agccagctgtgggctcaggcgg

SEQ ID NO: 8352935 - DNA, 22 bp, Homo sapiens
agccagctgtgtggtcaggcaa

SEQ ID NO: 8352936 - DNA, 22 bp, Homo sapiens
agccagctggtgggtcagctgg

SEQ ID NO: 8352937 - DNA, 22 bp, Homo sapiens
agccagaggtcatgagcacagg

SEQ ID NO: 8352938 - DNA, 19 bp, Homo sapiens
agccagagtggcccagggg

SEQ ID NO: 8352939 - DNA, 19 bp, Homo sapiens
agccagagtggcccagggg

SEQ ID NO: 8352940 - DNA, 23 bp, Homo sapiens
aaatgacatatggtttctgaagg

SEQ ID NO: 8352941 - DNA, 22 bp, Homo sapiens
aaatcagagtctgattttaagg

SEQ ID NO: 8352942 - DNA, 22 bp, Homo sapiens
aaatcagagaatatatttagaa

SEQ ID NO: 8352943 - DNA, 22 bp, Homo sapiens
aaatcagacttgaattttcatc

SEQ ID NO: 8352944 - DNA, 22 bp, Homo sapiens
aaatatttgtctgaggcggttg

SEQ ID NO: 8352945 - DNA, 22 bp, Homo sapiens
aaatcaaggagggattatattt

SEQ ID NO: 8352946 - DNA, 22 bp, Homo sapiens
aaatatttgtctgaggcggttg

SEQ ID NO: 8352947 - DNA, 22 bp, Homo sapiens
aaatcacagggtctctaagtat

SEQ ID NO: 8352948 - DNA, 22 bp, Homo sapiens
aaatgattgtcaaagttctgtt

SEQ ID NO: 8352949 - DNA, 22 bp, Homo sapiens
aaatgcaaggcacattcctttt

SEQ ID NO: 8352950 - DNA, 22 bp, Homo sapiens
aaatgctgttcttttaggtaga

SEQ ID NO: 8352951 - DNA, 22 bp, Homo sapiens
aaatgcttagaggtgttcaaat

SEQ ID NO: 8352952 - DNA, 22 bp, Homo sapiens
aaatgcttattagtgtcacaaa

SEQ ID NO: 8352953 - DNA, 19 bp, Homo sapiens
aaatggaaaactttgggaa

SEQ ID NO: 8352954 - DNA, 21 bp, Homo sapiens
aaatgctttgtatatatctgt

SEQ ID NO: 8352955 - DNA, 22 bp, Homo sapiens
aaatggaaaatgctgttttggt

SEQ ID NO: 8352956 - DNA, 22 bp, Homo sapiens
aaatggaactgggctactaggt

SEQ ID NO: 8352957 - DNA, 22 bp, Homo sapiens
aaatgcttgtaaattttccatg

SEQ ID NO: 8352958 - DNA, 22 bp, Homo sapiens
aaatatagtgacacttatagtc

SEQ ID NO: 8352959 - DNA, 22 bp, Homo sapiens
aaatatagtgacacttatagtc

SEQ ID NO: 8352960 - DNA, 22 bp, Homo sapiens
aaatatagtaaatgcatagttc

SEQ ID NO: 8352961 - DNA, 22 bp, Homo sapiens
aaatatagcaattatgcctact

SEQ ID NO: 8352962 - DNA, 22 bp, Homo sapiens
aaatatacggtccctaacagtc

SEQ ID NO: 8352963 - DNA, 22 bp, Homo sapiens
aaatacagtggcagcagataat

SEQ ID NO: 8352964 - DNA, 22 bp, Homo sapiens
aaatacagtggcagcagataat

SEQ ID NO: 8352965 - DNA, 22 bp, Homo sapiens
aaatacagtggcagcagataat

SEQ ID NO: 8352966 - DNA, 22 bp, Homo sapiens
aaatacagtgtgtgttctttga

SEQ ID NO: 8352967 - DNA, 22 bp, Homo sapiens
aagaagtggtccttttctttct

SEQ ID NO: 8352968 - DNA, 22 bp, Homo sapiens
aaatacaggagtttggacttct

SEQ ID NO: 8352969 - DNA, 22 bp, Homo sapiens
aaatacagcagactcctgttgt

SEQ ID NO: 8352970 - DNA, 22 bp, Homo sapiens
aaagttgtaatggaagaaatgc

SEQ ID NO: 8352971 - DNA, 22 bp, Homo sapiens
aaagttgagttttatgtgttac

SEQ ID NO: 8352972 - DNA, 22 bp, Homo sapiens
aaagttgagtgctgatctgatt

SEQ ID NO: 8352973 - DNA, 22 bp, Homo sapiens
aaagcagtcactccagtgtgat

SEQ ID NO: 8352974 - DNA, 22 bp, Homo sapiens
aaagcagtagttttcaaatagt

SEQ ID NO: 8352975 - DNA, 22 bp, Homo sapiens
aaattgtataatgttccagctg

SEQ ID NO: 8352976 - DNA, 22 bp, Homo sapiens
aaattgtaatgacttcacttga

SEQ ID NO: 8352977 - DNA, 22 bp, Homo sapiens
aaattgtatattccatttgtat

SEQ ID NO: 8352978 - DNA, 22 bp, Homo sapiens
aaattgtatattccatttgtat

SEQ ID NO: 8352979 - DNA, 22 bp, Homo sapiens
aaaggattaaataaatgtgctg

SEQ ID NO: 8352980 - DNA, 22 bp, Homo sapiens
aaagcatttcatgtctagaaag

SEQ ID NO: 8352981 - DNA, 22 bp, Homo sapiens
aaagcattattctgtggaaaaa

SEQ ID NO: 8352982 - DNA, 22 bp, Homo sapiens
aaagcattgtttcaagattaac

SEQ ID NO: 8352983 - DNA, 22 bp, Homo sapiens
aaagcattgtttcaagattaac

SEQ ID NO: 8352984 - DNA, 22 bp, Homo sapiens
aaaggaagattgagcttttcca

SEQ ID NO: 8352985 - DNA, 22 bp, Homo sapiens
aaaggaagtgccactcttcttc

SEQ ID NO: 8352986 - DNA, 22 bp, Homo sapiens
aaaggaagtgccactcttcttc

SEQ ID NO: 8352987 - DNA, 22 bp, Homo sapiens
aaagcagtgctgtgagaacact

SEQ ID NO: 8352988 - DNA, 22 bp, Homo sapiens
aaagcatagaattagagttagg

SEQ ID NO: 8352989 - DNA, 22 bp, Homo sapiens
aaagcatagaattagagttagg

SEQ ID NO: 8352990 - DNA, 20 bp, Homo sapiens
aaagtctgtttatctctgga

SEQ ID NO: 8352991 - DNA, 22 bp, Homo sapiens
aaaggctggattcagagaggtg

SEQ ID NO: 8352992 - DNA, 22 bp, Homo sapiens
aacatgatgacaaaggtatatt

SEQ ID NO: 8352993 - DNA, 22 bp, Homo sapiens
aacatgaagttttctatagtga

SEQ ID NO: 8352994 - DNA, 18 bp, Homo sapiens
aaaggctgaatatagaag

SEQ ID NO: 8352995 - DNA, 22 bp, Homo sapiens
aaaggctgccaggtaaaatatt

SEQ ID NO: 8352996 - DNA, 22 bp, Homo sapiens
aaaaattgctgagaacggaatt

SEQ ID NO: 8352997 - DNA, 22 bp, Homo sapiens
aaaaatgaaacggctggttggc

SEQ ID NO: 8352998 - DNA, 22 bp, Homo sapiens
aaaagcaaggcagtctgtctga

SEQ ID NO: 8352999 - DNA, 22 bp, Homo sapiens
aaaacattctgtgaactctcaa

SEQ ID NO: 8353000 - DNA, 22 bp, Homo sapiens
aaaacattctgtgaactctcaa

SEQ ID NO: 8353001 - DNA, 22 bp, Homo sapiens
aaaacattctgtgaactctcaa

SEQ ID NO: 8353002 - DNA, 22 bp, Homo sapiens
aaaacatgtccatacagaaact

SEQ ID NO: 8353003 - DNA, 22 bp, Homo sapiens
aaaacattgaattgcacactat

SEQ ID NO: 8353004 - DNA, 22 bp, Homo sapiens
aaaacattttactgccatctca

SEQ ID NO: 8353005 - DNA, 22 bp, Homo sapiens
aaaaccaggcgtttcctattat

SEQ ID NO: 8353006 - DNA, 22 bp, Homo sapiens
aaaagagtcttaggcagtcata

SEQ ID NO: 8353007 - DNA, 22 bp, Homo sapiens
aaaagccatgcatacctaagag

SEQ ID NO: 8353008 - DNA, 22 bp, Homo sapiens
aaaagccatgcatacctaagag

SEQ ID NO: 8353009 - DNA, 22 bp, Homo sapiens
aaaagccaaggtcctcttcaga

SEQ ID NO: 8353010 - DNA, 22 bp, Homo sapiens
aaaagccaaggtcctcttcaga

SEQ ID NO: 8353011 - DNA, 22 bp, Homo sapiens
aaaagcaattgcagttcttgcc

SEQ ID NO: 8353012 - DNA, 22 bp, Homo sapiens
aaaagcactacaatttcgcttc

SEQ ID NO: 8353013 - DNA, 22 bp, Homo sapiens
aaaacagtttttgctaactgct

SEQ ID NO: 8353014 - DNA, 22 bp, Homo sapiens
aaaacagttataaacagagtca

SEQ ID NO: 8353015 - DNA, 22 bp, Homo sapiens
aaaatctggcaacactaagttt

SEQ ID NO: 8353016 - DNA, 22 bp, Homo sapiens
aaaatctggcaacactaagttt

SEQ ID NO: 8353017 - DNA, 22 bp, Homo sapiens
aaaataagttggtcctgtcctt

SEQ ID NO: 8353018 - DNA, 22 bp, Homo sapiens
aaaataacttctactatttgca

SEQ ID NO: 8353019 - DNA, 22 bp, Homo sapiens
aaaagttacctctgtaatataa

SEQ ID NO: 8353020 - DNA, 22 bp, Homo sapiens
aaaagttaactgtgttcatgca

SEQ ID NO: 8353021 - DNA, 22 bp, Homo sapiens
aaaagtttaagactcattctag

SEQ ID NO: 8353022 - DNA, 21 bp, Homo sapiens
aaaaggaaggtctgtttgggg

SEQ ID NO: 8353023 - DNA, 21 bp, Homo sapiens
aaaaggaaggtctgtttgggg

SEQ ID NO: 8353024 - DNA, 22 bp, Homo sapiens
aaaagctttgccagatgagttg

SEQ ID NO: 8353025 - DNA, 19 bp, Homo sapiens
aaaaggaatattctttggg

SEQ ID NO: 8353026 - DNA, 22 bp, Homo sapiens
aaaatgcaaacctacctacata

SEQ ID NO: 8353027 - DNA, 22 bp, Homo sapiens
aaaatgcaaacctacctacata

SEQ ID NO: 8353028 - DNA, 18 bp, Homo sapiens
aaaatgcaggcgacatgg

SEQ ID NO: 8353029 - DNA, 22 bp, Homo sapiens
aaaatgtaaagcttgagtgtag

SEQ ID NO: 8353030 - DNA, 22 bp, Homo sapiens
aaagcagcagaatctctcaggg

SEQ ID NO: 8353031 - DNA, 22 bp, Homo sapiens
aaagcagccacagagagagcgt

SEQ ID NO: 8353032 - DNA, 22 bp, Homo sapiens
aaagcagccactctctctgcct

SEQ ID NO: 8353033 - DNA, 21 bp, Homo sapiens
aaaatgtagacttttccctga

SEQ ID NO: 8353034 - DNA, 22 bp, Homo sapiens
aaaatgtatgatggaggtgcta

SEQ ID NO: 8353035 - DNA, 22 bp, Homo sapiens
aaagcagcctgctcatcctgga

SEQ ID NO: 8353036 - DNA, 22 bp, Homo sapiens
aaagcagctgatagtctcatct

SEQ ID NO: 8353037 - DNA, 22 bp, Homo sapiens
aaagcagctgatctcagagcct

SEQ ID NO: 8353038 - DNA, 22 bp, Homo sapiens
aaagcagctttcggccctcggg

SEQ ID NO: 8353039 - DNA, 22 bp, Homo sapiens
aaaattgtaggaactgaatcaa

SEQ ID NO: 8353040 - DNA, 22 bp, Homo sapiens
aaagtacatgcaattcttctga

SEQ ID NO: 8353041 - DNA, 22 bp, Homo sapiens
aaagtacatgtttggccatttg

SEQ ID NO: 8353042 - DNA, 22 bp, Homo sapiens
aaagtacaaggaaaggatctga

SEQ ID NO: 8353043 - DNA, 22 bp, Homo sapiens
aaagtacaatattgagattgat

SEQ ID NO: 8353044 - DNA, 22 bp, Homo sapiens
aaagtacagatggtgaggttgg

SEQ ID NO: 8353045 - DNA, 22 bp, Homo sapiens
aaagtcattgtaatatatgcta

SEQ ID NO: 8353046 - DNA, 22 bp, Homo sapiens
aaagtcatgtaatgatatgatt

SEQ ID NO: 8353047 - DNA, 22 bp, Homo sapiens
aaagctatgaggcatgcatttc

SEQ ID NO: 8353048 - DNA, 22 bp, Homo sapiens
aaagctatttgtgagttataga

SEQ ID NO: 8353049 - DNA, 22 bp, Homo sapiens
aaagctatttgttatgagagaa

SEQ ID NO: 8353050 - DNA, 22 bp, Homo sapiens
aaaattttactggtgtttcctt

SEQ ID NO: 8353051 - DNA, 22 bp, Homo sapiens
aaaattttcagcttgacttgat

SEQ ID NO: 8353052 - DNA, 22 bp, Homo sapiens
aaaattgtcagaagttgatctt

SEQ ID NO: 8353053 - DNA, 23 bp, Homo sapiens
aaagctctgctgcatgtagaata

SEQ ID NO: 8353054 - DNA, 22 bp, Homo sapiens
aaagctcacagtaatacaaggc

SEQ ID NO: 8353055 - DNA, 22 bp, Homo sapiens
aaagctcttaatgagattatcc

SEQ ID NO: 8353056 - DNA, 22 bp, Homo sapiens
aaaggagagtgagtcagatgcc

SEQ ID NO: 8353057 - DNA, 22 bp, Homo sapiens
aaaggagacagtcttacctgga

SEQ ID NO: 8353058 - DNA, 22 bp, Homo sapiens
aaaggagaaaacatacaggact

SEQ ID NO: 8353059 - DNA, 22 bp, Homo sapiens
aaataaaggtccactttagggc

SEQ ID NO: 8353060 - DNA, 21 bp, Homo sapiens
aaatacagaaacttgttttca

SEQ ID NO: 8353061 - DNA, 22 bp, Homo sapiens
aaatacaatttcaggctgtaat

SEQ ID NO: 8353062 - DNA, 21 bp, Homo sapiens
aaatacagatgcaaatctgtt

SEQ ID NO: 8353063 - DNA, 21 bp, Homo sapiens
aaatacagatgcaaatctgtt

SEQ ID NO: 8353064 - DNA, 21 bp, Homo sapiens
aaatacagatgcaaatctgtt

SEQ ID NO: 8353065 - DNA, 22 bp, Homo sapiens
aaatacagatagatttaaccca

SEQ ID NO: 8353066 - DNA, 21 bp, Homo sapiens
aaatacagatgcaaatctgtt

SEQ ID NO: 8353067 - DNA, 22 bp, Homo sapiens
aaatacagagttgcttaaaagc

SEQ ID NO: 8353068 - DNA, 22 bp, Homo sapiens
aaatacagagttgcttaaaagc

SEQ ID NO: 8353069 - DNA, 22 bp, Homo sapiens
aaatgacactcattcagtgtca

SEQ ID NO: 8353070 - DNA, 22 bp, Homo sapiens
aaactgtgagctagtaaatagg

SEQ ID NO: 8353071 - DNA, 22 bp, Homo sapiens
aaatgacagagctgggactagt

SEQ ID NO: 8353072 - DNA, 23 bp, Homo sapiens
aaactgttgcttcaatgtatcct

SEQ ID NO: 8353073 - DNA, 22 bp, Homo sapiens
aaatgacaataaaagtccatgc

SEQ ID NO: 8353074 - DNA, 21 bp, Homo sapiens
aaatgaatgtggtagtgcaag

SEQ ID NO: 8353075 - DNA, 22 bp, Homo sapiens
aaatccagtgttcaaagtttga

SEQ ID NO: 8353076 - DNA, 22 bp, Homo sapiens
aaatgtctgagacttctgaact

SEQ ID NO: 8353077 - DNA, 22 bp, Homo sapiens
aaatgtctttatctcatgtaac

SEQ ID NO: 8353078 - DNA, 23 bp, Homo sapiens
aaatgtcttctagctcttgagaa

SEQ ID NO: 8353079 - DNA, 22 bp, Homo sapiens
aaatgtctttatctcatgtaac

SEQ ID NO: 8353080 - DNA, 22 bp, Homo sapiens
aaagacatatttctaagtttat

SEQ ID NO: 8353081 - DNA, 22 bp, Homo sapiens
aaatgtctttgagtttttataa

SEQ ID NO: 8353082 - DNA, 22 bp, Homo sapiens
aaatgtgacagatgcagtacag

SEQ ID NO: 8353083 - DNA, 22 bp, Homo sapiens
aaatgtgagactgagttttcct

SEQ ID NO: 8353084 - DNA, 22 bp, Homo sapiens
aaatgtgagttatagcaataga

SEQ ID NO: 8353085 - DNA, 22 bp, Homo sapiens
aaatgtgagttatagcaataga

SEQ ID NO: 8353086 - DNA, 22 bp, Homo sapiens
aaagacacacagtgcttcagtt

SEQ ID NO: 8353087 - DNA, 22 bp, Homo sapiens
aaatggaggcaaaattggtttc

SEQ ID NO: 8353088 - DNA, 22 bp, Homo sapiens
aaatggaagaagtgcaatactg

SEQ ID NO: 8353089 - DNA, 22 bp, Homo sapiens
aaatggaagctatttatgattc

SEQ ID NO: 8353090 - DNA, 22 bp, Homo sapiens
aaatggaagtgtatttagtgtt

SEQ ID NO: 8353091 - DNA, 22 bp, Homo sapiens
aaatggaatgtgtttataattc

SEQ ID NO: 8353092 - DNA, 16 bp, Homo sapiens
aaggagggaagagaat

SEQ ID NO: 8353093 - DNA, 22 bp, Homo sapiens
aaggagggaaagcagtgcttct

SEQ ID NO: 8353094 - DNA, 22 bp, Homo sapiens
aaggcactagcaagctgcctgg

SEQ ID NO: 8353095 - DNA, 20 bp, Homo sapiens
aaggcactatgtctgctagc

SEQ ID NO: 8353096 - DNA, 22 bp, Homo sapiens
aaggcactagcagaattagtga

SEQ ID NO: 8353097 - DNA, 22 bp, Homo sapiens
aaggcactcattcaaggagata

SEQ ID NO: 8353098 - DNA, 22 bp, Homo sapiens
aaggcactcagccttgggacag

SEQ ID NO: 8353099 - DNA, 22 bp, Homo sapiens
aaggcactgactgtgcagggga

SEQ ID NO: 8353100 - DNA, 22 bp, Homo sapiens
aaggcactgagccagccgtctc

SEQ ID NO: 8353101 - DNA, 22 bp, Homo sapiens
aaggcactgaaaaattgtgtgt

SEQ ID NO: 8353102 - DNA, 22 bp, Homo sapiens
aaggcactgaacttaaattctg

SEQ ID NO: 8353103 - DNA, 22 bp, Homo sapiens
aaggagggttcccaggtcctgg

SEQ ID NO: 8353104 - DNA, 22 bp, Homo sapiens
aaggctgactcaacagggggcc

SEQ ID NO: 8353105 - DNA, 22 bp, Homo sapiens
aaggcactgctttgctgcgccc

SEQ ID NO: 8353106 - DNA, 22 bp, Homo sapiens
aaggcactgtactagttagtta

SEQ ID NO: 8353107 - DNA, 22 bp, Homo sapiens
aacagtggtctggggagtggag

SEQ ID NO: 8353108 - DNA, 22 bp, Homo sapiens
aacagtgtgtacacatcatagg

SEQ ID NO: 8353109 - DNA, 17 bp, Homo sapiens
aacagttaatgggggaa

SEQ ID NO: 8353110 - DNA, 22 bp, Homo sapiens
aacagttacccttaagatcttt

SEQ ID NO: 8353111 - DNA, 22 bp, Homo sapiens
aacagttattatcacattagtg

SEQ ID NO: 8353112 - DNA, 22 bp, Homo sapiens
aacagttatctcacatatggaa

SEQ ID NO: 8353113 - DNA, 22 bp, Homo sapiens
aacagttaagcagtcctgatat

SEQ ID NO: 8353114 - DNA, 22 bp, Homo sapiens
aacagttaacattttgggagct

SEQ ID NO: 8353115 - DNA, 22 bp, Homo sapiens
aacagttaatgaagaggaagcc

SEQ ID NO: 8353116 - DNA, 22 bp, Homo sapiens
aagtgctgtttctgatgaatgc

SEQ ID NO: 8353117 - DNA, 22 bp, Homo sapiens
aagtgctgggattacaggcgtc

SEQ ID NO: 8353118 - DNA, 22 bp, Homo sapiens
aagtgctgggattacaggcgtg

SEQ ID NO: 8353119 - DNA, 23 bp, Homo sapiens
aagtgctcagtggacagcattgc

SEQ ID NO: 8353120 - DNA, 22 bp, Homo sapiens
aagtgctcccatatcctgccct

SEQ ID NO: 8353121 - DNA, 22 bp, Homo sapiens
aagtgaaacatgtatctcttta

SEQ ID NO: 8353122 - DNA, 22 bp, Homo sapiens
aagtgaaacatgtatctcttta

SEQ ID NO: 8353123 - DNA, 22 bp, Homo sapiens
aagtaagtttctctctccaaga

SEQ ID NO: 8353124 - DNA, 22 bp, Homo sapiens
aagtaacatgggaacatctgaa

SEQ ID NO: 8353125 - DNA, 23 bp, Homo sapiens
aaggtgtttgttttcagaaagca

SEQ ID NO: 8353126 - DNA, 22 bp, Homo sapiens
aagtaacaggtgcttagtttat

SEQ ID NO: 8353127 - DNA, 22 bp, Homo sapiens
aagtaacatctgaacatgatgt

SEQ ID NO: 8353128 - DNA, 22 bp, Homo sapiens
aagtaacatctgaacatgatgt

SEQ ID NO: 8353129 - DNA, 22 bp, Homo sapiens
aagtacaaattttgaagagctt

SEQ ID NO: 8353130 - DNA, 22 bp, Homo sapiens
aagtaatggttaaataattcta

SEQ ID NO: 8353131 - DNA, 22 bp, Homo sapiens
aagtacaacgcatacagagaaa

SEQ ID NO: 8353132 - DNA, 22 bp, Homo sapiens
aagtacaacgcatacagagaaa

SEQ ID NO: 8353133 - DNA, 22 bp, Homo sapiens
aagggctgctgtagaagcagag

SEQ ID NO: 8353134 - DNA, 22 bp, Homo sapiens
aaggtgtggagtggtgcgactg

SEQ ID NO: 8353135 - DNA, 22 bp, Homo sapiens
aaggtgtgctgtgagacctggt

SEQ ID NO: 8353136 - DNA, 22 bp, Homo sapiens
aaggtgtgaagagatgggaaga

SEQ ID NO: 8353137 - DNA, 22 bp, Homo sapiens
aatatttcgttgcgtggctaga

SEQ ID NO: 8353138 - DNA, 22 bp, Homo sapiens
aatatttcaaaaggaaacacag

SEQ ID NO: 8353139 - DNA, 22 bp, Homo sapiens
aatatttctgtagctatgttct

SEQ ID NO: 8353140 - DNA, 22 bp, Homo sapiens
aatatttctggtgcttctcact

SEQ ID NO: 8353141 - DNA, 22 bp, Homo sapiens
aatctcactcaaagaattctct

SEQ ID NO: 8353142 - DNA, 22 bp, Homo sapiens
aatccagatgagcaatcatact

SEQ ID NO: 8353143 - DNA, 22 bp, Homo sapiens
aatatttatgacaggaagtagc

SEQ ID NO: 8353144 - DNA, 22 bp, Homo sapiens
aatatttatatttctcttccct

SEQ ID NO: 8353145 - DNA, 22 bp, Homo sapiens
aatatctgtctctaatgcatat

SEQ ID NO: 8353146 - DNA, 22 bp, Homo sapiens
aatatcctgaccagtaaactaa

SEQ ID NO: 8353147 - DNA, 22 bp, Homo sapiens
aatatctagcctttagcagctt

SEQ ID NO: 8353148 - DNA, 22 bp, Homo sapiens
aatacagtaattttgatgagtt

SEQ ID NO: 8353149 - DNA, 22 bp, Homo sapiens
aatacagtaattttgatgagtt

SEQ ID NO: 8353150 - DNA, 22 bp, Homo sapiens
aatacagtcttactagaaaatc

SEQ ID NO: 8353151 - DNA, 22 bp, Homo sapiens
aatacagtcttactagaaaatc

SEQ ID NO: 8353152 - DNA, 19 bp, Homo sapiens
aatacagtgttatagaatt

SEQ ID NO: 8353153 - DNA, 19 bp, Homo sapiens
aatacagtgttatagaatt

SEQ ID NO: 8353154 - DNA, 22 bp, Homo sapiens
aagttacacattttcattgtaa

SEQ ID NO: 8353155 - DNA, 22 bp, Homo sapiens
aacagttattatcacattagtg

SEQ ID NO: 8353156 - DNA, 22 bp, Homo sapiens
aacagttgatgtagctttggag

SEQ ID NO: 8353157 - DNA, 21 bp, Homo sapiens
aacagttctctttgaaggtgt

SEQ ID NO: 8353158 - DNA, 22 bp, Homo sapiens
aacagttgctgaagtagtattc

SEQ ID NO: 8353159 - DNA, 22 bp, Homo sapiens
aacagtttatgataaattctta

SEQ ID NO: 8353160 - DNA, 22 bp, Homo sapiens
aagttacagttattatttaaaa

SEQ ID NO: 8353161 - DNA, 22 bp, Homo sapiens
aataatctcactttatgtggaa

SEQ ID NO: 8353162 - DNA, 22 bp, Homo sapiens
aataatatttgaagcttcaaag

SEQ ID NO: 8353163 - DNA, 22 bp, Homo sapiens
aataatcttgactactgaatca

SEQ ID NO: 8353164 - DNA, 22 bp, Homo sapiens
aataatcttgactactgaatca

SEQ ID NO: 8353165 - DNA, 22 bp, Homo sapiens
aataatctccctttttgtatgt

SEQ ID NO: 8353166 - DNA, 22 bp, Homo sapiens
aataatgagcttgtctaattgt

SEQ ID NO: 8353167 - DNA, 22 bp, Homo sapiens
aataatgataatggttatagct

SEQ ID NO: 8353168 - DNA, 22 bp, Homo sapiens
aatacagaggggtcacaattca

SEQ ID NO: 8353169 - DNA, 22 bp, Homo sapiens
aatacagatggcatgtgaagat

SEQ ID NO: 8353170 - DNA, 22 bp, Homo sapiens
aataatgtctatggttccaaaa

SEQ ID NO: 8353171 - DNA, 22 bp, Homo sapiens
aataatgtctgctattttaaaa

SEQ ID NO: 8353172 - DNA, 22 bp, Homo sapiens
aataatgtacatacatatttcg

SEQ ID NO: 8353173 - DNA, 22 bp, Homo sapiens
aatgaaatagttggctgtagag

SEQ ID NO: 8353174 - DNA, 22 bp, Homo sapiens
aatctggagttaatgttttcgc

SEQ ID NO: 8353175 - DNA, 22 bp, Homo sapiens
aatctgtaacattcaataaaga

SEQ ID NO: 8353176 - DNA, 22 bp, Homo sapiens
aatctggcatttgagagtagga

SEQ ID NO: 8353177 - DNA, 22 bp, Homo sapiens
aatctggcatgtaagcttagag

SEQ ID NO: 8353178 - DNA, 15 bp, Homo sapiens
aatctggcggcaagt

SEQ ID NO: 8353179 - DNA, 22 bp, Homo sapiens
aatctggctcagaagaagatga

SEQ ID NO: 8353180 - DNA, 23 bp, Homo sapiens
aatctggctgatgttttttctct

SEQ ID NO: 8353181 - DNA, 19 bp, Homo sapiens
aatctctgacatctggctc

SEQ ID NO: 8353182 - DNA, 22 bp, Homo sapiens
aatgaaatgaagatatgatcag

SEQ ID NO: 8353183 - DNA, 22 bp, Homo sapiens
aatgaaatgtagcttatccata

SEQ ID NO: 8353184 - DNA, 22 bp, Homo sapiens
aatgaaatgtagcttatccata

SEQ ID NO: 8353185 - DNA, 22 bp, Homo sapiens
aatgcagattcttattctgtag

SEQ ID NO: 8353186 - DNA, 22 bp, Homo sapiens
aatgtaaagttgggcacaaatg

SEQ ID NO: 8353187 - DNA, 22 bp, Homo sapiens
aatgtacaaaccttctttgtag

SEQ ID NO: 8353188 - DNA, 22 bp, Homo sapiens
aatgtacaaaccttctttgtag

SEQ ID NO: 8353189 - DNA, 22 bp, Homo sapiens
aatgtacaaaccttctttgtag

SEQ ID NO: 8353190 - DNA, 22 bp, Homo sapiens
aacttgttagaaatgcagaatc

SEQ ID NO: 8353191 - DNA, 22 bp, Homo sapiens
aatgcttccaaaataccaagcc

SEQ ID NO: 8353192 - DNA, 20 bp, Homo sapiens
acaatatgtagatgaatagc

SEQ ID NO: 8353193 - DNA, 22 bp, Homo sapiens
acaatgtaggatatgtacttgt

SEQ ID NO: 8353194 - DNA, 22 bp, Homo sapiens
acaatgtgcttatgaaggcagt

SEQ ID NO: 8353195 - DNA, 22 bp, Homo sapiens
acaatgtgggcatgagaaacca

SEQ ID NO: 8353196 - DNA, 20 bp, Homo sapiens
acaatagatttgagcaaagt

SEQ ID NO: 8353197 - DNA, 22 bp, Homo sapiens
acaaatttattgaagggcatat

SEQ ID NO: 8353198 - DNA, 22 bp, Homo sapiens
acaatgttctacatatacataa

SEQ ID NO: 8353199 - DNA, 22 bp, Homo sapiens
acacagagccaaaccatatcac

SEQ ID NO: 8353200 - DNA, 22 bp, Homo sapiens
acacagagcaaatcatgacaga

SEQ ID NO: 8353201 - DNA, 22 bp, Homo sapiens
acacagcaacttgcagtatgga

SEQ ID NO: 8353202 - DNA, 22 bp, Homo sapiens
aagatacacggtcaactctcaa

SEQ ID NO: 8353203 - DNA, 22 bp, Homo sapiens
aagatacaccaagagcctagta

SEQ ID NO: 8353204 - DNA, 22 bp, Homo sapiens
acaaaacagtgttcctgcccct

SEQ ID NO: 8353205 - DNA, 21 bp, Homo sapiens
aagaagcaatttattggaagg

SEQ ID NO: 8353206 - DNA, 22 bp, Homo sapiens
aagaagaagtgttatttttaga

SEQ ID NO: 8353207 - DNA, 22 bp, Homo sapiens
aagaagagaaatgtgctgctgg

SEQ ID NO: 8353208 - DNA, 22 bp, Homo sapiens
aagaagaattattccctaatca

SEQ ID NO: 8353209 - DNA, 22 bp, Homo sapiens
aagaacaggttctagaaccatt

SEQ ID NO: 8353210 - DNA, 22 bp, Homo sapiens
aatgtacaataagacaaagagg

SEQ ID NO: 8353211 - DNA, 22 bp, Homo sapiens
aatgtacaataagacaaagagg

SEQ ID NO: 8353212 - DNA, 22 bp, Homo sapiens
aatgtacaagggttccagtttt

SEQ ID NO: 8353213 - DNA, 22 bp, Homo sapiens
aagaacattcgaactattttct

SEQ ID NO: 8353214 - DNA, 22 bp, Homo sapiens
aagaacatgttaaaagattcac

SEQ ID NO: 8353215 - DNA, 22 bp, Homo sapiens
aagaacattttgtagaatgaca

SEQ ID NO: 8353216 - DNA, 22 bp, Homo sapiens
aagaacattgatattgtctatg

SEQ ID NO: 8353217 - DNA, 22 bp, Homo sapiens
aagaacattgatattgtctatg

SEQ ID NO: 8353218 - DNA, 22 bp, Homo sapiens
acaaatgaacctgaaatctcag

SEQ ID NO: 8353219 - DNA, 22 bp, Homo sapiens
acaaatgaatcatacataatgt

SEQ ID NO: 8353220 - DNA, 22 bp, Homo sapiens
aagaatatctgttttatttagg

SEQ ID NO: 8353221 - DNA, 22 bp, Homo sapiens
acaaaagtgagtgtgtctcaga

SEQ ID NO: 8353222 - DNA, 22 bp, Homo sapiens
aagaatatagattttttgaagt

SEQ ID NO: 8353223 - DNA, 22 bp, Homo sapiens
aagaatatctgttttatttagg

SEQ ID NO: 8353224 - DNA, 17 bp, Homo sapiens
aagaatcattagagaag

SEQ ID NO: 8353225 - DNA, 22 bp, Homo sapiens
aagaatatctgttttatttagg

SEQ ID NO: 8353226 - DNA, 22 bp, Homo sapiens
acaaaagaataagatgagtcat

SEQ ID NO: 8353227 - DNA, 22 bp, Homo sapiens
acaaaagaataagatgagtcat

SEQ ID NO: 8353228 - DNA, 22 bp, Homo sapiens
aagcagggctccctggggactc

SEQ ID NO: 8353229 - DNA, 22 bp, Homo sapiens
aagcagtaatgaggtactattt

SEQ ID NO: 8353230 - DNA, 22 bp, Homo sapiens
aagcagtagaatgcattgcttt

SEQ ID NO: 8353231 - DNA, 22 bp, Homo sapiens
aagcagtagggccaacttgcag

SEQ ID NO: 8353232 - DNA, 22 bp, Homo sapiens
aagcaggtgtgagccagtgggc

SEQ ID NO: 8353233 - DNA, 22 bp, Homo sapiens
aagcaggagagcctgggcgagc

SEQ ID NO: 8353234 - DNA, 21 bp, Homo sapiens
aagcaggacatatgatgccct

SEQ ID NO: 8353235 - DNA, 22 bp, Homo sapiens
aagcagttaatgttttgtcaat

SEQ ID NO: 8353236 - DNA, 22 bp, Homo sapiens
aagcagtcttggctgggttcag

SEQ ID NO: 8353237 - DNA, 22 bp, Homo sapiens
acagcagggggagctgttggac

SEQ ID NO: 8353238 - DNA, 23 bp, Homo sapiens
acagccaggatgggagcagaagc

SEQ ID NO: 8353239 - DNA, 22 bp, Homo sapiens
acagccaggacttggccctctt

SEQ ID NO: 8353240 - DNA, 22 bp, Homo sapiens
acagccaggaggaactcagtga

SEQ ID NO: 8353241 - DNA, 22 bp, Homo sapiens
aagcccagatgtgagaactgag

SEQ ID NO: 8353242 - DNA, 22 bp, Homo sapiens
acagccaggcccagcacgcagg

SEQ ID NO: 8353243 - DNA, 22 bp, Homo sapiens
acagccagggacatacaatggt

SEQ ID NO: 8353244 - DNA, 21 bp, Homo sapiens
acagccaggaacatgaggggc

SEQ ID NO: 8353245 - DNA, 22 bp, Homo sapiens
acagccaggaattctggagaag

SEQ ID NO: 8353246 - DNA, 22 bp, Homo sapiens
acagcaggttacagtggcacag

SEQ ID NO: 8353247 - DNA, 22 bp, Homo sapiens
acagccagatctgagagatctt

SEQ ID NO: 8353248 - DNA, 22 bp, Homo sapiens
acagctgctgtggaggttttca

SEQ ID NO: 8353249 - DNA, 22 bp, Homo sapiens
acagctgctgcttctcactggg

SEQ ID NO: 8353250 - DNA, 22 bp, Homo sapiens
acagctgctctatatctcagcc

SEQ ID NO: 8353251 - DNA, 22 bp, Homo sapiens
acagaaataactttttatgttt

SEQ ID NO: 8353252 - DNA, 22 bp, Homo sapiens
acagaaataactttttatgttt

SEQ ID NO: 8353253 - DNA, 22 bp, Homo sapiens
acagaaatgatgtttggcaata

SEQ ID NO: 8353254 - DNA, 22 bp, Homo sapiens
acagagatggcttttcagaggc

SEQ ID NO: 8353255 - DNA, 22 bp, Homo sapiens
acagagatggcacagagaaggt

SEQ ID NO: 8353256 - DNA, 22 bp, Homo sapiens
acagagatgagtcaacacagct

SEQ ID NO: 8353257 - DNA, 22 bp, Homo sapiens
acagagatgcaagtgtgtattt

SEQ ID NO: 8353258 - DNA, 20 bp, Homo sapiens
acagagatcagctgatgggc

SEQ ID NO: 8353259 - DNA, 20 bp, Homo sapiens
acagagatcctctctttatc

SEQ ID NO: 8353260 - DNA, 22 bp, Homo sapiens
acacttctctttgaagaacaat

SEQ ID NO: 8353261 - DNA, 22 bp, Homo sapiens
acacttggagcaacacttatgg

SEQ ID NO: 8353262 - DNA, 20 bp, Homo sapiens
acacatagataagaagctga

SEQ ID NO: 8353263 - DNA, 22 bp, Homo sapiens
acacatatatacatatttgtgc

SEQ ID NO: 8353264 - DNA, 22 bp, Homo sapiens
aagatacacgttgtattgaata

SEQ ID NO: 8353265 - DNA, 22 bp, Homo sapiens
aagatacacgttgtattgaata

SEQ ID NO: 8353266 - DNA, 18 bp, Homo sapiens
agcaggcgttgcctggga

SEQ ID NO: 8353267 - DNA, 22 bp, Homo sapiens
agcaggcctgccacctcggggt

SEQ ID NO: 8353268 - DNA, 19 bp, Homo sapiens
agcaggccaggcaggtggc

SEQ ID NO: 8353269 - DNA, 22 bp, Homo sapiens
agcaggcctcatgcaccagcta

SEQ ID NO: 8353270 - DNA, 22 bp, Homo sapiens
agcaggcccagggcttctcagc

SEQ ID NO: 8353271 - DNA, 22 bp, Homo sapiens
cacatttaaaaaatccacgatc

SEQ ID NO: 8353272 - DNA, 22 bp, Homo sapiens
cacatttaaaggttgaagctga

SEQ ID NO: 8353273 - DNA, 22 bp, Homo sapiens
cacattgaaatgacccaataat

SEQ ID NO: 8353274 - DNA, 23 bp, Homo sapiens
cacattgaacactctctttcctg

SEQ ID NO: 8353275 - DNA, 22 bp, Homo sapiens
cacattctttcacagttctgaa

SEQ ID NO: 8353276 - DNA, 22 bp, Homo sapiens
cacattgaacttgtctggtggg

SEQ ID NO: 8353277 - DNA, 22 bp, Homo sapiens
cacattgataattaaggcctcc

SEQ ID NO: 8353278 - DNA, 22 bp, Homo sapiens
cacgttttatgacagaagaagc

SEQ ID NO: 8353279 - DNA, 20 bp, Homo sapiens
cacgtttttccactagcaaa

SEQ ID NO: 8353280 - DNA, 22 bp, Homo sapiens
cacgggcagtgagcacagcctg

SEQ ID NO: 8353281 - DNA, 22 bp, Homo sapiens
cactagaaccaatgacatttct

SEQ ID NO: 8353282 - DNA, 22 bp, Homo sapiens
cactagaaaggtacagattatg

SEQ ID NO: 8353283 - DNA, 22 bp, Homo sapiens
cactacttgaaagaattacaga

SEQ ID NO: 8353284 - DNA, 22 bp, Homo sapiens
cactaattccatctccttttcc

SEQ ID NO: 8353285 - DNA, 22 bp, Homo sapiens
cactaattaacacgtcgtctct

SEQ ID NO: 8353286 - DNA, 22 bp, Homo sapiens
cactaaatgcctaggaagaagc

SEQ ID NO: 8353287 - DNA, 22 bp, Homo sapiens
cactaaatgtttcaatgtggga

SEQ ID NO: 8353288 - DNA, 22 bp, Homo sapiens
agcatttagttagtaaatgttt

SEQ ID NO: 8353289 - DNA, 22 bp, Homo sapiens
agcatttagtctttattgcagc

SEQ ID NO: 8353290 - DNA, 22 bp, Homo sapiens
agcatttatcttttgtttgagt

SEQ ID NO: 8353291 - DNA, 22 bp, Homo sapiens
agcatttatcttttgtttgagt

SEQ ID NO: 8353292 - DNA, 22 bp, Homo sapiens
agcatttatagataccctatgg

SEQ ID NO: 8353293 - DNA, 22 bp, Homo sapiens
agcatttatagcccctatcatc

SEQ ID NO: 8353294 - DNA, 22 bp, Homo sapiens
agcatttatgactaatgtaaaa

SEQ ID NO: 8353295 - DNA, 22 bp, Homo sapiens
agcatttattgacctgctgctg

SEQ ID NO: 8353296 - DNA, 22 bp, Homo sapiens
agcatttattgagtgccctggg

SEQ ID NO: 8353297 - DNA, 22 bp, Homo sapiens
agcatttatttcttagaaattg

SEQ ID NO: 8353298 - DNA, 22 bp, Homo sapiens
agcatttaggagaatttgagaa

SEQ ID NO: 8353299 - DNA, 22 bp, Homo sapiens
agcatttaggagaatttgagaa

SEQ ID NO: 8353300 - DNA, 21 bp, Homo sapiens
agcattcaaaagatgccataa

SEQ ID NO: 8353301 - DNA, 22 bp, Homo sapiens
cactgcactccatcctgggaaa

SEQ ID NO: 8353302 - DNA, 22 bp, Homo sapiens
cactgcactccagcccgggcaa

SEQ ID NO: 8353303 - DNA, 22 bp, Homo sapiens
cactgcacaatgtagcaaagaa

SEQ ID NO: 8353304 - DNA, 22 bp, Homo sapiens
cactgcactccagcccgggcaa

SEQ ID NO: 8353305 - DNA, 22 bp, Homo sapiens
agccaacaactctgagcccagt

SEQ ID NO: 8353306 - DNA, 22 bp, Homo sapiens
agcattttctgagagtatagat

SEQ ID NO: 8353307 - DNA, 22 bp, Homo sapiens
agcattttctgagagtatagat

SEQ ID NO: 8353308 - DNA, 20 bp, Homo sapiens
agcattttatggtaggaaac

SEQ ID NO: 8353309 - DNA, 22 bp, Homo sapiens
cactgggcgtgtcctgggtgag

SEQ ID NO: 8353310 - DNA, 22 bp, Homo sapiens
cactggggaaaacaggcttctt

SEQ ID NO: 8353311 - DNA, 22 bp, Homo sapiens
cactggggtgggcctggtagag

SEQ ID NO: 8353312 - DNA, 22 bp, Homo sapiens
cactggtacgtaggttggggca

SEQ ID NO: 8353313 - DNA, 22 bp, Homo sapiens
cactggtagcagttaagttagg

SEQ ID NO: 8353314 - DNA, 22 bp, Homo sapiens
cacagaaaaaggcttgaaaatc

SEQ ID NO: 8353315 - DNA, 22 bp, Homo sapiens
cacacatgtctctccatgctct

SEQ ID NO: 8353316 - DNA, 22 bp, Homo sapiens
cacacatgagtctccccattgg

SEQ ID NO: 8353317 - DNA, 22 bp, Homo sapiens
caatttttgtacttatagtact

SEQ ID NO: 8353318 - DNA, 22 bp, Homo sapiens
caatttttgtacttatagtact

SEQ ID NO: 8353319 - DNA, 22 bp, Homo sapiens
caatttcttgttaattctcagg

SEQ ID NO: 8353320 - DNA, 22 bp, Homo sapiens
caatttctctttatatctcaca

SEQ ID NO: 8353321 - DNA, 22 bp, Homo sapiens
cacaggaagcaagcctggggcc

SEQ ID NO: 8353322 - DNA, 22 bp, Homo sapiens
cacaggaagaggtatacaattc

SEQ ID NO: 8353323 - DNA, 22 bp, Homo sapiens
cacagctggggaagctgaggcc

SEQ ID NO: 8353324 - DNA, 22 bp, Homo sapiens
cacagctggggaagctgaggcc

SEQ ID NO: 8353325 - DNA, 22 bp, Homo sapiens
cacagaaatattgtgtcccttg

SEQ ID NO: 8353326 - DNA, 22 bp, Homo sapiens
cacagcagcgttcctccgtgtg

SEQ ID NO: 8353327 - DNA, 22 bp, Homo sapiens
cacagcagcgttcctccgtgtg

SEQ ID NO: 8353328 - DNA, 22 bp, Homo sapiens
cacagctgaccaccctgctccc

SEQ ID NO: 8353329 - DNA, 22 bp, Homo sapiens
cacagctgccatgcagtcagtg

SEQ ID NO: 8353330 - DNA, 22 bp, Homo sapiens
cacagctgccatggctgcactt

SEQ ID NO: 8353331 - DNA, 22 bp, Homo sapiens
cacagctgccatgcagtcagtg

SEQ ID NO: 8353332 - DNA, 22 bp, Homo sapiens
cacagctgcacagaggaggtgc

SEQ ID NO: 8353333 - DNA, 22 bp, Homo sapiens
cacagctgccctaactgtactc

SEQ ID NO: 8353334 - DNA, 22 bp, Homo sapiens
cacagctgccctaactgtactc

SEQ ID NO: 8353335 - DNA, 22 bp, Homo sapiens
cacagctgccctactccatgtg

SEQ ID NO: 8353336 - DNA, 22 bp, Homo sapiens
caagtccaagatcaagaagcca

SEQ ID NO: 8353337 - DNA, 22 bp, Homo sapiens
caagggccatctgagggcactg

SEQ ID NO: 8353338 - DNA, 22 bp, Homo sapiens
caagggcctccaccttgctcgt

SEQ ID NO: 8353339 - DNA, 22 bp, Homo sapiens
caagtcctcaaagggctctgct

SEQ ID NO: 8353340 - DNA, 22 bp, Homo sapiens
caagtcctcgcttctagctgtg

SEQ ID NO: 8353341 - DNA, 22 bp, Homo sapiens
caatgattctgcaactgtgtgc

SEQ ID NO: 8353342 - DNA, 22 bp, Homo sapiens
caatgatgtttagataaaatcc

SEQ ID NO: 8353343 - DNA, 22 bp, Homo sapiens
caatgatggctaggcagctgct

SEQ ID NO: 8353344 - DNA, 21 bp, Homo sapiens
caattactatgaaccagttga

SEQ ID NO: 8353345 - DNA, 21 bp, Homo sapiens
caattactatgaaccagttga

SEQ ID NO: 8353346 - DNA, 22 bp, Homo sapiens
caaggaagacccacgcagatat

SEQ ID NO: 8353347 - DNA, 21 bp, Homo sapiens
agcagacagcccaagaaaatc

SEQ ID NO: 8353348 - DNA, 22 bp, Homo sapiens
agcagacatggcttggatgtgg

SEQ ID NO: 8353349 - DNA, 22 bp, Homo sapiens
agcagacatatctcatgtcaca

SEQ ID NO: 8353350 - DNA, 22 bp, Homo sapiens
agcagagacatgaaatatgctt

SEQ ID NO: 8353351 - DNA, 22 bp, Homo sapiens
caaggaaaagaagtatttcaga

SEQ ID NO: 8353352 - DNA, 22 bp, Homo sapiens
caaggaaacatgaaatgcattg

SEQ ID NO: 8353353 - DNA, 22 bp, Homo sapiens
caaggaaaacagatgatcaaca

SEQ ID NO: 8353354 - DNA, 22 bp, Homo sapiens
caaggaaaaagcgagctcgggg

SEQ ID NO: 8353355 - DNA, 22 bp, Homo sapiens
caagctttccattacacacatt

SEQ ID NO: 8353356 - DNA, 22 bp, Homo sapiens
agcctagggttctgatgtcact

SEQ ID NO: 8353357 - DNA, 22 bp, Homo sapiens
agcccttggtattttccgatcc

SEQ ID NO: 8353358 - DNA, 22 bp, Homo sapiens
agcctagactaagacttgctct

SEQ ID NO: 8353359 - DNA, 22 bp, Homo sapiens
agccgctgtctcttgggccgcg

SEQ ID NO: 8353360 - DNA, 22 bp, Homo sapiens
agccggggtaattaacacgggg

SEQ ID NO: 8353361 - DNA, 22 bp, Homo sapiens
agcctagaagaagtggctactt

SEQ ID NO: 8353362 - DNA, 22 bp, Homo sapiens
cagatgaagatcatagaatagt

SEQ ID NO: 8353363 - DNA, 22 bp, Homo sapiens
cagagtggcgaccccctcagct

SEQ ID NO: 8353364 - DNA, 22 bp, Homo sapiens
cagagtggcagtcccaggccca

SEQ ID NO: 8353365 - DNA, 22 bp, Homo sapiens
cagagtggagtttttcagcggg

SEQ ID NO: 8353366 - DNA, 22 bp, Homo sapiens
cagagtggagaaacgcttcgtc

SEQ ID NO: 8353367 - DNA, 22 bp, Homo sapiens
agccctctctatggccctcttg

SEQ ID NO: 8353368 - DNA, 22 bp, Homo sapiens
agccctctctttagagatctga

SEQ ID NO: 8353369 - DNA, 22 bp, Homo sapiens
agccctctctttagagatctga

SEQ ID NO: 8353370 - DNA, 22 bp, Homo sapiens
agccctctctttagagatctga

SEQ ID NO: 8353371 - DNA, 22 bp, Homo sapiens
cagagtgatggcacctgctggg

SEQ ID NO: 8353372 - DNA, 22 bp, Homo sapiens
cagagtgagggcctgcacctgc

SEQ ID NO: 8353373 - DNA, 22 bp, Homo sapiens
cagaggagtgggccgttatggt

SEQ ID NO: 8353374 - DNA, 20 bp, Homo sapiens
cagaggagtacatatgttca

SEQ ID NO: 8353375 - DNA, 17 bp, Homo sapiens
cagaggagctttggggg

SEQ ID NO: 8353376 - DNA, 22 bp, Homo sapiens
cagaggaggcggtatacactgc

SEQ ID NO: 8353377 - DNA, 22 bp, Homo sapiens
cagaggaggccaccgcataggc

SEQ ID NO: 8353378 - DNA, 18 bp, Homo sapiens
cagaggagagacattcag

SEQ ID NO: 8353379 - DNA, 22 bp, Homo sapiens
cagaggagaattgcgggatcat

SEQ ID NO: 8353380 - DNA, 20 bp, Homo sapiens
agccaagaacaggcagaacc

SEQ ID NO: 8353381 - DNA, 22 bp, Homo sapiens
agccaagacatttagaaaagct

SEQ ID NO: 8353382 - DNA, 22 bp, Homo sapiens
agccaagagacagatgcccacc

SEQ ID NO: 8353383 - DNA, 22 bp, Homo sapiens
agccaagaggagcctaaagcga

SEQ ID NO: 8353384 - DNA, 22 bp, Homo sapiens
agccaggccttttctcaaggtt

SEQ ID NO: 8353385 - DNA, 22 bp, Homo sapiens
agccagggaagaggcctacctc

SEQ ID NO: 8353386 - DNA, 22 bp, Homo sapiens
agccagggacgctgcaggctac

SEQ ID NO: 8353387 - DNA, 22 bp, Homo sapiens
agccagggaagaggcctacctc

SEQ ID NO: 8353388 - DNA, 22 bp, Homo sapiens
agccagggacgctgcaggctac

SEQ ID NO: 8353389 - DNA, 22 bp, Homo sapiens
agccagggaaggataacaagaa

SEQ ID NO: 8353390 - DNA, 22 bp, Homo sapiens
agccagggctgcgagcagacag

SEQ ID NO: 8353391 - DNA, 22 bp, Homo sapiens
agccaggggagtcagctgctgg

SEQ ID NO: 8353392 - DNA, 22 bp, Homo sapiens
agccaggggagtcagctgctgg

SEQ ID NO: 8353393 - DNA, 23 bp, Homo sapiens
agccagggcactggtggagattg

SEQ ID NO: 8353394 - DNA, 22 bp, Homo sapiens
agccagggatggcagtgcccag

SEQ ID NO: 8353395 - DNA, 22 bp, Homo sapiens
agccagggatgcagcacagtga

SEQ ID NO: 8353396 - DNA, 22 bp, Homo sapiens
cagagctgtccaaaccctgaca

SEQ ID NO: 8353397 - DNA, 21 bp, Homo sapiens
cagagctgtccaaaccctgac

SEQ ID NO: 8353398 - DNA, 22 bp, Homo sapiens
cagagccatccaggtgcctgtt

SEQ ID NO: 8353399 - DNA, 22 bp, Homo sapiens
cagagccataaaggtgaaagag

SEQ ID NO: 8353400 - DNA, 22 bp, Homo sapiens
cagagccagggctaggaactgg

SEQ ID NO: 8353401 - DNA, 22 bp, Homo sapiens
cagagccaggtcttgaactcag

SEQ ID NO: 8353402 - DNA, 22 bp, Homo sapiens
cagagccaggtctaggagtctc

SEQ ID NO: 8353403 - DNA, 22 bp, Homo sapiens
cagagcagtaaatctggggcac

SEQ ID NO: 8353404 - DNA, 22 bp, Homo sapiens
cagcggaggacagatgggagct

SEQ ID NO: 8353405 - DNA, 22 bp, Homo sapiens
cagcggggcctgtgctggggag

SEQ ID NO: 8353406 - DNA, 22 bp, Homo sapiens
cagccttcgacagttggagtag

SEQ ID NO: 8353407 - DNA, 22 bp, Homo sapiens
cagcctctttccacatcaggca

SEQ ID NO: 8353408 - DNA, 22 bp, Homo sapiens
agctctggaagccctggtagtt

SEQ ID NO: 8353409 - DNA, 21 bp, Homo sapiens
agctctggagcagcaatcaag

SEQ ID NO: 8353410 - DNA, 22 bp, Homo sapiens
agctctggagccggaggatttc

SEQ ID NO: 8353411 - DNA, 22 bp, Homo sapiens
agctctggagccggaggatttc

SEQ ID NO: 8353412 - DNA, 22 bp, Homo sapiens
cagctggcatacctgggcccgg

SEQ ID NO: 8353413 - DNA, 22 bp, Homo sapiens
cagctgctttagttttccatcc

SEQ ID NO: 8353414 - DNA, 22 bp, Homo sapiens
cagctggatccctgcagaactt

SEQ ID NO: 8353415 - DNA, 22 bp, Homo sapiens
cagctggactgggatgtagcga

SEQ ID NO: 8353416 - DNA, 19 bp, Homo sapiens
cagctggaatcatctgagg

SEQ ID NO: 8353417 - DNA, 22 bp, Homo sapiens
agctctggcactggcgcgggat

SEQ ID NO: 8353418 - DNA, 22 bp, Homo sapiens
agctctggagccggaggatttc

SEQ ID NO: 8353419 - DNA, 23 bp, Homo sapiens
agctctggcgttggggaggtagt

SEQ ID NO: 8353420 - DNA, 22 bp, Homo sapiens
agcgagggaggtctgaggacag

SEQ ID NO: 8353421 - DNA, 22 bp, Homo sapiens
agcgaggtttgttctattcagt

SEQ ID NO: 8353422 - DNA, 22 bp, Homo sapiens
agcgccactgcactccagcctg

SEQ ID NO: 8353423 - DNA, 22 bp, Homo sapiens
cagcatgtatctttcaggtgtg

SEQ ID NO: 8353424 - DNA, 22 bp, Homo sapiens
cagcactggggggattcggagc

SEQ ID NO: 8353425 - DNA, 22 bp, Homo sapiens
cagcactggggccactggagtt

SEQ ID NO: 8353426 - DNA, 22 bp, Homo sapiens
cagcactgtgataactgagcca

SEQ ID NO: 8353427 - DNA, 22 bp, Homo sapiens
cagcctctctgtatctcaggat

SEQ ID NO: 8353428 - DNA, 22 bp, Homo sapiens
cagcctctaagcacagcctctc

SEQ ID NO: 8353429 - DNA, 22 bp, Homo sapiens
cagcctctctgtatctcaggat

SEQ ID NO: 8353430 - DNA, 22 bp, Homo sapiens
cagcctctaagcacagcctctc

SEQ ID NO: 8353431 - DNA, 22 bp, Homo sapiens
cagccctgggtccctgccctgg

SEQ ID NO: 8353432 - DNA, 22 bp, Homo sapiens
cagccccacacggtctagctct

SEQ ID NO: 8353433 - DNA, 22 bp, Homo sapiens
cagccagtgtgaccgaggagga

SEQ ID NO: 8353434 - DNA, 22 bp, Homo sapiens
cagccatcccagcctgtggttc

SEQ ID NO: 8353435 - DNA, 22 bp, Homo sapiens
atgctgaagagttcatgattat

SEQ ID NO: 8353436 - DNA, 22 bp, Homo sapiens
atgctgcagctgcaggatcaga

SEQ ID NO: 8353437 - DNA, 22 bp, Homo sapiens
agagaacacgtgcatctgcaat

SEQ ID NO: 8353438 - DNA, 22 bp, Homo sapiens
atgcttcagatttggggtatta

SEQ ID NO: 8353439 - DNA, 22 bp, Homo sapiens
atgcaacagtcagtacatccgg

SEQ ID NO: 8353440 - DNA, 22 bp, Homo sapiens
atgccacttctctaagtcatgt

SEQ ID NO: 8353441 - DNA, 22 bp, Homo sapiens
atgccactgacatggacaattt

SEQ ID NO: 8353442 - DNA, 19 bp, Homo sapiens
agacataaagagtttgcaa

SEQ ID NO: 8353443 - DNA, 22 bp, Homo sapiens
agacataagccagtcactcact

SEQ ID NO: 8353444 - DNA, 22 bp, Homo sapiens
agacatagataggcactgattg

SEQ ID NO: 8353445 - DNA, 22 bp, Homo sapiens
agacataattaattagttctac

SEQ ID NO: 8353446 - DNA, 22 bp, Homo sapiens
agacagttgatatactataaaa

SEQ ID NO: 8353447 - DNA, 22 bp, Homo sapiens
agacagttgatatactataaaa

SEQ ID NO: 8353448 - DNA, 22 bp, Homo sapiens
agacagttgatatactataaaa

SEQ ID NO: 8353449 - DNA, 22 bp, Homo sapiens
atgccagtcaaagaagatgaca

SEQ ID NO: 8353450 - DNA, 22 bp, Homo sapiens
atgccattgtatattcattgat

SEQ ID NO: 8353451 - DNA, 22 bp, Homo sapiens
atgacttctgctttacagagtt

SEQ ID NO: 8353452 - DNA, 22 bp, Homo sapiens
atgagaaagagttgtatctaga

SEQ ID NO: 8353453 - DNA, 22 bp, Homo sapiens
atgagaaagagttgtatctaga

SEQ ID NO: 8353454 - DNA, 22 bp, Homo sapiens
atgattctcattttactgtgat

SEQ ID NO: 8353455 - DNA, 22 bp, Homo sapiens
atgattctctgctactctaaat

SEQ ID NO: 8353456 - DNA, 22 bp, Homo sapiens
atgattggtggtcagcagtatg

SEQ ID NO: 8353457 - DNA, 22 bp, Homo sapiens
atgattgggaccttgaaatagg

SEQ ID NO: 8353458 - DNA, 22 bp, Homo sapiens
atgattgcctgtgtgtgagaaa

SEQ ID NO: 8353459 - DNA, 22 bp, Homo sapiens
atgatttccagttgttgctaag

SEQ ID NO: 8353460 - DNA, 22 bp, Homo sapiens
atgacttaatcatacttgcatt

SEQ ID NO: 8353461 - DNA, 22 bp, Homo sapiens
atcttacaattacaagacactc

SEQ ID NO: 8353462 - DNA, 21 bp, Homo sapiens
atcttaaaaggtcttaacttt

SEQ ID NO: 8353463 - DNA, 22 bp, Homo sapiens
atctgttcttgtgtcagtaatt

SEQ ID NO: 8353464 - DNA, 17 bp, Homo sapiens
atctggctgcttctaga

SEQ ID NO: 8353465 - DNA, 22 bp, Homo sapiens
atctggctgctgtgcttaagct

SEQ ID NO: 8353466 - DNA, 22 bp, Homo sapiens
atctggctggattcttagcgtt

SEQ ID NO: 8353467 - DNA, 22 bp, Homo sapiens
atctggcttacctagggtgcct

SEQ ID NO: 8353468 - DNA, 22 bp, Homo sapiens
atctggctgagcgaggcccaca

SEQ ID NO: 8353469 - DNA, 22 bp, Homo sapiens
atctggctgactttgtgggaca

SEQ ID NO: 8353470 - DNA, 22 bp, Homo sapiens
atctggcttacgaagcactggt

SEQ ID NO: 8353471 - DNA, 22 bp, Homo sapiens
atctggcttgggtgtgggtagc

SEQ ID NO: 8353472 - DNA, 22 bp, Homo sapiens
atctggcttgactttgcgactt

SEQ ID NO: 8353473 - DNA, 22 bp, Homo sapiens
atctggctttcttaatgactta

SEQ ID NO: 8353474 - DNA, 22 bp, Homo sapiens
atctggcttttaccccacggcc

SEQ ID NO: 8353475 - DNA, 22 bp, Homo sapiens
atctggcttttactgaattgct

SEQ ID NO: 8353476 - DNA, 22 bp, Homo sapiens
atgttacagaaagcaaagatga

SEQ ID NO: 8353477 - DNA, 22 bp, Homo sapiens
agagccaggaagtggcgtgggg

SEQ ID NO: 8353478 - DNA, 22 bp, Homo sapiens
agagccagcatttgacactggc

SEQ ID NO: 8353479 - DNA, 22 bp, Homo sapiens
agagattcatgtttactgtagg

SEQ ID NO: 8353480 - DNA, 21 bp, Homo sapiens
atgtgattatatgacttttac

SEQ ID NO: 8353481 - DNA, 22 bp, Homo sapiens
atgtatatgcatgcattcaaag

SEQ ID NO: 8353482 - DNA, 22 bp, Homo sapiens
atgtgcaattattaagaagaga

SEQ ID NO: 8353483 - DNA, 22 bp, Homo sapiens
atgtgcaattattaagaagaga

SEQ ID NO: 8353484 - DNA, 22 bp, Homo sapiens
atgtgcaaagtaaagtaatttt

SEQ ID NO: 8353485 - DNA, 22 bp, Homo sapiens
atgttcatagcatcggtattca

SEQ ID NO: 8353486 - DNA, 22 bp, Homo sapiens
atgttcattttatggcgatgcc

SEQ ID NO: 8353487 - DNA, 22 bp, Homo sapiens
atgttcattttcttaatgtgcc

SEQ ID NO: 8353488 - DNA, 22 bp, Homo sapiens
atgttcatgtggctgctggcag

SEQ ID NO: 8353489 - DNA, 22 bp, Homo sapiens
atgttcatcaacacattacaag

SEQ ID NO: 8353490 - DNA, 22 bp, Homo sapiens
atgttcatctacaaggcattgt

SEQ ID NO: 8353491 - DNA, 22 bp, Homo sapiens
agagcgagtctggggctcggat

SEQ ID NO: 8353492 - DNA, 22 bp, Homo sapiens
atgttctatatcattattgtga

SEQ ID NO: 8353493 - DNA, 22 bp, Homo sapiens
attaagctggtccagacaagtt

SEQ ID NO: 8353494 - DNA, 22 bp, Homo sapiens
agagctccaagaagtcctgcag

SEQ ID NO: 8353495 - DNA, 22 bp, Homo sapiens
agagctcccgagacaatgtatt

SEQ ID NO: 8353496 - DNA, 22 bp, Homo sapiens
agagctccagggttttgtagtg

SEQ ID NO: 8353497 - DNA, 22 bp, Homo sapiens
agagctcctaaatgtagccaac

SEQ ID NO: 8353498 - DNA, 22 bp, Homo sapiens
attaagtgactaaagtaatgct

SEQ ID NO: 8353499 - DNA, 22 bp, Homo sapiens
attaaggtgtcaatgtatttgg

SEQ ID NO: 8353500 - DNA, 22 bp, Homo sapiens
atggacaggaactcccttggca

SEQ ID NO: 8353501 - DNA, 22 bp, Homo sapiens
atggacaggctgagcttcctca

SEQ ID NO: 8353502 - DNA, 22 bp, Homo sapiens
atgggcagtaacagtggcagtc

SEQ ID NO: 8353503 - DNA, 16 bp, Homo sapiens
atgggcagtgaggaag

SEQ ID NO: 8353504 - DNA, 22 bp, Homo sapiens
atgggcagtgtattggaaggaa

SEQ ID NO: 8353505 - DNA, 22 bp, Homo sapiens
atgggcagttaggaggccagga

SEQ ID NO: 8353506 - DNA, 22 bp, Homo sapiens
agagaactactttttatatgtg

SEQ ID NO: 8353507 - DNA, 22 bp, Homo sapiens
agagaacttctcctaaatctca

SEQ ID NO: 8353508 - DNA, 22 bp, Homo sapiens
agagaacagcctcctagagaaa

SEQ ID NO: 8353509 - DNA, 22 bp, Homo sapiens
agagaacagcctcctagagaaa

SEQ ID NO: 8353510 - DNA, 22 bp, Homo sapiens
agagaacagtgttttgaaggag

SEQ ID NO: 8353511 - DNA, 22 bp, Homo sapiens
agagaacatattttgtatgatt

SEQ ID NO: 8353512 - DNA, 22 bp, Homo sapiens
agagaacatattttgtatgatt

SEQ ID NO: 8353513 - DNA, 22 bp, Homo sapiens
agagaacatattttgtatgatt

SEQ ID NO: 8353514 - DNA, 22 bp, Homo sapiens
atggacagaaggtagcacctat

SEQ ID NO: 8353515 - DNA, 19 bp, Homo sapiens
atggacagacagtttggcc

SEQ ID NO: 8353516 - DNA, 18 bp, Homo sapiens
agagatgggagttggaaa

SEQ ID NO: 8353517 - DNA, 18 bp, Homo sapiens
agagatgggagttggaaa

SEQ ID NO: 8353518 - DNA, 22 bp, Homo sapiens
atgtatatgaagctagtatttt

SEQ ID NO: 8353519 - DNA, 22 bp, Homo sapiens
atgtatatgaagctagtatttt

SEQ ID NO: 8353520 - DNA, 22 bp, Homo sapiens
atgtacatagcatcatctagga

SEQ ID NO: 8353521 - DNA, 21 bp, Homo sapiens
attttgtacatagaatttgtc

SEQ ID NO: 8353522 - DNA, 22 bp, Homo sapiens
agatttcaatggatattgcaag

SEQ ID NO: 8353523 - DNA, 22 bp, Homo sapiens
agatttcaatgtgagcattagt

SEQ ID NO: 8353524 - DNA, 22 bp, Homo sapiens
agattcctcagtcatgaagcct

SEQ ID NO: 8353525 - DNA, 23 bp, Homo sapiens
atttacagctgtgtgagcaagtt

SEQ ID NO: 8353526 - DNA, 22 bp, Homo sapiens
agatgacaagagcttgctgcag

SEQ ID NO: 8353527 - DNA, 21 bp, Homo sapiens
agatgaggatactgaggccta

SEQ ID NO: 8353528 - DNA, 22 bp, Homo sapiens
agatgacacaccatttttactt

SEQ ID NO: 8353529 - DNA, 22 bp, Homo sapiens
agatgacaatgaggttgttatt

SEQ ID NO: 8353530 - DNA, 22 bp, Homo sapiens
attttgttataggagctgaaat

SEQ ID NO: 8353531 - DNA, 22 bp, Homo sapiens
attttgttgaggtaattgtcaa

SEQ ID NO: 8353532 - DNA, 22 bp, Homo sapiens
attttgttgatggtggagtagc

SEQ ID NO: 8353533 - DNA, 22 bp, Homo sapiens
attttttagccaagactctgca

SEQ ID NO: 8353534 - DNA, 22 bp, Homo sapiens
attttttcagattgagtgttaa

SEQ ID NO: 8353535 - DNA, 22 bp, Homo sapiens
attttttatataccaaggtggg

SEQ ID NO: 8353536 - DNA, 22 bp, Homo sapiens
agcaataacagaaaactttcct

SEQ ID NO: 8353537 - DNA, 23 bp, Homo sapiens
agcaataagaagggatacatgtg

SEQ ID NO: 8353538 - DNA, 23 bp, Homo sapiens
agcaataagaagggatacatgtg

SEQ ID NO: 8353539 - DNA, 23 bp, Homo sapiens
agcaataagaagggatacatgtg

SEQ ID NO: 8353540 - DNA, 23 bp, Homo sapiens
attttttgtctttgtaactagat

SEQ ID NO: 8353541 - DNA, 22 bp, Homo sapiens
attttttcccagttagccagga

SEQ ID NO: 8353542 - DNA, 22 bp, Homo sapiens
agcaatatttaaaggtttgcaa

SEQ ID NO: 8353543 - DNA, 22 bp, Homo sapiens
agcaatataaatgttgggtaga

SEQ ID NO: 8353544 - DNA, 22 bp, Homo sapiens
agcaatatgacattgctacatc

SEQ ID NO: 8353545 - DNA, 22 bp, Homo sapiens
agcaatatttcagctagcaggt

SEQ ID NO: 8353546 - DNA, 22 bp, Homo sapiens
agcaatgaaatgaaatcagtct

SEQ ID NO: 8353547 - DNA, 22 bp, Homo sapiens
agcaatgaaatgaaatcagtct

SEQ ID NO: 8353548 - DNA, 22 bp, Homo sapiens
agcaatgactggctatatgatt

SEQ ID NO: 8353549 - DNA, 22 bp, Homo sapiens
agcaatgtctttttggccatct

SEQ ID NO: 8353550 - DNA, 22 bp, Homo sapiens
caaataagcaattccattcttc

SEQ ID NO: 8353551 - DNA, 22 bp, Homo sapiens
caaataagaaccacaggggagt

SEQ ID NO: 8353552 - DNA, 22 bp, Homo sapiens
caaagtggagagcctgtggttg

SEQ ID NO: 8353553 - DNA, 22 bp, Homo sapiens
caaagtggctggccgggagatc

SEQ ID NO: 8353554 - DNA, 22 bp, Homo sapiens
attgaaaaattcacaattctgg

SEQ ID NO: 8353555 - DNA, 22 bp, Homo sapiens
attgaaaatataattctaggag

SEQ ID NO: 8353556 - DNA, 22 bp, Homo sapiens
attgaaagataggctactgtgg

SEQ ID NO: 8353557 - DNA, 22 bp, Homo sapiens
attgaaagagttttctgctgca

SEQ ID NO: 8353558 - DNA, 22 bp, Homo sapiens
attgaaagagaatgtagctctt

SEQ ID NO: 8353559 - DNA, 22 bp, Homo sapiens
attgagaaaggcttatgtttgc

SEQ ID NO: 8353560 - DNA, 22 bp, Homo sapiens
attgagaaaataagtatggata

SEQ ID NO: 8353561 - DNA, 22 bp, Homo sapiens
attgagaaggagattggcatct

SEQ ID NO: 8353562 - DNA, 22 bp, Homo sapiens
attgaaagcatggatttggatt

SEQ ID NO: 8353563 - DNA, 22 bp, Homo sapiens
attgaaagcacaaagaacaagt

SEQ ID NO: 8353564 - DNA, 22 bp, Homo sapiens
attgaaagcacaaagaacaagt

SEQ ID NO: 8353565 - DNA, 22 bp, Homo sapiens
attgaaagattttgggctcatg

SEQ ID NO: 8353566 - DNA, 22 bp, Homo sapiens
attgaaagatatactgttctca

SEQ ID NO: 8353567 - DNA, 22 bp, Homo sapiens
attgaaaggttttgagcagata

SEQ ID NO: 8353568 - DNA, 21 bp, Homo sapiens
attgaaagtcaacaatcagtt

SEQ ID NO: 8353569 - DNA, 22 bp, Homo sapiens
attgaaaggcaaagtaggaagc

SEQ ID NO: 8353570 - DNA, 22 bp, Homo sapiens
attgaaaggcaaagtaggaagc

SEQ ID NO: 8353571 - DNA, 22 bp, Homo sapiens
attgaaagtcctatctaaggga

SEQ ID NO: 8353572 - DNA, 22 bp, Homo sapiens
attgaaatacataaaattgcca

SEQ ID NO: 8353573 - DNA, 22 bp, Homo sapiens
attgtatacaagcttaattgtt

SEQ ID NO: 8353574 - DNA, 22 bp, Homo sapiens
attgagaatccatttgagatga

SEQ ID NO: 8353575 - DNA, 22 bp, Homo sapiens
attgagaatatgatttagtata

SEQ ID NO: 8353576 - DNA, 22 bp, Homo sapiens
attgagaattgtgagtttggag

SEQ ID NO: 8353577 - DNA, 23 bp, Homo sapiens
agatacagatctacgtgtcaatg

SEQ ID NO: 8353578 - DNA, 22 bp, Homo sapiens
agatacagcttttttgtcagtc

SEQ ID NO: 8353579 - DNA, 22 bp, Homo sapiens
agatacaagttaagagaaagga

SEQ ID NO: 8353580 - DNA, 22 bp, Homo sapiens
agatacaagttaagagaaagga

SEQ ID NO: 8353581 - DNA, 22 bp, Homo sapiens
agatacaaaaagggagaagatt

SEQ ID NO: 8353582 - DNA, 22 bp, Homo sapiens
agatacaaaggcctacagagca

SEQ ID NO: 8353583 - DNA, 22 bp, Homo sapiens
agatacaaaggcctacagagca

SEQ ID NO: 8353584 - DNA, 22 bp, Homo sapiens
agatacaactgtttaaacatta

SEQ ID NO: 8353585 - DNA, 22 bp, Homo sapiens
agatacaactgtttaaacatta

SEQ ID NO: 8353586 - DNA, 22 bp, Homo sapiens
attgtatttaggagaaaagggt

SEQ ID NO: 8353587 - DNA, 22 bp, Homo sapiens
attgttaataactattacattg

SEQ ID NO: 8353588 - DNA, 22 bp, Homo sapiens
attgtgtaattttcagctcata

SEQ ID NO: 8353589 - DNA, 22 bp, Homo sapiens
attgtgtcctcattgaccttca

SEQ ID NO: 8353590 - DNA, 22 bp, Homo sapiens
attctacaacccaataataatt

SEQ ID NO: 8353591 - DNA, 22 bp, Homo sapiens
attctaaatgtaatttagaatt

SEQ ID NO: 8353592 - DNA, 22 bp, Homo sapiens
attctaaatgtaatttagaatt

SEQ ID NO: 8353593 - DNA, 22 bp, Homo sapiens
attctaaatgtaatttagaatt

SEQ ID NO: 8353594 - DNA, 22 bp, Homo sapiens
attcgcgggcctggagggtggg

SEQ ID NO: 8353595 - DNA, 22 bp, Homo sapiens
attcaaaagaccatgcagactc

SEQ ID NO: 8353596 - DNA, 22 bp, Homo sapiens
attcaaacaggaagaaatcatt

SEQ ID NO: 8353597 - DNA, 22 bp, Homo sapiens
attcccatcgtcaacttcactg

SEQ ID NO: 8353598 - DNA, 20 bp, Homo sapiens
attctacaagaataagcatg

SEQ ID NO: 8353599 - DNA, 22 bp, Homo sapiens
attctccagctcactgtccata

SEQ ID NO: 8353600 - DNA, 22 bp, Homo sapiens
attctccatcaccactggcact

SEQ ID NO: 8353601 - DNA, 20 bp, Homo sapiens
attctccctatactcacttt

SEQ ID NO: 8353602 - DNA, 22 bp, Homo sapiens
agaggccagggacactgctcaa

SEQ ID NO: 8353603 - DNA, 22 bp, Homo sapiens
attatttgtgtccacagaatac

SEQ ID NO: 8353604 - DNA, 22 bp, Homo sapiens
attatttgcttggctcatctaa

SEQ ID NO: 8353605 - DNA, 22 bp, Homo sapiens
attatttctcactcacataata

SEQ ID NO: 8353606 - DNA, 21 bp, Homo sapiens
aggtgcaggcctcaagcccca

SEQ ID NO: 8353607 - DNA, 19 bp, Homo sapiens
aggtgcaggtcacagggga

SEQ ID NO: 8353608 - DNA, 22 bp, Homo sapiens
aggtgcaggagctgtgcaggga

SEQ ID NO: 8353609 - DNA, 22 bp, Homo sapiens
aggtgcaggagctgtgcaggga

SEQ ID NO: 8353610 - DNA, 22 bp, Homo sapiens
agggtgcatgtttgcaagagtg

SEQ ID NO: 8353611 - DNA, 22 bp, Homo sapiens
aggtggaaatggctttcctagg

SEQ ID NO: 8353612 - DNA, 22 bp, Homo sapiens
aggtgccaattttcagtgaaca

SEQ ID NO: 8353613 - DNA, 22 bp, Homo sapiens
agggtgcaaaagcaaggacagt

SEQ ID NO: 8353614 - DNA, 21 bp, Homo sapiens
agggtcctacagggctcagga

SEQ ID NO: 8353615 - DNA, 22 bp, Homo sapiens
agggtgcagggacaggtgtgca

SEQ ID NO: 8353616 - DNA, 23 bp, Homo sapiens
agggtccagggatcaccaggtgt

SEQ ID NO: 8353617 - DNA, 22 bp, Homo sapiens
agggtcagttctgtgaggtgtt

SEQ ID NO: 8353618 - DNA, 22 bp, Homo sapiens
aggtggggttcagtctcagccg

SEQ ID NO: 8353619 - DNA, 22 bp, Homo sapiens
aggtggggaaaccagcgatccc

SEQ ID NO: 8353620 - DNA, 22 bp, Homo sapiens
actcacatttcatcaggccaag

SEQ ID NO: 8353621 - DNA, 22 bp, Homo sapiens
agtccttcaagaaatctggaaa

SEQ ID NO: 8353622 - DNA, 22 bp, Homo sapiens
agtcctggtgacactcctcttc

SEQ ID NO: 8353623 - DNA, 21 bp, Homo sapiens
agtccaggaggaggccaggtt

SEQ ID NO: 8353624 - DNA, 22 bp, Homo sapiens
agtcaggggttggacggggcca

SEQ ID NO: 8353625 - DNA, 18 bp, Homo sapiens
agtcagtcattgatagat

SEQ ID NO: 8353626 - DNA, 22 bp, Homo sapiens
agtcagtgaatctgaaggctaa

SEQ ID NO: 8353627 - DNA, 22 bp, Homo sapiens
agtcagtggatttaccatgcgt

SEQ ID NO: 8353628 - DNA, 22 bp, Homo sapiens
agtccagaccccggcagctggt

SEQ ID NO: 8353629 - DNA, 22 bp, Homo sapiens
agtaacatgagtttttctaatg

SEQ ID NO: 8353630 - DNA, 22 bp, Homo sapiens
actcagagtttgcgttccatac

SEQ ID NO: 8353631 - DNA, 22 bp, Homo sapiens
agttacatctgttatgtgtgtt

SEQ ID NO: 8353632 - DNA, 22 bp, Homo sapiens
agttacacaattattgcatgga

SEQ ID NO: 8353633 - DNA, 22 bp, Homo sapiens
agttacacagtgtcacttctac

SEQ ID NO: 8353634 - DNA, 22 bp, Homo sapiens
agttacaaccatgacacaagca

SEQ ID NO: 8353635 - DNA, 22 bp, Homo sapiens
agttattttggaaaatgagtca

SEQ ID NO: 8353636 - DNA, 22 bp, Homo sapiens
agttattttacatggaagtttg

SEQ ID NO: 8353637 - DNA, 22 bp, Homo sapiens
agttatttggctatagatggta

SEQ ID NO: 8353638 - DNA, 22 bp, Homo sapiens
actggggcctcctccatgctct

SEQ ID NO: 8353639 - DNA, 22 bp, Homo sapiens
actggggctgatgcgttcgtgt

SEQ ID NO: 8353640 - DNA, 22 bp, Homo sapiens
actggggcctcctccatgctct

SEQ ID NO: 8353641 - DNA, 22 bp, Homo sapiens
actggggcaggaaagtatgctg

SEQ ID NO: 8353642 - DNA, 22 bp, Homo sapiens
actggggattagggactcagtg

SEQ ID NO: 8353643 - DNA, 22 bp, Homo sapiens
actggggcagtgggcagtggtt

SEQ ID NO: 8353644 - DNA, 22 bp, Homo sapiens
actggggcagtgggcagtggtt

SEQ ID NO: 8353645 - DNA, 22 bp, Homo sapiens
agttacaaacactatcagttct

SEQ ID NO: 8353646 - DNA, 22 bp, Homo sapiens
agttacaaacactatcagttct

SEQ ID NO: 8353647 - DNA, 22 bp, Homo sapiens
agttacaaacactatcagttct

SEQ ID NO: 8353648 - DNA, 22 bp, Homo sapiens
actggtcagattttacttccca

SEQ ID NO: 8353649 - DNA, 22 bp, Homo sapiens
agtgggggctggctctgtctgt

SEQ ID NO: 8353650 - DNA, 22 bp, Homo sapiens
agtggggcggacaggaccagga

SEQ ID NO: 8353651 - DNA, 22 bp, Homo sapiens
agtggggccggtgaggccgagg

SEQ ID NO: 8353652 - DNA, 22 bp, Homo sapiens
agtgtctgtgctttgcagcaaa

SEQ ID NO: 8353653 - DNA, 22 bp, Homo sapiens
agtgtctgtgctttgcagcaaa

SEQ ID NO: 8353654 - DNA, 22 bp, Homo sapiens
agtggggtccatcccttccctc

SEQ ID NO: 8353655 - DNA, 22 bp, Homo sapiens
agtgtcttacatgaattgattt

SEQ ID NO: 8353656 - DNA, 22 bp, Homo sapiens
agtgtcttcatgatgtggcagc

SEQ ID NO: 8353657 - DNA, 22 bp, Homo sapiens
agtgtcttagtccatttgggct

SEQ ID NO: 8353658 - DNA, 22 bp, Homo sapiens
agtgtgggttttatggagccct

SEQ ID NO: 8353659 - DNA, 22 bp, Homo sapiens
agtgtggggtcaccggcccagg

SEQ ID NO: 8353660 - DNA, 22 bp, Homo sapiens
agtgggaggcggctgacgggcg

SEQ ID NO: 8353661 - DNA, 20 bp, Homo sapiens
agtgggagagggcagactgc

SEQ ID NO: 8353662 - DNA, 22 bp, Homo sapiens
agtggctggaattgcaggtgcg

SEQ ID NO: 8353663 - DNA, 22 bp, Homo sapiens
agtgcttggcaaccttctgacc

SEQ ID NO: 8353664 - DNA, 22 bp, Homo sapiens
agtgagacagtggactctgcat

SEQ ID NO: 8353665 - DNA, 22 bp, Homo sapiens
agtgaattctaaatgctaaaga

SEQ ID NO: 8353666 - DNA, 22 bp, Homo sapiens
agtccttcttttagttgcttgg

SEQ ID NO: 8353667 - DNA, 22 bp, Homo sapiens
agtgctgtctccttcccccggg

SEQ ID NO: 8353668 - DNA, 23 bp, Homo sapiens
agtgctgaattgaaagctccagg

SEQ ID NO: 8353669 - DNA, 22 bp, Homo sapiens
atagcatttacttttcagaaat

SEQ ID NO: 8353670 - DNA, 22 bp, Homo sapiens
atagaataaggcacagattctt

SEQ ID NO: 8353671 - DNA, 22 bp, Homo sapiens
atagaataaggcacagattctt

SEQ ID NO: 8353672 - DNA, 22 bp, Homo sapiens
atagaataaggcacagattctt

SEQ ID NO: 8353673 - DNA, 22 bp, Homo sapiens
atagaataaggcacagattctt

SEQ ID NO: 8353674 - DNA, 22 bp, Homo sapiens
atagaataaggcacagattctt

SEQ ID NO: 8353675 - DNA, 22 bp, Homo sapiens
atagaatacatttcatggagat

SEQ ID NO: 8353676 - DNA, 22 bp, Homo sapiens
atagaatagcatagaaaattga

SEQ ID NO: 8353677 - DNA, 22 bp, Homo sapiens
atagaatagcatagaaaattga

SEQ ID NO: 8353678 - DNA, 22 bp, Homo sapiens
atagaagcaagaacagaatgga

SEQ ID NO: 8353679 - DNA, 22 bp, Homo sapiens
atagaagaggaaactgaggttg

SEQ ID NO: 8353680 - DNA, 20 bp, Homo sapiens
atagaagtattatgtaatgt

SEQ ID NO: 8353681 - DNA, 22 bp, Homo sapiens
atagaagctgataaactacttc

SEQ ID NO: 8353682 - DNA, 22 bp, Homo sapiens
atagaagcttttaaataacagg

SEQ ID NO: 8353683 - DNA, 22 bp, Homo sapiens
atagaacaaggtagacagcttt

SEQ ID NO: 8353684 - DNA, 22 bp, Homo sapiens
atagaaatgtattttggactag

SEQ ID NO: 8353685 - DNA, 22 bp, Homo sapiens
agaaaagaggctttctaagcat

SEQ ID NO: 8353686 - DNA, 23 bp, Homo sapiens
agaaaagcttggacacatggcct

SEQ ID NO: 8353687 - DNA, 23 bp, Homo sapiens
agaaaagcttggacacatggcct

SEQ ID NO: 8353688 - DNA, 17 bp, Homo sapiens
agaaaagagaccagcag

SEQ ID NO: 8353689 - DNA, 22 bp, Homo sapiens
agaaaaggattgatggatcaga

SEQ ID NO: 8353690 - DNA, 22 bp, Homo sapiens
agaaaagggcaggagggataca

SEQ ID NO: 8353691 - DNA, 22 bp, Homo sapiens
agaaaaggcttgaagaggtttt

SEQ ID NO: 8353692 - DNA, 20 bp, Homo sapiens
agaaaaagtgtggaaatttc

SEQ ID NO: 8353693 - DNA, 23 bp, Homo sapiens
atagttatgctgcatgcatgtac

SEQ ID NO: 8353694 - DNA, 22 bp, Homo sapiens
atagttctagacctatagttct

SEQ ID NO: 8353695 - DNA, 22 bp, Homo sapiens
ataggaaagaaaattatgtagg

SEQ ID NO: 8353696 - DNA, 22 bp, Homo sapiens
ataggaaagaaaattatgtagg

SEQ ID NO: 8353697 - DNA, 22 bp, Homo sapiens
atagccaggtcacagagctagc

SEQ ID NO: 8353698 - DNA, 22 bp, Homo sapiens
atagcattatttacaattagta

SEQ ID NO: 8353699 - DNA, 22 bp, Homo sapiens
agttgaaggttggctgatccat

SEQ ID NO: 8353700 - DNA, 22 bp, Homo sapiens
agttgaagtcctcatcaaatat

SEQ ID NO: 8353701 - DNA, 22 bp, Homo sapiens
agttgaaattagagtcctggct

SEQ ID NO: 8353702 - DNA, 22 bp, Homo sapiens
agttgaaagccttatttctctg

SEQ ID NO: 8353703 - DNA, 22 bp, Homo sapiens
agttgaatgttacagttctaaa

SEQ ID NO: 8353704 - DNA, 22 bp, Homo sapiens
agttctttgtgagtaatacaga

SEQ ID NO: 8353705 - DNA, 23 bp, Homo sapiens
agttcataatttcttatttgtgt

SEQ ID NO: 8353706 - DNA, 22 bp, Homo sapiens
agttcttttgtgaacatatgct

SEQ ID NO: 8353707 - DNA, 22 bp, Homo sapiens
agttgaaaattaagtgaatttc

SEQ ID NO: 8353708 - DNA, 22 bp, Homo sapiens
ataaattctctgatgtatagta

SEQ ID NO: 8353709 - DNA, 22 bp, Homo sapiens
agttgcagacgcagagatgttg

SEQ ID NO: 8353710 - DNA, 22 bp, Homo sapiens
ataacagaataagtcattaccg

SEQ ID NO: 8353711 - DNA, 22 bp, Homo sapiens
ataacagacttagagttacaag

SEQ ID NO: 8353712 - DNA, 22 bp, Homo sapiens
atacacgtgccatgttggtgtg

SEQ ID NO: 8353713 - DNA, 22 bp, Homo sapiens
atacacagctacattgaacaat

SEQ ID NO: 8353714 - DNA, 22 bp, Homo sapiens
atacacagccattatgaattag

SEQ ID NO: 8353715 - DNA, 22 bp, Homo sapiens
atacaatgataatagtacttta

SEQ ID NO: 8353716 - DNA, 22 bp, Homo sapiens
atacaattattctgcagatatt

SEQ ID NO: 8353717 - DNA, 22 bp, Homo sapiens
atacaaagacaaatctcaatct

SEQ ID NO: 8353718 - DNA, 20 bp, Homo sapiens
atacaaagagattgatgtat

SEQ ID NO: 8353719 - DNA, 22 bp, Homo sapiens
ataaggcatctctcagttagca

SEQ ID NO: 8353720 - DNA, 22 bp, Homo sapiens
ataaggcatatagtcacttttt

SEQ ID NO: 8353721 - DNA, 23 bp, Homo sapiens
ataaggcataaaggtacattgga

SEQ ID NO: 8353722 - DNA, 19 bp, Homo sapiens
ataaggcagtgactttttt

SEQ ID NO: 8353723 - DNA, 22 bp, Homo sapiens
ataaggcagtcactggaatgtt

SEQ ID NO: 8353724 - DNA, 22 bp, Homo sapiens
ataaggcagtgacttcatctat

SEQ ID NO: 8353725 - DNA, 22 bp, Homo sapiens
ataaggcagtcccttaacaagg

SEQ ID NO: 8353726 - DNA, 22 bp, Homo sapiens
ataaggcagaaatagggaaagt

SEQ ID NO: 8353727 - DNA, 22 bp, Homo sapiens
ataaggcagaaatgattctagt

SEQ ID NO: 8353728 - DNA, 19 bp, Homo sapiens
ataaggcaggaggaaattt

SEQ ID NO: 8353729 - DNA, 22 bp, Homo sapiens
ataaggcacacatagatagggt

SEQ ID NO: 8353730 - DNA, 22 bp, Homo sapiens
ataaggcaagctgtcagtttgt

SEQ ID NO: 8353731 - DNA, 19 bp, Homo sapiens
ataaggcaattggatttgg

SEQ ID NO: 8353732 - DNA, 22 bp, Homo sapiens
ataaggaatgatgtatcagttt

SEQ ID NO: 8353733 - DNA, 22 bp, Homo sapiens
ataaggaatttagaatagggaa

SEQ ID NO: 8353734 - DNA, 22 bp, Homo sapiens
ataaggaagatgtcctcatctg

SEQ ID NO: 8353735 - DNA, 22 bp, Homo sapiens
ataaggaagttgcagaagtgga

SEQ ID NO: 8353736 - DNA, 22 bp, Homo sapiens
ataaggaaaattggagaaattg

SEQ ID NO: 8353737 - DNA, 22 bp, Homo sapiens
ataaggaaatgaaactctaata

SEQ ID NO: 8353738 - DNA, 22 bp, Homo sapiens
ataaggaacctgggcttaagag

SEQ ID NO: 8353739 - DNA, 22 bp, Homo sapiens
atatagtaagcagtctgtaaat

SEQ ID NO: 8353740 - DNA, 22 bp, Homo sapiens
atatagcacttgttttgcatgt

SEQ ID NO: 8353741 - DNA, 22 bp, Homo sapiens
atatagaaggtgctatttacat

SEQ ID NO: 8353742 - DNA, 22 bp, Homo sapiens
atatagaatacacagggaaagt

SEQ ID NO: 8353743 - DNA, 22 bp, Homo sapiens
atatagaaggtgctatttacat

SEQ ID NO: 8353744 - DNA, 22 bp, Homo sapiens
agaaagaacgcacttgtgctgc

SEQ ID NO: 8353745 - DNA, 22 bp, Homo sapiens
agaaactgtgttactagaatgt

SEQ ID NO: 8353746 - DNA, 20 bp, Homo sapiens
agaaacatttcttgagaact

SEQ ID NO: 8353747 - DNA, 22 bp, Homo sapiens
atattaagatgctattggtttt

SEQ ID NO: 8353748 - DNA, 22 bp, Homo sapiens
atattaatgggatttagtcagg

SEQ ID NO: 8353749 - DNA, 22 bp, Homo sapiens
atattaatgagcaagtaagtga

SEQ ID NO: 8353750 - DNA, 22 bp, Homo sapiens
agaaagaacgttggttatctta

SEQ ID NO: 8353751 - DNA, 22 bp, Homo sapiens
agaaagaggatgcagatctcat

SEQ ID NO: 8353752 - DNA, 22 bp, Homo sapiens
agaaatcaatgaagtctgctaa

SEQ ID NO: 8353753 - DNA, 22 bp, Homo sapiens
agaaatcaatatctatatgttg

SEQ ID NO: 8353754 - DNA, 20 bp, Homo sapiens
agaaatattgagttcagagg

SEQ ID NO: 8353755 - DNA, 20 bp, Homo sapiens
agaaatattgagttcagagg

SEQ ID NO: 8353756 - DNA, 22 bp, Homo sapiens
agaaatatgctgattagatgaa

SEQ ID NO: 8353757 - DNA, 22 bp, Homo sapiens
agaaatagtcacattggaggaa

SEQ ID NO: 8353758 - DNA, 22 bp, Homo sapiens
agaaatgctcttcctgaccaga

SEQ ID NO: 8353759 - DNA, 22 bp, Homo sapiens
agaaatgcattagcacatatag

SEQ ID NO: 8353760 - DNA, 23 bp, Homo sapiens
atcaagataatccagatgaccta

SEQ ID NO: 8353761 - DNA, 22 bp, Homo sapiens
atcaagaattgggagctattga

SEQ ID NO: 8353762 - DNA, 22 bp, Homo sapiens
atcaagcatatataaaactgca

SEQ ID NO: 8353763 - DNA, 22 bp, Homo sapiens
agaaatgttgaatacatcagga

SEQ ID NO: 8353764 - DNA, 22 bp, Homo sapiens
agaaatgttgaatacatcagga

SEQ ID NO: 8353765 - DNA, 22 bp, Homo sapiens
agaaatgtttactcaccccctt

SEQ ID NO: 8353766 - DNA, 22 bp, Homo sapiens
agaaatgtacacgacacccaga

SEQ ID NO: 8353767 - DNA, 22 bp, Homo sapiens
agaaatgttacagttgttattt

SEQ ID NO: 8353768 - DNA, 22 bp, Homo sapiens
agggccagtgggttgaaaggca

SEQ ID NO: 8353769 - DNA, 22 bp, Homo sapiens
agggccagtgggttgaaaggca

SEQ ID NO: 8353770 - DNA, 22 bp, Homo sapiens
agggccagtaccaggtgggtgg

SEQ ID NO: 8353771 - DNA, 22 bp, Homo sapiens
agggccagtaaatgtttcctca

SEQ ID NO: 8353772 - DNA, 22 bp, Homo sapiens
agggccagttcagaggacatgg

SEQ ID NO: 8353773 - DNA, 22 bp, Homo sapiens
agggccagttcagaggacatgg

SEQ ID NO: 8353774 - DNA, 22 bp, Homo sapiens
agggccagttctacctctgaat

SEQ ID NO: 8353775 - DNA, 22 bp, Homo sapiens
agggccagcccataatgccaaa

SEQ ID NO: 8353776 - DNA, 22 bp, Homo sapiens
agggccagcccataatgccaaa

SEQ ID NO: 8353777 - DNA, 22 bp, Homo sapiens
agggccagcagcttggccaacc

SEQ ID NO: 8353778 - DNA, 22 bp, Homo sapiens
agggccagccaggccctacaaa

SEQ ID NO: 8353779 - DNA, 22 bp, Homo sapiens
agggccagcagcttggccaacc

SEQ ID NO: 8353780 - DNA, 22 bp, Homo sapiens
agggccagcactcctggcagga

SEQ ID NO: 8353781 - DNA, 22 bp, Homo sapiens
agggccagcactcctggcagga

SEQ ID NO: 8353782 - DNA, 21 bp, Homo sapiens
agggccagatcaccaaggagc

SEQ ID NO: 8353783 - DNA, 22 bp, Homo sapiens
agggccagatgaagccacaagc

SEQ ID NO: 8353784 - DNA, 22 bp, Homo sapiens
accagagcccatctgctcctag

SEQ ID NO: 8353785 - DNA, 18 bp, Homo sapiens
accagagccctgttctgg

SEQ ID NO: 8353786 - DNA, 22 bp, Homo sapiens
accagagcgctcaagccttccc

SEQ ID NO: 8353787 - DNA, 22 bp, Homo sapiens
accagagctcttcagcacagga

SEQ ID NO: 8353788 - DNA, 22 bp, Homo sapiens
agggagctgactggctgccatt

SEQ ID NO: 8353789 - DNA, 22 bp, Homo sapiens
agggaggcaggaaagttgtctg

SEQ ID NO: 8353790 - DNA, 22 bp, Homo sapiens
agggcacatctgctgggaatgg

SEQ ID NO: 8353791 - DNA, 22 bp, Homo sapiens
agggcacaagactctgagcccc

SEQ ID NO: 8353792 - DNA, 22 bp, Homo sapiens
agggcaagggttgaagataaga

SEQ ID NO: 8353793 - DNA, 22 bp, Homo sapiens
agggaggcattagctactgcga

SEQ ID NO: 8353794 - DNA, 19 bp, Homo sapiens
agggaggtagcattggaaa

SEQ ID NO: 8353795 - DNA, 22 bp, Homo sapiens
aggggcaggtgctgcacttaga

SEQ ID NO: 8353796 - DNA, 22 bp, Homo sapiens
aggggcagttccaagttttgtg

SEQ ID NO: 8353797 - DNA, 22 bp, Homo sapiens
aggggcatcagttgcacatttt

SEQ ID NO: 8353798 - DNA, 22 bp, Homo sapiens
agggctgaagggaggtgctcat

SEQ ID NO: 8353799 - DNA, 22 bp, Homo sapiens
agggctcagttgcctggagccc

SEQ ID NO: 8353800 - DNA, 23 bp, Homo sapiens
aggggtggtcagtacccgcagtg

SEQ ID NO: 8353801 - DNA, 23 bp, Homo sapiens
aggggtggtcagtacccgcagtg

SEQ ID NO: 8353802 - DNA, 22 bp, Homo sapiens
aggggtggagagtgttgccagt

SEQ ID NO: 8353803 - DNA, 22 bp, Homo sapiens
aggggtggagagtgttgccagt

SEQ ID NO: 8353804 - DNA, 22 bp, Homo sapiens
aggggcctcgcaggaccgctcc

SEQ ID NO: 8353805 - DNA, 22 bp, Homo sapiens
aggggccaccaccaaggaaggt

SEQ ID NO: 8353806 - DNA, 22 bp, Homo sapiens
aggggccacctgtggcaccctg

SEQ ID NO: 8353807 - DNA, 22 bp, Homo sapiens
aggggccatgtaagtgtatcac

SEQ ID NO: 8353808 - DNA, 22 bp, Homo sapiens
aggggccattgttctgcccgct

SEQ ID NO: 8353809 - DNA, 21 bp, Homo sapiens
aggggcccttgccaggacgcc

SEQ ID NO: 8353810 - DNA, 22 bp, Homo sapiens
acctcaggatgtggacacagaa

SEQ ID NO: 8353811 - DNA, 22 bp, Homo sapiens
acctccagctttttagagacat

SEQ ID NO: 8353812 - DNA, 22 bp, Homo sapiens
acctccagctttttagagacat

SEQ ID NO: 8353813 - DNA, 22 bp, Homo sapiens
acattaaagagtaaggttagtt

SEQ ID NO: 8353814 - DNA, 22 bp, Homo sapiens
acattaaatttcatagtgatta

SEQ ID NO: 8353815 - DNA, 22 bp, Homo sapiens
aggctctgaagcaaccctttga

SEQ ID NO: 8353816 - DNA, 22 bp, Homo sapiens
aggctctggagtgtggtgctgg

SEQ ID NO: 8353817 - DNA, 22 bp, Homo sapiens
aggctctggagaagaatccgct

SEQ ID NO: 8353818 - DNA, 22 bp, Homo sapiens
aggctctggagtgtggtgctgg

SEQ ID NO: 8353819 - DNA, 22 bp, Homo sapiens
aggctctgacgtcacacgtggc

SEQ ID NO: 8353820 - DNA, 22 bp, Homo sapiens
aggctctgacccatgggaccca

SEQ ID NO: 8353821 - DNA, 22 bp, Homo sapiens
aggctctggacagtgaggagtt

SEQ ID NO: 8353822 - DNA, 22 bp, Homo sapiens
aggctctggacagtgaggagtt

SEQ ID NO: 8353823 - DNA, 22 bp, Homo sapiens
aggctctgcttttctggatata

SEQ ID NO: 8353824 - DNA, 22 bp, Homo sapiens
aggctctgcttttctggatata

SEQ ID NO: 8353825 - DNA, 22 bp, Homo sapiens
acatgtctgtaattattttagg

SEQ ID NO: 8353826 - DNA, 22 bp, Homo sapiens
aggctcaggcaggaatggcgga

SEQ ID NO: 8353827 - DNA, 22 bp, Homo sapiens
aggctcaggaggagctgccgga

SEQ ID NO: 8353828 - DNA, 22 bp, Homo sapiens
aggctcaggcaggaatggcgga

SEQ ID NO: 8353829 - DNA, 22 bp, Homo sapiens
aggctcagggacggggcccctt

SEQ ID NO: 8353830 - DNA, 22 bp, Homo sapiens
aggctcagggacggggcccctt

SEQ ID NO: 8353831 - DNA, 22 bp, Homo sapiens
aggctcagctggtggtgatcgc

SEQ ID NO: 8353832 - DNA, 20 bp, Homo sapiens
aggctcagctgagctcttgg

SEQ ID NO: 8353833 - DNA, 22 bp, Homo sapiens
aggctcagctggtggtgatcgc

SEQ ID NO: 8353834 - DNA, 22 bp, Homo sapiens
aggctcagctggtggtgatcgc

SEQ ID NO: 8353835 - DNA, 20 bp, Homo sapiens
aggctcagctgagctcttgg

SEQ ID NO: 8353836 - DNA, 22 bp, Homo sapiens
acatgtatctgatctgcaattg

SEQ ID NO: 8353837 - DNA, 22 bp, Homo sapiens
acatgtattgacattatattct

SEQ ID NO: 8353838 - DNA, 22 bp, Homo sapiens
acatgtctacacattctgcaat

SEQ ID NO: 8353839 - DNA, 22 bp, Homo sapiens
acatgtactgttggtgaagagg

SEQ ID NO: 8353840 - DNA, 22 bp, Homo sapiens
acatgtatctgatctgcaattg

SEQ ID NO: 8353841 - DNA, 19 bp, Homo sapiens
acatgtagtagagagagaa

SEQ ID NO: 8353842 - DNA, 22 bp, Homo sapiens
accactggctcaggagctggga

SEQ ID NO: 8353843 - DNA, 22 bp, Homo sapiens
accactggctcaggagctggga

SEQ ID NO: 8353844 - DNA, 22 bp, Homo sapiens
accactgtatctccagcacatt

SEQ ID NO: 8353845 - DNA, 22 bp, Homo sapiens
accactgtatctccagcacatt

SEQ ID NO: 8353846 - DNA, 22 bp, Homo sapiens
accagaagctggagcacaagga

SEQ ID NO: 8353847 - DNA, 22 bp, Homo sapiens
accagaagttctccaaaaagat

SEQ ID NO: 8353848 - DNA, 19 bp, Homo sapiens
aggctgtgagggaggactc

SEQ ID NO: 8353849 - DNA, 19 bp, Homo sapiens
aggctgtgagggaggactc

SEQ ID NO: 8353850 - DNA, 22 bp, Homo sapiens
aggctgtgagcaagaacaccta

SEQ ID NO: 8353851 - DNA, 22 bp, Homo sapiens
aggctggctttggtagcatggt

SEQ ID NO: 8353852 - DNA, 22 bp, Homo sapiens
aggctctggcaacagctggtgt

SEQ ID NO: 8353853 - DNA, 22 bp, Homo sapiens
aggctctggagttagccaggca

SEQ ID NO: 8353854 - DNA, 22 bp, Homo sapiens
aggctctggagttagccaggca

SEQ ID NO: 8353855 - DNA, 22 bp, Homo sapiens
aggctctggagttagccaggca

SEQ ID NO: 8353856 - DNA, 22 bp, Homo sapiens
aggctctggcaacagctggtgt

SEQ ID NO: 8353857 - DNA, 22 bp, Homo sapiens
aggctggccagtgctgcagtgg

SEQ ID NO: 8353858 - DNA, 22 bp, Homo sapiens
aggctggctggggatgcgtctt

SEQ ID NO: 8353859 - DNA, 22 bp, Homo sapiens
acatttctccttgcaggagtca

SEQ ID NO: 8353860 - DNA, 22 bp, Homo sapiens
aggctggcatacatttgttctt

SEQ ID NO: 8353861 - DNA, 18 bp, Homo sapiens
acatttctctctgcgtga

SEQ ID NO: 8353862 - DNA, 23 bp, Homo sapiens
aggctggcttcaggagcctctcc

SEQ ID NO: 8353863 - DNA, 22 bp, Homo sapiens
aggctggcttcccaagcgtcct

SEQ ID NO: 8353864 - DNA, 22 bp, Homo sapiens
aggctggcttggctctcctgtg

SEQ ID NO: 8353865 - DNA, 22 bp, Homo sapiens
acatttctccctgcatgcctgc

SEQ ID NO: 8353866 - DNA, 22 bp, Homo sapiens
acatttctcctacttgttattt

SEQ ID NO: 8353867 - DNA, 22 bp, Homo sapiens
acatttctcaggtaagtcattt

SEQ ID NO: 8353868 - DNA, 22 bp, Homo sapiens
acatttctcaggtaagtcattt

SEQ ID NO: 8353869 - DNA, 22 bp, Homo sapiens
acagtgaggaagcagctgtgct

SEQ ID NO: 8353870 - DNA, 22 bp, Homo sapiens
acagtgaatgagaatggagaaa

SEQ ID NO: 8353871 - DNA, 21 bp, Homo sapiens
acagtgagaaataaatggaaa

SEQ ID NO: 8353872 - DNA, 17 bp, Homo sapiens
acagtgagaagtcatct

SEQ ID NO: 8353873 - DNA, 22 bp, Homo sapiens
aggacttcatcacctgtataaa

SEQ ID NO: 8353874 - DNA, 17 bp, Homo sapiens
aggaggccctggcgttt

SEQ ID NO: 8353875 - DNA, 22 bp, Homo sapiens
acagtgctgtctatctcactaa

SEQ ID NO: 8353876 - DNA, 22 bp, Homo sapiens
acagtgctgtgcagtctgccct

SEQ ID NO: 8353877 - DNA, 22 bp, Homo sapiens
acagtgcttagcacagagtaga

SEQ ID NO: 8353878 - DNA, 19 bp, Homo sapiens
acagtgcttctgagtgagg

SEQ ID NO: 8353879 - DNA, 22 bp, Homo sapiens
acagtgcttggcacacagtaat

SEQ ID NO: 8353880 - DNA, 22 bp, Homo sapiens
acagtgcttttgttcctctcct

SEQ ID NO: 8353881 - DNA, 22 bp, Homo sapiens
acagtgcttctgatatgatgcc

SEQ ID NO: 8353882 - DNA, 22 bp, Homo sapiens
aggcacagcacacctggccccc

SEQ ID NO: 8353883 - DNA, 22 bp, Homo sapiens
acagtgggacagtgacggggga

SEQ ID NO: 8353884 - DNA, 22 bp, Homo sapiens
acagtggagaaggcatgaggct

SEQ ID NO: 8353885 - DNA, 22 bp, Homo sapiens
acagtggatatattaaatgaga

SEQ ID NO: 8353886 - DNA, 20 bp, Homo sapiens
acagtggaaattgatgtctg

SEQ ID NO: 8353887 - DNA, 22 bp, Homo sapiens
acagtggaagaagcactgaact

SEQ ID NO: 8353888 - DNA, 22 bp, Homo sapiens
aggcactgaaaggtggccagag

SEQ ID NO: 8353889 - DNA, 22 bp, Homo sapiens
acagtgttacttgatagtgtat

SEQ ID NO: 8353890 - DNA, 22 bp, Homo sapiens
aggcactggtccattttctgca

SEQ ID NO: 8353891 - DNA, 22 bp, Homo sapiens
acagtgttctgaaagttgaggg

SEQ ID NO: 8353892 - DNA, 22 bp, Homo sapiens
acagtgttcctttgttgtgact

SEQ ID NO: 8353893 - DNA, 22 bp, Homo sapiens
acagtgttcctttgttgtgact

SEQ ID NO: 8353894 - DNA, 22 bp, Homo sapiens
acagtgttcactaaggttagct

SEQ ID NO: 8353895 - DNA, 22 bp, Homo sapiens
acatctctgggtcctccatgca

SEQ ID NO: 8353896 - DNA, 22 bp, Homo sapiens
acatatatgtaaagtactttgt

SEQ ID NO: 8353897 - DNA, 22 bp, Homo sapiens
acatatatgctgggactgtgac

SEQ ID NO: 8353898 - DNA, 22 bp, Homo sapiens
acatatatgcgtgggctcatgg

SEQ ID NO: 8353899 - DNA, 22 bp, Homo sapiens
acatataagggatcagtgacag

SEQ ID NO: 8353900 - DNA, 22 bp, Homo sapiens
acatatattactagtaaagaca

SEQ ID NO: 8353901 - DNA, 22 bp, Homo sapiens
acatatattactagtaaagaca

SEQ ID NO: 8353902 - DNA, 22 bp, Homo sapiens
aggcagtgtgtagctggaagag

SEQ ID NO: 8353903 - DNA, 20 bp, Homo sapiens
aggcagtgtagagatgagta

SEQ ID NO: 8353904 - DNA, 22 bp, Homo sapiens
acatctttgctcttatagagct

SEQ ID NO: 8353905 - DNA, 22 bp, Homo sapiens
acatcttcccacacttgcaaaa

SEQ ID NO: 8353906 - DNA, 22 bp, Homo sapiens
acatctgtaatctagtcaaccc

SEQ ID NO: 8353907 - DNA, 22 bp, Homo sapiens
aggcagagaaaaaccagatatg

SEQ ID NO: 8353908 - DNA, 22 bp, Homo sapiens
aggcagatgggagctggaagtt

SEQ ID NO: 8353909 - DNA, 22 bp, Homo sapiens
aggcagcaatgaatgaaatgga

SEQ ID NO: 8353910 - DNA, 22 bp, Homo sapiens
aggcagcaaatgtctggaacag

SEQ ID NO: 8353911 - DNA, 22 bp, Homo sapiens
acagccagaagtcagggtggga

SEQ ID NO: 8353912 - DNA, 22 bp, Homo sapiens
acagccagaggagccaggctgg

SEQ ID NO: 8353913 - DNA, 22 bp, Homo sapiens
acagcagttactgaaataaagt

SEQ ID NO: 8353914 - DNA, 22 bp, Homo sapiens
acagcagtgggttgccagtggg

SEQ ID NO: 8353915 - DNA, 20 bp, Homo sapiens
acagccagaggaggcagaca

SEQ ID NO: 8353916 - DNA, 22 bp, Homo sapiens
acaggcaaacacagaaagtagg

SEQ ID NO: 8353917 - DNA, 23 bp, Homo sapiens
acaggcaataaagggagtctcca

SEQ ID NO: 8353918 - DNA, 21 bp, Homo sapiens
acaggcaatttcatatggttc

SEQ ID NO: 8353919 - DNA, 22 bp, Homo sapiens
acaggcaattagcaagctgtta

SEQ ID NO: 8353920 - DNA, 22 bp, Homo sapiens
acaggagaaatctggtcaaaag

SEQ ID NO: 8353921 - DNA, 22 bp, Homo sapiens
aggactggcagtgtgaggggtc

SEQ ID NO: 8353922 - DNA, 22 bp, Homo sapiens
aggactggccctgaggggaggc

SEQ ID NO: 8353923 - DNA, 22 bp, Homo sapiens
aggactggcggtcggtggggat

SEQ ID NO: 8353924 - DNA, 22 bp, Homo sapiens
aggactgggtgcagagggcatc

SEQ ID NO: 8353925 - DNA, 22 bp, Homo sapiens
aggactggtgccagacaaggta

SEQ ID NO: 8353926 - DNA, 22 bp, Homo sapiens
acagggcccttgccagcacaag

SEQ ID NO: 8353927 - DNA, 22 bp, Homo sapiens
acagggcctggctccaaaagat

SEQ ID NO: 8353928 - DNA, 22 bp, Homo sapiens
acagggcctcagccagggcaga

SEQ ID NO: 8353929 - DNA, 22 bp, Homo sapiens
acagggccctgtgggccccact

SEQ ID NO: 8353930 - DNA, 22 bp, Homo sapiens
aggacacaggtaagccagtgga

SEQ ID NO: 8353931 - DNA, 22 bp, Homo sapiens
aggacaggattgagctgaactg

SEQ ID NO: 8353932 - DNA, 22 bp, Homo sapiens
aggaaataagggacaagacaaa

SEQ ID NO: 8353933 - DNA, 22 bp, Homo sapiens
aggaaagtgaatgttattttgc

SEQ ID NO: 8353934 - DNA, 22 bp, Homo sapiens
aggaaagtggtgggaaatcagg

SEQ ID NO: 8353935 - DNA, 22 bp, Homo sapiens
aggaaaggttcagtgattgaaa

SEQ ID NO: 8353936 - DNA, 22 bp, Homo sapiens
acagggcaggtggctactggtc

SEQ ID NO: 8353937 - DNA, 18 bp, Homo sapiens
caggagcaggagttgaac

SEQ ID NO: 8353938 - DNA, 22 bp, Homo sapiens
caggagccacattccaccttga

SEQ ID NO: 8353939 - DNA, 22 bp, Homo sapiens
caggagcatgctgatgccagaa

SEQ ID NO: 8353940 - DNA, 22 bp, Homo sapiens
caggagcccagagtcctcagct

SEQ ID NO: 8353941 - DNA, 22 bp, Homo sapiens
caggcacacaggctccctgggc

SEQ ID NO: 8353942 - DNA, 22 bp, Homo sapiens
caggatgggatgtagtgggccc

SEQ ID NO: 8353943 - DNA, 22 bp, Homo sapiens
cagctgggtttagtggggtgtg

SEQ ID NO: 8353944 - DNA, 22 bp, Homo sapiens
cagctgggtttagtggggtgtg

SEQ ID NO: 8353945 - DNA, 22 bp, Homo sapiens
cagctggtcaactgaatgaaca

SEQ ID NO: 8353946 - DNA, 22 bp, Homo sapiens
cagctggtgtcaggcactgcag

SEQ ID NO: 8353947 - DNA, 22 bp, Homo sapiens
caggactggctcgcagtgggtg

SEQ ID NO: 8353948 - DNA, 22 bp, Homo sapiens
caggactggaagtctcaagaga

SEQ ID NO: 8353949 - DNA, 22 bp, Homo sapiens
caggagaaacataattttctgg

SEQ ID NO: 8353950 - DNA, 22 bp, Homo sapiens
caggactcacttctcacatccc

SEQ ID NO: 8353951 - DNA, 22 bp, Homo sapiens
caggacctgaagacaggcaggt

SEQ ID NO: 8353952 - DNA, 22 bp, Homo sapiens
caggcagtgtcccaggaagcca

SEQ ID NO: 8353953 - DNA, 22 bp, Homo sapiens
caggcagtgtgacgctagggtt

SEQ ID NO: 8353954 - DNA, 22 bp, Homo sapiens
caggcagcgctcgtggcctggc

SEQ ID NO: 8353955 - DNA, 22 bp, Homo sapiens
caggcagggagctggaaaggat

SEQ ID NO: 8353956 - DNA, 22 bp, Homo sapiens
caggcccatctgctcccaggct

SEQ ID NO: 8353957 - DNA, 22 bp, Homo sapiens
caggcccatctgctcccaggct

SEQ ID NO: 8353958 - DNA, 22 bp, Homo sapiens
agctgtctttctgcctcctgat

SEQ ID NO: 8353959 - DNA, 22 bp, Homo sapiens
agctgtctgtctcctgaggaga

SEQ ID NO: 8353960 - DNA, 22 bp, Homo sapiens
caggcccagtgatcagggctct

SEQ ID NO: 8353961 - DNA, 22 bp, Homo sapiens
caggcccagtgatcagggctct

SEQ ID NO: 8353962 - DNA, 22 bp, Homo sapiens
caggcccatctgctcccaggct

SEQ ID NO: 8353963 - DNA, 22 bp, Homo sapiens
caggcccagtgatcagggctct

SEQ ID NO: 8353964 - DNA, 21 bp, Homo sapiens
caggctctgctagaggagcct

SEQ ID NO: 8353965 - DNA, 22 bp, Homo sapiens
aggaagagctggaccagaggac

SEQ ID NO: 8353966 - DNA, 22 bp, Homo sapiens
aggaagagcccgggtgacataa

SEQ ID NO: 8353967 - DNA, 23 bp, Homo sapiens
aggaagaggcaatttctcttaga

SEQ ID NO: 8353968 - DNA, 22 bp, Homo sapiens
cagggctggctgtggcaatctc

SEQ ID NO: 8353969 - DNA, 22 bp, Homo sapiens
cagggctgggttaaaagcaggg

SEQ ID NO: 8353970 - DNA, 22 bp, Homo sapiens
cagggctggctgtggcaatctc

SEQ ID NO: 8353971 - DNA, 22 bp, Homo sapiens
cagggcaggatgctgtgattat

SEQ ID NO: 8353972 - DNA, 22 bp, Homo sapiens
cagggcagggatgttgcggcag

SEQ ID NO: 8353973 - DNA, 22 bp, Homo sapiens
cagggcagtaacgggaacatct

SEQ ID NO: 8353974 - DNA, 22 bp, Homo sapiens
cagtatcttgcttatagacaca

SEQ ID NO: 8353975 - DNA, 22 bp, Homo sapiens
cagtatgagagttgaatcaagg

SEQ ID NO: 8353976 - DNA, 22 bp, Homo sapiens
cagtatgactacaaacagcttt

SEQ ID NO: 8353977 - DNA, 22 bp, Homo sapiens
cagtatgagagttgaatcaagg

SEQ ID NO: 8353978 - DNA, 22 bp, Homo sapiens
cagtatttggaatatagctaag

SEQ ID NO: 8353979 - DNA, 22 bp, Homo sapiens
cagtaaattatctcatctctgt

SEQ ID NO: 8353980 - DNA, 22 bp, Homo sapiens
cagtaaatctctatctgccatt

SEQ ID NO: 8353981 - DNA, 22 bp, Homo sapiens
cagtaaagcatgtatgtcttca

SEQ ID NO: 8353982 - DNA, 22 bp, Homo sapiens
aggacagatttttggccaccag

SEQ ID NO: 8353983 - DNA, 21 bp, Homo sapiens
aggacagatgtaggaataaag

SEQ ID NO: 8353984 - DNA, 18 bp, Homo sapiens
aggacacattcttccctc

SEQ ID NO: 8353985 - DNA, 22 bp, Homo sapiens
aggacagaatctatattcagtt

SEQ ID NO: 8353986 - DNA, 22 bp, Homo sapiens
aggacagacctaggactggagc

SEQ ID NO: 8353987 - DNA, 22 bp, Homo sapiens
aggacagagccctagtttcata

SEQ ID NO: 8353988 - DNA, 22 bp, Homo sapiens
aggacagagcctgtgcagaccg

SEQ ID NO: 8353989 - DNA, 22 bp, Homo sapiens
aggaagtgtcagggataacgat

SEQ ID NO: 8353990 - DNA, 22 bp, Homo sapiens
aggaatatggatttgctcagct

SEQ ID NO: 8353991 - DNA, 22 bp, Homo sapiens
aggaatcccgcaccagctgctg

SEQ ID NO: 8353992 - DNA, 22 bp, Homo sapiens
aggaatctgtggttttaacagg

SEQ ID NO: 8353993 - DNA, 22 bp, Homo sapiens
caggtgggattttgctgcttga

SEQ ID NO: 8353994 - DNA, 22 bp, Homo sapiens
caggtggtgcctccaggctggt

SEQ ID NO: 8353995 - DNA, 21 bp, Homo sapiens
aggaagtggccagattgggaa

SEQ ID NO: 8353996 - DNA, 22 bp, Homo sapiens
caggtgtcagcagcactgtact

SEQ ID NO: 8353997 - DNA, 20 bp, Homo sapiens
caggtgtacagtgagctgag

SEQ ID NO: 8353998 - DNA, 22 bp, Homo sapiens
aggcaagaacagacatgggagt

SEQ ID NO: 8353999 - DNA, 22 bp, Homo sapiens
aggcaagagtgactacgtgaaa

SEQ ID NO: 8354000 - DNA, 23 bp, Homo sapiens
aggcaagaacgggttgttcaccc

SEQ ID NO: 8354001 - DNA, 22 bp, Homo sapiens
aggcaagcgcagaagcggagga

SEQ ID NO: 8354002 - DNA, 22 bp, Homo sapiens
aggcaagcccccagtgaggctc

SEQ ID NO: 8354003 - DNA, 22 bp, Homo sapiens
aggcaagattaggaccagaaga

SEQ ID NO: 8354004 - DNA, 22 bp, Homo sapiens
aggcaagcattgggaacagggc

SEQ ID NO: 8354005 - DNA, 22 bp, Homo sapiens
cattgcactttgggtccaggac

SEQ ID NO: 8354006 - DNA, 22 bp, Homo sapiens
cattgcactctagcctgggtga

SEQ ID NO: 8354007 - DNA, 22 bp, Homo sapiens
cattgcactctagtctgggtga

SEQ ID NO: 8354008 - DNA, 22 bp, Homo sapiens
cattgcactctggctggaacgg

SEQ ID NO: 8354009 - DNA, 22 bp, Homo sapiens
cattgcactgcagcccgggcaa

SEQ ID NO: 8354010 - DNA, 22 bp, Homo sapiens
cattctaaagtgttttatacct

SEQ ID NO: 8354011 - DNA, 22 bp, Homo sapiens
cattccttaacgtggggagtct

SEQ ID NO: 8354012 - DNA, 22 bp, Homo sapiens
cattgctcaggcccagcaggaa

SEQ ID NO: 8354013 - DNA, 22 bp, Homo sapiens
cattgcccagtaggatcaccag

SEQ ID NO: 8354014 - DNA, 22 bp, Homo sapiens
cattgcacttctgcttttcctc

SEQ ID NO: 8354015 - DNA, 22 bp, Homo sapiens
aggcaataggttcctcatcttt

SEQ ID NO: 8354016 - DNA, 22 bp, Homo sapiens
catttcaatactatctgagaat

SEQ ID NO: 8354017 - DNA, 22 bp, Homo sapiens
catttcaatgccttcaacatag

SEQ ID NO: 8354018 - DNA, 22 bp, Homo sapiens
catttcaaacagttacagctgc

SEQ ID NO: 8354019 - DNA, 22 bp, Homo sapiens
catttcaaaagaattgccagaa

SEQ ID NO: 8354020 - DNA, 22 bp, Homo sapiens
catttcaagtaacagattgctt

SEQ ID NO: 8354021 - DNA, 20 bp, Homo sapiens
cattggagtggagaggaaat

SEQ ID NO: 8354022 - DNA, 22 bp, Homo sapiens
cattggaagacatatcatgcta

SEQ ID NO: 8354023 - DNA, 22 bp, Homo sapiens
aggcactgtgggtgtggccgga

SEQ ID NO: 8354024 - DNA, 22 bp, Homo sapiens
aggcactgttcccagttatcct

SEQ ID NO: 8354025 - DNA, 20 bp, Homo sapiens
aggcactgttgtctgtatcc

SEQ ID NO: 8354026 - DNA, 21 bp, Homo sapiens
aggcactgtttgtggtttggg

SEQ ID NO: 8354027 - DNA, 22 bp, Homo sapiens
ccactcagcacagtggatgcag

SEQ ID NO: 8354028 - DNA, 22 bp, Homo sapiens
ccacagtttcttcatctataaa

SEQ ID NO: 8354029 - DNA, 22 bp, Homo sapiens
ccacagttattcatttgtgaca

SEQ ID NO: 8354030 - DNA, 21 bp, Homo sapiens
ccaccaggtcttctgctcggg

SEQ ID NO: 8354031 - DNA, 21 bp, Homo sapiens
ccaccaggtcttctgctcggg

SEQ ID NO: 8354032 - DNA, 23 bp, Homo sapiens
ccacagagctgccaattcctgtg

SEQ ID NO: 8354033 - DNA, 22 bp, Homo sapiens
catttgaaaatactcttttcca

SEQ ID NO: 8354034 - DNA, 22 bp, Homo sapiens
catttgaaacctggaatctacc

SEQ ID NO: 8354035 - DNA, 22 bp, Homo sapiens
cagtccagccagtagggtgtgg

SEQ ID NO: 8354036 - DNA, 22 bp, Homo sapiens
cagtccagagcccaccagagga

SEQ ID NO: 8354037 - DNA, 22 bp, Homo sapiens
cagtgtggagggagagagcctg

SEQ ID NO: 8354038 - DNA, 22 bp, Homo sapiens
cagtgtgggtttgggaggagta

SEQ ID NO: 8354039 - DNA, 22 bp, Homo sapiens
cagtccagtccaatcctcaatg

SEQ ID NO: 8354040 - DNA, 20 bp, Homo sapiens
cagtccaggctgcagcatct

SEQ ID NO: 8354041 - DNA, 22 bp, Homo sapiens
aggagccagcgttcctcaggat

SEQ ID NO: 8354042 - DNA, 22 bp, Homo sapiens
aggagccagcgttcctcaggat

SEQ ID NO: 8354043 - DNA, 22 bp, Homo sapiens
cagtgtgggtttgggaggagta

SEQ ID NO: 8354044 - DNA, 22 bp, Homo sapiens
cagtgttccaggcggcagtgaa

SEQ ID NO: 8354045 - DNA, 21 bp, Homo sapiens
cagtgttgatatttaatacat

SEQ ID NO: 8354046 - DNA, 22 bp, Homo sapiens
cataacatctgtgaagcaggaa

SEQ ID NO: 8354047 - DNA, 22 bp, Homo sapiens
cataatatctccgattacttgc

SEQ ID NO: 8354048 - DNA, 22 bp, Homo sapiens
cataagaatatttagtggcagc

SEQ ID NO: 8354049 - DNA, 22 bp, Homo sapiens
cataagaatcttccagggcatg

SEQ ID NO: 8354050 - DNA, 22 bp, Homo sapiens
cataagttgggtaatataatga

SEQ ID NO: 8354051 - DNA, 22 bp, Homo sapiens
cataagaaatttaacagaactt

SEQ ID NO: 8354052 - DNA, 22 bp, Homo sapiens
aggagctgtgaatgggaggggt

SEQ ID NO: 8354053 - DNA, 22 bp, Homo sapiens
aggagctgtgaatgggaggggt

SEQ ID NO: 8354054 - DNA, 22 bp, Homo sapiens
aggaggccgctgatgggctccc

SEQ ID NO: 8354055 - DNA, 22 bp, Homo sapiens
aggagctgtcagagtgccagag

SEQ ID NO: 8354056 - DNA, 22 bp, Homo sapiens
aggagctgtcagagtgccagag

SEQ ID NO: 8354057 - DNA, 16 bp, Homo sapiens
aggagctgggtaggag

SEQ ID NO: 8354058 - DNA, 22 bp, Homo sapiens
aggaggctctcaggtcctcccc

SEQ ID NO: 8354059 - DNA, 22 bp, Homo sapiens
aggaggctctcaggtcctcccc

SEQ ID NO: 8354060 - DNA, 23 bp, Homo sapiens
aggaggcctgaaactgaggctga

SEQ ID NO: 8354061 - DNA, 22 bp, Homo sapiens
catacaagcgtgcatgtgcttg

SEQ ID NO: 8354062 - DNA, 22 bp, Homo sapiens
catacagttttccctagatgtg

SEQ ID NO: 8354063 - DNA, 22 bp, Homo sapiens
catacagtcactgtggtaccac

SEQ ID NO: 8354064 - DNA, 22 bp, Homo sapiens
catctctgagacctcagctggg

SEQ ID NO: 8354065 - DNA, 22 bp, Homo sapiens
catctctgtgtccccagagctt

SEQ ID NO: 8354066 - DNA, 22 bp, Homo sapiens
catctctgtgtccccacaccca

SEQ ID NO: 8354067 - DNA, 22 bp, Homo sapiens
aggatggcttgcaggaggctgt

SEQ ID NO: 8354068 - DNA, 22 bp, Homo sapiens
aggatggggtctgcagcctggt

SEQ ID NO: 8354069 - DNA, 22 bp, Homo sapiens
catcttcaggttcatggtcata

SEQ ID NO: 8354070 - DNA, 22 bp, Homo sapiens
catcttgctgacttgcattatt

SEQ ID NO: 8354071 - DNA, 22 bp, Homo sapiens
catcttgctgttatgtttatgt

SEQ ID NO: 8354072 - DNA, 22 bp, Homo sapiens
catgagctgctgggagcctgtc

SEQ ID NO: 8354073 - DNA, 22 bp, Homo sapiens
cctacagttatattcttgattg

SEQ ID NO: 8354074 - DNA, 22 bp, Homo sapiens
agggctgagaatgacagggccg

SEQ ID NO: 8354075 - DNA, 22 bp, Homo sapiens
cctcaggggtgcccacagctgc

SEQ ID NO: 8354076 - DNA, 22 bp, Homo sapiens
cctcagggtctctcacagcacc

SEQ ID NO: 8354077 - DNA, 22 bp, Homo sapiens
cctcagggtctctcacagcacc

SEQ ID NO: 8354078 - DNA, 18 bp, Homo sapiens
cctcagggagatccagtg

SEQ ID NO: 8354079 - DNA, 18 bp, Homo sapiens
cctcaggggacctggcag

SEQ ID NO: 8354080 - DNA, 22 bp, Homo sapiens
agggcctgtccgctcccgcccg

SEQ ID NO: 8354081 - DNA, 22 bp, Homo sapiens
agggcctgtccgctcccgcccg

SEQ ID NO: 8354082 - DNA, 21 bp, Homo sapiens
agggcctgtgctctccaggtc

SEQ ID NO: 8354083 - DNA, 22 bp, Homo sapiens
ccctggcatgcatgtccctggc

SEQ ID NO: 8354084 - DNA, 22 bp, Homo sapiens
ccctggcagaatgtctctgggc

SEQ ID NO: 8354085 - DNA, 22 bp, Homo sapiens
agggcccatgtgggagcacttg

SEQ ID NO: 8354086 - DNA, 22 bp, Homo sapiens
agggcccagtggagagctgagc

SEQ ID NO: 8354087 - DNA, 22 bp, Homo sapiens
cctcctggtgggcgcttctggc

SEQ ID NO: 8354088 - DNA, 22 bp, Homo sapiens
cctcctgtctccttcctatatt

SEQ ID NO: 8354089 - DNA, 22 bp, Homo sapiens
cctccttcctgggacagagctg

SEQ ID NO: 8354090 - DNA, 22 bp, Homo sapiens
aggggctgactggaaagtgcca

SEQ ID NO: 8354091 - DNA, 22 bp, Homo sapiens
cctctgtgggccgggcctgctg

SEQ ID NO: 8354092 - DNA, 22 bp, Homo sapiens
aggggctctgagtgggccagga

SEQ ID NO: 8354093 - DNA, 22 bp, Homo sapiens
aggggctgactggaaagtgcca

SEQ ID NO: 8354094 - DNA, 22 bp, Homo sapiens
aggggctctgagtgggccagga

SEQ ID NO: 8354095 - DNA, 22 bp, Homo sapiens
aggggctcctttgtgctgcgtc

SEQ ID NO: 8354096 - DNA, 22 bp, Homo sapiens
aggggctcctggcctggagagc

SEQ ID NO: 8354097 - DNA, 22 bp, Homo sapiens
aggggctcctctctgagagtag

SEQ ID NO: 8354098 - DNA, 18 bp, Homo sapiens
aggggcagcttgtgtgga

SEQ ID NO: 8354099 - DNA, 22 bp, Homo sapiens
aggggcggcctgcctgaagcag

SEQ ID NO: 8354100 - DNA, 22 bp, Homo sapiens
aggggcctggttggcctctgtt

SEQ ID NO: 8354101 - DNA, 22 bp, Homo sapiens
aggggcgctgcggtcctcagcc

SEQ ID NO: 8354102 - DNA, 22 bp, Homo sapiens
aggggcgagtctgtccagccgg

SEQ ID NO: 8354103 - DNA, 22 bp, Homo sapiens
aggggcgaggggagccgtgcca

SEQ ID NO: 8354104 - DNA, 22 bp, Homo sapiens
aggggctcagttactttggcag

SEQ ID NO: 8354105 - DNA, 22 bp, Homo sapiens
aggggctcaagcagtgtggtct

SEQ ID NO: 8354106 - DNA, 22 bp, Homo sapiens
aggggctcaaagtgtgcaggga

SEQ ID NO: 8354107 - DNA, 22 bp, Homo sapiens
aggggctagaggtgccccagag

SEQ ID NO: 8354108 - DNA, 22 bp, Homo sapiens
aggggctcaaagtgtgcaggga

SEQ ID NO: 8354109 - DNA, 22 bp, Homo sapiens
aggggctcaaagtgtgcaggga

SEQ ID NO: 8354110 - DNA, 22 bp, Homo sapiens
agggggagacatgtgtgtgttt

SEQ ID NO: 8354111 - DNA, 22 bp, Homo sapiens
cctctgtgtgtgcatgcatgcg

SEQ ID NO: 8354112 - DNA, 22 bp, Homo sapiens
cctctgtggtctgtctaatgca

SEQ ID NO: 8354113 - DNA, 22 bp, Homo sapiens
aggggtctatcctgagatggtc

SEQ ID NO: 8354114 - DNA, 20 bp, Homo sapiens
aggggtctagcagcagtgct

SEQ ID NO: 8354115 - DNA, 22 bp, Homo sapiens
aggggtagagattgctggtgta

SEQ ID NO: 8354116 - DNA, 22 bp, Homo sapiens
aggggtagagattgctggtgta

SEQ ID NO: 8354117 - DNA, 22 bp, Homo sapiens
aggggtcttgaggactccagca

SEQ ID NO: 8354118 - DNA, 22 bp, Homo sapiens
aggggtgaaagagggccctcaa

SEQ ID NO: 8354119 - DNA, 22 bp, Homo sapiens
aggggtcttgggagtcctggct

SEQ ID NO: 8354120 - DNA, 22 bp, Homo sapiens
agggggtgctacttccagagtt

SEQ ID NO: 8354121 - DNA, 22 bp, Homo sapiens
agggggtgtctctgattgggtt

SEQ ID NO: 8354122 - DNA, 22 bp, Homo sapiens
aggggtagagattgctggtgta

SEQ ID NO: 8354123 - DNA, 22 bp, Homo sapiens
agggggtgcatttgtgaatgaa

SEQ ID NO: 8354124 - DNA, 22 bp, Homo sapiens
agggggtgatcaaggtgcggcg

SEQ ID NO: 8354125 - DNA, 22 bp, Homo sapiens
agggggtgatcaaggtgcggcg

SEQ ID NO: 8354126 - DNA, 22 bp, Homo sapiens
agggggtgcccagatgaaggat

SEQ ID NO: 8354127 - DNA, 23 bp, Homo sapiens
agggccaggtgcggaaacagctc

SEQ ID NO: 8354128 - DNA, 22 bp, Homo sapiens
agggcccaccttggtgctgagg

SEQ ID NO: 8354129 - DNA, 22 bp, Homo sapiens
ccctgaggcaaaggctagagtt

SEQ ID NO: 8354130 - DNA, 22 bp, Homo sapiens
ccccttcagagtagccacatta

SEQ ID NO: 8354131 - DNA, 22 bp, Homo sapiens
cccctggggatcagctggaatt

SEQ ID NO: 8354132 - DNA, 21 bp, Homo sapiens
cccctgggagccctgtcagta

SEQ ID NO: 8354133 - DNA, 22 bp, Homo sapiens
cccctgggtccaggcttctctg

SEQ ID NO: 8354134 - DNA, 22 bp, Homo sapiens
cccctgggtccaggcttctctg

SEQ ID NO: 8354135 - DNA, 22 bp, Homo sapiens
agggccacctctctgggttccc

SEQ ID NO: 8354136 - DNA, 22 bp, Homo sapiens
agggccaccagagcagggcagt

SEQ ID NO: 8354137 - DNA, 22 bp, Homo sapiens
agggccactggctgacggctgc

SEQ ID NO: 8354138 - DNA, 22 bp, Homo sapiens
ccctgaggatagggcaggaccc

SEQ ID NO: 8354139 - DNA, 22 bp, Homo sapiens
cccctgccagctatccctgaac

SEQ ID NO: 8354140 - DNA, 22 bp, Homo sapiens
cccctgagattctggcttggga

SEQ ID NO: 8354141 - DNA, 22 bp, Homo sapiens
cccctgccatagtcaaatctaa

SEQ ID NO: 8354142 - DNA, 22 bp, Homo sapiens
cccctgccagctatccctgaac

SEQ ID NO: 8354143 - DNA, 22 bp, Homo sapiens
cccctgccatagtcaaatctaa

SEQ ID NO: 8354144 - DNA, 22 bp, Homo sapiens
agggcagaaatattgatactgt

SEQ ID NO: 8354145 - DNA, 22 bp, Homo sapiens
agggcagaaatcgattacacct

SEQ ID NO: 8354146 - DNA, 22 bp, Homo sapiens
agggcagaagtacagacactta

SEQ ID NO: 8354147 - DNA, 22 bp, Homo sapiens
agggcagactaggatggaagtg

SEQ ID NO: 8354148 - DNA, 22 bp, Homo sapiens
agggcagactaggatggaagtg

SEQ ID NO: 8354149 - DNA, 22 bp, Homo sapiens
agggcagaccacgtgcaaggat

SEQ ID NO: 8354150 - DNA, 22 bp, Homo sapiens
agggagctttaccccagatcac

SEQ ID NO: 8354151 - DNA, 22 bp, Homo sapiens
agggcagaaaccaccttgatgg

SEQ ID NO: 8354152 - DNA, 22 bp, Homo sapiens
cccaggtgtttgtggcagaggt

SEQ ID NO: 8354153 - DNA, 22 bp, Homo sapiens
cccagagtggacggtggcccct

SEQ ID NO: 8354154 - DNA, 22 bp, Homo sapiens
cccagagttcaaaccctgcgtc

SEQ ID NO: 8354155 - DNA, 22 bp, Homo sapiens
cccaggccctggcagagcttgt

SEQ ID NO: 8354156 - DNA, 22 bp, Homo sapiens
cccaggcctggtctgggccagt

SEQ ID NO: 8354157 - DNA, 17 bp, Homo sapiens
cccaggccgccgggagc

SEQ ID NO: 8354158 - DNA, 21 bp, Homo sapiens
agggagctggccacacagcct

SEQ ID NO: 8354159 - DNA, 22 bp, Homo sapiens
agggagctgctctgcttccgtg

SEQ ID NO: 8354160 - DNA, 22 bp, Homo sapiens
agggagctgggccacactgatc

SEQ ID NO: 8354161 - DNA, 22 bp, Homo sapiens
agggagctgggccacactgatc

SEQ ID NO: 8354162 - DNA, 22 bp, Homo sapiens
agggagcttctggcctcagcct

SEQ ID NO: 8354163 - DNA, 22 bp, Homo sapiens
agggagctgtggtcagctcagt

SEQ ID NO: 8354164 - DNA, 22 bp, Homo sapiens
agggacctgctcactgcctggc

SEQ ID NO: 8354165 - DNA, 22 bp, Homo sapiens
cccaggccccagggcttgtcag

SEQ ID NO: 8354166 - DNA, 22 bp, Homo sapiens
cccaggccagaacttggttgct

SEQ ID NO: 8354167 - DNA, 22 bp, Homo sapiens
ccagaggttactttgccttgga

SEQ ID NO: 8354168 - DNA, 22 bp, Homo sapiens
ccagagtcattttgagtcataa

SEQ ID NO: 8354169 - DNA, 19 bp, Homo sapiens
ccagagtcatgtctccccc

SEQ ID NO: 8354170 - DNA, 19 bp, Homo sapiens
ccagagtcatgtctccccc

SEQ ID NO: 8354171 - DNA, 22 bp, Homo sapiens
ccagaggctggcaagggctcct

SEQ ID NO: 8354172 - DNA, 18 bp, Homo sapiens
ccagaggcccgggcaggc

SEQ ID NO: 8354173 - DNA, 22 bp, Homo sapiens
aggcaggtcccctggaaggcac

SEQ ID NO: 8354174 - DNA, 19 bp, Homo sapiens
aggcaggtgcagaggtccc

SEQ ID NO: 8354175 - DNA, 22 bp, Homo sapiens
ccagaggatgctggtcagcctc

SEQ ID NO: 8354176 - DNA, 22 bp, Homo sapiens
ccagccagctgcccttggggcc

SEQ ID NO: 8354177 - DNA, 22 bp, Homo sapiens
ccagccaggcattgcaaactga

SEQ ID NO: 8354178 - DNA, 22 bp, Homo sapiens
ccagccagccttgatctgagta

SEQ ID NO: 8354179 - DNA, 22 bp, Homo sapiens
ccagccagctggttggacgcct

SEQ ID NO: 8354180 - DNA, 22 bp, Homo sapiens
ccagccagtatattccaaagcc

SEQ ID NO: 8354181 - DNA, 22 bp, Homo sapiens
ccagagtctatgagtcctcatt

SEQ ID NO: 8354182 - DNA, 22 bp, Homo sapiens
ccagcaggcagtcatatccttt

SEQ ID NO: 8354183 - DNA, 22 bp, Homo sapiens
ccagccagatgataagctctat

SEQ ID NO: 8354184 - DNA, 22 bp, Homo sapiens
ccagccagatgataagctctat

SEQ ID NO: 8354185 - DNA, 22 bp, Homo sapiens
aggccctgcccagagctcctcg

SEQ ID NO: 8354186 - DNA, 23 bp, Homo sapiens
aggccctgcctgtccctcttttt

SEQ ID NO: 8354187 - DNA, 22 bp, Homo sapiens
aggccctgcccagtgccacaag

SEQ ID NO: 8354188 - DNA, 22 bp, Homo sapiens
aggccctgcggaaatgatcatt

SEQ ID NO: 8354189 - DNA, 22 bp, Homo sapiens
aggccctgagaaaatccctgca

SEQ ID NO: 8354190 - DNA, 22 bp, Homo sapiens
aggccctgacctgggagatcta

SEQ ID NO: 8354191 - DNA, 22 bp, Homo sapiens
ccagccctcctccatcagagga

SEQ ID NO: 8354192 - DNA, 22 bp, Homo sapiens
ccagccaggctggctgtggagg

SEQ ID NO: 8354193 - DNA, 22 bp, Homo sapiens
aggccctgctgaggcctccctc

SEQ ID NO: 8354194 - DNA, 22 bp, Homo sapiens
aggccctgctttccagagctca

SEQ ID NO: 8354195 - DNA, 22 bp, Homo sapiens
aggccctgctttccagagctca

SEQ ID NO: 8354196 - DNA, 22 bp, Homo sapiens
aggccctggacactcaagccgg

SEQ ID NO: 8354197 - DNA, 22 bp, Homo sapiens
aggccctggacactcaagccgg

SEQ ID NO: 8354198 - DNA, 22 bp, Homo sapiens
ccagctccaggtagatgggcag

SEQ ID NO: 8354199 - DNA, 22 bp, Homo sapiens
ccagctccaggtagatgggcag

SEQ ID NO: 8354200 - DNA, 23 bp, Homo sapiens
ccagctcccaggtctgaggactg

SEQ ID NO: 8354201 - DNA, 22 bp, Homo sapiens
ccagctccattgcttagtgtaa

SEQ ID NO: 8354202 - DNA, 21 bp, Homo sapiens
aggccctggaggtcagagaaa

SEQ ID NO: 8354203 - DNA, 21 bp, Homo sapiens
aggccctggaggtcagagaaa

SEQ ID NO: 8354204 - DNA, 22 bp, Homo sapiens
aggccctggcactgcctgggag

SEQ ID NO: 8354205 - DNA, 22 bp, Homo sapiens
ccagctccaggtagatgggcag

SEQ ID NO: 8354206 - DNA, 22 bp, Homo sapiens
ccagctcccctcagcaggtaat

SEQ ID NO: 8354207 - DNA, 22 bp, Homo sapiens
ccagctcccgcaggctgcacag

SEQ ID NO: 8354208 - DNA, 23 bp, Homo sapiens
ccagctcccaggtctgaggactg

SEQ ID NO: 8354209 - DNA, 22 bp, Homo sapiens
ccagctcccattcttcacctgt

SEQ ID NO: 8354210 - DNA, 22 bp, Homo sapiens
ccagctccctgaagcctggtct

SEQ ID NO: 8354211 - DNA, 22 bp, Homo sapiens
ccagctcccgcaggctgcacag

SEQ ID NO: 8354212 - DNA, 22 bp, Homo sapiens
ccagctccgggagttgctgctg

SEQ ID NO: 8354213 - DNA, 22 bp, Homo sapiens
ccagctccctgaagcctggtct

SEQ ID NO: 8354214 - DNA, 22 bp, Homo sapiens
ccaggaggtggcaggacttgcc

SEQ ID NO: 8354215 - DNA, 22 bp, Homo sapiens
ccaggaggtggaggttgcggtg

SEQ ID NO: 8354216 - DNA, 22 bp, Homo sapiens
ccagctccggtgtgcttatttc

SEQ ID NO: 8354217 - DNA, 22 bp, Homo sapiens
aggcctgggtgttcaccagaag

SEQ ID NO: 8354218 - DNA, 22 bp, Homo sapiens
aggctcagagagctgtgtccat

SEQ ID NO: 8354219 - DNA, 21 bp, Homo sapiens
aggctcagagagaaactcttg

SEQ ID NO: 8354220 - DNA, 21 bp, Homo sapiens
aggctcagagatcaaacagta

SEQ ID NO: 8354221 - DNA, 22 bp, Homo sapiens
aggctcagagagctgtgtccat

SEQ ID NO: 8354222 - DNA, 22 bp, Homo sapiens
aggctcagagatgagtaagcac

SEQ ID NO: 8354223 - DNA, 22 bp, Homo sapiens
aggctcagagatgagtaagcac

SEQ ID NO: 8354224 - DNA, 20 bp, Homo sapiens
aggctcagagcagtagtaca

SEQ ID NO: 8354225 - DNA, 20 bp, Homo sapiens
aggctcagagcagtagtaca

SEQ ID NO: 8354226 - DNA, 16 bp, Homo sapiens
aggctcagaggctgga

SEQ ID NO: 8354227 - DNA, 22 bp, Homo sapiens
aggctcagaggtgagcatctgc

SEQ ID NO: 8354228 - DNA, 20 bp, Homo sapiens
ccaggcactgtcccatgcag

SEQ ID NO: 8354229 - DNA, 22 bp, Homo sapiens
ccaggcacggtggctcatgcct

SEQ ID NO: 8354230 - DNA, 22 bp, Homo sapiens
ccaggttcaaatagctgtgtga

SEQ ID NO: 8354231 - DNA, 20 bp, Homo sapiens
ccaggtggtgcctggagagg

SEQ ID NO: 8354232 - DNA, 22 bp, Homo sapiens
ccaggtgtttggcctgcatgat

SEQ ID NO: 8354233 - DNA, 22 bp, Homo sapiens
ccaggtggtgaaagtgggccct

SEQ ID NO: 8354234 - DNA, 22 bp, Homo sapiens
aggctctgtatgaaggtttggg

SEQ ID NO: 8354235 - DNA, 19 bp, Homo sapiens
aggctctgtaggagagggc

SEQ ID NO: 8354236 - DNA, 19 bp, Homo sapiens
aggctctgtaggagagggc

SEQ ID NO: 8354237 - DNA, 19 bp, Homo sapiens
aggctctgtaggagagggc

SEQ ID NO: 8354238 - DNA, 22 bp, Homo sapiens
aggctctgtcaggcggagcagc

SEQ ID NO: 8354239 - DNA, 22 bp, Homo sapiens
aggctctgtcaggcggagcagc

SEQ ID NO: 8354240 - DNA, 22 bp, Homo sapiens
ccagggcacttaggcccagccc

SEQ ID NO: 8354241 - DNA, 22 bp, Homo sapiens
ccagggcagcgcccctccacgc

SEQ ID NO: 8354242 - DNA, 22 bp, Homo sapiens
ccagggcagccaacccagatgc

SEQ ID NO: 8354243 - DNA, 22 bp, Homo sapiens
ccagggcagaaaaagagggaat

SEQ ID NO: 8354244 - DNA, 22 bp, Homo sapiens
aggctcagcccctgggaggaga

SEQ ID NO: 8354245 - DNA, 22 bp, Homo sapiens
aggctcagcccctgggaggaga

SEQ ID NO: 8354246 - DNA, 22 bp, Homo sapiens
aggctcagcccaaggtggagag

SEQ ID NO: 8354247 - DNA, 22 bp, Homo sapiens
aggctcagcccaaggtggagag

SEQ ID NO: 8354248 - DNA, 21 bp, Homo sapiens
aggctcagcaggtgtataaag

SEQ ID NO: 8354249 - DNA, 22 bp, Homo sapiens
aggctcagcatctgattcatat

SEQ ID NO: 8354250 - DNA, 22 bp, Homo sapiens
aggctctggttggcaagtaaag

SEQ ID NO: 8354251 - DNA, 22 bp, Homo sapiens
aggctctggttggcaagtaaag

SEQ ID NO: 8354252 - DNA, 22 bp, Homo sapiens
aggctctggtgcagctgtaact

SEQ ID NO: 8354253 - DNA, 22 bp, Homo sapiens
aggctctgggaacagacgggtg

SEQ ID NO: 8354254 - DNA, 22 bp, Homo sapiens
aggctctgggaagcagtgagtt

SEQ ID NO: 8354255 - DNA, 22 bp, Homo sapiens
aggctctgggaacagacgggtg

SEQ ID NO: 8354256 - DNA, 22 bp, Homo sapiens
aggctctgggaacagacgggtg

SEQ ID NO: 8354257 - DNA, 20 bp, Homo sapiens
ccaggcctgggcctgctcta

SEQ ID NO: 8354258 - DNA, 20 bp, Homo sapiens
ccaggcctgggcctgctcta

SEQ ID NO: 8354259 - DNA, 22 bp, Homo sapiens
aggctcagattcacatttggtt

SEQ ID NO: 8354260 - DNA, 22 bp, Homo sapiens
aggctcagatccttgtgtcctg

SEQ ID NO: 8354261 - DNA, 22 bp, Homo sapiens
aggctcagatccttgtgtcctg

SEQ ID NO: 8354262 - DNA, 20 bp, Homo sapiens
aggctcagatacccagggaa

SEQ ID NO: 8354263 - DNA, 22 bp, Homo sapiens
ccaggccttctgaggacactct

SEQ ID NO: 8354264 - DNA, 22 bp, Homo sapiens
ccaggcctttcttcttggtctg

SEQ ID NO: 8354265 - DNA, 22 bp, Homo sapiens
cccactcctggagctagggctc

SEQ ID NO: 8354266 - DNA, 22 bp, Homo sapiens
cccactcctggagctagggctc

SEQ ID NO: 8354267 - DNA, 22 bp, Homo sapiens
cccactccctacgacacgctcc

SEQ ID NO: 8354268 - DNA, 22 bp, Homo sapiens
cccactccctgcacgcctgccg

SEQ ID NO: 8354269 - DNA, 18 bp, Homo sapiens
cccacggtgctgtagggc

SEQ ID NO: 8354270 - DNA, 22 bp, Homo sapiens
cccacgtcgaacttgctccaga

SEQ ID NO: 8354271 - DNA, 22 bp, Homo sapiens
aggctgtgggagttgagagtct

SEQ ID NO: 8354272 - DNA, 22 bp, Homo sapiens
aggctgtgcattttggagggcc

SEQ ID NO: 8354273 - DNA, 22 bp, Homo sapiens
aggctgtggtgctgaaggaggg

SEQ ID NO: 8354274 - DNA, 22 bp, Homo sapiens
cccaatttcttcctcatttgcc

SEQ ID NO: 8354275 - DNA, 22 bp, Homo sapiens
cccacacactggctgctgccaa

SEQ ID NO: 8354276 - DNA, 18 bp, Homo sapiens
cccacacagcagtagctc

SEQ ID NO: 8354277 - DNA, 22 bp, Homo sapiens
cccacacactggctgctgccaa

SEQ ID NO: 8354278 - DNA, 22 bp, Homo sapiens
aggctgccagaagccttcagga

SEQ ID NO: 8354279 - DNA, 22 bp, Homo sapiens
ccagtgggtaggccatggtgag

SEQ ID NO: 8354280 - DNA, 22 bp, Homo sapiens
ccagtgggagggagctaggcca

SEQ ID NO: 8354281 - DNA, 22 bp, Homo sapiens
aggctgccatagggaactgcat

SEQ ID NO: 8354282 - DNA, 19 bp, Homo sapiens
aggctgcccagtctctgcc

SEQ ID NO: 8354283 - DNA, 22 bp, Homo sapiens
aggctgccctgccgccagtggg

SEQ ID NO: 8354284 - DNA, 23 bp, Homo sapiens
ctgatccaggaggtctgtcgtga

SEQ ID NO: 8354285 - DNA, 22 bp, Homo sapiens
agttatttcagtaacataatag

SEQ ID NO: 8354286 - DNA, 22 bp, Homo sapiens
agttatttcagtaacataatag

SEQ ID NO: 8354287 - DNA, 22 bp, Homo sapiens
agttatcatcccttacactttg

SEQ ID NO: 8354288 - DNA, 22 bp, Homo sapiens
agttattaagtcctgttttgag

SEQ ID NO: 8354289 - DNA, 22 bp, Homo sapiens
agttattaagtcctgttttgag

SEQ ID NO: 8354290 - DNA, 22 bp, Homo sapiens
agttatattccatagattcaga

SEQ ID NO: 8354291 - DNA, 22 bp, Homo sapiens
agttatcaagacagtgtggtac

SEQ ID NO: 8354292 - DNA, 22 bp, Homo sapiens
agttatcaggtgttttcatgga

SEQ ID NO: 8354293 - DNA, 22 bp, Homo sapiens
agttattactctttaacatatt

SEQ ID NO: 8354294 - DNA, 22 bp, Homo sapiens
agttatttactcctttgtctct

SEQ ID NO: 8354295 - DNA, 22 bp, Homo sapiens
agttatttactcctttgtctct

SEQ ID NO: 8354296 - DNA, 22 bp, Homo sapiens
agttatttaaaatgattgtcct

SEQ ID NO: 8354297 - DNA, 22 bp, Homo sapiens
ctgaggagcagctggcccgcta

SEQ ID NO: 8354298 - DNA, 22 bp, Homo sapiens
ctgaggagaggtggcctgtgtt

SEQ ID NO: 8354299 - DNA, 22 bp, Homo sapiens
ctgcagggtttcgccagttgtg

SEQ ID NO: 8354300 - DNA, 20 bp, Homo sapiens
ctgcagggttagaggctcca

SEQ ID NO: 8354301 - DNA, 22 bp, Homo sapiens
ctgcagggtttttcaaggacaa

SEQ ID NO: 8354302 - DNA, 22 bp, Homo sapiens
ctgcatgagctgtcagtggagg

SEQ ID NO: 8354303 - DNA, 22 bp, Homo sapiens
ctgcattcatatcagatagaag

SEQ ID NO: 8354304 - DNA, 20 bp, Homo sapiens
ctgcagggtgagtgggcgat

SEQ ID NO: 8354305 - DNA, 22 bp, Homo sapiens
ctgcagagagtgccgggcagcc

SEQ ID NO: 8354306 - DNA, 23 bp, Homo sapiens
ctgcagagaactgagggacagcc

SEQ ID NO: 8354307 - DNA, 22 bp, Homo sapiens
atacaaatttatagatgcattt

SEQ ID NO: 8354308 - DNA, 22 bp, Homo sapiens
atacaaagtattaatcctggat

SEQ ID NO: 8354309 - DNA, 22 bp, Homo sapiens
ataatttactaagctctacctt

SEQ ID NO: 8354310 - DNA, 22 bp, Homo sapiens
atacaaaggaacacaggcatgt

SEQ ID NO: 8354311 - DNA, 22 bp, Homo sapiens
atacaaagctttctgtctggta

SEQ ID NO: 8354312 - DNA, 23 bp, Homo sapiens
ataagaaaacagtaggctcagag

SEQ ID NO: 8354313 - DNA, 23 bp, Homo sapiens
ataagaaaacagtaggctcagag

SEQ ID NO: 8354314 - DNA, 22 bp, Homo sapiens
ataagacacgccccactcactc

SEQ ID NO: 8354315 - DNA, 22 bp, Homo sapiens
ataagaaacattattctttcca

SEQ ID NO: 8354316 - DNA, 22 bp, Homo sapiens
ataagaaacattattctttcca

SEQ ID NO: 8354317 - DNA, 22 bp, Homo sapiens
ataatttggcttcctagatgta

SEQ ID NO: 8354318 - DNA, 17 bp, Homo sapiens
atacaaagccataaacc

SEQ ID NO: 8354319 - DNA, 22 bp, Homo sapiens
atacaaagctaaatatggtttc

SEQ ID NO: 8354320 - DNA, 21 bp, Homo sapiens
ataagcatgctgattacattt

SEQ ID NO: 8354321 - DNA, 21 bp, Homo sapiens
ataagcatgctgattacattt

SEQ ID NO: 8354322 - DNA, 22 bp, Homo sapiens
ataaatggctttcattcctagg

SEQ ID NO: 8354323 - DNA, 22 bp, Homo sapiens
ataaatgtgaaatgagcagtta

SEQ ID NO: 8354324 - DNA, 22 bp, Homo sapiens
ataaatgcctcagaatcatccc

SEQ ID NO: 8354325 - DNA, 22 bp, Homo sapiens
ctgccctgtttggacagcccgg

SEQ ID NO: 8354326 - DNA, 22 bp, Homo sapiens
ctgccctttatttcacaaagta

SEQ ID NO: 8354327 - DNA, 22 bp, Homo sapiens
ctgccctttgaaagaacgtctt

SEQ ID NO: 8354328 - DNA, 22 bp, Homo sapiens
ataacagtgacctctcagcacc

SEQ ID NO: 8354329 - DNA, 22 bp, Homo sapiens
ataacagatgtgaagtgctaat

SEQ ID NO: 8354330 - DNA, 22 bp, Homo sapiens
ataacattttgacaactggtga

SEQ ID NO: 8354331 - DNA, 22 bp, Homo sapiens
ataacattttgacaactggtga

SEQ ID NO: 8354332 - DNA, 22 bp, Homo sapiens
ataacctgagattgagctgcct

SEQ ID NO: 8354333 - DNA, 22 bp, Homo sapiens
ataacagatactctctgtgagg

SEQ ID NO: 8354334 - DNA, 22 bp, Homo sapiens
ataaatgtgaattagagctttg

SEQ ID NO: 8354335 - DNA, 22 bp, Homo sapiens
atacatacgtacatacgtatgt

SEQ ID NO: 8354336 - DNA, 22 bp, Homo sapiens
atacatagcagagtcaattaat

SEQ ID NO: 8354337 - DNA, 22 bp, Homo sapiens
atacagtgcacaacctgtgcag

SEQ ID NO: 8354338 - DNA, 22 bp, Homo sapiens
atacagtgccccttttcacatg

SEQ ID NO: 8354339 - DNA, 22 bp, Homo sapiens
atacagtggctgtgagctgggc

SEQ ID NO: 8354340 - DNA, 22 bp, Homo sapiens
atacagtggctgtgagctgggc

SEQ ID NO: 8354341 - DNA, 22 bp, Homo sapiens
atacctctgcttgttttttagt

SEQ ID NO: 8354342 - DNA, 22 bp, Homo sapiens
atacgcataatgtttattcctg

SEQ ID NO: 8354343 - DNA, 22 bp, Homo sapiens
ataccctttacaggaacagcaa

SEQ ID NO: 8354344 - DNA, 20 bp, Homo sapiens
ataccagagtacagtttatg

SEQ ID NO: 8354345 - DNA, 22 bp, Homo sapiens
atacattcctactgactagcta

SEQ ID NO: 8354346 - DNA, 21 bp, Homo sapiens
atacattctattaagcattta

SEQ ID NO: 8354347 - DNA, 21 bp, Homo sapiens
atacattctattaagcattta

SEQ ID NO: 8354348 - DNA, 22 bp, Homo sapiens
atacattcagcagtgctcatga

SEQ ID NO: 8354349 - DNA, 22 bp, Homo sapiens
atacattcatcacttttggtcc

SEQ ID NO: 8354350 - DNA, 22 bp, Homo sapiens
atacataggagaataacttcag

SEQ ID NO: 8354351 - DNA, 22 bp, Homo sapiens
atacatagttctgtgaaaagta

SEQ ID NO: 8354352 - DNA, 22 bp, Homo sapiens
atacatagttctgtgaaaagta

SEQ ID NO: 8354353 - DNA, 22 bp, Homo sapiens
atacagatgttaaagcaatttc

SEQ ID NO: 8354354 - DNA, 22 bp, Homo sapiens
atacagatgttaaagcaatttc

SEQ ID NO: 8354355 - DNA, 22 bp, Homo sapiens
ctgctgcaggatgggcactctg

SEQ ID NO: 8354356 - DNA, 22 bp, Homo sapiens
ctgctgcagatgacagacccaa

SEQ ID NO: 8354357 - DNA, 22 bp, Homo sapiens
atagcaaattctttaggtgctt

SEQ ID NO: 8354358 - DNA, 22 bp, Homo sapiens
ctggctgcagctccgaggaaga

SEQ ID NO: 8354359 - DNA, 22 bp, Homo sapiens
atagcagtaacactgacatttt

SEQ ID NO: 8354360 - DNA, 19 bp, Homo sapiens
ctggctgcaatgccagggt

SEQ ID NO: 8354361 - DNA, 22 bp, Homo sapiens
ctggctcccgaagccctcagtg

SEQ ID NO: 8354362 - DNA, 22 bp, Homo sapiens
ctggctcccatgagctctcacg

SEQ ID NO: 8354363 - DNA, 22 bp, Homo sapiens
ctggctccattactcagcatct

SEQ ID NO: 8354364 - DNA, 22 bp, Homo sapiens
ctggctcccagctttcagggag

SEQ ID NO: 8354365 - DNA, 22 bp, Homo sapiens
ctggctcccgttgtccttgaag

SEQ ID NO: 8354366 - DNA, 22 bp, Homo sapiens
ctggctcccgttgtccttgaag

SEQ ID NO: 8354367 - DNA, 22 bp, Homo sapiens
ctggctccctcgctgaggtgct

SEQ ID NO: 8354368 - DNA, 22 bp, Homo sapiens
ctggctcccggggatcgagcac

SEQ ID NO: 8354369 - DNA, 22 bp, Homo sapiens
ctggctcacctccgctccagca

SEQ ID NO: 8354370 - DNA, 22 bp, Homo sapiens
ctggctccatccttgagctctg

SEQ ID NO: 8354371 - DNA, 22 bp, Homo sapiens
ctggctccattactcagcatct

SEQ ID NO: 8354372 - DNA, 22 bp, Homo sapiens
atagcaaaggacaatagtcagt

SEQ ID NO: 8354373 - DNA, 22 bp, Homo sapiens
atagcaaactggagcttgcttt

SEQ ID NO: 8354374 - DNA, 22 bp, Homo sapiens
ctggcccatggtgagctctggg

SEQ ID NO: 8354375 - DNA, 22 bp, Homo sapiens
atagacttggttagtaaatttg

SEQ ID NO: 8354376 - DNA, 22 bp, Homo sapiens
atagagatgggtttagttataa

SEQ ID NO: 8354377 - DNA, 22 bp, Homo sapiens
atagagatgggtttagttataa

SEQ ID NO: 8354378 - DNA, 22 bp, Homo sapiens
atagagctataagaattttgtg

SEQ ID NO: 8354379 - DNA, 22 bp, Homo sapiens
atagattagccctatagtttta

SEQ ID NO: 8354380 - DNA, 22 bp, Homo sapiens
atactacaatcataattgtaca

SEQ ID NO: 8354381 - DNA, 22 bp, Homo sapiens
atactacaatcataattgtaca

SEQ ID NO: 8354382 - DNA, 22 bp, Homo sapiens
atactacaaggtatgtgctaaa

SEQ ID NO: 8354383 - DNA, 22 bp, Homo sapiens
atctgacaagttgtgtgtatag

SEQ ID NO: 8354384 - DNA, 22 bp, Homo sapiens
atctgacaaggccacatattct

SEQ ID NO: 8354385 - DNA, 22 bp, Homo sapiens
atctgcaggatgttaggatgat

SEQ ID NO: 8354386 - DNA, 22 bp, Homo sapiens
atctgcatgctaagtcttggtt

SEQ ID NO: 8354387 - DNA, 22 bp, Homo sapiens
cttcttggtgatggcttacctg

SEQ ID NO: 8354388 - DNA, 22 bp, Homo sapiens
cttcttgggtcagagaatcatt

SEQ ID NO: 8354389 - DNA, 21 bp, Homo sapiens
cttcttggggagcagctagac

SEQ ID NO: 8354390 - DNA, 22 bp, Homo sapiens
cttcttggctgcaagtctctgt

SEQ ID NO: 8354391 - DNA, 22 bp, Homo sapiens
cttcttggactactcactagag

SEQ ID NO: 8354392 - DNA, 22 bp, Homo sapiens
atctgacaacctattgacttga

SEQ ID NO: 8354393 - DNA, 22 bp, Homo sapiens
atctctgcgtccccagcatcga

SEQ ID NO: 8354394 - DNA, 22 bp, Homo sapiens
atctctgccaacagttaatgtt

SEQ ID NO: 8354395 - DNA, 22 bp, Homo sapiens
cttcctcctccatctcgaaggc

SEQ ID NO: 8354396 - DNA, 22 bp, Homo sapiens
cttccatacagacaatgcaatg

SEQ ID NO: 8354397 - DNA, 22 bp, Homo sapiens
cttcccaccaaagcccttgttg

SEQ ID NO: 8354398 - DNA, 22 bp, Homo sapiens
cttcccactaaagcccttgttg

SEQ ID NO: 8354399 - DNA, 22 bp, Homo sapiens
cttcccaagactgtattgcaag

SEQ ID NO: 8354400 - DNA, 22 bp, Homo sapiens
cttcctcccggcccatgctctg

SEQ ID NO: 8354401 - DNA, 22 bp, Homo sapiens
cttagaaggatgtttgctgttt

SEQ ID NO: 8354402 - DNA, 22 bp, Homo sapiens
cttagaaattgttactcattca

SEQ ID NO: 8354403 - DNA, 22 bp, Homo sapiens
cttagatgaagtcacagaaccc

SEQ ID NO: 8354404 - DNA, 22 bp, Homo sapiens
atccaccctgtggtggctttct

SEQ ID NO: 8354405 - DNA, 19 bp, Homo sapiens
ctgtggcctccaggaggga

SEQ ID NO: 8354406 - DNA, 22 bp, Homo sapiens
ctgtggccctgtgatctggcac

SEQ ID NO: 8354407 - DNA, 22 bp, Homo sapiens
ctgtggcctttgttggaggtcc

SEQ ID NO: 8354408 - DNA, 22 bp, Homo sapiens
ctgtggccttggaccagcatct

SEQ ID NO: 8354409 - DNA, 22 bp, Homo sapiens
ctgtggccttggaccagcatct

SEQ ID NO: 8354410 - DNA, 22 bp, Homo sapiens
atcagacagggagttctgtgtc

SEQ ID NO: 8354411 - DNA, 22 bp, Homo sapiens
atcagagattgtagtatgtgca

SEQ ID NO: 8354412 - DNA, 21 bp, Homo sapiens
ctgtgggaccaagcactggga

SEQ ID NO: 8354413 - DNA, 22 bp, Homo sapiens
ctgtggctcaggcctgtaagcc

SEQ ID NO: 8354414 - DNA, 22 bp, Homo sapiens
atcagaagttgtgcatgcatgg

SEQ ID NO: 8354415 - DNA, 22 bp, Homo sapiens
atcagaagcaggaggaatgaag

SEQ ID NO: 8354416 - DNA, 22 bp, Homo sapiens
atcagaaactcttagagcaggg

SEQ ID NO: 8354417 - DNA, 22 bp, Homo sapiens
atcagaaaaacataatgttatt

SEQ ID NO: 8354418 - DNA, 22 bp, Homo sapiens
atcacattctttcaaagcagtc

SEQ ID NO: 8354419 - DNA, 22 bp, Homo sapiens
atcacattgccagtgattaccc

SEQ ID NO: 8354420 - DNA, 22 bp, Homo sapiens
atcaacaggtatggatgagatt

SEQ ID NO: 8354421 - DNA, 22 bp, Homo sapiens
atcaacagagcaaagcctgaac

SEQ ID NO: 8354422 - DNA, 22 bp, Homo sapiens
atcaaatataataattttcgct

SEQ ID NO: 8354423 - DNA, 22 bp, Homo sapiens
atattcttgtgattataaagta

SEQ ID NO: 8354424 - DNA, 22 bp, Homo sapiens
atattgcaatagatgcatcatt

SEQ ID NO: 8354425 - DNA, 22 bp, Homo sapiens
atattgctagcctatgagttca

SEQ ID NO: 8354426 - DNA, 21 bp, Homo sapiens
atattggtatctttttaaatc

SEQ ID NO: 8354427 - DNA, 22 bp, Homo sapiens
atattttggggtgatgtgcatc

SEQ ID NO: 8354428 - DNA, 22 bp, Homo sapiens
atatttactgctgtggtgaagg

SEQ ID NO: 8354429 - DNA, 22 bp, Homo sapiens
atcaaaatggaagaatttggct

SEQ ID NO: 8354430 - DNA, 22 bp, Homo sapiens
atattatggccccatctaagct

SEQ ID NO: 8354431 - DNA, 22 bp, Homo sapiens
atattcttgaagggagattata

SEQ ID NO: 8354432 - DNA, 22 bp, Homo sapiens
atattcttgaagggagattata

SEQ ID NO: 8354433 - DNA, 22 bp, Homo sapiens
atattcttgaaagatcctggta

SEQ ID NO: 8354434 - DNA, 22 bp, Homo sapiens
atattactctgatttagtaaat

SEQ ID NO: 8354435 - DNA, 22 bp, Homo sapiens
atattagcagtgatcaaaatgg

SEQ ID NO: 8354436 - DNA, 22 bp, Homo sapiens
atattacttcctggtataaaat

SEQ ID NO: 8354437 - DNA, 22 bp, Homo sapiens
atattactctgatttagtaaat

SEQ ID NO: 8354438 - DNA, 22 bp, Homo sapiens
atatgctacaaataaactttta

SEQ ID NO: 8354439 - DNA, 20 bp, Homo sapiens
atatgctaatttttagtggg

SEQ ID NO: 8354440 - DNA, 22 bp, Homo sapiens
atatgtttttggaaagaacaca

SEQ ID NO: 8354441 - DNA, 22 bp, Homo sapiens
atatgctatgttgaataatttg

SEQ ID NO: 8354442 - DNA, 22 bp, Homo sapiens
atatgctatgttgaataatttg

SEQ ID NO: 8354443 - DNA, 22 bp, Homo sapiens
atatgcataatacaaagagtat

SEQ ID NO: 8354444 - DNA, 22 bp, Homo sapiens
atatgcagtctcttgcccttct

SEQ ID NO: 8354445 - DNA, 22 bp, Homo sapiens
ctgggctcacctgtggctggca

SEQ ID NO: 8354446 - DNA, 22 bp, Homo sapiens
ctcccaggttgattctttccct

SEQ ID NO: 8354447 - DNA, 22 bp, Homo sapiens
ctcccaggttgattctttccct

SEQ ID NO: 8354448 - DNA, 22 bp, Homo sapiens
ctcctcagaacagccttggctg

SEQ ID NO: 8354449 - DNA, 22 bp, Homo sapiens
ctcctcagaacagccttggctg

SEQ ID NO: 8354450 - DNA, 22 bp, Homo sapiens
ctcctgcccacgtgctacttct

SEQ ID NO: 8354451 - DNA, 22 bp, Homo sapiens
ctcctcacacccactgcaacca

SEQ ID NO: 8354452 - DNA, 22 bp, Homo sapiens
ctcctagatgtcttcagagaaa

SEQ ID NO: 8354453 - DNA, 22 bp, Homo sapiens
ctcctcactttccagactgggc

SEQ ID NO: 8354454 - DNA, 22 bp, Homo sapiens
ctccggaggggcgctcatgctt

SEQ ID NO: 8354455 - DNA, 21 bp, Homo sapiens
ctccggagtgagctgtgggta

SEQ ID NO: 8354456 - DNA, 22 bp, Homo sapiens
ctccggccgcggtgcccagcgc

SEQ ID NO: 8354457 - DNA, 22 bp, Homo sapiens
ctcctgggggacagcggcaggg

SEQ ID NO: 8354458 - DNA, 18 bp, Homo sapiens
ctcctggctgatggtgag

SEQ ID NO: 8354459 - DNA, 22 bp, Homo sapiens
ctcctgggtcattgccagcaaa

SEQ ID NO: 8354460 - DNA, 22 bp, Homo sapiens
agtggcagatctctggtctgga

SEQ ID NO: 8354461 - DNA, 17 bp, Homo sapiens
agtccctaggtcctggg

SEQ ID NO: 8354462 - DNA, 22 bp, Homo sapiens
agtccctgtactttccactgcc

SEQ ID NO: 8354463 - DNA, 22 bp, Homo sapiens
agtccggggtctggacacctgg

SEQ ID NO: 8354464 - DNA, 22 bp, Homo sapiens
agtcctagggtctgcgggctgg

SEQ ID NO: 8354465 - DNA, 22 bp, Homo sapiens
agtcctagccctggatccatca

SEQ ID NO: 8354466 - DNA, 22 bp, Homo sapiens
ctcatgcattctttttgtgtgt

SEQ ID NO: 8354467 - DNA, 22 bp, Homo sapiens
ctcatgtgtctggtaggagctt

SEQ ID NO: 8354468 - DNA, 22 bp, Homo sapiens
ctccaggaaaatagggaatgag

SEQ ID NO: 8354469 - DNA, 22 bp, Homo sapiens
ctccagcttccctcagctgtgg

SEQ ID NO: 8354470 - DNA, 22 bp, Homo sapiens
ctccagctgccaccagatgttt

SEQ ID NO: 8354471 - DNA, 22 bp, Homo sapiens
ctccagcttctgcccagagact

SEQ ID NO: 8354472 - DNA, 22 bp, Homo sapiens
ctccagcctcatctcctggctg

SEQ ID NO: 8354473 - DNA, 22 bp, Homo sapiens
ctccagagatacacggtcttgc

SEQ ID NO: 8354474 - DNA, 22 bp, Homo sapiens
ctccagctcttaactgcggaag

SEQ ID NO: 8354475 - DNA, 22 bp, Homo sapiens
ctccagctcgcgagctctgctc

SEQ ID NO: 8354476 - DNA, 18 bp, Homo sapiens
agtcttctgatccatttt

SEQ ID NO: 8354477 - DNA, 22 bp, Homo sapiens
agtcttctgaataagaatcact

SEQ ID NO: 8354478 - DNA, 22 bp, Homo sapiens
agtcttcagagaaattaactct

SEQ ID NO: 8354479 - DNA, 22 bp, Homo sapiens
agtcttcacatcagtctaaaga

SEQ ID NO: 8354480 - DNA, 19 bp, Homo sapiens
agtcttcatctgccaggcc

SEQ ID NO: 8354481 - DNA, 22 bp, Homo sapiens
agtcttcagcatagcatatggc

SEQ ID NO: 8354482 - DNA, 22 bp, Homo sapiens
ctctggcttctaccttgcagtt

SEQ ID NO: 8354483 - DNA, 22 bp, Homo sapiens
ctctgctcaccagccatgtgat

SEQ ID NO: 8354484 - DNA, 22 bp, Homo sapiens
ctctgcgccaccctcgcctgct

SEQ ID NO: 8354485 - DNA, 22 bp, Homo sapiens
ctctgctcaccagccatgtgat

SEQ ID NO: 8354486 - DNA, 22 bp, Homo sapiens
ctctgagcagcggtgccgaagt

SEQ ID NO: 8354487 - DNA, 22 bp, Homo sapiens
ctgaaataaagttgctaaaatt

SEQ ID NO: 8354488 - DNA, 22 bp, Homo sapiens
ctgaaatatagatgtgaacagt

SEQ ID NO: 8354489 - DNA, 22 bp, Homo sapiens
ctgaaatatatactgggaaaaa

SEQ ID NO: 8354490 - DNA, 22 bp, Homo sapiens
ctgaaatagtttcatagaactt

SEQ ID NO: 8354491 - DNA, 22 bp, Homo sapiens
ctgaaatagtttcatagaactt

SEQ ID NO: 8354492 - DNA, 22 bp, Homo sapiens
ctctggggtggaggaggctgac

SEQ ID NO: 8354493 - DNA, 22 bp, Homo sapiens
ctctggggtgcttcgacacttc

SEQ ID NO: 8354494 - DNA, 22 bp, Homo sapiens
ctctggggttaagcttccatgg

SEQ ID NO: 8354495 - DNA, 22 bp, Homo sapiens
ctctggggttaagcttccatgg

SEQ ID NO: 8354496 - DNA, 22 bp, Homo sapiens
ctctggggtggaggaggctgac

SEQ ID NO: 8354497 - DNA, 22 bp, Homo sapiens
ctctggggaagcagccagctgg

SEQ ID NO: 8354498 - DNA, 17 bp, Homo sapiens
ctctggggacagttcta

SEQ ID NO: 8354499 - DNA, 22 bp, Homo sapiens
ctctggctttaaggatgccaca

SEQ ID NO: 8354500 - DNA, 22 bp, Homo sapiens
ctgaaggaagcagaagcgaggt

SEQ ID NO: 8354501 - DNA, 22 bp, Homo sapiens
ctgaaggaagcaggtggcctgt

SEQ ID NO: 8354502 - DNA, 22 bp, Homo sapiens
agtgtctgctcagacagctaca

SEQ ID NO: 8354503 - DNA, 22 bp, Homo sapiens
agtgtctgctaggttcatcaac

SEQ ID NO: 8354504 - DNA, 22 bp, Homo sapiens
ctgaaatgttaaatacttggct

SEQ ID NO: 8354505 - DNA, 22 bp, Homo sapiens
ctgaaattccatttcagccaca

SEQ ID NO: 8354506 - DNA, 22 bp, Homo sapiens
ctgagaaaagacatttctagat

SEQ ID NO: 8354507 - DNA, 22 bp, Homo sapiens
ctgagaaaagacatttctagat

SEQ ID NO: 8354508 - DNA, 22 bp, Homo sapiens
ctgagaaaagctttcttataca

SEQ ID NO: 8354509 - DNA, 22 bp, Homo sapiens
ctgagaaaagctttcttataca

SEQ ID NO: 8354510 - DNA, 22 bp, Homo sapiens
ctgaatgcttgcctttggctaa

SEQ ID NO: 8354511 - DNA, 22 bp, Homo sapiens
ctgagcagcaattgctggccca

SEQ ID NO: 8354512 - DNA, 22 bp, Homo sapiens
ctgagcagcaattgctggccca

SEQ ID NO: 8354513 - DNA, 22 bp, Homo sapiens
ctgagcagcaacccagagcctc

SEQ ID NO: 8354514 - DNA, 22 bp, Homo sapiens
ctgagcagcacagggcgccagg

SEQ ID NO: 8354515 - DNA, 22 bp, Homo sapiens
ctgagcagatgaccagccccag

SEQ ID NO: 8354516 - DNA, 22 bp, Homo sapiens
ctgagcagatgttgcccagaag

SEQ ID NO: 8354517 - DNA, 22 bp, Homo sapiens
agttagtagacttttccattta

SEQ ID NO: 8354518 - DNA, 22 bp, Homo sapiens
agttatataactatctagatgc

SEQ ID NO: 8354519 - DNA, 22 bp, Homo sapiens
ctgagaaacaatgaattgtgat

SEQ ID NO: 8354520 - DNA, 22 bp, Homo sapiens
ctgagaaaccaggtgctctgat

SEQ ID NO: 8354521 - DNA, 23 bp, Homo sapiens
cctgcagctgccacgccctgctc

SEQ ID NO: 8354522 - DNA, 22 bp, Homo sapiens
cctgccagctgtgggccagcct

SEQ ID NO: 8354523 - DNA, 22 bp, Homo sapiens
aggtaggatgggtggagatgat

SEQ ID NO: 8354524 - DNA, 22 bp, Homo sapiens
aggtagggctaggctgcgtctg

SEQ ID NO: 8354525 - DNA, 22 bp, Homo sapiens
cctggaggtggaggttgcagtg

SEQ ID NO: 8354526 - DNA, 22 bp, Homo sapiens
aggtcattaaagttaaatgagg

SEQ ID NO: 8354527 - DNA, 22 bp, Homo sapiens
aggtcattggggactatctccg

SEQ ID NO: 8354528 - DNA, 22 bp, Homo sapiens
aggtcattccagccattcccct

SEQ ID NO: 8354529 - DNA, 22 bp, Homo sapiens
aggtcattacaattatcatttt

SEQ ID NO: 8354530 - DNA, 19 bp, Homo sapiens
aggtcattgatagtgcagg

SEQ ID NO: 8354531 - DNA, 22 bp, Homo sapiens
aggtcattgaagttattttctt

SEQ ID NO: 8354532 - DNA, 22 bp, Homo sapiens
aggtcattccttgtcttcttgc

SEQ ID NO: 8354533 - DNA, 22 bp, Homo sapiens
cctggctctgcagccactccag

SEQ ID NO: 8354534 - DNA, 22 bp, Homo sapiens
aggtcctctgtgcctgctggcg

SEQ ID NO: 8354535 - DNA, 22 bp, Homo sapiens
aggtcctctcccagggtactgc

SEQ ID NO: 8354536 - DNA, 22 bp, Homo sapiens
aggtcctcgtcgtgctgggcca

SEQ ID NO: 8354537 - DNA, 22 bp, Homo sapiens
aggtcctccaccaggtctcctg

SEQ ID NO: 8354538 - DNA, 22 bp, Homo sapiens
aggtcctcctcctccaggaagg

SEQ ID NO: 8354539 - DNA, 21 bp, Homo sapiens
aggtcccaggtttgggcagca

SEQ ID NO: 8354540 - DNA, 19 bp, Homo sapiens
aggtccctccctcgaggct

SEQ ID NO: 8354541 - DNA, 22 bp, Homo sapiens
aggtccctcagaggcctcaccg

SEQ ID NO: 8354542 - DNA, 22 bp, Homo sapiens
cctgtgagagggcgagtgtaga

SEQ ID NO: 8354543 - DNA, 22 bp, Homo sapiens
cctgtgaggtcatctgtggtaa

SEQ ID NO: 8354544 - DNA, 19 bp, Homo sapiens
cctgtgactatctttgtaa

SEQ ID NO: 8354545 - DNA, 20 bp, Homo sapiens
cctgtctcctcttacctggc

SEQ ID NO: 8354546 - DNA, 22 bp, Homo sapiens
cctgtccagggactgagggaga

SEQ ID NO: 8354547 - DNA, 20 bp, Homo sapiens
cctgtctcacgttccgcccc

SEQ ID NO: 8354548 - DNA, 22 bp, Homo sapiens
cctgtgccagccccttctgctg

SEQ ID NO: 8354549 - DNA, 22 bp, Homo sapiens
cctgtgccaaaaggctgcttat

SEQ ID NO: 8354550 - DNA, 22 bp, Homo sapiens
aggtgggcacacctcccttctc

SEQ ID NO: 8354551 - DNA, 22 bp, Homo sapiens
aggtgggcaatgaggcctgagt

SEQ ID NO: 8354552 - DNA, 22 bp, Homo sapiens
aggtgggcaatgaggcctgagt

SEQ ID NO: 8354553 - DNA, 22 bp, Homo sapiens
aggtggggccaaatgctacagt

SEQ ID NO: 8354554 - DNA, 21 bp, Homo sapiens
aggtggggctgcacctctgct

SEQ ID NO: 8354555 - DNA, 22 bp, Homo sapiens
aggtggggaggagtgtctcttt

SEQ ID NO: 8354556 - DNA, 22 bp, Homo sapiens
cctgggctcaagtgatggtccc

SEQ ID NO: 8354557 - DNA, 22 bp, Homo sapiens
cctgggcataaatcactccaag

SEQ ID NO: 8354558 - DNA, 22 bp, Homo sapiens
cctgggctcacagccaaggctc

SEQ ID NO: 8354559 - DNA, 22 bp, Homo sapiens
cctgggctcaggcttgggcagc

SEQ ID NO: 8354560 - DNA, 22 bp, Homo sapiens
cctggtgcccccaagccagctg

SEQ ID NO: 8354561 - DNA, 22 bp, Homo sapiens
cctgtcagttgctgtcagggat

SEQ ID NO: 8354562 - DNA, 22 bp, Homo sapiens
cctgggcttgcatctgtgctgg

SEQ ID NO: 8354563 - DNA, 22 bp, Homo sapiens
cgggctgctctggaccgacagc

SEQ ID NO: 8354564 - DNA, 22 bp, Homo sapiens
cgggcgcactccgggcagctgt

SEQ ID NO: 8354565 - DNA, 18 bp, Homo sapiens
cgggcgggcgcctggccc

SEQ ID NO: 8354566 - DNA, 18 bp, Homo sapiens
cgggcgggcgcctggccc

SEQ ID NO: 8354567 - DNA, 20 bp, Homo sapiens
agtacaatgtatgattcaga

SEQ ID NO: 8354568 - DNA, 22 bp, Homo sapiens
agtacaagtgatgtggtaaaaa

SEQ ID NO: 8354569 - DNA, 22 bp, Homo sapiens
agtacaagtattagagttattc

SEQ ID NO: 8354570 - DNA, 22 bp, Homo sapiens
agtacaagtagaatgctacaag

SEQ ID NO: 8354571 - DNA, 22 bp, Homo sapiens
agtacaagtattagagttattc

SEQ ID NO: 8354572 - DNA, 22 bp, Homo sapiens
cgggcccgagcacggcacccac

SEQ ID NO: 8354573 - DNA, 22 bp, Homo sapiens
cgggccgttaggaaggtggggc

SEQ ID NO: 8354574 - DNA, 22 bp, Homo sapiens
cgggcagattgggaaggttcat

SEQ ID NO: 8354575 - DNA, 22 bp, Homo sapiens
cgggcagatcacacagggcttg

SEQ ID NO: 8354576 - DNA, 22 bp, Homo sapiens
cgggcagcggcgtggccatggt

SEQ ID NO: 8354577 - DNA, 22 bp, Homo sapiens
cggctcagctagcttggcccca

SEQ ID NO: 8354578 - DNA, 22 bp, Homo sapiens
agtacagatttagacacgatag

SEQ ID NO: 8354579 - DNA, 22 bp, Homo sapiens
agtacagtagatgtaggaatag

SEQ ID NO: 8354580 - DNA, 22 bp, Homo sapiens
agtacagcaccatgagcacagg

SEQ ID NO: 8354581 - DNA, 22 bp, Homo sapiens
ctaagatagattttttcacttt

SEQ ID NO: 8354582 - DNA, 22 bp, Homo sapiens
ctaagcaagttccactctacaa

SEQ ID NO: 8354583 - DNA, 22 bp, Homo sapiens
cctgtgttctaatccatctcag

SEQ ID NO: 8354584 - DNA, 22 bp, Homo sapiens
cgaggcggcggaagtgcccgta

SEQ ID NO: 8354585 - DNA, 20 bp, Homo sapiens
cggctcagcctctccctccc

SEQ ID NO: 8354586 - DNA, 22 bp, Homo sapiens
agtaaaaatatgcttgtggcta

SEQ ID NO: 8354587 - DNA, 22 bp, Homo sapiens
agtaaaaagttcagaatggttg

SEQ ID NO: 8354588 - DNA, 22 bp, Homo sapiens
aggttttcagctgtatcctgag

SEQ ID NO: 8354589 - DNA, 22 bp, Homo sapiens
agtccacagctcatagtttttt

SEQ ID NO: 8354590 - DNA, 22 bp, Homo sapiens
ctagaatctatgtcaggaactc

SEQ ID NO: 8354591 - DNA, 20 bp, Homo sapiens
ctagaactgagaaatttaaa

SEQ ID NO: 8354592 - DNA, 22 bp, Homo sapiens
ctagaatactcgtattattccc

SEQ ID NO: 8354593 - DNA, 22 bp, Homo sapiens
ctagtattaagtgtgagtaaaa

SEQ ID NO: 8354594 - DNA, 22 bp, Homo sapiens
ctagtacaattttagcaagatg

SEQ ID NO: 8354595 - DNA, 22 bp, Homo sapiens
agtcccagctactcaagaggct

SEQ ID NO: 8354596 - DNA, 22 bp, Homo sapiens
ctagtcactcagcactgacaaa

SEQ ID NO: 8354597 - DNA, 22 bp, Homo sapiens
ctagtccactgtcctgcctcca

SEQ ID NO: 8354598 - DNA, 22 bp, Homo sapiens
agtccatggttctgactcatct

SEQ ID NO: 8354599 - DNA, 22 bp, Homo sapiens
ctagggtcaggggcctgcgtcg

SEQ ID NO: 8354600 - DNA, 22 bp, Homo sapiens
ctagggtctgttttccaggtgt

SEQ ID NO: 8354601 - DNA, 22 bp, Homo sapiens
agtatttcctggcttatctgct

SEQ ID NO: 8354602 - DNA, 22 bp, Homo sapiens
ctaagcatccatctcttcttca

SEQ ID NO: 8354603 - DNA, 22 bp, Homo sapiens
ctaagccagaactagtgattgg

SEQ ID NO: 8354604 - DNA, 22 bp, Homo sapiens
ctacattttaataagctgctta

SEQ ID NO: 8354605 - DNA, 22 bp, Homo sapiens
ctacatttgttctatagctttt

SEQ ID NO: 8354606 - DNA, 22 bp, Homo sapiens
ctagaaatctctgtttacatca

SEQ ID NO: 8354607 - DNA, 22 bp, Homo sapiens
ctacatttttcaccgagcctct

SEQ ID NO: 8354608 - DNA, 22 bp, Homo sapiens
ctagaacagaaagtacaggaaa

SEQ ID NO: 8354609 - DNA, 22 bp, Homo sapiens
ctagaaattctgattcagtagg

SEQ ID NO: 8354610 - DNA, 22 bp, Homo sapiens
ctagaaatgtagattcttagtg

SEQ ID NO: 8354611 - DNA, 22 bp, Homo sapiens
ctagaaatctctgtttacatca

SEQ ID NO: 8354612 - DNA, 22 bp, Homo sapiens
ggaaggggagctggaaagggta

SEQ ID NO: 8354613 - DNA, 22 bp, Homo sapiens
ggaagggcctcgggcgtgggac

SEQ ID NO: 8354614 - DNA, 22 bp, Homo sapiens
cacagaatggaccagttttaga

SEQ ID NO: 8354615 - DNA, 22 bp, Homo sapiens
cacagaatggaccagttttaga

SEQ ID NO: 8354616 - DNA, 22 bp, Homo sapiens
cacacaggagagtgctggaggt

SEQ ID NO: 8354617 - DNA, 22 bp, Homo sapiens
cacacaggaaaattggaattaa

SEQ ID NO: 8354618 - DNA, 22 bp, Homo sapiens
cacacagctcaggggcactgcc

SEQ ID NO: 8354619 - DNA, 22 bp, Homo sapiens
cacacagctagtgacaggagaa

SEQ ID NO: 8354620 - DNA, 22 bp, Homo sapiens
cacagagaaaatgttggtgctt

SEQ ID NO: 8354621 - DNA, 22 bp, Homo sapiens
cacagacttgagaagcacctta

SEQ ID NO: 8354622 - DNA, 22 bp, Homo sapiens
cacagagaactgtgggagtgtg

SEQ ID NO: 8354623 - DNA, 22 bp, Homo sapiens
cacagagagctacgtgcagcgt

SEQ ID NO: 8354624 - DNA, 22 bp, Homo sapiens
ggactgggcatgggtgctctgc

SEQ ID NO: 8354625 - DNA, 22 bp, Homo sapiens
cacagaggcatgaccctgccct

SEQ ID NO: 8354626 - DNA, 22 bp, Homo sapiens
cacagaggcggaaaattctgaa

SEQ ID NO: 8354627 - DNA, 22 bp, Homo sapiens
cacagaggcaaccttctggggt

SEQ ID NO: 8354628 - DNA, 22 bp, Homo sapiens
cacagaggagtgcacactctct

SEQ ID NO: 8354629 - DNA, 22 bp, Homo sapiens
cacagaggaaatgactttctta

SEQ ID NO: 8354630 - DNA, 22 bp, Homo sapiens
cacagaggaatgcatcagcaga

SEQ ID NO: 8354631 - DNA, 22 bp, Homo sapiens
cacagagctggaaaggctgggc

SEQ ID NO: 8354632 - DNA, 22 bp, Homo sapiens
cacagagctgaacctgggtcat

SEQ ID NO: 8354633 - DNA, 22 bp, Homo sapiens
cacagatagaccttatgagatt

SEQ ID NO: 8354634 - DNA, 22 bp, Homo sapiens
cacagatacctagtgaaacata

SEQ ID NO: 8354635 - DNA, 22 bp, Homo sapiens
cacagagttgaatattgacatt

SEQ ID NO: 8354636 - DNA, 22 bp, Homo sapiens
cacagagttgaatattgacatt

SEQ ID NO: 8354637 - DNA, 22 bp, Homo sapiens
cacagaggtgatagtggtcaag

SEQ ID NO: 8354638 - DNA, 22 bp, Homo sapiens
cacagaggtctgggcccagcag

SEQ ID NO: 8354639 - DNA, 22 bp, Homo sapiens
cacagatttcctaagcatcaat

SEQ ID NO: 8354640 - DNA, 22 bp, Homo sapiens
cacagatttcctaagcatcaat

SEQ ID NO: 8354641 - DNA, 19 bp, Homo sapiens
ggagccgccgcccttcatt

SEQ ID NO: 8354642 - DNA, 22 bp, Homo sapiens
ggagccggagggccactggcag

SEQ ID NO: 8354643 - DNA, 22 bp, Homo sapiens
ggagctggagagtacagagttt

SEQ ID NO: 8354644 - DNA, 22 bp, Homo sapiens
cacaggaagtggtcagtgccag

SEQ ID NO: 8354645 - DNA, 22 bp, Homo sapiens
ggaggcagaatagagtgtgggt

SEQ ID NO: 8354646 - DNA, 21 bp, Homo sapiens
caagccagaccaatagcagcc

SEQ ID NO: 8354647 - DNA, 22 bp, Homo sapiens
caagcatactgtgagagtttta

SEQ ID NO: 8354648 - DNA, 22 bp, Homo sapiens
caagcagggtttatgcatggag

SEQ ID NO: 8354649 - DNA, 22 bp, Homo sapiens
caagcagggatactgcagggag

SEQ ID NO: 8354650 - DNA, 22 bp, Homo sapiens
caagccagctcctgccacagag

SEQ ID NO: 8354651 - DNA, 22 bp, Homo sapiens
caagccaggaaggatccagcac

SEQ ID NO: 8354652 - DNA, 22 bp, Homo sapiens
caagccaggtgaacataacaag

SEQ ID NO: 8354653 - DNA, 22 bp, Homo sapiens
caagccaggtgaacataacaag

SEQ ID NO: 8354654 - DNA, 22 bp, Homo sapiens
gctggaggatggactggaagaa

SEQ ID NO: 8354655 - DNA, 22 bp, Homo sapiens
gctggaggatggactggaagaa

SEQ ID NO: 8354656 - DNA, 22 bp, Homo sapiens
gctggaggatggactggaagaa

SEQ ID NO: 8354657 - DNA, 22 bp, Homo sapiens
gctggaggaggaagtgtgaggg

SEQ ID NO: 8354658 - DNA, 22 bp, Homo sapiens
gctggaggatcacttgagccca

SEQ ID NO: 8354659 - DNA, 22 bp, Homo sapiens
gctggaggaggaagtgtgaggg

SEQ ID NO: 8354660 - DNA, 22 bp, Homo sapiens
caaatgtaattgcggtttttgc

SEQ ID NO: 8354661 - DNA, 22 bp, Homo sapiens
caaatgtaataaggagtttccc

SEQ ID NO: 8354662 - DNA, 22 bp, Homo sapiens
caaatgtaatggcaggttttgc

SEQ ID NO: 8354663 - DNA, 22 bp, Homo sapiens
caaatgtataaatgtactttct

SEQ ID NO: 8354664 - DNA, 23 bp, Homo sapiens
caaatgtagtgtgtccacccctg

SEQ ID NO: 8354665 - DNA, 22 bp, Homo sapiens
caaatgtatcagcccagggatt

SEQ ID NO: 8354666 - DNA, 22 bp, Homo sapiens
caaatgtaaattcttttgaagc

SEQ ID NO: 8354667 - DNA, 22 bp, Homo sapiens
caaatgtaaattcttttgaagc

SEQ ID NO: 8354668 - DNA, 22 bp, Homo sapiens
caagcaggcctggctggaccgt

SEQ ID NO: 8354669 - DNA, 22 bp, Homo sapiens
caaatgtggtttctcagcattc

SEQ ID NO: 8354670 - DNA, 22 bp, Homo sapiens
caagattatcttcttcttgtta

SEQ ID NO: 8354671 - DNA, 22 bp, Homo sapiens
caaatgtatgttttcctatgta

SEQ ID NO: 8354672 - DNA, 22 bp, Homo sapiens
caaatgtattctcacttcaggg

SEQ ID NO: 8354673 - DNA, 22 bp, Homo sapiens
caaggcagcttaatagaatttg

SEQ ID NO: 8354674 - DNA, 22 bp, Homo sapiens
gctggctgggtccctgagaggc

SEQ ID NO: 8354675 - DNA, 22 bp, Homo sapiens
gctggctgggtccctgagaggc

SEQ ID NO: 8354676 - DNA, 22 bp, Homo sapiens
gctggctgtatcacctggccag

SEQ ID NO: 8354677 - DNA, 22 bp, Homo sapiens
gctggctggtccagcaggggct

SEQ ID NO: 8354678 - DNA, 19 bp, Homo sapiens
caagggttgggtctgtcat

SEQ ID NO: 8354679 - DNA, 20 bp, Homo sapiens
caagggtttgcattggcttt

SEQ ID NO: 8354680 - DNA, 22 bp, Homo sapiens
caagtttgtgttctatcattct

SEQ ID NO: 8354681 - DNA, 17 bp, Homo sapiens
gcttgggctgcctgttg

SEQ ID NO: 8354682 - DNA, 20 bp, Homo sapiens
caagggtttgcattggcttt

SEQ ID NO: 8354683 - DNA, 22 bp, Homo sapiens
caaggtgccatgctgggcgggg

SEQ ID NO: 8354684 - DNA, 22 bp, Homo sapiens
caaggtgccatgctgggcgggg

SEQ ID NO: 8354685 - DNA, 22 bp, Homo sapiens
caagtatatttgaacatgtaaa

SEQ ID NO: 8354686 - DNA, 22 bp, Homo sapiens
gctgttctctgtaacatgcatt

SEQ ID NO: 8354687 - DNA, 22 bp, Homo sapiens
gctgttcattagaaatagaatg

SEQ ID NO: 8354688 - DNA, 19 bp, Homo sapiens
gctgttaaggaccctcgga

SEQ ID NO: 8354689 - DNA, 22 bp, Homo sapiens
gctgtggcgattggtatcgatt

SEQ ID NO: 8354690 - DNA, 22 bp, Homo sapiens
caagtcaaagactagaactagt

SEQ ID NO: 8354691 - DNA, 23 bp, Homo sapiens
cagaaataaactggtttgtagat

SEQ ID NO: 8354692 - DNA, 23 bp, Homo sapiens
cagaaagtttgagaagatacatc

SEQ ID NO: 8354693 - DNA, 23 bp, Homo sapiens
cagaaataaactggtttgtagat

SEQ ID NO: 8354694 - DNA, 22 bp, Homo sapiens
cagaaataaagtggacagagta

SEQ ID NO: 8354695 - DNA, 22 bp, Homo sapiens
cagaaagcttaggcaagttgga

SEQ ID NO: 8354696 - DNA, 22 bp, Homo sapiens
cagaaagcttggtacaatatgc

SEQ ID NO: 8354697 - DNA, 22 bp, Homo sapiens
ggctgttcctctgagagctgat

SEQ ID NO: 8354698 - DNA, 22 bp, Homo sapiens
ggctgtctctgtgactgccacc

SEQ ID NO: 8354699 - DNA, 22 bp, Homo sapiens
ggctgtctgtggtggagcgttg

SEQ ID NO: 8354700 - DNA, 22 bp, Homo sapiens
ggctggtgttacagtcggcagc

SEQ ID NO: 8354701 - DNA, 21 bp, Homo sapiens
ggctggtgtttagctgtgata

SEQ ID NO: 8354702 - DNA, 21 bp, Homo sapiens
ggctggtgtttagctgtgata

SEQ ID NO: 8354703 - DNA, 22 bp, Homo sapiens
ggctggttcagctagtgctgtt

SEQ ID NO: 8354704 - DNA, 22 bp, Homo sapiens
ggctggttagttgaggaggact

SEQ ID NO: 8354705 - DNA, 22 bp, Homo sapiens
ggctgtccttggccaaggcact

SEQ ID NO: 8354706 - DNA, 20 bp, Homo sapiens
ggctgtcccgcggctgccgg

SEQ ID NO: 8354707 - DNA, 22 bp, Homo sapiens
ggctgtccacctaccatgccgg

SEQ ID NO: 8354708 - DNA, 22 bp, Homo sapiens
cagaaaataaacatttgtggaa

SEQ ID NO: 8354709 - DNA, 22 bp, Homo sapiens
cagaaaataaagtttctacgca

SEQ ID NO: 8354710 - DNA, 20 bp, Homo sapiens
ggctgcccactccagagtac

SEQ ID NO: 8354711 - DNA, 22 bp, Homo sapiens
ggctgccccagtgctcatggct

SEQ ID NO: 8354712 - DNA, 22 bp, Homo sapiens
ggctgaggcggcgatgcccttg

SEQ ID NO: 8354713 - DNA, 22 bp, Homo sapiens
cactttgtgtgggatcaggggt

SEQ ID NO: 8354714 - DNA, 17 bp, Homo sapiens
cactttgttgctgtggg

SEQ ID NO: 8354715 - DNA, 22 bp, Homo sapiens
cactttgtttattgtgcagtta

SEQ ID NO: 8354716 - DNA, 22 bp, Homo sapiens
cagaaaacaaacctatcctgag

SEQ ID NO: 8354717 - DNA, 22 bp, Homo sapiens
cacttttaacaggagaattccc

SEQ ID NO: 8354718 - DNA, 23 bp, Homo sapiens
cagaaaacccagagctcagtccc

SEQ ID NO: 8354719 - DNA, 22 bp, Homo sapiens
cagaaaacctgactctagaact

SEQ ID NO: 8354720 - DNA, 22 bp, Homo sapiens
cagaaagcaaaatggatctctg

SEQ ID NO: 8354721 - DNA, 22 bp, Homo sapiens
ggctgccctgggaggcaagggt

SEQ ID NO: 8354722 - DNA, 22 bp, Homo sapiens
ggctgccctcgtctactgccca

SEQ ID NO: 8354723 - DNA, 22 bp, Homo sapiens
cagaaagcagagctgagccttt

SEQ ID NO: 8354724 - DNA, 22 bp, Homo sapiens
cagaaagcaagccattcactgt

SEQ ID NO: 8354725 - DNA, 20 bp, Homo sapiens
cagaaagcatgttccagggc

SEQ ID NO: 8354726 - DNA, 22 bp, Homo sapiens
cagaaagcagttgtcaatgggc

SEQ ID NO: 8354727 - DNA, 22 bp, Homo sapiens
cagaaagccctatgtacagtgg

SEQ ID NO: 8354728 - DNA, 22 bp, Homo sapiens
cagaaagccaactccaactgtc

SEQ ID NO: 8354729 - DNA, 22 bp, Homo sapiens
cagaaagccgacttacaatgga

SEQ ID NO: 8354730 - DNA, 23 bp, Homo sapiens
cagaaagccctttccccacagta

SEQ ID NO: 8354731 - DNA, 22 bp, Homo sapiens
cagaaagcgggatgcagcatgt

SEQ ID NO: 8354732 - DNA, 22 bp, Homo sapiens
cagaaagctctttcaatcttgc

SEQ ID NO: 8354733 - DNA, 22 bp, Homo sapiens
cagaaagcgggatgcagcatgt

SEQ ID NO: 8354734 - DNA, 22 bp, Homo sapiens
ggcctgaggcgtcccagctgtg

SEQ ID NO: 8354735 - DNA, 22 bp, Homo sapiens
ggcctgaggcgtcccagctgtg

SEQ ID NO: 8354736 - DNA, 22 bp, Homo sapiens
ggcctgtgcacatgtgcaggaa

SEQ ID NO: 8354737 - DNA, 22 bp, Homo sapiens
ggcctgtgagaatcaaggaaaa

SEQ ID NO: 8354738 - DNA, 19 bp, Homo sapiens
ggctcagggcgctgccgcc

SEQ ID NO: 8354739 - DNA, 22 bp, Homo sapiens
ggctcaggggccaggcctgtcc

SEQ ID NO: 8354740 - DNA, 22 bp, Homo sapiens
ggctcaggggccaggcctgtcc

SEQ ID NO: 8354741 - DNA, 19 bp, Homo sapiens
ggctcagggcgctgccgcc

SEQ ID NO: 8354742 - DNA, 22 bp, Homo sapiens
ggctcagggaatgaggaagaat

SEQ ID NO: 8354743 - DNA, 22 bp, Homo sapiens
ggctcaggctggagtgcagtgg

SEQ ID NO: 8354744 - DNA, 18 bp, Homo sapiens
ggctcaggctatcctaac

SEQ ID NO: 8354745 - DNA, 22 bp, Homo sapiens
ggctcaggctggagtgcagtgg

SEQ ID NO: 8354746 - DNA, 18 bp, Homo sapiens
ggctcaggctatcctaac

SEQ ID NO: 8354747 - DNA, 22 bp, Homo sapiens
ggcctgtgtcctccttgccctg

SEQ ID NO: 8354748 - DNA, 22 bp, Homo sapiens
ggcctgtgtcggccccgggttc

SEQ ID NO: 8354749 - DNA, 22 bp, Homo sapiens
ggcctgtgtctgtgcctgtcct

SEQ ID NO: 8354750 - DNA, 17 bp, Homo sapiens
ggcctgtgtggctgcag

SEQ ID NO: 8354751 - DNA, 22 bp, Homo sapiens
ggcctgtggcaaggtgagaatg

SEQ ID NO: 8354752 - DNA, 22 bp, Homo sapiens
ggcctgtgggaggacagctggg

SEQ ID NO: 8354753 - DNA, 22 bp, Homo sapiens
ggcctgtggatctgatgaacca

SEQ ID NO: 8354754 - DNA, 22 bp, Homo sapiens
ggcctgtgctgtcagccctagt

SEQ ID NO: 8354755 - DNA, 22 bp, Homo sapiens
ggcctgtgctgagaacctggct

SEQ ID NO: 8354756 - DNA, 22 bp, Homo sapiens
ggcctgtgctgagaacctggct

SEQ ID NO: 8354757 - DNA, 22 bp, Homo sapiens
ggctctggtgccctggctccca

SEQ ID NO: 8354758 - DNA, 22 bp, Homo sapiens
ggctgagcgtggctgccgtggg

SEQ ID NO: 8354759 - DNA, 22 bp, Homo sapiens
ggctccagggtacccctggatg

SEQ ID NO: 8354760 - DNA, 22 bp, Homo sapiens
ggctccagggtacccctggatg

SEQ ID NO: 8354761 - DNA, 22 bp, Homo sapiens
ggctccagggtctctccttgtg

SEQ ID NO: 8354762 - DNA, 22 bp, Homo sapiens
ggctcaggtttaaagtgcttta

SEQ ID NO: 8354763 - DNA, 22 bp, Homo sapiens
ggctcaggttgggtcacatgac

SEQ ID NO: 8354764 - DNA, 22 bp, Homo sapiens
ggctccagggtacccctggatg

SEQ ID NO: 8354765 - DNA, 22 bp, Homo sapiens
ggctcaggttgggtcacatgac

SEQ ID NO: 8354766 - DNA, 22 bp, Homo sapiens
ggctcaggttaccagtccctcc

SEQ ID NO: 8354767 - DNA, 22 bp, Homo sapiens
ggctcaggttaccagtccctcc

SEQ ID NO: 8354768 - DNA, 22 bp, Homo sapiens
ggctctggtcagtgaggggcct

SEQ ID NO: 8354769 - DNA, 20 bp, Homo sapiens
ggctctggaatctggtgggc

SEQ ID NO: 8354770 - DNA, 22 bp, Homo sapiens
ggcatttgaaactattcggaga

SEQ ID NO: 8354771 - DNA, 22 bp, Homo sapiens
ggcattgatgggagatggtgga

SEQ ID NO: 8354772 - DNA, 22 bp, Homo sapiens
ggcattcaaagaatggtaatta

SEQ ID NO: 8354773 - DNA, 22 bp, Homo sapiens
ggcagggcaggaaagtcaggaa

SEQ ID NO: 8354774 - DNA, 22 bp, Homo sapiens
ggcaggtgcacctgagccatct

SEQ ID NO: 8354775 - DNA, 22 bp, Homo sapiens
ggcaggtgcacctgagccatct

SEQ ID NO: 8354776 - DNA, 22 bp, Homo sapiens
ggcaggtgccagttggcttggg

SEQ ID NO: 8354777 - DNA, 22 bp, Homo sapiens
ggcaggtgcccagagagcacga

SEQ ID NO: 8354778 - DNA, 22 bp, Homo sapiens
ggcaggtgcccagagagcacga

SEQ ID NO: 8354779 - DNA, 21 bp, Homo sapiens
ggccgccgccttgtgctctgc

SEQ ID NO: 8354780 - DNA, 21 bp, Homo sapiens
ggccgccgccttgtgctctgc

SEQ ID NO: 8354781 - DNA, 19 bp, Homo sapiens
ggccgcggcccgcagtggg

SEQ ID NO: 8354782 - DNA, 22 bp, Homo sapiens
ggccgctgcgcctccaaccgag

SEQ ID NO: 8354783 - DNA, 20 bp, Homo sapiens
ggccggggagctctccaggg

SEQ ID NO: 8354784 - DNA, 22 bp, Homo sapiens
cacctggttctagtgaaagtct

SEQ ID NO: 8354785 - DNA, 22 bp, Homo sapiens
ggccggggcctgctcgcctgtg

SEQ ID NO: 8354786 - DNA, 22 bp, Homo sapiens
ggccggtgtcatggcttggtct

SEQ ID NO: 8354787 - DNA, 22 bp, Homo sapiens
ggccggggcctccccgcgtcgc

SEQ ID NO: 8354788 - DNA, 22 bp, Homo sapiens
ggccggggcctgctcgcctgtg

SEQ ID NO: 8354789 - DNA, 22 bp, Homo sapiens
cacgcacgctgggtggaggcgc

SEQ ID NO: 8354790 - DNA, 21 bp, Homo sapiens
ggccctggttacgcctcctct

SEQ ID NO: 8354791 - DNA, 22 bp, Homo sapiens
ggccctgtccccttcagttttg

SEQ ID NO: 8354792 - DNA, 22 bp, Homo sapiens
ggccctgtcctggctgtctccg

SEQ ID NO: 8354793 - DNA, 22 bp, Homo sapiens
ggccctgtccctggccgtctgt

SEQ ID NO: 8354794 - DNA, 22 bp, Homo sapiens
ggcccttcctgctctcttagct

SEQ ID NO: 8354795 - DNA, 22 bp, Homo sapiens
ggcccttgcagcaggcgctggc

SEQ ID NO: 8354796 - DNA, 22 bp, Homo sapiens
ggccctgttccacgtggggtgt

SEQ ID NO: 8354797 - DNA, 22 bp, Homo sapiens
ggccactgctctccagcctggg

SEQ ID NO: 8354798 - DNA, 23 bp, Homo sapiens
ggccactgaattttctgcatctt

SEQ ID NO: 8354799 - DNA, 22 bp, Homo sapiens
ggccactgacctacatctgggg

SEQ ID NO: 8354800 - DNA, 22 bp, Homo sapiens
cacatagataggcagaagaaca

SEQ ID NO: 8354801 - DNA, 22 bp, Homo sapiens
cacatttaattggtttagggtg

SEQ ID NO: 8354802 - DNA, 22 bp, Homo sapiens
cacatttacatataaaactttc

SEQ ID NO: 8354803 - DNA, 22 bp, Homo sapiens
cacatttacatataaaactttc

SEQ ID NO: 8354804 - DNA, 22 bp, Homo sapiens
cacatttagaggttagcatggt

SEQ ID NO: 8354805 - DNA, 22 bp, Homo sapiens
cacatttacttttatcccttgg

SEQ ID NO: 8354806 - DNA, 22 bp, Homo sapiens
cacatttacttttatcccttgg

SEQ ID NO: 8354807 - DNA, 22 bp, Homo sapiens
cacatttaggttcctatagcca

SEQ ID NO: 8354808 - DNA, 22 bp, Homo sapiens
cacatacttgtgtgtacatatg

SEQ ID NO: 8354809 - DNA, 22 bp, Homo sapiens
cacagttttgtcttggtttcca

SEQ ID NO: 8354810 - DNA, 22 bp, Homo sapiens
cacagttttgtcttggtttcca

SEQ ID NO: 8354811 - DNA, 22 bp, Homo sapiens
cacagttttgtcttggtttcca

SEQ ID NO: 8354812 - DNA, 22 bp, Homo sapiens
cacagttttgcccagggcttct

SEQ ID NO: 8354813 - DNA, 22 bp, Homo sapiens
cacataagtgggttccattgca

SEQ ID NO: 8354814 - DNA, 22 bp, Homo sapiens
cacataattgaacgtgatgagt

SEQ ID NO: 8354815 - DNA, 22 bp, Homo sapiens
cacataatacatgttccactta

SEQ ID NO: 8354816 - DNA, 22 bp, Homo sapiens
ggaggtgctgatcccagtcaac

SEQ ID NO: 8354817 - DNA, 22 bp, Homo sapiens
cacagtttggttttgctgtaat

SEQ ID NO: 8354818 - DNA, 22 bp, Homo sapiens
cacagtttggttttgctgtaat

SEQ ID NO: 8354819 - DNA, 22 bp, Homo sapiens
cacagttttatcttatactgat

SEQ ID NO: 8354820 - DNA, 22 bp, Homo sapiens
cacagttttatcttatactgat

SEQ ID NO: 8354821 - DNA, 22 bp, Homo sapiens
cagcagctgggaaggaggctga

SEQ ID NO: 8354822 - DNA, 22 bp, Homo sapiens
cagcaccctttccactgccttg

SEQ ID NO: 8354823 - DNA, 22 bp, Homo sapiens
cagcaggacatggaggagtaaa

SEQ ID NO: 8354824 - DNA, 22 bp, Homo sapiens
gtcataaagacagaaacattcc

SEQ ID NO: 8354825 - DNA, 22 bp, Homo sapiens
cagcaggaaagacatctgagca

SEQ ID NO: 8354826 - DNA, 20 bp, Homo sapiens
cagcaggaaaagtgcctcag

SEQ ID NO: 8354827 - DNA, 20 bp, Homo sapiens
cagcaggaaaagtgcctcag

SEQ ID NO: 8354828 - DNA, 22 bp, Homo sapiens
gtcatatacactgcatgtaatc

SEQ ID NO: 8354829 - DNA, 20 bp, Homo sapiens
gtcatcgccggcagcaaaga

SEQ ID NO: 8354830 - DNA, 22 bp, Homo sapiens
gtcatcatttttagcatatggg

SEQ ID NO: 8354831 - DNA, 22 bp, Homo sapiens
gtcatgcctggcttcttagaca

SEQ ID NO: 8354832 - DNA, 22 bp, Homo sapiens
gtcatgccagcggagctcggga

SEQ ID NO: 8354833 - DNA, 22 bp, Homo sapiens
gtcatgcatgggctctgaagaa

SEQ ID NO: 8354834 - DNA, 22 bp, Homo sapiens
gtcatctctgtgaatgaggcag

SEQ ID NO: 8354835 - DNA, 22 bp, Homo sapiens
gtcattatctacagaagtgtgt

SEQ ID NO: 8354836 - DNA, 22 bp, Homo sapiens
cagcaggcggcccgcgggcccg

SEQ ID NO: 8354837 - DNA, 22 bp, Homo sapiens
cagcaggctctgagtggctgcc

SEQ ID NO: 8354838 - DNA, 22 bp, Homo sapiens
gtcccaggcagagtcaggaggg

SEQ ID NO: 8354839 - DNA, 22 bp, Homo sapiens
gtcccagatgtctggaactccc

SEQ ID NO: 8354840 - DNA, 22 bp, Homo sapiens
cagccctcaggtcctcagcagc

SEQ ID NO: 8354841 - DNA, 22 bp, Homo sapiens
gtctgtcctgtacccagcatct

SEQ ID NO: 8354842 - DNA, 22 bp, Homo sapiens
gtctgtccttccgactgtagct

SEQ ID NO: 8354843 - DNA, 22 bp, Homo sapiens
cagccccttcctggcatctgga

SEQ ID NO: 8354844 - DNA, 22 bp, Homo sapiens
cagccctcaaaccacttccagg

SEQ ID NO: 8354845 - DNA, 22 bp, Homo sapiens
cagccagggagggcaaatgaga

SEQ ID NO: 8354846 - DNA, 22 bp, Homo sapiens
cagccaggtatgggcgtgcggg

SEQ ID NO: 8354847 - DNA, 22 bp, Homo sapiens
cagccaggtatgggcgtgcggg

SEQ ID NO: 8354848 - DNA, 22 bp, Homo sapiens
gtccctgggtctaaggcagtaa

SEQ ID NO: 8354849 - DNA, 22 bp, Homo sapiens
gtccctgggggtttaggactca

SEQ ID NO: 8354850 - DNA, 22 bp, Homo sapiens
gtccctggtctaccgtggcttc

SEQ ID NO: 8354851 - DNA, 22 bp, Homo sapiens
gtccctggtctaccgtggcttc

SEQ ID NO: 8354852 - DNA, 19 bp, Homo sapiens
gtcccttcactcctgctgg

SEQ ID NO: 8354853 - DNA, 22 bp, Homo sapiens
gtcccttcctcattccacttta

SEQ ID NO: 8354854 - DNA, 22 bp, Homo sapiens
gtctgcttttctgaattgcctg

SEQ ID NO: 8354855 - DNA, 22 bp, Homo sapiens
gtccctgggatgcccttctggg

SEQ ID NO: 8354856 - DNA, 22 bp, Homo sapiens
gtccctggggaatcagctggag

SEQ ID NO: 8354857 - DNA, 22 bp, Homo sapiens
gtccctgggcgcctccgtgctc

SEQ ID NO: 8354858 - DNA, 22 bp, Homo sapiens
gtccctggggaatcagctggag

SEQ ID NO: 8354859 - DNA, 22 bp, Homo sapiens
gtctggagagctgagcagagtt

SEQ ID NO: 8354860 - DNA, 22 bp, Homo sapiens
gtctggagccactgctgctgct

SEQ ID NO: 8354861 - DNA, 22 bp, Homo sapiens
cagccagggagcaaagagttga

SEQ ID NO: 8354862 - DNA, 22 bp, Homo sapiens
cagccaggcctggtgaccaaag

SEQ ID NO: 8354863 - DNA, 20 bp, Homo sapiens
gtgcccagttggtgacagac

SEQ ID NO: 8354864 - DNA, 22 bp, Homo sapiens
gtgctgtgcgctttttctgtat

SEQ ID NO: 8354865 - DNA, 22 bp, Homo sapiens
cagccctgctgacactgtctga

SEQ ID NO: 8354866 - DNA, 22 bp, Homo sapiens
cagccctgccatggagcctcct

SEQ ID NO: 8354867 - DNA, 17 bp, Homo sapiens
cagccctgccgttccca

SEQ ID NO: 8354868 - DNA, 22 bp, Homo sapiens
cagccctgccatggagcctcct

SEQ ID NO: 8354869 - DNA, 22 bp, Homo sapiens
cagccctgcagccatggcctgt

SEQ ID NO: 8354870 - DNA, 22 bp, Homo sapiens
cagccctgcagagggcgctcct

SEQ ID NO: 8354871 - DNA, 22 bp, Homo sapiens
cagcctctttccacatcaggca

SEQ ID NO: 8354872 - DNA, 22 bp, Homo sapiens
cagcctgcaggaggccgtcagc

SEQ ID NO: 8354873 - DNA, 23 bp, Homo sapiens
cagccctggagatgtgggaggca

SEQ ID NO: 8354874 - DNA, 22 bp, Homo sapiens
cagccctgcttccccgctagtt

SEQ ID NO: 8354875 - DNA, 22 bp, Homo sapiens
cagctagaaagtctgttaggga

SEQ ID NO: 8354876 - DNA, 22 bp, Homo sapiens
cagctagctaagaaggccagag

SEQ ID NO: 8354877 - DNA, 22 bp, Homo sapiens
cagctagaaatgggattggtat

SEQ ID NO: 8354878 - DNA, 22 bp, Homo sapiens
cagcctgggctccagagtccct

SEQ ID NO: 8354879 - DNA, 22 bp, Homo sapiens
cagcctggcctgggactgctga

SEQ ID NO: 8354880 - DNA, 22 bp, Homo sapiens
cagcctgggctccagagtccct

SEQ ID NO: 8354881 - DNA, 21 bp, Homo sapiens
cagaccctctagaggccacct

SEQ ID NO: 8354882 - DNA, 22 bp, Homo sapiens
cagactgagggcatcacatacg

SEQ ID NO: 8354883 - DNA, 22 bp, Homo sapiens
gggcagagaaatggacagttgg

SEQ ID NO: 8354884 - DNA, 22 bp, Homo sapiens
cagacctgaggagcactgagcc

SEQ ID NO: 8354885 - DNA, 20 bp, Homo sapiens
cagacctgcacccacttcga

SEQ ID NO: 8354886 - DNA, 19 bp, Homo sapiens
cagacctgtccagcctgtg

SEQ ID NO: 8354887 - DNA, 22 bp, Homo sapiens
gggcagtgggtggctgcagcct

SEQ ID NO: 8354888 - DNA, 19 bp, Homo sapiens
gggcagtggcactagggag

SEQ ID NO: 8354889 - DNA, 22 bp, Homo sapiens
gggcagtggctcacgcctgtaa

SEQ ID NO: 8354890 - DNA, 22 bp, Homo sapiens
gggcagtggctcacgcctgtaa

SEQ ID NO: 8354891 - DNA, 22 bp, Homo sapiens
gggcagtgggaccaggcaccag

SEQ ID NO: 8354892 - DNA, 22 bp, Homo sapiens
gggcagcatcaggaggggcttt

SEQ ID NO: 8354893 - DNA, 22 bp, Homo sapiens
gggcagcataacaatcactgaa

SEQ ID NO: 8354894 - DNA, 22 bp, Homo sapiens
gggcagcattctgtgggcaggt

SEQ ID NO: 8354895 - DNA, 22 bp, Homo sapiens
gggcagcattctgtgggcaggt

SEQ ID NO: 8354896 - DNA, 22 bp, Homo sapiens
gggccagcagtatcggaggcat

SEQ ID NO: 8354897 - DNA, 22 bp, Homo sapiens
gggctctgcgggcccggactcc

SEQ ID NO: 8354898 - DNA, 22 bp, Homo sapiens
gggctctgcgggcccggactcc

SEQ ID NO: 8354899 - DNA, 22 bp, Homo sapiens
gggccagcctactgctagaccc

SEQ ID NO: 8354900 - DNA, 20 bp, Homo sapiens
gggctctgcttggcagaagt

SEQ ID NO: 8354901 - DNA, 22 bp, Homo sapiens
gggctctgtgttctagctctcg

SEQ ID NO: 8354902 - DNA, 22 bp, Homo sapiens
gggccagagcacagaggatgtt

SEQ ID NO: 8354903 - DNA, 22 bp, Homo sapiens
gggccactcagattgtcccctt

SEQ ID NO: 8354904 - DNA, 22 bp, Homo sapiens
gggccactgggtcctgctggcc

SEQ ID NO: 8354905 - DNA, 22 bp, Homo sapiens
gggccactcctggctgctgagt

SEQ ID NO: 8354906 - DNA, 22 bp, Homo sapiens
gggcagtgtcggggcccaggga

SEQ ID NO: 8354907 - DNA, 22 bp, Homo sapiens
gggcagtgtcgaggtctggtcc

SEQ ID NO: 8354908 - DNA, 22 bp, Homo sapiens
gggcagtgtcgaggtctggtcc

SEQ ID NO: 8354909 - DNA, 22 bp, Homo sapiens
gggcagtgtctggcccccaggc

SEQ ID NO: 8354910 - DNA, 22 bp, Homo sapiens
gggcagtgtcggggcccaggga

SEQ ID NO: 8354911 - DNA, 22 bp, Homo sapiens
gggctgacaccacccaggcgca

SEQ ID NO: 8354912 - DNA, 22 bp, Homo sapiens
gggctgacaccacccaggcgca

SEQ ID NO: 8354913 - DNA, 22 bp, Homo sapiens
gggctgacatatttggtgctct

SEQ ID NO: 8354914 - DNA, 22 bp, Homo sapiens
gggctctgtttagatcagagat

SEQ ID NO: 8354915 - DNA, 22 bp, Homo sapiens
gggctctgtttagaccagagat

SEQ ID NO: 8354916 - DNA, 22 bp, Homo sapiens
gggctgacgaaggccatgtgtg

SEQ ID NO: 8354917 - DNA, 22 bp, Homo sapiens
cagagcctccctcctctgccat

SEQ ID NO: 8354918 - DNA, 22 bp, Homo sapiens
cagagctgggtttgggaaacct

SEQ ID NO: 8354919 - DNA, 22 bp, Homo sapiens
cagagctggctctgcatgtaca

SEQ ID NO: 8354920 - DNA, 22 bp, Homo sapiens
cagagctggctctgcatgtaca

SEQ ID NO: 8354921 - DNA, 23 bp, Homo sapiens
cagagctggctcagagctgcctg

SEQ ID NO: 8354922 - DNA, 22 bp, Homo sapiens
cagagctgcttcccagtttgtg

SEQ ID NO: 8354923 - DNA, 22 bp, Homo sapiens
cagagcctctcagccccttggg

SEQ ID NO: 8354924 - DNA, 22 bp, Homo sapiens
gggctgaggggtatctcatggg

SEQ ID NO: 8354925 - DNA, 22 bp, Homo sapiens
cagaggattatttcagaatcta

SEQ ID NO: 8354926 - DNA, 22 bp, Homo sapiens
cagaggagttcagtacacagcc

SEQ ID NO: 8354927 - DNA, 22 bp, Homo sapiens
ggggagcaggctgggctgtctg

SEQ ID NO: 8354928 - DNA, 22 bp, Homo sapiens
cagaggcacaagaaagcaaggc

SEQ ID NO: 8354929 - DNA, 22 bp, Homo sapiens
cagaggcacaagaaagcaaggc

SEQ ID NO: 8354930 - DNA, 22 bp, Homo sapiens
cagagggaaaaggggagtaata

SEQ ID NO: 8354931 - DNA, 22 bp, Homo sapiens
cagaggctttgccctggaaacc

SEQ ID NO: 8354932 - DNA, 22 bp, Homo sapiens
cagagggtcaccaggaagtgca

SEQ ID NO: 8354933 - DNA, 23 bp, Homo sapiens
cagagggttccatggagcatggt

SEQ ID NO: 8354934 - DNA, 22 bp, Homo sapiens
cagagggtgtgaaggggatgaa

SEQ ID NO: 8354935 - DNA, 22 bp, Homo sapiens
cagaggggataacaggtgtaga

SEQ ID NO: 8354936 - DNA, 19 bp, Homo sapiens
cagagtccttgaccagtcc

SEQ ID NO: 8354937 - DNA, 22 bp, Homo sapiens
cagagtcctgcaccagctccag

SEQ ID NO: 8354938 - DNA, 22 bp, Homo sapiens
cagagtccaattgctcagagcg

SEQ ID NO: 8354939 - DNA, 22 bp, Homo sapiens
cagagtccccagcggcgcgggc

SEQ ID NO: 8354940 - DNA, 22 bp, Homo sapiens
cagagtcccagatgcccctcct

SEQ ID NO: 8354941 - DNA, 22 bp, Homo sapiens
ggtccaaggctcggtggcgggg

SEQ ID NO: 8354942 - DNA, 22 bp, Homo sapiens
ggtcattgttcttttctgtgat

SEQ ID NO: 8354943 - DNA, 22 bp, Homo sapiens
ggtcattgaaatcagaagggtt

SEQ ID NO: 8354944 - DNA, 22 bp, Homo sapiens
ggtcattgtcagagcctgtact

SEQ ID NO: 8354945 - DNA, 23 bp, Homo sapiens
ggtccacccgagcctgcagcttc

SEQ ID NO: 8354946 - DNA, 22 bp, Homo sapiens
ggtccacctccaagctggggac

SEQ ID NO: 8354947 - DNA, 22 bp, Homo sapiens
ggtcatgctgtgaatcagtgct

SEQ ID NO: 8354948 - DNA, 22 bp, Homo sapiens
ggtcatcttgaatttccattct

SEQ ID NO: 8354949 - DNA, 21 bp, Homo sapiens
cagagggtttctcaggtgttt

SEQ ID NO: 8354950 - DNA, 21 bp, Homo sapiens
cagagggtttctcaggtgttt

SEQ ID NO: 8354951 - DNA, 22 bp, Homo sapiens
cagagggttgatgtgaggctta

SEQ ID NO: 8354952 - DNA, 22 bp, Homo sapiens
ggtcacaggggagaagagtgat

SEQ ID NO: 8354953 - DNA, 22 bp, Homo sapiens
ggtctgcgatggcaagggtctt

SEQ ID NO: 8354954 - DNA, 22 bp, Homo sapiens
ggtctgctttccttgccactgt

SEQ ID NO: 8354955 - DNA, 22 bp, Homo sapiens
ggtctgccctgggtggaggcgc

SEQ ID NO: 8354956 - DNA, 22 bp, Homo sapiens
ggtgacagttccggaggtacag

SEQ ID NO: 8354957 - DNA, 21 bp, Homo sapiens
cagcaagacatgtttatcaag

SEQ ID NO: 8354958 - DNA, 22 bp, Homo sapiens
cagcaagacttcagggcttggt

SEQ ID NO: 8354959 - DNA, 22 bp, Homo sapiens
cagcaagagaggcagggcaaat

SEQ ID NO: 8354960 - DNA, 22 bp, Homo sapiens
cagcacatttactcagccctca

SEQ ID NO: 8354961 - DNA, 22 bp, Homo sapiens
cagcaccatttgcagcctcttt

SEQ ID NO: 8354962 - DNA, 22 bp, Homo sapiens
cagcacatctccaagaatttct

SEQ ID NO: 8354963 - DNA, 21 bp, Homo sapiens
cagcacagtactgggtcttgc

SEQ ID NO: 8354964 - DNA, 22 bp, Homo sapiens
ggtgctgctgctgaacccagct

SEQ ID NO: 8354965 - DNA, 22 bp, Homo sapiens
ggtgctgatttgttgctgagat

SEQ ID NO: 8354966 - DNA, 22 bp, Homo sapiens
ggtgctgactctgtcgtgagca

SEQ ID NO: 8354967 - DNA, 18 bp, Homo sapiens
atggtctcatactgggag

SEQ ID NO: 8354968 - DNA, 21 bp, Homo sapiens
atggtctgaggatagcaaaaa

SEQ ID NO: 8354969 - DNA, 22 bp, Homo sapiens
atggtgaagcttcatgggtgtt

SEQ ID NO: 8354970 - DNA, 22 bp, Homo sapiens
gaggagaagctattggaaggac

SEQ ID NO: 8354971 - DNA, 22 bp, Homo sapiens
gaggagaagctattggaaggac

SEQ ID NO: 8354972 - DNA, 22 bp, Homo sapiens
gaggcagcctcagtggacctcg

SEQ ID NO: 8354973 - DNA, 22 bp, Homo sapiens
gaggcagcatctatggtgggaa

SEQ ID NO: 8354974 - DNA, 22 bp, Homo sapiens
gaggcagcatggtaccttggag

SEQ ID NO: 8354975 - DNA, 22 bp, Homo sapiens
gaggcagcatctatggtgggaa

SEQ ID NO: 8354976 - DNA, 22 bp, Homo sapiens
gaggcagcatctatggtgggaa

SEQ ID NO: 8354977 - DNA, 22 bp, Homo sapiens
gaggcagcagggctggttcctt

SEQ ID NO: 8354978 - DNA, 22 bp, Homo sapiens
atggggctagacaaccagtgcc

SEQ ID NO: 8354979 - DNA, 22 bp, Homo sapiens
atggggagagaagggctgagct

SEQ ID NO: 8354980 - DNA, 22 bp, Homo sapiens
atgggcagggcagtgtataaga

SEQ ID NO: 8354981 - DNA, 18 bp, Homo sapiens
atgggcaggtaagatcca

SEQ ID NO: 8354982 - DNA, 22 bp, Homo sapiens
atgggcaggcctctcatttctg

SEQ ID NO: 8354983 - DNA, 22 bp, Homo sapiens
atgggacaggcatgggacttag

SEQ ID NO: 8354984 - DNA, 22 bp, Homo sapiens
atggctggcatccaggtgggct

SEQ ID NO: 8354985 - DNA, 22 bp, Homo sapiens
atggagggaaaagtggagagcc

SEQ ID NO: 8354986 - DNA, 22 bp, Homo sapiens
atggagggaaaagtggagagcc

SEQ ID NO: 8354987 - DNA, 18 bp, Homo sapiens
atggaggcagagagctga

SEQ ID NO: 8354988 - DNA, 22 bp, Homo sapiens
atggaggatgtgcagcatgggc

SEQ ID NO: 8354989 - DNA, 17 bp, Homo sapiens
atggaggcagacaggtc

SEQ ID NO: 8354990 - DNA, 22 bp, Homo sapiens
gagagtcactgtctgcatttcc

SEQ ID NO: 8354991 - DNA, 22 bp, Homo sapiens
gagacatggcaaaagcactggt

SEQ ID NO: 8354992 - DNA, 22 bp, Homo sapiens
gagagcagactctcaaagctgg

SEQ ID NO: 8354993 - DNA, 22 bp, Homo sapiens
gatatcagagacttggctacca

SEQ ID NO: 8354994 - DNA, 22 bp, Homo sapiens
gatatgaagtggcattgtgaag

SEQ ID NO: 8354995 - DNA, 22 bp, Homo sapiens
gatacaagactaataggaaaca

SEQ ID NO: 8354996 - DNA, 22 bp, Homo sapiens
gatacacaaaagtctagtgagg

SEQ ID NO: 8354997 - DNA, 22 bp, Homo sapiens
gataatttgatacctcaatcag

SEQ ID NO: 8354998 - DNA, 22 bp, Homo sapiens
gataatattagaagatacaaat

SEQ ID NO: 8354999 - DNA, 22 bp, Homo sapiens
gagttccttctgcctcagcttg

SEQ ID NO: 8355000 - DNA, 22 bp, Homo sapiens
atgtttaaatttatagacagtg

SEQ ID NO: 8355001 - DNA, 22 bp, Homo sapiens
atgtttaaaggagtcagagact

SEQ ID NO: 8355002 - DNA, 22 bp, Homo sapiens
atgttgttttttcataaagtat

SEQ ID NO: 8355003 - DNA, 22 bp, Homo sapiens
atgttgttttttcataaagtat

SEQ ID NO: 8355004 - DNA, 22 bp, Homo sapiens
atgttgtagcatatgaaatata

SEQ ID NO: 8355005 - DNA, 22 bp, Homo sapiens
atgttgtactgagaattaggag

SEQ ID NO: 8355006 - DNA, 22 bp, Homo sapiens
atgttggagtcgtaaggcatgg

SEQ ID NO: 8355007 - DNA, 22 bp, Homo sapiens
gaggtggccaagcgaggaaggg

SEQ ID NO: 8355008 - DNA, 22 bp, Homo sapiens
gaggtggccaagcgaggaaggg

SEQ ID NO: 8355009 - DNA, 22 bp, Homo sapiens
gaggtggcactgtgaggagcac

SEQ ID NO: 8355010 - DNA, 22 bp, Homo sapiens
gaggtggcactgtgaggagcac

SEQ ID NO: 8355011 - DNA, 22 bp, Homo sapiens
gaggtggcactgtgaggagcac

SEQ ID NO: 8355012 - DNA, 22 bp, Homo sapiens
atgttcttccttcaatttggaa

SEQ ID NO: 8355013 - DNA, 22 bp, Homo sapiens
atgttcttctatctttattaaa

SEQ ID NO: 8355014 - DNA, 20 bp, Homo sapiens
atgttcttcatttaatgttc

SEQ ID NO: 8355015 - DNA, 22 bp, Homo sapiens
atgttattttggaaaatacaaa

SEQ ID NO: 8355016 - DNA, 22 bp, Homo sapiens
atgttctgcctccattttgagt

SEQ ID NO: 8355017 - DNA, 22 bp, Homo sapiens
atgttctgtttcttaatcttga

SEQ ID NO: 8355018 - DNA, 22 bp, Homo sapiens
gagggcgcttcagagagatgaa

SEQ ID NO: 8355019 - DNA, 22 bp, Homo sapiens
gaggtagggcagaggctgaatg

SEQ ID NO: 8355020 - DNA, 20 bp, Homo sapiens
gaggtagggcttaaggcaag

SEQ ID NO: 8355021 - DNA, 22 bp, Homo sapiens
atgtgagaactcaggaaatact

SEQ ID NO: 8355022 - DNA, 22 bp, Homo sapiens
atgtgaaatattaagccgagga

SEQ ID NO: 8355023 - DNA, 22 bp, Homo sapiens
gagggctgaagattgtggcccc

SEQ ID NO: 8355024 - DNA, 22 bp, Homo sapiens
atgtgaaactgaagcatccata

SEQ ID NO: 8355025 - DNA, 22 bp, Homo sapiens
atgtgaaagaggtgttcagtgg

SEQ ID NO: 8355026 - DNA, 22 bp, Homo sapiens
atgtccttccattttgatctgt

SEQ ID NO: 8355027 - DNA, 22 bp, Homo sapiens
atgtagaatggtgattggcagg

SEQ ID NO: 8355028 - DNA, 22 bp, Homo sapiens
atgtagaagtgggcattataga

SEQ ID NO: 8355029 - DNA, 22 bp, Homo sapiens
atgtagaaataatttcagttcc

SEQ ID NO: 8355030 - DNA, 22 bp, Homo sapiens
gaggcagcggctcacagagaaa

SEQ ID NO: 8355031 - DNA, 22 bp, Homo sapiens
atgtagaattccttctactttg

SEQ ID NO: 8355032 - DNA, 22 bp, Homo sapiens
gacatttatgaaggagatatgc

SEQ ID NO: 8355033 - DNA, 22 bp, Homo sapiens
gacataaatgaagtttgactat

SEQ ID NO: 8355034 - DNA, 22 bp, Homo sapiens
gacatttattggattttacgag

SEQ ID NO: 8355035 - DNA, 22 bp, Homo sapiens
gacatttatgaaggagatatgc

SEQ ID NO: 8355036 - DNA, 22 bp, Homo sapiens
gacatttattagaaaactatca

SEQ ID NO: 8355037 - DNA, 22 bp, Homo sapiens
gaccacagaagccttgataggg

SEQ ID NO: 8355038 - DNA, 22 bp, Homo sapiens
gaccacagcagtgcaagaggag

SEQ ID NO: 8355039 - DNA, 19 bp, Homo sapiens
gacaattagagatcactca

SEQ ID NO: 8355040 - DNA, 22 bp, Homo sapiens
gacacagtttttctcacggtgg

SEQ ID NO: 8355041 - DNA, 22 bp, Homo sapiens
gacacatatgcgtatagtttag

SEQ ID NO: 8355042 - DNA, 22 bp, Homo sapiens
gacacccttcctcctgaggcta

SEQ ID NO: 8355043 - DNA, 22 bp, Homo sapiens
gacggagctggttgctgcggct

SEQ ID NO: 8355044 - DNA, 22 bp, Homo sapiens
gacggggcagccagctggtggc

SEQ ID NO: 8355045 - DNA, 22 bp, Homo sapiens
gacgggtgtatgctcccagcca

SEQ ID NO: 8355046 - DNA, 19 bp, Homo sapiens
gactaaataaactctcccc

SEQ ID NO: 8355047 - DNA, 19 bp, Homo sapiens
gactaaataataatagcag

SEQ ID NO: 8355048 - DNA, 22 bp, Homo sapiens
gactaaataaaagccaaacttc

SEQ ID NO: 8355049 - DNA, 22 bp, Homo sapiens
gactaaatcagacttttccaaa

SEQ ID NO: 8355050 - DNA, 22 bp, Homo sapiens
gactaaatgctttgtgcatgca

SEQ ID NO: 8355051 - DNA, 22 bp, Homo sapiens
gactaaattcctgttcgcgatg

SEQ ID NO: 8355052 - DNA, 22 bp, Homo sapiens
gactggagcccccaaggacacc

SEQ ID NO: 8355053 - DNA, 22 bp, Homo sapiens
gactggagtgcctccaggaaag

SEQ ID NO: 8355054 - DNA, 22 bp, Homo sapiens
gactggagtcaatgagcagcac

SEQ ID NO: 8355055 - DNA, 22 bp, Homo sapiens
gactggagtcaatgagcagcac

SEQ ID NO: 8355056 - DNA, 21 bp, Homo sapiens
gactggagagaggaagtctgg

SEQ ID NO: 8355057 - DNA, 17 bp, Homo sapiens
atgctctatagtcagtg

SEQ ID NO: 8355058 - DNA, 22 bp, Homo sapiens
gaccctggagttagtcctgtgt

SEQ ID NO: 8355059 - DNA, 22 bp, Homo sapiens
atgctccagtgtgatgcttcat

SEQ ID NO: 8355060 - DNA, 20 bp, Homo sapiens
atgctcgtcccactaagctc

SEQ ID NO: 8355061 - DNA, 22 bp, Homo sapiens
atgctcacttcagagaagatga

SEQ ID NO: 8355062 - DNA, 22 bp, Homo sapiens
gaatcagatgcggtttagctta

SEQ ID NO: 8355063 - DNA, 22 bp, Homo sapiens
gaatcagataataagcaagcat

SEQ ID NO: 8355064 - DNA, 22 bp, Homo sapiens
gaatcagaatctgcatttttaa

SEQ ID NO: 8355065 - DNA, 22 bp, Homo sapiens
gaatcagaatctgcatgttaag

SEQ ID NO: 8355066 - DNA, 22 bp, Homo sapiens
gaatcacggtattctgcacggg

SEQ ID NO: 8355067 - DNA, 22 bp, Homo sapiens
gaatcagaatctctaaggtggg

SEQ ID NO: 8355068 - DNA, 22 bp, Homo sapiens
gaatattttcagtacagatggt

SEQ ID NO: 8355069 - DNA, 22 bp, Homo sapiens
gaatatttttaaagggactaat

SEQ ID NO: 8355070 - DNA, 22 bp, Homo sapiens
gaatacaaagcagaactcatac

SEQ ID NO: 8355071 - DNA, 22 bp, Homo sapiens
gaatacaaagcagaactcatac

SEQ ID NO: 8355072 - DNA, 22 bp, Homo sapiens
gaataatattgactttgcaggc

SEQ ID NO: 8355073 - DNA, 22 bp, Homo sapiens
gaacaatagtggtaacaaagcc

SEQ ID NO: 8355074 - DNA, 22 bp, Homo sapiens
gaacaagtttccaaattataac

SEQ ID NO: 8355075 - DNA, 22 bp, Homo sapiens
gaaggctggctttctgagagca

SEQ ID NO: 8355076 - DNA, 22 bp, Homo sapiens
gaaggctggccattccccattc

SEQ ID NO: 8355077 - DNA, 22 bp, Homo sapiens
gaaggctgctgggaagtgtggt

SEQ ID NO: 8355078 - DNA, 22 bp, Homo sapiens
gaaggctgtcagagaggagggc

SEQ ID NO: 8355079 - DNA, 22 bp, Homo sapiens
gaaggctgtttctggtagtgat

SEQ ID NO: 8355080 - DNA, 22 bp, Homo sapiens
atgcacagacccaaaggccatc

SEQ ID NO: 8355081 - DNA, 22 bp, Homo sapiens
atgcacagcagtgagttcagtg

SEQ ID NO: 8355082 - DNA, 22 bp, Homo sapiens
atgcacagctgaacactctaaa

SEQ ID NO: 8355083 - DNA, 22 bp, Homo sapiens
atgcacaggacagcctctactc

SEQ ID NO: 8355084 - DNA, 22 bp, Homo sapiens
atgcacaggaagtgtccccatt

SEQ ID NO: 8355085 - DNA, 22 bp, Homo sapiens
atgcacacacattatgtctgtg

SEQ ID NO: 8355086 - DNA, 22 bp, Homo sapiens
atgcacagaaaaattgcttact

SEQ ID NO: 8355087 - DNA, 22 bp, Homo sapiens
ctttcaaagagtaggaggtttt

SEQ ID NO: 8355088 - DNA, 22 bp, Homo sapiens
ctttcaaagaccttggcatggg

SEQ ID NO: 8355089 - DNA, 22 bp, Homo sapiens
atctggctcacttagtctagga

SEQ ID NO: 8355090 - DNA, 22 bp, Homo sapiens
atctggctatttctggtcgggg

SEQ ID NO: 8355091 - DNA, 22 bp, Homo sapiens
atctggctcacctgggtaaata

SEQ ID NO: 8355092 - DNA, 22 bp, Homo sapiens
atctggctattgacatgttata

SEQ ID NO: 8355093 - DNA, 22 bp, Homo sapiens
atgaaacagtgaattagtcaag

SEQ ID NO: 8355094 - DNA, 22 bp, Homo sapiens
atgaaacagtgtgtatagcaaa

SEQ ID NO: 8355095 - DNA, 22 bp, Homo sapiens
atgaaacagtgtgtatagcaaa

SEQ ID NO: 8355096 - DNA, 22 bp, Homo sapiens
atgaaattcatctgagaatgct

SEQ ID NO: 8355097 - DNA, 22 bp, Homo sapiens
atgaacagaggaatagaattct

SEQ ID NO: 8355098 - DNA, 22 bp, Homo sapiens
atgaaacaaacctctatggagt

SEQ ID NO: 8355099 - DNA, 22 bp, Homo sapiens
atgaaaattgacagcggaagta

SEQ ID NO: 8355100 - DNA, 22 bp, Homo sapiens
atgaaaatactgtggttgatag

SEQ ID NO: 8355101 - DNA, 22 bp, Homo sapiens
atgaaaatgtacatgtgtataa

SEQ ID NO: 8355102 - DNA, 22 bp, Homo sapiens
ctttcttcaacctcattctgca

SEQ ID NO: 8355103 - DNA, 22 bp, Homo sapiens
ctttctgaagtttaagttctaa

SEQ ID NO: 8355104 - DNA, 22 bp, Homo sapiens
atgaacatgtgactcagacctg

SEQ ID NO: 8355105 - DNA, 23 bp, Homo sapiens
atgaacattagtttcagatattg

SEQ ID NO: 8355106 - DNA, 22 bp, Homo sapiens
gaaatagaggacagctggatca

SEQ ID NO: 8355107 - DNA, 22 bp, Homo sapiens
gaaatagtacagcatagttctt

SEQ ID NO: 8355108 - DNA, 19 bp, Homo sapiens
atgatacaggtgaaaattg

SEQ ID NO: 8355109 - DNA, 22 bp, Homo sapiens
atgatattttagtaaagtgata

SEQ ID NO: 8355110 - DNA, 18 bp, Homo sapiens
atgatcttagcaaatatt

SEQ ID NO: 8355111 - DNA, 22 bp, Homo sapiens
gaaagtgcagtcagacaaggca

SEQ ID NO: 8355112 - DNA, 22 bp, Homo sapiens
gaaatacagttgggaggaggta

SEQ ID NO: 8355113 - DNA, 22 bp, Homo sapiens
gaaatagaagctgccaatttct

SEQ ID NO: 8355114 - DNA, 22 bp, Homo sapiens
gaaatagacactttctatgaat

SEQ ID NO: 8355115 - DNA, 22 bp, Homo sapiens
gaaagtaacatttcttgaatta

SEQ ID NO: 8355116 - DNA, 20 bp, Homo sapiens
gaaacattggcagcaactga

SEQ ID NO: 8355117 - DNA, 22 bp, Homo sapiens
gaaacattgtgttctacagatt

SEQ ID NO: 8355118 - DNA, 22 bp, Homo sapiens
gaaacattcatatgagaaacct

SEQ ID NO: 8355119 - DNA, 22 bp, Homo sapiens
ctttcttcatctgtaatatgga

SEQ ID NO: 8355120 - DNA, 22 bp, Homo sapiens
gaaaatgttagcttcatagtca

SEQ ID NO: 8355121 - DNA, 22 bp, Homo sapiens
gaaacaggtggcaggctagatt

SEQ ID NO: 8355122 - DNA, 17 bp, Homo sapiens
atgacagcattaaggta

SEQ ID NO: 8355123 - DNA, 22 bp, Homo sapiens
atgacagcattttcttctaagg

SEQ ID NO: 8355124 - DNA, 22 bp, Homo sapiens
atgacagctctagcacacagta

SEQ ID NO: 8355125 - DNA, 22 bp, Homo sapiens
atgacagctctagcacacagta

SEQ ID NO: 8355126 - DNA, 22 bp, Homo sapiens
gaaaccacagtacccaggaaaa

SEQ ID NO: 8355127 - DNA, 22 bp, Homo sapiens
gaaacatttgttgagtacttgc

SEQ ID NO: 8355128 - DNA, 22 bp, Homo sapiens
gaaacatttgttgagtacttgc

SEQ ID NO: 8355129 - DNA, 22 bp, Homo sapiens
gaaagcagtatttagttctgtt

SEQ ID NO: 8355130 - DNA, 22 bp, Homo sapiens
gaaagcataactaatatttatt

SEQ ID NO: 8355131 - DNA, 22 bp, Homo sapiens
atgacagtgggtcttgcaaaga

SEQ ID NO: 8355132 - DNA, 22 bp, Homo sapiens
atgacagtactggtgacaatac

SEQ ID NO: 8355133 - DNA, 22 bp, Homo sapiens
atttggaaatgtaagaatgcaa

SEQ ID NO: 8355134 - DNA, 22 bp, Homo sapiens
atttggaacttataataagttt

SEQ ID NO: 8355135 - DNA, 22 bp, Homo sapiens
atttggaacttataataagttt

SEQ ID NO: 8355136 - DNA, 22 bp, Homo sapiens
atttggaactgggcatgcaaac

SEQ ID NO: 8355137 - DNA, 22 bp, Homo sapiens
gcctcttgtttccttacatgga

SEQ ID NO: 8355138 - DNA, 19 bp, Homo sapiens
gcctcacaggtctcaggcc

SEQ ID NO: 8355139 - DNA, 22 bp, Homo sapiens
gcccccgtagtagatgaggcgc

SEQ ID NO: 8355140 - DNA, 22 bp, Homo sapiens
gccccctaaaggtgtcctcatc

SEQ ID NO: 8355141 - DNA, 22 bp, Homo sapiens
gccccctcaaagaggaagctct

SEQ ID NO: 8355142 - DNA, 22 bp, Homo sapiens
gcccccaggcactacatgtgaa

SEQ ID NO: 8355143 - DNA, 22 bp, Homo sapiens
atttggaaaagtttcttcaact

SEQ ID NO: 8355144 - DNA, 22 bp, Homo sapiens
atttggaaacaattatattctt

SEQ ID NO: 8355145 - DNA, 22 bp, Homo sapiens
gccccctctttggagccagcca

SEQ ID NO: 8355146 - DNA, 22 bp, Homo sapiens
gcctggattccttgtttctcag

SEQ ID NO: 8355147 - DNA, 22 bp, Homo sapiens
gcctggagttgtggtgaagcca

SEQ ID NO: 8355148 - DNA, 22 bp, Homo sapiens
atttggaatgctagtgaatgta

SEQ ID NO: 8355149 - DNA, 22 bp, Homo sapiens
attttactactccaattaatga

SEQ ID NO: 8355150 - DNA, 22 bp, Homo sapiens
atttggaaggtttacaaagaga

SEQ ID NO: 8355151 - DNA, 22 bp, Homo sapiens
atttggaatagctgtagaaata

SEQ ID NO: 8355152 - DNA, 22 bp, Homo sapiens
atttggaagtttggagtgaagg

SEQ ID NO: 8355153 - DNA, 22 bp, Homo sapiens
atttggaagcatttccaaagca

SEQ ID NO: 8355154 - DNA, 22 bp, Homo sapiens
gcctgagattctgcatttctaa

SEQ ID NO: 8355155 - DNA, 22 bp, Homo sapiens
atttggaaggagctgcacagca

SEQ ID NO: 8355156 - DNA, 22 bp, Homo sapiens
atttggaagcttgaagattatt

SEQ ID NO: 8355157 - DNA, 22 bp, Homo sapiens
atttggaagcttgaagattatt

SEQ ID NO: 8355158 - DNA, 22 bp, Homo sapiens
gcctgagagtctgcatttctaa

SEQ ID NO: 8355159 - DNA, 22 bp, Homo sapiens
atttccagtgcactgaatagaa

SEQ ID NO: 8355160 - DNA, 22 bp, Homo sapiens
gccacaggtgggctctgggaaa

SEQ ID NO: 8355161 - DNA, 22 bp, Homo sapiens
gccacaggtactatgggagaga

SEQ ID NO: 8355162 - DNA, 22 bp, Homo sapiens
gcccacctaacctgctcacctt

SEQ ID NO: 8355163 - DNA, 22 bp, Homo sapiens
atttctcagttcctactgttta

SEQ ID NO: 8355164 - DNA, 22 bp, Homo sapiens
atttctgctctgacctgaaagt

SEQ ID NO: 8355165 - DNA, 22 bp, Homo sapiens
atttctggactgaaaaggaagt

SEQ ID NO: 8355166 - DNA, 22 bp, Homo sapiens
atttctggattttggatgctgc

SEQ ID NO: 8355167 - DNA, 22 bp, Homo sapiens
atttctgtaacttatgaaagtt

SEQ ID NO: 8355168 - DNA, 22 bp, Homo sapiens
atttctgtatcctgctgtcaga

SEQ ID NO: 8355169 - DNA, 22 bp, Homo sapiens
atttctgttgcttataaattac

SEQ ID NO: 8355170 - DNA, 22 bp, Homo sapiens
gcccccacaggcgggctcgggt

SEQ ID NO: 8355171 - DNA, 22 bp, Homo sapiens
atttccattatcatgacaaatt

SEQ ID NO: 8355172 - DNA, 22 bp, Homo sapiens
atttccatgtcggtattttata

SEQ ID NO: 8355173 - DNA, 22 bp, Homo sapiens
atttccatacacccatttctga

SEQ ID NO: 8355174 - DNA, 22 bp, Homo sapiens
atttccatacacccatttctga

SEQ ID NO: 8355175 - DNA, 22 bp, Homo sapiens
atttccatacacccatttctga

SEQ ID NO: 8355176 - DNA, 22 bp, Homo sapiens
atttccatacacccatttctga

SEQ ID NO: 8355177 - DNA, 22 bp, Homo sapiens
atttccatagagcgtctcacag

SEQ ID NO: 8355178 - DNA, 22 bp, Homo sapiens
atttccatgaagtttagttata

SEQ ID NO: 8355179 - DNA, 22 bp, Homo sapiens
atttccatgaaggcagatttta

SEQ ID NO: 8355180 - DNA, 22 bp, Homo sapiens
atttccatgaaggcagatttta

SEQ ID NO: 8355181 - DNA, 22 bp, Homo sapiens
caaagcagagaactgtctcatt

SEQ ID NO: 8355182 - DNA, 22 bp, Homo sapiens
caaagcagcctgcagtgtggac

SEQ ID NO: 8355183 - DNA, 22 bp, Homo sapiens
caaagcagcggattgggatagt

SEQ ID NO: 8355184 - DNA, 22 bp, Homo sapiens
caaagcaggaagaatattgaaa

SEQ ID NO: 8355185 - DNA, 21 bp, Homo sapiens
caaagccaggcaactctctcc

SEQ ID NO: 8355186 - DNA, 20 bp, Homo sapiens
caaagcagtaggataaaaat

SEQ ID NO: 8355187 - DNA, 22 bp, Homo sapiens
caaaattagggagtgagctgga

SEQ ID NO: 8355188 - DNA, 22 bp, Homo sapiens
caaaatagatgttaacctggaa

SEQ ID NO: 8355189 - DNA, 22 bp, Homo sapiens
caaaatagatgttaacctggaa

SEQ ID NO: 8355190 - DNA, 22 bp, Homo sapiens
atttttctctttccactgagat

SEQ ID NO: 8355191 - DNA, 22 bp, Homo sapiens
atttttgagctgtgaacatagc

SEQ ID NO: 8355192 - DNA, 22 bp, Homo sapiens
atttttgagctgtgaacatagc

SEQ ID NO: 8355193 - DNA, 22 bp, Homo sapiens
atttttgccctgcagtacataa

SEQ ID NO: 8355194 - DNA, 22 bp, Homo sapiens
attttttagaacctggcctgat

SEQ ID NO: 8355195 - DNA, 22 bp, Homo sapiens
attttagagaaacaaacgtagg

SEQ ID NO: 8355196 - DNA, 22 bp, Homo sapiens
attttagagctccaagtacagc

SEQ ID NO: 8355197 - DNA, 22 bp, Homo sapiens
attttgctttatgtaaatatgt

SEQ ID NO: 8355198 - DNA, 22 bp, Homo sapiens
attttacttcatttgaaatgcc

SEQ ID NO: 8355199 - DNA, 22 bp, Homo sapiens
attttgtttcctttggagtaga

SEQ ID NO: 8355200 - DNA, 22 bp, Homo sapiens
caaatagactctagaatttatt

SEQ ID NO: 8355201 - DNA, 22 bp, Homo sapiens
caaatggcaacaagaacactgg

SEQ ID NO: 8355202 - DNA, 22 bp, Homo sapiens
caaatggatacaggcaaacatt

SEQ ID NO: 8355203 - DNA, 22 bp, Homo sapiens
caaatactgagtttattttcaa

SEQ ID NO: 8355204 - DNA, 22 bp, Homo sapiens
caaatactgtactgaacactgt

SEQ ID NO: 8355205 - DNA, 22 bp, Homo sapiens
caaatagaactcacagacaaga

SEQ ID NO: 8355206 - DNA, 22 bp, Homo sapiens
caaatagaaggtactcagagaa

SEQ ID NO: 8355207 - DNA, 22 bp, Homo sapiens
caaatagaaggtactcagagaa

SEQ ID NO: 8355208 - DNA, 21 bp, Homo sapiens
caaaggactgtagctcactga

SEQ ID NO: 8355209 - DNA, 22 bp, Homo sapiens
caaaggaagctccttgatggcg

SEQ ID NO: 8355210 - DNA, 22 bp, Homo sapiens
caaatacaaatacgggcagctt

SEQ ID NO: 8355211 - DNA, 22 bp, Homo sapiens
gatttcccagaaaagtgatctc

SEQ ID NO: 8355212 - DNA, 22 bp, Homo sapiens
gatttccattttcaactcctgc

SEQ ID NO: 8355213 - DNA, 22 bp, Homo sapiens
gatttcctaatgtggatctctg

SEQ ID NO: 8355214 - DNA, 22 bp, Homo sapiens
gatttcccagcaaaagctggtt

SEQ ID NO: 8355215 - DNA, 22 bp, Homo sapiens
gatttcccagaaaagtgatctc

SEQ ID NO: 8355216 - DNA, 22 bp, Homo sapiens
gatttccctatagttttctctt

SEQ ID NO: 8355217 - DNA, 22 bp, Homo sapiens
gatttcctcactaacatccatc

SEQ ID NO: 8355218 - DNA, 22 bp, Homo sapiens
gatttcctagacatggggcaga

SEQ ID NO: 8355219 - DNA, 17 bp, Homo sapiens
gatttcctgaagttctt

SEQ ID NO: 8355220 - DNA, 22 bp, Homo sapiens
gatttccttgcatattggtaat

SEQ ID NO: 8355221 - DNA, 22 bp, Homo sapiens
gatttccttgcatattggtaat

SEQ ID NO: 8355222 - DNA, 22 bp, Homo sapiens
gatttctcaatcctagtactat

SEQ ID NO: 8355223 - DNA, 22 bp, Homo sapiens
gatttctctgcacccactcagg

SEQ ID NO: 8355224 - DNA, 22 bp, Homo sapiens
attagaaaaactcaagggctct

SEQ ID NO: 8355225 - DNA, 23 bp, Homo sapiens
attagaaaggctttctggtgaaa

SEQ ID NO: 8355226 - DNA, 21 bp, Homo sapiens
gatttcacttaccttcattta

SEQ ID NO: 8355227 - DNA, 22 bp, Homo sapiens
gatttcacgggaggtggctgga

SEQ ID NO: 8355228 - DNA, 22 bp, Homo sapiens
gatttcagtggctgtctcaaat

SEQ ID NO: 8355229 - DNA, 22 bp, Homo sapiens
gatttcagggtgtcttccagct

SEQ ID NO: 8355230 - DNA, 22 bp, Homo sapiens
attactatgatttgatcattac

SEQ ID NO: 8355231 - DNA, 22 bp, Homo sapiens
attacatatgttggcaacattt

SEQ ID NO: 8355232 - DNA, 22 bp, Homo sapiens
attacatatgttggcaacattt

SEQ ID NO: 8355233 - DNA, 22 bp, Homo sapiens
gatattctatgtagaatgagct

SEQ ID NO: 8355234 - DNA, 22 bp, Homo sapiens
gatattctacctgctgaccaag

SEQ ID NO: 8355235 - DNA, 22 bp, Homo sapiens
gatattctacctgctgaccaag

SEQ ID NO: 8355236 - DNA, 22 bp, Homo sapiens
gatattctggtgaaacctttgg

SEQ ID NO: 8355237 - DNA, 22 bp, Homo sapiens
gatattctggtgaaacctttgg

SEQ ID NO: 8355238 - DNA, 22 bp, Homo sapiens
gatattctattttagccagcta

SEQ ID NO: 8355239 - DNA, 22 bp, Homo sapiens
gatatttaactctcacaggtcc

SEQ ID NO: 8355240 - DNA, 22 bp, Homo sapiens
attacaatcgagagaaacaaat

SEQ ID NO: 8355241 - DNA, 22 bp, Homo sapiens
attaggtatgattctcatttca

SEQ ID NO: 8355242 - DNA, 22 bp, Homo sapiens
attaggaaattatatgtcctcc

SEQ ID NO: 8355243 - DNA, 22 bp, Homo sapiens
attaggaagtaagtatcacaag

SEQ ID NO: 8355244 - DNA, 22 bp, Homo sapiens
attcaactagtgattgtgttat

SEQ ID NO: 8355245 - DNA, 22 bp, Homo sapiens
attcaactagtgattgtgttat

SEQ ID NO: 8355246 - DNA, 21 bp, Homo sapiens
attcaactagatgattatttc

SEQ ID NO: 8355247 - DNA, 22 bp, Homo sapiens
attcaactatgtatagtcttct

SEQ ID NO: 8355248 - DNA, 22 bp, Homo sapiens
attcaactgtaaacttgttcac

SEQ ID NO: 8355249 - DNA, 22 bp, Homo sapiens
attcaagagcccatgtttcctg

SEQ ID NO: 8355250 - DNA, 22 bp, Homo sapiens
attcaacttataagatattaat

SEQ ID NO: 8355251 - DNA, 22 bp, Homo sapiens
attcaacttacaaaggagaaga

SEQ ID NO: 8355252 - DNA, 22 bp, Homo sapiens
attatttccttgctttgaggaa

SEQ ID NO: 8355253 - DNA, 23 bp, Homo sapiens
attcactcagtgagagggcagcc

SEQ ID NO: 8355254 - DNA, 22 bp, Homo sapiens
attcactgtggtgactgatata

SEQ ID NO: 8355255 - DNA, 22 bp, Homo sapiens
attcagaaagttgtcatatttg

SEQ ID NO: 8355256 - DNA, 22 bp, Homo sapiens
attcacatgcccaagcagcacc

SEQ ID NO: 8355257 - DNA, 22 bp, Homo sapiens
attcacattctagggccctact

SEQ ID NO: 8355258 - DNA, 22 bp, Homo sapiens
attcacaatagcagcttgcatg

SEQ ID NO: 8355259 - DNA, 22 bp, Homo sapiens
gcactagaatcccttcaagaag

SEQ ID NO: 8355260 - DNA, 22 bp, Homo sapiens
attcagttctaaggtcagtgcc

SEQ ID NO: 8355261 - DNA, 22 bp, Homo sapiens
gcagcagaggccctactctttg

SEQ ID NO: 8355262 - DNA, 20 bp, Homo sapiens
gcagcagacagacaggggac

SEQ ID NO: 8355263 - DNA, 22 bp, Homo sapiens
attcagaagctattcttagttc

SEQ ID NO: 8355264 - DNA, 22 bp, Homo sapiens
gcaggcctgcccagcaggatgg

SEQ ID NO: 8355265 - DNA, 22 bp, Homo sapiens
gcaggcctgtaatgaagggaca

SEQ ID NO: 8355266 - DNA, 22 bp, Homo sapiens
attgattgaagtaaaataacct

SEQ ID NO: 8355267 - DNA, 22 bp, Homo sapiens
attgcaaagaaatacatgctta

SEQ ID NO: 8355268 - DNA, 22 bp, Homo sapiens
attgattttcagactatgcgag

SEQ ID NO: 8355269 - DNA, 18 bp, Homo sapiens
gcagggctggacaagtca

SEQ ID NO: 8355270 - DNA, 22 bp, Homo sapiens
attctttaattcaattgaagga

SEQ ID NO: 8355271 - DNA, 19 bp, Homo sapiens
attcttgttaagtgtcatc

SEQ ID NO: 8355272 - DNA, 22 bp, Homo sapiens
attctttcatataaaggctcag

SEQ ID NO: 8355273 - DNA, 22 bp, Homo sapiens
attctttcaaggaatagttatt

SEQ ID NO: 8355274 - DNA, 22 bp, Homo sapiens
attctttagccagcaggtatat

SEQ ID NO: 8355275 - DNA, 22 bp, Homo sapiens
attcttggagcagtcaaagaag

SEQ ID NO: 8355276 - DNA, 22 bp, Homo sapiens
attcttgatatagatagttaat

SEQ ID NO: 8355277 - DNA, 19 bp, Homo sapiens
attcttcagcagtgagacc

SEQ ID NO: 8355278 - DNA, 19 bp, Homo sapiens
gcagctgcttgaaaagaaa

SEQ ID NO: 8355279 - DNA, 22 bp, Homo sapiens
gcagctggacccacacggctta

SEQ ID NO: 8355280 - DNA, 22 bp, Homo sapiens
attccttgcacatcagatagtt

SEQ ID NO: 8355281 - DNA, 23 bp, Homo sapiens
gcattctgatggttctctgtgat

SEQ ID NO: 8355282 - DNA, 22 bp, Homo sapiens
attgtcttctgtcttatagttc

SEQ ID NO: 8355283 - DNA, 22 bp, Homo sapiens
attgtcttctgtcttaggtgat

SEQ ID NO: 8355284 - DNA, 22 bp, Homo sapiens
attgtctgtactttaaaaatgt

SEQ ID NO: 8355285 - DNA, 22 bp, Homo sapiens
attgtctttccactgagaagtt

SEQ ID NO: 8355286 - DNA, 22 bp, Homo sapiens
attgtctttaaaaatatacaac

SEQ ID NO: 8355287 - DNA, 22 bp, Homo sapiens
attgtctttgtttaagggatac

SEQ ID NO: 8355288 - DNA, 21 bp, Homo sapiens
gccaagaacaagacagacatg

SEQ ID NO: 8355289 - DNA, 22 bp, Homo sapiens
gccacagggcagatgcgcagag

SEQ ID NO: 8355290 - DNA, 22 bp, Homo sapiens
gccaaattccttgaaaggtggg

SEQ ID NO: 8355291 - DNA, 22 bp, Homo sapiens
gccaactggctgatctcaaagc

SEQ ID NO: 8355292 - DNA, 22 bp, Homo sapiens
gcagtgtgtggtgagggctgcc

SEQ ID NO: 8355293 - DNA, 22 bp, Homo sapiens
gcagtgtgatgcttccagccac

SEQ ID NO: 8355294 - DNA, 22 bp, Homo sapiens
gcagtgtgacgctgttctccgt

SEQ ID NO: 8355295 - DNA, 22 bp, Homo sapiens
gcagtgcttgaagaggtggcca

SEQ ID NO: 8355296 - DNA, 20 bp, Homo sapiens
gcagtgctggtgcctctgct

SEQ ID NO: 8355297 - DNA, 22 bp, Homo sapiens
gcatagaaggttttggtatcaa

SEQ ID NO: 8355298 - DNA, 22 bp, Homo sapiens
gcatagaatttagagacaaaag

SEQ ID NO: 8355299 - DNA, 22 bp, Homo sapiens
gcatagaaggttttggtatcaa

SEQ ID NO: 8355300 - DNA, 22 bp, Homo sapiens
gcagtgtgtttggataacacac

SEQ ID NO: 8355301 - DNA, 22 bp, Homo sapiens
attgtcgcttatttaggtgctt

SEQ ID NO: 8355302 - DNA, 19 bp, Homo sapiens
gcatcaaagctgactcctg

SEQ ID NO: 8355303 - DNA, 22 bp, Homo sapiens
gcataggtcaagttaatgttat

SEQ ID NO: 8355304 - DNA, 22 bp, Homo sapiens
ccagctgctgtgcagggaggct

SEQ ID NO: 8355305 - DNA, 22 bp, Homo sapiens
ccagctgcccaagaggcatcct

SEQ ID NO: 8355306 - DNA, 22 bp, Homo sapiens
ccagctgctaacacaaaggagt

SEQ ID NO: 8355307 - DNA, 22 bp, Homo sapiens
ccagctctcttcaagcccactc

SEQ ID NO: 8355308 - DNA, 22 bp, Homo sapiens
ccagctgcaggggagcagtgga

SEQ ID NO: 8355309 - DNA, 20 bp, Homo sapiens
ccagctgcagttcttaatga

SEQ ID NO: 8355310 - DNA, 22 bp, Homo sapiens
tctgcttctcctacttcatggg

SEQ ID NO: 8355311 - DNA, 22 bp, Homo sapiens
tctcagagaacagttggtgctt

SEQ ID NO: 8355312 - DNA, 22 bp, Homo sapiens
tctcagagaaatgtgtcaccat

SEQ ID NO: 8355313 - DNA, 19 bp, Homo sapiens
tctcagactgtgcttctgt

SEQ ID NO: 8355314 - DNA, 22 bp, Homo sapiens
tctcagactatagtagagattc

SEQ ID NO: 8355315 - DNA, 22 bp, Homo sapiens
ccaggactcagtggggaaaggg

SEQ ID NO: 8355316 - DNA, 22 bp, Homo sapiens
tctggtcaagacatcctaacat

SEQ ID NO: 8355317 - DNA, 22 bp, Homo sapiens
tctggtcagtctccattctacc

SEQ ID NO: 8355318 - DNA, 22 bp, Homo sapiens
tctggtccccattccaggtggg

SEQ ID NO: 8355319 - DNA, 22 bp, Homo sapiens
tctggtctccaggagtggtggt

SEQ ID NO: 8355320 - DNA, 22 bp, Homo sapiens
ccaggacttcgaggctacagtg

SEQ ID NO: 8355321 - DNA, 22 bp, Homo sapiens
ccaggactttaagtccagcact

SEQ ID NO: 8355322 - DNA, 22 bp, Homo sapiens
ccaggacttattacagtataac

SEQ ID NO: 8355323 - DNA, 19 bp, Homo sapiens
ccaggactttgcagacact

SEQ ID NO: 8355324 - DNA, 22 bp, Homo sapiens
ccaggacagtgaacatgtaaga

SEQ ID NO: 8355325 - DNA, 19 bp, Homo sapiens
ccaggacctttccagggtc

SEQ ID NO: 8355326 - DNA, 22 bp, Homo sapiens
ccaggacaggagttggcttcgc

SEQ ID NO: 8355327 - DNA, 22 bp, Homo sapiens
ccaggacactgcttcacagcag

SEQ ID NO: 8355328 - DNA, 22 bp, Homo sapiens
tctggctcaggtcagacaggga

SEQ ID NO: 8355329 - DNA, 22 bp, Homo sapiens
tctggctcagggctctgaggga

SEQ ID NO: 8355330 - DNA, 22 bp, Homo sapiens
tctggctcaggtcagacaggga

SEQ ID NO: 8355331 - DNA, 22 bp, Homo sapiens
tctggctcacttcaggcttcac

SEQ ID NO: 8355332 - DNA, 22 bp, Homo sapiens
tctggctcaaaatacgtactct

SEQ ID NO: 8355333 - DNA, 22 bp, Homo sapiens
tctggctcaggagctgtgttca

SEQ ID NO: 8355334 - DNA, 18 bp, Homo sapiens
tctggctcaggactgaac

SEQ ID NO: 8355335 - DNA, 22 bp, Homo sapiens
tctggcaggacatgctgaccat

SEQ ID NO: 8355336 - DNA, 22 bp, Homo sapiens
tctggcagctatcctctggcca

SEQ ID NO: 8355337 - DNA, 22 bp, Homo sapiens
tctttcaatccattcatatgtc

SEQ ID NO: 8355338 - DNA, 22 bp, Homo sapiens
tctttcaagggccctagtttgg

SEQ ID NO: 8355339 - DNA, 22 bp, Homo sapiens
ccaggcccaccttggccactta

SEQ ID NO: 8355340 - DNA, 22 bp, Homo sapiens
ccaggcccaccttggccactta

SEQ ID NO: 8355341 - DNA, 22 bp, Homo sapiens
ccaggccccagggctggctttc

SEQ ID NO: 8355342 - DNA, 22 bp, Homo sapiens
ccaggcccagggtactgaccaa

SEQ ID NO: 8355343 - DNA, 22 bp, Homo sapiens
ccaggccagggctgcagcgagc

SEQ ID NO: 8355344 - DNA, 22 bp, Homo sapiens
tctttctttatcacctgatatg

SEQ ID NO: 8355345 - DNA, 22 bp, Homo sapiens
ccaggcctgcattccctctcag

SEQ ID NO: 8355346 - DNA, 22 bp, Homo sapiens
ccaggcctgcattccctctcag

SEQ ID NO: 8355347 - DNA, 22 bp, Homo sapiens
tctttcttcagccctgtaagat

SEQ ID NO: 8355348 - DNA, 22 bp, Homo sapiens
ccaggctgaatatgttccaggg

SEQ ID NO: 8355349 - DNA, 22 bp, Homo sapiens
ccaggctgagcatgattggagc

SEQ ID NO: 8355350 - DNA, 22 bp, Homo sapiens
tctttggctatgatttactgtt

SEQ ID NO: 8355351 - DNA, 23 bp, Homo sapiens
ccaggctctttcacctgctattc

SEQ ID NO: 8355352 - DNA, 22 bp, Homo sapiens
tcttcagagatgtaacatatgg

SEQ ID NO: 8355353 - DNA, 22 bp, Homo sapiens
tcttcagagcatttctgaggta

SEQ ID NO: 8355354 - DNA, 22 bp, Homo sapiens
tcttcagagtgaaagtctgtga

SEQ ID NO: 8355355 - DNA, 22 bp, Homo sapiens
tcttcagaaaattatcacttgt

SEQ ID NO: 8355356 - DNA, 22 bp, Homo sapiens
tcttcagacccttagctgtgat

SEQ ID NO: 8355357 - DNA, 22 bp, Homo sapiens
tcttccagtgtagacatctgcc

SEQ ID NO: 8355358 - DNA, 22 bp, Homo sapiens
tcttcccaatgcaaagtaggac

SEQ ID NO: 8355359 - DNA, 22 bp, Homo sapiens
tcttcccagaccttacatgtga

SEQ ID NO: 8355360 - DNA, 22 bp, Homo sapiens
tcttcccagctgctgcgatgcc

SEQ ID NO: 8355361 - DNA, 22 bp, Homo sapiens
tcttcccagtgagacttatggg

SEQ ID NO: 8355362 - DNA, 20 bp, Homo sapiens
tcttccaggtacagtctgca

SEQ ID NO: 8355363 - DNA, 20 bp, Homo sapiens
tcttcagatgcttttggagt

SEQ ID NO: 8355364 - DNA, 19 bp, Homo sapiens
tcttccctggctgtcagtc

SEQ ID NO: 8355365 - DNA, 22 bp, Homo sapiens
ccaggcagggagctgtttggcc

SEQ ID NO: 8355366 - DNA, 22 bp, Homo sapiens
ccaggccagcctggagcatggc

SEQ ID NO: 8355367 - DNA, 22 bp, Homo sapiens
ccaggccagagtgcagtggcac

SEQ ID NO: 8355368 - DNA, 22 bp, Homo sapiens
tcttcacattcacgtaacatag

SEQ ID NO: 8355369 - DNA, 22 bp, Homo sapiens
ccaggaggttgaggctgcagtg

SEQ ID NO: 8355370 - DNA, 19 bp, Homo sapiens
ccaggtggaactgaggtag

SEQ ID NO: 8355371 - DNA, 22 bp, Homo sapiens
ccaggtggaaggtctgtgctct

SEQ ID NO: 8355372 - DNA, 22 bp, Homo sapiens
ccaggtctcgggtctgctcgtg

SEQ ID NO: 8355373 - DNA, 17 bp, Homo sapiens
ccaggtctccttgcttt

SEQ ID NO: 8355374 - DNA, 21 bp, Homo sapiens
ccagggtccagctgccatggt

SEQ ID NO: 8355375 - DNA, 22 bp, Homo sapiens
ccagggtcacaaataactgcag

SEQ ID NO: 8355376 - DNA, 22 bp, Homo sapiens
ccaggggctggtgctgagctgg

SEQ ID NO: 8355377 - DNA, 22 bp, Homo sapiens
tgagaaggaaacaatggctttt

SEQ ID NO: 8355378 - DNA, 21 bp, Homo sapiens
tgagaagtatgtcttcagcca

SEQ ID NO: 8355379 - DNA, 19 bp, Homo sapiens
tgagaaggtttccgtgggt

SEQ ID NO: 8355380 - DNA, 22 bp, Homo sapiens
tgagaaggtgaaagtgtggaga

SEQ ID NO: 8355381 - DNA, 22 bp, Homo sapiens
ccaggggctgcagatccatggt

SEQ ID NO: 8355382 - DNA, 22 bp, Homo sapiens
ccaggggctctcagggtgtgtg

SEQ ID NO: 8355383 - DNA, 22 bp, Homo sapiens
ccaggggctgcagatccatggt

SEQ ID NO: 8355384 - DNA, 22 bp, Homo sapiens
tgagaatagtaataatttctgg

SEQ ID NO: 8355385 - DNA, 22 bp, Homo sapiens
tgagaccatttgacatacagtg

SEQ ID NO: 8355386 - DNA, 22 bp, Homo sapiens
ccaggtgtagcactgctcacag

SEQ ID NO: 8355387 - DNA, 22 bp, Homo sapiens
ccaggtgtaagacatggtccta

SEQ ID NO: 8355388 - DNA, 22 bp, Homo sapiens
ccaggtgtccccgtcactgcag

SEQ ID NO: 8355389 - DNA, 22 bp, Homo sapiens
ccaggtgtgtacagaacagcac

SEQ ID NO: 8355390 - DNA, 22 bp, Homo sapiens
ccaggtgtggccacatggctgg

SEQ ID NO: 8355391 - DNA, 22 bp, Homo sapiens
ccaggtgtggggaggactcaca

SEQ ID NO: 8355392 - DNA, 22 bp, Homo sapiens
ccaggtgtgccagcagggactg

SEQ ID NO: 8355393 - DNA, 22 bp, Homo sapiens
tgacatagggcaaaagagtagg

SEQ ID NO: 8355394 - DNA, 22 bp, Homo sapiens
tgagaaaaggttgagatgataa

SEQ ID NO: 8355395 - DNA, 22 bp, Homo sapiens
tgagaaaagtacatggagaagc

SEQ ID NO: 8355396 - DNA, 22 bp, Homo sapiens
tgacagttgagcatgtaagaga

SEQ ID NO: 8355397 - DNA, 22 bp, Homo sapiens
tgacagttaaggtatacattca

SEQ ID NO: 8355398 - DNA, 22 bp, Homo sapiens
tgacagttgtattacatgggaa

SEQ ID NO: 8355399 - DNA, 20 bp, Homo sapiens
tgacagtttcatatggttca

SEQ ID NO: 8355400 - DNA, 22 bp, Homo sapiens
tgacagttaaggtatacattca

SEQ ID NO: 8355401 - DNA, 21 bp, Homo sapiens
ccaggggcaaattgtcgtttc

SEQ ID NO: 8355402 - DNA, 22 bp, Homo sapiens
tgacaatacagagagagcaaaa

SEQ ID NO: 8355403 - DNA, 22 bp, Homo sapiens
ccagggcttcccacgtgccctg

SEQ ID NO: 8355404 - DNA, 22 bp, Homo sapiens
tgaatgatgtataatattgaga

SEQ ID NO: 8355405 - DNA, 22 bp, Homo sapiens
ccaggctggagtgcagtggcac

SEQ ID NO: 8355406 - DNA, 22 bp, Homo sapiens
ccaggctggagtgcagtagtgt

SEQ ID NO: 8355407 - DNA, 22 bp, Homo sapiens
ccaggctggattttgcagttca

SEQ ID NO: 8355408 - DNA, 20 bp, Homo sapiens
ccaggctggcaaatgggggc

SEQ ID NO: 8355409 - DNA, 22 bp, Homo sapiens
ccaggctggagtgtagtcgcat

SEQ ID NO: 8355410 - DNA, 22 bp, Homo sapiens
ccagtctcagttcacgttggta

SEQ ID NO: 8355411 - DNA, 22 bp, Homo sapiens
ccagtcctgccaccctgtctat

SEQ ID NO: 8355412 - DNA, 22 bp, Homo sapiens
ccagtcctttgagccagttctg

SEQ ID NO: 8355413 - DNA, 22 bp, Homo sapiens
tgagggctgcttccagagctag

SEQ ID NO: 8355414 - DNA, 22 bp, Homo sapiens
ccatgcccttgtcatctccagg

SEQ ID NO: 8355415 - DNA, 22 bp, Homo sapiens
ccatgcctggactccactctca

SEQ ID NO: 8355416 - DNA, 22 bp, Homo sapiens
ccatggcctgaaggagtgcatc

SEQ ID NO: 8355417 - DNA, 22 bp, Homo sapiens
ccatggcctcgctctacgtggg

SEQ ID NO: 8355418 - DNA, 22 bp, Homo sapiens
ccattaagtattattaatgatt

SEQ ID NO: 8355419 - DNA, 22 bp, Homo sapiens
ccattcactgaacaaggctaaa

SEQ ID NO: 8355420 - DNA, 22 bp, Homo sapiens
tgatttgaactctgggacttgt

SEQ ID NO: 8355421 - DNA, 22 bp, Homo sapiens
tgatttcttctaatttccatca

SEQ ID NO: 8355422 - DNA, 22 bp, Homo sapiens
tgattttattggtgaggaaatt

SEQ ID NO: 8355423 - DNA, 22 bp, Homo sapiens
tgattttattgaaacttcactt

SEQ ID NO: 8355424 - DNA, 22 bp, Homo sapiens
tgatttctcatattgttcaaaa

SEQ ID NO: 8355425 - DNA, 22 bp, Homo sapiens
ccattgtaaattctgtggaagt

SEQ ID NO: 8355426 - DNA, 21 bp, Homo sapiens
tgatttctgccaagttcacta

SEQ ID NO: 8355427 - DNA, 22 bp, Homo sapiens
tgatttctcttggcaatatgtt

SEQ ID NO: 8355428 - DNA, 22 bp, Homo sapiens
tgatttcctgtgcgcccttagg

SEQ ID NO: 8355429 - DNA, 22 bp, Homo sapiens
tgcaaatagcctgatgaaagaa

SEQ ID NO: 8355430 - DNA, 22 bp, Homo sapiens
cccacccctggacaggtgagtg

SEQ ID NO: 8355431 - DNA, 22 bp, Homo sapiens
cccactgtctgttcccagggcc

SEQ ID NO: 8355432 - DNA, 22 bp, Homo sapiens
tgcaaatacaaaatggtacagc

SEQ ID NO: 8355433 - DNA, 22 bp, Homo sapiens
cccagacagtcaagaggcctgc

SEQ ID NO: 8355434 - DNA, 22 bp, Homo sapiens
tgcacagacaactctttctaga

SEQ ID NO: 8355435 - DNA, 22 bp, Homo sapiens
tgcacagaataatatatgttct

SEQ ID NO: 8355436 - DNA, 20 bp, Homo sapiens
cctctgcctttctagtctga

SEQ ID NO: 8355437 - DNA, 22 bp, Homo sapiens
cctctgcctttagtgaaagttg

SEQ ID NO: 8355438 - DNA, 18 bp, Homo sapiens
cctctgcctttgtagagc

SEQ ID NO: 8355439 - DNA, 18 bp, Homo sapiens
cctctgcctttgtagagc

SEQ ID NO: 8355440 - DNA, 20 bp, Homo sapiens
cctctgcctttctagtctga

SEQ ID NO: 8355441 - DNA, 22 bp, Homo sapiens
cctctgctgctgttgagcaccg

SEQ ID NO: 8355442 - DNA, 19 bp, Homo sapiens
cctctgcgctgtcctgctc

SEQ ID NO: 8355443 - DNA, 20 bp, Homo sapiens
cctctgccccggggctgcta

SEQ ID NO: 8355444 - DNA, 22 bp, Homo sapiens
cctctgcccttttcctgtatca

SEQ ID NO: 8355445 - DNA, 22 bp, Homo sapiens
cctctgcctgcacatcatcctg

SEQ ID NO: 8355446 - DNA, 20 bp, Homo sapiens
cctctgccccggggctgcta

SEQ ID NO: 8355447 - DNA, 18 bp, Homo sapiens
cctctgccatagccagca

SEQ ID NO: 8355448 - DNA, 22 bp, Homo sapiens
cctctgagtcatgcgcatagga

SEQ ID NO: 8355449 - DNA, 18 bp, Homo sapiens
cctctgccatagccagca

SEQ ID NO: 8355450 - DNA, 22 bp, Homo sapiens
cctctgagtagactggacatga

SEQ ID NO: 8355451 - DNA, 19 bp, Homo sapiens
cctctgtgggagtcagtga

SEQ ID NO: 8355452 - DNA, 22 bp, Homo sapiens
cctctgtggccttggaccagct

SEQ ID NO: 8355453 - DNA, 22 bp, Homo sapiens
tgggaaggacgtgtcagtggca

SEQ ID NO: 8355454 - DNA, 22 bp, Homo sapiens
tgggaagctgcattttaacaag

SEQ ID NO: 8355455 - DNA, 22 bp, Homo sapiens
cctctgctgctgttgagcaccg

SEQ ID NO: 8355456 - DNA, 22 bp, Homo sapiens
tggctggctgtcagtaggctgt

SEQ ID NO: 8355457 - DNA, 22 bp, Homo sapiens
tggctggctgtccagctgggca

SEQ ID NO: 8355458 - DNA, 22 bp, Homo sapiens
tggctggctgtcaaggaaagcc

SEQ ID NO: 8355459 - DNA, 22 bp, Homo sapiens
tggctggcttgttcactgactg

SEQ ID NO: 8355460 - DNA, 20 bp, Homo sapiens
tggctggcttgtatttcctt

SEQ ID NO: 8355461 - DNA, 22 bp, Homo sapiens
tggctggctttcttgtatttac

SEQ ID NO: 8355462 - DNA, 22 bp, Homo sapiens
tggctggctggaccacacctgc

SEQ ID NO: 8355463 - DNA, 18 bp, Homo sapiens
tggctggctctgtcatct

SEQ ID NO: 8355464 - DNA, 22 bp, Homo sapiens
tggctggctagtgggcaggatt

SEQ ID NO: 8355465 - DNA, 19 bp, Homo sapiens
tggctctgtcgaaggcaca

SEQ ID NO: 8355466 - DNA, 22 bp, Homo sapiens
tggctctgtcactgtgagctat

SEQ ID NO: 8355467 - DNA, 22 bp, Homo sapiens
cctgagctcaagaaggtgacca

SEQ ID NO: 8355468 - DNA, 22 bp, Homo sapiens
tgggctgcttcctcagctgaga

SEQ ID NO: 8355469 - DNA, 22 bp, Homo sapiens
tgggctgcttctattggtggtc

SEQ ID NO: 8355470 - DNA, 22 bp, Homo sapiens
tgggctgctgttacaggggctg

SEQ ID NO: 8355471 - DNA, 22 bp, Homo sapiens
tgggctggagcttgttgcttcc

SEQ ID NO: 8355472 - DNA, 22 bp, Homo sapiens
tgggctgcttctcaaatgtctc

SEQ ID NO: 8355473 - DNA, 22 bp, Homo sapiens
tgggctgctgtctgcacatgct

SEQ ID NO: 8355474 - DNA, 22 bp, Homo sapiens
tgggctgctgagaatgagagag

SEQ ID NO: 8355475 - DNA, 22 bp, Homo sapiens
tgggctgctgcggtgctcttgg

SEQ ID NO: 8355476 - DNA, 22 bp, Homo sapiens
tgggctgcggataggcctcgga

SEQ ID NO: 8355477 - DNA, 18 bp, Homo sapiens
tgggctgcctggcctctg

SEQ ID NO: 8355478 - DNA, 22 bp, Homo sapiens
tgggccctggtggccatgcctc

SEQ ID NO: 8355479 - DNA, 22 bp, Homo sapiens
tgggcccttatgaagctcaaga

SEQ ID NO: 8355480 - DNA, 23 bp, Homo sapiens
tgggccctggagtcgccagtctg

SEQ ID NO: 8355481 - DNA, 22 bp, Homo sapiens
tgggcccgcagctgctgctcca

SEQ ID NO: 8355482 - DNA, 22 bp, Homo sapiens
tgggcccaggtcctgggagaag

SEQ ID NO: 8355483 - DNA, 22 bp, Homo sapiens
tgggcccaagagagtctccaac

SEQ ID NO: 8355484 - DNA, 21 bp, Homo sapiens
tgggcccagttcccgctgggc

SEQ ID NO: 8355485 - DNA, 23 bp, Homo sapiens
tgggagtgttgggatctctgctc

SEQ ID NO: 8355486 - DNA, 18 bp, Homo sapiens
tgggagtgggagtggata

SEQ ID NO: 8355487 - DNA, 19 bp, Homo sapiens
cctcttctctggcagcaga

SEQ ID NO: 8355488 - DNA, 22 bp, Homo sapiens
tgggagtggggcatagaaggta

SEQ ID NO: 8355489 - DNA, 22 bp, Homo sapiens
cctcttctaggtttcagcctgc

SEQ ID NO: 8355490 - DNA, 22 bp, Homo sapiens
cctcttctaccatttacatttt

SEQ ID NO: 8355491 - DNA, 22 bp, Homo sapiens
cccttctctttcactcactatt

SEQ ID NO: 8355492 - DNA, 19 bp, Homo sapiens
tggcagaggacaaggactt

SEQ ID NO: 8355493 - DNA, 23 bp, Homo sapiens
ccctgcagtcagggtgagatggt

SEQ ID NO: 8355494 - DNA, 22 bp, Homo sapiens
tggagcagggcatcactgtgcg

SEQ ID NO: 8355495 - DNA, 22 bp, Homo sapiens
tggagcaggccggaagtggctt

SEQ ID NO: 8355496 - DNA, 18 bp, Homo sapiens
tggagcaggtaggcatga

SEQ ID NO: 8355497 - DNA, 19 bp, Homo sapiens
tggagcagggcccttgttt

SEQ ID NO: 8355498 - DNA, 22 bp, Homo sapiens
cctaggagttcgaagctgcagt

SEQ ID NO: 8355499 - DNA, 22 bp, Homo sapiens
cctcagaggcagatggtaagaa

SEQ ID NO: 8355500 - DNA, 18 bp, Homo sapiens
tggcaggtagactcaggt

SEQ ID NO: 8355501 - DNA, 22 bp, Homo sapiens
cctagccccagatatctcacac

SEQ ID NO: 8355502 - DNA, 22 bp, Homo sapiens
cctagatggattatgtaagatt

SEQ ID NO: 8355503 - DNA, 22 bp, Homo sapiens
cctagcagggaagcagtgagga

SEQ ID NO: 8355504 - DNA, 22 bp, Homo sapiens
tggctctgagacacaggctctc

SEQ ID NO: 8355505 - DNA, 22 bp, Homo sapiens
tggctctgtcaaactgcacaca

SEQ ID NO: 8355506 - DNA, 22 bp, Homo sapiens
tggctctggtgcgggctcctgc

SEQ ID NO: 8355507 - DNA, 22 bp, Homo sapiens
cctcatgctgcatctctgaggt

SEQ ID NO: 8355508 - DNA, 22 bp, Homo sapiens
cctcatttatagccaaagtaaa

SEQ ID NO: 8355509 - DNA, 22 bp, Homo sapiens
cctcatctgtcatcctagggaa

SEQ ID NO: 8355510 - DNA, 22 bp, Homo sapiens
cctcagtgagtgtttccttctt

SEQ ID NO: 8355511 - DNA, 22 bp, Homo sapiens
tggcccagcactccaagtaggg

SEQ ID NO: 8355512 - DNA, 22 bp, Homo sapiens
tggcccagagcactgctgggca

SEQ ID NO: 8355513 - DNA, 22 bp, Homo sapiens
tggcccagagcactgctgggca

SEQ ID NO: 8355514 - DNA, 19 bp, Homo sapiens
tggcccagatggtcctggg

SEQ ID NO: 8355515 - DNA, 22 bp, Homo sapiens
cctcagagtttaagatgtcaga

SEQ ID NO: 8355516 - DNA, 22 bp, Homo sapiens
cctcagagttggccacgagagc

SEQ ID NO: 8355517 - DNA, 22 bp, Homo sapiens
cctcagggaatgggaggctggg

SEQ ID NO: 8355518 - DNA, 22 bp, Homo sapiens
cctcaggcttcgtcttccaccc

SEQ ID NO: 8355519 - DNA, 22 bp, Homo sapiens
cctcaggctagctactgtccct

SEQ ID NO: 8355520 - DNA, 22 bp, Homo sapiens
cctcaggctagctactgtccct

SEQ ID NO: 8355521 - DNA, 22 bp, Homo sapiens
cctcaggctgggctgcccctgg

SEQ ID NO: 8355522 - DNA, 22 bp, Homo sapiens
ccctctccctgcagaatgtggc

SEQ ID NO: 8355523 - DNA, 18 bp, Homo sapiens
ccctctcctgctagtggg

SEQ ID NO: 8355524 - DNA, 22 bp, Homo sapiens
ccctgaacaaagcccaggctct

SEQ ID NO: 8355525 - DNA, 22 bp, Homo sapiens
ccctgacccaaaactgtcagaa

SEQ ID NO: 8355526 - DNA, 22 bp, Homo sapiens
ccctgaccatcccgcactgact

SEQ ID NO: 8355527 - DNA, 22 bp, Homo sapiens
ccctgacccaaaactgtcagaa

SEQ ID NO: 8355528 - DNA, 22 bp, Homo sapiens
ccctgagaggttgagtgtctgc

SEQ ID NO: 8355529 - DNA, 23 bp, Homo sapiens
ccctgagctggtccaggctcaac

SEQ ID NO: 8355530 - DNA, 16 bp, Homo sapiens
tggagcaggcaggatg

SEQ ID NO: 8355531 - DNA, 22 bp, Homo sapiens
tggagcaggactgctgccctca

SEQ ID NO: 8355532 - DNA, 22 bp, Homo sapiens
ccctgagcagtctgcagagagc

SEQ ID NO: 8355533 - DNA, 22 bp, Homo sapiens
ccctcctggaggcggatgccca

SEQ ID NO: 8355534 - DNA, 22 bp, Homo sapiens
ccctcgccgcagctgcttcccg

SEQ ID NO: 8355535 - DNA, 22 bp, Homo sapiens
tggaatggaaacaaactgagga

SEQ ID NO: 8355536 - DNA, 22 bp, Homo sapiens
tgctggcccatgaagacgcagt

SEQ ID NO: 8355537 - DNA, 22 bp, Homo sapiens
tgctggccgtgagctctcggga

SEQ ID NO: 8355538 - DNA, 22 bp, Homo sapiens
ccccttctctgcaagcctgctc

SEQ ID NO: 8355539 - DNA, 22 bp, Homo sapiens
cccgagcgggccctggggtgac

SEQ ID NO: 8355540 - DNA, 22 bp, Homo sapiens
ccccttccttcctcagacagcc

SEQ ID NO: 8355541 - DNA, 23 bp, Homo sapiens
cccctctggtggctcagctcctg

SEQ ID NO: 8355542 - DNA, 22 bp, Homo sapiens
cccattcatcctcgcttccttc

SEQ ID NO: 8355543 - DNA, 22 bp, Homo sapiens
cccattcatcctcgcttccttc

SEQ ID NO: 8355544 - DNA, 22 bp, Homo sapiens
ccccacaactcatgttgaaact

SEQ ID NO: 8355545 - DNA, 22 bp, Homo sapiens
ccccacagtccgtgaggagcca

SEQ ID NO: 8355546 - DNA, 22 bp, Homo sapiens
ccccaccaccaaggctcagttt

SEQ ID NO: 8355547 - DNA, 22 bp, Homo sapiens
ccccacagccgccagcagggag

SEQ ID NO: 8355548 - DNA, 22 bp, Homo sapiens
tgctggccaatggcagaggcgg

SEQ ID NO: 8355549 - DNA, 22 bp, Homo sapiens
cccaggggttcaaggctgcagt

SEQ ID NO: 8355550 - DNA, 22 bp, Homo sapiens
cccaggggttcaaggctgcagt

SEQ ID NO: 8355551 - DNA, 22 bp, Homo sapiens
cccagggtagctgagctggcag

SEQ ID NO: 8355552 - DNA, 22 bp, Homo sapiens
cccagggttgcctgcctctgct

SEQ ID NO: 8355553 - DNA, 22 bp, Homo sapiens
cccagggtccctgctctctgtg

SEQ ID NO: 8355554 - DNA, 22 bp, Homo sapiens
cccagggtggatgcaagcagca

SEQ ID NO: 8355555 - DNA, 22 bp, Homo sapiens
tgccctggtatcatgtggaatt

SEQ ID NO: 8355556 - DNA, 22 bp, Homo sapiens
tgccctggttacactggagtcc

SEQ ID NO: 8355557 - DNA, 22 bp, Homo sapiens
tgccctggtgaagtgctctcct

SEQ ID NO: 8355558 - DNA, 22 bp, Homo sapiens
tgcccagcctaaacttggcaag

SEQ ID NO: 8355559 - DNA, 22 bp, Homo sapiens
tgcccagcctaaacttggcaag

SEQ ID NO: 8355560 - DNA, 22 bp, Homo sapiens
tgcccagcccctatccctggga

SEQ ID NO: 8355561 - DNA, 22 bp, Homo sapiens
cccaggctcccaggtgggacaa

SEQ ID NO: 8355562 - DNA, 21 bp, Homo sapiens
tgccctggggctcttccctca

SEQ ID NO: 8355563 - DNA, 21 bp, Homo sapiens
tgccctggggctcttccctca

SEQ ID NO: 8355564 - DNA, 22 bp, Homo sapiens
tgccctgggagttggagctgct

SEQ ID NO: 8355565 - DNA, 22 bp, Homo sapiens
tgccagtgaaacatggaagaat

SEQ ID NO: 8355566 - DNA, 22 bp, Homo sapiens
tgccagtgagccctgggatgtg

SEQ ID NO: 8355567 - DNA, 22 bp, Homo sapiens
tgccaggaggaggtgggacaga

SEQ ID NO: 8355568 - DNA, 22 bp, Homo sapiens
tgcacagagggaggcataaaat

SEQ ID NO: 8355569 - DNA, 22 bp, Homo sapiens
tgccacagcagtgctttgacag

SEQ ID NO: 8355570 - DNA, 22 bp, Homo sapiens
tccaggagaggtgtggggactg

SEQ ID NO: 8355571 - DNA, 22 bp, Homo sapiens
tccaggagaggcctgaccaggt

SEQ ID NO: 8355572 - DNA, 21 bp, Homo sapiens
tccaggagcacgggactagga

SEQ ID NO: 8355573 - DNA, 22 bp, Homo sapiens
tccattttgtaggtatgctaca

SEQ ID NO: 8355574 - DNA, 22 bp, Homo sapiens
tcccaaaatacttttctctcct

SEQ ID NO: 8355575 - DNA, 22 bp, Homo sapiens
tccattttcatctcatgtataa

SEQ ID NO: 8355576 - DNA, 22 bp, Homo sapiens
catgggcccgtgagaggcaggg

SEQ ID NO: 8355577 - DNA, 22 bp, Homo sapiens
catgggccagagctcctctggg

SEQ ID NO: 8355578 - DNA, 22 bp, Homo sapiens
catgggccatggtgaagccagg

SEQ ID NO: 8355579 - DNA, 22 bp, Homo sapiens
catgggcagaagtggcatcatt

SEQ ID NO: 8355580 - DNA, 22 bp, Homo sapiens
cattctaaagtgttttatacct

SEQ ID NO: 8355581 - DNA, 22 bp, Homo sapiens
cattagaaggttttaaaggaat

SEQ ID NO: 8355582 - DNA, 22 bp, Homo sapiens
cattagacacagatgtataaat

SEQ ID NO: 8355583 - DNA, 22 bp, Homo sapiens
cattagaagaacagttatatta

SEQ ID NO: 8355584 - DNA, 22 bp, Homo sapiens
cattagaacctataaaaagcat

SEQ ID NO: 8355585 - DNA, 22 bp, Homo sapiens
cattacgagctctaaaatacta

SEQ ID NO: 8355586 - DNA, 22 bp, Homo sapiens
cattacagaatatgtaatgatc

SEQ ID NO: 8355587 - DNA, 22 bp, Homo sapiens
cattcttacacaatattttaat

SEQ ID NO: 8355588 - DNA, 22 bp, Homo sapiens
cattcttctggatagttagttg

SEQ ID NO: 8355589 - DNA, 22 bp, Homo sapiens
cattctctctacttgttttcaa

SEQ ID NO: 8355590 - DNA, 22 bp, Homo sapiens
cattctgagtcactctttagca

SEQ ID NO: 8355591 - DNA, 22 bp, Homo sapiens
cattctgagctaatatgcttat

SEQ ID NO: 8355592 - DNA, 22 bp, Homo sapiens
cattctgcgatcctcaagcaca

SEQ ID NO: 8355593 - DNA, 22 bp, Homo sapiens
tcccaccaggtgaccatttcat

SEQ ID NO: 8355594 - DNA, 22 bp, Homo sapiens
tccctctccctattgcctggag

SEQ ID NO: 8355595 - DNA, 22 bp, Homo sapiens
catttattcatgatctgtagct

SEQ ID NO: 8355596 - DNA, 22 bp, Homo sapiens
tccctctcttgggcgtggctca

SEQ ID NO: 8355597 - DNA, 22 bp, Homo sapiens
tccctctctagcctgttcagta

SEQ ID NO: 8355598 - DNA, 22 bp, Homo sapiens
tccctctctggctggggtgcgg

SEQ ID NO: 8355599 - DNA, 22 bp, Homo sapiens
catttattctcagatccttgtc

SEQ ID NO: 8355600 - DNA, 22 bp, Homo sapiens
tccctggaacagagagacaacg

SEQ ID NO: 8355601 - DNA, 20 bp, Homo sapiens
tccctggggccctacttcct

SEQ ID NO: 8355602 - DNA, 18 bp, Homo sapiens
tccctggggctgccaccc

SEQ ID NO: 8355603 - DNA, 22 bp, Homo sapiens
tccctggggtatcgctgaggca

SEQ ID NO: 8355604 - DNA, 22 bp, Homo sapiens
tccctggggtaacattagaggg

SEQ ID NO: 8355605 - DNA, 22 bp, Homo sapiens
tccctggggtatcgctgaggca

SEQ ID NO: 8355606 - DNA, 22 bp, Homo sapiens
tccctgggtcctgcttgctctc

SEQ ID NO: 8355607 - DNA, 22 bp, Homo sapiens
tccctgggtcattctctggcac

SEQ ID NO: 8355608 - DNA, 22 bp, Homo sapiens
tccctggggttcctccagccac

SEQ ID NO: 8355609 - DNA, 22 bp, Homo sapiens
tccctgggttacctttcaaggt

SEQ ID NO: 8355610 - DNA, 22 bp, Homo sapiens
tccctgggttcccgtggaagtg

SEQ ID NO: 8355611 - DNA, 22 bp, Homo sapiens
catttacaatgtacaggttgtg

SEQ ID NO: 8355612 - DNA, 22 bp, Homo sapiens
catttacacacagaggtgtgct

SEQ ID NO: 8355613 - DNA, 22 bp, Homo sapiens
catttacacttctaaccacaag

SEQ ID NO: 8355614 - DNA, 22 bp, Homo sapiens
tccctcctgcatgaggctcggc

SEQ ID NO: 8355615 - DNA, 22 bp, Homo sapiens
catttaaaggttgtgggtaaaa

SEQ ID NO: 8355616 - DNA, 22 bp, Homo sapiens
cattgttatagcattacacacc

SEQ ID NO: 8355617 - DNA, 22 bp, Homo sapiens
cattgtattgaggatacttaag

SEQ ID NO: 8355618 - DNA, 16 bp, Homo sapiens
cattgcactctagcct

SEQ ID NO: 8355619 - DNA, 21 bp, Homo sapiens
cattgtcgacattttcccctc

SEQ ID NO: 8355620 - DNA, 22 bp, Homo sapiens
cattgtcacccaaagctcatag

SEQ ID NO: 8355621 - DNA, 22 bp, Homo sapiens
tcccactcccaggcaggcctct

SEQ ID NO: 8355622 - DNA, 22 bp, Homo sapiens
tcccactcccaggcaggcctct

SEQ ID NO: 8355623 - DNA, 22 bp, Homo sapiens
cattgcactccagcctgggcaa

SEQ ID NO: 8355624 - DNA, 22 bp, Homo sapiens
cattgcactccagcctgggcca

SEQ ID NO: 8355625 - DNA, 22 bp, Homo sapiens
cattgcactccaccctaggcaa

SEQ ID NO: 8355626 - DNA, 22 bp, Homo sapiens
cattgcactccagcctaggcaa

SEQ ID NO: 8355627 - DNA, 22 bp, Homo sapiens
cattgcactccatcttgggcaa

SEQ ID NO: 8355628 - DNA, 22 bp, Homo sapiens
cattgcactcctgcctgggcaa

SEQ ID NO: 8355629 - DNA, 22 bp, Homo sapiens
cattgcactccagtctgggcca

SEQ ID NO: 8355630 - DNA, 22 bp, Homo sapiens
cattgcactccagcttgggcaa

SEQ ID NO: 8355631 - DNA, 22 bp, Homo sapiens
cattgcactccagcctgggtga

SEQ ID NO: 8355632 - DNA, 22 bp, Homo sapiens
cattgcactccagccttggcaa

SEQ ID NO: 8355633 - DNA, 22 bp, Homo sapiens
cattgcactccagctctgggcg

SEQ ID NO: 8355634 - DNA, 22 bp, Homo sapiens
cattgcactccagcctgggtaa

SEQ ID NO: 8355635 - DNA, 22 bp, Homo sapiens
tcctttagctttcttggacaaa

SEQ ID NO: 8355636 - DNA, 19 bp, Homo sapiens
tcctggggaggggcatggc

SEQ ID NO: 8355637 - DNA, 19 bp, Homo sapiens
tcctggggaggggcatggc

SEQ ID NO: 8355638 - DNA, 22 bp, Homo sapiens
tcctgggcttagtggctaggtc

SEQ ID NO: 8355639 - DNA, 22 bp, Homo sapiens
tcctgggcttcacagactctgt

SEQ ID NO: 8355640 - DNA, 19 bp, Homo sapiens
tccttccagttcctggggt

SEQ ID NO: 8355641 - DNA, 22 bp, Homo sapiens
ccactgtcttttccaggctgaa

SEQ ID NO: 8355642 - DNA, 22 bp, Homo sapiens
ccactgtctgcaggcctcagca

SEQ ID NO: 8355643 - DNA, 22 bp, Homo sapiens
ccactgtcagaggggctgtgcc

SEQ ID NO: 8355644 - DNA, 22 bp, Homo sapiens
ccacactgaccagctgtgagac

SEQ ID NO: 8355645 - DNA, 22 bp, Homo sapiens
ccacactgaacctcagtgtctt

SEQ ID NO: 8355646 - DNA, 22 bp, Homo sapiens
ccaaggagcaaggctcaacaag

SEQ ID NO: 8355647 - DNA, 22 bp, Homo sapiens
ccaaggagcaagtttacacctg

SEQ ID NO: 8355648 - DNA, 22 bp, Homo sapiens
ccaaggagctgcaggcacttgt

SEQ ID NO: 8355649 - DNA, 22 bp, Homo sapiens
ccaaggagctcatattcttgtt

SEQ ID NO: 8355650 - DNA, 22 bp, Homo sapiens
ccaaggaggccccaggtcagct

SEQ ID NO: 8355651 - DNA, 22 bp, Homo sapiens
ccaaggagtagagcaggaagct

SEQ ID NO: 8355652 - DNA, 22 bp, Homo sapiens
ccaaggccacaaacagcctggc

SEQ ID NO: 8355653 - DNA, 17 bp, Homo sapiens
cataaaacagttctatt

SEQ ID NO: 8355654 - DNA, 22 bp, Homo sapiens
cagtttttcaaaattacatgat

SEQ ID NO: 8355655 - DNA, 22 bp, Homo sapiens
cagtttttcaaaattacatgat

SEQ ID NO: 8355656 - DNA, 22 bp, Homo sapiens
cagtttttcaaaattacatgat

SEQ ID NO: 8355657 - DNA, 22 bp, Homo sapiens
cagtttttgccattaagagtaa

SEQ ID NO: 8355658 - DNA, 18 bp, Homo sapiens
cagtttttatatctggca

SEQ ID NO: 8355659 - DNA, 22 bp, Homo sapiens
cagtttttagattagttggtgg

SEQ ID NO: 8355660 - DNA, 22 bp, Homo sapiens
cagttttggtgatatttgagaa

SEQ ID NO: 8355661 - DNA, 22 bp, Homo sapiens
cagttttctaaagtctctttaa

SEQ ID NO: 8355662 - DNA, 22 bp, Homo sapiens
tcagatccgagtgtgccaagga

SEQ ID NO: 8355663 - DNA, 22 bp, Homo sapiens
tcagaggagcaaaagaggggat

SEQ ID NO: 8355664 - DNA, 22 bp, Homo sapiens
tcagaggatcatgtccctactc

SEQ ID NO: 8355665 - DNA, 22 bp, Homo sapiens
tcagagttttattttattccgg

SEQ ID NO: 8355666 - DNA, 22 bp, Homo sapiens
tcaatatttttatgagcataga

SEQ ID NO: 8355667 - DNA, 22 bp, Homo sapiens
cagttgatgggactcatgtggg

SEQ ID NO: 8355668 - DNA, 22 bp, Homo sapiens
cagttgataataccagagagag

SEQ ID NO: 8355669 - DNA, 22 bp, Homo sapiens
cagttagaggaggtaaagatgc

SEQ ID NO: 8355670 - DNA, 22 bp, Homo sapiens
tcaatgaaagagcatgcatttt

SEQ ID NO: 8355671 - DNA, 22 bp, Homo sapiens
cagttgctacagttcaagtgtg

SEQ ID NO: 8355672 - DNA, 22 bp, Homo sapiens
cagttgctggatgtgcagctct

SEQ ID NO: 8355673 - DNA, 22 bp, Homo sapiens
cagttgctggatgtgcagctct

SEQ ID NO: 8355674 - DNA, 22 bp, Homo sapiens
cagttgtcctttgtaccaagtt

SEQ ID NO: 8355675 - DNA, 22 bp, Homo sapiens
tcagagatgcagtgccacctac

SEQ ID NO: 8355676 - DNA, 23 bp, Homo sapiens
tcagagatggaaagcagaccacg

SEQ ID NO: 8355677 - DNA, 22 bp, Homo sapiens
tcagagcaacttttcctgcttt

SEQ ID NO: 8355678 - DNA, 22 bp, Homo sapiens
tcagagcaaattcctgtgagcc

SEQ ID NO: 8355679 - DNA, 22 bp, Homo sapiens
catagaacagctcctagcacat

SEQ ID NO: 8355680 - DNA, 22 bp, Homo sapiens
catagaatcatagcacatttga

SEQ ID NO: 8355681 - DNA, 22 bp, Homo sapiens
catagaatatgtgtgattgtta

SEQ ID NO: 8355682 - DNA, 22 bp, Homo sapiens
catagaatgcagcaggaaagtt

SEQ ID NO: 8355683 - DNA, 22 bp, Homo sapiens
catagaatggattgacaagatt

SEQ ID NO: 8355684 - DNA, 22 bp, Homo sapiens
catagaaactgagacaaggatt

SEQ ID NO: 8355685 - DNA, 22 bp, Homo sapiens
catagaaactgagacaaggatt

SEQ ID NO: 8355686 - DNA, 22 bp, Homo sapiens
catagaaacttgcagcaagcac

SEQ ID NO: 8355687 - DNA, 22 bp, Homo sapiens
catagaaacttgcagcaagcac

SEQ ID NO: 8355688 - DNA, 22 bp, Homo sapiens
catagaaacttgcagcaagcac

SEQ ID NO: 8355689 - DNA, 22 bp, Homo sapiens
catagaaagtattatggaattt

SEQ ID NO: 8355690 - DNA, 22 bp, Homo sapiens
catagaaagtattatggaattt

SEQ ID NO: 8355691 - DNA, 22 bp, Homo sapiens
catagaaagtattatggaattt

SEQ ID NO: 8355692 - DNA, 22 bp, Homo sapiens
catagaaatcaggtgagaatct

SEQ ID NO: 8355693 - DNA, 22 bp, Homo sapiens
catagaaatcaggtgagaatct

SEQ ID NO: 8355694 - DNA, 22 bp, Homo sapiens
catagaaatcaggtgagaatct

SEQ ID NO: 8355695 - DNA, 22 bp, Homo sapiens
tcaggcctagaacacagcagat

SEQ ID NO: 8355696 - DNA, 22 bp, Homo sapiens
cataatttgatatgcttgatgg

SEQ ID NO: 8355697 - DNA, 22 bp, Homo sapiens
tcagcagtcacatgttgtccca

SEQ ID NO: 8355698 - DNA, 22 bp, Homo sapiens
cataatatctccgattacttgc

SEQ ID NO: 8355699 - DNA, 20 bp, Homo sapiens
tcagtgctcaggcaccaggt

SEQ ID NO: 8355700 - DNA, 22 bp, Homo sapiens
tcagtgctaaaagagctggtgt

SEQ ID NO: 8355701 - DNA, 22 bp, Homo sapiens
tcagtgctgagtagcgtgcacc

SEQ ID NO: 8355702 - DNA, 22 bp, Homo sapiens
tcagtgctgagtagcgtgcacc

SEQ ID NO: 8355703 - DNA, 22 bp, Homo sapiens
catctcacttccctgcagcatc

SEQ ID NO: 8355704 - DNA, 22 bp, Homo sapiens
catctcttgccaaagtttgacc

SEQ ID NO: 8355705 - DNA, 22 bp, Homo sapiens
catgaaatttgaagtacagcaa

SEQ ID NO: 8355706 - DNA, 22 bp, Homo sapiens
catgaacaatttgctcactgat

SEQ ID NO: 8355707 - DNA, 22 bp, Homo sapiens
catgaacaaattctgtttgagg

SEQ ID NO: 8355708 - DNA, 21 bp, Homo sapiens
catgaacatgcttatcctcag

SEQ ID NO: 8355709 - DNA, 22 bp, Homo sapiens
catgaacagctaacattttggg

SEQ ID NO: 8355710 - DNA, 22 bp, Homo sapiens
catctggctagctatcattgtg

SEQ ID NO: 8355711 - DNA, 19 bp, Homo sapiens
catctggatgattctcctg

SEQ ID NO: 8355712 - DNA, 22 bp, Homo sapiens
catgcaggtgaccaggtgtggg

SEQ ID NO: 8355713 - DNA, 22 bp, Homo sapiens
catgcagtgactcagacacagg

SEQ ID NO: 8355714 - DNA, 22 bp, Homo sapiens
catgcagtgatgcactgcatca

SEQ ID NO: 8355715 - DNA, 22 bp, Homo sapiens
catgcaggcctatggagcagtg

SEQ ID NO: 8355716 - DNA, 22 bp, Homo sapiens
catggcagggctgtgggcaggt

SEQ ID NO: 8355717 - DNA, 22 bp, Homo sapiens
catggcagggctgtgggcaggt

SEQ ID NO: 8355718 - DNA, 22 bp, Homo sapiens
catgcattacaattgcatagta

SEQ ID NO: 8355719 - DNA, 22 bp, Homo sapiens
catgcattttctattcactcag

SEQ ID NO: 8355720 - DNA, 23 bp, Homo sapiens
catggcagcaagagctcatggcc

SEQ ID NO: 8355721 - DNA, 22 bp, Homo sapiens
catggcagagcctgcaggtggg

SEQ ID NO: 8355722 - DNA, 22 bp, Homo sapiens
catggcagctttgggaggagga

SEQ ID NO: 8355723 - DNA, 22 bp, Homo sapiens
taatcagaagttacattagggt

SEQ ID NO: 8355724 - DNA, 22 bp, Homo sapiens
taatccagcgggtgattgcaca

SEQ ID NO: 8355725 - DNA, 22 bp, Homo sapiens
taatgtacctcattctttctag

SEQ ID NO: 8355726 - DNA, 22 bp, Homo sapiens
taatgtataacaaatactcatc

SEQ ID NO: 8355727 - DNA, 22 bp, Homo sapiens
taatgtataacaaatactcatc

SEQ ID NO: 8355728 - DNA, 22 bp, Homo sapiens
taatatttctaccctgctgcct

SEQ ID NO: 8355729 - DNA, 22 bp, Homo sapiens
caggcatgcttctgtctgggca

SEQ ID NO: 8355730 - DNA, 22 bp, Homo sapiens
caggcatgatcataggagttta

SEQ ID NO: 8355731 - DNA, 22 bp, Homo sapiens
taatgtctagatcagacctcga

SEQ ID NO: 8355732 - DNA, 22 bp, Homo sapiens
caggcatgtggcccaggggtga

SEQ ID NO: 8355733 - DNA, 22 bp, Homo sapiens
caggcattgccattcctccaga

SEQ ID NO: 8355734 - DNA, 22 bp, Homo sapiens
caggcccaagactgatgagtct

SEQ ID NO: 8355735 - DNA, 22 bp, Homo sapiens
caggcccagaggcctcttccca

SEQ ID NO: 8355736 - DNA, 22 bp, Homo sapiens
caggcccacgaggcacacagag

SEQ ID NO: 8355737 - DNA, 22 bp, Homo sapiens
caggccagggttgagaagagaa

SEQ ID NO: 8355738 - DNA, 22 bp, Homo sapiens
taagtcgtggatgattcttcgg

SEQ ID NO: 8355739 - DNA, 22 bp, Homo sapiens
taagtgaaataagtcagataca

SEQ ID NO: 8355740 - DNA, 22 bp, Homo sapiens
caggcaccaatagggatcgtgg

SEQ ID NO: 8355741 - DNA, 22 bp, Homo sapiens
taagtcataagtcatgatgtta

SEQ ID NO: 8355742 - DNA, 22 bp, Homo sapiens
taagtcatatgtgtcccaagtc

SEQ ID NO: 8355743 - DNA, 22 bp, Homo sapiens
taagtcatcacattgcagagat

SEQ ID NO: 8355744 - DNA, 22 bp, Homo sapiens
taagtcataagtcaacaaagga

SEQ ID NO: 8355745 - DNA, 22 bp, Homo sapiens
cagctcagacgcaggtcgagca

SEQ ID NO: 8355746 - DNA, 22 bp, Homo sapiens
cagctcagacgcaggtcgagca

SEQ ID NO: 8355747 - DNA, 22 bp, Homo sapiens
gtgcttctccgttctgcagcac

SEQ ID NO: 8355748 - DNA, 22 bp, Homo sapiens
gtgcttaatacatgtcaataac

SEQ ID NO: 8355749 - DNA, 22 bp, Homo sapiens
gtgctgttttaagtgttcttat

SEQ ID NO: 8355750 - DNA, 22 bp, Homo sapiens
caggcagagctgaagatagatg

SEQ ID NO: 8355751 - DNA, 22 bp, Homo sapiens
caggcagagttagagcaactgg

SEQ ID NO: 8355752 - DNA, 22 bp, Homo sapiens
caggcaccccaggtgagcactg

SEQ ID NO: 8355753 - DNA, 22 bp, Homo sapiens
caggcacctttgtgcatgggca

SEQ ID NO: 8355754 - DNA, 22 bp, Homo sapiens
taatacagaagtgtattaaaat

SEQ ID NO: 8355755 - DNA, 22 bp, Homo sapiens
caggcagatttgctgccctcca

SEQ ID NO: 8355756 - DNA, 22 bp, Homo sapiens
caggcagcagaggagtgtggga

SEQ ID NO: 8355757 - DNA, 22 bp, Homo sapiens
caggcctctatggtcagctgag

SEQ ID NO: 8355758 - DNA, 22 bp, Homo sapiens
caggcctctccttagtctggca

SEQ ID NO: 8355759 - DNA, 22 bp, Homo sapiens
caggcctctccttagtctggca

SEQ ID NO: 8355760 - DNA, 22 bp, Homo sapiens
caggcccagggagggagaccaa

SEQ ID NO: 8355761 - DNA, 22 bp, Homo sapiens
caggccgggcactgcgctaggt

SEQ ID NO: 8355762 - DNA, 22 bp, Homo sapiens
caggcccagcccagcccttcga

SEQ ID NO: 8355763 - DNA, 22 bp, Homo sapiens
caggcccagcccttagccaggt

SEQ ID NO: 8355764 - DNA, 22 bp, Homo sapiens
caggcctgaccctgagcttcac

SEQ ID NO: 8355765 - DNA, 19 bp, Homo sapiens
caggcctcttaccctctct

SEQ ID NO: 8355766 - DNA, 18 bp, Homo sapiens
caggcctcttgatcttcc

SEQ ID NO: 8355767 - DNA, 22 bp, Homo sapiens
tacattgcttatttgatagtac

SEQ ID NO: 8355768 - DNA, 22 bp, Homo sapiens
tacattgcactttattagatac

SEQ ID NO: 8355769 - DNA, 22 bp, Homo sapiens
tacattgctagaaatgtatttt

SEQ ID NO: 8355770 - DNA, 22 bp, Homo sapiens
tacattgattcaggatataggc

SEQ ID NO: 8355771 - DNA, 22 bp, Homo sapiens
caggctgcagcagcagtggccc

SEQ ID NO: 8355772 - DNA, 22 bp, Homo sapiens
tacatttataaggcttctctgt

SEQ ID NO: 8355773 - DNA, 22 bp, Homo sapiens
tacatttataaggcttctctgt

SEQ ID NO: 8355774 - DNA, 22 bp, Homo sapiens
tacatttcctgtcagagatata

SEQ ID NO: 8355775 - DNA, 22 bp, Homo sapiens
tacatttacagagccttctctg

SEQ ID NO: 8355776 - DNA, 22 bp, Homo sapiens
tacattgtgatgtttcaataca

SEQ ID NO: 8355777 - DNA, 22 bp, Homo sapiens
caggcgctgtggctcccacctg

SEQ ID NO: 8355778 - DNA, 22 bp, Homo sapiens
caggcggtggctcctggctgag

SEQ ID NO: 8355779 - DNA, 22 bp, Homo sapiens
caggcgggcaggtgcggcccct

SEQ ID NO: 8355780 - DNA, 18 bp, Homo sapiens
caggcctttgagacagaa

SEQ ID NO: 8355781 - DNA, 22 bp, Homo sapiens
tagaaacaaaatctgatgactc

SEQ ID NO: 8355782 - DNA, 22 bp, Homo sapiens
tagaaaatgttccactgccatt

SEQ ID NO: 8355783 - DNA, 22 bp, Homo sapiens
tagaaaatgttccactgccatt

SEQ ID NO: 8355784 - DNA, 22 bp, Homo sapiens
tagaaacaaagacctgggtgct

SEQ ID NO: 8355785 - DNA, 22 bp, Homo sapiens
tagaaaatggccaagcaggact

SEQ ID NO: 8355786 - DNA, 22 bp, Homo sapiens
tagaaaatggccaagcaggact

SEQ ID NO: 8355787 - DNA, 22 bp, Homo sapiens
tagaaaatggccaagcaggact

SEQ ID NO: 8355788 - DNA, 22 bp, Homo sapiens
tagaaaatccagtgtggggaga

SEQ ID NO: 8355789 - DNA, 22 bp, Homo sapiens
tagaaaatccagtgtggggaga

SEQ ID NO: 8355790 - DNA, 22 bp, Homo sapiens
tagaaaatagggcctgtggagc

SEQ ID NO: 8355791 - DNA, 22 bp, Homo sapiens
tagaaaatagggcctgtggagc

SEQ ID NO: 8355792 - DNA, 22 bp, Homo sapiens
tagaaaagtatgggactgacat

SEQ ID NO: 8355793 - DNA, 22 bp, Homo sapiens
tagaaaagctctaaggcctctc

SEQ ID NO: 8355794 - DNA, 22 bp, Homo sapiens
tagaaaagctctaaggcctctc

SEQ ID NO: 8355795 - DNA, 22 bp, Homo sapiens
caggctgggaacgccacccgct

SEQ ID NO: 8355796 - DNA, 22 bp, Homo sapiens
caggctggcaatgcgtcaagca

SEQ ID NO: 8355797 - DNA, 22 bp, Homo sapiens
caggctggcaatgcgtcaagca

SEQ ID NO: 8355798 - DNA, 22 bp, Homo sapiens
caggctggagttcagtggtgtg

SEQ ID NO: 8355799 - DNA, 22 bp, Homo sapiens
caggctggagttcagtggtgtg

SEQ ID NO: 8355800 - DNA, 22 bp, Homo sapiens
caggctgccgtgaagcaggcct

SEQ ID NO: 8355801 - DNA, 22 bp, Homo sapiens
caggctgcagtgcagtggctat

SEQ ID NO: 8355802 - DNA, 22 bp, Homo sapiens
tagatacaggcaagattatgaa

SEQ ID NO: 8355803 - DNA, 22 bp, Homo sapiens
tagattctgaccctctttttac

SEQ ID NO: 8355804 - DNA, 22 bp, Homo sapiens
tagattctcagaattttagaaa

SEQ ID NO: 8355805 - DNA, 22 bp, Homo sapiens
tagattctccacatgtagcaat

SEQ ID NO: 8355806 - DNA, 22 bp, Homo sapiens
tagaaacaagggagaggattct

SEQ ID NO: 8355807 - DNA, 22 bp, Homo sapiens
caggcttttgcatagcactggg

SEQ ID NO: 8355808 - DNA, 18 bp, Homo sapiens
caggctttgattttggag

SEQ ID NO: 8355809 - DNA, 22 bp, Homo sapiens
caggctttttctgctgtcctct

SEQ ID NO: 8355810 - DNA, 22 bp, Homo sapiens
tagatttcaggctggcttgcgg

SEQ ID NO: 8355811 - DNA, 22 bp, Homo sapiens
tagatttcgctgcatctcaatc

SEQ ID NO: 8355812 - DNA, 22 bp, Homo sapiens
tagatttcctcttcctcattcc

SEQ ID NO: 8355813 - DNA, 20 bp, Homo sapiens
tagatttcatacttctcttt

SEQ ID NO: 8355814 - DNA, 22 bp, Homo sapiens
tagattgttcttaactttataa

SEQ ID NO: 8355815 - DNA, 22 bp, Homo sapiens
tagatttctcattcatagattg

SEQ ID NO: 8355816 - DNA, 22 bp, Homo sapiens
tagatttctcattcatagattg

SEQ ID NO: 8355817 - DNA, 22 bp, Homo sapiens
cagggagcaggctctgtccatc

SEQ ID NO: 8355818 - DNA, 22 bp, Homo sapiens
cagggccaggctgatggcctgg

SEQ ID NO: 8355819 - DNA, 22 bp, Homo sapiens
cagggccagggctatggtgaag

SEQ ID NO: 8355820 - DNA, 22 bp, Homo sapiens
cagggccagggctccatttcct

SEQ ID NO: 8355821 - DNA, 22 bp, Homo sapiens
cagggccattggcgtggctgtc

SEQ ID NO: 8355822 - DNA, 22 bp, Homo sapiens
cagggccatgaggcacagggtc

SEQ ID NO: 8355823 - DNA, 22 bp, Homo sapiens
cagggccatatcttgtgcacca

SEQ ID NO: 8355824 - DNA, 22 bp, Homo sapiens
tagcttcagtggccctagacac

SEQ ID NO: 8355825 - DNA, 22 bp, Homo sapiens
tagcttcagggaaaccactgct

SEQ ID NO: 8355826 - DNA, 22 bp, Homo sapiens
tagcttcatgcttcaccacgct

SEQ ID NO: 8355827 - DNA, 22 bp, Homo sapiens
taggaggcagtcgttcttcagt

SEQ ID NO: 8355828 - DNA, 22 bp, Homo sapiens
taggcagtagcttgagatataa

SEQ ID NO: 8355829 - DNA, 22 bp, Homo sapiens
taggaggcatttgctcccaggg

SEQ ID NO: 8355830 - DNA, 18 bp, Homo sapiens
taggaggctcctgggggc

SEQ ID NO: 8355831 - DNA, 22 bp, Homo sapiens
taggaggctcatgttacaggaa

SEQ ID NO: 8355832 - DNA, 22 bp, Homo sapiens
taggaggcttaaagctgctcag

SEQ ID NO: 8355833 - DNA, 22 bp, Homo sapiens
cagggcccagtccctgctgtca

SEQ ID NO: 8355834 - DNA, 22 bp, Homo sapiens
cagggcccatggctcaggtagg

SEQ ID NO: 8355835 - DNA, 22 bp, Homo sapiens
cagggcccaggccactgggttg

SEQ ID NO: 8355836 - DNA, 22 bp, Homo sapiens
cagggcccaagacacaatgagg

SEQ ID NO: 8355837 - DNA, 22 bp, Homo sapiens
cagggcccatggctcaggtagg

SEQ ID NO: 8355838 - DNA, 18 bp, Homo sapiens
cagggccccagaattatc

SEQ ID NO: 8355839 - DNA, 22 bp, Homo sapiens
cagggccccagggatgtctgct

SEQ ID NO: 8355840 - DNA, 22 bp, Homo sapiens
cagggccctaagatacacatca

SEQ ID NO: 8355841 - DNA, 22 bp, Homo sapiens
cagggccccagggatgtctgct

SEQ ID NO: 8355842 - DNA, 23 bp, Homo sapiens
cagggccctgctcaatttctcca

SEQ ID NO: 8355843 - DNA, 22 bp, Homo sapiens
cagggccctgctcaatttctcc

SEQ ID NO: 8355844 - DNA, 22 bp, Homo sapiens
cagggcctcatcctcagagatt

SEQ ID NO: 8355845 - DNA, 20 bp, Homo sapiens
cagggctctgggcctggcct

SEQ ID NO: 8355846 - DNA, 22 bp, Homo sapiens
cagggctcttccggagcaggga

SEQ ID NO: 8355847 - DNA, 22 bp, Homo sapiens
taggctgggcctgccttccagg

SEQ ID NO: 8355848 - DNA, 22 bp, Homo sapiens
cagggctgagaatttagagaca

SEQ ID NO: 8355849 - DNA, 22 bp, Homo sapiens
caggggctgtttgcctcaggcc

SEQ ID NO: 8355850 - DNA, 22 bp, Homo sapiens
caggggcttaagtgacagaagg

SEQ ID NO: 8355851 - DNA, 22 bp, Homo sapiens
caggggcttaagtgacagaagg

SEQ ID NO: 8355852 - DNA, 22 bp, Homo sapiens
caggggcttttcctctataagg

SEQ ID NO: 8355853 - DNA, 17 bp, Homo sapiens
cagggctgtctgcctag

SEQ ID NO: 8355854 - DNA, 22 bp, Homo sapiens
cagggtagacagtaggtgtctg

SEQ ID NO: 8355855 - DNA, 22 bp, Homo sapiens
cagggtcaagagactccagcag

SEQ ID NO: 8355856 - DNA, 22 bp, Homo sapiens
cagggtcccaggagctgctttc

SEQ ID NO: 8355857 - DNA, 22 bp, Homo sapiens
cagggtctgaaactgatcacag

SEQ ID NO: 8355858 - DNA, 22 bp, Homo sapiens
cagggtagggcaagggaacctg

SEQ ID NO: 8355859 - DNA, 22 bp, Homo sapiens
caggggtgtttttggccaggag

SEQ ID NO: 8355860 - DNA, 22 bp, Homo sapiens
caggggtgtttttggccaggag

SEQ ID NO: 8355861 - DNA, 22 bp, Homo sapiens
caggggtggctgcagcagaggt

SEQ ID NO: 8355862 - DNA, 22 bp, Homo sapiens
caggggtggctgcagcagaggt

SEQ ID NO: 8355863 - DNA, 22 bp, Homo sapiens
cagtcacattgccctgcattta

SEQ ID NO: 8355864 - DNA, 22 bp, Homo sapiens
cagtcacatggatgatggatag

SEQ ID NO: 8355865 - DNA, 22 bp, Homo sapiens
cagtcacacaagtggacttggg

SEQ ID NO: 8355866 - DNA, 22 bp, Homo sapiens
cagtatattctgcagagcctta

SEQ ID NO: 8355867 - DNA, 22 bp, Homo sapiens
tatttgaagacagggtctttaa

SEQ ID NO: 8355868 - DNA, 22 bp, Homo sapiens
cagtcatcagagactcttgatt

SEQ ID NO: 8355869 - DNA, 22 bp, Homo sapiens
cagtcatccaggaaatgtatcc

SEQ ID NO: 8355870 - DNA, 22 bp, Homo sapiens
tattttatctgccagagtggag

SEQ ID NO: 8355871 - DNA, 22 bp, Homo sapiens
tcaaaaatgttttatattggta

SEQ ID NO: 8355872 - DNA, 22 bp, Homo sapiens
tcaaaacactattacctttaat

SEQ ID NO: 8355873 - DNA, 22 bp, Homo sapiens
tcaaaaattttctgaggatgag

SEQ ID NO: 8355874 - DNA, 22 bp, Homo sapiens
tcaagcaaatgtccttttgttc

SEQ ID NO: 8355875 - DNA, 22 bp, Homo sapiens
tcaagcaacagaactgtgagac

SEQ ID NO: 8355876 - DNA, 22 bp, Homo sapiens
tcaagcaactgaattctaaaag

SEQ ID NO: 8355877 - DNA, 22 bp, Homo sapiens
tcaagcaagtgtttggtgtaaa

SEQ ID NO: 8355878 - DNA, 22 bp, Homo sapiens
tcaagcaaagtttagctggtta

SEQ ID NO: 8355879 - DNA, 22 bp, Homo sapiens
tcaagcaaactctgagaaataa

SEQ ID NO: 8355880 - DNA, 22 bp, Homo sapiens
tcaagcaaagatacaaatggaa

SEQ ID NO: 8355881 - DNA, 22 bp, Homo sapiens
tcaagccactggcagaagatta

SEQ ID NO: 8355882 - DNA, 22 bp, Homo sapiens
tcaagcatcttggtctacgatc

SEQ ID NO: 8355883 - DNA, 22 bp, Homo sapiens
tcaagcaatctctgtgtccctg

SEQ ID NO: 8355884 - DNA, 22 bp, Homo sapiens
tcaagcaattctcctgcctcag

SEQ ID NO: 8355885 - DNA, 23 bp, Homo sapiens
tcaagcaattctcctgcctcggc

SEQ ID NO: 8355886 - DNA, 22 bp, Homo sapiens
tcaagcaagttgcatattgcta

SEQ ID NO: 8355887 - DNA, 23 bp, Homo sapiens
tcaagcaataattggtaatagtg

SEQ ID NO: 8355888 - DNA, 22 bp, Homo sapiens
caggtggcatgactgcctacaa

SEQ ID NO: 8355889 - DNA, 22 bp, Homo sapiens
caggtggcattgtcccgccagc

SEQ ID NO: 8355890 - DNA, 22 bp, Homo sapiens
caggtggagctgactgagggca

SEQ ID NO: 8355891 - DNA, 19 bp, Homo sapiens
caggtggcgctctacaggg

SEQ ID NO: 8355892 - DNA, 18 bp, Homo sapiens
caggtgggtctcctgccc

SEQ ID NO: 8355893 - DNA, 22 bp, Homo sapiens
caggtgggtacatcacagagac

SEQ ID NO: 8355894 - DNA, 22 bp, Homo sapiens
caggtgggtacatcacagagac

SEQ ID NO: 8355895 - DNA, 22 bp, Homo sapiens
caggtggggggcttccgagcct

SEQ ID NO: 8355896 - DNA, 22 bp, Homo sapiens
tattatcattggtaatatggtc

SEQ ID NO: 8355897 - DNA, 22 bp, Homo sapiens
tattatcatgttaattagtggg

SEQ ID NO: 8355898 - DNA, 22 bp, Homo sapiens
caggtgcccaggggacagtggc

SEQ ID NO: 8355899 - DNA, 22 bp, Homo sapiens
caggtgctctgctgcaggtaag

SEQ ID NO: 8355900 - DNA, 22 bp, Homo sapiens
caggtgcttctgtaagaaagac

SEQ ID NO: 8355901 - DNA, 22 bp, Homo sapiens
caggtcagcacttggaggtgca

SEQ ID NO: 8355902 - DNA, 22 bp, Homo sapiens
caggtccaagagatcctcctac

SEQ ID NO: 8355903 - DNA, 17 bp, Homo sapiens
caggtacattgctactg

SEQ ID NO: 8355904 - DNA, 22 bp, Homo sapiens
caggtacacaggacaaagtact

SEQ ID NO: 8355905 - DNA, 22 bp, Homo sapiens
caggtaacatgataaaacttac

SEQ ID NO: 8355906 - DNA, 22 bp, Homo sapiens
caggtattaataaatggagagt

SEQ ID NO: 8355907 - DNA, 22 bp, Homo sapiens
caggtaggatggaagggctcaa

SEQ ID NO: 8355908 - DNA, 22 bp, Homo sapiens
ctcccagccttcgccagtctga

SEQ ID NO: 8355909 - DNA, 22 bp, Homo sapiens
ctcccagaaaattctcagacaa

SEQ ID NO: 8355910 - DNA, 22 bp, Homo sapiens
ctcccaaggggtaagggagctg

SEQ ID NO: 8355911 - DNA, 22 bp, Homo sapiens
ctccatggctttcgcatctgca

SEQ ID NO: 8355912 - DNA, 22 bp, Homo sapiens
ctcccaggcacagggaggagcc

SEQ ID NO: 8355913 - DNA, 22 bp, Homo sapiens
ctcccaggactggctctaactg

SEQ ID NO: 8355914 - DNA, 22 bp, Homo sapiens
ctcccaggactggctctaactg

SEQ ID NO: 8355915 - DNA, 22 bp, Homo sapiens
ctcccaggcagggctgcccact

SEQ ID NO: 8355916 - DNA, 22 bp, Homo sapiens
ctcccaggcagggctgcccact

SEQ ID NO: 8355917 - DNA, 22 bp, Homo sapiens
ctcccaggccatgctctagcca

SEQ ID NO: 8355918 - DNA, 22 bp, Homo sapiens
ctcccaggccatgctctagcca

SEQ ID NO: 8355919 - DNA, 22 bp, Homo sapiens
ctcccaggccatgctctagcca

SEQ ID NO: 8355920 - DNA, 22 bp, Homo sapiens
ctcccagggccatcgagtcact

SEQ ID NO: 8355921 - DNA, 22 bp, Homo sapiens
tttaatatttctttcctgaagc

SEQ ID NO: 8355922 - DNA, 22 bp, Homo sapiens
tttaatattctgcattctcctt

SEQ ID NO: 8355923 - DNA, 22 bp, Homo sapiens
tttaatatccagtggatacaaa

SEQ ID NO: 8355924 - DNA, 22 bp, Homo sapiens
ctccagccagagtgcctctgtt

SEQ ID NO: 8355925 - DNA, 20 bp, Homo sapiens
ctccagcccctgccctggtc

SEQ ID NO: 8355926 - DNA, 20 bp, Homo sapiens
ctccagcccctgccctggtc

SEQ ID NO: 8355927 - DNA, 22 bp, Homo sapiens
ctccagcaggtgcgtctcagag

SEQ ID NO: 8355928 - DNA, 22 bp, Homo sapiens
ctccagccagagtgcctctgtt

SEQ ID NO: 8355929 - DNA, 22 bp, Homo sapiens
ctccagccagagtgcctctgtt

SEQ ID NO: 8355930 - DNA, 20 bp, Homo sapiens
ctccagcccctgccctggtc

SEQ ID NO: 8355931 - DNA, 22 bp, Homo sapiens
ctccagcctcagatgacggtac

SEQ ID NO: 8355932 - DNA, 22 bp, Homo sapiens
ctccagcctcagatgacggtac

SEQ ID NO: 8355933 - DNA, 22 bp, Homo sapiens
ttgtctgtccaggcaccccaag

SEQ ID NO: 8355934 - DNA, 22 bp, Homo sapiens
ttgtctgtcccagcttgtgcat

SEQ ID NO: 8355935 - DNA, 22 bp, Homo sapiens
ttgtctgtgaaatggaaatagt

SEQ ID NO: 8355936 - DNA, 23 bp, Homo sapiens
ttgtctgtgcttttccagttgct

SEQ ID NO: 8355937 - DNA, 22 bp, Homo sapiens
ttgtggggttggcagttcttta

SEQ ID NO: 8355938 - DNA, 22 bp, Homo sapiens
ttgtgaaacattcatggatttg

SEQ ID NO: 8355939 - DNA, 22 bp, Homo sapiens
ttgtgaaacattcatggatttg

SEQ ID NO: 8355940 - DNA, 22 bp, Homo sapiens
ttgtgaaaagccgcaagtatag

SEQ ID NO: 8355941 - DNA, 21 bp, Homo sapiens
ttgtgaaagtccaggaacaac

SEQ ID NO: 8355942 - DNA, 22 bp, Homo sapiens
ttgtggggaacccctgtcccac

SEQ ID NO: 8355943 - DNA, 22 bp, Homo sapiens
ttgtggggaggatttgatgaga

SEQ ID NO: 8355944 - DNA, 22 bp, Homo sapiens
ttgtggggcaacagcaggtgaa

SEQ ID NO: 8355945 - DNA, 22 bp, Homo sapiens
ttgtggggccccaatgttgctg

SEQ ID NO: 8355946 - DNA, 22 bp, Homo sapiens
ttcttttcaagaggggcaagga

SEQ ID NO: 8355947 - DNA, 22 bp, Homo sapiens
ttcttttagtcattcagggaag

SEQ ID NO: 8355948 - DNA, 22 bp, Homo sapiens
ttgaaagggttaaagtggtaaa

SEQ ID NO: 8355949 - DNA, 22 bp, Homo sapiens
ttcttttcggcctgtgagaagg

SEQ ID NO: 8355950 - DNA, 22 bp, Homo sapiens
ttgaaaggtgctgtgtgctgat

SEQ ID NO: 8355951 - DNA, 23 bp, Homo sapiens
ttgaaaggtagctggcagctaga

SEQ ID NO: 8355952 - DNA, 22 bp, Homo sapiens
ttgaaaggtgaacatgatgcac

SEQ ID NO: 8355953 - DNA, 22 bp, Homo sapiens
ttgaaaggtgacattgttagag

SEQ ID NO: 8355954 - DNA, 18 bp, Homo sapiens
ttcttttcatgtgatctc

SEQ ID NO: 8355955 - DNA, 22 bp, Homo sapiens
ttcttttcccaatattttgctg

SEQ ID NO: 8355956 - DNA, 22 bp, Homo sapiens
ttcttttcctacacagcgattt

SEQ ID NO: 8355957 - DNA, 22 bp, Homo sapiens
ttcttttcctgtggctcatcca

SEQ ID NO: 8355958 - DNA, 22 bp, Homo sapiens
ttgaaagtctaggcttacagta

SEQ ID NO: 8355959 - DNA, 22 bp, Homo sapiens
ttgaaagtagcagctgcatatg

SEQ ID NO: 8355960 - DNA, 22 bp, Homo sapiens
ttgaaatactgcattgttcagt

SEQ ID NO: 8355961 - DNA, 22 bp, Homo sapiens
ttgaaatactgcattgttcagt

SEQ ID NO: 8355962 - DNA, 22 bp, Homo sapiens
ctcatttagggggcatggtaca

SEQ ID NO: 8355963 - DNA, 22 bp, Homo sapiens
ctcatttgttggcctagagtgg

SEQ ID NO: 8355964 - DNA, 22 bp, Homo sapiens
ctcatttgtaattagttctcag

SEQ ID NO: 8355965 - DNA, 22 bp, Homo sapiens
ctcatttgttacaattcatact

SEQ ID NO: 8355966 - DNA, 22 bp, Homo sapiens
ttgtaatggagcaaacaggttg

SEQ ID NO: 8355967 - DNA, 22 bp, Homo sapiens
ctccacccaaatctcaccttga

SEQ ID NO: 8355968 - DNA, 22 bp, Homo sapiens
ctccaccacacatctgtccacc

SEQ ID NO: 8355969 - DNA, 22 bp, Homo sapiens
ctccacagctcaggctcagagt

SEQ ID NO: 8355970 - DNA, 22 bp, Homo sapiens
ctctccagggcatgagttccac

SEQ ID NO: 8355971 - DNA, 21 bp, Homo sapiens
ctctccaggtaggataaatgt

SEQ ID NO: 8355972 - DNA, 22 bp, Homo sapiens
tttcctatgatattctatgtgt

SEQ ID NO: 8355973 - DNA, 22 bp, Homo sapiens
ctctccaggagctcagagtcta

SEQ ID NO: 8355974 - DNA, 22 bp, Homo sapiens
ctctctgctgtatccttaggct

SEQ ID NO: 8355975 - DNA, 22 bp, Homo sapiens
ctctctgagtgagggacaagct

SEQ ID NO: 8355976 - DNA, 18 bp, Homo sapiens
tttccttgtatgaacata

SEQ ID NO: 8355977 - DNA, 22 bp, Homo sapiens
ctctctgaaactggagagtctc

SEQ ID NO: 8355978 - DNA, 22 bp, Homo sapiens
tttcacatacagtgtatagtag

SEQ ID NO: 8355979 - DNA, 22 bp, Homo sapiens
tttcaaatggatccctcagcct

SEQ ID NO: 8355980 - DNA, 22 bp, Homo sapiens
tttcaatgtatgtctttctgag

SEQ ID NO: 8355981 - DNA, 22 bp, Homo sapiens
tttcaatgtaacatttccaggc

SEQ ID NO: 8355982 - DNA, 22 bp, Homo sapiens
tttcaaatggatccctcagcct

SEQ ID NO: 8355983 - DNA, 21 bp, Homo sapiens
tttcaatgtgttctttgtagt

SEQ ID NO: 8355984 - DNA, 21 bp, Homo sapiens
tttcaatttgccttgagtcat

SEQ ID NO: 8355985 - DNA, 22 bp, Homo sapiens
ctcctcccaattgccaagtgct

SEQ ID NO: 8355986 - DNA, 22 bp, Homo sapiens
ctcctccagcttccagtggctc

SEQ ID NO: 8355987 - DNA, 22 bp, Homo sapiens
ctcctccagctctccctggggg

SEQ ID NO: 8355988 - DNA, 22 bp, Homo sapiens
ctcctccagacttactgaatcc

SEQ ID NO: 8355989 - DNA, 22 bp, Homo sapiens
ctcctccacccgctggggccca

SEQ ID NO: 8355990 - DNA, 18 bp, Homo sapiens
ctcctccacagcccctgc

SEQ ID NO: 8355991 - DNA, 22 bp, Homo sapiens
tttattgttgttagtcataagt

SEQ ID NO: 8355992 - DNA, 22 bp, Homo sapiens
tttatttaccttatgtcctcca

SEQ ID NO: 8355993 - DNA, 22 bp, Homo sapiens
ctcctggcactcagtgtggaag

SEQ ID NO: 8355994 - DNA, 22 bp, Homo sapiens
tttatttaaagtcgtgtgttaa

SEQ ID NO: 8355995 - DNA, 22 bp, Homo sapiens
tttatttaccttatgtcctcca

SEQ ID NO: 8355996 - DNA, 22 bp, Homo sapiens
ctcctggcactgtcttgaccca

SEQ ID NO: 8355997 - DNA, 22 bp, Homo sapiens
ctcctggccacgttcttgctgg

SEQ ID NO: 8355998 - DNA, 22 bp, Homo sapiens
ctcccctccttaggtcttctag

SEQ ID NO: 8355999 - DNA, 21 bp, Homo sapiens
tttagagaatactcactattt

SEQ ID NO: 8356000 - DNA, 22 bp, Homo sapiens
tttagagaagttaggaaataaa

SEQ ID NO: 8356001 - DNA, 22 bp, Homo sapiens
tttaggcagtcattgaacaagt

SEQ ID NO: 8356002 - DNA, 21 bp, Homo sapiens
tttagagaagacaatgggcat

SEQ ID NO: 8356003 - DNA, 22 bp, Homo sapiens
ctcccgtgccactggctcctgc

SEQ ID NO: 8356004 - DNA, 22 bp, Homo sapiens
ctccccttcttgccagatcctt

SEQ ID NO: 8356005 - DNA, 22 bp, Homo sapiens
ctccccttccgccagctcttga

SEQ ID NO: 8356006 - DNA, 22 bp, Homo sapiens
ctccccttccgccagctcttga

SEQ ID NO: 8356007 - DNA, 22 bp, Homo sapiens
ctcctccacagagtccttgcca

SEQ ID NO: 8356008 - DNA, 22 bp, Homo sapiens
ctcctccacagacctactgaat

SEQ ID NO: 8356009 - DNA, 22 bp, Homo sapiens
tttagtctaataaaagtggagt

SEQ ID NO: 8356010 - DNA, 22 bp, Homo sapiens
tttagtctagtctcctcagaaa

SEQ ID NO: 8356011 - DNA, 22 bp, Homo sapiens
tttaggcattgggtgctcaagt

SEQ ID NO: 8356012 - DNA, 22 bp, Homo sapiens
ctgcactgtgtaacagataact

SEQ ID NO: 8356013 - DNA, 22 bp, Homo sapiens
ctgcagggagaggggacagcct

SEQ ID NO: 8356014 - DNA, 22 bp, Homo sapiens
ctgcacccatgagctcaaggga

SEQ ID NO: 8356015 - DNA, 19 bp, Homo sapiens
ctgcagggatgtgcagagt

SEQ ID NO: 8356016 - DNA, 22 bp, Homo sapiens
ctgcagggcagaagggcataga

SEQ ID NO: 8356017 - DNA, 22 bp, Homo sapiens
ctgcagggcccgcctgagccct

SEQ ID NO: 8356018 - DNA, 22 bp, Homo sapiens
ctgcagggcccgcctgagccct

SEQ ID NO: 8356019 - DNA, 22 bp, Homo sapiens
ctgcagggcttaccttgctctg

SEQ ID NO: 8356020 - DNA, 22 bp, Homo sapiens
ctgcaggggcctcgagcacagg

SEQ ID NO: 8356021 - DNA, 22 bp, Homo sapiens
ctgcacagctgggcaagatata

SEQ ID NO: 8356022 - DNA, 22 bp, Homo sapiens
ctgaggccggagcactgaagag

SEQ ID NO: 8356023 - DNA, 22 bp, Homo sapiens
ctgaggccagaacccgaccctg

SEQ ID NO: 8356024 - DNA, 22 bp, Homo sapiens
ctgaccagtccttagcacctgg

SEQ ID NO: 8356025 - DNA, 22 bp, Homo sapiens
ctgacccagaggaactgcaaag

SEQ ID NO: 8356026 - DNA, 20 bp, Homo sapiens
ctgaccagcagcctgtctcc

SEQ ID NO: 8356027 - DNA, 22 bp, Homo sapiens
ctgaccagccctgcccagggaa

SEQ ID NO: 8356028 - DNA, 22 bp, Homo sapiens
ctgacagtcttgccaagtttct

SEQ ID NO: 8356029 - DNA, 22 bp, Homo sapiens
ctctttgaaatccatcactgct

SEQ ID NO: 8356030 - DNA, 18 bp, Homo sapiens
ctctttctttggcacaaa

SEQ ID NO: 8356031 - DNA, 22 bp, Homo sapiens
ctctttcctcagccacagtcta

SEQ ID NO: 8356032 - DNA, 17 bp, Homo sapiens
ctctttataaagagtta

SEQ ID NO: 8356033 - DNA, 22 bp, Homo sapiens
ctgagccatccataccagctta

SEQ ID NO: 8356034 - DNA, 22 bp, Homo sapiens
ctctgccatcttggagctcaag

SEQ ID NO: 8356035 - DNA, 21 bp, Homo sapiens
ctctgcccagggcctcctgcc

SEQ ID NO: 8356036 - DNA, 21 bp, Homo sapiens
ctctgcccagggcctcctgcc

SEQ ID NO: 8356037 - DNA, 21 bp, Homo sapiens
ctctgcccagggcctcctgcc

SEQ ID NO: 8356038 - DNA, 22 bp, Homo sapiens
ctctgcccacgtcttgcccaga

SEQ ID NO: 8356039 - DNA, 22 bp, Homo sapiens
ctctgcccacgtcttgcccaga

SEQ ID NO: 8356040 - DNA, 22 bp, Homo sapiens
tttcctttatgacatcaccact

SEQ ID NO: 8356041 - DNA, 22 bp, Homo sapiens
tttcctttatgacatcaccact

SEQ ID NO: 8356042 - DNA, 22 bp, Homo sapiens
ctctgccaccatgcttcctgac

SEQ ID NO: 8356043 - DNA, 20 bp, Homo sapiens
ctctgcccccagactgacag

SEQ ID NO: 8356044 - DNA, 22 bp, Homo sapiens
ctctgcccccagctggtgcttg

SEQ ID NO: 8356045 - DNA, 21 bp, Homo sapiens
ctctgcccagggcctcctgcc

SEQ ID NO: 8356046 - DNA, 22 bp, Homo sapiens
ctctgcccgtgcctttcccagt

SEQ ID NO: 8356047 - DNA, 22 bp, Homo sapiens
ctctgcccgcggatgccacgtc

SEQ ID NO: 8356048 - DNA, 22 bp, Homo sapiens
ctctgcccgcggatgccacgtc

SEQ ID NO: 8356049 - DNA, 22 bp, Homo sapiens
ctctgccctcgcacatctgcca

SEQ ID NO: 8356050 - DNA, 22 bp, Homo sapiens
ctctgccctcgcacatctgcca

SEQ ID NO: 8356051 - DNA, 19 bp, Homo sapiens
ctctgcctccctcctgggt

SEQ ID NO: 8356052 - DNA, 22 bp, Homo sapiens
tttgccacattctatacatttg

SEQ ID NO: 8356053 - DNA, 22 bp, Homo sapiens
tttgcattttagatttaggcct

SEQ ID NO: 8356054 - DNA, 22 bp, Homo sapiens
tttgcattttgataagatcact

SEQ ID NO: 8356055 - DNA, 22 bp, Homo sapiens
tttgcattttagatttaggcct

SEQ ID NO: 8356056 - DNA, 22 bp, Homo sapiens
tttgctatttttctgtgcagct

SEQ ID NO: 8356057 - DNA, 22 bp, Homo sapiens
tttgctataaaagggtcacacg

SEQ ID NO: 8356058 - DNA, 22 bp, Homo sapiens
tttgctctctcaggctcctggg

SEQ ID NO: 8356059 - DNA, 22 bp, Homo sapiens
tttgctcacttgtgtattttca

SEQ ID NO: 8356060 - DNA, 22 bp, Homo sapiens
tttgctcagttctctgtatttt

SEQ ID NO: 8356061 - DNA, 22 bp, Homo sapiens
tttgggaactctatcatggaaa

SEQ ID NO: 8356062 - DNA, 22 bp, Homo sapiens
tttgggaagaggaatctctgga

SEQ ID NO: 8356063 - DNA, 22 bp, Homo sapiens
tttgggaagaagttgcaaattt

SEQ ID NO: 8356064 - DNA, 22 bp, Homo sapiens
tttgggaataattgcacagatt

SEQ ID NO: 8356065 - DNA, 22 bp, Homo sapiens
tttgggaagtttaaaataagta

SEQ ID NO: 8356066 - DNA, 22 bp, Homo sapiens
tttgggaataattgcacagatt

SEQ ID NO: 8356067 - DNA, 22 bp, Homo sapiens
tttgggaaatattgtgttcaag

SEQ ID NO: 8356068 - DNA, 22 bp, Homo sapiens
tttgggaaatagtagaaaatgt

SEQ ID NO: 8356069 - DNA, 22 bp, Homo sapiens
ttttagattataagtctaattc

SEQ ID NO: 8356070 - DNA, 22 bp, Homo sapiens
ttttagattataagtctaattc

SEQ ID NO: 8356071 - DNA, 22 bp, Homo sapiens
ttttagatagtttaactgcact

SEQ ID NO: 8356072 - DNA, 22 bp, Homo sapiens
ttttagattgggaaatgtaaag

SEQ ID NO: 8356073 - DNA, 22 bp, Homo sapiens
ttttagattgggaaatgtaaag

SEQ ID NO: 8356074 - DNA, 22 bp, Homo sapiens
ttttaagaggaggctgtttgaa

SEQ ID NO: 8356075 - DNA, 22 bp, Homo sapiens
ttttaagatgctagtatttcag

SEQ ID NO: 8356076 - DNA, 22 bp, Homo sapiens
ttttcagaattagcataccatt

SEQ ID NO: 8356077 - DNA, 22 bp, Homo sapiens
ttttcagagagcttttatgtcc

SEQ ID NO: 8356078 - DNA, 22 bp, Homo sapiens
ttttcagaattagcataccatt

SEQ ID NO: 8356079 - DNA, 22 bp, Homo sapiens
ttttcagaaagatgagaaatta

SEQ ID NO: 8356080 - DNA, 22 bp, Homo sapiens
ttttcacttaaggaatttcatg

SEQ ID NO: 8356081 - DNA, 22 bp, Homo sapiens
ttttcagaggcctaagaggttt

SEQ ID NO: 8356082 - DNA, 22 bp, Homo sapiens
ttttcagtggcttgcatatgtt

SEQ ID NO: 8356083 - DNA, 22 bp, Homo sapiens
ttttcagtaatgtctacataat

SEQ ID NO: 8356084 - DNA, 22 bp, Homo sapiens
ctctttaagctcctaacagcca

SEQ ID NO: 8356085 - DNA, 22 bp, Homo sapiens
ctctttagtggtgatgatgcta

SEQ ID NO: 8356086 - DNA, 21 bp, Homo sapiens
ctcttcagtggtgagctcttc

SEQ ID NO: 8356087 - DNA, 22 bp, Homo sapiens
ctcttcatgtgtttaattttta

SEQ ID NO: 8356088 - DNA, 22 bp, Homo sapiens
ctctgtttctcagcctatttcc

SEQ ID NO: 8356089 - DNA, 22 bp, Homo sapiens
ttttagtaccaaccagaagatg

SEQ ID NO: 8356090 - DNA, 22 bp, Homo sapiens
ctcttattcctacagtaacagg

SEQ ID NO: 8356091 - DNA, 21 bp, Homo sapiens
ccttctccacagggtctccgg

SEQ ID NO: 8356092 - DNA, 21 bp, Homo sapiens
ccttctccacagggtctccgg

SEQ ID NO: 8356093 - DNA, 22 bp, Homo sapiens
ccttcctttcagggctatgcct

SEQ ID NO: 8356094 - DNA, 22 bp, Homo sapiens
ttagaaaaaacgtcttctagtg

SEQ ID NO: 8356095 - DNA, 22 bp, Homo sapiens
ttagaaaaaacgtcttctagtg

SEQ ID NO: 8356096 - DNA, 22 bp, Homo sapiens
ttagaatttctgctcactttga

SEQ ID NO: 8356097 - DNA, 22 bp, Homo sapiens
ttagaattattgtttccttcta

SEQ ID NO: 8356098 - DNA, 22 bp, Homo sapiens
ttagaattattgtttccttcta

SEQ ID NO: 8356099 - DNA, 22 bp, Homo sapiens
ttagaatcttgtatcagaagtt

SEQ ID NO: 8356100 - DNA, 22 bp, Homo sapiens
ttagaatccatggttgcagtgg

SEQ ID NO: 8356101 - DNA, 22 bp, Homo sapiens
ttagaatcaggtgttataatca

SEQ ID NO: 8356102 - DNA, 22 bp, Homo sapiens
ttagaatcagaagagaggtatt

SEQ ID NO: 8356103 - DNA, 22 bp, Homo sapiens
ttagaaaaaggctgtggtctta

SEQ ID NO: 8356104 - DNA, 22 bp, Homo sapiens
ttagaaaaaggctgtggtctta

SEQ ID NO: 8356105 - DNA, 22 bp, Homo sapiens
ttagaaaaatgttcagtagttt

SEQ ID NO: 8356106 - DNA, 22 bp, Homo sapiens
ttagaaaaatgttcagtagttt

SEQ ID NO: 8356107 - DNA, 22 bp, Homo sapiens
ttagaaaatggaggtgggaggg

SEQ ID NO: 8356108 - DNA, 22 bp, Homo sapiens
ttagaaaatggaggtgggaggg

SEQ ID NO: 8356109 - DNA, 22 bp, Homo sapiens
ttagaaaacataagtggtaaag

SEQ ID NO: 8356110 - DNA, 22 bp, Homo sapiens
ttagaaaacataagtggtaaag

SEQ ID NO: 8356111 - DNA, 22 bp, Homo sapiens
ttagaaaatttgcttctttgga

SEQ ID NO: 8356112 - DNA, 22 bp, Homo sapiens
ttagaaaatttgcttctttgga

SEQ ID NO: 8356113 - DNA, 22 bp, Homo sapiens
ttagaaaatggaggtgggaggg

SEQ ID NO: 8356114 - DNA, 20 bp, Homo sapiens
ccttccccacccgctgaggt

SEQ ID NO: 8356115 - DNA, 22 bp, Homo sapiens
ccttccccaggtgctcactgtc

SEQ ID NO: 8356116 - DNA, 22 bp, Homo sapiens
ccttccccaggtgctcactgtc

SEQ ID NO: 8356117 - DNA, 22 bp, Homo sapiens
ccttccccagtgattctctcag

SEQ ID NO: 8356118 - DNA, 17 bp, Homo sapiens
ccttcctcatctccttc

SEQ ID NO: 8356119 - DNA, 22 bp, Homo sapiens
ccttcctggctgtccgcctgat

SEQ ID NO: 8356120 - DNA, 19 bp, Homo sapiens
ccttcctccccagggccat

SEQ ID NO: 8356121 - DNA, 22 bp, Homo sapiens
ccttcctggagcccatgcagat

SEQ ID NO: 8356122 - DNA, 22 bp, Homo sapiens
tgtttagaggaacaacagactt

SEQ ID NO: 8356123 - DNA, 22 bp, Homo sapiens
tgtttactttccttctcacagg

SEQ ID NO: 8356124 - DNA, 22 bp, Homo sapiens
tgtttagaatcattcaaaagtt

SEQ ID NO: 8356125 - DNA, 22 bp, Homo sapiens
tgtttataaattttcttgccat

SEQ ID NO: 8356126 - DNA, 22 bp, Homo sapiens
cctgtctctgttaccacatttg

SEQ ID NO: 8356127 - DNA, 22 bp, Homo sapiens
cctgtctctgcagggccctgcc

SEQ ID NO: 8356128 - DNA, 22 bp, Homo sapiens
cctgtgggaaaggtctgctctc

SEQ ID NO: 8356129 - DNA, 22 bp, Homo sapiens
ttaaagtttgcctatgtgttgt

SEQ ID NO: 8356130 - DNA, 22 bp, Homo sapiens
cctgtgctggacagggctgggc

SEQ ID NO: 8356131 - DNA, 22 bp, Homo sapiens
cctgtgctggctttattctcag

SEQ ID NO: 8356132 - DNA, 20 bp, Homo sapiens
cctgtgctgccctcggggcc

SEQ ID NO: 8356133 - DNA, 22 bp, Homo sapiens
cctgtgctccctatgtatctgg

SEQ ID NO: 8356134 - DNA, 22 bp, Homo sapiens
cctgtgcttcagctggaggagg

SEQ ID NO: 8356135 - DNA, 22 bp, Homo sapiens
ttaaagctgctgaatcctattt

SEQ ID NO: 8356136 - DNA, 22 bp, Homo sapiens
ttaaagctggcgttacagtttg

SEQ ID NO: 8356137 - DNA, 22 bp, Homo sapiens
ttaaagctgtagagttacttgc

SEQ ID NO: 8356138 - DNA, 22 bp, Homo sapiens
cctgtgccctggaaggagagag

SEQ ID NO: 8356139 - DNA, 22 bp, Homo sapiens
cctgtgccctcagcctggctct

SEQ ID NO: 8356140 - DNA, 22 bp, Homo sapiens
cctgtgccatcctgagcatccc

SEQ ID NO: 8356141 - DNA, 22 bp, Homo sapiens
cctgtgccctcagcctggctct

SEQ ID NO: 8356142 - DNA, 22 bp, Homo sapiens
cctgtgctcccatagcttctgt

SEQ ID NO: 8356143 - DNA, 19 bp, Homo sapiens
cctgtgctaggagctgacc

SEQ ID NO: 8356144 - DNA, 18 bp, Homo sapiens
tgttccaaggaaggaatc

SEQ ID NO: 8356145 - DNA, 22 bp, Homo sapiens
tgttccataagtggtgctttgt

SEQ ID NO: 8356146 - DNA, 22 bp, Homo sapiens
tgttcattctgtatatgctgta

SEQ ID NO: 8356147 - DNA, 22 bp, Homo sapiens
tgttcattcaacatgtcatcta

SEQ ID NO: 8356148 - DNA, 22 bp, Homo sapiens
tgttcattactgctgtttgcca

SEQ ID NO: 8356149 - DNA, 22 bp, Homo sapiens
cctggtgcttaccagagctttt

SEQ ID NO: 8356150 - DNA, 22 bp, Homo sapiens
tgttccatcagtttttggttga

SEQ ID NO: 8356151 - DNA, 22 bp, Homo sapiens
cctgggctgtacctgtgcgcgg

SEQ ID NO: 8356152 - DNA, 23 bp, Homo sapiens
tgttacaagcaccacaggtggct

SEQ ID NO: 8356153 - DNA, 22 bp, Homo sapiens
cctgggagtgtcagacttgctt

SEQ ID NO: 8356154 - DNA, 21 bp, Homo sapiens
tgggggagaattggttgcttt

SEQ ID NO: 8356155 - DNA, 22 bp, Homo sapiens
cctgggaggtggaggttgcagt

SEQ ID NO: 8356156 - DNA, 22 bp, Homo sapiens
cctgggaggtggatgttgcggt

SEQ ID NO: 8356157 - DNA, 22 bp, Homo sapiens
tggggcagccacatagacaaca

SEQ ID NO: 8356158 - DNA, 22 bp, Homo sapiens
tggggcagctccatctattcca

SEQ ID NO: 8356159 - DNA, 22 bp, Homo sapiens
tggggcagcagacctttcttgg

SEQ ID NO: 8356160 - DNA, 22 bp, Homo sapiens
tggggcagggatgggaaactat

SEQ ID NO: 8356161 - DNA, 22 bp, Homo sapiens
tggggcagtggcttttcaccct

SEQ ID NO: 8356162 - DNA, 22 bp, Homo sapiens
tggggccacacatctctttcta

SEQ ID NO: 8356163 - DNA, 23 bp, Homo sapiens
tggggccaagtgaggaagggtct

SEQ ID NO: 8356164 - DNA, 22 bp, Homo sapiens
tggggcagttaataaacattct

SEQ ID NO: 8356165 - DNA, 22 bp, Homo sapiens
tggggccaagaaggtctcatgt

SEQ ID NO: 8356166 - DNA, 22 bp, Homo sapiens
tggggccaagaaggtctcatgt

SEQ ID NO: 8356167 - DNA, 23 bp, Homo sapiens
tggggccaagtgaggaagggtct

SEQ ID NO: 8356168 - DNA, 22 bp, Homo sapiens
tggggctgtggattctcacgaa

SEQ ID NO: 8356169 - DNA, 22 bp, Homo sapiens
tggggctgtgagactacaggat

SEQ ID NO: 8356170 - DNA, 22 bp, Homo sapiens
cctgggcaacatagtgagacct

SEQ ID NO: 8356171 - DNA, 22 bp, Homo sapiens
cctgggcaacatagtgagaccc

SEQ ID NO: 8356172 - DNA, 22 bp, Homo sapiens
cctgggcaacatagggagaccc

SEQ ID NO: 8356173 - DNA, 22 bp, Homo sapiens
cctgggcaaattatgttactca

SEQ ID NO: 8356174 - DNA, 22 bp, Homo sapiens
cctgggcaaatgccagagacaa

SEQ ID NO: 8356175 - DNA, 22 bp, Homo sapiens
tgtgtattaatgtttgtatatg

SEQ ID NO: 8356176 - DNA, 22 bp, Homo sapiens
ctacagagtgaatgcagaaaat

SEQ ID NO: 8356177 - DNA, 21 bp, Homo sapiens
ctacagaggagagggaaaggc

SEQ ID NO: 8356178 - DNA, 21 bp, Homo sapiens
ctactgtgagacacaaagtgc

SEQ ID NO: 8356179 - DNA, 22 bp, Homo sapiens
ctagaaaaatactttattgtga

SEQ ID NO: 8356180 - DNA, 19 bp, Homo sapiens
ctactttataatatgcctc

SEQ ID NO: 8356181 - DNA, 22 bp, Homo sapiens
ctagaaaaatactttattgtga

SEQ ID NO: 8356182 - DNA, 22 bp, Homo sapiens
ttctctggagggctgcccggcc

SEQ ID NO: 8356183 - DNA, 20 bp, Homo sapiens
ttctctggatagccagatgt

SEQ ID NO: 8356184 - DNA, 21 bp, Homo sapiens
ttctctggataggccagtcct

SEQ ID NO: 8356185 - DNA, 22 bp, Homo sapiens
ttctctggactatttgcactcc

SEQ ID NO: 8356186 - DNA, 22 bp, Homo sapiens
ttctcgctcttcttgagaaact

SEQ ID NO: 8356187 - DNA, 22 bp, Homo sapiens
ctagaaacgcctttagcacaac

SEQ ID NO: 8356188 - DNA, 22 bp, Homo sapiens
ctactgccattgtctctgccat

SEQ ID NO: 8356189 - DNA, 22 bp, Homo sapiens
ctactcttttgagtcttcagat

SEQ ID NO: 8356190 - DNA, 22 bp, Homo sapiens
ctactactccaccacttaccag

SEQ ID NO: 8356191 - DNA, 22 bp, Homo sapiens
ctactatttgtcctttataagc

SEQ ID NO: 8356192 - DNA, 22 bp, Homo sapiens
ctattattaatgtggggctttg

SEQ ID NO: 8356193 - DNA, 22 bp, Homo sapiens
ctattattagataatctacttg

SEQ ID NO: 8356194 - DNA, 22 bp, Homo sapiens
ctattattagataatctacttg

SEQ ID NO: 8356195 - DNA, 22 bp, Homo sapiens
ctattattatcctaatttctgt

SEQ ID NO: 8356196 - DNA, 22 bp, Homo sapiens
ctattattagcaaaaggtggat

SEQ ID NO: 8356197 - DNA, 22 bp, Homo sapiens
ctattattatgttaactggact

SEQ ID NO: 8356198 - DNA, 22 bp, Homo sapiens
ctattatttcctcatctataaa

SEQ ID NO: 8356199 - DNA, 22 bp, Homo sapiens
ctattatttcctcatctataaa

SEQ ID NO: 8356200 - DNA, 22 bp, Homo sapiens
ctcaaggaaagtctggagaaga

SEQ ID NO: 8356201 - DNA, 22 bp, Homo sapiens
ctcaaggacttattcatgcctg

SEQ ID NO: 8356202 - DNA, 22 bp, Homo sapiens
ctcaagtaagaaacagaattgg

SEQ ID NO: 8356203 - DNA, 22 bp, Homo sapiens
ctcaagtcccgcagtgttcctc

SEQ ID NO: 8356204 - DNA, 22 bp, Homo sapiens
ctcacagctgcttcaggatcca

SEQ ID NO: 8356205 - DNA, 22 bp, Homo sapiens
ctcacaggtaccagcaccctcc

SEQ ID NO: 8356206 - DNA, 22 bp, Homo sapiens
ctatgctttagtaatattctca

SEQ ID NO: 8356207 - DNA, 22 bp, Homo sapiens
ctatggcatttattttgtcaat

SEQ ID NO: 8356208 - DNA, 23 bp, Homo sapiens
ctatggttttaaaggtggatatc

SEQ ID NO: 8356209 - DNA, 22 bp, Homo sapiens
ctattaaacactactgtgcact

SEQ ID NO: 8356210 - DNA, 19 bp, Homo sapiens
ctatgtttatatatccagt

SEQ ID NO: 8356211 - DNA, 22 bp, Homo sapiens
ctatgtttatctgtatttctgt

SEQ ID NO: 8356212 - DNA, 22 bp, Homo sapiens
ctattacatttctggacattca

SEQ ID NO: 8356213 - DNA, 22 bp, Homo sapiens
ctattaaatactcttcaaattg

SEQ ID NO: 8356214 - DNA, 22 bp, Homo sapiens
ttctctggccatagctggctag

SEQ ID NO: 8356215 - DNA, 22 bp, Homo sapiens
ttctctggatgtttctcagtca

SEQ ID NO: 8356216 - DNA, 22 bp, Homo sapiens
ctagcaattaggtttataaggc

SEQ ID NO: 8356217 - DNA, 22 bp, Homo sapiens
ctagcactgagaatagtgcata

SEQ ID NO: 8356218 - DNA, 21 bp, Homo sapiens
ttctctggcttctgtagctgg

SEQ ID NO: 8356219 - DNA, 22 bp, Homo sapiens
ctagattcatatatttttggag

SEQ ID NO: 8356220 - DNA, 22 bp, Homo sapiens
ctagcaggtcaaaccagctgat

SEQ ID NO: 8356221 - DNA, 22 bp, Homo sapiens
ctagcacttagggattgttatg

SEQ ID NO: 8356222 - DNA, 22 bp, Homo sapiens
ttcaagtctgaagaggactaat

SEQ ID NO: 8356223 - DNA, 22 bp, Homo sapiens
cgccgcctgctgcagcagctgt

SEQ ID NO: 8356224 - DNA, 18 bp, Homo sapiens
cgccctgctataaatgac

SEQ ID NO: 8356225 - DNA, 22 bp, Homo sapiens
cgcccctcagcgacccaccagc

SEQ ID NO: 8356226 - DNA, 23 bp, Homo sapiens
cgcccagcctcagtgacctgggc

SEQ ID NO: 8356227 - DNA, 22 bp, Homo sapiens
cctttagaaagtcagtagttgc

SEQ ID NO: 8356228 - DNA, 22 bp, Homo sapiens
cctttctctatcgacccatcgc

SEQ ID NO: 8356229 - DNA, 22 bp, Homo sapiens
ttcagagggttttagggtcaga

SEQ ID NO: 8356230 - DNA, 22 bp, Homo sapiens
ttcagaggtagagaggatcttg

SEQ ID NO: 8356231 - DNA, 22 bp, Homo sapiens
ttcagaggtgggctgagaggat

SEQ ID NO: 8356232 - DNA, 22 bp, Homo sapiens
ttcagaggttagagcagtggga

SEQ ID NO: 8356233 - DNA, 22 bp, Homo sapiens
ttcagaggtttccgggccatgc

SEQ ID NO: 8356234 - DNA, 22 bp, Homo sapiens
ttcagataagtcaagttagtat

SEQ ID NO: 8356235 - DNA, 22 bp, Homo sapiens
ttcagataatgacaggtcagga

SEQ ID NO: 8356236 - DNA, 22 bp, Homo sapiens
cggggctgtagcacagctgagc

SEQ ID NO: 8356237 - DNA, 22 bp, Homo sapiens
cggggctgtagcacagctgagc

SEQ ID NO: 8356238 - DNA, 22 bp, Homo sapiens
cggggctggcacaggtgaccac

SEQ ID NO: 8356239 - DNA, 20 bp, Homo sapiens
ttcaggattctagaccacac

SEQ ID NO: 8356240 - DNA, 22 bp, Homo sapiens
ttcagcaaaatatctcagatag

SEQ ID NO: 8356241 - DNA, 22 bp, Homo sapiens
cgtcacttcttagtctattttc

SEQ ID NO: 8356242 - DNA, 22 bp, Homo sapiens
ttcatgaaaaggtctatttctt

SEQ ID NO: 8356243 - DNA, 22 bp, Homo sapiens
ttcatctgtacgccaagtactc

SEQ ID NO: 8356244 - DNA, 22 bp, Homo sapiens
ttcatctggaatttatgttata

SEQ ID NO: 8356245 - DNA, 22 bp, Homo sapiens
cggtctcccgtgtgtgtgcgct

SEQ ID NO: 8356246 - DNA, 22 bp, Homo sapiens
cggtgcggtgattgggtaggtc

SEQ ID NO: 8356247 - DNA, 20 bp, Homo sapiens
cgtaaggcaagtgctgcatc

SEQ ID NO: 8356248 - DNA, 22 bp, Homo sapiens
ctaaataatccctctggtctta

SEQ ID NO: 8356249 - DNA, 22 bp, Homo sapiens
ttcatgaatatattgaattagc

SEQ ID NO: 8356250 - DNA, 22 bp, Homo sapiens
ttcatgaataccccttctgtaa

SEQ ID NO: 8356251 - DNA, 22 bp, Homo sapiens
ttcatgaagggtgaatatagtc

SEQ ID NO: 8356252 - DNA, 22 bp, Homo sapiens
ttcatgaagggtgaatatagtc

SEQ ID NO: 8356253 - DNA, 22 bp, Homo sapiens
ttcatgaacgaacatatgtata

SEQ ID NO: 8356254 - DNA, 22 bp, Homo sapiens
ctggccctcagactcatgggca

SEQ ID NO: 8356255 - DNA, 22 bp, Homo sapiens
ctggccctggagggctgtgcga

SEQ ID NO: 8356256 - DNA, 22 bp, Homo sapiens
ctggccctggagggctgtgcga

SEQ ID NO: 8356257 - DNA, 16 bp, Homo sapiens
ctggccctggctctgg

SEQ ID NO: 8356258 - DNA, 22 bp, Homo sapiens
ctggccctgctccgcgccgcgg

SEQ ID NO: 8356259 - DNA, 22 bp, Homo sapiens
ctggccctcgtcagtttcactg

SEQ ID NO: 8356260 - DNA, 22 bp, Homo sapiens
ctggccctcggagtccagctgc

SEQ ID NO: 8356261 - DNA, 22 bp, Homo sapiens
ctggctcactagccctgccctg

SEQ ID NO: 8356262 - DNA, 22 bp, Homo sapiens
ctggctcacctccgctccagca

SEQ ID NO: 8356263 - DNA, 22 bp, Homo sapiens
ctggctcagacagctgtgcagt

SEQ ID NO: 8356264 - DNA, 22 bp, Homo sapiens
ctggctcagacagctgtgcagt

SEQ ID NO: 8356265 - DNA, 22 bp, Homo sapiens
ctggctcagggtggtctgggtc

SEQ ID NO: 8356266 - DNA, 22 bp, Homo sapiens
ctggctcaggaaagttgctgct

SEQ ID NO: 8356267 - DNA, 22 bp, Homo sapiens
ctggccctgtcagcacagaatc

SEQ ID NO: 8356268 - DNA, 22 bp, Homo sapiens
ctggccctgtggaggcaggaac

SEQ ID NO: 8356269 - DNA, 22 bp, Homo sapiens
ctggccctgtaggatgtgagtt

SEQ ID NO: 8356270 - DNA, 22 bp, Homo sapiens
ctggccctgtaggatgtgagtt

SEQ ID NO: 8356271 - DNA, 22 bp, Homo sapiens
ctggccctggtaaggacaccca

SEQ ID NO: 8356272 - DNA, 23 bp, Homo sapiens
ctggccctggctctgtgatcatg

SEQ ID NO: 8356273 - DNA, 22 bp, Homo sapiens
ctggccctggctggagcccagg

SEQ ID NO: 8356274 - DNA, 22 bp, Homo sapiens
ctggctgcaggaaggagtgggc

SEQ ID NO: 8356275 - DNA, 22 bp, Homo sapiens
ctggctgcaggatgaggctgcc

SEQ ID NO: 8356276 - DNA, 22 bp, Homo sapiens
ctggctcatgtgatgagggcaa

SEQ ID NO: 8356277 - DNA, 23 bp, Homo sapiens
ctggctcatcctggttgcagtgg

SEQ ID NO: 8356278 - DNA, 22 bp, Homo sapiens
ctggctcattttagcatcaggt

SEQ ID NO: 8356279 - DNA, 22 bp, Homo sapiens
ctggctcagttcttggttttca

SEQ ID NO: 8356280 - DNA, 22 bp, Homo sapiens
ctggctcagtgccttcagaagt

SEQ ID NO: 8356281 - DNA, 22 bp, Homo sapiens
ctggctcatagagcagctccaa

SEQ ID NO: 8356282 - DNA, 22 bp, Homo sapiens
ctggctcatccaggtgttgctc

SEQ ID NO: 8356283 - DNA, 22 bp, Homo sapiens
ctggctcatagagcagctccaa

SEQ ID NO: 8356284 - DNA, 22 bp, Homo sapiens
ctggctgcagtagcaagagact

SEQ ID NO: 8356285 - DNA, 22 bp, Homo sapiens
ctggctgcctggagtgagggag

SEQ ID NO: 8356286 - DNA, 22 bp, Homo sapiens
ctggcaggctctctggtcggtt

SEQ ID NO: 8356287 - DNA, 22 bp, Homo sapiens
ctggcaggctctctggtcggtt

SEQ ID NO: 8356288 - DNA, 22 bp, Homo sapiens
ctggcaggcaaattggtgggag

SEQ ID NO: 8356289 - DNA, 22 bp, Homo sapiens
ctggcaggcagacttctgcaag

SEQ ID NO: 8356290 - DNA, 22 bp, Homo sapiens
ctggcaggcggcagagcccagg

SEQ ID NO: 8356291 - DNA, 22 bp, Homo sapiens
ctggcaggatctaaccagggaa

SEQ ID NO: 8356292 - DNA, 20 bp, Homo sapiens
ctggcaggagcgagtctacc

SEQ ID NO: 8356293 - DNA, 21 bp, Homo sapiens
ctgccacctgctccatcagca

SEQ ID NO: 8356294 - DNA, 22 bp, Homo sapiens
ctgccactctgggtgggcctgg

SEQ ID NO: 8356295 - DNA, 22 bp, Homo sapiens
ctgccagacacgttatgctcat

SEQ ID NO: 8356296 - DNA, 22 bp, Homo sapiens
ctgccactttggagtgctcaga

SEQ ID NO: 8356297 - DNA, 22 bp, Homo sapiens
ctgccagaaggttcctgctgca

SEQ ID NO: 8356298 - DNA, 22 bp, Homo sapiens
ctgccagcagaggccagcgctg

SEQ ID NO: 8356299 - DNA, 22 bp, Homo sapiens
ctgccagccaggccaggtaggc

SEQ ID NO: 8356300 - DNA, 22 bp, Homo sapiens
ctgccagctcaaagcgcagcta

SEQ ID NO: 8356301 - DNA, 22 bp, Homo sapiens
ctggcagccaagtgggatactc

SEQ ID NO: 8356302 - DNA, 22 bp, Homo sapiens
ctgccagctcaccggctcagac

SEQ ID NO: 8356303 - DNA, 22 bp, Homo sapiens
ctggcaggaagttagatggtaa

SEQ ID NO: 8356304 - DNA, 22 bp, Homo sapiens
ctggggcccatcgagggctgag

SEQ ID NO: 8356305 - DNA, 22 bp, Homo sapiens
ctggggcccgagccttgggcca

SEQ ID NO: 8356306 - DNA, 22 bp, Homo sapiens
ctggggccagtgaggaggcttt

SEQ ID NO: 8356307 - DNA, 22 bp, Homo sapiens
ctggggccacaacggcgcacgc

SEQ ID NO: 8356308 - DNA, 22 bp, Homo sapiens
ctggggcattgggagaggcctg

SEQ ID NO: 8356309 - DNA, 22 bp, Homo sapiens
ctggggcccgagccttgggcca

SEQ ID NO: 8356310 - DNA, 22 bp, Homo sapiens
ctggggccctgggtctgccctc

SEQ ID NO: 8356311 - DNA, 22 bp, Homo sapiens
ctggggccctgggtctgccctc

SEQ ID NO: 8356312 - DNA, 22 bp, Homo sapiens
ctggggctcactttggtcaggc

SEQ ID NO: 8356313 - DNA, 23 bp, Homo sapiens
ctggggctcattgcagtagccat

SEQ ID NO: 8356314 - DNA, 22 bp, Homo sapiens
ctggggctctctggaatgcttg

SEQ ID NO: 8356315 - DNA, 22 bp, Homo sapiens
ctggggctcactttggtcaggc

SEQ ID NO: 8356316 - DNA, 23 bp, Homo sapiens
ctggggctcattgcagtagccat

SEQ ID NO: 8356317 - DNA, 22 bp, Homo sapiens
ctggggctgcggacgggagccc

SEQ ID NO: 8356318 - DNA, 22 bp, Homo sapiens
ctggggctgcggtggaggagcc

SEQ ID NO: 8356319 - DNA, 22 bp, Homo sapiens
ctggggctgcagcgatcttcat

SEQ ID NO: 8356320 - DNA, 22 bp, Homo sapiens
ctggggctgcggacgggagccc

SEQ ID NO: 8356321 - DNA, 22 bp, Homo sapiens
ctggggctggtgaggcaggctc

SEQ ID NO: 8356322 - DNA, 22 bp, Homo sapiens
ctgggctgcatcaaagaggcat

SEQ ID NO: 8356323 - DNA, 19 bp, Homo sapiens
ctgggccagagctgtcctc

SEQ ID NO: 8356324 - DNA, 22 bp, Homo sapiens
ctgggccagaccttgtggtctt

SEQ ID NO: 8356325 - DNA, 20 bp, Homo sapiens
ctggggaggaggatgtgttc

SEQ ID NO: 8356326 - DNA, 22 bp, Homo sapiens
ctgggaggcaccgcgtcgtgct

SEQ ID NO: 8356327 - DNA, 22 bp, Homo sapiens
ctgggaggcaccgcgtcgtgct

SEQ ID NO: 8356328 - DNA, 22 bp, Homo sapiens
ctgggaggattcattgaggtga

SEQ ID NO: 8356329 - DNA, 22 bp, Homo sapiens
ctgggaggcactattcaggagg

SEQ ID NO: 8356330 - DNA, 22 bp, Homo sapiens
ctgggaggcagaggttgcagtg

SEQ ID NO: 8356331 - DNA, 22 bp, Homo sapiens
ctgggaggcagaggttgtagtg

SEQ ID NO: 8356332 - DNA, 22 bp, Homo sapiens
ctgggaggcccacgttgggaag

SEQ ID NO: 8356333 - DNA, 22 bp, Homo sapiens
ctgggaggcccacgttgggaag

SEQ ID NO: 8356334 - DNA, 22 bp, Homo sapiens
ctgggcagctgtgcaaacaata

SEQ ID NO: 8356335 - DNA, 22 bp, Homo sapiens
ctgggccactccagatgcccac

SEQ ID NO: 8356336 - DNA, 22 bp, Homo sapiens
ctgggccacaagcctgtgtgat

SEQ ID NO: 8356337 - DNA, 22 bp, Homo sapiens
ctgggcagttttacatcattgc

SEQ ID NO: 8356338 - DNA, 22 bp, Homo sapiens
ctgggcagtttattcagttctg

SEQ ID NO: 8356339 - DNA, 22 bp, Homo sapiens
ctgggcaggagaggtggttgga

SEQ ID NO: 8356340 - DNA, 22 bp, Homo sapiens
ctgtgtctcgttaaagcattgg

SEQ ID NO: 8356341 - DNA, 22 bp, Homo sapiens
ctgtgtctctccttacaagact

SEQ ID NO: 8356342 - DNA, 22 bp, Homo sapiens
ctgttctttagttccactgcaa

SEQ ID NO: 8356343 - DNA, 22 bp, Homo sapiens
ctgttctgaccagtgcagggat

SEQ ID NO: 8356344 - DNA, 22 bp, Homo sapiens
ctgttctgctgcataaaaactt

SEQ ID NO: 8356345 - DNA, 22 bp, Homo sapiens
ctgttctgaccagtgcagggat

SEQ ID NO: 8356346 - DNA, 22 bp, Homo sapiens
ctgttctgtaagctgctgttgt

SEQ ID NO: 8356347 - DNA, 22 bp, Homo sapiens
ctgttctgaactgcctgcatgc

SEQ ID NO: 8356348 - DNA, 22 bp, Homo sapiens
ctgttcatgttgaggcataggg

SEQ ID NO: 8356349 - DNA, 22 bp, Homo sapiens
ctgttattttcctctgaactct

SEQ ID NO: 8356350 - DNA, 22 bp, Homo sapiens
ctgtggtggcctccctgccatg

SEQ ID NO: 8356351 - DNA, 22 bp, Homo sapiens
ctgtggctgcgtaggtctggca

SEQ ID NO: 8356352 - DNA, 22 bp, Homo sapiens
ctgtgtctaatcttatacatca

SEQ ID NO: 8356353 - DNA, 22 bp, Homo sapiens
ctgtggctctcagaggctgctg

SEQ ID NO: 8356354 - DNA, 22 bp, Homo sapiens
ctgtcctgaagttttcatgaga

SEQ ID NO: 8356355 - DNA, 22 bp, Homo sapiens
ctgggtgccacgggcaccctgg

SEQ ID NO: 8356356 - DNA, 19 bp, Homo sapiens
ctgtcctggtttggtccct

SEQ ID NO: 8356357 - DNA, 22 bp, Homo sapiens
ctgtcctgatggtgccactggt

SEQ ID NO: 8356358 - DNA, 22 bp, Homo sapiens
ctgtcctgcagttgggggcagg

SEQ ID NO: 8356359 - DNA, 22 bp, Homo sapiens
ctgtgcagtgtggggtaggcct

SEQ ID NO: 8356360 - DNA, 22 bp, Homo sapiens
ctgtgccactgggggccggcaa

SEQ ID NO: 8356361 - DNA, 22 bp, Homo sapiens
ctgtgagtcttcagcaagtgtt

SEQ ID NO: 8356362 - DNA, 22 bp, Homo sapiens
ctgtcctgtgcattgtcagatg

SEQ ID NO: 8356363 - DNA, 23 bp, Homo sapiens
ctgtcctgtagttcacgttggcc

SEQ ID NO: 8356364 - DNA, 22 bp, Homo sapiens
ctgtggccagtcccacacctcc

SEQ ID NO: 8356365 - DNA, 22 bp, Homo sapiens
ctgtggccagatggtgccagtt

SEQ ID NO: 8356366 - DNA, 22 bp, Homo sapiens
ctgtggccccaccctcttggcc

SEQ ID NO: 8356367 - DNA, 23 bp, Homo sapiens
ctgtggccctgcttcatgcagcc

SEQ ID NO: 8356368 - DNA, 22 bp, Homo sapiens
ctgtggctcatatctgtaatct

SEQ ID NO: 8356369 - DNA, 22 bp, Homo sapiens
ctgtgcccataatctggtattt

SEQ ID NO: 8356370 - DNA, 22 bp, Homo sapiens
ctgtgccccacagagctccaca

SEQ ID NO: 8356371 - DNA, 23 bp, Homo sapiens
ctgtgcccggggctccacctgat

SEQ ID NO: 8356372 - DNA, 22 bp, Homo sapiens
ctgtgccagcctgtcccaggag

SEQ ID NO: 8356373 - DNA, 22 bp, Homo sapiens
ctgtgcccagctccctgactgc

SEQ ID NO: 8356374 - DNA, 19 bp, Homo sapiens
cttcctggaggagagcctc

SEQ ID NO: 8356375 - DNA, 22 bp, Homo sapiens
cttgaccgaatatgatcacttc

SEQ ID NO: 8356376 - DNA, 22 bp, Homo sapiens
cttgaccgattctagtggacat

SEQ ID NO: 8356377 - DNA, 22 bp, Homo sapiens
cttgacattcttaataatttta

SEQ ID NO: 8356378 - DNA, 22 bp, Homo sapiens
cttgacattagttatgcagata

SEQ ID NO: 8356379 - DNA, 22 bp, Homo sapiens
cttcctggctcggtgcctcacc

SEQ ID NO: 8356380 - DNA, 22 bp, Homo sapiens
cttcctggcatgggtctcatga

SEQ ID NO: 8356381 - DNA, 22 bp, Homo sapiens
cttcctgggacacctaactcta

SEQ ID NO: 8356382 - DNA, 22 bp, Homo sapiens
cttgtctgtgtcggataaaact

SEQ ID NO: 8356383 - DNA, 22 bp, Homo sapiens
cttgcccgcgaagaagctagga

SEQ ID NO: 8356384 - DNA, 23 bp, Homo sapiens
cttattcattcatgtagcccatt

SEQ ID NO: 8356385 - DNA, 22 bp, Homo sapiens
cttcaaaagccagaagcctgcg

SEQ ID NO: 8356386 - DNA, 22 bp, Homo sapiens
cttcagaaccagccagaagagg

SEQ ID NO: 8356387 - DNA, 22 bp, Homo sapiens
cttcagaagagttaagtgtgag

SEQ ID NO: 8356388 - DNA, 22 bp, Homo sapiens
cttcagaagcctgcagcctttg

SEQ ID NO: 8356389 - DNA, 22 bp, Homo sapiens
cttccctttttatgtcttcagc

SEQ ID NO: 8356390 - DNA, 22 bp, Homo sapiens
cttcctgaggtgctgagcacag

SEQ ID NO: 8356391 - DNA, 22 bp, Homo sapiens
cttcagggaggagcatgggttc

SEQ ID NO: 8356392 - DNA, 21 bp, Homo sapiens
gagatttagaaggatcaattt

SEQ ID NO: 8356393 - DNA, 22 bp, Homo sapiens
gagattcagtaaccaatatggt

SEQ ID NO: 8356394 - DNA, 22 bp, Homo sapiens
gagatggaatctgtgtggaggg

SEQ ID NO: 8356395 - DNA, 22 bp, Homo sapiens
gagatggagtctttttctgtca

SEQ ID NO: 8356396 - DNA, 22 bp, Homo sapiens
gagatggagtctttttctgtca

SEQ ID NO: 8356397 - DNA, 22 bp, Homo sapiens
gagatgtacaatgtgtattaat

SEQ ID NO: 8356398 - DNA, 22 bp, Homo sapiens
gagccagaaaagctgcctgact

SEQ ID NO: 8356399 - DNA, 22 bp, Homo sapiens
gagccagccgcaagagctgtga

SEQ ID NO: 8356400 - DNA, 22 bp, Homo sapiens
gagccagcagccggcaccacca

SEQ ID NO: 8356401 - DNA, 22 bp, Homo sapiens
gagccaggtcgggccgcggcga

SEQ ID NO: 8356402 - DNA, 22 bp, Homo sapiens
gagccaggtcgggccgcggcga

SEQ ID NO: 8356403 - DNA, 22 bp, Homo sapiens
gagccaggttggaggctgcagt

SEQ ID NO: 8356404 - DNA, 22 bp, Homo sapiens
gagccaggggtcagctccgagg

SEQ ID NO: 8356405 - DNA, 22 bp, Homo sapiens
gagccagggctgtgagctgagc

SEQ ID NO: 8356406 - DNA, 22 bp, Homo sapiens
gagccaagcaatatacccaacc

SEQ ID NO: 8356407 - DNA, 22 bp, Homo sapiens
gagccacagaaggaaattgggg

SEQ ID NO: 8356408 - DNA, 22 bp, Homo sapiens
gagccacagcaacctcaaagga

SEQ ID NO: 8356409 - DNA, 22 bp, Homo sapiens
gagcagctgtccccaaagcttc

SEQ ID NO: 8356410 - DNA, 22 bp, Homo sapiens
gagcagctgtggggttgaccat

SEQ ID NO: 8356411 - DNA, 22 bp, Homo sapiens
gagaggccctgtggtcccagct

SEQ ID NO: 8356412 - DNA, 22 bp, Homo sapiens
gagaggccggcgtcgctgcggc

SEQ ID NO: 8356413 - DNA, 22 bp, Homo sapiens
gagaggcctgagaggctgcgga

SEQ ID NO: 8356414 - DNA, 22 bp, Homo sapiens
gagaggccctgaagcccacaga

SEQ ID NO: 8356415 - DNA, 18 bp, Homo sapiens
gagaggcccggctgtgcc

SEQ ID NO: 8356416 - DNA, 22 bp, Homo sapiens
gagagggagccagccaggaacc

SEQ ID NO: 8356417 - DNA, 22 bp, Homo sapiens
gagatgagtgggggatctctca

SEQ ID NO: 8356418 - DNA, 22 bp, Homo sapiens
gagatgagtgggggatctctca

SEQ ID NO: 8356419 - DNA, 22 bp, Homo sapiens
gagatgcttgtctgtcttatca

SEQ ID NO: 8356420 - DNA, 22 bp, Homo sapiens
gagatgacatgcctgttgtagg

SEQ ID NO: 8356421 - DNA, 22 bp, Homo sapiens
gagatcttcctgagattcattt

SEQ ID NO: 8356422 - DNA, 22 bp, Homo sapiens
gagatcggtaaagagcatgcac

SEQ ID NO: 8356423 - DNA, 22 bp, Homo sapiens
gacctctgaaggcagagcaggg

SEQ ID NO: 8356424 - DNA, 22 bp, Homo sapiens
gacctctgggtgatgcccaggc

SEQ ID NO: 8356425 - DNA, 22 bp, Homo sapiens
gacctctgggtgatgcccaggc

SEQ ID NO: 8356426 - DNA, 22 bp, Homo sapiens
gacctcgtgatccgccctcctt

SEQ ID NO: 8356427 - DNA, 22 bp, Homo sapiens
gagaagggatatggcttcttga

SEQ ID NO: 8356428 - DNA, 22 bp, Homo sapiens
gagaagggatatgccactctcg

SEQ ID NO: 8356429 - DNA, 22 bp, Homo sapiens
gaggaggctaagtgggctctgg

SEQ ID NO: 8356430 - DNA, 22 bp, Homo sapiens
gaggaggccagtggaaggaagc

SEQ ID NO: 8356431 - DNA, 22 bp, Homo sapiens
gaggaggccagtggaaggaagc

SEQ ID NO: 8356432 - DNA, 22 bp, Homo sapiens
gaggaggcacttgagcagatgt

SEQ ID NO: 8356433 - DNA, 22 bp, Homo sapiens
gaggaggcagcctatcccttag

SEQ ID NO: 8356434 - DNA, 22 bp, Homo sapiens
gaggaggcagcctatcccttag

SEQ ID NO: 8356435 - DNA, 22 bp, Homo sapiens
gaggaggcactagttagtgaca

SEQ ID NO: 8356436 - DNA, 22 bp, Homo sapiens
gaggaaaataacaactaagggc

SEQ ID NO: 8356437 - DNA, 20 bp, Homo sapiens
gaggaaaagctgccaggcct

SEQ ID NO: 8356438 - DNA, 22 bp, Homo sapiens
gaggaaaagagacaggttattg

SEQ ID NO: 8356439 - DNA, 22 bp, Homo sapiens
gaggaaaatgcaacaggaatgc

SEQ ID NO: 8356440 - DNA, 22 bp, Homo sapiens
gaggcagaagttgcagtgagca

SEQ ID NO: 8356441 - DNA, 22 bp, Homo sapiens
gaggcagaggttgcagtgagct

SEQ ID NO: 8356442 - DNA, 22 bp, Homo sapiens
gagcggcaggagccacctgcct

SEQ ID NO: 8356443 - DNA, 22 bp, Homo sapiens
gagccctgttcaggcctcctca

SEQ ID NO: 8356444 - DNA, 22 bp, Homo sapiens
gagcctcctcctggtgtgccga

SEQ ID NO: 8356445 - DNA, 22 bp, Homo sapiens
gagcctgagcaatgtgatgttt

SEQ ID NO: 8356446 - DNA, 22 bp, Homo sapiens
gagcgggggctgccgggatttg

SEQ ID NO: 8356447 - DNA, 22 bp, Homo sapiens
gagctctgtgtagcctgagggt

SEQ ID NO: 8356448 - DNA, 22 bp, Homo sapiens
gagctctgttctcgtcctgctg

SEQ ID NO: 8356449 - DNA, 22 bp, Homo sapiens
gagctctgactgctgggtgaca

SEQ ID NO: 8356450 - DNA, 22 bp, Homo sapiens
gagcttggacaccttggcaggt

SEQ ID NO: 8356451 - DNA, 22 bp, Homo sapiens
gaatatattggtgaaaatagtt

SEQ ID NO: 8356452 - DNA, 22 bp, Homo sapiens
gaatatattattcagcttttca

SEQ ID NO: 8356453 - DNA, 22 bp, Homo sapiens
gaatacctggtcccacatctca

SEQ ID NO: 8356454 - DNA, 22 bp, Homo sapiens
gaatatgtttgacatttagttg

SEQ ID NO: 8356455 - DNA, 22 bp, Homo sapiens
gaatatgtttgacatttagttg

SEQ ID NO: 8356456 - DNA, 22 bp, Homo sapiens
gaatatgtgcatttatgagtgt

SEQ ID NO: 8356457 - DNA, 22 bp, Homo sapiens
gaatattagtatcagttatacc

SEQ ID NO: 8356458 - DNA, 22 bp, Homo sapiens
gacaagctcttgtttcatggtt

SEQ ID NO: 8356459 - DNA, 22 bp, Homo sapiens
gacaagctcccggtggccctcc

SEQ ID NO: 8356460 - DNA, 22 bp, Homo sapiens
gacaagactatgtagaaagtat

SEQ ID NO: 8356461 - DNA, 22 bp, Homo sapiens
gacaagactggtttatttaagg

SEQ ID NO: 8356462 - DNA, 22 bp, Homo sapiens
gacaagatgagcagctcagtgt

SEQ ID NO: 8356463 - DNA, 22 bp, Homo sapiens
gacaagacacctctctccatcc

SEQ ID NO: 8356464 - DNA, 17 bp, Homo sapiens
gacaagacagaattcat

SEQ ID NO: 8356465 - DNA, 22 bp, Homo sapiens
gacaagacattggtaaagatat

SEQ ID NO: 8356466 - DNA, 22 bp, Homo sapiens
gacaagacagcttgcagacaac

SEQ ID NO: 8356467 - DNA, 22 bp, Homo sapiens
gacaagacatgtgatgacatca

SEQ ID NO: 8356468 - DNA, 22 bp, Homo sapiens
gaaggaaaggtctcatgccttt

SEQ ID NO: 8356469 - DNA, 22 bp, Homo sapiens
gaaggaaatctgtgatttatgc

SEQ ID NO: 8356470 - DNA, 22 bp, Homo sapiens
gaaggaagattctgttggaatc

SEQ ID NO: 8356471 - DNA, 22 bp, Homo sapiens
gaaggaaaaatactctgtaagg

SEQ ID NO: 8356472 - DNA, 22 bp, Homo sapiens
gaagctttattgcaagtgaggc

SEQ ID NO: 8356473 - DNA, 22 bp, Homo sapiens
gaagctttgagagcagaagccc

SEQ ID NO: 8356474 - DNA, 22 bp, Homo sapiens
gaaggaaaacagatctgcctga

SEQ ID NO: 8356475 - DNA, 23 bp, Homo sapiens
gaatacagagataaatagaacac

SEQ ID NO: 8356476 - DNA, 22 bp, Homo sapiens
gaatacaggcaggtggctgtgc

SEQ ID NO: 8356477 - DNA, 22 bp, Homo sapiens
gaatacaggcaggtggctgtgc

SEQ ID NO: 8356478 - DNA, 19 bp, Homo sapiens
gaatacagataataagcag

SEQ ID NO: 8356479 - DNA, 22 bp, Homo sapiens
gaataacagcaagtttgcaggc

SEQ ID NO: 8356480 - DNA, 22 bp, Homo sapiens
gaatacaagccaggcacaaggc

SEQ ID NO: 8356481 - DNA, 22 bp, Homo sapiens
gaataacattggaaccctgaag

SEQ ID NO: 8356482 - DNA, 22 bp, Homo sapiens
gaataacattttttcctttaca

SEQ ID NO: 8356483 - DNA, 22 bp, Homo sapiens
gaagttttagtcaaaatgtaga

SEQ ID NO: 8356484 - DNA, 22 bp, Homo sapiens
gacaaggagccaccagtcacgt

SEQ ID NO: 8356485 - DNA, 22 bp, Homo sapiens
gacacagaatgggtgctcagta

SEQ ID NO: 8356486 - DNA, 22 bp, Homo sapiens
gacaataaaatgatcttacagt

SEQ ID NO: 8356487 - DNA, 22 bp, Homo sapiens
gacaagttacacctgtgcttga

SEQ ID NO: 8356488 - DNA, 22 bp, Homo sapiens
gacaggtgtgtgtatattaggg

SEQ ID NO: 8356489 - DNA, 18 bp, Homo sapiens
gacaggtgggtgagacca

SEQ ID NO: 8356490 - DNA, 22 bp, Homo sapiens
gacaggtgggttctcgtatctg

SEQ ID NO: 8356491 - DNA, 22 bp, Homo sapiens
gacaggtgctaagggacctggc

SEQ ID NO: 8356492 - DNA, 22 bp, Homo sapiens
gacccagggtttctgcacaggg

SEQ ID NO: 8356493 - DNA, 22 bp, Homo sapiens
gaccctggtgggcactggcacc

SEQ ID NO: 8356494 - DNA, 22 bp, Homo sapiens
gaccctgtttctacaaataatt

SEQ ID NO: 8356495 - DNA, 22 bp, Homo sapiens
gaagagtatatttagtgaaatc

SEQ ID NO: 8356496 - DNA, 22 bp, Homo sapiens
gaagaggctttcctagggcaag

SEQ ID NO: 8356497 - DNA, 22 bp, Homo sapiens
gaagatacaaatttcttagatg

SEQ ID NO: 8356498 - DNA, 22 bp, Homo sapiens
gaagatacacagagctgtcttt

SEQ ID NO: 8356499 - DNA, 22 bp, Homo sapiens
gaagatacctcaattctttgaa

SEQ ID NO: 8356500 - DNA, 22 bp, Homo sapiens
gaagccagtactgtgctctgca

SEQ ID NO: 8356501 - DNA, 22 bp, Homo sapiens
gaagccagcatccctctcccat

SEQ ID NO: 8356502 - DNA, 22 bp, Homo sapiens
gaagacattaagtctatgtcac

SEQ ID NO: 8356503 - DNA, 21 bp, Homo sapiens
gaacatttgggttgtttctac

SEQ ID NO: 8356504 - DNA, 22 bp, Homo sapiens
gaacatttggcatgagaatttg

SEQ ID NO: 8356505 - DNA, 22 bp, Homo sapiens
gaagactttaagccgagattag

SEQ ID NO: 8356506 - DNA, 22 bp, Homo sapiens
gaagaggactgtggcatcctag

SEQ ID NO: 8356507 - DNA, 22 bp, Homo sapiens
gaagaggatgacaggagccggt

SEQ ID NO: 8356508 - DNA, 22 bp, Homo sapiens
gaaatcattagcaaagatatgt

SEQ ID NO: 8356509 - DNA, 22 bp, Homo sapiens
gaaatcattatatggtattgct

SEQ ID NO: 8356510 - DNA, 22 bp, Homo sapiens
gaaatcatctgagtaataatct

SEQ ID NO: 8356511 - DNA, 22 bp, Homo sapiens
gaaatcatattctcagtccttc

SEQ ID NO: 8356512 - DNA, 22 bp, Homo sapiens
gaaatcatagcacatggggctg

SEQ ID NO: 8356513 - DNA, 22 bp, Homo sapiens
gaaatcatgagatctcttggac

SEQ ID NO: 8356514 - DNA, 22 bp, Homo sapiens
gaaatgcagaacctgagaccat

SEQ ID NO: 8356515 - DNA, 20 bp, Homo sapiens
gaaatgtacacattaccaca

SEQ ID NO: 8356516 - DNA, 20 bp, Homo sapiens
gaaatgtacacattaccaca

SEQ ID NO: 8356517 - DNA, 22 bp, Homo sapiens
gaaatgtactttaaagccatcc

SEQ ID NO: 8356518 - DNA, 22 bp, Homo sapiens
gaaatgtaattctcttgaagat

SEQ ID NO: 8356519 - DNA, 22 bp, Homo sapiens
gaacagtgccagcacacaataa

SEQ ID NO: 8356520 - DNA, 22 bp, Homo sapiens
gaacatttggatttgtaaattt

SEQ ID NO: 8356521 - DNA, 22 bp, Homo sapiens
gaacagtttccctgtagaaaat

SEQ ID NO: 8356522 - DNA, 22 bp, Homo sapiens
gaacagtttccctgtagaaaat

SEQ ID NO: 8356523 - DNA, 22 bp, Homo sapiens
gaacagcatgtaagaagctact

SEQ ID NO: 8356524 - DNA, 22 bp, Homo sapiens
gaacagggttgggtgagagagg

SEQ ID NO: 8356525 - DNA, 22 bp, Homo sapiens
gaaatatttctcttgagcccct

SEQ ID NO: 8356526 - DNA, 22 bp, Homo sapiens
ctttcaatgtgcctgccttggg

SEQ ID NO: 8356527 - DNA, 18 bp, Homo sapiens
ctttcagtaatttcagcc

SEQ ID NO: 8356528 - DNA, 22 bp, Homo sapiens
ctttcagatagtctgagatata

SEQ ID NO: 8356529 - DNA, 22 bp, Homo sapiens
gtgcagagaggtggagggactt

SEQ ID NO: 8356530 - DNA, 21 bp, Homo sapiens
gtgcacagtcctgcacacagg

SEQ ID NO: 8356531 - DNA, 21 bp, Homo sapiens
gtgcacagtcctgcacacagg

SEQ ID NO: 8356532 - DNA, 22 bp, Homo sapiens
gtgagacaattcctcagtagac

SEQ ID NO: 8356533 - DNA, 22 bp, Homo sapiens
gtgagacaagatttgtaggcag

SEQ ID NO: 8356534 - DNA, 22 bp, Homo sapiens
gtgagaaatgacaaatgtgtcg

SEQ ID NO: 8356535 - DNA, 22 bp, Homo sapiens
gtgctagggacaaagcagtgaa

SEQ ID NO: 8356536 - DNA, 22 bp, Homo sapiens
gtgctatgattggacagaatag

SEQ ID NO: 8356537 - DNA, 22 bp, Homo sapiens
gtgcattgcgatgcagacgacc

SEQ ID NO: 8356538 - DNA, 22 bp, Homo sapiens
gtgcattggtgcgccacttcac

SEQ ID NO: 8356539 - DNA, 22 bp, Homo sapiens
gtgcattctctgattttcacaa

SEQ ID NO: 8356540 - DNA, 19 bp, Homo sapiens
gtgcattccaaagcaccat

SEQ ID NO: 8356541 - DNA, 22 bp, Homo sapiens
gtgcattccaaggcactttaga

SEQ ID NO: 8356542 - DNA, 22 bp, Homo sapiens
gtgcattctatcaaatggtaca

SEQ ID NO: 8356543 - DNA, 22 bp, Homo sapiens
gtgcattccaccgtgcaggttg

SEQ ID NO: 8356544 - DNA, 20 bp, Homo sapiens
gtgcagaggcagcctgtggg

SEQ ID NO: 8356545 - DNA, 22 bp, Homo sapiens
gtgcagagcaagggctgagggc

SEQ ID NO: 8356546 - DNA, 22 bp, Homo sapiens
gtgcagaggacgtggcggcctc

SEQ ID NO: 8356547 - DNA, 22 bp, Homo sapiens
gtgcaggtgttttggctgccag

SEQ ID NO: 8356548 - DNA, 22 bp, Homo sapiens
gtgcaggtggatttgggctcaa

SEQ ID NO: 8356549 - DNA, 22 bp, Homo sapiens
gtgaagaaggcaatacaaagaa

SEQ ID NO: 8356550 - DNA, 22 bp, Homo sapiens
gtctggagggtgggtagagacc

SEQ ID NO: 8356551 - DNA, 22 bp, Homo sapiens
gtgaaatctgaggcccatgatg

SEQ ID NO: 8356552 - DNA, 22 bp, Homo sapiens
gtgaaatgaatctggaaatatt

SEQ ID NO: 8356553 - DNA, 22 bp, Homo sapiens
gtgaaagagatgcagcataatg

SEQ ID NO: 8356554 - DNA, 18 bp, Homo sapiens
gtgaaagagacagggcag

SEQ ID NO: 8356555 - DNA, 22 bp, Homo sapiens
gtgaaatatttaacgtccaggt

SEQ ID NO: 8356556 - DNA, 22 bp, Homo sapiens
gtgaaacttcacattttgatag

SEQ ID NO: 8356557 - DNA, 22 bp, Homo sapiens
gtctgccccagaccctgaccca

SEQ ID NO: 8356558 - DNA, 22 bp, Homo sapiens
gtcctgggggcagctgtgtcca

SEQ ID NO: 8356559 - DNA, 22 bp, Homo sapiens
gtctgccctgcagacatgcctc

SEQ ID NO: 8356560 - DNA, 22 bp, Homo sapiens
gtctgcccggccttcctccacc

SEQ ID NO: 8356561 - DNA, 22 bp, Homo sapiens
gtctgccctgagctcccagtgc

SEQ ID NO: 8356562 - DNA, 22 bp, Homo sapiens
gtcctgggcctgctgaggctga

SEQ ID NO: 8356563 - DNA, 22 bp, Homo sapiens
gtcctgggcggagggctgctgt

SEQ ID NO: 8356564 - DNA, 22 bp, Homo sapiens
gtcctggggattatagagtgtt

SEQ ID NO: 8356565 - DNA, 22 bp, Homo sapiens
gtctgcccttggctcagccata

SEQ ID NO: 8356566 - DNA, 22 bp, Homo sapiens
gtctgctcatgctaccgcgggc

SEQ ID NO: 8356567 - DNA, 22 bp, Homo sapiens
gtctggaggagggctctgcggc

SEQ ID NO: 8356568 - DNA, 22 bp, Homo sapiens
gtctgctgtaggtaggacagca

SEQ ID NO: 8356569 - DNA, 22 bp, Homo sapiens
gtccccgacgtttggcttgatg

SEQ ID NO: 8356570 - DNA, 22 bp, Homo sapiens
gtccccagctgtgacgagagcc

SEQ ID NO: 8356571 - DNA, 22 bp, Homo sapiens
gtcctgggaggggctggtcctg

SEQ ID NO: 8356572 - DNA, 22 bp, Homo sapiens
gtcctgggcccaggggctgcct

SEQ ID NO: 8356573 - DNA, 22 bp, Homo sapiens
gtcctgggcccaggggctgcct

SEQ ID NO: 8356574 - DNA, 22 bp, Homo sapiens
gtcctgggcatgcagggctttc

SEQ ID NO: 8356575 - DNA, 22 bp, Homo sapiens
gtcctgggaggggctggtcctg

SEQ ID NO: 8356576 - DNA, 22 bp, Homo sapiens
gtccctgcatctgcaggccatg

SEQ ID NO: 8356577 - DNA, 22 bp, Homo sapiens
gtccctggaaaagagctggtga

SEQ ID NO: 8356578 - DNA, 22 bp, Homo sapiens
gtcctgggaaggaagccaggga

SEQ ID NO: 8356579 - DNA, 22 bp, Homo sapiens
gtcctgggagatgggaccctga

SEQ ID NO: 8356580 - DNA, 22 bp, Homo sapiens
gtcattttgctgcatatttaga

SEQ ID NO: 8356581 - DNA, 22 bp, Homo sapiens
gtcatttttttcgtaatagtgg

SEQ ID NO: 8356582 - DNA, 22 bp, Homo sapiens
gtcatttttgactttgaagtga

SEQ ID NO: 8356583 - DNA, 22 bp, Homo sapiens
gtatttccattagtgtgtgcac

SEQ ID NO: 8356584 - DNA, 22 bp, Homo sapiens
gtccccagagctggtggtggtt

SEQ ID NO: 8356585 - DNA, 22 bp, Homo sapiens
gtccccagaaaggtgaggcagg

SEQ ID NO: 8356586 - DNA, 22 bp, Homo sapiens
gtcccattccctgtatcttaga

SEQ ID NO: 8356587 - DNA, 22 bp, Homo sapiens
gtcccatttcaagaaattcatg

SEQ ID NO: 8356588 - DNA, 22 bp, Homo sapiens
gtccacttggcacaaggcactt

SEQ ID NO: 8356589 - DNA, 22 bp, Homo sapiens
gtccacagctctgaggtctccc

SEQ ID NO: 8356590 - DNA, 18 bp, Homo sapiens
gtccacagccctcacagc

SEQ ID NO: 8356591 - DNA, 22 bp, Homo sapiens
gtccacagagggctgggcaggc

SEQ ID NO: 8356592 - DNA, 22 bp, Homo sapiens
gtccacataggaacccagcttc

SEQ ID NO: 8356593 - DNA, 21 bp, Homo sapiens
gtccacaggggtttgtcctgg

SEQ ID NO: 8356594 - DNA, 22 bp, Homo sapiens
gtagaacactggggctctgttg

SEQ ID NO: 8356595 - DNA, 22 bp, Homo sapiens
gtagaacatggtagggcaggtg

SEQ ID NO: 8356596 - DNA, 22 bp, Homo sapiens
gtagaacatggtagggcaggtg

SEQ ID NO: 8356597 - DNA, 22 bp, Homo sapiens
gtagaattacctctctatgtcc

SEQ ID NO: 8356598 - DNA, 22 bp, Homo sapiens
gtagaattttaataatggagat

SEQ ID NO: 8356599 - DNA, 22 bp, Homo sapiens
gtagacactgtatttgatgctt

SEQ ID NO: 8356600 - DNA, 22 bp, Homo sapiens
gtattattaagtgtatttgacc

SEQ ID NO: 8356601 - DNA, 22 bp, Homo sapiens
gtattattgggtagtatggtaa

SEQ ID NO: 8356602 - DNA, 22 bp, Homo sapiens
gtattattgggtagtatggtaa

SEQ ID NO: 8356603 - DNA, 22 bp, Homo sapiens
gtattattctcagctttgggat

SEQ ID NO: 8356604 - DNA, 22 bp, Homo sapiens
gtattattgtcatgaaataata

SEQ ID NO: 8356605 - DNA, 22 bp, Homo sapiens
gtatttaattccattaagttag

SEQ ID NO: 8356606 - DNA, 22 bp, Homo sapiens
gtatttaattctgtgcttctag

SEQ ID NO: 8356607 - DNA, 21 bp, Homo sapiens
gtattgcagagttatgtgctc

SEQ ID NO: 8356608 - DNA, 22 bp, Homo sapiens
gtattcatattaaacatatcaa

SEQ ID NO: 8356609 - DNA, 22 bp, Homo sapiens
gtattcatttatttactcatcc

SEQ ID NO: 8356610 - DNA, 22 bp, Homo sapiens
gtattcttggttatcaaaatac

SEQ ID NO: 8356611 - DNA, 17 bp, Homo sapiens
gtattctttgccttcca

SEQ ID NO: 8356612 - DNA, 21 bp, Homo sapiens
gtattctttatgaagtgaaaa

SEQ ID NO: 8356613 - DNA, 22 bp, Homo sapiens
gtattcttatactcagtgagct

SEQ ID NO: 8356614 - DNA, 22 bp, Homo sapiens
gtattcttgagtggcaactagg

SEQ ID NO: 8356615 - DNA, 22 bp, Homo sapiens
gtattcttaaggattgagcaaa

SEQ ID NO: 8356616 - DNA, 22 bp, Homo sapiens
ggtttgcatgtgatgttgggca

SEQ ID NO: 8356617 - DNA, 22 bp, Homo sapiens
ggtttgcattctgaaaggctca

SEQ ID NO: 8356618 - DNA, 22 bp, Homo sapiens
ggtttgcacgatatttccatgg

SEQ ID NO: 8356619 - DNA, 22 bp, Homo sapiens
gtaaaactgtctaatggtatat

SEQ ID NO: 8356620 - DNA, 22 bp, Homo sapiens
gtacatttctcccaacactaaa

SEQ ID NO: 8356621 - DNA, 22 bp, Homo sapiens
ggtgtggatcatctgaggtcag

SEQ ID NO: 8356622 - DNA, 22 bp, Homo sapiens
ggtgtgggaactacaggttttt

SEQ ID NO: 8356623 - DNA, 22 bp, Homo sapiens
ggtgtgggaactacaggttttt

SEQ ID NO: 8356624 - DNA, 22 bp, Homo sapiens
ggtgtgggtccttgtgcttgct

SEQ ID NO: 8356625 - DNA, 19 bp, Homo sapiens
ggtggctctccctcaggga

SEQ ID NO: 8356626 - DNA, 22 bp, Homo sapiens
ggtggctcggccagtgcaggcc

SEQ ID NO: 8356627 - DNA, 17 bp, Homo sapiens
ggtggctcgggcgcggc

SEQ ID NO: 8356628 - DNA, 22 bp, Homo sapiens
ggtggctcgtttttcttgaaag

SEQ ID NO: 8356629 - DNA, 17 bp, Homo sapiens
ggtggctcgggcgcggc

SEQ ID NO: 8356630 - DNA, 22 bp, Homo sapiens
ggtggctccgcttccatgggct

SEQ ID NO: 8356631 - DNA, 22 bp, Homo sapiens
ggtggctctcttaagggcagcg

SEQ ID NO: 8356632 - DNA, 19 bp, Homo sapiens
ggtggctctccctcaggga

SEQ ID NO: 8356633 - DNA, 22 bp, Homo sapiens
ggtggctctctgtcagtgacag

SEQ ID NO: 8356634 - DNA, 22 bp, Homo sapiens
ggtgtccttcgtccgctggcat

SEQ ID NO: 8356635 - DNA, 22 bp, Homo sapiens
ggtggcctcggtggtgcacagg

SEQ ID NO: 8356636 - DNA, 22 bp, Homo sapiens
ggtggcctcgccgcggctctgc

SEQ ID NO: 8356637 - DNA, 22 bp, Homo sapiens
ggtggctcacgcctgtaagccc

SEQ ID NO: 8356638 - DNA, 22 bp, Homo sapiens
ggtggccttttatgagcagggt

SEQ ID NO: 8356639 - DNA, 22 bp, Homo sapiens
ggtggcggccacttcagccctg

SEQ ID NO: 8356640 - DNA, 19 bp, Homo sapiens
ggtggctcagggcccagcc

SEQ ID NO: 8356641 - DNA, 22 bp, Homo sapiens
ggtggctcagggctccaagcat

SEQ ID NO: 8356642 - DNA, 22 bp, Homo sapiens
ggtggctcagtgtcaggccctg

SEQ ID NO: 8356643 - DNA, 20 bp, Homo sapiens
ggtggccgtagcgggcggcg

SEQ ID NO: 8356644 - DNA, 22 bp, Homo sapiens
ggtctggattttatctactgta

SEQ ID NO: 8356645 - DNA, 22 bp, Homo sapiens
ggtctggagtaggatgatggct

SEQ ID NO: 8356646 - DNA, 22 bp, Homo sapiens
ggtctggagtaggatgatggct

SEQ ID NO: 8356647 - DNA, 22 bp, Homo sapiens
ggtctggaccctcctggagtgg

SEQ ID NO: 8356648 - DNA, 22 bp, Homo sapiens
ggtctctgtttggggctggcaa

SEQ ID NO: 8356649 - DNA, 22 bp, Homo sapiens
ggtccctggaagtccctcttct

SEQ ID NO: 8356650 - DNA, 22 bp, Homo sapiens
ggtcgggcactctccagggctg

SEQ ID NO: 8356651 - DNA, 22 bp, Homo sapiens
ggtcgctgagctagcatctgca

SEQ ID NO: 8356652 - DNA, 22 bp, Homo sapiens
ggtctcagactggcaggcagtg

SEQ ID NO: 8356653 - DNA, 22 bp, Homo sapiens
ggtctcagactggcaggcagtg

SEQ ID NO: 8356654 - DNA, 22 bp, Homo sapiens
ggtcggggatggccaggctccc

SEQ ID NO: 8356655 - DNA, 22 bp, Homo sapiens
ggtctctgaacttccactgcgc

SEQ ID NO: 8356656 - DNA, 22 bp, Homo sapiens
ggtctctgcagctcccggcccc

SEQ ID NO: 8356657 - DNA, 22 bp, Homo sapiens
ggtctctgctcagatgccactt

SEQ ID NO: 8356658 - DNA, 22 bp, Homo sapiens
ggtctctgagtgaggacctggg

SEQ ID NO: 8356659 - DNA, 22 bp, Homo sapiens
ggtctctgtcactgagtggccc

SEQ ID NO: 8356660 - DNA, 22 bp, Homo sapiens
ggtctccagctgggaccctgca

SEQ ID NO: 8356661 - DNA, 22 bp, Homo sapiens
ggtctcaggtagggcctaggaa

SEQ ID NO: 8356662 - DNA, 19 bp, Homo sapiens
ggtctcagtgcagctgcag

SEQ ID NO: 8356663 - DNA, 22 bp, Homo sapiens
ggtctcaggagactggagagca

SEQ ID NO: 8356664 - DNA, 22 bp, Homo sapiens
ggtctcaggagactggagagca

SEQ ID NO: 8356665 - DNA, 22 bp, Homo sapiens
ggtctcagctggagtccttggt

SEQ ID NO: 8356666 - DNA, 22 bp, Homo sapiens
ggtctcagccctcgccagcagc

SEQ ID NO: 8356667 - DNA, 22 bp, Homo sapiens
ggtctcagatctttattaaggc

SEQ ID NO: 8356668 - DNA, 22 bp, Homo sapiens
ggtctcagcagttgctttgact

SEQ ID NO: 8356669 - DNA, 19 bp, Homo sapiens
ggtcagagagatccaggct

SEQ ID NO: 8356670 - DNA, 22 bp, Homo sapiens
ggtcacgtgaccgcacctgcct

SEQ ID NO: 8356671 - DNA, 22 bp, Homo sapiens
ggtaggggcagggccaagctgt

SEQ ID NO: 8356672 - DNA, 22 bp, Homo sapiens
ggtcactgctctaaacaaaagt

SEQ ID NO: 8356673 - DNA, 20 bp, Homo sapiens
gggtggagttgcggtctgtg

SEQ ID NO: 8356674 - DNA, 22 bp, Homo sapiens
gggtggccttcatagctcaggg

SEQ ID NO: 8356675 - DNA, 22 bp, Homo sapiens
gggtggctaggtatcccccatt

SEQ ID NO: 8356676 - DNA, 22 bp, Homo sapiens
ggtagggcaaagtagggcacct

SEQ ID NO: 8356677 - DNA, 21 bp, Homo sapiens
gggtggccgcatgggtgcgtg

SEQ ID NO: 8356678 - DNA, 22 bp, Homo sapiens
ggggcggggctctgagaagcat

SEQ ID NO: 8356679 - DNA, 22 bp, Homo sapiens
ggggcgtcaccggggcacctgg

SEQ ID NO: 8356680 - DNA, 22 bp, Homo sapiens
ggggctgaacctggaggtggtc

SEQ ID NO: 8356681 - DNA, 22 bp, Homo sapiens
ggggctgacgggcatgtggctt

SEQ ID NO: 8356682 - DNA, 22 bp, Homo sapiens
ggggctgacgggcatgtggctt

SEQ ID NO: 8356683 - DNA, 22 bp, Homo sapiens
ggggctgagaattcagtctcgg

SEQ ID NO: 8356684 - DNA, 22 bp, Homo sapiens
ggggctcagttcggacagcctg

SEQ ID NO: 8356685 - DNA, 22 bp, Homo sapiens
ggggctctgcctctcccacgcc

SEQ ID NO: 8356686 - DNA, 22 bp, Homo sapiens
ggggctctcaggtctccccaaa

SEQ ID NO: 8356687 - DNA, 22 bp, Homo sapiens
ggggctgctcccacccctgagg

SEQ ID NO: 8356688 - DNA, 20 bp, Homo sapiens
ggggctgcatgcagagaaga

SEQ ID NO: 8356689 - DNA, 22 bp, Homo sapiens
ggggctgctcccacccctgagg

SEQ ID NO: 8356690 - DNA, 22 bp, Homo sapiens
ggggctgctcccacccctgagg

SEQ ID NO: 8356691 - DNA, 22 bp, Homo sapiens
ggggctgctcgccgcgcgtttc

SEQ ID NO: 8356692 - DNA, 22 bp, Homo sapiens
ggggctgctggtatttccagtt

SEQ ID NO: 8356693 - DNA, 22 bp, Homo sapiens
ggggctgcttcacctttttacg

SEQ ID NO: 8356694 - DNA, 22 bp, Homo sapiens
gggtaggctctgcaggctgggt

SEQ ID NO: 8356695 - DNA, 22 bp, Homo sapiens
gggtaggccagaagggcctgga

SEQ ID NO: 8356696 - DNA, 22 bp, Homo sapiens
gggtaggcagtgcgtcctgcct

SEQ ID NO: 8356697 - DNA, 22 bp, Homo sapiens
gggtaggctgctcctggggccc

SEQ ID NO: 8356698 - DNA, 22 bp, Homo sapiens
gggtggaggagaacaggcccca

SEQ ID NO: 8356699 - DNA, 22 bp, Homo sapiens
gggtggagtagaaagatgaatt

SEQ ID NO: 8356700 - DNA, 20 bp, Homo sapiens
gggtggagttgcggtctgtg

SEQ ID NO: 8356701 - DNA, 22 bp, Homo sapiens
gggtggagtagaaagatgaatt

SEQ ID NO: 8356702 - DNA, 22 bp, Homo sapiens
ggggtgtgtctgacaatggtat

SEQ ID NO: 8356703 - DNA, 22 bp, Homo sapiens
ggggtggggttactcattgtgc

SEQ ID NO: 8356704 - DNA, 22 bp, Homo sapiens
ggggtgtgagtagagctgggga

SEQ ID NO: 8356705 - DNA, 22 bp, Homo sapiens
ggggtgggcgtgcagggacacc

SEQ ID NO: 8356706 - DNA, 22 bp, Homo sapiens
gggccacacagaacctcctggt

SEQ ID NO: 8356707 - DNA, 22 bp, Homo sapiens
gggcatggtggtgcacacctgt

SEQ ID NO: 8356708 - DNA, 22 bp, Homo sapiens
gggcatgtaggaatccatggag

SEQ ID NO: 8356709 - DNA, 22 bp, Homo sapiens
gggcatgtacataatctagaaa

SEQ ID NO: 8356710 - DNA, 22 bp, Homo sapiens
gggcatgtctctaggctggcta

SEQ ID NO: 8356711 - DNA, 22 bp, Homo sapiens
gggccaaggggagctggaaggg

SEQ ID NO: 8356712 - DNA, 18 bp, Homo sapiens
gggcatggatgcagcatc

SEQ ID NO: 8356713 - DNA, 22 bp, Homo sapiens
gggctgagtgtcccaggccgaa

SEQ ID NO: 8356714 - DNA, 22 bp, Homo sapiens
gggctgagttcctgcctcactc

SEQ ID NO: 8356715 - DNA, 22 bp, Homo sapiens
gggctgcacgtattctgctcac

SEQ ID NO: 8356716 - DNA, 22 bp, Homo sapiens
gggctgcctttcttctgggagc

SEQ ID NO: 8356717 - DNA, 22 bp, Homo sapiens
gggctgccttttaattcttccc

SEQ ID NO: 8356718 - DNA, 22 bp, Homo sapiens
gggctgcctgagcatctcctcc

SEQ ID NO: 8356719 - DNA, 22 bp, Homo sapiens
gggctgccaagcctgcctgcct

SEQ ID NO: 8356720 - DNA, 22 bp, Homo sapiens
gggcttgctaagaagagcgcat

SEQ ID NO: 8356721 - DNA, 22 bp, Homo sapiens
gggctgctgctgccagcgacac

SEQ ID NO: 8356722 - DNA, 19 bp, Homo sapiens
ggccaggctgactgtggtc

SEQ ID NO: 8356723 - DNA, 22 bp, Homo sapiens
ggccagggcctggggactgtcc

SEQ ID NO: 8356724 - DNA, 22 bp, Homo sapiens
ggccatgcctggtctggcacca

SEQ ID NO: 8356725 - DNA, 22 bp, Homo sapiens
ggccatgccaggctgcctggga

SEQ ID NO: 8356726 - DNA, 22 bp, Homo sapiens
ggccagtctgggccacggtcgg

SEQ ID NO: 8356727 - DNA, 22 bp, Homo sapiens
ggcattaactctgtttcaattt

SEQ ID NO: 8356728 - DNA, 20 bp, Homo sapiens
ggcatgggtggggctcccag

SEQ ID NO: 8356729 - DNA, 22 bp, Homo sapiens
ggcatgggccgaggtgcctcct

SEQ ID NO: 8356730 - DNA, 22 bp, Homo sapiens
ggcatggcctgtaagacggaga

SEQ ID NO: 8356731 - DNA, 22 bp, Homo sapiens
ggcatggctgggttctggtgag

SEQ ID NO: 8356732 - DNA, 22 bp, Homo sapiens
ggcatggctgttggggatagag

SEQ ID NO: 8356733 - DNA, 21 bp, Homo sapiens
ggcatggcacctctgggcagg

SEQ ID NO: 8356734 - DNA, 22 bp, Homo sapiens
ggcatggctcggagtcagaaca

SEQ ID NO: 8356735 - DNA, 22 bp, Homo sapiens
ggcagtctgcaatttcattagc

SEQ ID NO: 8356736 - DNA, 20 bp, Homo sapiens
ggcatggcaaatgttcttgc

SEQ ID NO: 8356737 - DNA, 22 bp, Homo sapiens
ggcagtcagtgtggttcataaa

SEQ ID NO: 8356738 - DNA, 22 bp, Homo sapiens
ggcagtcccagcccagaggcgc

SEQ ID NO: 8356739 - DNA, 22 bp, Homo sapiens
ggcaggtggcactgctgctccc

SEQ ID NO: 8356740 - DNA, 22 bp, Homo sapiens
ggcaggtgggaaccctccccac

SEQ ID NO: 8356741 - DNA, 22 bp, Homo sapiens
ggcaggtggaagttggcagagc

SEQ ID NO: 8356742 - DNA, 22 bp, Homo sapiens
ggcaggtggaagttggcagagc

SEQ ID NO: 8356743 - DNA, 22 bp, Homo sapiens
ggcaggtggattttctactcta

SEQ ID NO: 8356744 - DNA, 17 bp, Homo sapiens
ggccttgggctgctctt

SEQ ID NO: 8356745 - DNA, 22 bp, Homo sapiens
ggccttgggcgagtccctcagt

SEQ ID NO: 8356746 - DNA, 22 bp, Homo sapiens
ggccttgggctggctgcagtat

SEQ ID NO: 8356747 - DNA, 19 bp, Homo sapiens
ggccttggggtcccaaagt

SEQ ID NO: 8356748 - DNA, 22 bp, Homo sapiens
ggcctgagtcacatcaggagag

SEQ ID NO: 8356749 - DNA, 22 bp, Homo sapiens
ggccttgggcagacacgtcaca

SEQ ID NO: 8356750 - DNA, 22 bp, Homo sapiens
ggcctgcacagaggtggctcta

SEQ ID NO: 8356751 - DNA, 17 bp, Homo sapiens
ggcctgcacctcctgct

SEQ ID NO: 8356752 - DNA, 21 bp, Homo sapiens
ggcctgagcacctgtccacct

SEQ ID NO: 8356753 - DNA, 22 bp, Homo sapiens
ggcctctggttcgtggtgacct

SEQ ID NO: 8356754 - DNA, 22 bp, Homo sapiens
ggcctctgtttggagccaggat

SEQ ID NO: 8356755 - DNA, 22 bp, Homo sapiens
ggcctctgtttggagccaggat

SEQ ID NO: 8356756 - DNA, 22 bp, Homo sapiens
ggcctcagtgggccgctgcagg

SEQ ID NO: 8356757 - DNA, 21 bp, Homo sapiens
ggcctcagccacctggctctg

SEQ ID NO: 8356758 - DNA, 21 bp, Homo sapiens
ggcctcagccacctggctctg

SEQ ID NO: 8356759 - DNA, 22 bp, Homo sapiens
ggcctcagaggaggtgtgagtc

SEQ ID NO: 8356760 - DNA, 22 bp, Homo sapiens
ggcctcagagaaggctgtgcgg

SEQ ID NO: 8356761 - DNA, 23 bp, Homo sapiens
ggcctcagcgcacagaaactgct

SEQ ID NO: 8356762 - DNA, 18 bp, Homo sapiens
ggcctcagcctggccgga

SEQ ID NO: 8356763 - DNA, 22 bp, Homo sapiens
ggcctcagagaaggctgtgcgg

SEQ ID NO: 8356764 - DNA, 22 bp, Homo sapiens
ggcctcagagaaggctgtgcgg

SEQ ID NO: 8356765 - DNA, 22 bp, Homo sapiens
ggccatgctgttgcctgctggt

SEQ ID NO: 8356766 - DNA, 22 bp, Homo sapiens
ggccatgctcgtggctggactg

SEQ ID NO: 8356767 - DNA, 23 bp, Homo sapiens
ggagccagcctgtggggagcggg

SEQ ID NO: 8356768 - DNA, 19 bp, Homo sapiens
ggagccagctgtggaaggc

SEQ ID NO: 8356769 - DNA, 22 bp, Homo sapiens
ggagccagagcactggggagcc

SEQ ID NO: 8356770 - DNA, 22 bp, Homo sapiens
ggagccagagtctgcagtgtaa

SEQ ID NO: 8356771 - DNA, 22 bp, Homo sapiens
ggagccagaggctgctgctgtg

SEQ ID NO: 8356772 - DNA, 22 bp, Homo sapiens
ggagtctgactctgaccctgga

SEQ ID NO: 8356773 - DNA, 22 bp, Homo sapiens
ggagtctgagcttgtgtcctgg

SEQ ID NO: 8356774 - DNA, 22 bp, Homo sapiens
ggagtctgagcttgtgtcctgg

SEQ ID NO: 8356775 - DNA, 21 bp, Homo sapiens
ggagtcattagtcatttcctt

SEQ ID NO: 8356776 - DNA, 22 bp, Homo sapiens
ggagtccggcccagagctccct

SEQ ID NO: 8356777 - DNA, 22 bp, Homo sapiens
ggcaaaaagttcccatcagtgt

SEQ ID NO: 8356778 - DNA, 22 bp, Homo sapiens
ggcaaaaaccataattactttt

SEQ ID NO: 8356779 - DNA, 22 bp, Homo sapiens
ggcaaaaaccgcaataacttct

SEQ ID NO: 8356780 - DNA, 22 bp, Homo sapiens
ggcaaaaacagcaatgactttt

SEQ ID NO: 8356781 - DNA, 22 bp, Homo sapiens
ggcaaaaaccacaattactttt

SEQ ID NO: 8356782 - DNA, 23 bp, Homo sapiens
ggagtgcaatggcgccatctcgg

SEQ ID NO: 8356783 - DNA, 22 bp, Homo sapiens
ggagtgagtggccttgtcactg

SEQ ID NO: 8356784 - DNA, 22 bp, Homo sapiens
ggagtgagtactggagtagctg

SEQ ID NO: 8356785 - DNA, 22 bp, Homo sapiens
ggagtgaggcatttgtagctga

SEQ ID NO: 8356786 - DNA, 22 bp, Homo sapiens
ggcaaattgctgcaattactta

SEQ ID NO: 8356787 - DNA, 22 bp, Homo sapiens
ggcaaattaaattagtatggca

SEQ ID NO: 8356788 - DNA, 22 bp, Homo sapiens
ggcaaaggaaccaggccacact

SEQ ID NO: 8356789 - DNA, 21 bp, Homo sapiens
ggcaagaaacacaatcaagta

SEQ ID NO: 8356790 - DNA, 22 bp, Homo sapiens
ggcacaggagctagtcaaagcc

SEQ ID NO: 8356791 - DNA, 23 bp, Homo sapiens
ggcaccaacctctgctccctctt

SEQ ID NO: 8356792 - DNA, 22 bp, Homo sapiens
ggcacaggaatctgtgaagtgc

SEQ ID NO: 8356793 - DNA, 22 bp, Homo sapiens
ggcacagccctctctgtggaca

SEQ ID NO: 8356794 - DNA, 22 bp, Homo sapiens
ggcagaggaaggatgaattcac

SEQ ID NO: 8356795 - DNA, 22 bp, Homo sapiens
ggcagaggaagctggaagtggg

SEQ ID NO: 8356796 - DNA, 22 bp, Homo sapiens
ggcaccaggacatgactcccag

SEQ ID NO: 8356797 - DNA, 22 bp, Homo sapiens
ggcagaggagctggaaacatgg

SEQ ID NO: 8356798 - DNA, 20 bp, Homo sapiens
ggcagagggcctgggagaag

SEQ ID NO: 8356799 - DNA, 22 bp, Homo sapiens
ggcaggagggcggacaatgacc

SEQ ID NO: 8356800 - DNA, 22 bp, Homo sapiens
ggcaggagggcggacaatgacc

SEQ ID NO: 8356801 - DNA, 22 bp, Homo sapiens
ggcaggcactgtgctaggcgct

SEQ ID NO: 8356802 - DNA, 22 bp, Homo sapiens
ggcaggaggtgagtggcgggtg

SEQ ID NO: 8356803 - DNA, 22 bp, Homo sapiens
ggctgggctccgggagcatgcg

SEQ ID NO: 8356804 - DNA, 22 bp, Homo sapiens
ggctgggctcgctgattggctg

SEQ ID NO: 8356805 - DNA, 22 bp, Homo sapiens
ggctgggcctctccctcagctg

SEQ ID NO: 8356806 - DNA, 22 bp, Homo sapiens
ggctgggccgcggctacccaga

SEQ ID NO: 8356807 - DNA, 22 bp, Homo sapiens
ggctgggccagggcctgtggac

SEQ ID NO: 8356808 - DNA, 22 bp, Homo sapiens
ggctgggcatccatccatgaga

SEQ ID NO: 8356809 - DNA, 21 bp, Homo sapiens
ggctgggcaggacccacccct

SEQ ID NO: 8356810 - DNA, 22 bp, Homo sapiens
ggcttctggtgggagcatgact

SEQ ID NO: 8356811 - DNA, 22 bp, Homo sapiens
ggcttctgtcctctggatctgt

SEQ ID NO: 8356812 - DNA, 22 bp, Homo sapiens
ggcttctgtctcaagcaccagc

SEQ ID NO: 8356813 - DNA, 22 bp, Homo sapiens
ggcttctgagtgctctgctgtt

SEQ ID NO: 8356814 - DNA, 22 bp, Homo sapiens
ggctgctgacttcatccagctt

SEQ ID NO: 8356815 - DNA, 22 bp, Homo sapiens
ggctgctgacaaacatgatcat

SEQ ID NO: 8356816 - DNA, 22 bp, Homo sapiens
ggctgctgccctcctaagtgca

SEQ ID NO: 8356817 - DNA, 22 bp, Homo sapiens
ggctgctgctgtgtaggcctgt

SEQ ID NO: 8356818 - DNA, 22 bp, Homo sapiens
ggctgctggaagactgaacaag

SEQ ID NO: 8356819 - DNA, 22 bp, Homo sapiens
ggctgctgagttggccaggaga

SEQ ID NO: 8356820 - DNA, 22 bp, Homo sapiens
ggctgctgagtcacgacagtga

SEQ ID NO: 8356821 - DNA, 22 bp, Homo sapiens
ggctgctgagttggccaggaga

SEQ ID NO: 8356822 - DNA, 22 bp, Homo sapiens
ggctgctgcccacccctgcatg

SEQ ID NO: 8356823 - DNA, 22 bp, Homo sapiens
ggctgctgggaatatgccagct

SEQ ID NO: 8356824 - DNA, 22 bp, Homo sapiens
ggctgctggccagcctaggagt

SEQ ID NO: 8356825 - DNA, 22 bp, Homo sapiens
ggctgctggcctctccccggcc

SEQ ID NO: 8356826 - DNA, 22 bp, Homo sapiens
ggctgctggccagcctaggagt

SEQ ID NO: 8356827 - DNA, 22 bp, Homo sapiens
ggctgctggcattgaggtaggt

SEQ ID NO: 8356828 - DNA, 22 bp, Homo sapiens
ggctgctggcagatgtagttta

SEQ ID NO: 8356829 - DNA, 22 bp, Homo sapiens
ggctgctggattgtgtatctgt

SEQ ID NO: 8356830 - DNA, 22 bp, Homo sapiens
ggctgctggagttgggtctctc

SEQ ID NO: 8356831 - DNA, 22 bp, Homo sapiens
ggctggcttggtgagctgtcac

SEQ ID NO: 8356832 - DNA, 21 bp, Homo sapiens
ggctgctgggagagctgcgtg

SEQ ID NO: 8356833 - DNA, 21 bp, Homo sapiens
ggctgctgggagagctgcgtg

SEQ ID NO: 8356834 - DNA, 21 bp, Homo sapiens
ggctgctgggagagctgcgtg

SEQ ID NO: 8356835 - DNA, 22 bp, Homo sapiens
ggctgggcaaacaagactcttc

SEQ ID NO: 8356836 - DNA, 22 bp, Homo sapiens
ggctgggaggccgtgctgacct

SEQ ID NO: 8356837 - DNA, 22 bp, Homo sapiens
ggctccaggagatgctgggcag

SEQ ID NO: 8356838 - DNA, 22 bp, Homo sapiens
ggctctgctgcaagtcttcctc

SEQ ID NO: 8356839 - DNA, 22 bp, Homo sapiens
ggctctgctgcacccttggctc

SEQ ID NO: 8356840 - DNA, 22 bp, Homo sapiens
ggctctgctcctggtgccagtg

SEQ ID NO: 8356841 - DNA, 22 bp, Homo sapiens
ggctctgctcacagcccgcagc

SEQ ID NO: 8356842 - DNA, 22 bp, Homo sapiens
ggctccagatgtcccctggcaa

SEQ ID NO: 8356843 - DNA, 22 bp, Homo sapiens
ggctccagatgtcccctggcaa

SEQ ID NO: 8356844 - DNA, 22 bp, Homo sapiens
ggcggcgcgtagccggagactt

SEQ ID NO: 8356845 - DNA, 22 bp, Homo sapiens
ggcgggacggggcgtgcacaga

SEQ ID NO: 8356846 - DNA, 22 bp, Homo sapiens
ggcgggagcagcagctctgagc

SEQ ID NO: 8356847 - DNA, 21 bp, Homo sapiens
ggcggcgcagagctgcggctc

SEQ ID NO: 8356848 - DNA, 21 bp, Homo sapiens
ggcggcgcagagctgcggctc

SEQ ID NO: 8356849 - DNA, 22 bp, Homo sapiens
ggcggcgcctgctgcgtgacct

SEQ ID NO: 8356850 - DNA, 22 bp, Homo sapiens
ggcggccgcagctcttgctctg

SEQ ID NO: 8356851 - DNA, 22 bp, Homo sapiens
ggcggccgccttcggccacggc

SEQ ID NO: 8356852 - DNA, 22 bp, Homo sapiens
ggcgggaggctgaggagttggt

SEQ ID NO: 8356853 - DNA, 22 bp, Homo sapiens
ggcgggaggctgaggagttggt

SEQ ID NO: 8356854 - DNA, 22 bp, Homo sapiens
ggcgggggtccaggagcctgca

SEQ ID NO: 8356855 - DNA, 22 bp, Homo sapiens
ggcgggggtccaggagcctgca

SEQ ID NO: 8356856 - DNA, 22 bp, Homo sapiens
ggcggggcctcgcgaacggcct

SEQ ID NO: 8356857 - DNA, 22 bp, Homo sapiens
ggcgggcagatgcggacacgcg

SEQ ID NO: 8356858 - DNA, 23 bp, Homo sapiens
ggcggggataacagccccttgtc

SEQ ID NO: 8356859 - DNA, 22 bp, Homo sapiens
ggctgaaacagatttcaagaca

SEQ ID NO: 8356860 - DNA, 22 bp, Homo sapiens
ggctgagactagagtgaggcat

SEQ ID NO: 8356861 - DNA, 22 bp, Homo sapiens
ggctctgggaaatggtcttcct

SEQ ID NO: 8356862 - DNA, 22 bp, Homo sapiens
ggctctggcgtccaatggagcg

SEQ ID NO: 8356863 - DNA, 22 bp, Homo sapiens
ggctctggagacatgtggagag

SEQ ID NO: 8356864 - DNA, 22 bp, Homo sapiens
ggctctggagcacagacgtctg

SEQ ID NO: 8356865 - DNA, 22 bp, Homo sapiens
ggctctggcaaggggaggctac

SEQ ID NO: 8356866 - DNA, 22 bp, Homo sapiens
gggagatgaatcagaagtgatc

SEQ ID NO: 8356867 - DNA, 17 bp, Homo sapiens
gggagatgaagggatat

SEQ ID NO: 8356868 - DNA, 22 bp, Homo sapiens
gggagctggcggattccccagg

SEQ ID NO: 8356869 - DNA, 18 bp, Homo sapiens
gggagctgggaagctggt

SEQ ID NO: 8356870 - DNA, 18 bp, Homo sapiens
gggagctgggaagctggt

SEQ ID NO: 8356871 - DNA, 22 bp, Homo sapiens
gggagctgtaagggacaggtag

SEQ ID NO: 8356872 - DNA, 19 bp, Homo sapiens
gggagctgtctgcccgtgg

SEQ ID NO: 8356873 - DNA, 22 bp, Homo sapiens
gggagctggttcctgccctcca

SEQ ID NO: 8356874 - DNA, 22 bp, Homo sapiens
gggagctggttcctgccctcca

SEQ ID NO: 8356875 - DNA, 19 bp, Homo sapiens
gggagagccaggctcaccc

SEQ ID NO: 8356876 - DNA, 22 bp, Homo sapiens
gggagagcgcgctagggccgag

SEQ ID NO: 8356877 - DNA, 22 bp, Homo sapiens
gggagagcgggaggtgccacag

SEQ ID NO: 8356878 - DNA, 22 bp, Homo sapiens
gggagagagaaaacgtggcgca

SEQ ID NO: 8356879 - DNA, 22 bp, Homo sapiens
gggacagctgtagtgcttggct

SEQ ID NO: 8356880 - DNA, 22 bp, Homo sapiens
gggaccagaggctgtgcacaat

SEQ ID NO: 8356881 - DNA, 23 bp, Homo sapiens
gggaccagctagggctgtgacct

SEQ ID NO: 8356882 - DNA, 22 bp, Homo sapiens
gggacaggcccctcgctagctt

SEQ ID NO: 8356883 - DNA, 22 bp, Homo sapiens
gggcacaggaatttgggatgtg

SEQ ID NO: 8356884 - DNA, 19 bp, Homo sapiens
gggcatgctggctctagag

SEQ ID NO: 8356885 - DNA, 22 bp, Homo sapiens
gggcaggagagggccacctgga

SEQ ID NO: 8356886 - DNA, 22 bp, Homo sapiens
gggcacagcccagtggggtccc

SEQ ID NO: 8356887 - DNA, 19 bp, Homo sapiens
gggcaaatcccttctttct

SEQ ID NO: 8356888 - DNA, 20 bp, Homo sapiens
gggcaaattgctatttcttt

SEQ ID NO: 8356889 - DNA, 22 bp, Homo sapiens
gggcaacagagcgagggcctgt

SEQ ID NO: 8356890 - DNA, 22 bp, Homo sapiens
gggcacagcctaactatggaga

SEQ ID NO: 8356891 - DNA, 22 bp, Homo sapiens
gggcacagcccagtggggtccc

SEQ ID NO: 8356892 - DNA, 19 bp, Homo sapiens
gggcaaagtgatcgtcctg

SEQ ID NO: 8356893 - DNA, 22 bp, Homo sapiens
gggatggggtcgggaccctgct

SEQ ID NO: 8356894 - DNA, 22 bp, Homo sapiens
gggatggggtcgggaccctgct

SEQ ID NO: 8356895 - DNA, 22 bp, Homo sapiens
gggatggggagctggaaagggg

SEQ ID NO: 8356896 - DNA, 22 bp, Homo sapiens
gggatggggtcaacatgtacct

SEQ ID NO: 8356897 - DNA, 22 bp, Homo sapiens
gggatggggggaagcgtccatg

SEQ ID NO: 8356898 - DNA, 22 bp, Homo sapiens
gctgccccccggactcggcggg

SEQ ID NO: 8356899 - DNA, 22 bp, Homo sapiens
gctgccccagctgggggctgga

SEQ ID NO: 8356900 - DNA, 22 bp, Homo sapiens
gctgccctacccgaggcactct

SEQ ID NO: 8356901 - DNA, 22 bp, Homo sapiens
gctgccctacccgaggcactct

SEQ ID NO: 8356902 - DNA, 22 bp, Homo sapiens
gctgccctacccgaggcactct

SEQ ID NO: 8356903 - DNA, 22 bp, Homo sapiens
gctgccctagaagtacagagag

SEQ ID NO: 8356904 - DNA, 22 bp, Homo sapiens
gctgccctgtctgcagcaggac

SEQ ID NO: 8356905 - DNA, 22 bp, Homo sapiens
gctgccctgtggtccagcaggt

SEQ ID NO: 8356906 - DNA, 22 bp, Homo sapiens
gctgccctgtttagccagggtt

SEQ ID NO: 8356907 - DNA, 22 bp, Homo sapiens
gctgccctgtggtccagcaggt

SEQ ID NO: 8356908 - DNA, 22 bp, Homo sapiens
gctgcccttcgtcatctataaa

SEQ ID NO: 8356909 - DNA, 22 bp, Homo sapiens
gctgcccagcaggccccagggg

SEQ ID NO: 8356910 - DNA, 22 bp, Homo sapiens
gctgcccaggagaggtggggct

SEQ ID NO: 8356911 - DNA, 22 bp, Homo sapiens
gctgcccagtgtgctcatgcag

SEQ ID NO: 8356912 - DNA, 22 bp, Homo sapiens
gctgcccagttctgctgctgcc

SEQ ID NO: 8356913 - DNA, 22 bp, Homo sapiens
gctgagggctggtcacatttgt

SEQ ID NO: 8356914 - DNA, 22 bp, Homo sapiens
gctgcccaattacagggccgtg

SEQ ID NO: 8356915 - DNA, 22 bp, Homo sapiens
gctgctgttgatttagtccaat

SEQ ID NO: 8356916 - DNA, 22 bp, Homo sapiens
gctgctgttatgatgttacttt

SEQ ID NO: 8356917 - DNA, 22 bp, Homo sapiens
gctgctgttccggctacagccc

SEQ ID NO: 8356918 - DNA, 22 bp, Homo sapiens
gctgctccgcagagtgtgtgtg

SEQ ID NO: 8356919 - DNA, 22 bp, Homo sapiens
gctgctccgtctgagctctggt

SEQ ID NO: 8356920 - DNA, 22 bp, Homo sapiens
gctgctcctgagtcccgcgcgc

SEQ ID NO: 8356921 - DNA, 22 bp, Homo sapiens
gctgctccagctgtgctgcaga

SEQ ID NO: 8356922 - DNA, 22 bp, Homo sapiens
gctgctccagtgttctgtctag

SEQ ID NO: 8356923 - DNA, 22 bp, Homo sapiens
gctgctcatttgtatcctttgt

SEQ ID NO: 8356924 - DNA, 19 bp, Homo sapiens
gctgctcctggctgaccac

SEQ ID NO: 8356925 - DNA, 22 bp, Homo sapiens
gctcctccctgtgcagacccag

SEQ ID NO: 8356926 - DNA, 22 bp, Homo sapiens
gctcctccctgtgcagacccag

SEQ ID NO: 8356927 - DNA, 22 bp, Homo sapiens
gctcctccaatatggactcctc

SEQ ID NO: 8356928 - DNA, 22 bp, Homo sapiens
gctccggcttggtgtgcagggt

SEQ ID NO: 8356929 - DNA, 22 bp, Homo sapiens
gctccgggggttccagatcatc

SEQ ID NO: 8356930 - DNA, 22 bp, Homo sapiens
gctctgggaactgactgccttc

SEQ ID NO: 8356931 - DNA, 20 bp, Homo sapiens
gctctgggagggatgtgatg

SEQ ID NO: 8356932 - DNA, 22 bp, Homo sapiens
gctctgggccgggcaccagcct

SEQ ID NO: 8356933 - DNA, 22 bp, Homo sapiens
gctctgggccatcctggccggg

SEQ ID NO: 8356934 - DNA, 22 bp, Homo sapiens
gctctgggctgccctctggaca

SEQ ID NO: 8356935 - DNA, 23 bp, Homo sapiens
gctgaatgtaatgttctttgggt

SEQ ID NO: 8356936 - DNA, 22 bp, Homo sapiens
gctctggggatgcttctgccgt

SEQ ID NO: 8356937 - DNA, 22 bp, Homo sapiens
gctgagagcggccagctgggaa

SEQ ID NO: 8356938 - DNA, 22 bp, Homo sapiens
gctgagaggcagccagaccctc

SEQ ID NO: 8356939 - DNA, 22 bp, Homo sapiens
gctgaattttgttctagggttt

SEQ ID NO: 8356940 - DNA, 21 bp, Homo sapiens
gctgagacgcaacctcagtga

SEQ ID NO: 8356941 - DNA, 22 bp, Homo sapiens
gccttgtttcattacacgtggt

SEQ ID NO: 8356942 - DNA, 22 bp, Homo sapiens
gcgggtggaacggctccacgtg

SEQ ID NO: 8356943 - DNA, 22 bp, Homo sapiens
gcggggggcagcagtcgctcag

SEQ ID NO: 8356944 - DNA, 22 bp, Homo sapiens
gcgggttgaagggcgcatcgaa

SEQ ID NO: 8356945 - DNA, 22 bp, Homo sapiens
gcgggtggtgtccctgctcctc

SEQ ID NO: 8356946 - DNA, 22 bp, Homo sapiens
gcgggtggatcatgaggtcagg

SEQ ID NO: 8356947 - DNA, 18 bp, Homo sapiens
gcgtggagcgggctcggt

SEQ ID NO: 8356948 - DNA, 22 bp, Homo sapiens
gcgtgggctggactgggatgaa

SEQ ID NO: 8356949 - DNA, 22 bp, Homo sapiens
gcgtggggcagcccagggcttc

SEQ ID NO: 8356950 - DNA, 22 bp, Homo sapiens
gcgtggggcagcccagggcttc

SEQ ID NO: 8356951 - DNA, 22 bp, Homo sapiens
gctacagagctctgtgaagaga

SEQ ID NO: 8356952 - DNA, 22 bp, Homo sapiens
gctacagatttatcatgttata

SEQ ID NO: 8356953 - DNA, 22 bp, Homo sapiens
gcggtgaggaactggtgggaag

SEQ ID NO: 8356954 - DNA, 22 bp, Homo sapiens
gcggtggggaaaggaggtgctg

SEQ ID NO: 8356955 - DNA, 22 bp, Homo sapiens
gcggtggggaaaggaggtgctg

SEQ ID NO: 8356956 - DNA, 22 bp, Homo sapiens
gcggtgggggaaaggagcggtt

SEQ ID NO: 8356957 - DNA, 22 bp, Homo sapiens
gcgtaaggcctctggtctcgga

SEQ ID NO: 8356958 - DNA, 22 bp, Homo sapiens
gcggtgggggaaaggagcggtt

SEQ ID NO: 8356959 - DNA, 23 bp, Homo sapiens
gcgtccggcctctctcgctcccg

SEQ ID NO: 8356960 - DNA, 22 bp, Homo sapiens
gcctctggcttctgcatcagtg

SEQ ID NO: 8356961 - DNA, 22 bp, Homo sapiens
gcctctggggcagctgagtcat

SEQ ID NO: 8356962 - DNA, 22 bp, Homo sapiens
gcctctgggttggtgacaggct

SEQ ID NO: 8356963 - DNA, 22 bp, Homo sapiens
gcctctgtggctcagccttgct

SEQ ID NO: 8356964 - DNA, 18 bp, Homo sapiens
gcctctgttgcttgcctg

SEQ ID NO: 8356965 - DNA, 22 bp, Homo sapiens
gcctctgtaggagtgagagcat

SEQ ID NO: 8356966 - DNA, 22 bp, Homo sapiens
gccttgggcacaggcagggccc

SEQ ID NO: 8356967 - DNA, 22 bp, Homo sapiens
gccttgctaatttctcctcaac

SEQ ID NO: 8356968 - DNA, 22 bp, Homo sapiens
gccttgcctcagccatggaaac

SEQ ID NO: 8356969 - DNA, 22 bp, Homo sapiens
gctccctgcatttcccaccctt

SEQ ID NO: 8356970 - DNA, 21 bp, Homo sapiens
gctccctgctcagctcctggg

SEQ ID NO: 8356971 - DNA, 22 bp, Homo sapiens
gctccctgactcagttcctgag

SEQ ID NO: 8356972 - DNA, 23 bp, Homo sapiens
gctccctgtgctccaggagatgc

SEQ ID NO: 8356973 - DNA, 22 bp, Homo sapiens
gctccctgtctctggggtccat

SEQ ID NO: 8356974 - DNA, 22 bp, Homo sapiens
gctccctgtctctggggtccat

SEQ ID NO: 8356975 - DNA, 22 bp, Homo sapiens
gctccaggtatttgccctttta

SEQ ID NO: 8356976 - DNA, 22 bp, Homo sapiens
gctcccaactcaggcctcctcc

SEQ ID NO: 8356977 - DNA, 23 bp, Homo sapiens
gctcagcctcagcaggcccagga

SEQ ID NO: 8356978 - DNA, 22 bp, Homo sapiens
gctcagcgtggacctggagctt

SEQ ID NO: 8356979 - DNA, 22 bp, Homo sapiens
gctcagccgaacttcagagcag

SEQ ID NO: 8356980 - DNA, 19 bp, Homo sapiens
gctcagagtccccctgcgg

SEQ ID NO: 8356981 - DNA, 19 bp, Homo sapiens
gctcagagtccccctgcgg

SEQ ID NO: 8356982 - DNA, 22 bp, Homo sapiens
gctcagagggttttggccaagt

SEQ ID NO: 8356983 - DNA, 23 bp, Homo sapiens
gctcagaggtttttctctggatg

SEQ ID NO: 8356984 - DNA, 21 bp, Homo sapiens
gctactcaagaagaaggcttt

SEQ ID NO: 8356985 - DNA, 22 bp, Homo sapiens
gctcagaggcacgacctcttgg

SEQ ID NO: 8356986 - DNA, 22 bp, Homo sapiens
gctcagaggatgctcctttatg

SEQ ID NO: 8356987 - DNA, 22 bp, Homo sapiens
gctcagagcttgaagttccact

SEQ ID NO: 8356988 - DNA, 22 bp, Homo sapiens
gctcagaggagcatcataagga

SEQ ID NO: 8356989 - DNA, 19 bp, Homo sapiens
gctcagagggccctgtgct

SEQ ID NO: 8356990 - DNA, 22 bp, Homo sapiens
gctcagagggaacaaggggctg

SEQ ID NO: 8356991 - DNA, 23 bp, Homo sapiens
ggacacaggccttgtctgcgcct

SEQ ID NO: 8356992 - DNA, 23 bp, Homo sapiens
ggacacaggccttgtctgcgcct

SEQ ID NO: 8356993 - DNA, 22 bp, Homo sapiens
ggacacagggctcactctctct

SEQ ID NO: 8356994 - DNA, 22 bp, Homo sapiens
ggacacaggtaaataccactga

SEQ ID NO: 8356995 - DNA, 22 bp, Homo sapiens
ggacacagggctcactctctct

SEQ ID NO: 8356996 - DNA, 22 bp, Homo sapiens
ggacacagtggaagacagcttg

SEQ ID NO: 8356997 - DNA, 22 bp, Homo sapiens
ggacatagatctagactttaaa

SEQ ID NO: 8356998 - DNA, 22 bp, Homo sapiens
ggaccaggctgagcacctgcct

SEQ ID NO: 8356999 - DNA, 22 bp, Homo sapiens
ggaccaggccagcctccctgcg

SEQ ID NO: 8357000 - DNA, 22 bp, Homo sapiens
ggaccaggggcgcactccctgc

SEQ ID NO: 8357001 - DNA, 19 bp, Homo sapiens
ggaccaggtcctgggcagc

SEQ ID NO: 8357002 - DNA, 22 bp, Homo sapiens
ggagagagacctccatgcccag

SEQ ID NO: 8357003 - DNA, 22 bp, Homo sapiens
ggagagagagattgtgtttatt

SEQ ID NO: 8357004 - DNA, 22 bp, Homo sapiens
ggagcaggcagggccgtgtctg

SEQ ID NO: 8357005 - DNA, 22 bp, Homo sapiens
ggagcagggaattacagcgcag

SEQ ID NO: 8357006 - DNA, 22 bp, Homo sapiens
ggagagaaattgaggtagcaag

SEQ ID NO: 8357007 - DNA, 18 bp, Homo sapiens
ggacacagataggtacag

SEQ ID NO: 8357008 - DNA, 22 bp, Homo sapiens
ggacacagctgcagccacaccc

SEQ ID NO: 8357009 - DNA, 17 bp, Homo sapiens
ggacacagctcatggct

SEQ ID NO: 8357010 - DNA, 18 bp, Homo sapiens
ggaatgtggacaggctgg

SEQ ID NO: 8357011 - DNA, 22 bp, Homo sapiens
ggaatgtgcgtactcagtgtca

SEQ ID NO: 8357012 - DNA, 22 bp, Homo sapiens
ggaatgtgctgacacgcgagag

SEQ ID NO: 8357013 - DNA, 22 bp, Homo sapiens
ggaagagggaaccacgactgta

SEQ ID NO: 8357014 - DNA, 20 bp, Homo sapiens
ggaagcagagaactgttttc

SEQ ID NO: 8357015 - DNA, 22 bp, Homo sapiens
ggaagcagcctgaagccaaggg

SEQ ID NO: 8357016 - DNA, 22 bp, Homo sapiens
gctttgctgggtgcttcatgta

SEQ ID NO: 8357017 - DNA, 22 bp, Homo sapiens
ggaagaggaggagccaggcttt

SEQ ID NO: 8357018 - DNA, 22 bp, Homo sapiens
ggaagaggctgagccaggtccc

SEQ ID NO: 8357019 - DNA, 22 bp, Homo sapiens
ggaagaggctgaggccatgctg

SEQ ID NO: 8357020 - DNA, 22 bp, Homo sapiens
ggaagaggctctcattgagggc

SEQ ID NO: 8357021 - DNA, 22 bp, Homo sapiens
gcttgagtcatttagatcatca

SEQ ID NO: 8357022 - DNA, 22 bp, Homo sapiens
gcttgaggagacttttggggga

SEQ ID NO: 8357023 - DNA, 22 bp, Homo sapiens
gctttatgtgagtagcactgtc

SEQ ID NO: 8357024 - DNA, 22 bp, Homo sapiens
gctgtgtgaaaactgggcctgg

SEQ ID NO: 8357025 - DNA, 22 bp, Homo sapiens
gctgtgggtaaacgctgagggt

SEQ ID NO: 8357026 - DNA, 22 bp, Homo sapiens
gctgtgggccatggccaagtga

SEQ ID NO: 8357027 - DNA, 22 bp, Homo sapiens
gctgtgggccacacggctgagt

SEQ ID NO: 8357028 - DNA, 22 bp, Homo sapiens
gctgtgggccacacggctgagt

SEQ ID NO: 8357029 - DNA, 22 bp, Homo sapiens
gctgtgggtgctggctccaccc

SEQ ID NO: 8357030 - DNA, 22 bp, Homo sapiens
gctgtgggtgctggctccaccc

SEQ ID NO: 8357031 - DNA, 22 bp, Homo sapiens
gctgtggcggcagcagctggtg

SEQ ID NO: 8357032 - DNA, 22 bp, Homo sapiens
gctgtggctgtacagagaccat

SEQ ID NO: 8357033 - DNA, 22 bp, Homo sapiens
gctggggcctgaacagtcagct

SEQ ID NO: 8357034 - DNA, 19 bp, Homo sapiens
gctggggcctgaccagaca

SEQ ID NO: 8357035 - DNA, 19 bp, Homo sapiens
gctggggcctgaccagaca

SEQ ID NO: 8357036 - DNA, 19 bp, Homo sapiens
gctggggcctgaccagaca

SEQ ID NO: 8357037 - DNA, 22 bp, Homo sapiens
gctggggctgggctgaggaaga

SEQ ID NO: 8357038 - DNA, 22 bp, Homo sapiens
gctgtgctcaacgtgccttcct

SEQ ID NO: 8357039 - DNA, 22 bp, Homo sapiens
gctggggcctgaacagtcagct

SEQ ID NO: 8357040 - DNA, 22 bp, Homo sapiens
gctggggcctctgtgaggttaa

SEQ ID NO: 8357041 - DNA, 22 bp, Homo sapiens
gctggggaggcagcagagaaca

SEQ ID NO: 8357042 - DNA, 19 bp, Homo sapiens
gctggctggaggagggaca

SEQ ID NO: 8357043 - DNA, 22 bp, Homo sapiens
gctggctggagtaaggagggag

SEQ ID NO: 8357044 - DNA, 22 bp, Homo sapiens
gctggctggaggtgaggaagaa

SEQ ID NO: 8357045 - DNA, 22 bp, Homo sapiens
gctggagaaacaggaggaggaa

SEQ ID NO: 8357046 - DNA, 22 bp, Homo sapiens
gctggagagataggcatggggt

SEQ ID NO: 8357047 - DNA, 22 bp, Homo sapiens
gcagccctgcaggcagctccag

SEQ ID NO: 8357048 - DNA, 22 bp, Homo sapiens
gcagccctttctgggcagggga

SEQ ID NO: 8357049 - DNA, 22 bp, Homo sapiens
gcagcccttcaggtgaggggca

SEQ ID NO: 8357050 - DNA, 19 bp, Homo sapiens
gcaggaaatgagtgattgc

SEQ ID NO: 8357051 - DNA, 22 bp, Homo sapiens
gcaggaaccccgggaggctggc

SEQ ID NO: 8357052 - DNA, 22 bp, Homo sapiens
gcagccctcgctagctctcccc

SEQ ID NO: 8357053 - DNA, 22 bp, Homo sapiens
gcagccctgcagctccacaccg

SEQ ID NO: 8357054 - DNA, 22 bp, Homo sapiens
gcagatgggagccccaggggag

SEQ ID NO: 8357055 - DNA, 22 bp, Homo sapiens
gcagatggtggaggcaagaggc

SEQ ID NO: 8357056 - DNA, 22 bp, Homo sapiens
gcagatggcagcccaggctggg

SEQ ID NO: 8357057 - DNA, 22 bp, Homo sapiens
gcagatggcagcccaggctggg

SEQ ID NO: 8357058 - DNA, 22 bp, Homo sapiens
gcagatggatgtggacggcgcc

SEQ ID NO: 8357059 - DNA, 22 bp, Homo sapiens
gcagatggatcacctgaggtcg

SEQ ID NO: 8357060 - DNA, 23 bp, Homo sapiens
gcagatggccccagagtgctgcc

SEQ ID NO: 8357061 - DNA, 23 bp, Homo sapiens
gcagatggccccagagtgctgcc

SEQ ID NO: 8357062 - DNA, 23 bp, Homo sapiens
gcagatggccccagagtgctgcc

SEQ ID NO: 8357063 - DNA, 22 bp, Homo sapiens
gcagggctgttcaggagggtgg

SEQ ID NO: 8357064 - DNA, 22 bp, Homo sapiens
gcagggctgggtgggagacaga

SEQ ID NO: 8357065 - DNA, 21 bp, Homo sapiens
gcagggaccgcgacttctggg

SEQ ID NO: 8357066 - DNA, 22 bp, Homo sapiens
gcagggaccaaaagaggcagta

SEQ ID NO: 8357067 - DNA, 22 bp, Homo sapiens
gcagggaccagggccagatcca

SEQ ID NO: 8357068 - DNA, 22 bp, Homo sapiens
gcagggacctgccactgctgtc

SEQ ID NO: 8357069 - DNA, 22 bp, Homo sapiens
gcagggacatcttcagatcact

SEQ ID NO: 8357070 - DNA, 22 bp, Homo sapiens
gcagggacaactgtgcacctga

SEQ ID NO: 8357071 - DNA, 18 bp, Homo sapiens
gcagggacacagggtcac

SEQ ID NO: 8357072 - DNA, 18 bp, Homo sapiens
gcagggacacagggtcac

SEQ ID NO: 8357073 - DNA, 22 bp, Homo sapiens
gcaggcaggtggcatcttgtga

SEQ ID NO: 8357074 - DNA, 21 bp, Homo sapiens
gcagggacaaagcttcaggag

SEQ ID NO: 8357075 - DNA, 22 bp, Homo sapiens
gcaggcagaggtggaggagaca

SEQ ID NO: 8357076 - DNA, 22 bp, Homo sapiens
gcaggcagatcacctgtcagga

SEQ ID NO: 8357077 - DNA, 22 bp, Homo sapiens
gcaggcagatcacctgtcagga

SEQ ID NO: 8357078 - DNA, 22 bp, Homo sapiens
gcagagggtcctgtgccagcag

SEQ ID NO: 8357079 - DNA, 22 bp, Homo sapiens
gcagagggtcctgtgccagcag

SEQ ID NO: 8357080 - DNA, 20 bp, Homo sapiens
gcagagtgtgagagggtgaa

SEQ ID NO: 8357081 - DNA, 22 bp, Homo sapiens
gcagagtggtttcagagttgag

SEQ ID NO: 8357082 - DNA, 22 bp, Homo sapiens
gcagaggtgagaagggcctccc

SEQ ID NO: 8357083 - DNA, 19 bp, Homo sapiens
gcagagtggggtggagggt

SEQ ID NO: 8357084 - DNA, 22 bp, Homo sapiens
gcagaggatcaggctctggaaa

SEQ ID NO: 8357085 - DNA, 22 bp, Homo sapiens
gcagaggatagcatatgaacct

SEQ ID NO: 8357086 - DNA, 22 bp, Homo sapiens
gcagaggaggacccaggaatta

SEQ ID NO: 8357087 - DNA, 22 bp, Homo sapiens
gcagaggagtgattatgccgtg

SEQ ID NO: 8357088 - DNA, 22 bp, Homo sapiens
gcagagaaagttttgtcctcag

SEQ ID NO: 8357089 - DNA, 22 bp, Homo sapiens
gcagagcaccctgcagtggtat

SEQ ID NO: 8357090 - DNA, 22 bp, Homo sapiens
gcagacattttgaatctaggct

SEQ ID NO: 8357091 - DNA, 22 bp, Homo sapiens
gcacatgagctgctgggatggg

SEQ ID NO: 8357092 - DNA, 19 bp, Homo sapiens
gcagacaggtccagagagg

SEQ ID NO: 8357093 - DNA, 23 bp, Homo sapiens
gcacatagtaagtaagcagacat

SEQ ID NO: 8357094 - DNA, 21 bp, Homo sapiens
gcacagtgccaggcacacagt

SEQ ID NO: 8357095 - DNA, 22 bp, Homo sapiens
gcacagtggtgaaagcatgggt

SEQ ID NO: 8357096 - DNA, 22 bp, Homo sapiens
gcacacagaatcagtgggcata

SEQ ID NO: 8357097 - DNA, 22 bp, Homo sapiens
gcacacatgcatgcacaggagt

SEQ ID NO: 8357098 - DNA, 19 bp, Homo sapiens
gcacaccctgcaccaccat

SEQ ID NO: 8357099 - DNA, 22 bp, Homo sapiens
gcacaccctctcaccagcactg

SEQ ID NO: 8357100 - DNA, 22 bp, Homo sapiens
gcacagggctgccaggcggctt

SEQ ID NO: 8357101 - DNA, 22 bp, Homo sapiens
gaggcccaatgcttccctcctt

SEQ ID NO: 8357102 - DNA, 22 bp, Homo sapiens
gcaaactggtagctcgcctgcc

SEQ ID NO: 8357103 - DNA, 22 bp, Homo sapiens
gcaaactgttggagtagagtct

SEQ ID NO: 8357104 - DNA, 22 bp, Homo sapiens
gcaaagcagtcttctgtgccta

SEQ ID NO: 8357105 - DNA, 22 bp, Homo sapiens
gcaaagcaagctgtcagcctca

SEQ ID NO: 8357106 - DNA, 22 bp, Homo sapiens
gcaaagtattaagtattaagtt

SEQ ID NO: 8357107 - DNA, 22 bp, Homo sapiens
gcaaatacatgttgagcaccta

SEQ ID NO: 8357108 - DNA, 22 bp, Homo sapiens
gcaaatacatgttgagcaccta

SEQ ID NO: 8357109 - DNA, 22 bp, Homo sapiens
gcagtggctaggagtctggcgt

SEQ ID NO: 8357110 - DNA, 22 bp, Homo sapiens
gcagtgggaaggttggcacatg

SEQ ID NO: 8357111 - DNA, 22 bp, Homo sapiens
gcagtgggagcttaggcagtgc

SEQ ID NO: 8357112 - DNA, 22 bp, Homo sapiens
gcagtggcaccgctggctctgg

SEQ ID NO: 8357113 - DNA, 22 bp, Homo sapiens
gcagtggcatgatgtgggctca

SEQ ID NO: 8357114 - DNA, 22 bp, Homo sapiens
gcagtgataactttactctttt

SEQ ID NO: 8357115 - DNA, 22 bp, Homo sapiens
gcagtgctttagtctgtccttt

SEQ ID NO: 8357116 - DNA, 22 bp, Homo sapiens
gcagtgaatctggcaagaattt

SEQ ID NO: 8357117 - DNA, 22 bp, Homo sapiens
gcaggggagtggcaggcccgga

SEQ ID NO: 8357118 - DNA, 22 bp, Homo sapiens
gcaggggagtggcaggcccgga

SEQ ID NO: 8357119 - DNA, 22 bp, Homo sapiens
gcaggggagtggcaggcccgga

SEQ ID NO: 8357120 - DNA, 22 bp, Homo sapiens
gcaggggagtggatgatggatt

SEQ ID NO: 8357121 - DNA, 22 bp, Homo sapiens
gcatggctattatgaggcagaa

SEQ ID NO: 8357122 - DNA, 22 bp, Homo sapiens
gcatggccttcagggacagctg

SEQ ID NO: 8357123 - DNA, 21 bp, Homo sapiens
gcatgcctgcatcttagtgtt

SEQ ID NO: 8357124 - DNA, 22 bp, Homo sapiens
gcatgctacagcccaactgtga

SEQ ID NO: 8357125 - DNA, 22 bp, Homo sapiens
gcatgctgctgaggctggaata

SEQ ID NO: 8357126 - DNA, 22 bp, Homo sapiens
gcatgcatggtttgtgactgtg

SEQ ID NO: 8357127 - DNA, 22 bp, Homo sapiens
gccagcctgtgggggctctgtg

SEQ ID NO: 8357128 - DNA, 23 bp, Homo sapiens
gccagccttgctctcctgcagcc

SEQ ID NO: 8357129 - DNA, 22 bp, Homo sapiens
gccagccttctgtggcctgcaa

SEQ ID NO: 8357130 - DNA, 22 bp, Homo sapiens
gccagctcagatgcaggaagga

SEQ ID NO: 8357131 - DNA, 22 bp, Homo sapiens
gccagctgaaatttcagttctg

SEQ ID NO: 8357132 - DNA, 22 bp, Homo sapiens
gccagggcaggggagcatctgc

SEQ ID NO: 8357133 - DNA, 22 bp, Homo sapiens
gccagggcaggggagcatctgc

SEQ ID NO: 8357134 - DNA, 22 bp, Homo sapiens
gccagggctgtgcaggtttgtt

SEQ ID NO: 8357135 - DNA, 22 bp, Homo sapiens
gccagggctcgcggtccctcgt

SEQ ID NO: 8357136 - DNA, 20 bp, Homo sapiens
gccctggagccttgtcctgg

SEQ ID NO: 8357137 - DNA, 17 bp, Homo sapiens
gccctggagccaggcta

SEQ ID NO: 8357138 - DNA, 17 bp, Homo sapiens
gccctggagccaggcta

SEQ ID NO: 8357139 - DNA, 22 bp, Homo sapiens
gccctggatgtacaggcatgtt

SEQ ID NO: 8357140 - DNA, 22 bp, Homo sapiens
gccctggatgtacaggcatgtt

SEQ ID NO: 8357141 - DNA, 22 bp, Homo sapiens
gccctgggattgggtggaggct

SEQ ID NO: 8357142 - DNA, 22 bp, Homo sapiens
gccctggccttcatctcagaca

SEQ ID NO: 8357143 - DNA, 22 bp, Homo sapiens
gccctgggcaaggttctggcca

SEQ ID NO: 8357144 - DNA, 22 bp, Homo sapiens
gccctgtgcgactctagaggtt

SEQ ID NO: 8357145 - DNA, 22 bp, Homo sapiens
gccctgtggacagtgagaagtg

SEQ ID NO: 8357146 - DNA, 22 bp, Homo sapiens
gccctgtggattaatgagcagg

SEQ ID NO: 8357147 - DNA, 22 bp, Homo sapiens
gcctccggagtcacagtgtctt

SEQ ID NO: 8357148 - DNA, 22 bp, Homo sapiens
gcctccggagttgcagtgtctt

SEQ ID NO: 8357149 - DNA, 22 bp, Homo sapiens
gccctgtggttccaggaagcaa

SEQ ID NO: 8357150 - DNA, 22 bp, Homo sapiens
gccctgtgtgatcacatgaaca

SEQ ID NO: 8357151 - DNA, 22 bp, Homo sapiens
gcctcctcacaatgtacccacg

SEQ ID NO: 8357152 - DNA, 22 bp, Homo sapiens
gcctcctcacaatgtacccacg

SEQ ID NO: 8357153 - DNA, 22 bp, Homo sapiens
gcctcctgaaaggaagagctcc

SEQ ID NO: 8357154 - DNA, 22 bp, Homo sapiens
gcctctggagttgcttgtaaat

SEQ ID NO: 8357155 - DNA, 22 bp, Homo sapiens
gcccagcacattgctgaggacc

SEQ ID NO: 8357156 - DNA, 22 bp, Homo sapiens
gcccagcacatctggccttgaa

SEQ ID NO: 8357157 - DNA, 22 bp, Homo sapiens
gccagggggtcagcaggcactt

SEQ ID NO: 8357158 - DNA, 22 bp, Homo sapiens
gccagggggtcagcaggcactt

SEQ ID NO: 8357159 - DNA, 22 bp, Homo sapiens
gccagggtgtgcagggacagga

SEQ ID NO: 8357160 - DNA, 22 bp, Homo sapiens
gccagggttcgaatccgtatgg

SEQ ID NO: 8357161 - DNA, 22 bp, Homo sapiens
gcccagccctgaggtcacagct

SEQ ID NO: 8357162 - DNA, 22 bp, Homo sapiens
gcccagcacctctctcagggtt

SEQ ID NO: 8357163 - DNA, 22 bp, Homo sapiens
gcccagcagatctcagtgtctc

SEQ ID NO: 8357164 - DNA, 22 bp, Homo sapiens
gcccagcccctgggtggacgtg

SEQ ID NO: 8357165 - DNA, 22 bp, Homo sapiens
gccccaagggagcccagcacac

SEQ ID NO: 8357166 - DNA, 22 bp, Homo sapiens
gccccactgtggaacctaagtc

SEQ ID NO: 8357167 - DNA, 22 bp, Homo sapiens
gccccactttcctaggcagtat

SEQ ID NO: 8357168 - DNA, 22 bp, Homo sapiens
tccccaaaatacatggacgtgt

SEQ ID NO: 8357169 - DNA, 22 bp, Homo sapiens
tccccaaagctttgtggtcagg

SEQ ID NO: 8357170 - DNA, 22 bp, Homo sapiens
tccccacacagatacagagtag

SEQ ID NO: 8357171 - DNA, 22 bp, Homo sapiens
tccccacctacacactgctcct

SEQ ID NO: 8357172 - DNA, 22 bp, Homo sapiens
tccccaccccagaactactagg

SEQ ID NO: 8357173 - DNA, 22 bp, Homo sapiens
tcccagtttttctccactaagg

SEQ ID NO: 8357174 - DNA, 23 bp, Homo sapiens
tcccatcaaccagagtgaaacac

SEQ ID NO: 8357175 - DNA, 22 bp, Homo sapiens
tcccatcaatgtctgcagaaga

SEQ ID NO: 8357176 - DNA, 20 bp, Homo sapiens
tcccagtcagccagagtgag

SEQ ID NO: 8357177 - DNA, 22 bp, Homo sapiens
tcccattgtttgctctaggctg

SEQ ID NO: 8357178 - DNA, 23 bp, Homo sapiens
tcccattgccctatagtgcctca

SEQ ID NO: 8357179 - DNA, 22 bp, Homo sapiens
tcccatcatctgttctggctac

SEQ ID NO: 8357180 - DNA, 18 bp, Homo sapiens
tcccatcatcctctccag

SEQ ID NO: 8357181 - DNA, 19 bp, Homo sapiens
tcccatcaggaactggctt

SEQ ID NO: 8357182 - DNA, 22 bp, Homo sapiens
tcccatcactctggaatgggta

SEQ ID NO: 8357183 - DNA, 22 bp, Homo sapiens
tcccatcagctgggaagggtgt

SEQ ID NO: 8357184 - DNA, 22 bp, Homo sapiens
tcccatcaggtttaggtgggag

SEQ ID NO: 8357185 - DNA, 22 bp, Homo sapiens
tcccatcagtcattggttgagg

SEQ ID NO: 8357186 - DNA, 21 bp, Homo sapiens
tcccatcaggtctttttatag

SEQ ID NO: 8357187 - DNA, 22 bp, Homo sapiens
tcccatcacatggagagtgaag

SEQ ID NO: 8357188 - DNA, 22 bp, Homo sapiens
tcccatcactagcatctgcacc

SEQ ID NO: 8357189 - DNA, 20 bp, Homo sapiens
tcccatcacgcctgtgccag

SEQ ID NO: 8357190 - DNA, 22 bp, Homo sapiens
tcccagggactgggctaggctt

SEQ ID NO: 8357191 - DNA, 22 bp, Homo sapiens
tcccagggtgcgcctgccctcg

SEQ ID NO: 8357192 - DNA, 22 bp, Homo sapiens
tccatgccaggcagtcgatgca

SEQ ID NO: 8357193 - DNA, 22 bp, Homo sapiens
tcccaatttcgagagttttaga

SEQ ID NO: 8357194 - DNA, 22 bp, Homo sapiens
tccatctcacctgcactctgcg

SEQ ID NO: 8357195 - DNA, 22 bp, Homo sapiens
tccagggctcattccctctgca

SEQ ID NO: 8357196 - DNA, 22 bp, Homo sapiens
tccagggctccccaacatccag

SEQ ID NO: 8357197 - DNA, 22 bp, Homo sapiens
tccagggctccccaacatccag

SEQ ID NO: 8357198 - DNA, 22 bp, Homo sapiens
tccatcagattccctcctgaga

SEQ ID NO: 8357199 - DNA, 22 bp, Homo sapiens
tccatcatgttcacagctatat

SEQ ID NO: 8357200 - DNA, 20 bp, Homo sapiens
tccagggctagggagctcat

SEQ ID NO: 8357201 - DNA, 21 bp, Homo sapiens
tccagggcgggcgcacggaga

SEQ ID NO: 8357202 - DNA, 22 bp, Homo sapiens
tccagggcgtgtgtgaaggaaa

SEQ ID NO: 8357203 - DNA, 20 bp, Homo sapiens
tccagggccctggctcctct

SEQ ID NO: 8357204 - DNA, 22 bp, Homo sapiens
tccagggccatctccatgaggc

SEQ ID NO: 8357205 - DNA, 19 bp, Homo sapiens
tccagggcaggaacatgta

SEQ ID NO: 8357206 - DNA, 22 bp, Homo sapiens
tccagggcagggtgcgcatggg

SEQ ID NO: 8357207 - DNA, 22 bp, Homo sapiens
tccaggagggttttctgccttc

SEQ ID NO: 8357208 - DNA, 22 bp, Homo sapiens
tccaggagggggagccgtgccg

SEQ ID NO: 8357209 - DNA, 22 bp, Homo sapiens
tccaggagtttgacctgtgggc

SEQ ID NO: 8357210 - DNA, 22 bp, Homo sapiens
tccaggccactgcagaggctct

SEQ ID NO: 8357211 - DNA, 22 bp, Homo sapiens
tccaggccactgcagaggctct

SEQ ID NO: 8357212 - DNA, 23 bp, Homo sapiens
tccaggcatgagctctggatgga

SEQ ID NO: 8357213 - DNA, 22 bp, Homo sapiens
tccaggccacgacctcctggat

SEQ ID NO: 8357214 - DNA, 22 bp, Homo sapiens
tccaggccacatggatggcgat

SEQ ID NO: 8357215 - DNA, 22 bp, Homo sapiens
tccaggccaatgtagcaggccc

SEQ ID NO: 8357216 - DNA, 22 bp, Homo sapiens
tcattgcactccagcctgggca

SEQ ID NO: 8357217 - DNA, 22 bp, Homo sapiens
tcattgcaccccagtcccagct

SEQ ID NO: 8357218 - DNA, 22 bp, Homo sapiens
tcattgcagaaataaaggtgaa

SEQ ID NO: 8357219 - DNA, 22 bp, Homo sapiens
tcattgcagcttcaggtgttca

SEQ ID NO: 8357220 - DNA, 22 bp, Homo sapiens
tcattgcaggcattcccctgcc

SEQ ID NO: 8357221 - DNA, 22 bp, Homo sapiens
tcattgcagtagggagagaccc

SEQ ID NO: 8357222 - DNA, 22 bp, Homo sapiens
tcattgcagtagggagagaccc

SEQ ID NO: 8357223 - DNA, 22 bp, Homo sapiens
tcattgcagtgatgttgtatgt

SEQ ID NO: 8357224 - DNA, 22 bp, Homo sapiens
tcattgcagtgatgttgtatgt

SEQ ID NO: 8357225 - DNA, 22 bp, Homo sapiens
tcattgcagactaacaatctca

SEQ ID NO: 8357226 - DNA, 22 bp, Homo sapiens
tcattgcatttattcactggca

SEQ ID NO: 8357227 - DNA, 22 bp, Homo sapiens
tcattgcagttgagttgtgtta

SEQ ID NO: 8357228 - DNA, 22 bp, Homo sapiens
tcattgcagttgagttgtgtta

SEQ ID NO: 8357229 - DNA, 22 bp, Homo sapiens
tcattgaatttcacagctttat

SEQ ID NO: 8357230 - DNA, 22 bp, Homo sapiens
tcattgaatttcacagctttat

SEQ ID NO: 8357231 - DNA, 22 bp, Homo sapiens
tcattgaatgctctgcaggttg

SEQ ID NO: 8357232 - DNA, 22 bp, Homo sapiens
tcattgaatgagatgcaataga

SEQ ID NO: 8357233 - DNA, 22 bp, Homo sapiens
tcattgaagtgactgaaagatt

SEQ ID NO: 8357234 - DNA, 22 bp, Homo sapiens
tcattgaagacttactggcttc

SEQ ID NO: 8357235 - DNA, 22 bp, Homo sapiens
tcattgcaagctcatttatctg

SEQ ID NO: 8357236 - DNA, 22 bp, Homo sapiens
tcattgcaagctcatttatctg

SEQ ID NO: 8357237 - DNA, 20 bp, Homo sapiens
tcattgcacataatggaagc

SEQ ID NO: 8357238 - DNA, 20 bp, Homo sapiens
tcattgcacataatggaagc

SEQ ID NO: 8357239 - DNA, 22 bp, Homo sapiens
tccagagatccaaagaatatga

SEQ ID NO: 8357240 - DNA, 22 bp, Homo sapiens
tccagagatccaaagaatatga

SEQ ID NO: 8357241 - DNA, 22 bp, Homo sapiens
tccagagcatgcagatcatcaa

SEQ ID NO: 8357242 - DNA, 22 bp, Homo sapiens
tccagagcctttctgcttgaca

SEQ ID NO: 8357243 - DNA, 22 bp, Homo sapiens
tccagcagactcatcagcaagg

SEQ ID NO: 8357244 - DNA, 22 bp, Homo sapiens
tccagcagagtctctgaggggg

SEQ ID NO: 8357245 - DNA, 22 bp, Homo sapiens
tccagcaggtccgagacaagtt

SEQ ID NO: 8357246 - DNA, 22 bp, Homo sapiens
tccagagggcgatggctggggg

SEQ ID NO: 8357247 - DNA, 22 bp, Homo sapiens
tccagcagaccatcaaggctca

SEQ ID NO: 8357248 - DNA, 20 bp, Homo sapiens
tccagaggccacatccagtg

SEQ ID NO: 8357249 - DNA, 16 bp, Homo sapiens
tccagcagtctctgta

SEQ ID NO: 8357250 - DNA, 22 bp, Homo sapiens
tccagcagtgctcaggactcac

SEQ ID NO: 8357251 - DNA, 22 bp, Homo sapiens
tccagccaccaccttgattgcc

SEQ ID NO: 8357252 - DNA, 22 bp, Homo sapiens
tccagccaagccttggtagctg

SEQ ID NO: 8357253 - DNA, 22 bp, Homo sapiens
tccagccaatcagagctgaggc

SEQ ID NO: 8357254 - DNA, 22 bp, Homo sapiens
tccagccaatcagagctgaggc

SEQ ID NO: 8357255 - DNA, 22 bp, Homo sapiens
tccagccaatcaactattgttt

SEQ ID NO: 8357256 - DNA, 23 bp, Homo sapiens
tccagccaaatctggctgacagt

SEQ ID NO: 8357257 - DNA, 23 bp, Homo sapiens
tccagccaaatctggctgacagt

SEQ ID NO: 8357258 - DNA, 22 bp, Homo sapiens
tccagcctttctactcactgag

SEQ ID NO: 8357259 - DNA, 22 bp, Homo sapiens
tccagctcacagatagcgtggg

SEQ ID NO: 8357260 - DNA, 22 bp, Homo sapiens
tccagctcagatgcagggatca

SEQ ID NO: 8357261 - DNA, 18 bp, Homo sapiens
tccagctcacagatgggc

SEQ ID NO: 8357262 - DNA, 22 bp, Homo sapiens
tccagctcagatgcagggatca

SEQ ID NO: 8357263 - DNA, 22 bp, Homo sapiens
tccagctcacagatagcgtggg

SEQ ID NO: 8357264 - DNA, 22 bp, Homo sapiens
tccagcttcagctcttggatag

SEQ ID NO: 8357265 - DNA, 22 bp, Homo sapiens
tccagcttggcagagctacctg

SEQ ID NO: 8357266 - DNA, 22 bp, Homo sapiens
tccaggagggattgggctgtgg

SEQ ID NO: 8357267 - DNA, 22 bp, Homo sapiens
tccagctttggctctagctaca

SEQ ID NO: 8357268 - DNA, 22 bp, Homo sapiens
tccagctctggcttggctagct

SEQ ID NO: 8357269 - DNA, 22 bp, Homo sapiens
tccagctctaacatgctgggcc

SEQ ID NO: 8357270 - DNA, 21 bp, Homo sapiens
tccagctctcatagtgttcca

SEQ ID NO: 8357271 - DNA, 22 bp, Homo sapiens
tccagctctgattctcactagc

SEQ ID NO: 8357272 - DNA, 22 bp, Homo sapiens
tccagctctggcttggctagct

SEQ ID NO: 8357273 - DNA, 22 bp, Homo sapiens
tccagctctgcttcacagtctc

SEQ ID NO: 8357274 - DNA, 21 bp, Homo sapiens
tcagtgtatttaagaatgttg

SEQ ID NO: 8357275 - DNA, 22 bp, Homo sapiens
tcagtgtctgtgggcaggatgg

SEQ ID NO: 8357276 - DNA, 20 bp, Homo sapiens
tcagtgattatctctgagtg

SEQ ID NO: 8357277 - DNA, 23 bp, Homo sapiens
tcagtgatgttgaacctagcagt

SEQ ID NO: 8357278 - DNA, 23 bp, Homo sapiens
tcagtcttggcttctgattttcc

SEQ ID NO: 8357279 - DNA, 22 bp, Homo sapiens
tcaggtggccaaatgggagcgc

SEQ ID NO: 8357280 - DNA, 17 bp, Homo sapiens
tcagtctctgtcctgga

SEQ ID NO: 8357281 - DNA, 21 bp, Homo sapiens
tcattcacagggtattgtata

SEQ ID NO: 8357282 - DNA, 19 bp, Homo sapiens
tcattcaggaccagtggat

SEQ ID NO: 8357283 - DNA, 22 bp, Homo sapiens
tcattgaacgaagagctccatt

SEQ ID NO: 8357284 - DNA, 22 bp, Homo sapiens
tcattacagagatataatctac

SEQ ID NO: 8357285 - DNA, 22 bp, Homo sapiens
tcattactttttttgtgtctac

SEQ ID NO: 8357286 - DNA, 22 bp, Homo sapiens
tcatgcttttatgatatttact

SEQ ID NO: 8357287 - DNA, 22 bp, Homo sapiens
tcatggcacatgccctccaggg

SEQ ID NO: 8357288 - DNA, 22 bp, Homo sapiens
tcatggccaaagtcaggagtgt

SEQ ID NO: 8357289 - DNA, 21 bp, Homo sapiens
tcatggccagcaagtggcaga

SEQ ID NO: 8357290 - DNA, 22 bp, Homo sapiens
tcatatgcatatgaaatttttg

SEQ ID NO: 8357291 - DNA, 22 bp, Homo sapiens
tcatatgcatatgaaatttttg

SEQ ID NO: 8357292 - DNA, 22 bp, Homo sapiens
tcatatatttagttgtgcaaca

SEQ ID NO: 8357293 - DNA, 22 bp, Homo sapiens
tcatatatcgaatgggcatcat

SEQ ID NO: 8357294 - DNA, 22 bp, Homo sapiens
tcatatatctgcaaagcagtat

SEQ ID NO: 8357295 - DNA, 22 bp, Homo sapiens
tcatatatctgcaaagcagtat

SEQ ID NO: 8357296 - DNA, 22 bp, Homo sapiens
tcatatacctgcatgtgcatgt

SEQ ID NO: 8357297 - DNA, 22 bp, Homo sapiens
tcatataactggatattttcaa

SEQ ID NO: 8357298 - DNA, 22 bp, Homo sapiens
tcatataagtttaaaactatct

SEQ ID NO: 8357299 - DNA, 22 bp, Homo sapiens
tcatataagtttaaaactatct

SEQ ID NO: 8357300 - DNA, 21 bp, Homo sapiens
tcatatttctcttgctattgt

SEQ ID NO: 8357301 - DNA, 17 bp, Homo sapiens
tcatgcccaactattac

SEQ ID NO: 8357302 - DNA, 22 bp, Homo sapiens
tcatgcccagagcagtaaatta

SEQ ID NO: 8357303 - DNA, 22 bp, Homo sapiens
tcatgccagttaaaggctgtga

SEQ ID NO: 8357304 - DNA, 23 bp, Homo sapiens
tcatgcccaggctccagatgtca

SEQ ID NO: 8357305 - DNA, 22 bp, Homo sapiens
tcagctccacagctcctctgcc

SEQ ID NO: 8357306 - DNA, 22 bp, Homo sapiens
tcagctccacagctcctctgcc

SEQ ID NO: 8357307 - DNA, 22 bp, Homo sapiens
tcagctccatccctgcttttgc

SEQ ID NO: 8357308 - DNA, 22 bp, Homo sapiens
tcagctcctatactttgtcctg

SEQ ID NO: 8357309 - DNA, 22 bp, Homo sapiens
tcagctcggcctaggcccacgg

SEQ ID NO: 8357310 - DNA, 22 bp, Homo sapiens
tcagcagaaaggcactagatga

SEQ ID NO: 8357311 - DNA, 21 bp, Homo sapiens
tcagcagcttttgcagtccct

SEQ ID NO: 8357312 - DNA, 21 bp, Homo sapiens
tcagcagaaggaccactaggg

SEQ ID NO: 8357313 - DNA, 22 bp, Homo sapiens
tcagcaggcacggacaggctgc

SEQ ID NO: 8357314 - DNA, 22 bp, Homo sapiens
tcagcaggcacaccaaaaactg

SEQ ID NO: 8357315 - DNA, 22 bp, Homo sapiens
tcaggagtctgtgcagttccac

SEQ ID NO: 8357316 - DNA, 22 bp, Homo sapiens
tcagctctgcaaggtcacctcc

SEQ ID NO: 8357317 - DNA, 22 bp, Homo sapiens
tcaggccttgtcctgacctcct

SEQ ID NO: 8357318 - DNA, 22 bp, Homo sapiens
tcaggatcggcctttttttaag

SEQ ID NO: 8357319 - DNA, 17 bp, Homo sapiens
tcaggatccagggttct

SEQ ID NO: 8357320 - DNA, 17 bp, Homo sapiens
tcaggatccagggttct

SEQ ID NO: 8357321 - DNA, 22 bp, Homo sapiens
tcaggatcaggggcctttcctt

SEQ ID NO: 8357322 - DNA, 22 bp, Homo sapiens
tcaggatccatagactcccaaa

SEQ ID NO: 8357323 - DNA, 22 bp, Homo sapiens
tcaggatggcacccaagctctt

SEQ ID NO: 8357324 - DNA, 22 bp, Homo sapiens
tcaggcctgcaaggagagtccc

SEQ ID NO: 8357325 - DNA, 22 bp, Homo sapiens
tcaggcatggctcttcctcagg

SEQ ID NO: 8357326 - DNA, 22 bp, Homo sapiens
tcacaggataaggtggcatcac

SEQ ID NO: 8357327 - DNA, 22 bp, Homo sapiens
tcacaggagtcataattacagt

SEQ ID NO: 8357328 - DNA, 22 bp, Homo sapiens
tcacagtacatgattcagtggt

SEQ ID NO: 8357329 - DNA, 22 bp, Homo sapiens
tcacagtaaatccagaagaaat

SEQ ID NO: 8357330 - DNA, 22 bp, Homo sapiens
tcacagtaaaagcatggaagag

SEQ ID NO: 8357331 - DNA, 22 bp, Homo sapiens
tcacagtactgtgtgacttgag

SEQ ID NO: 8357332 - DNA, 22 bp, Homo sapiens
tcacagggtttggaagcctcct

SEQ ID NO: 8357333 - DNA, 22 bp, Homo sapiens
tcacagggtgtacatcacctat

SEQ ID NO: 8357334 - DNA, 20 bp, Homo sapiens
tcacaggggaccaggagcag

SEQ ID NO: 8357335 - DNA, 22 bp, Homo sapiens
tcacagaagagatattgacaga

SEQ ID NO: 8357336 - DNA, 22 bp, Homo sapiens
tcacagaacaagcctggtggag

SEQ ID NO: 8357337 - DNA, 22 bp, Homo sapiens
tcacacatgctaagccagagat

SEQ ID NO: 8357338 - DNA, 22 bp, Homo sapiens
tcacaaaagcttttgaatttgg

SEQ ID NO: 8357339 - DNA, 22 bp, Homo sapiens
tcacaaatagctatattaagga

SEQ ID NO: 8357340 - DNA, 22 bp, Homo sapiens
tcaataatggcaggataaattt

SEQ ID NO: 8357341 - DNA, 22 bp, Homo sapiens
tcaatacagaaaggatattttg

SEQ ID NO: 8357342 - DNA, 22 bp, Homo sapiens
tcaatttatgtggctattcatt

SEQ ID NO: 8357343 - DNA, 22 bp, Homo sapiens
tcaagtgtagtggtgtcaggtc

SEQ ID NO: 8357344 - DNA, 22 bp, Homo sapiens
tcaataaaattgttttcctatc

SEQ ID NO: 8357345 - DNA, 22 bp, Homo sapiens
tcaagtatatctagtcattagg

SEQ ID NO: 8357346 - DNA, 22 bp, Homo sapiens
tcaagtcctgctgtggaccaca

SEQ ID NO: 8357347 - DNA, 22 bp, Homo sapiens
tcaaggaggtgcttggcttcac

SEQ ID NO: 8357348 - DNA, 22 bp, Homo sapiens
tatttcttgagtggtcagtttc

SEQ ID NO: 8357349 - DNA, 22 bp, Homo sapiens
tcaagaatagctgcaaacaggg

SEQ ID NO: 8357350 - DNA, 22 bp, Homo sapiens
tcaagaatttggataagaaatg

SEQ ID NO: 8357351 - DNA, 22 bp, Homo sapiens
tatttctgtatgcataaaagga

SEQ ID NO: 8357352 - DNA, 22 bp, Homo sapiens
tatttctgtcagccagatatgg

SEQ ID NO: 8357353 - DNA, 22 bp, Homo sapiens
tcaagctgcatcagtgcagtga

SEQ ID NO: 8357354 - DNA, 22 bp, Homo sapiens
tcaagataccaccattatatgt

SEQ ID NO: 8357355 - DNA, 22 bp, Homo sapiens
tcaagagaaggggaaatagact

SEQ ID NO: 8357356 - DNA, 18 bp, Homo sapiens
tcaagacatcatgaaata

SEQ ID NO: 8357357 - DNA, 22 bp, Homo sapiens
tcaagagccaggtaagcacagg

SEQ ID NO: 8357358 - DNA, 22 bp, Homo sapiens
tcagaaaagagaaaatcttata

SEQ ID NO: 8357359 - DNA, 22 bp, Homo sapiens
tcagaaaataactgttagtttg

SEQ ID NO: 8357360 - DNA, 22 bp, Homo sapiens
tcagacaggctggacagcttgc

SEQ ID NO: 8357361 - DNA, 22 bp, Homo sapiens
tcagacagtcatcagagcttgt

SEQ ID NO: 8357362 - DNA, 22 bp, Homo sapiens
tcagacagggagtcagaaaata

SEQ ID NO: 8357363 - DNA, 22 bp, Homo sapiens
tcagacagtgtgatcagtctct

SEQ ID NO: 8357364 - DNA, 22 bp, Homo sapiens
tcagagaagacatcattgtgaa

SEQ ID NO: 8357365 - DNA, 22 bp, Homo sapiens
tcagagaagcttaagctgtaat

SEQ ID NO: 8357366 - DNA, 22 bp, Homo sapiens
tcagcaatgagaactggcattt

SEQ ID NO: 8357367 - DNA, 22 bp, Homo sapiens
tcagcaatcctcccacaggtgg

SEQ ID NO: 8357368 - DNA, 22 bp, Homo sapiens
tcagcaatatgataggctttgt

SEQ ID NO: 8357369 - DNA, 22 bp, Homo sapiens
tcagcaatgtgatactgtgcaa

SEQ ID NO: 8357370 - DNA, 22 bp, Homo sapiens
tcagaggaaaggtcagatggct

SEQ ID NO: 8357371 - DNA, 22 bp, Homo sapiens
tcagaggaaaggtcagatggct

SEQ ID NO: 8357372 - DNA, 22 bp, Homo sapiens
tcagagcattcgggtgacaaat

SEQ ID NO: 8357373 - DNA, 22 bp, Homo sapiens
tcagagcagcattttacaggat

SEQ ID NO: 8357374 - DNA, 22 bp, Homo sapiens
tcagagcatgtgggctgcagtt

SEQ ID NO: 8357375 - DNA, 22 bp, Homo sapiens
tcactacacaatatatttcaga

SEQ ID NO: 8357376 - DNA, 22 bp, Homo sapiens
tcacattttctactactgtacg

SEQ ID NO: 8357377 - DNA, 22 bp, Homo sapiens
tcacattttcaaaagctggtgc

SEQ ID NO: 8357378 - DNA, 22 bp, Homo sapiens
tcaccactgaacagacctttgg

SEQ ID NO: 8357379 - DNA, 22 bp, Homo sapiens
tcactttaatgatttgtagaat

SEQ ID NO: 8357380 - DNA, 22 bp, Homo sapiens
tcactttgaattccttgatttt

SEQ ID NO: 8357381 - DNA, 22 bp, Homo sapiens
tcactttgatgacattgtagct

SEQ ID NO: 8357382 - DNA, 22 bp, Homo sapiens
tcactttggattatgtaatttc

SEQ ID NO: 8357383 - DNA, 22 bp, Homo sapiens
tcacttgagagatattagaagt

SEQ ID NO: 8357384 - DNA, 22 bp, Homo sapiens
tcactctgttttactcactgtt

SEQ ID NO: 8357385 - DNA, 22 bp, Homo sapiens
tcactgaaaaccatacttcttt

SEQ ID NO: 8357386 - DNA, 22 bp, Homo sapiens
tcactgaagactgggctctaaa

SEQ ID NO: 8357387 - DNA, 22 bp, Homo sapiens
tcactgaagtcttcaagtagga

SEQ ID NO: 8357388 - DNA, 22 bp, Homo sapiens
tcactgaatacttgtctcatcc

SEQ ID NO: 8357389 - DNA, 22 bp, Homo sapiens
taaaattgcggtgaatatttcc

SEQ ID NO: 8357390 - DNA, 22 bp, Homo sapiens
taaaatttgtccctgagtgttg

SEQ ID NO: 8357391 - DNA, 22 bp, Homo sapiens
taaaattgcggtgaatatttcc

SEQ ID NO: 8357392 - DNA, 22 bp, Homo sapiens
taaacaagctgtctgatattct

SEQ ID NO: 8357393 - DNA, 22 bp, Homo sapiens
taaagggtaggttttactgtaa

SEQ ID NO: 8357394 - DNA, 22 bp, Homo sapiens
taaaatgtgtttctgtatggtt

SEQ ID NO: 8357395 - DNA, 22 bp, Homo sapiens
taaaatagaggatgtcatgcta

SEQ ID NO: 8357396 - DNA, 22 bp, Homo sapiens
taaaatagaggatgtcatgcta

SEQ ID NO: 8357397 - DNA, 22 bp, Homo sapiens
taaaagttttagttgtacataa

SEQ ID NO: 8357398 - DNA, 22 bp, Homo sapiens
gtttttatctaatagcagttat

SEQ ID NO: 8357399 - DNA, 22 bp, Homo sapiens
gtttttatctaatagcagttat

SEQ ID NO: 8357400 - DNA, 22 bp, Homo sapiens
gttttctttgaatgcttctaga

SEQ ID NO: 8357401 - DNA, 22 bp, Homo sapiens
gttttgaatactactagaactt

SEQ ID NO: 8357402 - DNA, 22 bp, Homo sapiens
gttttccactggattgtttgga

SEQ ID NO: 8357403 - DNA, 18 bp, Homo sapiens
gttttgaattgtcttaca

SEQ ID NO: 8357404 - DNA, 22 bp, Homo sapiens
gttttggagtcaggcttagatg

SEQ ID NO: 8357405 - DNA, 22 bp, Homo sapiens
gtttccagagatcatttacata

SEQ ID NO: 8357406 - DNA, 22 bp, Homo sapiens
gtttccagagatcatttacata

SEQ ID NO: 8357407 - DNA, 22 bp, Homo sapiens
gttttcatgtctattgggcata

SEQ ID NO: 8357408 - DNA, 21 bp, Homo sapiens
gttttcatgatagagtctgta

SEQ ID NO: 8357409 - DNA, 22 bp, Homo sapiens
taactaggattacaagcgtgcg

SEQ ID NO: 8357410 - DNA, 22 bp, Homo sapiens
taactcaaatatgttgtctgaa

SEQ ID NO: 8357411 - DNA, 22 bp, Homo sapiens
taactaagtgactcaagtgatc

SEQ ID NO: 8357412 - DNA, 22 bp, Homo sapiens
taacgtttgataacttctgttc

SEQ ID NO: 8357413 - DNA, 22 bp, Homo sapiens
taactagatatagactttctac

SEQ ID NO: 8357414 - DNA, 22 bp, Homo sapiens
taactagatgtgagaatattca

SEQ ID NO: 8357415 - DNA, 22 bp, Homo sapiens
taactagaatggctattttgag

SEQ ID NO: 8357416 - DNA, 22 bp, Homo sapiens
taacattaaaagagataattga

SEQ ID NO: 8357417 - DNA, 22 bp, Homo sapiens
taacattacagacaccttgtgt

SEQ ID NO: 8357418 - DNA, 22 bp, Homo sapiens
taaccacattattatgggttct

SEQ ID NO: 8357419 - DNA, 22 bp, Homo sapiens
taaattctgatcaagttccttc

SEQ ID NO: 8357420 - DNA, 22 bp, Homo sapiens
taaattctacaacttcaaagat

SEQ ID NO: 8357421 - DNA, 22 bp, Homo sapiens
taaattctacaacttcaaagat

SEQ ID NO: 8357422 - DNA, 22 bp, Homo sapiens
taaattcagtgagtaatttctg

SEQ ID NO: 8357423 - DNA, 22 bp, Homo sapiens
taaattcagtgagtaatttctg

SEQ ID NO: 8357424 - DNA, 22 bp, Homo sapiens
taaattgttttctagaagttgt

SEQ ID NO: 8357425 - DNA, 22 bp, Homo sapiens
taaagtgtcctagctaggaggc

SEQ ID NO: 8357426 - DNA, 22 bp, Homo sapiens
gttaatgtgatataaagtattt

SEQ ID NO: 8357427 - DNA, 22 bp, Homo sapiens
gttacaaactcaggtgccaaaa

SEQ ID NO: 8357428 - DNA, 22 bp, Homo sapiens
gttacaaaggaagcttcactgc

SEQ ID NO: 8357429 - DNA, 22 bp, Homo sapiens
gttacaaagcacttcaagtgaa

SEQ ID NO: 8357430 - DNA, 22 bp, Homo sapiens
gtgtggcttgggtgaggcgcct

SEQ ID NO: 8357431 - DNA, 22 bp, Homo sapiens
gtgtgggaaggctaggatgctg

SEQ ID NO: 8357432 - DNA, 22 bp, Homo sapiens
gtgtggccttgggagaggtctg

SEQ ID NO: 8357433 - DNA, 22 bp, Homo sapiens
gtgtgcatgcatagacaccaca

SEQ ID NO: 8357434 - DNA, 22 bp, Homo sapiens
gtgtgcagtgagcaaaagatct

SEQ ID NO: 8357435 - DNA, 22 bp, Homo sapiens
gtgctccaacattagtgtgctt

SEQ ID NO: 8357436 - DNA, 22 bp, Homo sapiens
gtgctccaggataggctgacct

SEQ ID NO: 8357437 - DNA, 22 bp, Homo sapiens
gtgctatgtgctgaactcaggt

SEQ ID NO: 8357438 - DNA, 22 bp, Homo sapiens
gtgctcaggaagctgttcctgc

SEQ ID NO: 8357439 - DNA, 22 bp, Homo sapiens
gtgctcagggcctggctgggga

SEQ ID NO: 8357440 - DNA, 22 bp, Homo sapiens
gtgctcaggggcaatcctggga

SEQ ID NO: 8357441 - DNA, 22 bp, Homo sapiens
gtgctcaggttcccatgagtgc

SEQ ID NO: 8357442 - DNA, 22 bp, Homo sapiens
gtgctctcctggctgccctgac

SEQ ID NO: 8357443 - DNA, 22 bp, Homo sapiens
gtgctctgagtttgcatgtcag

SEQ ID NO: 8357444 - DNA, 22 bp, Homo sapiens
gtgctctgatctgtctgacatc

SEQ ID NO: 8357445 - DNA, 22 bp, Homo sapiens
gtgctctccagccccacgtgga

SEQ ID NO: 8357446 - DNA, 22 bp, Homo sapiens
gtgctcctcacagtgtggccct

SEQ ID NO: 8357447 - DNA, 22 bp, Homo sapiens
gtttcagagttagtgctggctg

SEQ ID NO: 8357448 - DNA, 22 bp, Homo sapiens
gtttcagatatatttgtactta

SEQ ID NO: 8357449 - DNA, 22 bp, Homo sapiens
gtttcagatatatttgtactta

SEQ ID NO: 8357450 - DNA, 22 bp, Homo sapiens
gtttcagcttcctttactgcag

SEQ ID NO: 8357451 - DNA, 22 bp, Homo sapiens
gtttcagatttggtttcagaag

SEQ ID NO: 8357452 - DNA, 22 bp, Homo sapiens
gtttcagaggtgttcattttca

SEQ ID NO: 8357453 - DNA, 22 bp, Homo sapiens
gtttcagaaatgttctcctgct

SEQ ID NO: 8357454 - DNA, 22 bp, Homo sapiens
gtttcatatgcagttaacagca

SEQ ID NO: 8357455 - DNA, 22 bp, Homo sapiens
gtttcatagctacgattttggg

SEQ ID NO: 8357456 - DNA, 22 bp, Homo sapiens
gtttcatatatagtaactgaaa

SEQ ID NO: 8357457 - DNA, 22 bp, Homo sapiens
gtttcatataccaagcacttga

SEQ ID NO: 8357458 - DNA, 22 bp, Homo sapiens
gtttcataattcaatcaaatga

SEQ ID NO: 8357459 - DNA, 22 bp, Homo sapiens
gtttcatagcatatacgtgtgt

SEQ ID NO: 8357460 - DNA, 22 bp, Homo sapiens
gtttcatacagattattcatgg

SEQ ID NO: 8357461 - DNA, 22 bp, Homo sapiens
gttgcataagaccacaaggagc

SEQ ID NO: 8357462 - DNA, 22 bp, Homo sapiens
gttgcctaggctggtcttgaac

SEQ ID NO: 8357463 - DNA, 22 bp, Homo sapiens
gttgcataaagccttcctcata

SEQ ID NO: 8357464 - DNA, 22 bp, Homo sapiens
gttgggcttatgtaattttaag

SEQ ID NO: 8357465 - DNA, 22 bp, Homo sapiens
gttgctcaggcaggagtacagt

SEQ ID NO: 8357466 - DNA, 22 bp, Homo sapiens
gttcagatttcatgagtaattg

SEQ ID NO: 8357467 - DNA, 22 bp, Homo sapiens
gttacaaaggtcataaaagtgt

SEQ ID NO: 8357468 - DNA, 22 bp, Homo sapiens
gttacaaaggactgggggccac

SEQ ID NO: 8357469 - DNA, 22 bp, Homo sapiens
gttacaaaggactgggggccac

SEQ ID NO: 8357470 - DNA, 22 bp, Homo sapiens
gttcacatcacttcactgaacc

SEQ ID NO: 8357471 - DNA, 22 bp, Homo sapiens
gttcatttatgatgtaacatgt

SEQ ID NO: 8357472 - DNA, 22 bp, Homo sapiens
gttcatatttaactaagatagg

SEQ ID NO: 8357473 - DNA, 22 bp, Homo sapiens
gttcatgtttgtgtattgctca

SEQ ID NO: 8357474 - DNA, 22 bp, Homo sapiens
tacaaactctttatatttcata

SEQ ID NO: 8357475 - DNA, 22 bp, Homo sapiens
tacaaactgttattattattgt

SEQ ID NO: 8357476 - DNA, 22 bp, Homo sapiens
tacaaagaggtaattgcatata

SEQ ID NO: 8357477 - DNA, 22 bp, Homo sapiens
tacaaagagtttggtctctaga

SEQ ID NO: 8357478 - DNA, 22 bp, Homo sapiens
tacaaagagtttggtctctaga

SEQ ID NO: 8357479 - DNA, 20 bp, Homo sapiens
tacaaagaatgaggttcagg

SEQ ID NO: 8357480 - DNA, 22 bp, Homo sapiens
tacaaagaggcagctccatttt

SEQ ID NO: 8357481 - DNA, 22 bp, Homo sapiens
tacaaagataaaatctcaccat

SEQ ID NO: 8357482 - DNA, 22 bp, Homo sapiens
tacaaagataaaatctcaccat

SEQ ID NO: 8357483 - DNA, 22 bp, Homo sapiens
tacaaagtagaaattcagtaaa

SEQ ID NO: 8357484 - DNA, 22 bp, Homo sapiens
tacaaaggcaggtttcccagga

SEQ ID NO: 8357485 - DNA, 22 bp, Homo sapiens
taatggttttttggagactgct

SEQ ID NO: 8357486 - DNA, 22 bp, Homo sapiens
taatgtttagaagcagacagct

SEQ ID NO: 8357487 - DNA, 22 bp, Homo sapiens
taatggtttttctatactgtcc

SEQ ID NO: 8357488 - DNA, 22 bp, Homo sapiens
taatagaatagtggaaacattg

SEQ ID NO: 8357489 - DNA, 22 bp, Homo sapiens
taattataacagttacatctta

SEQ ID NO: 8357490 - DNA, 22 bp, Homo sapiens
taattataacagttacatctta

SEQ ID NO: 8357491 - DNA, 22 bp, Homo sapiens
taattataacagttacatctta

SEQ ID NO: 8357492 - DNA, 18 bp, Homo sapiens
taagtaaggtcatatggg

SEQ ID NO: 8357493 - DNA, 22 bp, Homo sapiens
taagtacaaatgtatacataag

SEQ ID NO: 8357494 - DNA, 22 bp, Homo sapiens
taagtaaatttataatgtgatt

SEQ ID NO: 8357495 - DNA, 22 bp, Homo sapiens
taagtgcaatgttttacttaaa

SEQ ID NO: 8357496 - DNA, 17 bp, Homo sapiens
taagtgattatctcata

SEQ ID NO: 8357497 - DNA, 22 bp, Homo sapiens
taagtgatgatagtacctagaa

SEQ ID NO: 8357498 - DNA, 22 bp, Homo sapiens
taatacagtagcttttacacag

SEQ ID NO: 8357499 - DNA, 22 bp, Homo sapiens
taatacagtagcttttacacag

SEQ ID NO: 8357500 - DNA, 22 bp, Homo sapiens
taagtgttattattctcacttt

SEQ ID NO: 8357501 - DNA, 22 bp, Homo sapiens
taaggtcatggtgaataataag

SEQ ID NO: 8357502 - DNA, 22 bp, Homo sapiens
taaggccaagttcatatacaac

SEQ ID NO: 8357503 - DNA, 22 bp, Homo sapiens
tacatatagacagttactctag

SEQ ID NO: 8357504 - DNA, 22 bp, Homo sapiens
tacatcatggtgagcaggaggc

SEQ ID NO: 8357505 - DNA, 22 bp, Homo sapiens
tacatagttccacttctgtttt

SEQ ID NO: 8357506 - DNA, 22 bp, Homo sapiens
tacatagttccacttctgtttt

SEQ ID NO: 8357507 - DNA, 22 bp, Homo sapiens
tacatagtgaacatttacagag

SEQ ID NO: 8357508 - DNA, 22 bp, Homo sapiens
tacatatactgagtgatttgct

SEQ ID NO: 8357509 - DNA, 22 bp, Homo sapiens
tacatagtattcacattgtttt

SEQ ID NO: 8357510 - DNA, 20 bp, Homo sapiens
tacatctctcagatgtctaa

SEQ ID NO: 8357511 - DNA, 22 bp, Homo sapiens
tacatcattttggagatgagca

SEQ ID NO: 8357512 - DNA, 19 bp, Homo sapiens
tacatcctcttcctctttg

SEQ ID NO: 8357513 - DNA, 23 bp, Homo sapiens
tacattctgtatttttatagagt

SEQ ID NO: 8357514 - DNA, 22 bp, Homo sapiens
tacattgaaagtcatttaatcc

SEQ ID NO: 8357515 - DNA, 22 bp, Homo sapiens
tacattgaaagtcatttaatcc

SEQ ID NO: 8357516 - DNA, 22 bp, Homo sapiens
tacattgaactatgagttcagt

SEQ ID NO: 8357517 - DNA, 22 bp, Homo sapiens
tacattgaaatcaatggatgtg

SEQ ID NO: 8357518 - DNA, 22 bp, Homo sapiens
tacattctatatctgttacatc

SEQ ID NO: 8357519 - DNA, 16 bp, Homo sapiens
tacattctgatcactg

SEQ ID NO: 8357520 - DNA, 22 bp, Homo sapiens
tacattgagcacgtactatgtg

SEQ ID NO: 8357521 - DNA, 22 bp, Homo sapiens
tacattgagaaccactgcttag

SEQ ID NO: 8357522 - DNA, 22 bp, Homo sapiens
tacattgactgtgtgcatcaca

SEQ ID NO: 8357523 - DNA, 22 bp, Homo sapiens
tacattgactctctgtccctaa

SEQ ID NO: 8357524 - DNA, 21 bp, Homo sapiens
tacattgactacaaataaagc

SEQ ID NO: 8357525 - DNA, 22 bp, Homo sapiens
tacattgaattttttagcatgt

SEQ ID NO: 8357526 - DNA, 22 bp, Homo sapiens
tacattgacctttgttaggttg

SEQ ID NO: 8357527 - DNA, 22 bp, Homo sapiens
tacattgaggcagtagctggag

SEQ ID NO: 8357528 - DNA, 22 bp, Homo sapiens
tacattgagtattatttagcca

SEQ ID NO: 8357529 - DNA, 22 bp, Homo sapiens
tacattgatggagtacctagct

SEQ ID NO: 8357530 - DNA, 22 bp, Homo sapiens
tacagtaagatgaaatagcaat

SEQ ID NO: 8357531 - DNA, 22 bp, Homo sapiens
tacagtaagatgaaatagcaat

SEQ ID NO: 8357532 - DNA, 22 bp, Homo sapiens
tacaggcatgaatgaaatctgt

SEQ ID NO: 8357533 - DNA, 22 bp, Homo sapiens
tacaggatatcacttcatttct

SEQ ID NO: 8357534 - DNA, 22 bp, Homo sapiens
tacatagaatatttcacttaaa

SEQ ID NO: 8357535 - DNA, 22 bp, Homo sapiens
tacatagagggtaatagcatca

SEQ ID NO: 8357536 - DNA, 22 bp, Homo sapiens
tacatagagggtaatagcatca

SEQ ID NO: 8357537 - DNA, 22 bp, Homo sapiens
tacatagagaagttacagtgga

SEQ ID NO: 8357538 - DNA, 21 bp, Homo sapiens
tacatagaggtgatatctgtt

SEQ ID NO: 8357539 - DNA, 22 bp, Homo sapiens
tacatagcaaggaaatgacaga

SEQ ID NO: 8357540 - DNA, 22 bp, Homo sapiens
tacatacattacctcatttagt

SEQ ID NO: 8357541 - DNA, 19 bp, Homo sapiens
tacatacttattctaaaag

SEQ ID NO: 8357542 - DNA, 22 bp, Homo sapiens
tacagtaccctgatgaactaaa

SEQ ID NO: 8357543 - DNA, 22 bp, Homo sapiens
tacagaaattgccaccagctct

SEQ ID NO: 8357544 - DNA, 22 bp, Homo sapiens
tacagaaattgccaccagctct

SEQ ID NO: 8357545 - DNA, 22 bp, Homo sapiens
tacagataaattttaagtagaa

SEQ ID NO: 8357546 - DNA, 22 bp, Homo sapiens
tacagatacagatctagataca

SEQ ID NO: 8357547 - DNA, 22 bp, Homo sapiens
tacagatatagagatttataga

SEQ ID NO: 8357548 - DNA, 22 bp, Homo sapiens
tacagatatagagatttataga

SEQ ID NO: 8357549 - DNA, 22 bp, Homo sapiens
tacagataggaggaatctgaaa

SEQ ID NO: 8357550 - DNA, 22 bp, Homo sapiens
tacagatgaggaaactgaggca

SEQ ID NO: 8357551 - DNA, 22 bp, Homo sapiens
tacagcaatgctacaagatgac

SEQ ID NO: 8357552 - DNA, 22 bp, Homo sapiens
tacagcaatgcctgaaatagta

SEQ ID NO: 8357553 - DNA, 22 bp, Homo sapiens
tacagaaacagcgtggttagaa

SEQ ID NO: 8357554 - DNA, 22 bp, Homo sapiens
tacagaaacagcgtggttagaa

SEQ ID NO: 8357555 - DNA, 22 bp, Homo sapiens
tacactattttactgatacaaa

SEQ ID NO: 8357556 - DNA, 22 bp, Homo sapiens
tacaacagacaggaataagatt

SEQ ID NO: 8357557 - DNA, 22 bp, Homo sapiens
tacaacactggttcgacatgtg

SEQ ID NO: 8357558 - DNA, 22 bp, Homo sapiens
tacaacaatttccacattagaa

SEQ ID NO: 8357559 - DNA, 20 bp, Homo sapiens
tacaacaagtagagacatac

SEQ ID NO: 8357560 - DNA, 22 bp, Homo sapiens
tacaaagtgctttagaaatgaa

SEQ ID NO: 8357561 - DNA, 22 bp, Homo sapiens
tacaaagtcttgggttctaggc

SEQ ID NO: 8357562 - DNA, 22 bp, Homo sapiens
tacaaagtcagaataacaggtg

SEQ ID NO: 8357563 - DNA, 22 bp, Homo sapiens
taggatttattctacaatattg

SEQ ID NO: 8357564 - DNA, 22 bp, Homo sapiens
taggctgggagcctgaggctag

SEQ ID NO: 8357565 - DNA, 22 bp, Homo sapiens
tagggatgagcaactggtagtg

SEQ ID NO: 8357566 - DNA, 22 bp, Homo sapiens
taggagggccctgaaaatggca

SEQ ID NO: 8357567 - DNA, 22 bp, Homo sapiens
taggagggggaacaaggcatac

SEQ ID NO: 8357568 - DNA, 22 bp, Homo sapiens
taggacagtggagataaccaga

SEQ ID NO: 8357569 - DNA, 22 bp, Homo sapiens
taggagggttagagggaaatat

SEQ ID NO: 8357570 - DNA, 22 bp, Homo sapiens
taggaaaagtctagattgatga

SEQ ID NO: 8357571 - DNA, 22 bp, Homo sapiens
taggaaaaatacagaattatat

SEQ ID NO: 8357572 - DNA, 18 bp, Homo sapiens
tagaggggaagaccttta

SEQ ID NO: 8357573 - DNA, 22 bp, Homo sapiens
tagcagaggcaaggatgtgaat

SEQ ID NO: 8357574 - DNA, 22 bp, Homo sapiens
tagcagagcagggatcagagcc

SEQ ID NO: 8357575 - DNA, 19 bp, Homo sapiens
tagcagagatgactccagc

SEQ ID NO: 8357576 - DNA, 22 bp, Homo sapiens
tagcagctatgccattttgaca

SEQ ID NO: 8357577 - DNA, 22 bp, Homo sapiens
tagctcttgccatctgtcttat

SEQ ID NO: 8357578 - DNA, 22 bp, Homo sapiens
tagctctttgagattggttctt

SEQ ID NO: 8357579 - DNA, 22 bp, Homo sapiens
tagctcttgtgttttacatata

SEQ ID NO: 8357580 - DNA, 22 bp, Homo sapiens
tagaaacagcatatattagccc

SEQ ID NO: 8357581 - DNA, 22 bp, Homo sapiens
tagaaacagcatatattagccc

SEQ ID NO: 8357582 - DNA, 22 bp, Homo sapiens
tagaaacatataggatggcagg

SEQ ID NO: 8357583 - DNA, 22 bp, Homo sapiens
tagaaacatatgtttgagacat

SEQ ID NO: 8357584 - DNA, 22 bp, Homo sapiens
tagaaacagatgtttttgaaga

SEQ ID NO: 8357585 - DNA, 22 bp, Homo sapiens
tagaaacagatgtttttgaaga

SEQ ID NO: 8357586 - DNA, 22 bp, Homo sapiens
tagaaacagatgtttttgaaga

SEQ ID NO: 8357587 - DNA, 22 bp, Homo sapiens
tagaaacagaatatgagtgaga

SEQ ID NO: 8357588 - DNA, 22 bp, Homo sapiens
tagaaacagaaaactgtaatag

SEQ ID NO: 8357589 - DNA, 22 bp, Homo sapiens
tagaaacagaaaactgtaatag

SEQ ID NO: 8357590 - DNA, 22 bp, Homo sapiens
tagaaacacagatctggtgtca

SEQ ID NO: 8357591 - DNA, 22 bp, Homo sapiens
tagaaacaatgacatgcttgta

SEQ ID NO: 8357592 - DNA, 22 bp, Homo sapiens
tagaaacaatgacatgcttgta

SEQ ID NO: 8357593 - DNA, 22 bp, Homo sapiens
tagaaaagccccagctggaggg

SEQ ID NO: 8357594 - DNA, 22 bp, Homo sapiens
tagaaacaatgacatgcttgta

SEQ ID NO: 8357595 - DNA, 22 bp, Homo sapiens
tagaaactactagaataagaga

SEQ ID NO: 8357596 - DNA, 22 bp, Homo sapiens
tagaaactcacgttatcattgc

SEQ ID NO: 8357597 - DNA, 22 bp, Homo sapiens
tagaaactcaggatactcttcc

SEQ ID NO: 8357598 - DNA, 22 bp, Homo sapiens
tagaaagaaattcagattggct

SEQ ID NO: 8357599 - DNA, 22 bp, Homo sapiens
tagaaactgatagtcttgtgct

SEQ ID NO: 8357600 - DNA, 22 bp, Homo sapiens
tagaaacatgagagaaactctt

SEQ ID NO: 8357601 - DNA, 22 bp, Homo sapiens
tagaaacatgttctgttctgtt

SEQ ID NO: 8357602 - DNA, 22 bp, Homo sapiens
tagaaacattcagttgcagtcc

SEQ ID NO: 8357603 - DNA, 22 bp, Homo sapiens
tagaaacatgttctgttctgtt

SEQ ID NO: 8357604 - DNA, 22 bp, Homo sapiens
tactttgctaaaatgtgcagaa

SEQ ID NO: 8357605 - DNA, 22 bp, Homo sapiens
tactttggatccttacaatagc

SEQ ID NO: 8357606 - DNA, 22 bp, Homo sapiens
taccaaaagcttgtttcataca

SEQ ID NO: 8357607 - DNA, 22 bp, Homo sapiens
tactttgagatgatgctgatcg

SEQ ID NO: 8357608 - DNA, 22 bp, Homo sapiens
tagaaaagaattttatttgata

SEQ ID NO: 8357609 - DNA, 22 bp, Homo sapiens
tactttttgtctctttgaatgt

SEQ ID NO: 8357610 - DNA, 22 bp, Homo sapiens
tagaaaactaatacatgcttga

SEQ ID NO: 8357611 - DNA, 19 bp, Homo sapiens
tactttttcaggacagagt

SEQ ID NO: 8357612 - DNA, 22 bp, Homo sapiens
tactttttatgataagaactga

SEQ ID NO: 8357613 - DNA, 22 bp, Homo sapiens
tacttttctataggtttgaaat

SEQ ID NO: 8357614 - DNA, 22 bp, Homo sapiens
tagaaatcatttagaagtattg

SEQ ID NO: 8357615 - DNA, 20 bp, Homo sapiens
tagaaatcttataaaagact

SEQ ID NO: 8357616 - DNA, 22 bp, Homo sapiens
tagaaatcagcaggcatatgta

SEQ ID NO: 8357617 - DNA, 22 bp, Homo sapiens
tagaaatcacagaaaatcaggg

SEQ ID NO: 8357618 - DNA, 22 bp, Homo sapiens
tagaaatgaatgtttaaaagtc

SEQ ID NO: 8357619 - DNA, 22 bp, Homo sapiens
tagaaagccctgtgttcactgc

SEQ ID NO: 8357620 - DNA, 19 bp, Homo sapiens
tagaaagccagaaaacaga

SEQ ID NO: 8357621 - DNA, 22 bp, Homo sapiens
tagaaagaacttcatgtaaaac

SEQ ID NO: 8357622 - DNA, 22 bp, Homo sapiens
tagaaagctgagtaatacattt

SEQ ID NO: 8357623 - DNA, 22 bp, Homo sapiens
tagaaagcgttaaatctacaga

SEQ ID NO: 8357624 - DNA, 22 bp, Homo sapiens
tagaaagctggaggaattcttt

SEQ ID NO: 8357625 - DNA, 22 bp, Homo sapiens
tagaaagcttggggtgtttaaa

SEQ ID NO: 8357626 - DNA, 22 bp, Homo sapiens
tagaatgttcacctttaaatga

SEQ ID NO: 8357627 - DNA, 22 bp, Homo sapiens
tagaatgttaagaatatgtata

SEQ ID NO: 8357628 - DNA, 22 bp, Homo sapiens
tagaatgtggaggtaacagact

SEQ ID NO: 8357629 - DNA, 22 bp, Homo sapiens
tagaatgtgcctggaatacagt

SEQ ID NO: 8357630 - DNA, 23 bp, Homo sapiens
tagaatgtcattcaatgatatgg

SEQ ID NO: 8357631 - DNA, 22 bp, Homo sapiens
tagaatctttaaaattcatagt

SEQ ID NO: 8357632 - DNA, 22 bp, Homo sapiens
tagaatgtagtgcttcaagatt

SEQ ID NO: 8357633 - DNA, 22 bp, Homo sapiens
tagacacaagagaagggtataa

SEQ ID NO: 8357634 - DNA, 22 bp, Homo sapiens
tagaattttctgctttgatagt

SEQ ID NO: 8357635 - DNA, 22 bp, Homo sapiens
tagaatttcatgtatgttgggg

SEQ ID NO: 8357636 - DNA, 22 bp, Homo sapiens
tagaattgggcctaacttccat

SEQ ID NO: 8357637 - DNA, 22 bp, Homo sapiens
tagaattttctgctttgatagt

SEQ ID NO: 8357638 - DNA, 22 bp, Homo sapiens
tagacacatccgtggaagcttc

SEQ ID NO: 8357639 - DNA, 22 bp, Homo sapiens
tagacacatcaagtatagttaa

SEQ ID NO: 8357640 - DNA, 22 bp, Homo sapiens
tagacacatcaagtatagttaa

SEQ ID NO: 8357641 - DNA, 22 bp, Homo sapiens
tattcatgtcggctgaaaaagc

SEQ ID NO: 8357642 - DNA, 22 bp, Homo sapiens
tattccttggcaaaaaatatat

SEQ ID NO: 8357643 - DNA, 22 bp, Homo sapiens
tattattttagcactgaggatt

SEQ ID NO: 8357644 - DNA, 22 bp, Homo sapiens
tattattatgcatagcatgaaa

SEQ ID NO: 8357645 - DNA, 22 bp, Homo sapiens
tattattatctttgaatgggac

SEQ ID NO: 8357646 - DNA, 22 bp, Homo sapiens
tattattaaatggcagaatttt

SEQ ID NO: 8357647 - DNA, 22 bp, Homo sapiens
tattattatattggatgagact

SEQ ID NO: 8357648 - DNA, 22 bp, Homo sapiens
tattattatagttattgggaag

SEQ ID NO: 8357649 - DNA, 22 bp, Homo sapiens
tattgacaataggcaactgagg

SEQ ID NO: 8357650 - DNA, 22 bp, Homo sapiens
tattgacaatttgtgaaactat

SEQ ID NO: 8357651 - DNA, 22 bp, Homo sapiens
tattgaaattcttcatgtcctc

SEQ ID NO: 8357652 - DNA, 22 bp, Homo sapiens
tattgaaatccattacgttctt

SEQ ID NO: 8357653 - DNA, 22 bp, Homo sapiens
tattgaaatgaatgacagtgat

SEQ ID NO: 8357654 - DNA, 22 bp, Homo sapiens
tattcttgtatactacaatctt

SEQ ID NO: 8357655 - DNA, 22 bp, Homo sapiens
tattcttgtaccttaaatgatt

SEQ ID NO: 8357656 - DNA, 22 bp, Homo sapiens
tattcttgactgcttactatgt

SEQ ID NO: 8357657 - DNA, 22 bp, Homo sapiens
tattctgtgtgatatgtaaatg

SEQ ID NO: 8357658 - DNA, 22 bp, Homo sapiens
tattctacagtgttagtgttag

SEQ ID NO: 8357659 - DNA, 22 bp, Homo sapiens
tattctacgagtttggtaattt

SEQ ID NO: 8357660 - DNA, 22 bp, Homo sapiens
tattctcagtgctataagtaga

SEQ ID NO: 8357661 - DNA, 21 bp, Homo sapiens
tatttatctcaggctatcttt

SEQ ID NO: 8357662 - DNA, 22 bp, Homo sapiens
tatttatcgagtgtctactatg

SEQ ID NO: 8357663 - DNA, 22 bp, Homo sapiens
tatttatcgagtgtctactatg

SEQ ID NO: 8357664 - DNA, 22 bp, Homo sapiens
tatttatgtggaccataagcct

SEQ ID NO: 8357665 - DNA, 21 bp, Homo sapiens
tatttattaatttgtaaggct

SEQ ID NO: 8357666 - DNA, 22 bp, Homo sapiens
tatttataatctgccaaagaga

SEQ ID NO: 8357667 - DNA, 22 bp, Homo sapiens
tattgacagagggtcagaagag

SEQ ID NO: 8357668 - DNA, 20 bp, Homo sapiens
tatttacaacttagagcctc

SEQ ID NO: 8357669 - DNA, 22 bp, Homo sapiens
tatttaatttgctcattgtgat

SEQ ID NO: 8357670 - DNA, 22 bp, Homo sapiens
tatttctcagcattttacatcc

SEQ ID NO: 8357671 - DNA, 22 bp, Homo sapiens
tatttctcagcattttacatcc

SEQ ID NO: 8357672 - DNA, 22 bp, Homo sapiens
tatttctaagctgtaagtctga

SEQ ID NO: 8357673 - DNA, 22 bp, Homo sapiens
tatttctgaatccaaaaggtca

SEQ ID NO: 8357674 - DNA, 22 bp, Homo sapiens
tatttctctttgtagggatata

SEQ ID NO: 8357675 - DNA, 22 bp, Homo sapiens
tatttctctttgtagggatata

SEQ ID NO: 8357676 - DNA, 22 bp, Homo sapiens
tatttctctcacggttgcctgg

SEQ ID NO: 8357677 - DNA, 22 bp, Homo sapiens
tatttctcttcaaaattgatgt

SEQ ID NO: 8357678 - DNA, 22 bp, Homo sapiens
tatttattctttgtactgcctt

SEQ ID NO: 8357679 - DNA, 22 bp, Homo sapiens
tatgtacagtccttaacttaaa

SEQ ID NO: 8357680 - DNA, 22 bp, Homo sapiens
tatgtacataacatgaaatgca

SEQ ID NO: 8357681 - DNA, 22 bp, Homo sapiens
tatgtacatacatgtgcatacg

SEQ ID NO: 8357682 - DNA, 22 bp, Homo sapiens
tatgtcctgctactctctcatg

SEQ ID NO: 8357683 - DNA, 22 bp, Homo sapiens
tatgtacacatacacttgtaat

SEQ ID NO: 8357684 - DNA, 22 bp, Homo sapiens
tatgtacacatacacttgtaat

SEQ ID NO: 8357685 - DNA, 22 bp, Homo sapiens
tatgtacagggatagaacttga

SEQ ID NO: 8357686 - DNA, 23 bp, Homo sapiens
tatgagaattaagtgcgagtgcc

SEQ ID NO: 8357687 - DNA, 22 bp, Homo sapiens
tatgagaatttgctaattggct

SEQ ID NO: 8357688 - DNA, 22 bp, Homo sapiens
tatgagatactacagattgtga

SEQ ID NO: 8357689 - DNA, 22 bp, Homo sapiens
tatgaggcttacaggcaggcca

SEQ ID NO: 8357690 - DNA, 22 bp, Homo sapiens
tatgaggtaggtattatactta

SEQ ID NO: 8357691 - DNA, 22 bp, Homo sapiens
tatgtacaatttgttgtatgtc

SEQ ID NO: 8357692 - DNA, 22 bp, Homo sapiens
tattacagttcgagtttctagg

SEQ ID NO: 8357693 - DNA, 22 bp, Homo sapiens
tattacagggctagttatgagt

SEQ ID NO: 8357694 - DNA, 22 bp, Homo sapiens
tattagaaagcttaatatcgtg

SEQ ID NO: 8357695 - DNA, 22 bp, Homo sapiens
tatgtcttagaacaaaacagtg

SEQ ID NO: 8357696 - DNA, 22 bp, Homo sapiens
tatgtctggcatgttgtaatta

SEQ ID NO: 8357697 - DNA, 22 bp, Homo sapiens
tatgtcttaactctagaaaggt

SEQ ID NO: 8357698 - DNA, 22 bp, Homo sapiens
tataactgagaagatacatagt

SEQ ID NO: 8357699 - DNA, 22 bp, Homo sapiens
tataactacttgaagagttcag

SEQ ID NO: 8357700 - DNA, 22 bp, Homo sapiens
tataacactcagaaagaatcat

SEQ ID NO: 8357701 - DNA, 22 bp, Homo sapiens
tataaatgccaggactttagat

SEQ ID NO: 8357702 - DNA, 22 bp, Homo sapiens
tataaatgccaggactttagat

SEQ ID NO: 8357703 - DNA, 22 bp, Homo sapiens
tataaagtttcgaaagatgtat

SEQ ID NO: 8357704 - DNA, 22 bp, Homo sapiens
tataaatgcacttttgaaatat

SEQ ID NO: 8357705 - DNA, 22 bp, Homo sapiens
taggtcatcagattgacaaggg

SEQ ID NO: 8357706 - DNA, 22 bp, Homo sapiens
taggggtgtttcgagagaggtt

SEQ ID NO: 8357707 - DNA, 22 bp, Homo sapiens
taggggtgaggccaggcatcag

SEQ ID NO: 8357708 - DNA, 17 bp, Homo sapiens
tatacacagacagactg

SEQ ID NO: 8357709 - DNA, 22 bp, Homo sapiens
tatacacatatacgtttgtgtg

SEQ ID NO: 8357710 - DNA, 22 bp, Homo sapiens
tataattttaagtggtaaatta

SEQ ID NO: 8357711 - DNA, 22 bp, Homo sapiens
tatacaagaggtgagatgagca

SEQ ID NO: 8357712 - DNA, 22 bp, Homo sapiens
tatacaatggctgaatcatcca

SEQ ID NO: 8357713 - DNA, 22 bp, Homo sapiens
tatatctaagtgtatgtaagag

SEQ ID NO: 8357714 - DNA, 22 bp, Homo sapiens
tatatctaaatatgctgatcac

SEQ ID NO: 8357715 - DNA, 22 bp, Homo sapiens
tatatcatggagattaacattc

SEQ ID NO: 8357716 - DNA, 19 bp, Homo sapiens
tatatattttggggttgtg

SEQ ID NO: 8357717 - DNA, 22 bp, Homo sapiens
tatatcagagttaaaagaatgt

SEQ ID NO: 8357718 - DNA, 22 bp, Homo sapiens
tatagtgcattatttacagtaa

SEQ ID NO: 8357719 - DNA, 21 bp, Homo sapiens
tatagcagcatgatttataat

SEQ ID NO: 8357720 - DNA, 22 bp, Homo sapiens
tatagctttgctgagaaaaaga

SEQ ID NO: 8357721 - DNA, 22 bp, Homo sapiens
tatagcatttatcatctctgaa

SEQ ID NO: 8357722 - DNA, 22 bp, Homo sapiens
tatagcatctaggatgattgca

SEQ ID NO: 8357723 - DNA, 22 bp, Homo sapiens
tatagcatggctatattgttgc

SEQ ID NO: 8357724 - DNA, 22 bp, Homo sapiens
tataggaacagctagcacagaa

SEQ ID NO: 8357725 - DNA, 22 bp, Homo sapiens
tatctaaatggaatattccaga

SEQ ID NO: 8357726 - DNA, 20 bp, Homo sapiens
tatctaaatgcttacattac

SEQ ID NO: 8357727 - DNA, 22 bp, Homo sapiens
tatctaaaggatttaatttagt

SEQ ID NO: 8357728 - DNA, 23 bp, Homo sapiens
tatctactttgcaattcagtacc

SEQ ID NO: 8357729 - DNA, 22 bp, Homo sapiens
tatctacagttaatatgtcatc

SEQ ID NO: 8357730 - DNA, 22 bp, Homo sapiens
tatgacattttgccagcattgc

SEQ ID NO: 8357731 - DNA, 22 bp, Homo sapiens
tatgacattttgccagcattgc

SEQ ID NO: 8357732 - DNA, 22 bp, Homo sapiens
tatgacattatgtattacatgt

SEQ ID NO: 8357733 - DNA, 22 bp, Homo sapiens
tatgacattgctttttagaact

SEQ ID NO: 8357734 - DNA, 22 bp, Homo sapiens
tatgacattatgtattacatgt

SEQ ID NO: 8357735 - DNA, 22 bp, Homo sapiens
tatgacagtgaaaaaaatcaga

SEQ ID NO: 8357736 - DNA, 22 bp, Homo sapiens
tatgacttttcccaattcagga

SEQ ID NO: 8357737 - DNA, 21 bp, Homo sapiens
tatgagaaaactgaggtgcat

SEQ ID NO: 8357738 - DNA, 22 bp, Homo sapiens
tatgagaaaataaatatctgtt

SEQ ID NO: 8357739 - DNA, 22 bp, Homo sapiens
tatgagaaagtcgtatgtctcc

SEQ ID NO: 8357740 - DNA, 22 bp, Homo sapiens
tatgagaaattgctgatatttg

SEQ ID NO: 8357741 - DNA, 22 bp, Homo sapiens
tatgagaacaagaacaatctcc

SEQ ID NO: 8357742 - DNA, 22 bp, Homo sapiens
tatgagaacaagaacaatctcc

SEQ ID NO: 8357743 - DNA, 22 bp, Homo sapiens
tatgagaataatctggtaaata

SEQ ID NO: 8357744 - DNA, 22 bp, Homo sapiens
tatgagaactgacagagtgcca

SEQ ID NO: 8357745 - DNA, 18 bp, Homo sapiens
tatgagaagattagcaat

SEQ ID NO: 8357746 - DNA, 22 bp, Homo sapiens
tcccctctctgcgctcccaggt

SEQ ID NO: 8357747 - DNA, 22 bp, Homo sapiens
tcccctgcagatgagggcagtg

SEQ ID NO: 8357748 - DNA, 22 bp, Homo sapiens
tcccctgcagcgcctgcttcta

SEQ ID NO: 8357749 - DNA, 18 bp, Homo sapiens
tcccctgctctggtgctc

SEQ ID NO: 8357750 - DNA, 22 bp, Homo sapiens
tgtggagctcagaagtagcagt

SEQ ID NO: 8357751 - DNA, 22 bp, Homo sapiens
tgtggagcagcgtcacagcctt

SEQ ID NO: 8357752 - DNA, 22 bp, Homo sapiens
tccccagtcccggcggtgggtg

SEQ ID NO: 8357753 - DNA, 22 bp, Homo sapiens
tcccccaactcttagcactgta

SEQ ID NO: 8357754 - DNA, 22 bp, Homo sapiens
tcccccactctaaaggagcctt

SEQ ID NO: 8357755 - DNA, 22 bp, Homo sapiens
tccccctcctgtggttttctgc

SEQ ID NO: 8357756 - DNA, 22 bp, Homo sapiens
tccccctccaattgccatgtta

SEQ ID NO: 8357757 - DNA, 22 bp, Homo sapiens
tgtggccaggaaaaggagatgg

SEQ ID NO: 8357758 - DNA, 19 bp, Homo sapiens
tgtggccatggttcagctg

SEQ ID NO: 8357759 - DNA, 20 bp, Homo sapiens
tgtggccatgttccaactca

SEQ ID NO: 8357760 - DNA, 22 bp, Homo sapiens
tgtggccattcttgaggtcgac

SEQ ID NO: 8357761 - DNA, 22 bp, Homo sapiens
tgtggcagtaaaattgggcaac

SEQ ID NO: 8357762 - DNA, 18 bp, Homo sapiens
tgtggcaggggtgggaga

SEQ ID NO: 8357763 - DNA, 22 bp, Homo sapiens
tgtggcagaactgggactcaaa

SEQ ID NO: 8357764 - DNA, 20 bp, Homo sapiens
tgtggatgaggtaaggatag

SEQ ID NO: 8357765 - DNA, 22 bp, Homo sapiens
tgtggatgaataaagtgcagac

SEQ ID NO: 8357766 - DNA, 22 bp, Homo sapiens
tgtggatgagggagtgaacaaa

SEQ ID NO: 8357767 - DNA, 22 bp, Homo sapiens
tgtggcagagtaaggacccagt

SEQ ID NO: 8357768 - DNA, 22 bp, Homo sapiens
tgtggcagaggaggcagcgtcc

SEQ ID NO: 8357769 - DNA, 21 bp, Homo sapiens
tgtggcagatgttgggaggca

SEQ ID NO: 8357770 - DNA, 22 bp, Homo sapiens
tgtgggtgctcagagtaccccc

SEQ ID NO: 8357771 - DNA, 17 bp, Homo sapiens
tgtgtaagttgcataga

SEQ ID NO: 8357772 - DNA, 22 bp, Homo sapiens
tgtgtcagatttaggctcaaac

SEQ ID NO: 8357773 - DNA, 19 bp, Homo sapiens
tgtgtcagcagggggcttc

SEQ ID NO: 8357774 - DNA, 22 bp, Homo sapiens
tgtgtccattcaggcactgacc

SEQ ID NO: 8357775 - DNA, 22 bp, Homo sapiens
tgtttacaaggagtttatattg

SEQ ID NO: 8357776 - DNA, 22 bp, Homo sapiens
tgttctcttctcattgaacatg

SEQ ID NO: 8357777 - DNA, 22 bp, Homo sapiens
tgttctaaatttgcatggtcca

SEQ ID NO: 8357778 - DNA, 22 bp, Homo sapiens
tgtttccctaaggtctggctct

SEQ ID NO: 8357779 - DNA, 22 bp, Homo sapiens
tgtttactcactgtatccacaa

SEQ ID NO: 8357780 - DNA, 22 bp, Homo sapiens
tgtttgatgacgacattgtaga

SEQ ID NO: 8357781 - DNA, 22 bp, Homo sapiens
tgtttgcaaccccttgtgagaa

SEQ ID NO: 8357782 - DNA, 22 bp, Homo sapiens
tgttttcacaatgatgtcagat

SEQ ID NO: 8357783 - DNA, 22 bp, Homo sapiens
tgtttcttgataaagcagaaaa

SEQ ID NO: 8357784 - DNA, 22 bp, Homo sapiens
tgtttcttgggtgctcacatca

SEQ ID NO: 8357785 - DNA, 22 bp, Homo sapiens
tgtttcttgggtgctcacatca

SEQ ID NO: 8357786 - DNA, 22 bp, Homo sapiens
tgttcctaaatatgaatggaga

SEQ ID NO: 8357787 - DNA, 22 bp, Homo sapiens
tgttatttgggaaagttgtaca

SEQ ID NO: 8357788 - DNA, 22 bp, Homo sapiens
tgttcaatccccaggtcctgaa

SEQ ID NO: 8357789 - DNA, 22 bp, Homo sapiens
tgttattgaggttacttataag

SEQ ID NO: 8357790 - DNA, 22 bp, Homo sapiens
tgttattatgtttccagagcct

SEQ ID NO: 8357791 - DNA, 22 bp, Homo sapiens
tgttattatctgttaggtgttc

SEQ ID NO: 8357792 - DNA, 22 bp, Homo sapiens
tgttattgatatctaatgctct

SEQ ID NO: 8357793 - DNA, 22 bp, Homo sapiens
tgttatttatctgagcatttat

SEQ ID NO: 8357794 - DNA, 22 bp, Homo sapiens
tgttatttatctgagcatttat

SEQ ID NO: 8357795 - DNA, 22 bp, Homo sapiens
tgttatttatttcacctccaga

SEQ ID NO: 8357796 - DNA, 22 bp, Homo sapiens
tgttatttctttgccatatctt

SEQ ID NO: 8357797 - DNA, 22 bp, Homo sapiens
tgttatttctttgccatatctt

SEQ ID NO: 8357798 - DNA, 22 bp, Homo sapiens
tgttatttgggaaagttgtaca

SEQ ID NO: 8357799 - DNA, 22 bp, Homo sapiens
tgttatctgagcaacgtcgacg

SEQ ID NO: 8357800 - DNA, 20 bp, Homo sapiens
tgttattagcaagcttcttt

SEQ ID NO: 8357801 - DNA, 22 bp, Homo sapiens
tgttattaaataattctctctt

SEQ ID NO: 8357802 - DNA, 23 bp, Homo sapiens
tgtgtttacctgaggatcttgtt

SEQ ID NO: 8357803 - DNA, 22 bp, Homo sapiens
tgtgttttatctattgtatctt

SEQ ID NO: 8357804 - DNA, 22 bp, Homo sapiens
tgtgttttatctattgtatctt

SEQ ID NO: 8357805 - DNA, 22 bp, Homo sapiens
tgtgttttgaactcatctactg

SEQ ID NO: 8357806 - DNA, 22 bp, Homo sapiens
tgtgttttacaaattctcttaa

SEQ ID NO: 8357807 - DNA, 22 bp, Homo sapiens
tgtgttttacaaattctcttaa

SEQ ID NO: 8357808 - DNA, 22 bp, Homo sapiens
tgtgttttacaaattctcttaa

SEQ ID NO: 8357809 - DNA, 18 bp, Homo sapiens
ttactacagcactttctt

SEQ ID NO: 8357810 - DNA, 22 bp, Homo sapiens
ttactatctttccagtttggct

SEQ ID NO: 8357811 - DNA, 22 bp, Homo sapiens
ttactgcaacataatgtagtct

SEQ ID NO: 8357812 - DNA, 22 bp, Homo sapiens
ttactgtttgggtctgaggtca

SEQ ID NO: 8357813 - DNA, 22 bp, Homo sapiens
ttacttaaacagaaatgcagaa

SEQ ID NO: 8357814 - DNA, 20 bp, Homo sapiens
ttagaaagagcgtgataaga

SEQ ID NO: 8357815 - DNA, 22 bp, Homo sapiens
ttagaaagaatagcctggctgc

SEQ ID NO: 8357816 - DNA, 21 bp, Homo sapiens
ttagaaagctcactacagtta

SEQ ID NO: 8357817 - DNA, 22 bp, Homo sapiens
ttagaaagaactttagatatca

SEQ ID NO: 8357818 - DNA, 22 bp, Homo sapiens
ttagaaactttggaggatagat

SEQ ID NO: 8357819 - DNA, 22 bp, Homo sapiens
ttagaaacccagactcttaggt

SEQ ID NO: 8357820 - DNA, 22 bp, Homo sapiens
ttagaaacaaaatagttatttg

SEQ ID NO: 8357821 - DNA, 22 bp, Homo sapiens
ttagaaacaaaatagttatttg

SEQ ID NO: 8357822 - DNA, 22 bp, Homo sapiens
ttacttttctattcgatatgtg

SEQ ID NO: 8357823 - DNA, 22 bp, Homo sapiens
ttagagaattccaaatgactac

SEQ ID NO: 8357824 - DNA, 22 bp, Homo sapiens
ttagagaagctgtaattattca

SEQ ID NO: 8357825 - DNA, 22 bp, Homo sapiens
ttagagaagatgaaccatcgtt

SEQ ID NO: 8357826 - DNA, 22 bp, Homo sapiens
ttagagaaccaatgaatagtct

SEQ ID NO: 8357827 - DNA, 22 bp, Homo sapiens
ttagacatcagtgcttctcagc

SEQ ID NO: 8357828 - DNA, 22 bp, Homo sapiens
ttagacatgatggtgcagagag

SEQ ID NO: 8357829 - DNA, 22 bp, Homo sapiens
ttagaaagctttccatagtcaa

SEQ ID NO: 8357830 - DNA, 22 bp, Homo sapiens
ttagaaagctttccatagtcaa

SEQ ID NO: 8357831 - DNA, 22 bp, Homo sapiens
ttacacagatggttagtagagg

SEQ ID NO: 8357832 - DNA, 22 bp, Homo sapiens
ttacacagcttctatccttgaa

SEQ ID NO: 8357833 - DNA, 22 bp, Homo sapiens
ttacacaattttattgacctaa

SEQ ID NO: 8357834 - DNA, 22 bp, Homo sapiens
ttacacagaaattttattgcct

SEQ ID NO: 8357835 - DNA, 22 bp, Homo sapiens
ttacacattgcagatcaaaatg

SEQ ID NO: 8357836 - DNA, 22 bp, Homo sapiens
ttacacattgcagatcaaaatg

SEQ ID NO: 8357837 - DNA, 22 bp, Homo sapiens
ttacacaacatctgtattatta

SEQ ID NO: 8357838 - DNA, 22 bp, Homo sapiens
ttacaaactgtcatatagtatt

SEQ ID NO: 8357839 - DNA, 22 bp, Homo sapiens
ttacaaactgtcatatagtatt

SEQ ID NO: 8357840 - DNA, 22 bp, Homo sapiens
ttacatcactttacttaataat

SEQ ID NO: 8357841 - DNA, 22 bp, Homo sapiens
ttaacaggttatattgtacagg

SEQ ID NO: 8357842 - DNA, 22 bp, Homo sapiens
ttaacatttagtgtacccctgt

SEQ ID NO: 8357843 - DNA, 22 bp, Homo sapiens
ttaacattgtccttagcagatt

SEQ ID NO: 8357844 - DNA, 22 bp, Homo sapiens
ttaagaatggaatgaggaattt

SEQ ID NO: 8357845 - DNA, 22 bp, Homo sapiens
ttaagtgtgtattatctcatta

SEQ ID NO: 8357846 - DNA, 22 bp, Homo sapiens
ttaagttttaaagctagagtct

SEQ ID NO: 8357847 - DNA, 22 bp, Homo sapiens
ttaaatcagtaggctactcctt

SEQ ID NO: 8357848 - DNA, 22 bp, Homo sapiens
ttaaatattttcagcagggtca

SEQ ID NO: 8357849 - DNA, 22 bp, Homo sapiens
ttaaatgagatgttcagatatt

SEQ ID NO: 8357850 - DNA, 22 bp, Homo sapiens
ttaaatgtcaatagattgcttg

SEQ ID NO: 8357851 - DNA, 22 bp, Homo sapiens
ttaaatgctcacataaaggtag

SEQ ID NO: 8357852 - DNA, 22 bp, Homo sapiens
ttaaatgaggctgatgtagatt

SEQ ID NO: 8357853 - DNA, 22 bp, Homo sapiens
ttaacaatagagtttcttcagg

SEQ ID NO: 8357854 - DNA, 22 bp, Homo sapiens
ttaaatgtgatttcatttatgt

SEQ ID NO: 8357855 - DNA, 22 bp, Homo sapiens
ttaaatgtgcctaaacctgtaa

SEQ ID NO: 8357856 - DNA, 22 bp, Homo sapiens
ttaaatgtttaatctaacttga

SEQ ID NO: 8357857 - DNA, 22 bp, Homo sapiens
ttaaatgtgatcctggtatgca

SEQ ID NO: 8357858 - DNA, 22 bp, Homo sapiens
ttaaatattatgttgtctgcaa

SEQ ID NO: 8357859 - DNA, 22 bp, Homo sapiens
tgtttttatctctgtgtacaac

SEQ ID NO: 8357860 - DNA, 22 bp, Homo sapiens
tgtttttaaataatgatagaaa

SEQ ID NO: 8357861 - DNA, 22 bp, Homo sapiens
ttaaagcatcacactattaatt

SEQ ID NO: 8357862 - DNA, 22 bp, Homo sapiens
ttaaagcatgttgcttaacagg

SEQ ID NO: 8357863 - DNA, 22 bp, Homo sapiens
tgttttctgatggttaatgagt

SEQ ID NO: 8357864 - DNA, 22 bp, Homo sapiens
tgttttgtctaatctaaattct

SEQ ID NO: 8357865 - DNA, 22 bp, Homo sapiens
tgttttggagtggactttgcat

SEQ ID NO: 8357866 - DNA, 22 bp, Homo sapiens
tgttttgggtcactttccttgg

SEQ ID NO: 8357867 - DNA, 22 bp, Homo sapiens
tgttttggtggtctataggaaa

SEQ ID NO: 8357868 - DNA, 22 bp, Homo sapiens
tgttttgtccttttctatatac

SEQ ID NO: 8357869 - DNA, 22 bp, Homo sapiens
ttccagaacttttgttaatttc

SEQ ID NO: 8357870 - DNA, 22 bp, Homo sapiens
ttcctaactggcctttatggat

SEQ ID NO: 8357871 - DNA, 20 bp, Homo sapiens
ttcctcaggagaggatgtta

SEQ ID NO: 8357872 - DNA, 22 bp, Homo sapiens
ttcctcagggcggatgggcagg

SEQ ID NO: 8357873 - DNA, 22 bp, Homo sapiens
ttcctcatctgtgcacctcact

SEQ ID NO: 8357874 - DNA, 22 bp, Homo sapiens
ttcctcatggggttccttcaga

SEQ ID NO: 8357875 - DNA, 22 bp, Homo sapiens
ttcctatttccatgaaacacaa

SEQ ID NO: 8357876 - DNA, 22 bp, Homo sapiens
ttcctcacactcccccattcga

SEQ ID NO: 8357877 - DNA, 22 bp, Homo sapiens
ttcctataagtcacactgttgt

SEQ ID NO: 8357878 - DNA, 22 bp, Homo sapiens
ttcctcagccaaggctgggatc

SEQ ID NO: 8357879 - DNA, 22 bp, Homo sapiens
ttcctcagagggcgctggggaa

SEQ ID NO: 8357880 - DNA, 20 bp, Homo sapiens
ttcctcacaagtccctcggc

SEQ ID NO: 8357881 - DNA, 22 bp, Homo sapiens
ttcctcacctaattgggagggg

SEQ ID NO: 8357882 - DNA, 22 bp, Homo sapiens
ttcctgtatgtcagtgaagagc

SEQ ID NO: 8357883 - DNA, 22 bp, Homo sapiens
ttcctgtccgcaatggcctggg

SEQ ID NO: 8357884 - DNA, 22 bp, Homo sapiens
ttcctgtattttgcgaattttc

SEQ ID NO: 8357885 - DNA, 22 bp, Homo sapiens
ttcctgtattctaaagggaaag

SEQ ID NO: 8357886 - DNA, 22 bp, Homo sapiens
ttcctgaaaatacagggagacc

SEQ ID NO: 8357887 - DNA, 22 bp, Homo sapiens
ttcctgaaaatacagggagaga

SEQ ID NO: 8357888 - DNA, 22 bp, Homo sapiens
ttctaattgaccttaggctgtg

SEQ ID NO: 8357889 - DNA, 22 bp, Homo sapiens
ttctaagtctgctgtcttcatc

SEQ ID NO: 8357890 - DNA, 22 bp, Homo sapiens
ttctaattaaatctacgctagg

SEQ ID NO: 8357891 - DNA, 22 bp, Homo sapiens
ttctaattattcccttgtccca

SEQ ID NO: 8357892 - DNA, 19 bp, Homo sapiens
ttctaatgttacattttgg

SEQ ID NO: 8357893 - DNA, 22 bp, Homo sapiens
ttctaattgtgtttgcatatct

SEQ ID NO: 8357894 - DNA, 22 bp, Homo sapiens
ttctaattgcaagttttagtat

SEQ ID NO: 8357895 - DNA, 22 bp, Homo sapiens
ttcaactagaggtgattttgcc

SEQ ID NO: 8357896 - DNA, 22 bp, Homo sapiens
ttagagtttttgtaagtacaat

SEQ ID NO: 8357897 - DNA, 22 bp, Homo sapiens
ttagagttttctgttcctctaa

SEQ ID NO: 8357898 - DNA, 22 bp, Homo sapiens
ttcacagtgctcacagttcagt

SEQ ID NO: 8357899 - DNA, 22 bp, Homo sapiens
ttcacagtgctcacagttcagt

SEQ ID NO: 8357900 - DNA, 22 bp, Homo sapiens
ttcacagtgctcacagttcagt

SEQ ID NO: 8357901 - DNA, 22 bp, Homo sapiens
ttcacaggttgaagcctaatcc

SEQ ID NO: 8357902 - DNA, 22 bp, Homo sapiens
ttcacattataatcagttctgc

SEQ ID NO: 8357903 - DNA, 22 bp, Homo sapiens
ttcacattatcaggattgtttc

SEQ ID NO: 8357904 - DNA, 22 bp, Homo sapiens
ttcacattccgcggctattttc

SEQ ID NO: 8357905 - DNA, 22 bp, Homo sapiens
ttcagtcagtgactaagcagtt

SEQ ID NO: 8357906 - DNA, 20 bp, Homo sapiens
ttcagtctcctgcttccttc

SEQ ID NO: 8357907 - DNA, 18 bp, Homo sapiens
ttcaggtcagaaagatgg

SEQ ID NO: 8357908 - DNA, 22 bp, Homo sapiens
ttcatgcatggccttactccct

SEQ ID NO: 8357909 - DNA, 20 bp, Homo sapiens
ttcatgcagtggttgctgtg

SEQ ID NO: 8357910 - DNA, 22 bp, Homo sapiens
ttcatgcactatttcttctagc

SEQ ID NO: 8357911 - DNA, 22 bp, Homo sapiens
ttcatcatcagaactgttcact

SEQ ID NO: 8357912 - DNA, 22 bp, Homo sapiens
ttcatgtagtgtaatgtcttca

SEQ ID NO: 8357913 - DNA, 20 bp, Homo sapiens
ttcatgggagcaaagaggcc

SEQ ID NO: 8357914 - DNA, 22 bp, Homo sapiens
ttctatatgacttctaggcagg

SEQ ID NO: 8357915 - DNA, 22 bp, Homo sapiens
ttctagttactcttaaatgctg

SEQ ID NO: 8357916 - DNA, 22 bp, Homo sapiens
ttctagttaaagtatgtattag

SEQ ID NO: 8357917 - DNA, 20 bp, Homo sapiens
ttctagtttggagttattaa

SEQ ID NO: 8357918 - DNA, 22 bp, Homo sapiens
ttctgacatttgtcaaaatgat

SEQ ID NO: 8357919 - DNA, 22 bp, Homo sapiens
ttctgagaggtttgcattttca

SEQ ID NO: 8357920 - DNA, 22 bp, Homo sapiens
ttctgagaggcagagcttgtga

SEQ ID NO: 8357921 - DNA, 22 bp, Homo sapiens
ttctgagagagcctctcatgtt

SEQ ID NO: 8357922 - DNA, 18 bp, Homo sapiens
ttctgcggtgacagatat

SEQ ID NO: 8357923 - DNA, 22 bp, Homo sapiens
ttctgctccaccacttccagca

SEQ ID NO: 8357924 - DNA, 21 bp, Homo sapiens
ttctgctgttcaccaccaccc

SEQ ID NO: 8357925 - DNA, 22 bp, Homo sapiens
ttctgcttctgtgtgtcccagg

SEQ ID NO: 8357926 - DNA, 22 bp, Homo sapiens
ttctgggggaatacagctatga

SEQ ID NO: 8357927 - DNA, 22 bp, Homo sapiens
ttcttacactcttaaaaatcat

SEQ ID NO: 8357928 - DNA, 22 bp, Homo sapiens
ttctgtttataatttgcagttg

SEQ ID NO: 8357929 - DNA, 22 bp, Homo sapiens
ttctgtttcctgccttcccatt

SEQ ID NO: 8357930 - DNA, 22 bp, Homo sapiens
ttctgttccctaggacctgggg

SEQ ID NO: 8357931 - DNA, 22 bp, Homo sapiens
ttctgttctgatacttgtttct

SEQ ID NO: 8357932 - DNA, 22 bp, Homo sapiens
ttctgttctttatttaccatat

SEQ ID NO: 8357933 - DNA, 22 bp, Homo sapiens
ttctgttactctggtctgctgt

SEQ ID NO: 8357934 - DNA, 22 bp, Homo sapiens
ttctgttagaattttgaaaata

SEQ ID NO: 8357935 - DNA, 22 bp, Homo sapiens
ttctttatcagttactcatagg

SEQ ID NO: 8357936 - DNA, 18 bp, Homo sapiens
ttctttaattcagtttga

SEQ ID NO: 8357937 - DNA, 22 bp, Homo sapiens
ttctttaaaatagtgagaaaga

SEQ ID NO: 8357938 - DNA, 22 bp, Homo sapiens
ttcttacagccctattactaaa

SEQ ID NO: 8357939 - DNA, 22 bp, Homo sapiens
ttcttacagagtttacagagcc

SEQ ID NO: 8357940 - DNA, 22 bp, Homo sapiens
ttcttacagccctattactaaa

SEQ ID NO: 8357941 - DNA, 22 bp, Homo sapiens
ttcttctttccaattacatggt

SEQ ID NO: 8357942 - DNA, 22 bp, Homo sapiens
ttcttctttatctcagtatcct

SEQ ID NO: 8357943 - DNA, 22 bp, Homo sapiens
ttcttacatctataaagttggg

SEQ ID NO: 8357944 - DNA, 22 bp, Homo sapiens
ttcttacatattttcatatggt

SEQ ID NO: 8357945 - DNA, 22 bp, Homo sapiens
ttcttacattactttacatgtg

SEQ ID NO: 8357946 - DNA, 22 bp, Homo sapiens
ttcttgaaggggatataaatag

SEQ ID NO: 8357947 - DNA, 19 bp, Homo sapiens
ttcttgagacctcagtctg

SEQ ID NO: 8357948 - DNA, 22 bp, Homo sapiens
ttcttctttcctataattaatt

SEQ ID NO: 8357949 - DNA, 22 bp, Homo sapiens
ttgaagaacataatagctactt

SEQ ID NO: 8357950 - DNA, 22 bp, Homo sapiens
ttgaagatggatcgccactctc

SEQ ID NO: 8357951 - DNA, 22 bp, Homo sapiens
ttctttattagtttagtgagct

SEQ ID NO: 8357952 - DNA, 20 bp, Homo sapiens
ttctttcatctacacgttgt

SEQ ID NO: 8357953 - DNA, 22 bp, Homo sapiens
ttgaatgcatctttgagctcct

SEQ ID NO: 8357954 - DNA, 22 bp, Homo sapiens
ttgagatgacttaaatttggga

SEQ ID NO: 8357955 - DNA, 22 bp, Homo sapiens
ttgaaggacatcctatttctag

SEQ ID NO: 8357956 - DNA, 22 bp, Homo sapiens
ttgaagcatttgctatagcatt

SEQ ID NO: 8357957 - DNA, 22 bp, Homo sapiens
ttgaagcagagaaatacttgaa

SEQ ID NO: 8357958 - DNA, 22 bp, Homo sapiens
ttgaagcacaatgtcttttatc

SEQ ID NO: 8357959 - DNA, 22 bp, Homo sapiens
ttgaagcacaatgtcttttatc

SEQ ID NO: 8357960 - DNA, 21 bp, Homo sapiens
ttgaagcaagggtggctctga

SEQ ID NO: 8357961 - DNA, 22 bp, Homo sapiens
ttgaagcaaattctgtgcagta

SEQ ID NO: 8357962 - DNA, 22 bp, Homo sapiens
ttgaagcaaattctgtgcagta

SEQ ID NO: 8357963 - DNA, 22 bp, Homo sapiens
ttgaagcaaggcgaatcttgtg

SEQ ID NO: 8357964 - DNA, 21 bp, Homo sapiens
ttgaagcaagggtggctctga

SEQ ID NO: 8357965 - DNA, 22 bp, Homo sapiens
ttgaagcagctcaggaggctta

SEQ ID NO: 8357966 - DNA, 22 bp, Homo sapiens
ttgaagcaggaaaatttctatt

SEQ ID NO: 8357967 - DNA, 22 bp, Homo sapiens
ttgaagcagctcaggaggctta

SEQ ID NO: 8357968 - DNA, 22 bp, Homo sapiens
ttgaagcatggtacttgttcaa

SEQ ID NO: 8357969 - DNA, 22 bp, Homo sapiens
ttgaagcatttgctatagcatt

SEQ ID NO: 8357970 - DNA, 22 bp, Homo sapiens
ttgaagcattgtggcttgtatt

SEQ ID NO: 8357971 - DNA, 22 bp, Homo sapiens
ttgaagcatttctttgagcttc

SEQ ID NO: 8357972 - DNA, 22 bp, Homo sapiens
ttgaagcattgtggcttgtatt

SEQ ID NO: 8357973 - DNA, 22 bp, Homo sapiens
ttgagatttggaggtaattccc

SEQ ID NO: 8357974 - DNA, 22 bp, Homo sapiens
ttgagcaaaggagtaaaatgca

SEQ ID NO: 8357975 - DNA, 22 bp, Homo sapiens
ttgagcaatgctgcaaagagat

SEQ ID NO: 8357976 - DNA, 22 bp, Homo sapiens
ttgagcaattaggaaataaaga

SEQ ID NO: 8357977 - DNA, 22 bp, Homo sapiens
ttgatgaacacagataatcagt

SEQ ID NO: 8357978 - DNA, 22 bp, Homo sapiens
ttgatgttcataaatgatacag

SEQ ID NO: 8357979 - DNA, 22 bp, Homo sapiens
ttgattctgatcctttgctagc

SEQ ID NO: 8357980 - DNA, 22 bp, Homo sapiens
ttgcaaatgtttcataacagta

SEQ ID NO: 8357981 - DNA, 22 bp, Homo sapiens
ttgcaaattaaagaggatagca

SEQ ID NO: 8357982 - DNA, 21 bp, Homo sapiens
ttgattttaggaagtttgtca

SEQ ID NO: 8357983 - DNA, 21 bp, Homo sapiens
ttgattttaggaagtttgtca

SEQ ID NO: 8357984 - DNA, 22 bp, Homo sapiens
ttgcaaagtgtcatgcaaagta

SEQ ID NO: 8357985 - DNA, 22 bp, Homo sapiens
ttgcaaaggggaataaagcaat

SEQ ID NO: 8357986 - DNA, 20 bp, Homo sapiens
ttgcaaagtgaatagcaatt

SEQ ID NO: 8357987 - DNA, 22 bp, Homo sapiens
ttgcaaagagtcatgtaagtca

SEQ ID NO: 8357988 - DNA, 23 bp, Homo sapiens
ttgatttcaaatgcagagaacac

SEQ ID NO: 8357989 - DNA, 22 bp, Homo sapiens
ttgatttcaacatcatcccttt

SEQ ID NO: 8357990 - DNA, 22 bp, Homo sapiens
ttgatttcttattaccctagtt

SEQ ID NO: 8357991 - DNA, 22 bp, Homo sapiens
ttgatttctattgagttcctgt

SEQ ID NO: 8357992 - DNA, 22 bp, Homo sapiens
ttgatttcactctctgtccaat

SEQ ID NO: 8357993 - DNA, 22 bp, Homo sapiens
ttgatttctattcagatgtaga

SEQ ID NO: 8357994 - DNA, 22 bp, Homo sapiens
ttgattttaaaatagtgacact

SEQ ID NO: 8357995 - DNA, 22 bp, Homo sapiens
ttgatttgattgtaatggctct

SEQ ID NO: 8357996 - DNA, 22 bp, Homo sapiens
ttggtcctgggcactgattaac

SEQ ID NO: 8357997 - DNA, 22 bp, Homo sapiens
ttggtcctgcagaggggtctgg

SEQ ID NO: 8357998 - DNA, 22 bp, Homo sapiens
ttggtcttgtggcatctttcca

SEQ ID NO: 8357999 - DNA, 22 bp, Homo sapiens
ttggtcatagcattcaaaatgg

SEQ ID NO: 8358000 - DNA, 19 bp, Homo sapiens
ttggtggtggttttggttc

SEQ ID NO: 8358001 - DNA, 22 bp, Homo sapiens
ttggtcttttctattaaatata

SEQ ID NO: 8358002 - DNA, 20 bp, Homo sapiens
ttggttgagccagggcctgg

SEQ ID NO: 8358003 - DNA, 22 bp, Homo sapiens
ttggtttactaggattcaaatt

SEQ ID NO: 8358004 - DNA, 22 bp, Homo sapiens
ttggtttagagagtgtggttac

SEQ ID NO: 8358005 - DNA, 22 bp, Homo sapiens
ttgtctatacatcaataatgat

SEQ ID NO: 8358006 - DNA, 22 bp, Homo sapiens
ttgtccttggatgaagctggga

SEQ ID NO: 8358007 - DNA, 22 bp, Homo sapiens
ttgtccttgtgatagtttgctg

SEQ ID NO: 8358008 - DNA, 22 bp, Homo sapiens
ttgtccttagatgtggcctcca

SEQ ID NO: 8358009 - DNA, 22 bp, Homo sapiens
ttgtctgaaagatcattacatt

SEQ ID NO: 8358010 - DNA, 22 bp, Homo sapiens
ttgtctctggaaggaaaaagca

SEQ ID NO: 8358011 - DNA, 22 bp, Homo sapiens
ttgtctgtaaagacggccacca

SEQ ID NO: 8358012 - DNA, 22 bp, Homo sapiens
ttgtgaatgcttaatatgtttc

SEQ ID NO: 8358013 - DNA, 22 bp, Homo sapiens
ttgtgaatagtgccgctataaa

SEQ ID NO: 8358014 - DNA, 22 bp, Homo sapiens
ttgtttgtatgctgagaagaat

SEQ ID NO: 8358015 - DNA, 22 bp, Homo sapiens
ttgtttgaggtcactgatattt

SEQ ID NO: 8358016 - DNA, 23 bp, Homo sapiens
ttgtttctttgtattgtctctat

SEQ ID NO: 8358017 - DNA, 22 bp, Homo sapiens
ttgtttcttcaggcttttagga

SEQ ID NO: 8358018 - DNA, 17 bp, Homo sapiens
ttgtttcttctctgtgg

SEQ ID NO: 8358019 - DNA, 22 bp, Homo sapiens
ttgtttccctggatctagagct

SEQ ID NO: 8358020 - DNA, 22 bp, Homo sapiens
ttgtttctgagttttcatgtat

SEQ ID NO: 8358021 - DNA, 22 bp, Homo sapiens
ttgtttctgagttttcatgtat

SEQ ID NO: 8358022 - DNA, 22 bp, Homo sapiens
ttgtttctgagttttcatgtat

SEQ ID NO: 8358023 - DNA, 17 bp, Homo sapiens
ttgtttgttcttgcccc

SEQ ID NO: 8358024 - DNA, 22 bp, Homo sapiens
ttgtttttaaacatgtgactga

SEQ ID NO: 8358025 - DNA, 22 bp, Homo sapiens
ttgttttctccactgcatctta

SEQ ID NO: 8358026 - DNA, 22 bp, Homo sapiens
ttgttttctccactgcatctta

SEQ ID NO: 8358027 - DNA, 22 bp, Homo sapiens
ttgttttcagggtgtcattcac

SEQ ID NO: 8358028 - DNA, 22 bp, Homo sapiens
ttgttttcctgggataccaacc

SEQ ID NO: 8358029 - DNA, 22 bp, Homo sapiens
ttgttttcagggtgtcattcac

SEQ ID NO: 8358030 - DNA, 22 bp, Homo sapiens
ttgttttattctgcaatttccc

SEQ ID NO: 8358031 - DNA, 22 bp, Homo sapiens
ttgtgttggcgaaagcatgtca

SEQ ID NO: 8358032 - DNA, 20 bp, Homo sapiens
ttgttagaggaatgccatag

SEQ ID NO: 8358033 - DNA, 22 bp, Homo sapiens
ttgttactgttctacatacagt

SEQ ID NO: 8358034 - DNA, 22 bp, Homo sapiens
tttattattctgttctctctac

SEQ ID NO: 8358035 - DNA, 22 bp, Homo sapiens
tttattattctctggagaatgt

SEQ ID NO: 8358036 - DNA, 22 bp, Homo sapiens
tttatagatgtctgtattataa

SEQ ID NO: 8358037 - DNA, 22 bp, Homo sapiens
tttatataacagagactgctat

SEQ ID NO: 8358038 - DNA, 22 bp, Homo sapiens
tttatagtcgtctcagtaataa

SEQ ID NO: 8358039 - DNA, 21 bp, Homo sapiens
tttaatttgcatgtatgacgc

SEQ ID NO: 8358040 - DNA, 22 bp, Homo sapiens
tttaaaagttatcatctgtcca

SEQ ID NO: 8358041 - DNA, 23 bp, Homo sapiens
ttgtttttagaggtggcatgaga

SEQ ID NO: 8358042 - DNA, 22 bp, Homo sapiens
ttgtttttatgaacatccagga

SEQ ID NO: 8358043 - DNA, 22 bp, Homo sapiens
tttactttctcaagtatatagg

SEQ ID NO: 8358044 - DNA, 22 bp, Homo sapiens
tttagaaattcatctatggcct

SEQ ID NO: 8358045 - DNA, 22 bp, Homo sapiens
tttagaaattcatctatggcct

SEQ ID NO: 8358046 - DNA, 22 bp, Homo sapiens
tttagttattgttacagtatga

SEQ ID NO: 8358047 - DNA, 22 bp, Homo sapiens
tttacaagtacacctaacagct

SEQ ID NO: 8358048 - DNA, 22 bp, Homo sapiens
tttcctcttctggcaggcaggg

SEQ ID NO: 8358049 - DNA, 22 bp, Homo sapiens
tttcctcttcgattaagtttgg

SEQ ID NO: 8358050 - DNA, 22 bp, Homo sapiens
tttcctcttccgagggggaggc

SEQ ID NO: 8358051 - DNA, 22 bp, Homo sapiens
tttcctcttcttcccatgtcat

SEQ ID NO: 8358052 - DNA, 22 bp, Homo sapiens
tttcctctgtcatgacagctga

SEQ ID NO: 8358053 - DNA, 22 bp, Homo sapiens
tttcctcttatacagtgtttat

SEQ ID NO: 8358054 - DNA, 22 bp, Homo sapiens
tttcctctgctgccattgcccc

SEQ ID NO: 8358055 - DNA, 22 bp, Homo sapiens
tttcctctgctgccattgcccc

SEQ ID NO: 8358056 - DNA, 22 bp, Homo sapiens
tttcctctgggccctgccaccc

SEQ ID NO: 8358057 - DNA, 22 bp, Homo sapiens
tttcatttcatagaattgtgtt

SEQ ID NO: 8358058 - DNA, 22 bp, Homo sapiens
tttcagtgcttctgtttaccgg

SEQ ID NO: 8358059 - DNA, 22 bp, Homo sapiens
tttcaaactttactcttgaatc

SEQ ID NO: 8358060 - DNA, 22 bp, Homo sapiens
tttcagatcattttttaagtac

SEQ ID NO: 8358061 - DNA, 22 bp, Homo sapiens
tttcagatcattttttaagtac

SEQ ID NO: 8358062 - DNA, 22 bp, Homo sapiens
tttcagatggaggtttaggaca

SEQ ID NO: 8358063 - DNA, 22 bp, Homo sapiens
tttcagatggtatatacagtag

SEQ ID NO: 8358064 - DNA, 22 bp, Homo sapiens
tttcagatggtatatacagtag

SEQ ID NO: 8358065 - DNA, 22 bp, Homo sapiens
tttcagatgtgtgtctctgaag

SEQ ID NO: 8358066 - DNA, 22 bp, Homo sapiens
tttcagatgtgtgtctctgaag

SEQ ID NO: 8358067 - DNA, 22 bp, Homo sapiens
tttcagcactttaggcagcagg

SEQ ID NO: 8358068 - DNA, 20 bp, Homo sapiens
tttcagatttacagaaatgt

SEQ ID NO: 8358069 - DNA, 19 bp, Homo sapiens
tttcaggagctatgcaggg

SEQ ID NO: 8358070 - DNA, 22 bp, Homo sapiens
tttctacttctcctgaatgtct

SEQ ID NO: 8358071 - DNA, 22 bp, Homo sapiens
tttctagaaacattatctctat

SEQ ID NO: 8358072 - DNA, 22 bp, Homo sapiens
tttctagaagatggctaataag

SEQ ID NO: 8358073 - DNA, 22 bp, Homo sapiens
tttctagaaaccaagatattgt

SEQ ID NO: 8358074 - DNA, 22 bp, Homo sapiens
tttctatttacagtgctaggta

SEQ ID NO: 8358075 - DNA, 22 bp, Homo sapiens
tttctattgtaagtctcctata

SEQ ID NO: 8358076 - DNA, 21 bp, Homo sapiens
tttctcataaaatactcatta

SEQ ID NO: 8358077 - DNA, 22 bp, Homo sapiens
tttctcatggaacatagctcct

SEQ ID NO: 8358078 - DNA, 22 bp, Homo sapiens
tttctcatggacccttcatgat

SEQ ID NO: 8358079 - DNA, 22 bp, Homo sapiens
tttctcatggaacatcgtttag

SEQ ID NO: 8358080 - DNA, 23 bp, Homo sapiens
tttctcatccagagagtcagtcc

SEQ ID NO: 8358081 - DNA, 16 bp, Homo sapiens
tttctcattgtcatca

SEQ ID NO: 8358082 - DNA, 22 bp, Homo sapiens
tttctcatggacccttcatgat

SEQ ID NO: 8358083 - DNA, 22 bp, Homo sapiens
tttctaatctttagttacaaaa

SEQ ID NO: 8358084 - DNA, 22 bp, Homo sapiens
tttctaatctgattctcctacc

SEQ ID NO: 8358085 - DNA, 22 bp, Homo sapiens
tttcctctttgtgacacagctg

SEQ ID NO: 8358086 - DNA, 22 bp, Homo sapiens
tttcctctttgtaccttgacta

SEQ ID NO: 8358087 - DNA, 20 bp, Homo sapiens
tttctgtagctcagtattca

SEQ ID NO: 8358088 - DNA, 22 bp, Homo sapiens
tttctgtagggatttcacagtt

SEQ ID NO: 8358089 - DNA, 22 bp, Homo sapiens
tttctgtacacccactattcat

SEQ ID NO: 8358090 - DNA, 20 bp, Homo sapiens
tttctgtaaggcattaatct

SEQ ID NO: 8358091 - DNA, 22 bp, Homo sapiens
tttctggcagcgggacaggggt

SEQ ID NO: 8358092 - DNA, 22 bp, Homo sapiens
tttctggaaccacaaaagtatg

SEQ ID NO: 8358093 - DNA, 22 bp, Homo sapiens
tttctggaaagcaagatacatt

SEQ ID NO: 8358094 - DNA, 22 bp, Homo sapiens
tttctggaaactgtaaagagga

SEQ ID NO: 8358095 - DNA, 22 bp, Homo sapiens
tttctggattcatacagatgta

SEQ ID NO: 8358096 - DNA, 22 bp, Homo sapiens
tttctgctttctatccttgtca

SEQ ID NO: 8358097 - DNA, 22 bp, Homo sapiens
tttctgctttctatccttgtca

SEQ ID NO: 8358098 - DNA, 22 bp, Homo sapiens
tttctgctgtgctttcttgcgt

SEQ ID NO: 8358099 - DNA, 22 bp, Homo sapiens
tttctgcttaggactctgtgga

SEQ ID NO: 8358100 - DNA, 22 bp, Homo sapiens
tttctgaatttactcaaggtca

SEQ ID NO: 8358101 - DNA, 18 bp, Homo sapiens
tttctgaatgtctatttc

SEQ ID NO: 8358102 - DNA, 22 bp, Homo sapiens
tttctgaaggttaaggaattag

SEQ ID NO: 8358103 - DNA, 22 bp, Homo sapiens
tttctgaaggttaaggaattag

SEQ ID NO: 8358104 - DNA, 22 bp, Homo sapiens
tttctgctcgctctcaatcagg

SEQ ID NO: 8358105 - DNA, 22 bp, Homo sapiens
tttctgacttttatatgcatat

SEQ ID NO: 8358106 - DNA, 22 bp, Homo sapiens
tttctgcattgtcctcttggtt

SEQ ID NO: 8358107 - DNA, 22 bp, Homo sapiens
tttctcttaatgtctctgtgct

SEQ ID NO: 8358108 - DNA, 22 bp, Homo sapiens
tttctcttcactgtgtgcctca

SEQ ID NO: 8358109 - DNA, 22 bp, Homo sapiens
tttctctgtgggctttatgcat

SEQ ID NO: 8358110 - DNA, 22 bp, Homo sapiens
tttctgaaacatggtctttgta

SEQ ID NO: 8358111 - DNA, 22 bp, Homo sapiens
tttctcttcactgtgtgcctca

SEQ ID NO: 8358112 - DNA, 22 bp, Homo sapiens
tttctcttcactgtgtgcctca

SEQ ID NO: 8358113 - DNA, 22 bp, Homo sapiens
tttctcttgcgatatgctacac

SEQ ID NO: 8358114 - DNA, 22 bp, Homo sapiens
tttctctttcaatctgcagtac

SEQ ID NO: 8358115 - DNA, 22 bp, Homo sapiens
tttctctttcaatctgcagtac

SEQ ID NO: 8358116 - DNA, 22 bp, Homo sapiens
tttctctttggaggggctgaat

SEQ ID NO: 8358117 - DNA, 22 bp, Homo sapiens
tttctctttgacaggaatcaga

SEQ ID NO: 8358118 - DNA, 22 bp, Homo sapiens
tttcttatgagcaagactctat

SEQ ID NO: 8358119 - DNA, 21 bp, Homo sapiens
tttctgtctctgccactagtt

SEQ ID NO: 8358120 - DNA, 23 bp, Homo sapiens
tttctgttgggtatatatccaag

SEQ ID NO: 8358121 - DNA, 22 bp, Homo sapiens
tttctgttaggcatcattttaa

SEQ ID NO: 8358122 - DNA, 22 bp, Homo sapiens
tttctttaattctcacagcaat

SEQ ID NO: 8358123 - DNA, 22 bp, Homo sapiens
tttctttatcatagcatctttg

SEQ ID NO: 8358124 - DNA, 22 bp, Homo sapiens
tttcttctctaatctcaatgat

SEQ ID NO: 8358125 - DNA, 22 bp, Homo sapiens
tttcttctgagatcagggagaa

SEQ ID NO: 8358126 - DNA, 22 bp, Homo sapiens
tttcttctctgattaaggctca

SEQ ID NO: 8358127 - DNA, 22 bp, Homo sapiens
tttcttctctgattaaggctca

SEQ ID NO: 8358128 - DNA, 22 bp, Homo sapiens
tttcttctaagatttcaaacta

SEQ ID NO: 8358129 - DNA, 22 bp, Homo sapiens
tttcttctcacccaggacagag

SEQ ID NO: 8358130 - DNA, 22 bp, Homo sapiens
tttcttctatgtgtgatatttt

SEQ ID NO: 8358131 - DNA, 22 bp, Homo sapiens
tttcttctcgacaccttatccc

SEQ ID NO: 8358132 - DNA, 22 bp, Homo sapiens
tttcttctcgacaccttatccc

SEQ ID NO: 8358133 - DNA, 22 bp, Homo sapiens
tttggacttagcctgcagaatt

SEQ ID NO: 8358134 - DNA, 22 bp, Homo sapiens
tttggactgcatgatgatctgg

SEQ ID NO: 8358135 - DNA, 22 bp, Homo sapiens
tttggaagacagggcaggaaag

SEQ ID NO: 8358136 - DNA, 22 bp, Homo sapiens
tttggaagggaaagaaagtact

SEQ ID NO: 8358137 - DNA, 22 bp, Homo sapiens
tttggaaggtgaggcatgaagg

SEQ ID NO: 8358138 - DNA, 22 bp, Homo sapiens
tttggaagggaaccaaaacatg

SEQ ID NO: 8358139 - DNA, 22 bp, Homo sapiens
tttggagttcatttaccacttt

SEQ ID NO: 8358140 - DNA, 19 bp, Homo sapiens
tttggcactctgaagtgtt

SEQ ID NO: 8358141 - DNA, 19 bp, Homo sapiens
tttggcactctgaagtgtt

SEQ ID NO: 8358142 - DNA, 22 bp, Homo sapiens
tttggcactgttctaggtgcaa

SEQ ID NO: 8358143 - DNA, 20 bp, Homo sapiens
tttggcactgagtggtataa

SEQ ID NO: 8358144 - DNA, 22 bp, Homo sapiens
tttggcacttggcagttgagtt

SEQ ID NO: 8358145 - DNA, 22 bp, Homo sapiens
tttggcacagcttcccagactt

SEQ ID NO: 8358146 - DNA, 22 bp, Homo sapiens
tttggcacagtactttttggct

SEQ ID NO: 8358147 - DNA, 22 bp, Homo sapiens
tttggcaccaaaggagaagatc

SEQ ID NO: 8358148 - DNA, 22 bp, Homo sapiens
tttggcacattctgtcacattc

SEQ ID NO: 8358149 - DNA, 22 bp, Homo sapiens
tttggcaccatttttattctct

SEQ ID NO: 8358150 - DNA, 22 bp, Homo sapiens
tttggcactcacttatcattgg

SEQ ID NO: 8358151 - DNA, 22 bp, Homo sapiens
tttggcacctccaaggactcgc

SEQ ID NO: 8358152 - DNA, 22 bp, Homo sapiens
tttggcactataggtaaatttg

SEQ ID NO: 8358153 - DNA, 22 bp, Homo sapiens
tttggcagagtcatttcagaaa

SEQ ID NO: 8358154 - DNA, 22 bp, Homo sapiens
tttgtaatgataatgttaaatt

SEQ ID NO: 8358155 - DNA, 22 bp, Homo sapiens
tttgcaaataccatgaaacttg

SEQ ID NO: 8358156 - DNA, 22 bp, Homo sapiens
tttctttatcctcctttgcaca

SEQ ID NO: 8358157 - DNA, 22 bp, Homo sapiens
tttgcaacagactcatcattga

SEQ ID NO: 8358158 - DNA, 23 bp, Homo sapiens
tttgcaaattggacacaaccaca

SEQ ID NO: 8358159 - DNA, 22 bp, Homo sapiens
tttgcagagtacctgaagagga

SEQ ID NO: 8358160 - DNA, 22 bp, Homo sapiens
tttgcacacattcttagaaatg

SEQ ID NO: 8358161 - DNA, 22 bp, Homo sapiens
tttgcacacacaataacaaatg

SEQ ID NO: 8358162 - DNA, 22 bp, Homo sapiens
tttgcactctaagtagtttgga

SEQ ID NO: 8358163 - DNA, 22 bp, Homo sapiens
tttgcacagcctttctggctgc

SEQ ID NO: 8358164 - DNA, 22 bp, Homo sapiens
tttgcacttaacttatttgaaa

SEQ ID NO: 8358165 - DNA, 21 bp, Homo sapiens
tttgcacttccctgatggtta

SEQ ID NO: 8358166 - DNA, 22 bp, Homo sapiens
tttgcacttcctaatgtgtttt

SEQ ID NO: 8358167 - DNA, 22 bp, Homo sapiens
tttgcagaagaaaacatgaaca

SEQ ID NO: 8358168 - DNA, 22 bp, Homo sapiens
tttgtattacaaagtcacagta

SEQ ID NO: 8358169 - DNA, 22 bp, Homo sapiens
tttgtatgtgataagactattc

SEQ ID NO: 8358170 - DNA, 22 bp, Homo sapiens
tttgtatgaatgcatattttca

SEQ ID NO: 8358171 - DNA, 22 bp, Homo sapiens
tttgtatgggcagaaattagat

SEQ ID NO: 8358172 - DNA, 22 bp, Homo sapiens
tttgtagattttctctccagta

SEQ ID NO: 8358173 - DNA, 22 bp, Homo sapiens
tttgtagagggtaattgacaga

SEQ ID NO: 8358174 - DNA, 22 bp, Homo sapiens
tttgtagaactatacttacatt

SEQ ID NO: 8358175 - DNA, 22 bp, Homo sapiens
tttgtagaaagggttgtatgaa

SEQ ID NO: 8358176 - DNA, 22 bp, Homo sapiens
tttgtagaataatatctttctg

SEQ ID NO: 8358177 - DNA, 22 bp, Homo sapiens
tttgtagaataatatctttctg

SEQ ID NO: 8358178 - DNA, 22 bp, Homo sapiens
tttgtttactcattcattgatg

SEQ ID NO: 8358179 - DNA, 22 bp, Homo sapiens
tttgttcttgcaacagttatta

SEQ ID NO: 8358180 - DNA, 22 bp, Homo sapiens
tttgtatttttcccagctagct

SEQ ID NO: 8358181 - DNA, 22 bp, Homo sapiens
ttttagaagttcacttgggttt

SEQ ID NO: 8358182 - DNA, 22 bp, Homo sapiens
tttgtttagatggtaaatcagt

SEQ ID NO: 8358183 - DNA, 22 bp, Homo sapiens
tttgttttcaatgtgtcattca

SEQ ID NO: 8358184 - DNA, 22 bp, Homo sapiens
tttgtttctgcaatacctatag

SEQ ID NO: 8358185 - DNA, 22 bp, Homo sapiens
ttttatagctgaatagtattcc

SEQ ID NO: 8358186 - DNA, 22 bp, Homo sapiens
ttttagaatcaggttgtctggg

SEQ ID NO: 8358187 - DNA, 22 bp, Homo sapiens
ttttatattgagtgagagttcc

SEQ ID NO: 8358188 - DNA, 22 bp, Homo sapiens
ttttatatggcacattggttgg

SEQ ID NO: 8358189 - DNA, 22 bp, Homo sapiens
ttttatatggcacattggttgg

SEQ ID NO: 8358190 - DNA, 22 bp, Homo sapiens
ttttatcaatcattaagacatt

SEQ ID NO: 8358191 - DNA, 22 bp, Homo sapiens
tttttgcaccaacctaatagaa

SEQ ID NO: 8358192 - DNA, 22 bp, Homo sapiens
tttttgctaatccccagccact

SEQ ID NO: 8358193 - DNA, 22 bp, Homo sapiens
tttttgaaggctgatgtgatta

SEQ ID NO: 8358194 - DNA, 22 bp, Homo sapiens
tttttgaaggctgatgtgatta

SEQ ID NO: 8358195 - DNA, 22 bp, Homo sapiens
tttttctactggtgttggtgta

SEQ ID NO: 8358196 - DNA, 22 bp, Homo sapiens
tttttgaaggctgatgtgatta

SEQ ID NO: 8358197 - DNA, 22 bp, Homo sapiens
tttttctaatggcttaggatgt

SEQ ID NO: 8358198 - DNA, 22 bp, Homo sapiens
tttttctactgcccacattgta

SEQ ID NO: 8358199 - DNA, 22 bp, Homo sapiens
tttttccttggatgtgtctctc

SEQ ID NO: 8358200 - DNA, 22 bp, Homo sapiens
tttttcctaagcagtggagctg

SEQ ID NO: 8358201 - DNA, 22 bp, Homo sapiens
tttttccaccgtacttcctgag

SEQ ID NO: 8358202 - DNA, 22 bp, Homo sapiens
tttttcctagtgctttctggta

SEQ ID NO: 8358203 - DNA, 22 bp, Homo sapiens
tttttcctagcgatttgtcagc

SEQ ID NO: 8358204 - DNA, 20 bp, Homo sapiens
tttttccttctctacaggca

SEQ ID NO: 8358205 - DNA, 22 bp, Homo sapiens
tttttccttaggggttactcac

SEQ ID NO: 8358206 - DNA, 22 bp, Homo sapiens
ttttggcactttgtctgattct

SEQ ID NO: 8358207 - DNA, 22 bp, Homo sapiens
ttttggcactttgtctgattct

SEQ ID NO: 8358208 - DNA, 22 bp, Homo sapiens
ttttggcactgcgtctacatgg

SEQ ID NO: 8358209 - DNA, 22 bp, Homo sapiens
ttttggcagattacttaatatg

SEQ ID NO: 8358210 - DNA, 22 bp, Homo sapiens
ttttggaatctgggaaaacagt

SEQ ID NO: 8358211 - DNA, 22 bp, Homo sapiens
ttttggcaaaggcattctcttt

SEQ ID NO: 8358212 - DNA, 22 bp, Homo sapiens
ttttggcaaaggcattctcttt

SEQ ID NO: 8358213 - DNA, 22 bp, Homo sapiens
ttttgagatggagtcttgctct

SEQ ID NO: 8358214 - DNA, 22 bp, Homo sapiens
ttttgaataattcagaaacagc

SEQ ID NO: 8358215 - DNA, 22 bp, Homo sapiens
ttttgaataattcagaaacagc

SEQ ID NO: 8358216 - DNA, 22 bp, Homo sapiens
ttttgaaagggtgatttggctt

SEQ ID NO: 8358217 - DNA, 22 bp, Homo sapiens
ttttgaaagccaggtttgtatg

SEQ ID NO: 8358218 - DNA, 22 bp, Homo sapiens
ttttgaaagccaggtttgtatg

SEQ ID NO: 8358219 - DNA, 22 bp, Homo sapiens
ttttatgaagataattttctga

SEQ ID NO: 8358220 - DNA, 22 bp, Homo sapiens
ttttatgaagataattttctga

SEQ ID NO: 8358221 - DNA, 22 bp, Homo sapiens
ttttatcttcattcctatctac

SEQ ID NO: 8358222 - DNA, 22 bp, Homo sapiens
ttttatctacctatgctcattt

SEQ ID NO: 8358223 - DNA, 22 bp, Homo sapiens
ttttatctgtgacatctggcag

SEQ ID NO: 8358224 - DNA, 22 bp, Homo sapiens
ttttatctgcttcattagttga

SEQ ID NO: 8358225 - DNA, 22 bp, Homo sapiens
ttttctattaactcattttgca

SEQ ID NO: 8358226 - DNA, 22 bp, Homo sapiens
ttttctagggtgctaaatgaac

SEQ ID NO: 8358227 - DNA, 22 bp, Homo sapiens
ttttctaacatctagtaatttg

SEQ ID NO: 8358228 - DNA, 22 bp, Homo sapiens
gcatattttcacaagctcttgg

SEQ ID NO: 8358229 - DNA, 22 bp, Homo sapiens
gcatcagaatcatccggggaat

SEQ ID NO: 8358230 - DNA, 22 bp, Homo sapiens
attgtacttttattacatgtag

SEQ ID NO: 8358231 - DNA, 22 bp, Homo sapiens
attgtctctttcaataacttgt

SEQ ID NO: 8358232 - DNA, 22 bp, Homo sapiens
attgtcattccagtcattgtta

SEQ ID NO: 8358233 - DNA, 22 bp, Homo sapiens
attgtcattccagtcattgtta

SEQ ID NO: 8358234 - DNA, 22 bp, Homo sapiens
attgtcattggcttctatgtct

SEQ ID NO: 8358235 - DNA, 22 bp, Homo sapiens
attgtcattggcttctatgtct

SEQ ID NO: 8358236 - DNA, 22 bp, Homo sapiens
attgtcctatctcagtgccatg

SEQ ID NO: 8358237 - DNA, 22 bp, Homo sapiens
attgtatttgtacaagacatgt

SEQ ID NO: 8358238 - DNA, 22 bp, Homo sapiens
attgtcacttaaaagtgcatgt

SEQ ID NO: 8358239 - DNA, 22 bp, Homo sapiens
attgtcagtgggatttgtcaac

SEQ ID NO: 8358240 - DNA, 22 bp, Homo sapiens
attgtctttggtgcttccagga

SEQ ID NO: 8358241 - DNA, 22 bp, Homo sapiens
attgtctttggtgcttccagga

SEQ ID NO: 8358242 - DNA, 22 bp, Homo sapiens
attgtctttaaaaatatacaac

SEQ ID NO: 8358243 - DNA, 22 bp, Homo sapiens
attgtctttaaaaatatacaac

SEQ ID NO: 8358244 - DNA, 22 bp, Homo sapiens
attgtctttccactgagaagtt

SEQ ID NO: 8358245 - DNA, 22 bp, Homo sapiens
attgtcttacatactgtggagg

SEQ ID NO: 8358246 - DNA, 22 bp, Homo sapiens
attgtcttctggtcttatcttt

SEQ ID NO: 8358247 - DNA, 22 bp, Homo sapiens
attgtcttctggtcttatcttt

SEQ ID NO: 8358248 - DNA, 22 bp, Homo sapiens
attgtcttctgtcttatagttc

SEQ ID NO: 8358249 - DNA, 22 bp, Homo sapiens
attgtcttctgtcttatagttc

SEQ ID NO: 8358250 - DNA, 22 bp, Homo sapiens
gccaaagcccaggagacagcca

SEQ ID NO: 8358251 - DNA, 22 bp, Homo sapiens
attgtgaatagtgccgcagtaa

SEQ ID NO: 8358252 - DNA, 22 bp, Homo sapiens
attgtgaattgagagtacttct

SEQ ID NO: 8358253 - DNA, 22 bp, Homo sapiens
gcagctgctgtggcatcaagct

SEQ ID NO: 8358254 - DNA, 22 bp, Homo sapiens
gcagctgctggagggaggcagg

SEQ ID NO: 8358255 - DNA, 22 bp, Homo sapiens
gcagctgctggagggaggcagg

SEQ ID NO: 8358256 - DNA, 22 bp, Homo sapiens
gcagctgctggagggaggcagg

SEQ ID NO: 8358257 - DNA, 22 bp, Homo sapiens
gcagctgctggaagttcctgcc

SEQ ID NO: 8358258 - DNA, 22 bp, Homo sapiens
gcagctgctcccttttacagtg

SEQ ID NO: 8358259 - DNA, 22 bp, Homo sapiens
gcagctgctcacattctcacaa

SEQ ID NO: 8358260 - DNA, 22 bp, Homo sapiens
gcagctgcgaagaagtctatct

SEQ ID NO: 8358261 - DNA, 22 bp, Homo sapiens
gcagctgcgctggtgtggggca

SEQ ID NO: 8358262 - DNA, 22 bp, Homo sapiens
gcagctgcgctggtgtggggca

SEQ ID NO: 8358263 - DNA, 22 bp, Homo sapiens
gcagctgcctattcagggcttg

SEQ ID NO: 8358264 - DNA, 22 bp, Homo sapiens
gcagcgaggtgatgaaatagct

SEQ ID NO: 8358265 - DNA, 22 bp, Homo sapiens
gcagcgagtgcggctgccacag

SEQ ID NO: 8358266 - DNA, 22 bp, Homo sapiens
gcagctgccttcagctggatgg

SEQ ID NO: 8358267 - DNA, 22 bp, Homo sapiens
gcagctgccttcagctggatgg

SEQ ID NO: 8358268 - DNA, 22 bp, Homo sapiens
attcttcagtatgtgtggattg

SEQ ID NO: 8358269 - DNA, 22 bp, Homo sapiens
attcttgatatagatagttaat

SEQ ID NO: 8358270 - DNA, 19 bp, Homo sapiens
attcttggtgcaccttgta

SEQ ID NO: 8358271 - DNA, 22 bp, Homo sapiens
attctttacattggcttcttcc

SEQ ID NO: 8358272 - DNA, 22 bp, Homo sapiens
gcagggctgcagagggcactgt

SEQ ID NO: 8358273 - DNA, 22 bp, Homo sapiens
attgatttaggcttgttatgac

SEQ ID NO: 8358274 - DNA, 22 bp, Homo sapiens
gcaggcctgtcttgctcgccct

SEQ ID NO: 8358275 - DNA, 22 bp, Homo sapiens
gcaggcctgtaatgaagggaca

SEQ ID NO: 8358276 - DNA, 22 bp, Homo sapiens
gcaggcctggtttacatggtag

SEQ ID NO: 8358277 - DNA, 22 bp, Homo sapiens
gcaggcctggtttacatggtag

SEQ ID NO: 8358278 - DNA, 22 bp, Homo sapiens
gcaggccttggcaatgagcctg

SEQ ID NO: 8358279 - DNA, 22 bp, Homo sapiens
gcaggccttggcaatgagcctg

SEQ ID NO: 8358280 - DNA, 22 bp, Homo sapiens
gcaggcctgggagtcatcttgt

SEQ ID NO: 8358281 - DNA, 22 bp, Homo sapiens
gcaggcctgcccagcaggatgg

SEQ ID NO: 8358282 - DNA, 22 bp, Homo sapiens
gcaggcctgcccagcaggatgg

SEQ ID NO: 8358283 - DNA, 22 bp, Homo sapiens
gcaggcctgactgtagggggca

SEQ ID NO: 8358284 - DNA, 22 bp, Homo sapiens
gcaggcctgcaggtatggccgg

SEQ ID NO: 8358285 - DNA, 22 bp, Homo sapiens
attgatcatgcagatgcttcac

SEQ ID NO: 8358286 - DNA, 22 bp, Homo sapiens
gcaggcctttatccctgcctca

SEQ ID NO: 8358287 - DNA, 22 bp, Homo sapiens
attgacctattggacatgaaac

SEQ ID NO: 8358288 - DNA, 22 bp, Homo sapiens
attcagaagctattcttagttc

SEQ ID NO: 8358289 - DNA, 22 bp, Homo sapiens
attcagaatggcaaacttctag

SEQ ID NO: 8358290 - DNA, 20 bp, Homo sapiens
attcagaataggcatgtaaa

SEQ ID NO: 8358291 - DNA, 20 bp, Homo sapiens
attcagaataggcatgtaaa

SEQ ID NO: 8358292 - DNA, 23 bp, Homo sapiens
attcagaattgtgtgtttgtata

SEQ ID NO: 8358293 - DNA, 23 bp, Homo sapiens
attcagaattgtgtgtttgtata

SEQ ID NO: 8358294 - DNA, 22 bp, Homo sapiens
attcagaattgtgggcagtaca

SEQ ID NO: 8358295 - DNA, 22 bp, Homo sapiens
attcagaattttggggagctaa

SEQ ID NO: 8358296 - DNA, 20 bp, Homo sapiens
gcagcagacagacaggggac

SEQ ID NO: 8358297 - DNA, 20 bp, Homo sapiens
gcagcagacagacaggggac

SEQ ID NO: 8358298 - DNA, 22 bp, Homo sapiens
gcagcagagaacacaatgatgg

SEQ ID NO: 8358299 - DNA, 22 bp, Homo sapiens
gcagcagagaccccaggaagga

SEQ ID NO: 8358300 - DNA, 22 bp, Homo sapiens
gcagcagagaccccaggaagga

SEQ ID NO: 8358301 - DNA, 22 bp, Homo sapiens
gcagcagaggccctactctttg

SEQ ID NO: 8358302 - DNA, 22 bp, Homo sapiens
gcagcagaggccctactctttg

SEQ ID NO: 8358303 - DNA, 22 bp, Homo sapiens
gcagcagagctttgtcctggct

SEQ ID NO: 8358304 - DNA, 22 bp, Homo sapiens
gcagcagagctttgtcctggct

SEQ ID NO: 8358305 - DNA, 22 bp, Homo sapiens
gcagcagagctttgtcctggct

SEQ ID NO: 8358306 - DNA, 22 bp, Homo sapiens
gcagcagatgtgggcccagagc

SEQ ID NO: 8358307 - DNA, 22 bp, Homo sapiens
gcagcagatgtgggcccagagc

SEQ ID NO: 8358308 - DNA, 22 bp, Homo sapiens
attcagttgtctactactgcct

SEQ ID NO: 8358309 - DNA, 22 bp, Homo sapiens
gcagcagagtttgggagatggt

SEQ ID NO: 8358310 - DNA, 22 bp, Homo sapiens
gcagcagagtttgggagatggt

SEQ ID NO: 8358311 - DNA, 22 bp, Homo sapiens
gcagcagagtttgggagatggt

SEQ ID NO: 8358312 - DNA, 22 bp, Homo sapiens
gcagcagagtagacagagccct

SEQ ID NO: 8358313 - DNA, 22 bp, Homo sapiens
gcagcagatgctttcatggaca

SEQ ID NO: 8358314 - DNA, 22 bp, Homo sapiens
gcagcagatgctttcatggaca

SEQ ID NO: 8358315 - DNA, 22 bp, Homo sapiens
gcagcagagtttgggagatggt

SEQ ID NO: 8358316 - DNA, 22 bp, Homo sapiens
attcagtttttattggaccagc

SEQ ID NO: 8358317 - DNA, 21 bp, Homo sapiens
attcagtttgacatctagcag

SEQ ID NO: 8358318 - DNA, 22 bp, Homo sapiens
attcagtttcaatcattgtagt

SEQ ID NO: 8358319 - DNA, 22 bp, Homo sapiens
attcagtttcatggcacagcta

SEQ ID NO: 8358320 - DNA, 22 bp, Homo sapiens
attcatacaggctttgctctta

SEQ ID NO: 8358321 - DNA, 22 bp, Homo sapiens
attcataacggcaaatgtcacc

SEQ ID NO: 8358322 - DNA, 22 bp, Homo sapiens
attcataacggcaaatgtcacc

SEQ ID NO: 8358323 - DNA, 22 bp, Homo sapiens
attcatcagctaatggacattt

SEQ ID NO: 8358324 - DNA, 22 bp, Homo sapiens
attcatatcatagagttattga

SEQ ID NO: 8358325 - DNA, 22 bp, Homo sapiens
attcatcagctaatggacattt

SEQ ID NO: 8358326 - DNA, 19 bp, Homo sapiens
attcacatccctgggaagg

SEQ ID NO: 8358327 - DNA, 22 bp, Homo sapiens
attcacatgatgtatgtagggc

SEQ ID NO: 8358328 - DNA, 20 bp, Homo sapiens
attcacatataccagggagg

SEQ ID NO: 8358329 - DNA, 22 bp, Homo sapiens
gcacggcaagacggggcctcct

SEQ ID NO: 8358330 - DNA, 22 bp, Homo sapiens
gcacctttctatattcagtggc

SEQ ID NO: 8358331 - DNA, 22 bp, Homo sapiens
gcacgaggcaccgctgttttgt

SEQ ID NO: 8358332 - DNA, 22 bp, Homo sapiens
attcacattctagggccctact

SEQ ID NO: 8358333 - DNA, 22 bp, Homo sapiens
attcacatgttgaagccctaac

SEQ ID NO: 8358334 - DNA, 22 bp, Homo sapiens
attcacattgagcttcactgtg

SEQ ID NO: 8358335 - DNA, 22 bp, Homo sapiens
attcacatgcccaagcagcacc

SEQ ID NO: 8358336 - DNA, 22 bp, Homo sapiens
attcacatgtgcttcttatcac

SEQ ID NO: 8358337 - DNA, 22 bp, Homo sapiens
attcacatgtgcttcttatcac

SEQ ID NO: 8358338 - DNA, 22 bp, Homo sapiens
attcacatttagcctctgacat

SEQ ID NO: 8358339 - DNA, 22 bp, Homo sapiens
attcacatttagacatcaggta

SEQ ID NO: 8358340 - DNA, 22 bp, Homo sapiens
attcacatttacaaagcactca

SEQ ID NO: 8358341 - DNA, 15 bp, Homo sapiens
attcacattgcttca

SEQ ID NO: 8358342 - DNA, 22 bp, Homo sapiens
attcacattttatttcactgga

SEQ ID NO: 8358343 - DNA, 22 bp, Homo sapiens
attcacatttagcctctgacat

SEQ ID NO: 8358344 - DNA, 22 bp, Homo sapiens
attcacccacgtcttagtctgt

SEQ ID NO: 8358345 - DNA, 22 bp, Homo sapiens
attcagaaagggttgcctggtt

SEQ ID NO: 8358346 - DNA, 22 bp, Homo sapiens
attcagaaagttgtcatatttg

SEQ ID NO: 8358347 - DNA, 22 bp, Homo sapiens
attcagaaatagaaaatttgat

SEQ ID NO: 8358348 - DNA, 22 bp, Homo sapiens
attcagaaagcaagtgctgggt

SEQ ID NO: 8358349 - DNA, 21 bp, Homo sapiens
attcagaaagggaataaactc

SEQ ID NO: 8358350 - DNA, 22 bp, Homo sapiens
attcagaaagatatgcctggtt

SEQ ID NO: 8358351 - DNA, 22 bp, Homo sapiens
attcagaaactctgggcagaac

SEQ ID NO: 8358352 - DNA, 22 bp, Homo sapiens
attcaccccctatttgcaatgc

SEQ ID NO: 8358353 - DNA, 22 bp, Homo sapiens
attcaaagtaataaccagaact

SEQ ID NO: 8358354 - DNA, 22 bp, Homo sapiens
attagtgactctcacatatgcc

SEQ ID NO: 8358355 - DNA, 22 bp, Homo sapiens
attcaactatgtatagtcttct

SEQ ID NO: 8358356 - DNA, 22 bp, Homo sapiens
attcaactgtaaacttgttcac

SEQ ID NO: 8358357 - DNA, 22 bp, Homo sapiens
attcaaagtctagatgtagtgt

SEQ ID NO: 8358358 - DNA, 22 bp, Homo sapiens
attcaaagtactagctattttt

SEQ ID NO: 8358359 - DNA, 22 bp, Homo sapiens
attcaaagtagatgaagtttca

SEQ ID NO: 8358360 - DNA, 22 bp, Homo sapiens
attcaaatgtcaaatccaccag

SEQ ID NO: 8358361 - DNA, 22 bp, Homo sapiens
attaggaagtaagtatcacaag

SEQ ID NO: 8358362 - DNA, 22 bp, Homo sapiens
attaggaagaggatgtcagcat

SEQ ID NO: 8358363 - DNA, 22 bp, Homo sapiens
attaggaaactgaatgtcagaa

SEQ ID NO: 8358364 - DNA, 22 bp, Homo sapiens
attagtcagtatttgtttgcca

SEQ ID NO: 8358365 - DNA, 22 bp, Homo sapiens
gatatttaactctcacaggtcc

SEQ ID NO: 8358366 - DNA, 22 bp, Homo sapiens
gatatgtattgaatgatcattt

SEQ ID NO: 8358367 - DNA, 22 bp, Homo sapiens
attacatatgttggcaacattt

SEQ ID NO: 8358368 - DNA, 21 bp, Homo sapiens
attacatccctggtgatacat

SEQ ID NO: 8358369 - DNA, 22 bp, Homo sapiens
attacatgagagaatgtaaata

SEQ ID NO: 8358370 - DNA, 22 bp, Homo sapiens
gatttccaggtcattaataaag

SEQ ID NO: 8358371 - DNA, 22 bp, Homo sapiens
gatttccaggtcattaataaag

SEQ ID NO: 8358372 - DNA, 23 bp, Homo sapiens
attagaaaggctttctggtgaaa

SEQ ID NO: 8358373 - DNA, 22 bp, Homo sapiens
attagaaaccaagaggcaggct

SEQ ID NO: 8358374 - DNA, 23 bp, Homo sapiens
attagaaaggctttctggtgaaa

SEQ ID NO: 8358375 - DNA, 22 bp, Homo sapiens
attagaaaatctggaggtgggg

SEQ ID NO: 8358376 - DNA, 22 bp, Homo sapiens
attagaaaatacatgggctgtc

SEQ ID NO: 8358377 - DNA, 22 bp, Homo sapiens
attagaaaatacatgggctgtc

SEQ ID NO: 8358378 - DNA, 22 bp, Homo sapiens
attagaaaaactcaagggctct

SEQ ID NO: 8358379 - DNA, 22 bp, Homo sapiens
attagaaaaactcaagggctct

SEQ ID NO: 8358380 - DNA, 22 bp, Homo sapiens
attactgtgactagccatctgg

SEQ ID NO: 8358381 - DNA, 22 bp, Homo sapiens
gatttctcaatcctagtactat

SEQ ID NO: 8358382 - DNA, 22 bp, Homo sapiens
caaataattactatcctcactt

SEQ ID NO: 8358383 - DNA, 22 bp, Homo sapiens
caaatactaaacataagatttt

SEQ ID NO: 8358384 - DNA, 22 bp, Homo sapiens
caaatactaaacataagatttt

SEQ ID NO: 8358385 - DNA, 22 bp, Homo sapiens
caaatactacgattcttgcagt

SEQ ID NO: 8358386 - DNA, 22 bp, Homo sapiens
caaaggacccataattaaaacc

SEQ ID NO: 8358387 - DNA, 22 bp, Homo sapiens
caaagccctggaaagatgaaga

SEQ ID NO: 8358388 - DNA, 22 bp, Homo sapiens
caaagctataaattcagacaga

SEQ ID NO: 8358389 - DNA, 22 bp, Homo sapiens
caaagctgacgaggtcagcatc

SEQ ID NO: 8358390 - DNA, 22 bp, Homo sapiens
caaagctgtgaattcctacaaa

SEQ ID NO: 8358391 - DNA, 22 bp, Homo sapiens
caaaggaaatactaatctggaa

SEQ ID NO: 8358392 - DNA, 22 bp, Homo sapiens
caaaggaagctccttgatggcg

SEQ ID NO: 8358393 - DNA, 22 bp, Homo sapiens
caaagctgtgaattcctacaaa

SEQ ID NO: 8358394 - DNA, 22 bp, Homo sapiens
caaatacttttagcctattgag

SEQ ID NO: 8358395 - DNA, 21 bp, Homo sapiens
caaatacttagaaacttaaga

SEQ ID NO: 8358396 - DNA, 21 bp, Homo sapiens
caaatacttagaaacttaaga

SEQ ID NO: 8358397 - DNA, 21 bp, Homo sapiens
caaatacttagaaacttaaga

SEQ ID NO: 8358398 - DNA, 22 bp, Homo sapiens
caaatactttatatacttcaaa

SEQ ID NO: 8358399 - DNA, 22 bp, Homo sapiens
caaatacttttagcctattgag

SEQ ID NO: 8358400 - DNA, 22 bp, Homo sapiens
caaatactgtactgaacactgt

SEQ ID NO: 8358401 - DNA, 22 bp, Homo sapiens
caaatactgtactgaacactgt

SEQ ID NO: 8358402 - DNA, 22 bp, Homo sapiens
caaatacttactgaacctgtgc

SEQ ID NO: 8358403 - DNA, 22 bp, Homo sapiens
caaatacttactgaacctgtgc

SEQ ID NO: 8358404 - DNA, 18 bp, Homo sapiens
caaatactgttgtcttat

SEQ ID NO: 8358405 - DNA, 18 bp, Homo sapiens
caaatactgttgtcttat

SEQ ID NO: 8358406 - DNA, 22 bp, Homo sapiens
caaatactgagtttattttcaa

SEQ ID NO: 8358407 - DNA, 22 bp, Homo sapiens
caaatactgagtttattttcaa

SEQ ID NO: 8358408 - DNA, 22 bp, Homo sapiens
caaatactgagcacgcaatcaa

SEQ ID NO: 8358409 - DNA, 22 bp, Homo sapiens
caaatactctggatgtgtttgt

SEQ ID NO: 8358410 - DNA, 22 bp, Homo sapiens
caaatactctggatgtgtttgt

SEQ ID NO: 8358411 - DNA, 22 bp, Homo sapiens
caaatggcaacaagaacactgg

SEQ ID NO: 8358412 - DNA, 21 bp, Homo sapiens
caaatgctggctggatgagga

SEQ ID NO: 8358413 - DNA, 22 bp, Homo sapiens
caaatgctatgattttgagttt

SEQ ID NO: 8358414 - DNA, 22 bp, Homo sapiens
caaatgctactaataggcaagt

SEQ ID NO: 8358415 - DNA, 22 bp, Homo sapiens
caaatgctactaataggcaagt

SEQ ID NO: 8358416 - DNA, 22 bp, Homo sapiens
gctcttgggggacagatggagt

SEQ ID NO: 8358417 - DNA, 22 bp, Homo sapiens
gctcttgtcaaaaattagttga

SEQ ID NO: 8358418 - DNA, 22 bp, Homo sapiens
attttgtttcctttggagtaga

SEQ ID NO: 8358419 - DNA, 22 bp, Homo sapiens
atttttatgacaaaccatcctc

SEQ ID NO: 8358420 - DNA, 22 bp, Homo sapiens
atttttcaactttggaaatggc

SEQ ID NO: 8358421 - DNA, 22 bp, Homo sapiens
atttttcagcttcattgaggca

SEQ ID NO: 8358422 - DNA, 22 bp, Homo sapiens
attttactttgtgaatattgac

SEQ ID NO: 8358423 - DNA, 22 bp, Homo sapiens
attttactttgtgaatattgac

SEQ ID NO: 8358424 - DNA, 22 bp, Homo sapiens
attttgctttatgtaaatatgt

SEQ ID NO: 8358425 - DNA, 22 bp, Homo sapiens
attttgctgtggtacattagga

SEQ ID NO: 8358426 - DNA, 22 bp, Homo sapiens
caaaagcagttctatctgagtt

SEQ ID NO: 8358427 - DNA, 22 bp, Homo sapiens
atttttgagctgtgaacatagc

SEQ ID NO: 8358428 - DNA, 22 bp, Homo sapiens
atttttgagctgtgaacatagc

SEQ ID NO: 8358429 - DNA, 19 bp, Homo sapiens
atttttcttcctctgtgca

SEQ ID NO: 8358430 - DNA, 19 bp, Homo sapiens
atttttcttcctctgtgca

SEQ ID NO: 8358431 - DNA, 22 bp, Homo sapiens
atttttctctttccactgagat

SEQ ID NO: 8358432 - DNA, 22 bp, Homo sapiens
atttttctctttccactgagat

SEQ ID NO: 8358433 - DNA, 22 bp, Homo sapiens
atttttctctcacacttaccag

SEQ ID NO: 8358434 - DNA, 22 bp, Homo sapiens
atttttctctccactccattaa

SEQ ID NO: 8358435 - DNA, 22 bp, Homo sapiens
caaaatgatgtgattttattgt

SEQ ID NO: 8358436 - DNA, 22 bp, Homo sapiens
caaaattagaaatgcagctgtt

SEQ ID NO: 8358437 - DNA, 22 bp, Homo sapiens
caaaatgttctggcacctttaa

SEQ ID NO: 8358438 - DNA, 22 bp, Homo sapiens
caaaattagaaatgcagctgtt

SEQ ID NO: 8358439 - DNA, 22 bp, Homo sapiens
caaaattctgcatttctaataa

SEQ ID NO: 8358440 - DNA, 22 bp, Homo sapiens
caaaattagggagtgagctgga

SEQ ID NO: 8358441 - DNA, 22 bp, Homo sapiens
caaacaatttgcatttccttag

SEQ ID NO: 8358442 - DNA, 22 bp, Homo sapiens
caaaattgatgaatgtatgatt

SEQ ID NO: 8358443 - DNA, 22 bp, Homo sapiens
caaacaatttgcatttccttag

SEQ ID NO: 8358444 - DNA, 18 bp, Homo sapiens
caaagcaggtgacagtgt

SEQ ID NO: 8358445 - DNA, 21 bp, Homo sapiens
caaagccaggcaactctctcc

SEQ ID NO: 8358446 - DNA, 22 bp, Homo sapiens
caaagcagttttaatcaagtag

SEQ ID NO: 8358447 - DNA, 22 bp, Homo sapiens
caaagccaggctttctaatgta

SEQ ID NO: 8358448 - DNA, 22 bp, Homo sapiens
caaacattcagatgcaatggta

SEQ ID NO: 8358449 - DNA, 22 bp, Homo sapiens
atttccatgaattcccactcat

SEQ ID NO: 8358450 - DNA, 22 bp, Homo sapiens
atttccatgccttagcttaagg

SEQ ID NO: 8358451 - DNA, 22 bp, Homo sapiens
atttccatgaaggcagatttta

SEQ ID NO: 8358452 - DNA, 22 bp, Homo sapiens
atttccatcatcattaggccta

SEQ ID NO: 8358453 - DNA, 22 bp, Homo sapiens
atttccatgtcggtattttata

SEQ ID NO: 8358454 - DNA, 22 bp, Homo sapiens
atttccattatcatgacaaatt

SEQ ID NO: 8358455 - DNA, 22 bp, Homo sapiens
atttccattttcagccattact

SEQ ID NO: 8358456 - DNA, 22 bp, Homo sapiens
atttccattttcagccattact

SEQ ID NO: 8358457 - DNA, 22 bp, Homo sapiens
gcccacagtctatcagtttgcg

SEQ ID NO: 8358458 - DNA, 21 bp, Homo sapiens
gcccacagtgaggaggatccc

SEQ ID NO: 8358459 - DNA, 23 bp, Homo sapiens
gcccaccctcagcgtcctcacgg

SEQ ID NO: 8358460 - DNA, 17 bp, Homo sapiens
gcccccagaaatctcag

SEQ ID NO: 8358461 - DNA, 22 bp, Homo sapiens
atttctgttgcttataaattac

SEQ ID NO: 8358462 - DNA, 22 bp, Homo sapiens
atttctgttatacctttctcag

SEQ ID NO: 8358463 - DNA, 22 bp, Homo sapiens
atttctggctgttggaaagttc

SEQ ID NO: 8358464 - DNA, 22 bp, Homo sapiens
atttctgccaaagtggggacct

SEQ ID NO: 8358465 - DNA, 22 bp, Homo sapiens
atttctcagtgtgatcaggcct

SEQ ID NO: 8358466 - DNA, 22 bp, Homo sapiens
gcccacctaacctgctcacctt

SEQ ID NO: 8358467 - DNA, 22 bp, Homo sapiens
atttctcagtgtacattatgtt

SEQ ID NO: 8358468 - DNA, 22 bp, Homo sapiens
atttctcagtgtacattatgtt

SEQ ID NO: 8358469 - DNA, 22 bp, Homo sapiens
gcccacctaacctgctcacctt

SEQ ID NO: 8358470 - DNA, 22 bp, Homo sapiens
gccacaggtactatgggagaga

SEQ ID NO: 8358471 - DNA, 22 bp, Homo sapiens
gccacagtcactgctgcagggg

SEQ ID NO: 8358472 - DNA, 22 bp, Homo sapiens
gccacagtcactgctgcagggg

SEQ ID NO: 8358473 - DNA, 22 bp, Homo sapiens
gccaggctggaaagaacagaca

SEQ ID NO: 8358474 - DNA, 22 bp, Homo sapiens
atttccagtgcactgaatagaa

SEQ ID NO: 8358475 - DNA, 22 bp, Homo sapiens
atttccagtacccagaacagag

SEQ ID NO: 8358476 - DNA, 22 bp, Homo sapiens
atttcatgtttcatctacctaa

SEQ ID NO: 8358477 - DNA, 22 bp, Homo sapiens
atttcatgttgatctttcgagg

SEQ ID NO: 8358478 - DNA, 22 bp, Homo sapiens
gccaggtgctatccctgcgctg

SEQ ID NO: 8358479 - DNA, 22 bp, Homo sapiens
gcctgaagtttcatgcctctat

SEQ ID NO: 8358480 - DNA, 22 bp, Homo sapiens
gcctgaaggagtcagagagggc

SEQ ID NO: 8358481 - DNA, 22 bp, Homo sapiens
gcctgaagctggaataattgta

SEQ ID NO: 8358482 - DNA, 22 bp, Homo sapiens
gcctgagaaggacacagcaggt

SEQ ID NO: 8358483 - DNA, 22 bp, Homo sapiens
atttggaagcttgaagattatt

SEQ ID NO: 8358484 - DNA, 22 bp, Homo sapiens
atttggaagcttgaagattatt

SEQ ID NO: 8358485 - DNA, 22 bp, Homo sapiens
atttggaaggagctgcacagca

SEQ ID NO: 8358486 - DNA, 22 bp, Homo sapiens
atttggaaggagctgcacagca

SEQ ID NO: 8358487 - DNA, 22 bp, Homo sapiens
atttggaagcatttccaaagca

SEQ ID NO: 8358488 - DNA, 22 bp, Homo sapiens
atttggaagcatttccaaagca

SEQ ID NO: 8358489 - DNA, 22 bp, Homo sapiens
atttggaagtttggagtgaagg

SEQ ID NO: 8358490 - DNA, 22 bp, Homo sapiens
atttggaagtttggagtgaagg

SEQ ID NO: 8358491 - DNA, 22 bp, Homo sapiens
atttggaatagctgtagaaata

SEQ ID NO: 8358492 - DNA, 22 bp, Homo sapiens
atttggaatagctgtagaaata

SEQ ID NO: 8358493 - DNA, 22 bp, Homo sapiens
atttggaagtttttgtgggaat

SEQ ID NO: 8358494 - DNA, 22 bp, Homo sapiens
atttggaagtttttgtgggaat

SEQ ID NO: 8358495 - DNA, 22 bp, Homo sapiens
atttggaaggtttacaaagaga

SEQ ID NO: 8358496 - DNA, 22 bp, Homo sapiens
atttggaaggcgtttctctgta

SEQ ID NO: 8358497 - DNA, 22 bp, Homo sapiens
atttggaaggcgtttctctgta

SEQ ID NO: 8358498 - DNA, 22 bp, Homo sapiens
atttggaaggtttacaaagaga

SEQ ID NO: 8358499 - DNA, 22 bp, Homo sapiens
attttacttagtgtaatgtcca

SEQ ID NO: 8358500 - DNA, 22 bp, Homo sapiens
gcctggcaatggcctcaggaag

SEQ ID NO: 8358501 - DNA, 22 bp, Homo sapiens
atttggaatgctagtgaatgta

SEQ ID NO: 8358502 - DNA, 22 bp, Homo sapiens
atttggaatgctagtgaatgta

SEQ ID NO: 8358503 - DNA, 22 bp, Homo sapiens
atttggaatgggagcctggcat

SEQ ID NO: 8358504 - DNA, 22 bp, Homo sapiens
atttggaatgtgtttgatcacc

SEQ ID NO: 8358505 - DNA, 22 bp, Homo sapiens
atttggaatggtctggcatttg

SEQ ID NO: 8358506 - DNA, 22 bp, Homo sapiens
atttggaatggtctggcatttg

SEQ ID NO: 8358507 - DNA, 22 bp, Homo sapiens
atttggaatgggagcctggcat

SEQ ID NO: 8358508 - DNA, 22 bp, Homo sapiens
gcctggagttgtggtgaagcca

SEQ ID NO: 8358509 - DNA, 22 bp, Homo sapiens
atttggaaaagtttcttcaact

SEQ ID NO: 8358510 - DNA, 22 bp, Homo sapiens
atttggaaaagtttcttcaact

SEQ ID NO: 8358511 - DNA, 22 bp, Homo sapiens
atttggaaaagcggtaacttgc

SEQ ID NO: 8358512 - DNA, 22 bp, Homo sapiens
atttggaaaagcggtaacttgc

SEQ ID NO: 8358513 - DNA, 22 bp, Homo sapiens
atttggaaacaattatattctt

SEQ ID NO: 8358514 - DNA, 22 bp, Homo sapiens
atttggaaacaaatggtttcgc

SEQ ID NO: 8358515 - DNA, 22 bp, Homo sapiens
atttggaaacaattatattctt

SEQ ID NO: 8358516 - DNA, 22 bp, Homo sapiens
atttggaaacaaatggtttcgc

SEQ ID NO: 8358517 - DNA, 22 bp, Homo sapiens
atttggaaaatctggttataga

SEQ ID NO: 8358518 - DNA, 22 bp, Homo sapiens
atttggaaaatctggttataga

SEQ ID NO: 8358519 - DNA, 22 bp, Homo sapiens
atttggaaatgcatctcttgag

SEQ ID NO: 8358520 - DNA, 22 bp, Homo sapiens
atttggaaatacgcgcttttgg

SEQ ID NO: 8358521 - DNA, 19 bp, Homo sapiens
atttggaaataaggtcttc

SEQ ID NO: 8358522 - DNA, 22 bp, Homo sapiens
atttggaaatacgcgcttttgg

SEQ ID NO: 8358523 - DNA, 22 bp, Homo sapiens
atttggaaacatgctgaccatg

SEQ ID NO: 8358524 - DNA, 22 bp, Homo sapiens
atttggaaacatgctgaccatg

SEQ ID NO: 8358525 - DNA, 19 bp, Homo sapiens
atttggaaataaggtcttc

SEQ ID NO: 8358526 - DNA, 22 bp, Homo sapiens
gcccccagctctcaagctcaaa

SEQ ID NO: 8358527 - DNA, 22 bp, Homo sapiens
gcccccaggctctggagaacct

SEQ ID NO: 8358528 - DNA, 22 bp, Homo sapiens
gcccccagaagggccacagatt

SEQ ID NO: 8358529 - DNA, 22 bp, Homo sapiens
gcccccagagaatgaggtacga

SEQ ID NO: 8358530 - DNA, 22 bp, Homo sapiens
gcctcttgtttccttacatgga

SEQ ID NO: 8358531 - DNA, 19 bp, Homo sapiens
gcctatgtcttcaaatcat

SEQ ID NO: 8358532 - DNA, 22 bp, Homo sapiens
gcctattttattatgcatgtaa

SEQ ID NO: 8358533 - DNA, 22 bp, Homo sapiens
gcctcaaatgtggagcactatt

SEQ ID NO: 8358534 - DNA, 22 bp, Homo sapiens
atttggaactgggcatgcaaac

SEQ ID NO: 8358535 - DNA, 22 bp, Homo sapiens
atttggaactgggcatgcaaac

SEQ ID NO: 8358536 - DNA, 22 bp, Homo sapiens
atttggaacttataataagttt

SEQ ID NO: 8358537 - DNA, 22 bp, Homo sapiens
atttggaacttataataagttt

SEQ ID NO: 8358538 - DNA, 22 bp, Homo sapiens
atttggaaatgtaagaatgcaa

SEQ ID NO: 8358539 - DNA, 22 bp, Homo sapiens
atttggaaatgcatctcttgag

SEQ ID NO: 8358540 - DNA, 22 bp, Homo sapiens
atttggaaatgtaagaatgcaa

SEQ ID NO: 8358541 - DNA, 22 bp, Homo sapiens
atttggaacaaatattagtaaa

SEQ ID NO: 8358542 - DNA, 22 bp, Homo sapiens
atttggaacaaatattagtaaa

SEQ ID NO: 8358543 - DNA, 22 bp, Homo sapiens
atttggaagaaatctgtcacag

SEQ ID NO: 8358544 - DNA, 22 bp, Homo sapiens
atttggaagaaatctgtcacag

SEQ ID NO: 8358545 - DNA, 22 bp, Homo sapiens
atgacagtactggtgacaatac

SEQ ID NO: 8358546 - DNA, 22 bp, Homo sapiens
atgacagtactggtgacaatac

SEQ ID NO: 8358547 - DNA, 22 bp, Homo sapiens
atgacagtaggtaaatgatagc

SEQ ID NO: 8358548 - DNA, 22 bp, Homo sapiens
atgacagtgggtcttgcaaaga

SEQ ID NO: 8358549 - DNA, 22 bp, Homo sapiens
atgacagtgggtcttgcaaaga

SEQ ID NO: 8358550 - DNA, 22 bp, Homo sapiens
gaaacatttgttgagtacttgc

SEQ ID NO: 8358551 - DNA, 22 bp, Homo sapiens
gaaacatttgttgagtacttgc

SEQ ID NO: 8358552 - DNA, 22 bp, Homo sapiens
gaaacatttgttgagtacttgc

SEQ ID NO: 8358553 - DNA, 22 bp, Homo sapiens
gaaaccacagtacccaggaaaa

SEQ ID NO: 8358554 - DNA, 22 bp, Homo sapiens
gaaaccacagtacccaggaaaa

SEQ ID NO: 8358555 - DNA, 22 bp, Homo sapiens
gaaacagtcaactttctttccc

SEQ ID NO: 8358556 - DNA, 22 bp, Homo sapiens
gaaacagtgagaacttttcctg

SEQ ID NO: 8358557 - DNA, 22 bp, Homo sapiens
gaaacattcatatgagaaacct

SEQ ID NO: 8358558 - DNA, 22 bp, Homo sapiens
gaaacattcatatgagaaacct

SEQ ID NO: 8358559 - DNA, 22 bp, Homo sapiens
gaaacattgtgttctacagatt

SEQ ID NO: 8358560 - DNA, 22 bp, Homo sapiens
gaaacattgtgttctacagatt

SEQ ID NO: 8358561 - DNA, 22 bp, Homo sapiens
gaaacattggtctgccccttat

SEQ ID NO: 8358562 - DNA, 20 bp, Homo sapiens
gaaacattggcagcaactga

SEQ ID NO: 8358563 - DNA, 20 bp, Homo sapiens
gaaacattggcagcaactga

SEQ ID NO: 8358564 - DNA, 20 bp, Homo sapiens
gaaacattggcagcaactga

SEQ ID NO: 8358565 - DNA, 22 bp, Homo sapiens
gaaacattcatatgagaaacct

SEQ ID NO: 8358566 - DNA, 22 bp, Homo sapiens
gaaacattgagcagaaggagaa

SEQ ID NO: 8358567 - DNA, 22 bp, Homo sapiens
gaaagtaacatttcttgaatta

SEQ ID NO: 8358568 - DNA, 22 bp, Homo sapiens
gaaagtatttacattaacatct

SEQ ID NO: 8358569 - DNA, 19 bp, Homo sapiens
gaaagtcatagagcttgtc

SEQ ID NO: 8358570 - DNA, 22 bp, Homo sapiens
gaaatactgtaaagttattatt

SEQ ID NO: 8358571 - DNA, 22 bp, Homo sapiens
gaaatactgtaaagttattatt

SEQ ID NO: 8358572 - DNA, 22 bp, Homo sapiens
gaaatactgcacaccctgtaag

SEQ ID NO: 8358573 - DNA, 22 bp, Homo sapiens
atgatgaaactaggaactagag

SEQ ID NO: 8358574 - DNA, 22 bp, Homo sapiens
atgatctcattctttcaaaggg

SEQ ID NO: 8358575 - DNA, 22 bp, Homo sapiens
gaaatttattatctacatcatt

SEQ ID NO: 8358576 - DNA, 22 bp, Homo sapiens
gaaatttattatctacatcatt

SEQ ID NO: 8358577 - DNA, 22 bp, Homo sapiens
atgatattttagtaaagtgata

SEQ ID NO: 8358578 - DNA, 22 bp, Homo sapiens
atgatatttgcaatgtgcttgc

SEQ ID NO: 8358579 - DNA, 22 bp, Homo sapiens
atgaacattaaaatggtagaat

SEQ ID NO: 8358580 - DNA, 22 bp, Homo sapiens
atgaagaaaaatccagctgtcc

SEQ ID NO: 8358581 - DNA, 22 bp, Homo sapiens
ctttctcttgagcaagagctgt

SEQ ID NO: 8358582 - DNA, 22 bp, Homo sapiens
ctttctcttgagcaagagctgt

SEQ ID NO: 8358583 - DNA, 22 bp, Homo sapiens
ctttctgaaagacattttaact

SEQ ID NO: 8358584 - DNA, 22 bp, Homo sapiens
ctttctcttcgaaaacctgccc

SEQ ID NO: 8358585 - DNA, 22 bp, Homo sapiens
ctttctcttcgaaaacctgccc

SEQ ID NO: 8358586 - DNA, 22 bp, Homo sapiens
ctttctggagtggaaaggtatt

SEQ ID NO: 8358587 - DNA, 22 bp, Homo sapiens
atgaaaatgtacatgtgtataa

SEQ ID NO: 8358588 - DNA, 22 bp, Homo sapiens
atgaaaatgtacatgtgtataa

SEQ ID NO: 8358589 - DNA, 22 bp, Homo sapiens
atgaaaagttcgatctagaagg

SEQ ID NO: 8358590 - DNA, 22 bp, Homo sapiens
atgaaaatactgtggttgatag

SEQ ID NO: 8358591 - DNA, 22 bp, Homo sapiens
atgaaaatgtacatgtgtataa

SEQ ID NO: 8358592 - DNA, 22 bp, Homo sapiens
atgaaaattgacagcggaagta

SEQ ID NO: 8358593 - DNA, 22 bp, Homo sapiens
atgaaacagagtacttaatata

SEQ ID NO: 8358594 - DNA, 22 bp, Homo sapiens
atgaaattaatcaacacataca

SEQ ID NO: 8358595 - DNA, 22 bp, Homo sapiens
cttctttaatgtatacaaaaga

SEQ ID NO: 8358596 - DNA, 22 bp, Homo sapiens
cttctttactttctagaaataa

SEQ ID NO: 8358597 - DNA, 22 bp, Homo sapiens
cttctttaccaagagatagagt

SEQ ID NO: 8358598 - DNA, 22 bp, Homo sapiens
cttctttaatgtatacaaaaga

SEQ ID NO: 8358599 - DNA, 22 bp, Homo sapiens
cttctttactttctagaaataa

SEQ ID NO: 8358600 - DNA, 22 bp, Homo sapiens
atctggctatttctggtcgggg

SEQ ID NO: 8358601 - DNA, 22 bp, Homo sapiens
atctggctattgacatgttata

SEQ ID NO: 8358602 - DNA, 22 bp, Homo sapiens
atctggctcacttagtctagga

SEQ ID NO: 8358603 - DNA, 22 bp, Homo sapiens
ctttcaaagaccttggcatggg

SEQ ID NO: 8358604 - DNA, 22 bp, Homo sapiens
ctttccagtttctaagtacagt

SEQ ID NO: 8358605 - DNA, 22 bp, Homo sapiens
ctttcccttagccccattctat

SEQ ID NO: 8358606 - DNA, 22 bp, Homo sapiens
ctttcccttagccccattctat

SEQ ID NO: 8358607 - DNA, 22 bp, Homo sapiens
ctttccctgcttagaaggattt

SEQ ID NO: 8358608 - DNA, 22 bp, Homo sapiens
ctttccccaagcaccacagtgc

SEQ ID NO: 8358609 - DNA, 22 bp, Homo sapiens
ctttcccttagccccattctat

SEQ ID NO: 8358610 - DNA, 22 bp, Homo sapiens
ctttcccttttgccttgcgtgg

SEQ ID NO: 8358611 - DNA, 22 bp, Homo sapiens
ctttcctagaaatatatactta

SEQ ID NO: 8358612 - DNA, 22 bp, Homo sapiens
atgaaaagttcgatctagaagg

SEQ ID NO: 8358613 - DNA, 22 bp, Homo sapiens
ctttcctagatggccatctttc

SEQ ID NO: 8358614 - DNA, 22 bp, Homo sapiens
atgcacacacattatgtctgtg

SEQ ID NO: 8358615 - DNA, 22 bp, Homo sapiens
gaaggctgtttctggtagtgat

SEQ ID NO: 8358616 - DNA, 22 bp, Homo sapiens
gaaggcttagaaacaagggagc

SEQ ID NO: 8358617 - DNA, 16 bp, Homo sapiens
gaaggcttactgcagg

SEQ ID NO: 8358618 - DNA, 22 bp, Homo sapiens
gaaggcttatgtgtgactttcg

SEQ ID NO: 8358619 - DNA, 22 bp, Homo sapiens
gaaggctgtcagagaggagggc

SEQ ID NO: 8358620 - DNA, 22 bp, Homo sapiens
gaaggctgtcagagaggagggc

SEQ ID NO: 8358621 - DNA, 16 bp, Homo sapiens
gaaggctgggtgatcc

SEQ ID NO: 8358622 - DNA, 22 bp, Homo sapiens
gaaggctgctgggaagtgtggt

SEQ ID NO: 8358623 - DNA, 22 bp, Homo sapiens
gaaggctgctgggaagtgtggt

SEQ ID NO: 8358624 - DNA, 22 bp, Homo sapiens
gaaggctggaaggcaagtagga

SEQ ID NO: 8358625 - DNA, 22 bp, Homo sapiens
gaaggctggctttctgagagca

SEQ ID NO: 8358626 - DNA, 22 bp, Homo sapiens
gaaatttattatctacatcatt

SEQ ID NO: 8358627 - DNA, 22 bp, Homo sapiens
gaaatttattatctacatcatt

SEQ ID NO: 8358628 - DNA, 22 bp, Homo sapiens
gaacaaatcccttcctgtctcc

SEQ ID NO: 8358629 - DNA, 22 bp, Homo sapiens
gaataatattgactttgcaggc

SEQ ID NO: 8358630 - DNA, 22 bp, Homo sapiens
gaataatattgactttgcaggc

SEQ ID NO: 8358631 - DNA, 22 bp, Homo sapiens
gaataatagcagaaattagcag

SEQ ID NO: 8358632 - DNA, 22 bp, Homo sapiens
gaataatagcagaaattagcag

SEQ ID NO: 8358633 - DNA, 22 bp, Homo sapiens
atgcacagtaatgagctggttg

SEQ ID NO: 8358634 - DNA, 22 bp, Homo sapiens
gaatacaaacttaaggctttac

SEQ ID NO: 8358635 - DNA, 22 bp, Homo sapiens
gaataatcatatcgtctcacat

SEQ ID NO: 8358636 - DNA, 22 bp, Homo sapiens
gaataattgtgatgcttgaagt

SEQ ID NO: 8358637 - DNA, 22 bp, Homo sapiens
gaataattttgatcagaaggga

SEQ ID NO: 8358638 - DNA, 22 bp, Homo sapiens
gaatatttttaaagggactaat

SEQ ID NO: 8358639 - DNA, 22 bp, Homo sapiens
gaatcagaatctctaaggtggg

SEQ ID NO: 8358640 - DNA, 22 bp, Homo sapiens
gaatcacactcgtaagtgagtt

SEQ ID NO: 8358641 - DNA, 22 bp, Homo sapiens
gaatcagataataagcaagcat

SEQ ID NO: 8358642 - DNA, 19 bp, Homo sapiens
gaattttaggacttcagca

SEQ ID NO: 8358643 - DNA, 19 bp, Homo sapiens
gaattttaggacttcagca

SEQ ID NO: 8358644 - DNA, 22 bp, Homo sapiens
gaattttatcttattacttgca

SEQ ID NO: 8358645 - DNA, 22 bp, Homo sapiens
atgctattttacataggaatgg

SEQ ID NO: 8358646 - DNA, 22 bp, Homo sapiens
atgctattgaaaagaaataaga

SEQ ID NO: 8358647 - DNA, 22 bp, Homo sapiens
atgctattccagaatgtaaatt

SEQ ID NO: 8358648 - DNA, 22 bp, Homo sapiens
atgctccttggcttcaaagcca

SEQ ID NO: 8358649 - DNA, 22 bp, Homo sapiens
atgctcctcgagtgtctcacag

SEQ ID NO: 8358650 - DNA, 22 bp, Homo sapiens
atgctcattttattgagaatga

SEQ ID NO: 8358651 - DNA, 22 bp, Homo sapiens
gaccttgtgctccgaggcgggc

SEQ ID NO: 8358652 - DNA, 22 bp, Homo sapiens
gaccttgtgctccgaggcgggc

SEQ ID NO: 8358653 - DNA, 22 bp, Homo sapiens
gactggagtcaatgagcagcac

SEQ ID NO: 8358654 - DNA, 22 bp, Homo sapiens
gactggctctatctccttggcg

SEQ ID NO: 8358655 - DNA, 22 bp, Homo sapiens
gactggctctatcaggataaat

SEQ ID NO: 8358656 - DNA, 22 bp, Homo sapiens
gactggatgttttgaacatgag

SEQ ID NO: 8358657 - DNA, 22 bp, Homo sapiens
gacaattgcttttgccgaataa

SEQ ID NO: 8358658 - DNA, 22 bp, Homo sapiens
gacaatttctcaatatagaaac

SEQ ID NO: 8358659 - DNA, 22 bp, Homo sapiens
gacacaaagtttgtcagaaatt

SEQ ID NO: 8358660 - DNA, 22 bp, Homo sapiens
gacacaaagtttgtcagaaatt

SEQ ID NO: 8358661 - DNA, 21 bp, Homo sapiens
gacacaaagggtagtaatggt

SEQ ID NO: 8358662 - DNA, 22 bp, Homo sapiens
atgctattccagaatgtaaatt

SEQ ID NO: 8358663 - DNA, 22 bp, Homo sapiens
atgctatgtaactggcagatag

SEQ ID NO: 8358664 - DNA, 22 bp, Homo sapiens
gacatttgttcctctaagtgac

SEQ ID NO: 8358665 - DNA, 22 bp, Homo sapiens
gacatttattagaaaactatca

SEQ ID NO: 8358666 - DNA, 22 bp, Homo sapiens
gacatttcaatctcattatggg

SEQ ID NO: 8358667 - DNA, 22 bp, Homo sapiens
gacatttatgaaggagatatgc

SEQ ID NO: 8358668 - DNA, 23 bp, Homo sapiens
atgtagagtacagcacaacagca

SEQ ID NO: 8358669 - DNA, 22 bp, Homo sapiens
atgtagcatctatcctgataaa

SEQ ID NO: 8358670 - DNA, 22 bp, Homo sapiens
atgtagctgcagatgataatgc

SEQ ID NO: 8358671 - DNA, 22 bp, Homo sapiens
atgtagaacaggttaatgacag

SEQ ID NO: 8358672 - DNA, 22 bp, Homo sapiens
atgtagaatggtgattggcagg

SEQ ID NO: 8358673 - DNA, 22 bp, Homo sapiens
atgtagaagtgggcattataga

SEQ ID NO: 8358674 - DNA, 22 bp, Homo sapiens
atgtccttcatctaggagatgg

SEQ ID NO: 8358675 - DNA, 22 bp, Homo sapiens
atgtccttcggacaaaattctt

SEQ ID NO: 8358676 - DNA, 22 bp, Homo sapiens
atgtccttgtgagtaaatgatg

SEQ ID NO: 8358677 - DNA, 22 bp, Homo sapiens
atgtcctttgttctgagggagt

SEQ ID NO: 8358678 - DNA, 22 bp, Homo sapiens
atgtctaaaagataaagtttaa

SEQ ID NO: 8358679 - DNA, 22 bp, Homo sapiens
atgtcgaggctcccctagttat

SEQ ID NO: 8358680 - DNA, 22 bp, Homo sapiens
atgtctagagcaagagatgctg

SEQ ID NO: 8358681 - DNA, 22 bp, Homo sapiens
atgtctatatagtcaataatca

SEQ ID NO: 8358682 - DNA, 22 bp, Homo sapiens
atgtctctctctgagtgccaga

SEQ ID NO: 8358683 - DNA, 22 bp, Homo sapiens
atgtctctcaggtttaacttta

SEQ ID NO: 8358684 - DNA, 22 bp, Homo sapiens
atgtctctcaggtttaacttta

SEQ ID NO: 8358685 - DNA, 19 bp, Homo sapiens
atgtctctgtagcacatac

SEQ ID NO: 8358686 - DNA, 19 bp, Homo sapiens
atgtctctgtagcacatac

SEQ ID NO: 8358687 - DNA, 23 bp, Homo sapiens
atgtctctgggcagtagggcttg

SEQ ID NO: 8358688 - DNA, 22 bp, Homo sapiens
atgtgaaagaggtgttcagtgg

SEQ ID NO: 8358689 - DNA, 20 bp, Homo sapiens
atgtgaaagatcagttgtct

SEQ ID NO: 8358690 - DNA, 22 bp, Homo sapiens
atgtgaaatagctggatatgaa

SEQ ID NO: 8358691 - DNA, 22 bp, Homo sapiens
atgtgacagtgtttgacagatg

SEQ ID NO: 8358692 - DNA, 22 bp, Homo sapiens
atgtgagaataactcaaaacaa

SEQ ID NO: 8358693 - DNA, 22 bp, Homo sapiens
atgtgagaactcaggaaatact

SEQ ID NO: 8358694 - DNA, 18 bp, Homo sapiens
atgtgagagaatcttctt

SEQ ID NO: 8358695 - DNA, 22 bp, Homo sapiens
atgtgagactaaaaagatgtgc

SEQ ID NO: 8358696 - DNA, 22 bp, Homo sapiens
atgtgagatgcacataattata

SEQ ID NO: 8358697 - DNA, 20 bp, Homo sapiens
gaggtagggcttaaggcaag

SEQ ID NO: 8358698 - DNA, 22 bp, Homo sapiens
gaggtagggcagaggctgaatg

SEQ ID NO: 8358699 - DNA, 22 bp, Homo sapiens
atgtgagggaaatcagtcagaa

SEQ ID NO: 8358700 - DNA, 22 bp, Homo sapiens
atgtctctttactcttagaacc

SEQ ID NO: 8358701 - DNA, 22 bp, Homo sapiens
atgtctctttagagcaacagta

SEQ ID NO: 8358702 - DNA, 22 bp, Homo sapiens
gagggctcctcacattctctat

SEQ ID NO: 8358703 - DNA, 22 bp, Homo sapiens
gagggctctgtctggaagggaa

SEQ ID NO: 8358704 - DNA, 20 bp, Homo sapiens
atgttctgtggctgtcatgg

SEQ ID NO: 8358705 - DNA, 22 bp, Homo sapiens
atgttctgtttcttaatcttga

SEQ ID NO: 8358706 - DNA, 22 bp, Homo sapiens
atgttctgtttcttaatcttga

SEQ ID NO: 8358707 - DNA, 22 bp, Homo sapiens
atgttctgcctccattttgagt

SEQ ID NO: 8358708 - DNA, 19 bp, Homo sapiens
atgttctgaattactgtaa

SEQ ID NO: 8358709 - DNA, 19 bp, Homo sapiens
atgttctgaattactgtaa

SEQ ID NO: 8358710 - DNA, 22 bp, Homo sapiens
atgttctgaatcaagcaactct

SEQ ID NO: 8358711 - DNA, 22 bp, Homo sapiens
atgttatttctgaaagatcatt

SEQ ID NO: 8358712 - DNA, 22 bp, Homo sapiens
atgttatttctgaaagatcatt

SEQ ID NO: 8358713 - DNA, 22 bp, Homo sapiens
atgttattttggaaaatacaaa

SEQ ID NO: 8358714 - DNA, 22 bp, Homo sapiens
atgttctgaataatgtgcatta

SEQ ID NO: 8358715 - DNA, 22 bp, Homo sapiens
atgttctgaataatgtgcatta

SEQ ID NO: 8358716 - DNA, 20 bp, Homo sapiens
atgtgtcttagagcatcagg

SEQ ID NO: 8358717 - DNA, 20 bp, Homo sapiens
atgttcttcatttaatgttc

SEQ ID NO: 8358718 - DNA, 22 bp, Homo sapiens
atgttctgttttgtaattcata

SEQ ID NO: 8358719 - DNA, 22 bp, Homo sapiens
atgttcttctatctttattaaa

SEQ ID NO: 8358720 - DNA, 22 bp, Homo sapiens
atgttcttctatctttattaaa

SEQ ID NO: 8358721 - DNA, 22 bp, Homo sapiens
atgttcttggatgttgtgtata

SEQ ID NO: 8358722 - DNA, 22 bp, Homo sapiens
atgttctttgaaatattttaga

SEQ ID NO: 8358723 - DNA, 22 bp, Homo sapiens
atgttctttcagccagtgcatc

SEQ ID NO: 8358724 - DNA, 22 bp, Homo sapiens
atgttctttcagccagtgcatc

SEQ ID NO: 8358725 - DNA, 22 bp, Homo sapiens
atgttctttggaatttatgaaa

SEQ ID NO: 8358726 - DNA, 22 bp, Homo sapiens
gaggtggcactgtgaggagcac

SEQ ID NO: 8358727 - DNA, 22 bp, Homo sapiens
gaggtggcctcaagcagtcttc

SEQ ID NO: 8358728 - DNA, 22 bp, Homo sapiens
gaggtggctccaggagcaatgc

SEQ ID NO: 8358729 - DNA, 22 bp, Homo sapiens
atgtgtctctaccaatgcaatt

SEQ ID NO: 8358730 - DNA, 22 bp, Homo sapiens
atgttgtgtttgactgttaccc

SEQ ID NO: 8358731 - DNA, 22 bp, Homo sapiens
atgtttaaagggttgagaaata

SEQ ID NO: 8358732 - DNA, 22 bp, Homo sapiens
gataatgatgacaatgacaacc

SEQ ID NO: 8358733 - DNA, 22 bp, Homo sapiens
gataatattagaagatacaaat

SEQ ID NO: 8358734 - DNA, 20 bp, Homo sapiens
gataatatttactaggtact

SEQ ID NO: 8358735 - DNA, 20 bp, Homo sapiens
gataatatttactaggtact

SEQ ID NO: 8358736 - DNA, 22 bp, Homo sapiens
gagttcatattcagagatcgct

SEQ ID NO: 8358737 - DNA, 22 bp, Homo sapiens
gataattttggttccaggttgg

SEQ ID NO: 8358738 - DNA, 22 bp, Homo sapiens
gataattttagtctgaaaattg

SEQ ID NO: 8358739 - DNA, 22 bp, Homo sapiens
gatacaaaatataaatggagag

SEQ ID NO: 8358740 - DNA, 22 bp, Homo sapiens
gatacaaattcatgtctgaatt

SEQ ID NO: 8358741 - DNA, 22 bp, Homo sapiens
gatatattttccatggtctgca

SEQ ID NO: 8358742 - DNA, 22 bp, Homo sapiens
gatatgtatgaggagtatgtat

SEQ ID NO: 8358743 - DNA, 18 bp, Homo sapiens
gatatggaaggccatgcc

SEQ ID NO: 8358744 - DNA, 22 bp, Homo sapiens
gatatgtaccacctcttaaaag

SEQ ID NO: 8358745 - DNA, 18 bp, Homo sapiens
gatatggaaggccatgcc

SEQ ID NO: 8358746 - DNA, 22 bp, Homo sapiens
gagagcagactctcaaagctgg

SEQ ID NO: 8358747 - DNA, 22 bp, Homo sapiens
gagagcacggtcttgggcatgg

SEQ ID NO: 8358748 - DNA, 23 bp, Homo sapiens
gagagcaatgagatgtaaacact

SEQ ID NO: 8358749 - DNA, 22 bp, Homo sapiens
gagagaggcctccatgtactga

SEQ ID NO: 8358750 - DNA, 22 bp, Homo sapiens
gagagaggcctccatgtactga

SEQ ID NO: 8358751 - DNA, 23 bp, Homo sapiens
gagagagattgctaaaccactcc

SEQ ID NO: 8358752 - DNA, 22 bp, Homo sapiens
gagagagaagtgggtgtcacct

SEQ ID NO: 8358753 - DNA, 22 bp, Homo sapiens
gagagagacatgtaaacgcggt

SEQ ID NO: 8358754 - DNA, 22 bp, Homo sapiens
atggagggtgtcagagagcgaa

SEQ ID NO: 8358755 - DNA, 22 bp, Homo sapiens
gagatgggcgagaaggtggact

SEQ ID NO: 8358756 - DNA, 22 bp, Homo sapiens
gagatggctctcagatctttga

SEQ ID NO: 8358757 - DNA, 17 bp, Homo sapiens
atggaggcagacaggtc

SEQ ID NO: 8358758 - DNA, 22 bp, Homo sapiens
atggaggatgtgcagcatgggc

SEQ ID NO: 8358759 - DNA, 22 bp, Homo sapiens
atggaggatgtgcagcatgggc

SEQ ID NO: 8358760 - DNA, 18 bp, Homo sapiens
atggaggcagagagctga

SEQ ID NO: 8358761 - DNA, 22 bp, Homo sapiens
atggagggaaaagtggagagcc

SEQ ID NO: 8358762 - DNA, 21 bp, Homo sapiens
atggagggaccagggaagcag

SEQ ID NO: 8358763 - DNA, 22 bp, Homo sapiens
atggagggtggtaagacagaga

SEQ ID NO: 8358764 - DNA, 22 bp, Homo sapiens
atggcttccaaggccctccgtg

SEQ ID NO: 8358765 - DNA, 17 bp, Homo sapiens
atggcttccattgacca

SEQ ID NO: 8358766 - DNA, 21 bp, Homo sapiens
atggcttctcaggtgcactga

SEQ ID NO: 8358767 - DNA, 21 bp, Homo sapiens
atggcttctcaggtgcactga

SEQ ID NO: 8358768 - DNA, 22 bp, Homo sapiens
atggcttctcgctggcacctgt

SEQ ID NO: 8358769 - DNA, 18 bp, Homo sapiens
atggcttctgagtggagg

SEQ ID NO: 8358770 - DNA, 22 bp, Homo sapiens
atggctttttagactttggtac

SEQ ID NO: 8358771 - DNA, 22 bp, Homo sapiens
atggctttgctcaagtttagcc

SEQ ID NO: 8358772 - DNA, 22 bp, Homo sapiens
atggctttccggactttggcca

SEQ ID NO: 8358773 - DNA, 22 bp, Homo sapiens
atggctttccggactttggcca

SEQ ID NO: 8358774 - DNA, 22 bp, Homo sapiens
gagatggggaataggagcaagc

SEQ ID NO: 8358775 - DNA, 22 bp, Homo sapiens
gagatggtgttccactgccagt

SEQ ID NO: 8358776 - DNA, 17 bp, Homo sapiens
gagatgggtggatcacc

SEQ ID NO: 8358777 - DNA, 22 bp, Homo sapiens
atggcatttgtcaagataagta

SEQ ID NO: 8358778 - DNA, 22 bp, Homo sapiens
atggccaagcatatacagattg

SEQ ID NO: 8358779 - DNA, 22 bp, Homo sapiens
atggccaactgaaatgaaagat

SEQ ID NO: 8358780 - DNA, 22 bp, Homo sapiens
atgggacaggtactagaaaggg

SEQ ID NO: 8358781 - DNA, 22 bp, Homo sapiens
atgggagaaacatcatgaggca

SEQ ID NO: 8358782 - DNA, 22 bp, Homo sapiens
atgggacatagatccttgaggt

SEQ ID NO: 8358783 - DNA, 22 bp, Homo sapiens
atgggacaatttgaacacagtg

SEQ ID NO: 8358784 - DNA, 22 bp, Homo sapiens
atgggacagcatcttggtatta

SEQ ID NO: 8358785 - DNA, 22 bp, Homo sapiens
atgggaagtgaagtcagggagg

SEQ ID NO: 8358786 - DNA, 22 bp, Homo sapiens
atgggaaggttttgagagcggg

SEQ ID NO: 8358787 - DNA, 22 bp, Homo sapiens
atgggaaagaagccactgccca

SEQ ID NO: 8358788 - DNA, 19 bp, Homo sapiens
atgggaagcggccagcgga

SEQ ID NO: 8358789 - DNA, 22 bp, Homo sapiens
atgggaagctgacctgcatgga

SEQ ID NO: 8358790 - DNA, 22 bp, Homo sapiens
atgggaaggttttgagagcggg

SEQ ID NO: 8358791 - DNA, 22 bp, Homo sapiens
atgggagaaacatcatgaggca

SEQ ID NO: 8358792 - DNA, 22 bp, Homo sapiens
atgggctgcttctccagcacct

SEQ ID NO: 8358793 - DNA, 22 bp, Homo sapiens
atgggctgacccagtcgtggca

SEQ ID NO: 8358794 - DNA, 22 bp, Homo sapiens
atgggctgcttggcttccaccc

SEQ ID NO: 8358795 - DNA, 22 bp, Homo sapiens
atgggctggggaagctcactcc

SEQ ID NO: 8358796 - DNA, 22 bp, Homo sapiens
atgggctgtcctagtccagccc

SEQ ID NO: 8358797 - DNA, 22 bp, Homo sapiens
atgggctgtccattgctggctg

SEQ ID NO: 8358798 - DNA, 22 bp, Homo sapiens
gaggcagcagggctggttcctt

SEQ ID NO: 8358799 - DNA, 22 bp, Homo sapiens
gaggcagcagggctggttcctt

SEQ ID NO: 8358800 - DNA, 22 bp, Homo sapiens
atggtggaggtgtattctggat

SEQ ID NO: 8358801 - DNA, 22 bp, Homo sapiens
atggtggatttgtgattcagct

SEQ ID NO: 8358802 - DNA, 22 bp, Homo sapiens
atggtggactcttgattcaggc

SEQ ID NO: 8358803 - DNA, 22 bp, Homo sapiens
atggtggacgggagacaggact

SEQ ID NO: 8358804 - DNA, 22 bp, Homo sapiens
gaggcagcattcgcatagacag

SEQ ID NO: 8358805 - DNA, 22 bp, Homo sapiens
gaggcagcggctcacagagaaa

SEQ ID NO: 8358806 - DNA, 22 bp, Homo sapiens
gaggcagcctcagtggacctcg

SEQ ID NO: 8358807 - DNA, 22 bp, Homo sapiens
gaggcagccagaggttctcatt

SEQ ID NO: 8358808 - DNA, 22 bp, Homo sapiens
gaggcagcctcagtggacctcg

SEQ ID NO: 8358809 - DNA, 22 bp, Homo sapiens
gaggagaagctattggaaggac

SEQ ID NO: 8358810 - DNA, 22 bp, Homo sapiens
gaggaagggactttattatctg

SEQ ID NO: 8358811 - DNA, 22 bp, Homo sapiens
atggtggaagagcatcagaaag

SEQ ID NO: 8358812 - DNA, 22 bp, Homo sapiens
atggtggaatcggcgtgaatgg

SEQ ID NO: 8358813 - DNA, 22 bp, Homo sapiens
ggtgctggacacgtggcactcc

SEQ ID NO: 8358814 - DNA, 23 bp, Homo sapiens
cagcacagtacatttcctgtctc

SEQ ID NO: 8358815 - DNA, 22 bp, Homo sapiens
cagcacagtgaccagacccact

SEQ ID NO: 8358816 - DNA, 22 bp, Homo sapiens
cagcacagtgaccagacccact

SEQ ID NO: 8358817 - DNA, 22 bp, Homo sapiens
cagcacagtcctttgcttactg

SEQ ID NO: 8358818 - DNA, 22 bp, Homo sapiens
cagcacagtgcagatgctgact

SEQ ID NO: 8358819 - DNA, 22 bp, Homo sapiens
cagcacagtgcagatgctgact

SEQ ID NO: 8358820 - DNA, 22 bp, Homo sapiens
cagcaagagaggcagggcaaat

SEQ ID NO: 8358821 - DNA, 22 bp, Homo sapiens
cagcaagagactgttctctaag

SEQ ID NO: 8358822 - DNA, 22 bp, Homo sapiens
cagcaagattaagggcagaaaa

SEQ ID NO: 8358823 - DNA, 22 bp, Homo sapiens
cagcaagatggtgaatgagacg

SEQ ID NO: 8358824 - DNA, 22 bp, Homo sapiens
cagcaaagtaagctgacatgta

SEQ ID NO: 8358825 - DNA, 22 bp, Homo sapiens
ggtgacgaatccatagcatcga

SEQ ID NO: 8358826 - DNA, 22 bp, Homo sapiens
ggtgactcccagctgctctctt

SEQ ID NO: 8358827 - DNA, 17 bp, Homo sapiens
ggtgagacctcccactc

SEQ ID NO: 8358828 - DNA, 22 bp, Homo sapiens
ggtgacctcacctggtcccacc

SEQ ID NO: 8358829 - DNA, 22 bp, Homo sapiens
ggtgacctcacctggtcccacc

SEQ ID NO: 8358830 - DNA, 22 bp, Homo sapiens
ggtgacagtggttaaaatttgt

SEQ ID NO: 8358831 - DNA, 22 bp, Homo sapiens
ggtctgaggtgggacccaggaa

SEQ ID NO: 8358832 - DNA, 21 bp, Homo sapiens
cagagggtttctcaggtgttt

SEQ ID NO: 8358833 - DNA, 22 bp, Homo sapiens
cagagggttgatgtgaggctta

SEQ ID NO: 8358834 - DNA, 22 bp, Homo sapiens
cagaggtagaactggccctcac

SEQ ID NO: 8358835 - DNA, 22 bp, Homo sapiens
cagagtcatatcagagaatatg

SEQ ID NO: 8358836 - DNA, 22 bp, Homo sapiens
cagagtcagtattgaattgaaa

SEQ ID NO: 8358837 - DNA, 22 bp, Homo sapiens
cagagtcatgggccgtcaggca

SEQ ID NO: 8358838 - DNA, 22 bp, Homo sapiens
cagagtcatgggccgtcaggca

SEQ ID NO: 8358839 - DNA, 22 bp, Homo sapiens
cagagtcccagatgcccctcct

SEQ ID NO: 8358840 - DNA, 22 bp, Homo sapiens
cagagtcattgacttccaggag

SEQ ID NO: 8358841 - DNA, 22 bp, Homo sapiens
cagagtcctgcaccagctccag

SEQ ID NO: 8358842 - DNA, 17 bp, Homo sapiens
cagagtctgtctgcatc

SEQ ID NO: 8358843 - DNA, 22 bp, Homo sapiens
cagagtcttgtgtgttcagccc

SEQ ID NO: 8358844 - DNA, 22 bp, Homo sapiens
cagaggggataacaggtgtaga

SEQ ID NO: 8358845 - DNA, 21 bp, Homo sapiens
cagagggcttttctctgttct

SEQ ID NO: 8358846 - DNA, 22 bp, Homo sapiens
cagaggggataacaggtgtaga

SEQ ID NO: 8358847 - DNA, 22 bp, Homo sapiens
cagagggtgtgaaggggatgaa

SEQ ID NO: 8358848 - DNA, 23 bp, Homo sapiens
cagagggttccatggagcatggt

SEQ ID NO: 8358849 - DNA, 22 bp, Homo sapiens
cagagggtcaccaggaagtgca

SEQ ID NO: 8358850 - DNA, 22 bp, Homo sapiens
cagagggaaaaggggagtaata

SEQ ID NO: 8358851 - DNA, 22 bp, Homo sapiens
cagagggcgtccgggttaactt

SEQ ID NO: 8358852 - DNA, 21 bp, Homo sapiens
cagagggccggcatgtggtct

SEQ ID NO: 8358853 - DNA, 22 bp, Homo sapiens
cagagggctcggcggccgctcc

SEQ ID NO: 8358854 - DNA, 22 bp, Homo sapiens
cagagggcttcaggttcaggat

SEQ ID NO: 8358855 - DNA, 22 bp, Homo sapiens
cagagggctgtgtaaggatgtt

SEQ ID NO: 8358856 - DNA, 22 bp, Homo sapiens
cagagggctgccctgagttcgt

SEQ ID NO: 8358857 - DNA, 22 bp, Homo sapiens
cagaggcacagtgcgggccact

SEQ ID NO: 8358858 - DNA, 19 bp, Homo sapiens
cagaggcaccaggtataga

SEQ ID NO: 8358859 - DNA, 22 bp, Homo sapiens
cagaggcacagtgcgggccact

SEQ ID NO: 8358860 - DNA, 19 bp, Homo sapiens
cagaggcaccaggtataga

SEQ ID NO: 8358861 - DNA, 22 bp, Homo sapiens
ggggagcaggctgggctgtctg

SEQ ID NO: 8358862 - DNA, 22 bp, Homo sapiens
ggggagcaattgcccccttaga

SEQ ID NO: 8358863 - DNA, 22 bp, Homo sapiens
ggggagcaggctgggctgtctg

SEQ ID NO: 8358864 - DNA, 22 bp, Homo sapiens
ggggagcaatagttgaggtgtg

SEQ ID NO: 8358865 - DNA, 22 bp, Homo sapiens
cagaggagaattgcgggatcat

SEQ ID NO: 8358866 - DNA, 22 bp, Homo sapiens
cagaggagaattgcgggatcat

SEQ ID NO: 8358867 - DNA, 22 bp, Homo sapiens
cagaggagaattgcgggatcat

SEQ ID NO: 8358868 - DNA, 22 bp, Homo sapiens
cagaggatgatctggcctctct

SEQ ID NO: 8358869 - DNA, 22 bp, Homo sapiens
cagaggattccctagtgacctg

SEQ ID NO: 8358870 - DNA, 22 bp, Homo sapiens
cagaggcaaaagaggtggaggt

SEQ ID NO: 8358871 - DNA, 22 bp, Homo sapiens
cagaggcaaaagaggtggaggt

SEQ ID NO: 8358872 - DNA, 20 bp, Homo sapiens
cagaggcaaggagacttgga

SEQ ID NO: 8358873 - DNA, 22 bp, Homo sapiens
cagaggcacaagaaagcaaggc

SEQ ID NO: 8358874 - DNA, 23 bp, Homo sapiens
cagagctggctcagagctgcctg

SEQ ID NO: 8358875 - DNA, 22 bp, Homo sapiens
cagagctggctctgcatgtaca

SEQ ID NO: 8358876 - DNA, 22 bp, Homo sapiens
cagagctgggatcccatgggcg

SEQ ID NO: 8358877 - DNA, 22 bp, Homo sapiens
cagagcctcatcatccactcca

SEQ ID NO: 8358878 - DNA, 19 bp, Homo sapiens
cagagcctcagagctagaa

SEQ ID NO: 8358879 - DNA, 22 bp, Homo sapiens
gggctgacgaaggccatgtgtg

SEQ ID NO: 8358880 - DNA, 22 bp, Homo sapiens
gggctgacagtttcccctgaaa

SEQ ID NO: 8358881 - DNA, 17 bp, Homo sapiens
gggctgacagtggcctc

SEQ ID NO: 8358882 - DNA, 22 bp, Homo sapiens
gggctgacaccacccaggcgca

SEQ ID NO: 8358883 - DNA, 22 bp, Homo sapiens
gggctgacaaccatctgacaag

SEQ ID NO: 8358884 - DNA, 22 bp, Homo sapiens
gggctgacagcacgccttctgt

SEQ ID NO: 8358885 - DNA, 22 bp, Homo sapiens
gggcagtgtctgcaaatgaaca

SEQ ID NO: 8358886 - DNA, 22 bp, Homo sapiens
gggcagtgtctggcccccaggc

SEQ ID NO: 8358887 - DNA, 22 bp, Homo sapiens
gggcagtgtggtcgtgcctttg

SEQ ID NO: 8358888 - DNA, 22 bp, Homo sapiens
gggcagtgtggtcgtgcctttg

SEQ ID NO: 8358889 - DNA, 22 bp, Homo sapiens
gggccagacccttggcgatctg

SEQ ID NO: 8358890 - DNA, 22 bp, Homo sapiens
gggccagagcacagaggatgtt

SEQ ID NO: 8358891 - DNA, 22 bp, Homo sapiens
gggccagagcacagaggatgtt

SEQ ID NO: 8358892 - DNA, 22 bp, Homo sapiens
gggccagacctcttctcaggga

SEQ ID NO: 8358893 - DNA, 22 bp, Homo sapiens
gggccagagcttggcagctggg

SEQ ID NO: 8358894 - DNA, 22 bp, Homo sapiens
gggccagcagtatcggaggcat

SEQ ID NO: 8358895 - DNA, 22 bp, Homo sapiens
gggcagcattctgtgggcaggt

SEQ ID NO: 8358896 - DNA, 22 bp, Homo sapiens
gggcagcccagaactgctgcag

SEQ ID NO: 8358897 - DNA, 22 bp, Homo sapiens
cagagacagcctgggagggaca

SEQ ID NO: 8358898 - DNA, 22 bp, Homo sapiens
gggcagtgtcgaggtctggtcc

SEQ ID NO: 8358899 - DNA, 22 bp, Homo sapiens
cagagacaggagtgctcccagt

SEQ ID NO: 8358900 - DNA, 22 bp, Homo sapiens
cagagacaggagtgctcccagt

SEQ ID NO: 8358901 - DNA, 22 bp, Homo sapiens
cagagacaggaatcagctgcag

SEQ ID NO: 8358902 - DNA, 22 bp, Homo sapiens
cagagacaggagtgctcccagt

SEQ ID NO: 8358903 - DNA, 22 bp, Homo sapiens
cagagacaggatctcgaagact

SEQ ID NO: 8358904 - DNA, 22 bp, Homo sapiens
gggcagcagagccctgccgagt

SEQ ID NO: 8358905 - DNA, 22 bp, Homo sapiens
gggcagcagagccctgccgagt

SEQ ID NO: 8358906 - DNA, 22 bp, Homo sapiens
gggcagagactcagaaacagaa

SEQ ID NO: 8358907 - DNA, 22 bp, Homo sapiens
cagactgggctggtggaaagct

SEQ ID NO: 8358908 - DNA, 22 bp, Homo sapiens
cagactcttgagctgattgtat

SEQ ID NO: 8358909 - DNA, 22 bp, Homo sapiens
cagaccctcttctattggtggg

SEQ ID NO: 8358910 - DNA, 22 bp, Homo sapiens
cagaccccgagtttgcagagtt

SEQ ID NO: 8358911 - DNA, 22 bp, Homo sapiens
cagacatggcgccaagtgctag

SEQ ID NO: 8358912 - DNA, 22 bp, Homo sapiens
ggcttcaatgtattcacattca

SEQ ID NO: 8358913 - DNA, 22 bp, Homo sapiens
cagcctggcctgggactgctga

SEQ ID NO: 8358914 - DNA, 22 bp, Homo sapiens
cagcctgggctccagagtccct

SEQ ID NO: 8358915 - DNA, 22 bp, Homo sapiens
cagcctgggctccagagtccct

SEQ ID NO: 8358916 - DNA, 22 bp, Homo sapiens
cagcctggtccccggctcaccc

SEQ ID NO: 8358917 - DNA, 22 bp, Homo sapiens
cagcctggtccccggctcaccc

SEQ ID NO: 8358918 - DNA, 22 bp, Homo sapiens
cagcctgctctcagatgttgag

SEQ ID NO: 8358919 - DNA, 22 bp, Homo sapiens
cagcctggacagcgaccagagt

SEQ ID NO: 8358920 - DNA, 22 bp, Homo sapiens
cagcctggagccacagcccagg

SEQ ID NO: 8358921 - DNA, 22 bp, Homo sapiens
cagcctggattgcagaatgcta

SEQ ID NO: 8358922 - DNA, 22 bp, Homo sapiens
cagctaggaaaccagagggcag

SEQ ID NO: 8358923 - DNA, 22 bp, Homo sapiens
cagctacaaatacttttgtatg

SEQ ID NO: 8358924 - DNA, 22 bp, Homo sapiens
gtgcccaggtgtccctgagaag

SEQ ID NO: 8358925 - DNA, 22 bp, Homo sapiens
gtgcccagtcctgccttgacag

SEQ ID NO: 8358926 - DNA, 22 bp, Homo sapiens
gtgcccagtcctgccttgacag

SEQ ID NO: 8358927 - DNA, 22 bp, Homo sapiens
gtgcccagtaaatgaaagcttt

SEQ ID NO: 8358928 - DNA, 22 bp, Homo sapiens
gtgcccagtcctgccttgacag

SEQ ID NO: 8358929 - DNA, 22 bp, Homo sapiens
cagctagtcagaggcagggcca

SEQ ID NO: 8358930 - DNA, 20 bp, Homo sapiens
cagctagtggtaggagtcgg

SEQ ID NO: 8358931 - DNA, 22 bp, Homo sapiens
cagctagtacaatgggagagca

SEQ ID NO: 8358932 - DNA, 22 bp, Homo sapiens
cagctaggagaaaaggtgtttt

SEQ ID NO: 8358933 - DNA, 22 bp, Homo sapiens
cagccctggaacagctgactca

SEQ ID NO: 8358934 - DNA, 22 bp, Homo sapiens
cagccctggaacagctgactca

SEQ ID NO: 8358935 - DNA, 22 bp, Homo sapiens
cagccctggaacagctgactca

SEQ ID NO: 8358936 - DNA, 23 bp, Homo sapiens
cagccctggagatgtgggaggca

SEQ ID NO: 8358937 - DNA, 23 bp, Homo sapiens
cagccctggagatgtgggaggca

SEQ ID NO: 8358938 - DNA, 22 bp, Homo sapiens
cagccctggcagctttcagggt

SEQ ID NO: 8358939 - DNA, 22 bp, Homo sapiens
cagccctggcccaggtgcctta

SEQ ID NO: 8358940 - DNA, 20 bp, Homo sapiens
cagcctccactcactcagct

SEQ ID NO: 8358941 - DNA, 22 bp, Homo sapiens
cagcctgactatggctgcaggt

SEQ ID NO: 8358942 - DNA, 16 bp, Homo sapiens
cagcctgcagtggtca

SEQ ID NO: 8358943 - DNA, 22 bp, Homo sapiens
cagcctgcagggctgcctgttg

SEQ ID NO: 8358944 - DNA, 22 bp, Homo sapiens
cagcctgcagggctgcctgttg

SEQ ID NO: 8358945 - DNA, 22 bp, Homo sapiens
cagcctgcctcagtttccctct

SEQ ID NO: 8358946 - DNA, 22 bp, Homo sapiens
cagccctgcagccatggcctgt

SEQ ID NO: 8358947 - DNA, 23 bp, Homo sapiens
cagccctgaaatcgaggtgacac

SEQ ID NO: 8358948 - DNA, 22 bp, Homo sapiens
cagccctgcagctggatctcac

SEQ ID NO: 8358949 - DNA, 22 bp, Homo sapiens
cagccctgccatggagcctcct

SEQ ID NO: 8358950 - DNA, 22 bp, Homo sapiens
cagccctgccatggagcctcct

SEQ ID NO: 8358951 - DNA, 22 bp, Homo sapiens
cagccctgcggaggtgtatact

SEQ ID NO: 8358952 - DNA, 17 bp, Homo sapiens
cagccctgccgttccca

SEQ ID NO: 8358953 - DNA, 22 bp, Homo sapiens
cagccctgctgacactgtctga

SEQ ID NO: 8358954 - DNA, 22 bp, Homo sapiens
cagccctgctcttagtgtctcc

SEQ ID NO: 8358955 - DNA, 22 bp, Homo sapiens
cagccctgctcttagtgtctcc

SEQ ID NO: 8358956 - DNA, 22 bp, Homo sapiens
cagccctgctcttagtgtctcc

SEQ ID NO: 8358957 - DNA, 22 bp, Homo sapiens
cagccctgctgccttagtgcct

SEQ ID NO: 8358958 - DNA, 22 bp, Homo sapiens
cagccctgctgccttagtgcct

SEQ ID NO: 8358959 - DNA, 22 bp, Homo sapiens
cagccctgctgacactgtctga

SEQ ID NO: 8358960 - DNA, 22 bp, Homo sapiens
cagccctgcttccccgctagtt

SEQ ID NO: 8358961 - DNA, 22 bp, Homo sapiens
cagccctgctggttttgggcaa

SEQ ID NO: 8358962 - DNA, 22 bp, Homo sapiens
cagccctgctggcaatgatgag

SEQ ID NO: 8358963 - DNA, 22 bp, Homo sapiens
cagccctgctggcaatgatgag

SEQ ID NO: 8358964 - DNA, 22 bp, Homo sapiens
gtgcccagttgaggccaggact

SEQ ID NO: 8358965 - DNA, 22 bp, Homo sapiens
gtgcccagttgaggccaggact

SEQ ID NO: 8358966 - DNA, 22 bp, Homo sapiens
gtgcccagttgaggccaggact

SEQ ID NO: 8358967 - DNA, 22 bp, Homo sapiens
gtgcccagtgcaggcccgcagg

SEQ ID NO: 8358968 - DNA, 22 bp, Homo sapiens
cagccaggcctggtgaccaaag

SEQ ID NO: 8358969 - DNA, 22 bp, Homo sapiens
cagccaggcctggtgaccaaag

SEQ ID NO: 8358970 - DNA, 22 bp, Homo sapiens
cagccagggagcaaagagttga

SEQ ID NO: 8358971 - DNA, 22 bp, Homo sapiens
cagccagggagcaaagagttga

SEQ ID NO: 8358972 - DNA, 22 bp, Homo sapiens
cagccagggagggcaaatgaga

SEQ ID NO: 8358973 - DNA, 22 bp, Homo sapiens
gtctggactttatcccaaggtt

SEQ ID NO: 8358974 - DNA, 22 bp, Homo sapiens
gtccctgggaaaggagagggca

SEQ ID NO: 8358975 - DNA, 22 bp, Homo sapiens
gtcccaggctccatggcagcca

SEQ ID NO: 8358976 - DNA, 22 bp, Homo sapiens
gtcccaggctccatggcagcca

SEQ ID NO: 8358977 - DNA, 22 bp, Homo sapiens
cagcccaggctcagatgttggg

SEQ ID NO: 8358978 - DNA, 22 bp, Homo sapiens
cagccaggttcaagtccttata

SEQ ID NO: 8358979 - DNA, 22 bp, Homo sapiens
cagccaggggctggcgtgttga

SEQ ID NO: 8358980 - DNA, 22 bp, Homo sapiens
cagccccttcctggcatctgga

SEQ ID NO: 8358981 - DNA, 22 bp, Homo sapiens
cagcccctcacagagctgtcct

SEQ ID NO: 8358982 - DNA, 22 bp, Homo sapiens
cagccctcatcccgcctgcgtt

SEQ ID NO: 8358983 - DNA, 22 bp, Homo sapiens
cagccctcatcccgcctgcgtt

SEQ ID NO: 8358984 - DNA, 22 bp, Homo sapiens
gtctgtggtagacaggaaggca

SEQ ID NO: 8358985 - DNA, 22 bp, Homo sapiens
gtctgtgtgcacagcgagtgcc

SEQ ID NO: 8358986 - DNA, 22 bp, Homo sapiens
gtctgtgcagttactagctggt

SEQ ID NO: 8358987 - DNA, 22 bp, Homo sapiens
gtctgtgggccaaatacagccc

SEQ ID NO: 8358988 - DNA, 22 bp, Homo sapiens
gtctgtggcaggggagaagttt

SEQ ID NO: 8358989 - DNA, 22 bp, Homo sapiens
gtcccaggaacattctggctag

SEQ ID NO: 8358990 - DNA, 22 bp, Homo sapiens
gtcccaggaacattctggctag

SEQ ID NO: 8358991 - DNA, 22 bp, Homo sapiens
gtcccaggcagagtcaggaggg

SEQ ID NO: 8358992 - DNA, 22 bp, Homo sapiens
gtcccaggagttgctgggcctt

SEQ ID NO: 8358993 - DNA, 22 bp, Homo sapiens
gtcccaggagttgctgggcctt

SEQ ID NO: 8358994 - DNA, 22 bp, Homo sapiens
gtcccaggcaggccactggcag

SEQ ID NO: 8358995 - DNA, 22 bp, Homo sapiens
cagcaggctctgagtggctgcc

SEQ ID NO: 8358996 - DNA, 22 bp, Homo sapiens
cagcaggctgcgattgctcatt

SEQ ID NO: 8358997 - DNA, 22 bp, Homo sapiens
cagcaggctctgagtggctgcc

SEQ ID NO: 8358998 - DNA, 22 bp, Homo sapiens
cagcaggctggacttcagtccc

SEQ ID NO: 8358999 - DNA, 22 bp, Homo sapiens
cagcaggctgtggaaatcctgg

SEQ ID NO: 8359000 - DNA, 22 bp, Homo sapiens
gtcattattctgggattctata

SEQ ID NO: 8359001 - DNA, 20 bp, Homo sapiens
cagcaggctatggggcaccc

SEQ ID NO: 8359002 - DNA, 22 bp, Homo sapiens
gtcatattgaagaagactggca

SEQ ID NO: 8359003 - DNA, 22 bp, Homo sapiens
gtcatataggtaggattcagct

SEQ ID NO: 8359004 - DNA, 22 bp, Homo sapiens
gtcatattataaatgttctgtt

SEQ ID NO: 8359005 - DNA, 22 bp, Homo sapiens
gtcatatacactgcatgtaatc

SEQ ID NO: 8359006 - DNA, 22 bp, Homo sapiens
gtcatatacactgcatgtaatc

SEQ ID NO: 8359007 - DNA, 20 bp, Homo sapiens
cagcaggaaaagtgcctcag

SEQ ID NO: 8359008 - DNA, 20 bp, Homo sapiens
cagcaggaaaagtgcctcag

SEQ ID NO: 8359009 - DNA, 22 bp, Homo sapiens
cagcagcttttgcattctcatt

SEQ ID NO: 8359010 - DNA, 22 bp, Homo sapiens
cagcagctggttgaatccttct

SEQ ID NO: 8359011 - DNA, 22 bp, Homo sapiens
cagcagctggttgaatccttct

SEQ ID NO: 8359012 - DNA, 20 bp, Homo sapiens
cagcaggaaaagtgcctcag

SEQ ID NO: 8359013 - DNA, 22 bp, Homo sapiens
cagcaggaaggtttcccctgca

SEQ ID NO: 8359014 - DNA, 22 bp, Homo sapiens
cagcaggacatggaggagtaaa

SEQ ID NO: 8359015 - DNA, 22 bp, Homo sapiens
gtcagcatagttcacacacagt

SEQ ID NO: 8359016 - DNA, 22 bp, Homo sapiens
cagcaggacatggaggagtaaa

SEQ ID NO: 8359017 - DNA, 22 bp, Homo sapiens
cagcaccctttccactgccttg

SEQ ID NO: 8359018 - DNA, 22 bp, Homo sapiens
cagcaccttcctatccaggaga

SEQ ID NO: 8359019 - DNA, 22 bp, Homo sapiens
cagcagctgggaaggaggctga

SEQ ID NO: 8359020 - DNA, 22 bp, Homo sapiens
cagcagctcactcaggtggctc

SEQ ID NO: 8359021 - DNA, 23 bp, Homo sapiens
cagcagctgcctggttttttggt

SEQ ID NO: 8359022 - DNA, 22 bp, Homo sapiens
cacagttttatcttatactgat

SEQ ID NO: 8359023 - DNA, 22 bp, Homo sapiens
cacagtttggttttgctgtaat

SEQ ID NO: 8359024 - DNA, 22 bp, Homo sapiens
cacagtttggttttgctgtaat

SEQ ID NO: 8359025 - DNA, 22 bp, Homo sapiens
ggaggtggaggttgcaatgagc

SEQ ID NO: 8359026 - DNA, 22 bp, Homo sapiens
ggaggtggaggttgcagtgagc

SEQ ID NO: 8359027 - DNA, 22 bp, Homo sapiens
ggaggtggaggttgcaatgagc

SEQ ID NO: 8359028 - DNA, 22 bp, Homo sapiens
cacagggaaccaaggctgggcc

SEQ ID NO: 8359029 - DNA, 22 bp, Homo sapiens
cacagggaaccaaggctgggcc

SEQ ID NO: 8359030 - DNA, 22 bp, Homo sapiens
cacagggaaccaaggctgggcc

SEQ ID NO: 8359031 - DNA, 22 bp, Homo sapiens
cacagggaacaactagaacaaa

SEQ ID NO: 8359032 - DNA, 22 bp, Homo sapiens
cacatacaatggtgttatttgg

SEQ ID NO: 8359033 - DNA, 22 bp, Homo sapiens
cacagttttgcccagggcttct

SEQ ID NO: 8359034 - DNA, 22 bp, Homo sapiens
cacagttttgtcttggtttcca

SEQ ID NO: 8359035 - DNA, 22 bp, Homo sapiens
cacatacttgtgtgtacatatg

SEQ ID NO: 8359036 - DNA, 22 bp, Homo sapiens
cacatacatgcacacctaaata

SEQ ID NO: 8359037 - DNA, 22 bp, Homo sapiens
cacatacatacgtatgtataca

SEQ ID NO: 8359038 - DNA, 19 bp, Homo sapiens
cacatacagaaaagagtaa

SEQ ID NO: 8359039 - DNA, 22 bp, Homo sapiens
cacatttatctgttctttctag

SEQ ID NO: 8359040 - DNA, 22 bp, Homo sapiens
cacatagataggcagaagaaca

SEQ ID NO: 8359041 - DNA, 22 bp, Homo sapiens
ggcagggaggaggtgaaagtga

SEQ ID NO: 8359042 - DNA, 22 bp, Homo sapiens
ggcagggaggaggtgaaagtga

SEQ ID NO: 8359043 - DNA, 22 bp, Homo sapiens
ggcaggcatggggtctgccatt

SEQ ID NO: 8359044 - DNA, 22 bp, Homo sapiens
ggcagggagagcatgctgataa

SEQ ID NO: 8359045 - DNA, 22 bp, Homo sapiens
ggcaggcatcatgtggtcatta

SEQ ID NO: 8359046 - DNA, 22 bp, Homo sapiens
ggcaggcatggccactccctag

SEQ ID NO: 8359047 - DNA, 22 bp, Homo sapiens
ggcaggcatcatgtggtcatta

SEQ ID NO: 8359048 - DNA, 22 bp, Homo sapiens
ggcaggcatggggtctgccatt

SEQ ID NO: 8359049 - DNA, 22 bp, Homo sapiens
ggcaggcagtgtggtgtgaaac

SEQ ID NO: 8359050 - DNA, 22 bp, Homo sapiens
ggcaggcaggagcgtgcttggg

SEQ ID NO: 8359051 - DNA, 22 bp, Homo sapiens
ggccactgtttcctgggcagtt

SEQ ID NO: 8359052 - DNA, 22 bp, Homo sapiens
ggccccaggtagaagatataga

SEQ ID NO: 8359053 - DNA, 22 bp, Homo sapiens
ggccccagggattaggccaacc

SEQ ID NO: 8359054 - DNA, 22 bp, Homo sapiens
cacgcacgctgggtggaggcgc

SEQ ID NO: 8359055 - DNA, 22 bp, Homo sapiens
cacgagaacctctcatttgatt

SEQ ID NO: 8359056 - DNA, 22 bp, Homo sapiens
caccttactccctctggatgcc

SEQ ID NO: 8359057 - DNA, 22 bp, Homo sapiens
cacctgttgtttattcatctct

SEQ ID NO: 8359058 - DNA, 22 bp, Homo sapiens
cacctgttcattacccatccca

SEQ ID NO: 8359059 - DNA, 21 bp, Homo sapiens
caccttggaaggtggagagtt

SEQ ID NO: 8359060 - DNA, 22 bp, Homo sapiens
ggccggtgtcatggcttggtct

SEQ ID NO: 8359061 - DNA, 22 bp, Homo sapiens
cacctgggtcattgctggtgtt

SEQ ID NO: 8359062 - DNA, 21 bp, Homo sapiens
ggccgccgccttgtgctctgc

SEQ ID NO: 8359063 - DNA, 22 bp, Homo sapiens
ggcaggtgcccagagagcacga

SEQ ID NO: 8359064 - DNA, 22 bp, Homo sapiens
ggcaggtgcacctgagccatct

SEQ ID NO: 8359065 - DNA, 22 bp, Homo sapiens
ggcaggtgcacctgagccatct

SEQ ID NO: 8359066 - DNA, 22 bp, Homo sapiens
ggcagggcaggaaagtcaggaa

SEQ ID NO: 8359067 - DNA, 22 bp, Homo sapiens
ggcagggagtggagactcccta

SEQ ID NO: 8359068 - DNA, 22 bp, Homo sapiens
ggcagggcagcgctgattaggg

SEQ ID NO: 8359069 - DNA, 22 bp, Homo sapiens
ggcattgatgggagatggtgga

SEQ ID NO: 8359070 - DNA, 22 bp, Homo sapiens
ggcattgtaaaggattcataga

SEQ ID NO: 8359071 - DNA, 22 bp, Homo sapiens
ggcatcaggagcttcttcaggt

SEQ ID NO: 8359072 - DNA, 22 bp, Homo sapiens
ggcatcaggatctgtcttgctt

SEQ ID NO: 8359073 - DNA, 22 bp, Homo sapiens
ggcatttgagccattggcctgt

SEQ ID NO: 8359074 - DNA, 22 bp, Homo sapiens
ggctcaggttgggtcacatgac

SEQ ID NO: 8359075 - DNA, 22 bp, Homo sapiens
ggctccagggtacccctggatg

SEQ ID NO: 8359076 - DNA, 22 bp, Homo sapiens
ggctccagggtacccctggatg

SEQ ID NO: 8359077 - DNA, 22 bp, Homo sapiens
ggctccagggtctctccttgtg

SEQ ID NO: 8359078 - DNA, 22 bp, Homo sapiens
ggctccagggtctctccttgtg

SEQ ID NO: 8359079 - DNA, 22 bp, Homo sapiens
ggctgaggcggcgatgcccttg

SEQ ID NO: 8359080 - DNA, 22 bp, Homo sapiens
ggctcaggctggagtgcagtgg

SEQ ID NO: 8359081 - DNA, 22 bp, Homo sapiens
ggctcagggaatgaggaagaat

SEQ ID NO: 8359082 - DNA, 22 bp, Homo sapiens
ggcctgtgagcccttgcatgta

SEQ ID NO: 8359083 - DNA, 22 bp, Homo sapiens
ggcctgaggccaccagcagccc

SEQ ID NO: 8359084 - DNA, 20 bp, Homo sapiens
ggcctgagcatggctggcag

SEQ ID NO: 8359085 - DNA, 22 bp, Homo sapiens
ggcctctctccctggcttgcag

SEQ ID NO: 8359086 - DNA, 23 bp, Homo sapiens
cagaaagccctttccccacagta

SEQ ID NO: 8359087 - DNA, 22 bp, Homo sapiens
cagaaagcagagctgagccttt

SEQ ID NO: 8359088 - DNA, 22 bp, Homo sapiens
ggctgcctactttcccagagtt

SEQ ID NO: 8359089 - DNA, 22 bp, Homo sapiens
ggctgccctcgtctactgccca

SEQ ID NO: 8359090 - DNA, 22 bp, Homo sapiens
ggctgcctagacttggaatttc

SEQ ID NO: 8359091 - DNA, 22 bp, Homo sapiens
cagaaacaggcaacgtgtgcac

SEQ ID NO: 8359092 - DNA, 23 bp, Homo sapiens
cagaaaacccagagctcagtccc

SEQ ID NO: 8359093 - DNA, 22 bp, Homo sapiens
ggctgccccatgggctgggctg

SEQ ID NO: 8359094 - DNA, 22 bp, Homo sapiens
ggctgccccagtgctcatggct

SEQ ID NO: 8359095 - DNA, 22 bp, Homo sapiens
ggctgccctagagctggcaagg

SEQ ID NO: 8359096 - DNA, 22 bp, Homo sapiens
cagaaaagggtgtttgttcagg

SEQ ID NO: 8359097 - DNA, 22 bp, Homo sapiens
cagaaaaggaagagctatgtaa

SEQ ID NO: 8359098 - DNA, 22 bp, Homo sapiens
cagaaaaggaagagctatgtaa

SEQ ID NO: 8359099 - DNA, 22 bp, Homo sapiens
cagaaaaggaagagctatgtaa

SEQ ID NO: 8359100 - DNA, 21 bp, Homo sapiens
ggctggtgtttagctgtgata

SEQ ID NO: 8359101 - DNA, 22 bp, Homo sapiens
ggctggtttgacaaactgacaa

SEQ ID NO: 8359102 - DNA, 22 bp, Homo sapiens
ggctggtgttacagtcggcagc

SEQ ID NO: 8359103 - DNA, 22 bp, Homo sapiens
ggctgtcttgggagctcccccg

SEQ ID NO: 8359104 - DNA, 22 bp, Homo sapiens
ggctgttcctctgagagctgat

SEQ ID NO: 8359105 - DNA, 22 bp, Homo sapiens
ggctgttcctctgagagctgat

SEQ ID NO: 8359106 - DNA, 22 bp, Homo sapiens
ggcttaaaaggaaaatgagagt

SEQ ID NO: 8359107 - DNA, 22 bp, Homo sapiens
ggcttaaaactttgaaagtgtt

SEQ ID NO: 8359108 - DNA, 22 bp, Homo sapiens
ggcttaaagaattaacagagat

SEQ ID NO: 8359109 - DNA, 22 bp, Homo sapiens
ggcttaaagttttctagaataa

SEQ ID NO: 8359110 - DNA, 22 bp, Homo sapiens
cagaaaggcacccactgggtct

SEQ ID NO: 8359111 - DNA, 22 bp, Homo sapiens
cagaaaggactttggttggctt

SEQ ID NO: 8359112 - DNA, 22 bp, Homo sapiens
cagaaaggacagagtgagggtg

SEQ ID NO: 8359113 - DNA, 23 bp, Homo sapiens
cagaaagtttgagaagatacatc

SEQ ID NO: 8359114 - DNA, 22 bp, Homo sapiens
cagaaaggtatgtgtgcctttg

SEQ ID NO: 8359115 - DNA, 22 bp, Homo sapiens
cagaaaggtatgtgtgcctttg

SEQ ID NO: 8359116 - DNA, 22 bp, Homo sapiens
cagaaataaagtggacagagta

SEQ ID NO: 8359117 - DNA, 22 bp, Homo sapiens
cagaaataaacttctcacatcg

SEQ ID NO: 8359118 - DNA, 22 bp, Homo sapiens
cagaaataaacttctcacatcg

SEQ ID NO: 8359119 - DNA, 22 bp, Homo sapiens
caagtcaactcaaattgttatc

SEQ ID NO: 8359120 - DNA, 22 bp, Homo sapiens
gctgttcattagaaatagaatg

SEQ ID NO: 8359121 - DNA, 22 bp, Homo sapiens
gctgttcccttgtgcctctgtc

SEQ ID NO: 8359122 - DNA, 20 bp, Homo sapiens
gctgttctgaagcagaaggc

SEQ ID NO: 8359123 - DNA, 22 bp, Homo sapiens
gctgttctctgtaacatgcatt

SEQ ID NO: 8359124 - DNA, 22 bp, Homo sapiens
gctgttctagcttcagtttcgc

SEQ ID NO: 8359125 - DNA, 22 bp, Homo sapiens
gctgttctaggagctgtgagca

SEQ ID NO: 8359126 - DNA, 19 bp, Homo sapiens
gctgttctgaccatcaccc

SEQ ID NO: 8359127 - DNA, 19 bp, Homo sapiens
gctgttctgaccatcaccc

SEQ ID NO: 8359128 - DNA, 22 bp, Homo sapiens
gctgttctgcaccagacttcag

SEQ ID NO: 8359129 - DNA, 22 bp, Homo sapiens
gctgttctgcgtcccaggctgg

SEQ ID NO: 8359130 - DNA, 22 bp, Homo sapiens
gctgttctgtccccatgggtaa

SEQ ID NO: 8359131 - DNA, 22 bp, Homo sapiens
caagtttacaatgtgtatgtgt

SEQ ID NO: 8359132 - DNA, 22 bp, Homo sapiens
caagtttacaatgtgtatgtgt

SEQ ID NO: 8359133 - DNA, 22 bp, Homo sapiens
gctgttctttggtcaaaggtat

SEQ ID NO: 8359134 - DNA, 22 bp, Homo sapiens
gctgttctttgcatctctggtg

SEQ ID NO: 8359135 - DNA, 22 bp, Homo sapiens
gctgttctttgcatctctggtg

SEQ ID NO: 8359136 - DNA, 21 bp, Homo sapiens
gctgttctttcagctggtctt

SEQ ID NO: 8359137 - DNA, 18 bp, Homo sapiens
gctgttcttcgcactggc

SEQ ID NO: 8359138 - DNA, 22 bp, Homo sapiens
caagtattctgtaaaaagtcaa

SEQ ID NO: 8359139 - DNA, 22 bp, Homo sapiens
caagtagagattacagtgtgca

SEQ ID NO: 8359140 - DNA, 22 bp, Homo sapiens
caagtaatggttttataatagt

SEQ ID NO: 8359141 - DNA, 22 bp, Homo sapiens
caagtaatggttttataatagt

SEQ ID NO: 8359142 - DNA, 22 bp, Homo sapiens
caaggttctatagcaaaatctg

SEQ ID NO: 8359143 - DNA, 22 bp, Homo sapiens
caaggtcacataacttgtcaaa

SEQ ID NO: 8359144 - DNA, 22 bp, Homo sapiens
caaggtgattgggatagctggt

SEQ ID NO: 8359145 - DNA, 22 bp, Homo sapiens
caaggtgatacttacattagtg

SEQ ID NO: 8359146 - DNA, 22 bp, Homo sapiens
caaggtgaacttgctgtacagc

SEQ ID NO: 8359147 - DNA, 17 bp, Homo sapiens
gcttgggctgcctgttg

SEQ ID NO: 8359148 - DNA, 22 bp, Homo sapiens
gctttctggtttgtgctacagg

SEQ ID NO: 8359149 - DNA, 22 bp, Homo sapiens
gctttctggttctcaaagcact

SEQ ID NO: 8359150 - DNA, 21 bp, Homo sapiens
gctttctgtggactctgcacc

SEQ ID NO: 8359151 - DNA, 21 bp, Homo sapiens
gctttctgtggactctgcacc

SEQ ID NO: 8359152 - DNA, 22 bp, Homo sapiens
gctttcttagtgtgttaattgg

SEQ ID NO: 8359153 - DNA, 18 bp, Homo sapiens
gctttctgtgcagcggag

SEQ ID NO: 8359154 - DNA, 18 bp, Homo sapiens
gctttctgtagaaaaggg

SEQ ID NO: 8359155 - DNA, 22 bp, Homo sapiens
gctttgctagcactgcgcttcc

SEQ ID NO: 8359156 - DNA, 22 bp, Homo sapiens
caatgtcaaggagaccaaaacg

SEQ ID NO: 8359157 - DNA, 21 bp, Homo sapiens
caatgtctgctctctgcctag

SEQ ID NO: 8359158 - DNA, 22 bp, Homo sapiens
caatgttccctgtactgctttt

SEQ ID NO: 8359159 - DNA, 22 bp, Homo sapiens
caatgtttactggggacccaga

SEQ ID NO: 8359160 - DNA, 22 bp, Homo sapiens
caatgtttcttgtaaccagtga

SEQ ID NO: 8359161 - DNA, 22 bp, Homo sapiens
caagggtggtattgggagcata

SEQ ID NO: 8359162 - DNA, 22 bp, Homo sapiens
caagggtggtattgggagcata

SEQ ID NO: 8359163 - DNA, 22 bp, Homo sapiens
caagggtgaaggctcctccagg

SEQ ID NO: 8359164 - DNA, 21 bp, Homo sapiens
gctggctgtcccagggaagca

SEQ ID NO: 8359165 - DNA, 22 bp, Homo sapiens
caaggcttgaattctgatgggt

SEQ ID NO: 8359166 - DNA, 22 bp, Homo sapiens
caagggaagaggacagggacct

SEQ ID NO: 8359167 - DNA, 22 bp, Homo sapiens
gctggctggtccagcaggggct

SEQ ID NO: 8359168 - DNA, 22 bp, Homo sapiens
gctggctgtatcacctggccag

SEQ ID NO: 8359169 - DNA, 22 bp, Homo sapiens
gctggctgggtccctgagaggc

SEQ ID NO: 8359170 - DNA, 22 bp, Homo sapiens
gctggctgggtccctgagaggc

SEQ ID NO: 8359171 - DNA, 22 bp, Homo sapiens
caaggcaggaagcctgtcttat

SEQ ID NO: 8359172 - DNA, 22 bp, Homo sapiens
caaggcagcttaatagaatttg

SEQ ID NO: 8359173 - DNA, 22 bp, Homo sapiens
gctggaggctggagtgcagtgg

SEQ ID NO: 8359174 - DNA, 22 bp, Homo sapiens
caaggccactccagagactggt

SEQ ID NO: 8359175 - DNA, 22 bp, Homo sapiens
caaggccaagtctctgtgaaga

SEQ ID NO: 8359176 - DNA, 22 bp, Homo sapiens
caaggccctgcaacctgacttg

SEQ ID NO: 8359177 - DNA, 22 bp, Homo sapiens
caaatgtgtaaggaagtgttag

SEQ ID NO: 8359178 - DNA, 22 bp, Homo sapiens
caagcaggatgaagcccaggga

SEQ ID NO: 8359179 - DNA, 20 bp, Homo sapiens
caaatggcttttatttcctt

SEQ ID NO: 8359180 - DNA, 22 bp, Homo sapiens
caaatgtaaattcttttgaagc

SEQ ID NO: 8359181 - DNA, 22 bp, Homo sapiens
caagccagtgacagccagggaa

SEQ ID NO: 8359182 - DNA, 22 bp, Homo sapiens
caagccagcttgatgacctgtc

SEQ ID NO: 8359183 - DNA, 22 bp, Homo sapiens
caagcatactgtgagagtttta

SEQ ID NO: 8359184 - DNA, 22 bp, Homo sapiens
caagcatgtcttcttaagcaat

SEQ ID NO: 8359185 - DNA, 22 bp, Homo sapiens
ggaggcaggaaagacaggttca

SEQ ID NO: 8359186 - DNA, 22 bp, Homo sapiens
cacaggagaaaggggaagctcg

SEQ ID NO: 8359187 - DNA, 22 bp, Homo sapiens
ggaggcagaatagagtgtgggt

SEQ ID NO: 8359188 - DNA, 22 bp, Homo sapiens
cacaggaccaattcacattcca

SEQ ID NO: 8359189 - DNA, 22 bp, Homo sapiens
cacaggaattagcagcctaaaa

SEQ ID NO: 8359190 - DNA, 22 bp, Homo sapiens
cacaggactcgactgcagacag

SEQ ID NO: 8359191 - DNA, 22 bp, Homo sapiens
cacaggaatctgcattttgacc

SEQ ID NO: 8359192 - DNA, 22 bp, Homo sapiens
cacaggaatctgcattttgacc

SEQ ID NO: 8359193 - DNA, 22 bp, Homo sapiens
cacaggaatgaacagggaaaga

SEQ ID NO: 8359194 - DNA, 22 bp, Homo sapiens
cacaggaagtggtcagtgccag

SEQ ID NO: 8359195 - DNA, 18 bp, Homo sapiens
cacaggaaggggaatatc

SEQ ID NO: 8359196 - DNA, 22 bp, Homo sapiens
cacaggaaggccttctcacaat

SEQ ID NO: 8359197 - DNA, 20 bp, Homo sapiens
ggagctggcatccagcctct

SEQ ID NO: 8359198 - DNA, 22 bp, Homo sapiens
cacaggaaggccttctcacaat

SEQ ID NO: 8359199 - DNA, 22 bp, Homo sapiens
cacaggaatataagtttgagtt

SEQ ID NO: 8359200 - DNA, 22 bp, Homo sapiens
cacaggaataagtcaaacttca

SEQ ID NO: 8359201 - DNA, 22 bp, Homo sapiens
cacaggaatcgtcacttagcgc

SEQ ID NO: 8359202 - DNA, 22 bp, Homo sapiens
cacaggaatcagcattaatggc

SEQ ID NO: 8359203 - DNA, 22 bp, Homo sapiens
cacaggaatcagcattaatggc

SEQ ID NO: 8359204 - DNA, 22 bp, Homo sapiens
cacaggcttgtcagcatgaggc

SEQ ID NO: 8359205 - DNA, 22 bp, Homo sapiens
cacaggcttgtcagcatgaggc

SEQ ID NO: 8359206 - DNA, 22 bp, Homo sapiens
cacaggcttttctgacataggc

SEQ ID NO: 8359207 - DNA, 20 bp, Homo sapiens
cacaggcttacagtttagat

SEQ ID NO: 8359208 - DNA, 23 bp, Homo sapiens
cacaggctgcgcataagcttctc

SEQ ID NO: 8359209 - DNA, 22 bp, Homo sapiens
ggagctggagagtacagagttt

SEQ ID NO: 8359210 - DNA, 22 bp, Homo sapiens
ggagctgctttgatctgaagaa

SEQ ID NO: 8359211 - DNA, 22 bp, Homo sapiens
ggagctgcttcttgctgtgggt

SEQ ID NO: 8359212 - DNA, 22 bp, Homo sapiens
ggagctgcttcttgctgtgggt

SEQ ID NO: 8359213 - DNA, 22 bp, Homo sapiens
ggagctggagagctagcctagg

SEQ ID NO: 8359214 - DNA, 22 bp, Homo sapiens
cacagagctcaagtcttagaaa

SEQ ID NO: 8359215 - DNA, 22 bp, Homo sapiens
cacagaggcaaccttctggggt

SEQ ID NO: 8359216 - DNA, 21 bp, Homo sapiens
cacagaggcgctgtatggctg

SEQ ID NO: 8359217 - DNA, 22 bp, Homo sapiens
ggactgggattctggatctgct

SEQ ID NO: 8359218 - DNA, 22 bp, Homo sapiens
ggactgggtaggagcccagggc

SEQ ID NO: 8359219 - DNA, 22 bp, Homo sapiens
cacagagaccccttctggggcc

SEQ ID NO: 8359220 - DNA, 22 bp, Homo sapiens
ggactggggccaacacctccct

SEQ ID NO: 8359221 - DNA, 22 bp, Homo sapiens
ggactgggagaatggaggcaag

SEQ ID NO: 8359222 - DNA, 20 bp, Homo sapiens
cacagactgtatgggcacca

SEQ ID NO: 8359223 - DNA, 22 bp, Homo sapiens
cacacagcaacaagaatagcca

SEQ ID NO: 8359224 - DNA, 22 bp, Homo sapiens
cacacagctagtgacaggagaa

SEQ ID NO: 8359225 - DNA, 22 bp, Homo sapiens
cacacagctagtgacaggagaa

SEQ ID NO: 8359226 - DNA, 22 bp, Homo sapiens
cacacagctcaggggcactgcc

SEQ ID NO: 8359227 - DNA, 22 bp, Homo sapiens
cacacagctcaggggcactgcc

SEQ ID NO: 8359228 - DNA, 22 bp, Homo sapiens
ggaagggcaataaaatctcagg

SEQ ID NO: 8359229 - DNA, 22 bp, Homo sapiens
cacacagacagctctctgaaga

SEQ ID NO: 8359230 - DNA, 18 bp, Homo sapiens
caatgttttagatctcta

SEQ ID NO: 8359231 - DNA, 22 bp, Homo sapiens
caatgtttgagtaggagcataa

SEQ ID NO: 8359232 - DNA, 22 bp, Homo sapiens
caatgtttgtgatctactgact

SEQ ID NO: 8359233 - DNA, 22 bp, Homo sapiens
cacaattttaatacacagtcaa

SEQ ID NO: 8359234 - DNA, 22 bp, Homo sapiens
cacaattttaatacacagtcaa

SEQ ID NO: 8359235 - DNA, 22 bp, Homo sapiens
cacagaactggttaatagcaga

SEQ ID NO: 8359236 - DNA, 22 bp, Homo sapiens
cacagaagaatcatgctgtgtt

SEQ ID NO: 8359237 - DNA, 22 bp, Homo sapiens
cacagaagtgtgtataactctt

SEQ ID NO: 8359238 - DNA, 22 bp, Homo sapiens
cacactgtctttatgagctgta

SEQ ID NO: 8359239 - DNA, 22 bp, Homo sapiens
ggaaggggagctggaaagggta

SEQ ID NO: 8359240 - DNA, 22 bp, Homo sapiens
ggaaggggagctggaaagggta

SEQ ID NO: 8359241 - DNA, 20 bp, Homo sapiens
ggaaggggcaaagtgtgtga

SEQ ID NO: 8359242 - DNA, 20 bp, Homo sapiens
ggaaggggcaaagtgtgtga

SEQ ID NO: 8359243 - DNA, 22 bp, Homo sapiens
ctacatttttcaccgagcctct

SEQ ID NO: 8359244 - DNA, 22 bp, Homo sapiens
ctacccagatccaggatggcta

SEQ ID NO: 8359245 - DNA, 22 bp, Homo sapiens
ctacccagatccaggatggcta

SEQ ID NO: 8359246 - DNA, 22 bp, Homo sapiens
ctacatttgttctatagctttt

SEQ ID NO: 8359247 - DNA, 22 bp, Homo sapiens
ctacattttaataagctgctta

SEQ ID NO: 8359248 - DNA, 22 bp, Homo sapiens
ctacattttgtgattatgaaat

SEQ ID NO: 8359249 - DNA, 22 bp, Homo sapiens
ctacatttcccagctgccttcc

SEQ ID NO: 8359250 - DNA, 22 bp, Homo sapiens
ctacatttggagagtataggaa

SEQ ID NO: 8359251 - DNA, 22 bp, Homo sapiens
ctacatttgttcaaataagctg

SEQ ID NO: 8359252 - DNA, 22 bp, Homo sapiens
ctaagcatccatctcttcttca

SEQ ID NO: 8359253 - DNA, 22 bp, Homo sapiens
ctaaggaattcaaatagttagt

SEQ ID NO: 8359254 - DNA, 22 bp, Homo sapiens
agtatgtcagagtgaaaatggt

SEQ ID NO: 8359255 - DNA, 22 bp, Homo sapiens
ctaaggaattggagcatgtgtt

SEQ ID NO: 8359256 - DNA, 22 bp, Homo sapiens
agtatgcaaatgtcataagcat

SEQ ID NO: 8359257 - DNA, 22 bp, Homo sapiens
agtatttagagacacaagatgg

SEQ ID NO: 8359258 - DNA, 22 bp, Homo sapiens
ctagggtcaggggcctgcgtcg

SEQ ID NO: 8359259 - DNA, 22 bp, Homo sapiens
ctagggtcaggggcctgcgtcg

SEQ ID NO: 8359260 - DNA, 22 bp, Homo sapiens
ctagggtcaggggcctgcgtcg

SEQ ID NO: 8359261 - DNA, 22 bp, Homo sapiens
agtccatggttctgactcatct

SEQ ID NO: 8359262 - DNA, 22 bp, Homo sapiens
agtccatggttgtagttctctc

SEQ ID NO: 8359263 - DNA, 19 bp, Homo sapiens
agtccatgaatggaggatg

SEQ ID NO: 8359264 - DNA, 22 bp, Homo sapiens
agtccatgctgtctacagaatc

SEQ ID NO: 8359265 - DNA, 22 bp, Homo sapiens
agtccattaactgtgttaacag

SEQ ID NO: 8359266 - DNA, 18 bp, Homo sapiens
agtccatgcatggctata

SEQ ID NO: 8359267 - DNA, 22 bp, Homo sapiens
agtccatgatgaaaccagatcc

SEQ ID NO: 8359268 - DNA, 22 bp, Homo sapiens
agtccatcttctcttgctggtc

SEQ ID NO: 8359269 - DNA, 20 bp, Homo sapiens
ctagaactgagaaatttaaa

SEQ ID NO: 8359270 - DNA, 22 bp, Homo sapiens
agtccagggcttagtcagcggg

SEQ ID NO: 8359271 - DNA, 22 bp, Homo sapiens
aggtttggtttgacaagactga

SEQ ID NO: 8359272 - DNA, 22 bp, Homo sapiens
aggtttgggttcattgctggct

SEQ ID NO: 8359273 - DNA, 22 bp, Homo sapiens
aggtttgggagtagaaatcaga

SEQ ID NO: 8359274 - DNA, 22 bp, Homo sapiens
cgcaggctggcgcggagtggca

SEQ ID NO: 8359275 - DNA, 22 bp, Homo sapiens
cgcaggctgcagccaagaagag

SEQ ID NO: 8359276 - DNA, 22 bp, Homo sapiens
cgcaggctcggttcacagagca

SEQ ID NO: 8359277 - DNA, 22 bp, Homo sapiens
cgcaggctcggttcacagagca

SEQ ID NO: 8359278 - DNA, 22 bp, Homo sapiens
cgcaggggaggaaggtacacct

SEQ ID NO: 8359279 - DNA, 22 bp, Homo sapiens
cgcaggcaagagagtacagtta

SEQ ID NO: 8359280 - DNA, 19 bp, Homo sapiens
cgcaggagccgaggtgacc

SEQ ID NO: 8359281 - DNA, 22 bp, Homo sapiens
cgcaggcacagagtggacagcg

SEQ ID NO: 8359282 - DNA, 22 bp, Homo sapiens
cctgtgttagttatgggtctct

SEQ ID NO: 8359283 - DNA, 22 bp, Homo sapiens
cctgttcaagggatgattgacc

SEQ ID NO: 8359284 - DNA, 21 bp, Homo sapiens
cctgttcacagatctgtaact

SEQ ID NO: 8359285 - DNA, 22 bp, Homo sapiens
cctgttcaatattcttccttgt

SEQ ID NO: 8359286 - DNA, 22 bp, Homo sapiens
cctgttcaatgccctggcttca

SEQ ID NO: 8359287 - DNA, 19 bp, Homo sapiens
cctgttcatgactctgtcc

SEQ ID NO: 8359288 - DNA, 22 bp, Homo sapiens
cctgttcagagctaagcatcat

SEQ ID NO: 8359289 - DNA, 22 bp, Homo sapiens
cctgttcattttttgactctgc

SEQ ID NO: 8359290 - DNA, 22 bp, Homo sapiens
cctgttcaccctccatgcacag

SEQ ID NO: 8359291 - DNA, 22 bp, Homo sapiens
cctgttcaccatggtcacgtgc

SEQ ID NO: 8359292 - DNA, 20 bp, Homo sapiens
cctgttcactgcgcagtttc

SEQ ID NO: 8359293 - DNA, 22 bp, Homo sapiens
cctgttcactgcacagtttccg

SEQ ID NO: 8359294 - DNA, 22 bp, Homo sapiens
cctgttcactttgacttctcca

SEQ ID NO: 8359295 - DNA, 19 bp, Homo sapiens
cctgttcttggctgaggct

SEQ ID NO: 8359296 - DNA, 22 bp, Homo sapiens
ctaagcaagaatgagtgcaaca

SEQ ID NO: 8359297 - DNA, 22 bp, Homo sapiens
ctaagacatgccctgcatgata

SEQ ID NO: 8359298 - DNA, 22 bp, Homo sapiens
ctaagaaggaggaaaagtgcca

SEQ ID NO: 8359299 - DNA, 22 bp, Homo sapiens
ctaaacttcttggcaattttat

SEQ ID NO: 8359300 - DNA, 22 bp, Homo sapiens
cgggcagatcacacagggcttg

SEQ ID NO: 8359301 - DNA, 22 bp, Homo sapiens
cgggcagattgggaaggttcat

SEQ ID NO: 8359302 - DNA, 17 bp, Homo sapiens
cgggcatggagggcagg

SEQ ID NO: 8359303 - DNA, 22 bp, Homo sapiens
cgggctcagcccggcccctcgc

SEQ ID NO: 8359304 - DNA, 22 bp, Homo sapiens
cgggctcagccagcccattctt

SEQ ID NO: 8359305 - DNA, 22 bp, Homo sapiens
cgggctcaggaggaaacaggag

SEQ ID NO: 8359306 - DNA, 22 bp, Homo sapiens
cgggctcagctccacccacccc

SEQ ID NO: 8359307 - DNA, 22 bp, Homo sapiens
cctgggcttggttgttgagaac

SEQ ID NO: 8359308 - DNA, 22 bp, Homo sapiens
cctgggcttgcatctgtgctgg

SEQ ID NO: 8359309 - DNA, 22 bp, Homo sapiens
cctggtgctgctatcaggggta

SEQ ID NO: 8359310 - DNA, 22 bp, Homo sapiens
cctgtcagggtttgcctcagaa

SEQ ID NO: 8359311 - DNA, 22 bp, Homo sapiens
cctgggctttcaaaaccagcct

SEQ ID NO: 8359312 - DNA, 22 bp, Homo sapiens
cctgggctttcaaaaccagcct

SEQ ID NO: 8359313 - DNA, 22 bp, Homo sapiens
cctgggctttcggcggcttcct

SEQ ID NO: 8359314 - DNA, 22 bp, Homo sapiens
cctgggctttgagggcaggatg

SEQ ID NO: 8359315 - DNA, 22 bp, Homo sapiens
cctgggctccactccaagagca

SEQ ID NO: 8359316 - DNA, 22 bp, Homo sapiens
cctgggctcacagccaaggctc

SEQ ID NO: 8359317 - DNA, 22 bp, Homo sapiens
cctgggctcacagccaaggctc

SEQ ID NO: 8359318 - DNA, 22 bp, Homo sapiens
cctgggctcaagtgatggtccc

SEQ ID NO: 8359319 - DNA, 22 bp, Homo sapiens
cctgggcataaatcactccaag

SEQ ID NO: 8359320 - DNA, 22 bp, Homo sapiens
cctggctctggttccctcagct

SEQ ID NO: 8359321 - DNA, 22 bp, Homo sapiens
cctggctctgtcctcgcgcaaa

SEQ ID NO: 8359322 - DNA, 21 bp, Homo sapiens
aggtggggctgcacctctgct

SEQ ID NO: 8359323 - DNA, 22 bp, Homo sapiens
aggtggggaggagtgtctcttt

SEQ ID NO: 8359324 - DNA, 22 bp, Homo sapiens
cctgtgccagccccttctgctg

SEQ ID NO: 8359325 - DNA, 21 bp, Homo sapiens
cctgtgccaaagtgtgttagg

SEQ ID NO: 8359326 - DNA, 22 bp, Homo sapiens
cctgtcctccaagagcacatct

SEQ ID NO: 8359327 - DNA, 22 bp, Homo sapiens
cctgtcctccggagcgggctgt

SEQ ID NO: 8359328 - DNA, 22 bp, Homo sapiens
cctgtcccaagcagggctggcc

SEQ ID NO: 8359329 - DNA, 22 bp, Homo sapiens
cctgtcccctcacaatgccact

SEQ ID NO: 8359330 - DNA, 22 bp, Homo sapiens
cctgtgacattagaatttcatt

SEQ ID NO: 8359331 - DNA, 22 bp, Homo sapiens
aggtccctcagaggcctcaccg

SEQ ID NO: 8359332 - DNA, 22 bp, Homo sapiens
aggtccctggctagcactggaa

SEQ ID NO: 8359333 - DNA, 22 bp, Homo sapiens
aggtccatcgtggatgaactgc

SEQ ID NO: 8359334 - DNA, 22 bp, Homo sapiens
aggtcctccaccaggtctcctg

SEQ ID NO: 8359335 - DNA, 19 bp, Homo sapiens
aggtcctcaggatgaccct

SEQ ID NO: 8359336 - DNA, 21 bp, Homo sapiens
aggtcctctatccaagttaag

SEQ ID NO: 8359337 - DNA, 22 bp, Homo sapiens
cctggctctgcgtgcagctccg

SEQ ID NO: 8359338 - DNA, 22 bp, Homo sapiens
cctggctctgccacttactgcc

SEQ ID NO: 8359339 - DNA, 22 bp, Homo sapiens
aggtcattaaagttaaatgagg

SEQ ID NO: 8359340 - DNA, 22 bp, Homo sapiens
aggtccagttttctgacaaggg

SEQ ID NO: 8359341 - DNA, 22 bp, Homo sapiens
cctggcacagagcggtggtcac

SEQ ID NO: 8359342 - DNA, 22 bp, Homo sapiens
cctggcaagtgggctcccagat

SEQ ID NO: 8359343 - DNA, 23 bp, Homo sapiens
aggtaggttattgctgctacctg

SEQ ID NO: 8359344 - DNA, 23 bp, Homo sapiens
aggtaggttattgctgctacctg

SEQ ID NO: 8359345 - DNA, 22 bp, Homo sapiens
aggtagggaagaaggcatgaaa

SEQ ID NO: 8359346 - DNA, 22 bp, Homo sapiens
aggtaggatgggtggagatgat

SEQ ID NO: 8359347 - DNA, 22 bp, Homo sapiens
aggtaggatagataggaagacc

SEQ ID NO: 8359348 - DNA, 23 bp, Homo sapiens
cctgcagctgccacgccctgctc

SEQ ID NO: 8359349 - DNA, 22 bp, Homo sapiens
cctgcagctccggatttctggg

SEQ ID NO: 8359350 - DNA, 22 bp, Homo sapiens
cctgcagcctcttctgaaaatc

SEQ ID NO: 8359351 - DNA, 22 bp, Homo sapiens
cctgcagccgtcctgtttgtct

SEQ ID NO: 8359352 - DNA, 23 bp, Homo sapiens
cctgcagctgctggggctccacc

SEQ ID NO: 8359353 - DNA, 18 bp, Homo sapiens
cctgcagcccaggaggcc

SEQ ID NO: 8359354 - DNA, 22 bp, Homo sapiens
cctgcagcccttcaaaggctga

SEQ ID NO: 8359355 - DNA, 22 bp, Homo sapiens
cctgcagcagctgaaatcacag

SEQ ID NO: 8359356 - DNA, 21 bp, Homo sapiens
cctgcagcaccagaaggagat

SEQ ID NO: 8359357 - DNA, 22 bp, Homo sapiens
cctgcagatgtgggacagctgt

SEQ ID NO: 8359358 - DNA, 22 bp, Homo sapiens
cctgcagagcaggagaggcatc

SEQ ID NO: 8359359 - DNA, 22 bp, Homo sapiens
ctgagaaaggacctcaaacagg

SEQ ID NO: 8359360 - DNA, 22 bp, Homo sapiens
ctgagaaaccaggtgctctgat

SEQ ID NO: 8359361 - DNA, 22 bp, Homo sapiens
ctgagaaacatatttccatcta

SEQ ID NO: 8359362 - DNA, 22 bp, Homo sapiens
ctgagaaaccaggtgctctgat

SEQ ID NO: 8359363 - DNA, 22 bp, Homo sapiens
agttaagagtgtgaaaatgtta

SEQ ID NO: 8359364 - DNA, 23 bp, Homo sapiens
agttaggtcaagttaggtcaatt

SEQ ID NO: 8359365 - DNA, 22 bp, Homo sapiens
agttagcagcttattagaaaca

SEQ ID NO: 8359366 - DNA, 22 bp, Homo sapiens
agttagcatctcctccagtcta

SEQ ID NO: 8359367 - DNA, 22 bp, Homo sapiens
ctgagcagcaacccagagcctc

SEQ ID NO: 8359368 - DNA, 22 bp, Homo sapiens
ctgagcagcaccttcaagaaac

SEQ ID NO: 8359369 - DNA, 22 bp, Homo sapiens
ctgagcagcacagggcgccagg

SEQ ID NO: 8359370 - DNA, 22 bp, Homo sapiens
ctgagcagcaccttcaagaaac

SEQ ID NO: 8359371 - DNA, 22 bp, Homo sapiens
ctgaggagaccatcaactaatt

SEQ ID NO: 8359372 - DNA, 22 bp, Homo sapiens
ctgaggagaggtggcctgtgtt

SEQ ID NO: 8359373 - DNA, 22 bp, Homo sapiens
ctgaggagaggtggcctgtgtt

SEQ ID NO: 8359374 - DNA, 22 bp, Homo sapiens
ctgagctgggactcagtagcaa

SEQ ID NO: 8359375 - DNA, 22 bp, Homo sapiens
ctgagcagcagggagactggtg

SEQ ID NO: 8359376 - DNA, 17 bp, Homo sapiens
ctgaggagaacagaaag

SEQ ID NO: 8359377 - DNA, 22 bp, Homo sapiens
ctgaggagacagaagccaaata

SEQ ID NO: 8359378 - DNA, 22 bp, Homo sapiens
ctgagaaaagctttcttataca

SEQ ID NO: 8359379 - DNA, 22 bp, Homo sapiens
ctgacttttttcagccacagtg

SEQ ID NO: 8359380 - DNA, 22 bp, Homo sapiens
ctgagaaaatttcaggaagtgt

SEQ ID NO: 8359381 - DNA, 22 bp, Homo sapiens
ctgagaaaatttcaggaagtgt

SEQ ID NO: 8359382 - DNA, 22 bp, Homo sapiens
ctgagaaaagtatgagctctgg

SEQ ID NO: 8359383 - DNA, 22 bp, Homo sapiens
ctgagaaaagctttcttataca

SEQ ID NO: 8359384 - DNA, 22 bp, Homo sapiens
ctgagaaaagtatgagctctgg

SEQ ID NO: 8359385 - DNA, 22 bp, Homo sapiens
ctgactttagaacccaaaaagt

SEQ ID NO: 8359386 - DNA, 22 bp, Homo sapiens
ctgactttagaacccaaaaagt

SEQ ID NO: 8359387 - DNA, 22 bp, Homo sapiens
ctgactttgacttggtcattga

SEQ ID NO: 8359388 - DNA, 22 bp, Homo sapiens
ctgactttgacttggtcattga

SEQ ID NO: 8359389 - DNA, 22 bp, Homo sapiens
ctgactttgctcataggtcaaa

SEQ ID NO: 8359390 - DNA, 22 bp, Homo sapiens
ctgactttgctcataggtcaaa

SEQ ID NO: 8359391 - DNA, 22 bp, Homo sapiens
ctgacttttccaaataatactt

SEQ ID NO: 8359392 - DNA, 22 bp, Homo sapiens
ctgacttttttcagccacagtg

SEQ ID NO: 8359393 - DNA, 23 bp, Homo sapiens
ctgaaattcagatgctaaagata

SEQ ID NO: 8359394 - DNA, 23 bp, Homo sapiens
ctgaaattcagatgctaaagata

SEQ ID NO: 8359395 - DNA, 22 bp, Homo sapiens
ctgaaatggttgcctggagaat

SEQ ID NO: 8359396 - DNA, 22 bp, Homo sapiens
ctgaaattattgtttaatcaaa

SEQ ID NO: 8359397 - DNA, 22 bp, Homo sapiens
ctgaaattattgtttaatcaaa

SEQ ID NO: 8359398 - DNA, 22 bp, Homo sapiens
agtgtctgcgggcagaggagcg

SEQ ID NO: 8359399 - DNA, 22 bp, Homo sapiens
agtgtctgcctgggaggagcat

SEQ ID NO: 8359400 - DNA, 22 bp, Homo sapiens
ctgaagctttacttcaaataca

SEQ ID NO: 8359401 - DNA, 22 bp, Homo sapiens
agtgtctgctttgagtcaggtg

SEQ ID NO: 8359402 - DNA, 20 bp, Homo sapiens
agtgtctggattttgtaacc

SEQ ID NO: 8359403 - DNA, 22 bp, Homo sapiens
ctctggcttgttaatgcatatt

SEQ ID NO: 8359404 - DNA, 22 bp, Homo sapiens
ctctggctttaaggatgccaca

SEQ ID NO: 8359405 - DNA, 22 bp, Homo sapiens
ctctggcttgttaatgcatatt

SEQ ID NO: 8359406 - DNA, 22 bp, Homo sapiens
ctctggcttggtaaaaacttct

SEQ ID NO: 8359407 - DNA, 22 bp, Homo sapiens
ctctggctttcccagggaggag

SEQ ID NO: 8359408 - DNA, 22 bp, Homo sapiens
ctctggctttgctcatgcatcc

SEQ ID NO: 8359409 - DNA, 22 bp, Homo sapiens
ctctgggaattctgagcaagca

SEQ ID NO: 8359410 - DNA, 22 bp, Homo sapiens
ctctgggaagggctgagcactg

SEQ ID NO: 8359411 - DNA, 22 bp, Homo sapiens
ctctggctttgctcatgcatcc

SEQ ID NO: 8359412 - DNA, 22 bp, Homo sapiens
ctctggctttgctcatgcatcc

SEQ ID NO: 8359413 - DNA, 20 bp, Homo sapiens
ctctgggctgcgttgcaaac

SEQ ID NO: 8359414 - DNA, 22 bp, Homo sapiens
ctctgggaccacgtgactctgc

SEQ ID NO: 8359415 - DNA, 22 bp, Homo sapiens
ctctgggaccatggcaagtgcg

SEQ ID NO: 8359416 - DNA, 17 bp, Homo sapiens
ctctggggacagttcta

SEQ ID NO: 8359417 - DNA, 22 bp, Homo sapiens
ctctggggaagcagccagctgg

SEQ ID NO: 8359418 - DNA, 22 bp, Homo sapiens
ctctggggaaatggatatgtac

SEQ ID NO: 8359419 - DNA, 22 bp, Homo sapiens
ctctggggttaagcttccatgg

SEQ ID NO: 8359420 - DNA, 22 bp, Homo sapiens
ctctggggttaagcttccatgg

SEQ ID NO: 8359421 - DNA, 22 bp, Homo sapiens
ctctttggtgcaccttgcagtc

SEQ ID NO: 8359422 - DNA, 22 bp, Homo sapiens
ctctggggtggaggaggctgac

SEQ ID NO: 8359423 - DNA, 22 bp, Homo sapiens
ctgaaatgggcaaaagtagatt

SEQ ID NO: 8359424 - DNA, 22 bp, Homo sapiens
ctgaaataaagttgctaaaatt

SEQ ID NO: 8359425 - DNA, 23 bp, Homo sapiens
ctgaaataccagaaaatcagtgt

SEQ ID NO: 8359426 - DNA, 22 bp, Homo sapiens
ctctttggttaatcacacagat

SEQ ID NO: 8359427 - DNA, 22 bp, Homo sapiens
ctctgagctccaaaagtcagca

SEQ ID NO: 8359428 - DNA, 22 bp, Homo sapiens
ctctcatgagcattcctaaggg

SEQ ID NO: 8359429 - DNA, 22 bp, Homo sapiens
ctctcagtttcctcaactgtaa

SEQ ID NO: 8359430 - DNA, 22 bp, Homo sapiens
ctctcagtgccacacagccatt

SEQ ID NO: 8359431 - DNA, 22 bp, Homo sapiens
ctctcagggcaggtggcctttc

SEQ ID NO: 8359432 - DNA, 22 bp, Homo sapiens
ctctgcaggcacccagggtggg

SEQ ID NO: 8359433 - DNA, 22 bp, Homo sapiens
ctctgcaggcacccagggtggg

SEQ ID NO: 8359434 - DNA, 22 bp, Homo sapiens
ctctgcaggcctgtgaagggtg

SEQ ID NO: 8359435 - DNA, 23 bp, Homo sapiens
ctctgcaggagagtgggcagggc

SEQ ID NO: 8359436 - DNA, 22 bp, Homo sapiens
ctctgcaggccttgagtgtggt

SEQ ID NO: 8359437 - DNA, 22 bp, Homo sapiens
ctctgcaggggaggcatgcact

SEQ ID NO: 8359438 - DNA, 17 bp, Homo sapiens
ctctgcagtgcatggct

SEQ ID NO: 8359439 - DNA, 17 bp, Homo sapiens
ctctgcagtgcatggct

SEQ ID NO: 8359440 - DNA, 21 bp, Homo sapiens
ctctgcagtgcccaccttgcc

SEQ ID NO: 8359441 - DNA, 22 bp, Homo sapiens
ctctgctcaccagccatgtgat

SEQ ID NO: 8359442 - DNA, 22 bp, Homo sapiens
ctctggattgctgtgagatgct

SEQ ID NO: 8359443 - DNA, 22 bp, Homo sapiens
ctctgctgatctcagctgggct

SEQ ID NO: 8359444 - DNA, 22 bp, Homo sapiens
ctctgcatcaggcattatggat

SEQ ID NO: 8359445 - DNA, 22 bp, Homo sapiens
ctctgcatcagcttcattctgt

SEQ ID NO: 8359446 - DNA, 22 bp, Homo sapiens
ctctgcatgccacatgagtgac

SEQ ID NO: 8359447 - DNA, 22 bp, Homo sapiens
ctctgcattttaacagatgatt

SEQ ID NO: 8359448 - DNA, 22 bp, Homo sapiens
ctctgcctgtgtcgccaccaca

SEQ ID NO: 8359449 - DNA, 22 bp, Homo sapiens
agtcttatggttaaatagatgc

SEQ ID NO: 8359450 - DNA, 22 bp, Homo sapiens
agtcttatatcactatgctctg

SEQ ID NO: 8359451 - DNA, 22 bp, Homo sapiens
agtcttctcatttcacatgctt

SEQ ID NO: 8359452 - DNA, 21 bp, Homo sapiens
agtcttctccagaggctgggg

SEQ ID NO: 8359453 - DNA, 21 bp, Homo sapiens
agtcttctccagaggctgggg

SEQ ID NO: 8359454 - DNA, 22 bp, Homo sapiens
agtcttctcatttcacatgctt

SEQ ID NO: 8359455 - DNA, 22 bp, Homo sapiens
ctccagctgagtaagaacacta

SEQ ID NO: 8359456 - DNA, 22 bp, Homo sapiens
ctccagcttctgcccagagact

SEQ ID NO: 8359457 - DNA, 22 bp, Homo sapiens
ctccaggaaagcctgaggcccg

SEQ ID NO: 8359458 - DNA, 22 bp, Homo sapiens
ctccaggaaagcctgaggcccg

SEQ ID NO: 8359459 - DNA, 22 bp, Homo sapiens
ctcattagacaggtatacttta

SEQ ID NO: 8359460 - DNA, 22 bp, Homo sapiens
ctcattaaaggaaatcacctgc

SEQ ID NO: 8359461 - DNA, 18 bp, Homo sapiens
ctcatgtgtggtcccagc

SEQ ID NO: 8359462 - DNA, 20 bp, Homo sapiens
ctcatgtggcaccaggcact

SEQ ID NO: 8359463 - DNA, 22 bp, Homo sapiens
ctcatgtcaggggtgtcaatgt

SEQ ID NO: 8359464 - DNA, 22 bp, Homo sapiens
ctcatgtcttcacccattctaa

SEQ ID NO: 8359465 - DNA, 22 bp, Homo sapiens
ctcattgcagctgcattactgt

SEQ ID NO: 8359466 - DNA, 22 bp, Homo sapiens
ctcattctttcacagtctgtgg

SEQ ID NO: 8359467 - DNA, 22 bp, Homo sapiens
ctcattctttcacagtctgtgg

SEQ ID NO: 8359468 - DNA, 22 bp, Homo sapiens
agtcctggccccaaggaaggat

SEQ ID NO: 8359469 - DNA, 18 bp, Homo sapiens
ctcagtgtttgctgaaaa

SEQ ID NO: 8359470 - DNA, 22 bp, Homo sapiens
ctcagtgttggagaccttcagg

SEQ ID NO: 8359471 - DNA, 18 bp, Homo sapiens
ctcagtgtttgctgaaaa

SEQ ID NO: 8359472 - DNA, 22 bp, Homo sapiens
agtcctggccccaaggaaggat

SEQ ID NO: 8359473 - DNA, 22 bp, Homo sapiens
agtggcagatctctggtctgga

SEQ ID NO: 8359474 - DNA, 22 bp, Homo sapiens
agtggcagagttgaataattga

SEQ ID NO: 8359475 - DNA, 22 bp, Homo sapiens
ctctcagaagtttatgtcagaa

SEQ ID NO: 8359476 - DNA, 22 bp, Homo sapiens
ctcctgggtcattgccagcaaa

SEQ ID NO: 8359477 - DNA, 20 bp, Homo sapiens
ctcctggtccaggagcctga

SEQ ID NO: 8359478 - DNA, 22 bp, Homo sapiens
agtggcagagctgtgtcttgaa

SEQ ID NO: 8359479 - DNA, 22 bp, Homo sapiens
agtggcagaagtcactgggtag

SEQ ID NO: 8359480 - DNA, 22 bp, Homo sapiens
agtggcagaagccaagtctgca

SEQ ID NO: 8359481 - DNA, 22 bp, Homo sapiens
agtggcagaagccaagtctgca

SEQ ID NO: 8359482 - DNA, 22 bp, Homo sapiens
agtggcagaggttgactgcagt

SEQ ID NO: 8359483 - DNA, 22 bp, Homo sapiens
agtggcagagtcagggtttgga

SEQ ID NO: 8359484 - DNA, 22 bp, Homo sapiens
agtggcagagtgcactcaggca

SEQ ID NO: 8359485 - DNA, 22 bp, Homo sapiens
agtggcagagtgcactcaggca

SEQ ID NO: 8359486 - DNA, 22 bp, Homo sapiens
ctcctggctttcccagaccagg

SEQ ID NO: 8359487 - DNA, 22 bp, Homo sapiens
ctcctgggaaatgaaggggcag

SEQ ID NO: 8359488 - DNA, 22 bp, Homo sapiens
ctcctgggaaatgaaggggcag

SEQ ID NO: 8359489 - DNA, 22 bp, Homo sapiens
ctcctgggaatttagttgtgag

SEQ ID NO: 8359490 - DNA, 22 bp, Homo sapiens
ctcctgggggacagcggcaggg

SEQ ID NO: 8359491 - DNA, 22 bp, Homo sapiens
ctcctgggggacagcggcaggg

SEQ ID NO: 8359492 - DNA, 22 bp, Homo sapiens
ctcctggggccatggaaggaac

SEQ ID NO: 8359493 - DNA, 22 bp, Homo sapiens
ctccggaggggcgctcatgctt

SEQ ID NO: 8359494 - DNA, 22 bp, Homo sapiens
ctcctacattccaccttggact

SEQ ID NO: 8359495 - DNA, 22 bp, Homo sapiens
ctcctagatgtcttcagagaaa

SEQ ID NO: 8359496 - DNA, 22 bp, Homo sapiens
ctcctacagtgtttgagtccag

SEQ ID NO: 8359497 - DNA, 22 bp, Homo sapiens
ctcctacagtgtttgagtccag

SEQ ID NO: 8359498 - DNA, 22 bp, Homo sapiens
ctcctcactttccagactgggc

SEQ ID NO: 8359499 - DNA, 22 bp, Homo sapiens
ctcctaggtgctcactggggtc

SEQ ID NO: 8359500 - DNA, 18 bp, Homo sapiens
ctcctggctgatggtgag

SEQ ID NO: 8359501 - DNA, 18 bp, Homo sapiens
ctcctggctgatggtgag

SEQ ID NO: 8359502 - DNA, 22 bp, Homo sapiens
ctcctggctcgcccccagctga

SEQ ID NO: 8359503 - DNA, 22 bp, Homo sapiens
ctccctcagaggagcacctgtt

SEQ ID NO: 8359504 - DNA, 18 bp, Homo sapiens
ctccagggaactcagtca

SEQ ID NO: 8359505 - DNA, 22 bp, Homo sapiens
ctccctccaaataagactcggg

SEQ ID NO: 8359506 - DNA, 22 bp, Homo sapiens
ctccctccctacgtgagctcac

SEQ ID NO: 8359507 - DNA, 22 bp, Homo sapiens
ctgggctcacctgtggctggca

SEQ ID NO: 8359508 - DNA, 20 bp, Homo sapiens
ctgggctcaagtgatcctcc

SEQ ID NO: 8359509 - DNA, 22 bp, Homo sapiens
atatgcagagagcatgaatagg

SEQ ID NO: 8359510 - DNA, 22 bp, Homo sapiens
atatgcacatacatacataggt

SEQ ID NO: 8359511 - DNA, 22 bp, Homo sapiens
atatgcatataaagcttttagt

SEQ ID NO: 8359512 - DNA, 20 bp, Homo sapiens
ctggcttcgggaactagttt

SEQ ID NO: 8359513 - DNA, 22 bp, Homo sapiens
ctggctgggagcgagctgctca

SEQ ID NO: 8359514 - DNA, 22 bp, Homo sapiens
ctggctgtggattatcacaggc

SEQ ID NO: 8359515 - DNA, 22 bp, Homo sapiens
ctggctgtggtcacaggtaact

SEQ ID NO: 8359516 - DNA, 22 bp, Homo sapiens
ctggctgtgtcttggaggagct

SEQ ID NO: 8359517 - DNA, 22 bp, Homo sapiens
ctggctgtttcaggcagtgtcc

SEQ ID NO: 8359518 - DNA, 22 bp, Homo sapiens
ctggctgtttcaggcagtgtcc

SEQ ID NO: 8359519 - DNA, 19 bp, Homo sapiens
ctggcttcaagcagtcctc

SEQ ID NO: 8359520 - DNA, 22 bp, Homo sapiens
ctggcttccctgtcttatggaa

SEQ ID NO: 8359521 - DNA, 22 bp, Homo sapiens
ctggcttccctgtcttatggaa

SEQ ID NO: 8359522 - DNA, 22 bp, Homo sapiens
atatgtttttggaaagaacaca

SEQ ID NO: 8359523 - DNA, 22 bp, Homo sapiens
atattaaaactatggttttcag

SEQ ID NO: 8359524 - DNA, 22 bp, Homo sapiens
atattacataaacatgagtgaa

SEQ ID NO: 8359525 - DNA, 22 bp, Homo sapiens
atatgccattagctagaaataa

SEQ ID NO: 8359526 - DNA, 22 bp, Homo sapiens
atatgccattagctagaaataa

SEQ ID NO: 8359527 - DNA, 22 bp, Homo sapiens
atatgcatgcatgcttgtgaga

SEQ ID NO: 8359528 - DNA, 22 bp, Homo sapiens
atatgcatctgtgtgcgtgtct

SEQ ID NO: 8359529 - DNA, 22 bp, Homo sapiens
atatgcatctgtgtgcgtgtct

SEQ ID NO: 8359530 - DNA, 22 bp, Homo sapiens
atatgcatatgtcaaaacttat

SEQ ID NO: 8359531 - DNA, 22 bp, Homo sapiens
atatgcatgcatgcttgtgaga

SEQ ID NO: 8359532 - DNA, 22 bp, Homo sapiens
atatgcattaacattgtaggag

SEQ ID NO: 8359533 - DNA, 20 bp, Homo sapiens
atatgcatgtgttttcactt

SEQ ID NO: 8359534 - DNA, 22 bp, Homo sapiens
atatgccatactgtacaatact

SEQ ID NO: 8359535 - DNA, 21 bp, Homo sapiens
atatgccaaatgccagtaacc

SEQ ID NO: 8359536 - DNA, 22 bp, Homo sapiens
atatgcattcatacttagtgga

SEQ ID NO: 8359537 - DNA, 22 bp, Homo sapiens
atatgcattcatacttagtgga

SEQ ID NO: 8359538 - DNA, 22 bp, Homo sapiens
atattactctgatttagtaaat

SEQ ID NO: 8359539 - DNA, 22 bp, Homo sapiens
atattacttcctggtataaaat

SEQ ID NO: 8359540 - DNA, 22 bp, Homo sapiens
atattacataaacatgagtgaa

SEQ ID NO: 8359541 - DNA, 22 bp, Homo sapiens
atattagtttggagactacaat

SEQ ID NO: 8359542 - DNA, 22 bp, Homo sapiens
atattcttcttgttcagactat

SEQ ID NO: 8359543 - DNA, 22 bp, Homo sapiens
atattcactgggtactaaaaag

SEQ ID NO: 8359544 - DNA, 22 bp, Homo sapiens
ctgggctgagcctgggctgtgt

SEQ ID NO: 8359545 - DNA, 22 bp, Homo sapiens
ctgggctgaaggctccccacac

SEQ ID NO: 8359546 - DNA, 22 bp, Homo sapiens
atattatggccccatctaagct

SEQ ID NO: 8359547 - DNA, 22 bp, Homo sapiens
atattatagacagagtcttctg

SEQ ID NO: 8359548 - DNA, 22 bp, Homo sapiens
atattataagttatttcaagtt

SEQ ID NO: 8359549 - DNA, 22 bp, Homo sapiens
atattataagttatttcaagtt

SEQ ID NO: 8359550 - DNA, 22 bp, Homo sapiens
atcaaaatggaagaatttggct

SEQ ID NO: 8359551 - DNA, 22 bp, Homo sapiens
atcaaaatgctccagtgatggt

SEQ ID NO: 8359552 - DNA, 22 bp, Homo sapiens
atcaaagaatgtgactgaaata

SEQ ID NO: 8359553 - DNA, 22 bp, Homo sapiens
atcaaagaatgtgactgaaata

SEQ ID NO: 8359554 - DNA, 22 bp, Homo sapiens
atcaaagaatgtgactgaaata

SEQ ID NO: 8359555 - DNA, 22 bp, Homo sapiens
atatttaaacagggtaccaata

SEQ ID NO: 8359556 - DNA, 22 bp, Homo sapiens
atcaaagtgatttgtaaacagg

SEQ ID NO: 8359557 - DNA, 22 bp, Homo sapiens
atcaaaggtatctatgctgtct

SEQ ID NO: 8359558 - DNA, 22 bp, Homo sapiens
atcaaagtaattaacactgaga

SEQ ID NO: 8359559 - DNA, 22 bp, Homo sapiens
atcaaagtaattaacactgaga

SEQ ID NO: 8359560 - DNA, 22 bp, Homo sapiens
atcaaagtatctcaatatggta

SEQ ID NO: 8359561 - DNA, 23 bp, Homo sapiens
atcaaaggatgtagagaagaagc

SEQ ID NO: 8359562 - DNA, 22 bp, Homo sapiens
atattgtactagggttacatgt

SEQ ID NO: 8359563 - DNA, 22 bp, Homo sapiens
atattgtactagggttacatgt

SEQ ID NO: 8359564 - DNA, 21 bp, Homo sapiens
atattgtaggtaaagtgcagg

SEQ ID NO: 8359565 - DNA, 22 bp, Homo sapiens
atattgttagtaatatttcgaa

SEQ ID NO: 8359566 - DNA, 22 bp, Homo sapiens
atattgttgactataagagtaa

SEQ ID NO: 8359567 - DNA, 22 bp, Homo sapiens
atattgccagcttagtggattc

SEQ ID NO: 8359568 - DNA, 22 bp, Homo sapiens
atattgcattggctggtcttga

SEQ ID NO: 8359569 - DNA, 22 bp, Homo sapiens
atattgcaatagatgcatcatt

SEQ ID NO: 8359570 - DNA, 22 bp, Homo sapiens
atcaaatcattgcattaatgtt

SEQ ID NO: 8359571 - DNA, 22 bp, Homo sapiens
atcaaatcattgcattaatgtt

SEQ ID NO: 8359572 - DNA, 22 bp, Homo sapiens
atcaacagagcaaagcctgaac

SEQ ID NO: 8359573 - DNA, 22 bp, Homo sapiens
atcaaattggaatgaaaggctc

SEQ ID NO: 8359574 - DNA, 22 bp, Homo sapiens
atcaaatacaaagggcataagg

SEQ ID NO: 8359575 - DNA, 22 bp, Homo sapiens
atcaaagttcgtaactgataac

SEQ ID NO: 8359576 - DNA, 22 bp, Homo sapiens
atcacattctttcaaagcagtc

SEQ ID NO: 8359577 - DNA, 22 bp, Homo sapiens
atcaacttttagcatggtacct

SEQ ID NO: 8359578 - DNA, 22 bp, Homo sapiens
atcactttggtaccaattcagc

SEQ ID NO: 8359579 - DNA, 22 bp, Homo sapiens
atcaacattccaatgtggtaga

SEQ ID NO: 8359580 - DNA, 21 bp, Homo sapiens
atcagaaaatgtaatggagca

SEQ ID NO: 8359581 - DNA, 22 bp, Homo sapiens
atcagaaatagtcatgttactt

SEQ ID NO: 8359582 - DNA, 22 bp, Homo sapiens
atcagaaattgcccagctgttt

SEQ ID NO: 8359583 - DNA, 22 bp, Homo sapiens
atcagaaaggtgggcaagcaga

SEQ ID NO: 8359584 - DNA, 22 bp, Homo sapiens
atcagaaattgcccagctgttt

SEQ ID NO: 8359585 - DNA, 22 bp, Homo sapiens
atcagaatagtgggggacagtc

SEQ ID NO: 8359586 - DNA, 22 bp, Homo sapiens
atcagaatagtgggggacagtc

SEQ ID NO: 8359587 - DNA, 22 bp, Homo sapiens
ctgtgggaaaggatgagattgc

SEQ ID NO: 8359588 - DNA, 22 bp, Homo sapiens
ctgtggctcaattgcctactga

SEQ ID NO: 8359589 - DNA, 22 bp, Homo sapiens
ctgtgggactctgaggaaaagc

SEQ ID NO: 8359590 - DNA, 22 bp, Homo sapiens
ctgtgggactctgaggaaaagc

SEQ ID NO: 8359591 - DNA, 22 bp, Homo sapiens
ctgtgggagaagctagcacagg

SEQ ID NO: 8359592 - DNA, 21 bp, Homo sapiens
ctgtgggaccaagcactggga

SEQ ID NO: 8359593 - DNA, 21 bp, Homo sapiens
ctgtgggaccaagcactggga

SEQ ID NO: 8359594 - DNA, 21 bp, Homo sapiens
ctgtgggaccaagcactggga

SEQ ID NO: 8359595 - DNA, 22 bp, Homo sapiens
ctgtgggagaggtgcctggatt

SEQ ID NO: 8359596 - DNA, 22 bp, Homo sapiens
ctgtgggagaagttgctggagt

SEQ ID NO: 8359597 - DNA, 22 bp, Homo sapiens
ctgtgggagaagctagcacagg

SEQ ID NO: 8359598 - DNA, 22 bp, Homo sapiens
ctgtgggagaagggctttttct

SEQ ID NO: 8359599 - DNA, 22 bp, Homo sapiens
ctgtgggagaagttgctggagt

SEQ ID NO: 8359600 - DNA, 23 bp, Homo sapiens
ctgtgggaagtcggggagcgcgc

SEQ ID NO: 8359601 - DNA, 22 bp, Homo sapiens
ctgtgggaacactgaggacttc

SEQ ID NO: 8359602 - DNA, 23 bp, Homo sapiens
ctgtgggaagtcggggagcgcgc

SEQ ID NO: 8359603 - DNA, 18 bp, Homo sapiens
ctgtgggaaggctttcta

SEQ ID NO: 8359604 - DNA, 18 bp, Homo sapiens
ctgtgggaaggctttcta

SEQ ID NO: 8359605 - DNA, 22 bp, Homo sapiens
ctgtgggaatactgcgagtgta

SEQ ID NO: 8359606 - DNA, 22 bp, Homo sapiens
ctgtgggaatactgcgagtgta

SEQ ID NO: 8359607 - DNA, 22 bp, Homo sapiens
ctgtgggaaaggatgagattgc

SEQ ID NO: 8359608 - DNA, 22 bp, Homo sapiens
ctgtgggaacactgaggacttc

SEQ ID NO: 8359609 - DNA, 18 bp, Homo sapiens
ctgtgggaagagtttggg

SEQ ID NO: 8359610 - DNA, 18 bp, Homo sapiens
ctgtgggaagagtttggg

SEQ ID NO: 8359611 - DNA, 22 bp, Homo sapiens
atcagagcaatggataaaatca

SEQ ID NO: 8359612 - DNA, 22 bp, Homo sapiens
atcagagcactgagcaggacac

SEQ ID NO: 8359613 - DNA, 22 bp, Homo sapiens
atcagagacaaaaccagcactt

SEQ ID NO: 8359614 - DNA, 20 bp, Homo sapiens
atcagacttttaggaacata

SEQ ID NO: 8359615 - DNA, 22 bp, Homo sapiens
atcagagaagtttcactggcat

SEQ ID NO: 8359616 - DNA, 22 bp, Homo sapiens
atcagaattagccagtgaggct

SEQ ID NO: 8359617 - DNA, 21 bp, Homo sapiens
ctgtggcctggctagcaccgt

SEQ ID NO: 8359618 - DNA, 19 bp, Homo sapiens
ctgtggcctccaggaggga

SEQ ID NO: 8359619 - DNA, 22 bp, Homo sapiens
ctgtggcctttgttggaggtcc

SEQ ID NO: 8359620 - DNA, 22 bp, Homo sapiens
ctgtggccctgtgatctggcac

SEQ ID NO: 8359621 - DNA, 23 bp, Homo sapiens
ctgtggccctgcttcatgcagcc

SEQ ID NO: 8359622 - DNA, 22 bp, Homo sapiens
atccaccctgtggtggctttct

SEQ ID NO: 8359623 - DNA, 22 bp, Homo sapiens
ctgtgggagaggtgcctggatt

SEQ ID NO: 8359624 - DNA, 22 bp, Homo sapiens
ctgtgggagaggtgcctggatt

SEQ ID NO: 8359625 - DNA, 22 bp, Homo sapiens
atccagggataaaagtaaggtt

SEQ ID NO: 8359626 - DNA, 22 bp, Homo sapiens
atccagggtgtggagagagctc

SEQ ID NO: 8359627 - DNA, 22 bp, Homo sapiens
atccagtgagtgcagctgttgt

SEQ ID NO: 8359628 - DNA, 22 bp, Homo sapiens
atccagtcaaaattagtaaggt

SEQ ID NO: 8359629 - DNA, 22 bp, Homo sapiens
atcctgggctgcaccctcagcc

SEQ ID NO: 8359630 - DNA, 22 bp, Homo sapiens
atcctgtctttgttttaaatat

SEQ ID NO: 8359631 - DNA, 22 bp, Homo sapiens
atcctgtctatgagtagataat

SEQ ID NO: 8359632 - DNA, 22 bp, Homo sapiens
ctgtgtgtcctcggacgagttt

SEQ ID NO: 8359633 - DNA, 22 bp, Homo sapiens
ctgtgtgtcctcggacgagttt

SEQ ID NO: 8359634 - DNA, 22 bp, Homo sapiens
cttagatgaagtcacagaaccc

SEQ ID NO: 8359635 - DNA, 22 bp, Homo sapiens
cttagagatgggttttacttag

SEQ ID NO: 8359636 - DNA, 22 bp, Homo sapiens
cttagaaattgttactcattca

SEQ ID NO: 8359637 - DNA, 22 bp, Homo sapiens
cttagaaattgttactcattca

SEQ ID NO: 8359638 - DNA, 22 bp, Homo sapiens
atccttaagaaagttttctata

SEQ ID NO: 8359639 - DNA, 22 bp, Homo sapiens
atccttaaaggaattctgattt

SEQ ID NO: 8359640 - DNA, 20 bp, Homo sapiens
atccttaaagagaatttcta

SEQ ID NO: 8359641 - DNA, 22 bp, Homo sapiens
atcctgtgcaatgactgcatct

SEQ ID NO: 8359642 - DNA, 22 bp, Homo sapiens
cttagaaattgttactcattca

SEQ ID NO: 8359643 - DNA, 20 bp, Homo sapiens
cttagaaatttttaccctgg

SEQ ID NO: 8359644 - DNA, 22 bp, Homo sapiens
cttcctcccccacacactcact

SEQ ID NO: 8359645 - DNA, 22 bp, Homo sapiens
cttcccaagactgtattgcaag

SEQ ID NO: 8359646 - DNA, 22 bp, Homo sapiens
cttcccaagctttagttatttt

SEQ ID NO: 8359647 - DNA, 21 bp, Homo sapiens
cttcccaaggcttcaaagcct

SEQ ID NO: 8359648 - DNA, 17 bp, Homo sapiens
cttcccaccatctcctg

SEQ ID NO: 8359649 - DNA, 22 bp, Homo sapiens
cttcctcctccatctcgaaggc

SEQ ID NO: 8359650 - DNA, 22 bp, Homo sapiens
cttcctccgaagaagttgctgg

SEQ ID NO: 8359651 - DNA, 22 bp, Homo sapiens
cttcctcccggcccatgctctg

SEQ ID NO: 8359652 - DNA, 22 bp, Homo sapiens
atctgaaactctgacattgtct

SEQ ID NO: 8359653 - DNA, 22 bp, Homo sapiens
atctgaagtccttataatctga

SEQ ID NO: 8359654 - DNA, 22 bp, Homo sapiens
atctgcatcagactttgcatga

SEQ ID NO: 8359655 - DNA, 22 bp, Homo sapiens
atctgcaggatgttaggatgat

SEQ ID NO: 8359656 - DNA, 22 bp, Homo sapiens
atctgcagaggacaggcgagga

SEQ ID NO: 8359657 - DNA, 22 bp, Homo sapiens
atagattagccctatagtttta

SEQ ID NO: 8359658 - DNA, 22 bp, Homo sapiens
atagatgttcaatcagatattt

SEQ ID NO: 8359659 - DNA, 22 bp, Homo sapiens
atagacttgaggatataatgaa

SEQ ID NO: 8359660 - DNA, 22 bp, Homo sapiens
atactcaatttgttggaaagca

SEQ ID NO: 8359661 - DNA, 22 bp, Homo sapiens
atactcaaggttaatgattgaa

SEQ ID NO: 8359662 - DNA, 22 bp, Homo sapiens
atactcaaggttaatgattgaa

SEQ ID NO: 8359663 - DNA, 22 bp, Homo sapiens
ctggcccattgccttctctctc

SEQ ID NO: 8359664 - DNA, 22 bp, Homo sapiens
ctggcccatggtgagctctggg

SEQ ID NO: 8359665 - DNA, 20 bp, Homo sapiens
ctggcccatctaccgctctg

SEQ ID NO: 8359666 - DNA, 22 bp, Homo sapiens
atagcaaaaggcaccagagtga

SEQ ID NO: 8359667 - DNA, 22 bp, Homo sapiens
atagcaaactggcagcttgtgg

SEQ ID NO: 8359668 - DNA, 22 bp, Homo sapiens
atagcaaaggacaatagtcagt

SEQ ID NO: 8359669 - DNA, 22 bp, Homo sapiens
ctggcccagttctgcgttttgc

SEQ ID NO: 8359670 - DNA, 22 bp, Homo sapiens
ctggctcacaggtgagatgcat

SEQ ID NO: 8359671 - DNA, 22 bp, Homo sapiens
ctggctccatcactgggtgatg

SEQ ID NO: 8359672 - DNA, 22 bp, Homo sapiens
ctggctccatcactgggtgatg

SEQ ID NO: 8359673 - DNA, 22 bp, Homo sapiens
ctggctcccgtctggtggccat

SEQ ID NO: 8359674 - DNA, 22 bp, Homo sapiens
ctggctccctcgctgaggtgct

SEQ ID NO: 8359675 - DNA, 22 bp, Homo sapiens
ctggctcccagctttcagggag

SEQ ID NO: 8359676 - DNA, 22 bp, Homo sapiens
ctggctcccatgagctctcacg

SEQ ID NO: 8359677 - DNA, 22 bp, Homo sapiens
ctggctggcagatgctcttgct

SEQ ID NO: 8359678 - DNA, 22 bp, Homo sapiens
atagcaaggtatgactggagcc

SEQ ID NO: 8359679 - DNA, 22 bp, Homo sapiens
atagcaccatgactaaacaatt

SEQ ID NO: 8359680 - DNA, 22 bp, Homo sapiens
atagcacctcctcagggaagtc

SEQ ID NO: 8359681 - DNA, 22 bp, Homo sapiens
atagcacctgtgatgggatgag

SEQ ID NO: 8359682 - DNA, 22 bp, Homo sapiens
ctgctgcaggatgggcactctg

SEQ ID NO: 8359683 - DNA, 18 bp, Homo sapiens
ctgctgcaggcactcagg

SEQ ID NO: 8359684 - DNA, 22 bp, Homo sapiens
ctggaatgagcagggcttatgg

SEQ ID NO: 8359685 - DNA, 20 bp, Homo sapiens
ctggaatgggtgtgggttag

SEQ ID NO: 8359686 - DNA, 22 bp, Homo sapiens
ctggaatgtatgggaacccaaa

SEQ ID NO: 8359687 - DNA, 22 bp, Homo sapiens
ctggagagaatgttcattgcag

SEQ ID NO: 8359688 - DNA, 22 bp, Homo sapiens
atacagtagggaccatgtctga

SEQ ID NO: 8359689 - DNA, 22 bp, Homo sapiens
ctggagaagaggtagtatgtag

SEQ ID NO: 8359690 - DNA, 22 bp, Homo sapiens
ctggagaagccaaactagtcac

SEQ ID NO: 8359691 - DNA, 22 bp, Homo sapiens
atacatgtgtgtgcatacatgt

SEQ ID NO: 8359692 - DNA, 22 bp, Homo sapiens
atacattgagttttgatgttct

SEQ ID NO: 8359693 - DNA, 22 bp, Homo sapiens
ataccaattagagtttgttgca

SEQ ID NO: 8359694 - DNA, 17 bp, Homo sapiens
atacattgttaaagtat

SEQ ID NO: 8359695 - DNA, 22 bp, Homo sapiens
ataccacaacatggctcagagg

SEQ ID NO: 8359696 - DNA, 22 bp, Homo sapiens
ataccaccatctatgaaaggta

SEQ ID NO: 8359697 - DNA, 22 bp, Homo sapiens
ataccctttacaggaacagcaa

SEQ ID NO: 8359698 - DNA, 22 bp, Homo sapiens
atacccattccttgtgttcagt

SEQ ID NO: 8359699 - DNA, 22 bp, Homo sapiens
atacgtgctgttttaagataca

SEQ ID NO: 8359700 - DNA, 22 bp, Homo sapiens
atacagttagaaaaaaagcctt

SEQ ID NO: 8359701 - DNA, 22 bp, Homo sapiens
atacagtattacctgttcagga

SEQ ID NO: 8359702 - DNA, 22 bp, Homo sapiens
atacagtattacctgttcagga

SEQ ID NO: 8359703 - DNA, 22 bp, Homo sapiens
atacagtataactaataaaccc

SEQ ID NO: 8359704 - DNA, 22 bp, Homo sapiens
atacagtagggaccatgtctga

SEQ ID NO: 8359705 - DNA, 22 bp, Homo sapiens
atacatacgtacatacgtatgt

SEQ ID NO: 8359706 - DNA, 17 bp, Homo sapiens
atacagtttattttaca

SEQ ID NO: 8359707 - DNA, 17 bp, Homo sapiens
atacagtttattttaca

SEQ ID NO: 8359708 - DNA, 22 bp, Homo sapiens
atacagtttaccacactccttg

SEQ ID NO: 8359709 - DNA, 22 bp, Homo sapiens
ataaatgtgaattagagctttg

SEQ ID NO: 8359710 - DNA, 22 bp, Homo sapiens
ataacagatactctctgtgagg

SEQ ID NO: 8359711 - DNA, 22 bp, Homo sapiens
ataacattttgacaactggtga

SEQ ID NO: 8359712 - DNA, 22 bp, Homo sapiens
ataacattttgacaactggtga

SEQ ID NO: 8359713 - DNA, 22 bp, Homo sapiens
ataactgagagcaatctttctt

SEQ ID NO: 8359714 - DNA, 22 bp, Homo sapiens
ataactctgtttttttcatgca

SEQ ID NO: 8359715 - DNA, 22 bp, Homo sapiens
ataacagatgtgaagtgctaat

SEQ ID NO: 8359716 - DNA, 22 bp, Homo sapiens
ataacatgacctgtgcttcaca

SEQ ID NO: 8359717 - DNA, 22 bp, Homo sapiens
ctgccctttatttcacaaagta

SEQ ID NO: 8359718 - DNA, 22 bp, Homo sapiens
ctgccctttgaaagaacgtctt

SEQ ID NO: 8359719 - DNA, 22 bp, Homo sapiens
ctgcctctcagcctgaccgcca

SEQ ID NO: 8359720 - DNA, 22 bp, Homo sapiens
ctgcctctattcactgaggcag

SEQ ID NO: 8359721 - DNA, 22 bp, Homo sapiens
ctgcctctccccagagtggccc

SEQ ID NO: 8359722 - DNA, 22 bp, Homo sapiens
ctgcctctccccagagtggccc

SEQ ID NO: 8359723 - DNA, 22 bp, Homo sapiens
ctgcctctcaggtccctgagat

SEQ ID NO: 8359724 - DNA, 22 bp, Homo sapiens
ctgcctctcaggtccctgagat

SEQ ID NO: 8359725 - DNA, 22 bp, Homo sapiens
ctgcctctgcgtcccacagagt

SEQ ID NO: 8359726 - DNA, 22 bp, Homo sapiens
ctgcctctgcgtcccacagagt

SEQ ID NO: 8359727 - DNA, 22 bp, Homo sapiens
ctgcctctgcgtcccacagagt

SEQ ID NO: 8359728 - DNA, 22 bp, Homo sapiens
ctgcctctccccagagtggccc

SEQ ID NO: 8359729 - DNA, 22 bp, Homo sapiens
ataagcagggtcaaatgcctac

SEQ ID NO: 8359730 - DNA, 22 bp, Homo sapiens
ataagaggaattacagaagagg

SEQ ID NO: 8359731 - DNA, 22 bp, Homo sapiens
ataagagtcttgttttcttatt

SEQ ID NO: 8359732 - DNA, 22 bp, Homo sapiens
atacaaagctaaatatggtttc

SEQ ID NO: 8359733 - DNA, 22 bp, Homo sapiens
ataagaaacattattctttcca

SEQ ID NO: 8359734 - DNA, 22 bp, Homo sapiens
ataagaaacattattctttcca

SEQ ID NO: 8359735 - DNA, 22 bp, Homo sapiens
ataagaaacattattctttcca

SEQ ID NO: 8359736 - DNA, 23 bp, Homo sapiens
ataagaaaacagtaggctcagag

SEQ ID NO: 8359737 - DNA, 22 bp, Homo sapiens
ataacttaatgggtcatgctct

SEQ ID NO: 8359738 - DNA, 22 bp, Homo sapiens
ataacttagagtaggcaaaagt

SEQ ID NO: 8359739 - DNA, 22 bp, Homo sapiens
ataacttattagattggagctg

SEQ ID NO: 8359740 - DNA, 22 bp, Homo sapiens
atacaaaggaacacaggcatgt

SEQ ID NO: 8359741 - DNA, 22 bp, Homo sapiens
atacaaattataggccccatcc

SEQ ID NO: 8359742 - DNA, 22 bp, Homo sapiens
atacaaatcctctgggatggta

SEQ ID NO: 8359743 - DNA, 22 bp, Homo sapiens
atacaaattataggccccatcc

SEQ ID NO: 8359744 - DNA, 22 bp, Homo sapiens
atacaaatttatagatgcattt

SEQ ID NO: 8359745 - DNA, 22 bp, Homo sapiens
atacaaatttatagatgcattt

SEQ ID NO: 8359746 - DNA, 22 bp, Homo sapiens
atacaaatttatagatgcattt

SEQ ID NO: 8359747 - DNA, 22 bp, Homo sapiens
ctgctgaggtccttgctcagac

SEQ ID NO: 8359748 - DNA, 22 bp, Homo sapiens
ctgctgcaatctggcttccatg

SEQ ID NO: 8359749 - DNA, 22 bp, Homo sapiens
ctgctgattcttaaatgtggtt

SEQ ID NO: 8359750 - DNA, 22 bp, Homo sapiens
ctgctgaggtatactatgtgac

SEQ ID NO: 8359751 - DNA, 22 bp, Homo sapiens
ctgcagggagaggggacagcct

SEQ ID NO: 8359752 - DNA, 22 bp, Homo sapiens
ctgcaggggtgtcctgtattgg

SEQ ID NO: 8359753 - DNA, 22 bp, Homo sapiens
ctgcatgtcactctgctgtccc

SEQ ID NO: 8359754 - DNA, 22 bp, Homo sapiens
ctgcatgtgtttctgctgggtt

SEQ ID NO: 8359755 - DNA, 22 bp, Homo sapiens
ctgcatctgttagattatcacc

SEQ ID NO: 8359756 - DNA, 22 bp, Homo sapiens
ctgcatctgcataatcaacttc

SEQ ID NO: 8359757 - DNA, 20 bp, Homo sapiens
ctgcatctgtgacttgcaaa

SEQ ID NO: 8359758 - DNA, 21 bp, Homo sapiens
ctgcatctgagtcattatgcc

SEQ ID NO: 8359759 - DNA, 21 bp, Homo sapiens
ctgcatctcatagaacatgtc

SEQ ID NO: 8359760 - DNA, 21 bp, Homo sapiens
ctgcatctcatagaacatgtc

SEQ ID NO: 8359761 - DNA, 22 bp, Homo sapiens
ctgcagggtttcgccagttgtg

SEQ ID NO: 8359762 - DNA, 22 bp, Homo sapiens
ctgaggagatccccccagaagt

SEQ ID NO: 8359763 - DNA, 22 bp, Homo sapiens
ctgaggagatgataatgtcatt

SEQ ID NO: 8359764 - DNA, 22 bp, Homo sapiens
ctgaggagcagctggcccgcta

SEQ ID NO: 8359765 - DNA, 22 bp, Homo sapiens
ctgaggagcaaccccgtgccct

SEQ ID NO: 8359766 - DNA, 22 bp, Homo sapiens
agttatattccatagattcaga

SEQ ID NO: 8359767 - DNA, 22 bp, Homo sapiens
ctgaggagctgaaggccctcca

SEQ ID NO: 8359768 - DNA, 22 bp, Homo sapiens
agttatcaagacagtgtggtac

SEQ ID NO: 8359769 - DNA, 22 bp, Homo sapiens
agttatgtcctcagcaaatcaa

SEQ ID NO: 8359770 - DNA, 22 bp, Homo sapiens
agttatttcagtaacataatag

SEQ ID NO: 8359771 - DNA, 23 bp, Homo sapiens
ctgcaaggtacaagatgctggat

SEQ ID NO: 8359772 - DNA, 22 bp, Homo sapiens
ctgcaagggatcttcaggtagc

SEQ ID NO: 8359773 - DNA, 22 bp, Homo sapiens
ctgcaaggtcatgactctctgg

SEQ ID NO: 8359774 - DNA, 22 bp, Homo sapiens
ctgcaaggtccacctgctacat

SEQ ID NO: 8359775 - DNA, 20 bp, Homo sapiens
ctgcaagcaggttattccag

SEQ ID NO: 8359776 - DNA, 22 bp, Homo sapiens
ctgcaaggctggggtgagctgg

SEQ ID NO: 8359777 - DNA, 22 bp, Homo sapiens
aggctgccctgccgccagtggg

SEQ ID NO: 8359778 - DNA, 22 bp, Homo sapiens
aggctgccctgccgccagtggg

SEQ ID NO: 8359779 - DNA, 19 bp, Homo sapiens
aggctgcccagtctctgcc

SEQ ID NO: 8359780 - DNA, 19 bp, Homo sapiens
aggctgcccagtctctgcc

SEQ ID NO: 8359781 - DNA, 19 bp, Homo sapiens
aggctgcccagtctctgcc

SEQ ID NO: 8359782 - DNA, 22 bp, Homo sapiens
ccagtggtgaatccagggatgt

SEQ ID NO: 8359783 - DNA, 22 bp, Homo sapiens
ccagtgtattatttgagaaatt

SEQ ID NO: 8359784 - DNA, 21 bp, Homo sapiens
aggctgcatttatatggtgtg

SEQ ID NO: 8359785 - DNA, 22 bp, Homo sapiens
aggctgcagtgcaggtaggatt

SEQ ID NO: 8359786 - DNA, 22 bp, Homo sapiens
cccacacatttttcacttaccg

SEQ ID NO: 8359787 - DNA, 20 bp, Homo sapiens
cccacacccttcccacttgg

SEQ ID NO: 8359788 - DNA, 22 bp, Homo sapiens
ccagtgtccttcctttccatgg

SEQ ID NO: 8359789 - DNA, 22 bp, Homo sapiens
ccagtgtcagaaagattatcct

SEQ ID NO: 8359790 - DNA, 22 bp, Homo sapiens
ccagtgtctagcagatgacagg

SEQ ID NO: 8359791 - DNA, 22 bp, Homo sapiens
ccagtgtctactgtggcatatc

SEQ ID NO: 8359792 - DNA, 22 bp, Homo sapiens
ccagtgtctagtcacaggtact

SEQ ID NO: 8359793 - DNA, 19 bp, Homo sapiens
ccagtgtctagcgcacagc

SEQ ID NO: 8359794 - DNA, 22 bp, Homo sapiens
ccagtgtctgtggtatagaaag

SEQ ID NO: 8359795 - DNA, 22 bp, Homo sapiens
ccagtgtcttcagagtaaatct

SEQ ID NO: 8359796 - DNA, 22 bp, Homo sapiens
ccagtgtgattgttgcaagaat

SEQ ID NO: 8359797 - DNA, 22 bp, Homo sapiens
aggctgtggtgctgaaggaggg

SEQ ID NO: 8359798 - DNA, 22 bp, Homo sapiens
aggctgtggtgctgaaggaggg

SEQ ID NO: 8359799 - DNA, 22 bp, Homo sapiens
cccagaggtgcttcagaggtgc

SEQ ID NO: 8359800 - DNA, 22 bp, Homo sapiens
cccagaggtgacatcccattct

SEQ ID NO: 8359801 - DNA, 22 bp, Homo sapiens
cccagaggtgcttcagaggtgc

SEQ ID NO: 8359802 - DNA, 22 bp, Homo sapiens
cccagaggttccttagggacca

SEQ ID NO: 8359803 - DNA, 20 bp, Homo sapiens
cccagaggttgcggcaggag

SEQ ID NO: 8359804 - DNA, 20 bp, Homo sapiens
cccagaggttgcggcaggag

SEQ ID NO: 8359805 - DNA, 22 bp, Homo sapiens
aggctgtgggagttgagagtct

SEQ ID NO: 8359806 - DNA, 22 bp, Homo sapiens
aggctgtgggaatggctgcttg

SEQ ID NO: 8359807 - DNA, 22 bp, Homo sapiens
cccaccctgggctacacatcca

SEQ ID NO: 8359808 - DNA, 18 bp, Homo sapiens
cccaccctggctcttagt

SEQ ID NO: 8359809 - DNA, 22 bp, Homo sapiens
cccaccctgggaagctaggcag

SEQ ID NO: 8359810 - DNA, 22 bp, Homo sapiens
cccaccctgggaagctaggcag

SEQ ID NO: 8359811 - DNA, 22 bp, Homo sapiens
cccactctggctcccttctagt

SEQ ID NO: 8359812 - DNA, 22 bp, Homo sapiens
aggctgtgcattttggagggcc

SEQ ID NO: 8359813 - DNA, 22 bp, Homo sapiens
aggctgtgactacgcagggaag

SEQ ID NO: 8359814 - DNA, 22 bp, Homo sapiens
ccaggcctttcttcttggtctg

SEQ ID NO: 8359815 - DNA, 22 bp, Homo sapiens
ccaggccttctgaggacactct

SEQ ID NO: 8359816 - DNA, 22 bp, Homo sapiens
ccaggcgtggcttcagcagccc

SEQ ID NO: 8359817 - DNA, 20 bp, Homo sapiens
ccaggcctgggcctgctcta

SEQ ID NO: 8359818 - DNA, 22 bp, Homo sapiens
ccaggcctcccttttccagcca

SEQ ID NO: 8359819 - DNA, 22 bp, Homo sapiens
ccaggccttccagtacgcagaa

SEQ ID NO: 8359820 - DNA, 22 bp, Homo sapiens
ccaggcctgtgttgtgtggagg

SEQ ID NO: 8359821 - DNA, 22 bp, Homo sapiens
ccaggcctgtgcaaggagggag

SEQ ID NO: 8359822 - DNA, 22 bp, Homo sapiens
aggctctgcttttctggatata

SEQ ID NO: 8359823 - DNA, 22 bp, Homo sapiens
aggctctgcttttctggatata

SEQ ID NO: 8359824 - DNA, 22 bp, Homo sapiens
aggctctgggaagcagtgagtt

SEQ ID NO: 8359825 - DNA, 22 bp, Homo sapiens
aggctctggtgcagctgtaact

SEQ ID NO: 8359826 - DNA, 22 bp, Homo sapiens
aggctctgggaagcagtgagtt

SEQ ID NO: 8359827 - DNA, 20 bp, Homo sapiens
aggctctgcctgcaggccca

SEQ ID NO: 8359828 - DNA, 16 bp, Homo sapiens
ccaggtggggctgtga

SEQ ID NO: 8359829 - DNA, 22 bp, Homo sapiens
ccaggtgggcgtgtcttcacct

SEQ ID NO: 8359830 - DNA, 22 bp, Homo sapiens
ccagggcagaaaaagagggaat

SEQ ID NO: 8359831 - DNA, 22 bp, Homo sapiens
ccagggcagcagaattggggca

SEQ ID NO: 8359832 - DNA, 18 bp, Homo sapiens
ccaggtggtgacagagat

SEQ ID NO: 8359833 - DNA, 20 bp, Homo sapiens
ccaggtggtgcctggagagg

SEQ ID NO: 8359834 - DNA, 22 bp, Homo sapiens
ccagtattcgatctggccagtt

SEQ ID NO: 8359835 - DNA, 19 bp, Homo sapiens
ccagtagagacagctgcag

SEQ ID NO: 8359836 - DNA, 17 bp, Homo sapiens
ccagtagcctgagatgt

SEQ ID NO: 8359837 - DNA, 23 bp, Homo sapiens
ccagtagcacagttacccagtgg

SEQ ID NO: 8359838 - DNA, 22 bp, Homo sapiens
ccaggcaccatgttcttaggac

SEQ ID NO: 8359839 - DNA, 22 bp, Homo sapiens
ccaggcacggtggctcatgcct

SEQ ID NO: 8359840 - DNA, 20 bp, Homo sapiens
ccaggcactgtcccatgcag

SEQ ID NO: 8359841 - DNA, 22 bp, Homo sapiens
ccaggcactggctgggttcttt

SEQ ID NO: 8359842 - DNA, 22 bp, Homo sapiens
ccaggcactggctgggttcttt

SEQ ID NO: 8359843 - DNA, 22 bp, Homo sapiens
ccaggcactcagagactgggac

SEQ ID NO: 8359844 - DNA, 22 bp, Homo sapiens
aggctcagaggtgagcatctgc

SEQ ID NO: 8359845 - DNA, 22 bp, Homo sapiens
aggctcagaggtgagcatctgc

SEQ ID NO: 8359846 - DNA, 16 bp, Homo sapiens
aggctcagaggctgga

SEQ ID NO: 8359847 - DNA, 22 bp, Homo sapiens
aggcctggtgtgccggatgcag

SEQ ID NO: 8359848 - DNA, 22 bp, Homo sapiens
ccaggaggatgaggggcataga

SEQ ID NO: 8359849 - DNA, 22 bp, Homo sapiens
ccaggagggaggagttcctgag

SEQ ID NO: 8359850 - DNA, 22 bp, Homo sapiens
ccaggaggggtctctgtctccc

SEQ ID NO: 8359851 - DNA, 22 bp, Homo sapiens
ccaggaggggtctctgtctccc

SEQ ID NO: 8359852 - DNA, 22 bp, Homo sapiens
ccaggagggtggttactcaatc

SEQ ID NO: 8359853 - DNA, 22 bp, Homo sapiens
ccaggaggtctgagtgtggaca

SEQ ID NO: 8359854 - DNA, 22 bp, Homo sapiens
ccaggaggtgaaacttcaccag

SEQ ID NO: 8359855 - DNA, 22 bp, Homo sapiens
ccaggaggtggcaggacttgcc

SEQ ID NO: 8359856 - DNA, 22 bp, Homo sapiens
ccaggaggtggaggttgcggtg

SEQ ID NO: 8359857 - DNA, 22 bp, Homo sapiens
ccaggaggtggagattgcagtg

SEQ ID NO: 8359858 - DNA, 22 bp, Homo sapiens
ccaggaggtgctggaagaaagc

SEQ ID NO: 8359859 - DNA, 21 bp, Homo sapiens
aggccctggaggtcagagaaa

SEQ ID NO: 8359860 - DNA, 21 bp, Homo sapiens
aggccctggaggtcagagaaa

SEQ ID NO: 8359861 - DNA, 22 bp, Homo sapiens
aggccctgctttccagagctca

SEQ ID NO: 8359862 - DNA, 22 bp, Homo sapiens
ccagccagatgataagctctat

SEQ ID NO: 8359863 - DNA, 22 bp, Homo sapiens
ccagcagggaaaaacccaccaa

SEQ ID NO: 8359864 - DNA, 22 bp, Homo sapiens
ccagcaggcagtcatatccttt

SEQ ID NO: 8359865 - DNA, 22 bp, Homo sapiens
ccagagtctatgagtcctcatt

SEQ ID NO: 8359866 - DNA, 22 bp, Homo sapiens
ccagagtcccttgcagctcagt

SEQ ID NO: 8359867 - DNA, 22 bp, Homo sapiens
ccagccagctggttggacgcct

SEQ ID NO: 8359868 - DNA, 22 bp, Homo sapiens
ccagaggcagacttacactcca

SEQ ID NO: 8359869 - DNA, 22 bp, Homo sapiens
ccagaggatgctggtcagcctc

SEQ ID NO: 8359870 - DNA, 22 bp, Homo sapiens
ccagaggatgctggtcagcctc

SEQ ID NO: 8359871 - DNA, 22 bp, Homo sapiens
aggcaggtcccctggaaggcac

SEQ ID NO: 8359872 - DNA, 22 bp, Homo sapiens
aggcaggtagaaggatctttat

SEQ ID NO: 8359873 - DNA, 21 bp, Homo sapiens
ccagaggcctctcttggccac

SEQ ID NO: 8359874 - DNA, 22 bp, Homo sapiens
ccagaggctggcaagggctcct

SEQ ID NO: 8359875 - DNA, 20 bp, Homo sapiens
ccagaggctgacagactttg

SEQ ID NO: 8359876 - DNA, 19 bp, Homo sapiens
ccagaggtttgctgggcct

SEQ ID NO: 8359877 - DNA, 22 bp, Homo sapiens
ccagaggttccaggctagggag

SEQ ID NO: 8359878 - DNA, 22 bp, Homo sapiens
ccagaggttactttgccttgga

SEQ ID NO: 8359879 - DNA, 22 bp, Homo sapiens
ccagaggtggtggtgtctagaa

SEQ ID NO: 8359880 - DNA, 22 bp, Homo sapiens
agggacctgctcactgcctggc

SEQ ID NO: 8359881 - DNA, 22 bp, Homo sapiens
agggaccaggggtagctgagat

SEQ ID NO: 8359882 - DNA, 22 bp, Homo sapiens
agggacccatagagagaccagt

SEQ ID NO: 8359883 - DNA, 22 bp, Homo sapiens
agggaccagcgtgagtctgagg

SEQ ID NO: 8359884 - DNA, 22 bp, Homo sapiens
agggaccagcctgcccagggct

SEQ ID NO: 8359885 - DNA, 22 bp, Homo sapiens
agggaccacatcccctctgtgg

SEQ ID NO: 8359886 - DNA, 22 bp, Homo sapiens
agggaccaatcaccgacaggct

SEQ ID NO: 8359887 - DNA, 22 bp, Homo sapiens
agggacagttacatcatcagac

SEQ ID NO: 8359888 - DNA, 22 bp, Homo sapiens
agggacagtctactgttcactg

SEQ ID NO: 8359889 - DNA, 22 bp, Homo sapiens
agggacagttacatcatcagac

SEQ ID NO: 8359890 - DNA, 22 bp, Homo sapiens
cccaggaatgagcaggcagggg

SEQ ID NO: 8359891 - DNA, 22 bp, Homo sapiens
agggagctgtggtcagctcagt

SEQ ID NO: 8359892 - DNA, 21 bp, Homo sapiens
agggagctggccacacagcct

SEQ ID NO: 8359893 - DNA, 22 bp, Homo sapiens
cccaggccctggcagagcttgt

SEQ ID NO: 8359894 - DNA, 22 bp, Homo sapiens
cccaggcctggtctgggccagt

SEQ ID NO: 8359895 - DNA, 22 bp, Homo sapiens
agggagccttcctggctgtggt

SEQ ID NO: 8359896 - DNA, 22 bp, Homo sapiens
aggcttggctggcagccctggg

SEQ ID NO: 8359897 - DNA, 22 bp, Homo sapiens
aggctttcctgtcactcatgct

SEQ ID NO: 8359898 - DNA, 22 bp, Homo sapiens
aggctttggaatcagagttctg

SEQ ID NO: 8359899 - DNA, 22 bp, Homo sapiens
aggctttgcaaaaaagctcata

SEQ ID NO: 8359900 - DNA, 22 bp, Homo sapiens
aggctttgcaaaaaagctcata

SEQ ID NO: 8359901 - DNA, 21 bp, Homo sapiens
agggaaagaaaatgagctaat

SEQ ID NO: 8359902 - DNA, 21 bp, Homo sapiens
agggaaaaggctgagtgaggg

SEQ ID NO: 8359903 - DNA, 22 bp, Homo sapiens
agggaaaggctgatgctgtggg

SEQ ID NO: 8359904 - DNA, 22 bp, Homo sapiens
agggaaaggctgatgctgtggg

SEQ ID NO: 8359905 - DNA, 21 bp, Homo sapiens
agggaaagaaaatgagctaat

SEQ ID NO: 8359906 - DNA, 21 bp, Homo sapiens
agggaaagaaaatgagctaat

SEQ ID NO: 8359907 - DNA, 22 bp, Homo sapiens
agggaaaggtagtgaggtcaca

SEQ ID NO: 8359908 - DNA, 22 bp, Homo sapiens
agggaaaggtagtgaggtcaca

SEQ ID NO: 8359909 - DNA, 22 bp, Homo sapiens
agggaaaggtagtgaggtcaca

SEQ ID NO: 8359910 - DNA, 22 bp, Homo sapiens
agggaaagtaagcatttcatta

SEQ ID NO: 8359911 - DNA, 23 bp, Homo sapiens
agggaaagtagtaatggcctttg

SEQ ID NO: 8359912 - DNA, 22 bp, Homo sapiens
agggaaagtaagcatttcatta

SEQ ID NO: 8359913 - DNA, 23 bp, Homo sapiens
agggaaagtagtaatggcctttg

SEQ ID NO: 8359914 - DNA, 23 bp, Homo sapiens
agggaaagtagtaatggcctttg

SEQ ID NO: 8359915 - DNA, 22 bp, Homo sapiens
cccaggaacagggctcagaccc

SEQ ID NO: 8359916 - DNA, 22 bp, Homo sapiens
cccaggaacctaccagctcgag

SEQ ID NO: 8359917 - DNA, 22 bp, Homo sapiens
cccaggaaatgaacttctgatt

SEQ ID NO: 8359918 - DNA, 22 bp, Homo sapiens
cccaggaagttgagactgcagt

SEQ ID NO: 8359919 - DNA, 22 bp, Homo sapiens
cccaggaagaggggtcaggtgt

SEQ ID NO: 8359920 - DNA, 22 bp, Homo sapiens
cccaggaagcccagaattctgg

SEQ ID NO: 8359921 - DNA, 22 bp, Homo sapiens
cccaggaagggatgccaaggaa

SEQ ID NO: 8359922 - DNA, 22 bp, Homo sapiens
agggcagaaaccaccttgatgg

SEQ ID NO: 8359923 - DNA, 22 bp, Homo sapiens
agggatggtggaggttgcaagt

SEQ ID NO: 8359924 - DNA, 22 bp, Homo sapiens
agggatgggtctaacccagaac

SEQ ID NO: 8359925 - DNA, 21 bp, Homo sapiens
agggagctttaggtagaagtt

SEQ ID NO: 8359926 - DNA, 22 bp, Homo sapiens
cccaggtctgtgccagctctga

SEQ ID NO: 8359927 - DNA, 22 bp, Homo sapiens
agggcagactaggatggaagtg

SEQ ID NO: 8359928 - DNA, 22 bp, Homo sapiens
agggcagactaggatggaagtg

SEQ ID NO: 8359929 - DNA, 22 bp, Homo sapiens
agggcagaccacgtgcaaggat

SEQ ID NO: 8359930 - DNA, 22 bp, Homo sapiens
agggcagaccacgtgcaaggat

SEQ ID NO: 8359931 - DNA, 22 bp, Homo sapiens
agggcagaagtacagacactta

SEQ ID NO: 8359932 - DNA, 22 bp, Homo sapiens
agggcagaaatcgattacacct

SEQ ID NO: 8359933 - DNA, 22 bp, Homo sapiens
agggcagaaatattgatactgt

SEQ ID NO: 8359934 - DNA, 22 bp, Homo sapiens
cccctgctggcctgctggtttc

SEQ ID NO: 8359935 - DNA, 22 bp, Homo sapiens
cccctgctggtcgaaacaattt

SEQ ID NO: 8359936 - DNA, 22 bp, Homo sapiens
cccctgccagctatccctgaac

SEQ ID NO: 8359937 - DNA, 22 bp, Homo sapiens
cccctgaagacaatggagaggt

SEQ ID NO: 8359938 - DNA, 22 bp, Homo sapiens
cccctgaagacaatggagaggt

SEQ ID NO: 8359939 - DNA, 22 bp, Homo sapiens
agggcagagaaatgtagttgag

SEQ ID NO: 8359940 - DNA, 22 bp, Homo sapiens
agggcagagaaatgtagttgag

SEQ ID NO: 8359941 - DNA, 22 bp, Homo sapiens
ccctgaggatagggcaggaccc

SEQ ID NO: 8359942 - DNA, 22 bp, Homo sapiens
ccccttcagagtagccacatta

SEQ ID NO: 8359943 - DNA, 22 bp, Homo sapiens
ccctgaggcacaggccacgtat

SEQ ID NO: 8359944 - DNA, 22 bp, Homo sapiens
ccctgaggcaaaggctagagtt

SEQ ID NO: 8359945 - DNA, 22 bp, Homo sapiens
ccctgaggcaaaggctagagtt

SEQ ID NO: 8359946 - DNA, 18 bp, Homo sapiens
ccctgaggctagcatgct

SEQ ID NO: 8359947 - DNA, 22 bp, Homo sapiens
ccctgaggggagtggtgaggtg

SEQ ID NO: 8359948 - DNA, 22 bp, Homo sapiens
ccctgaggctgaggataggtgg

SEQ ID NO: 8359949 - DNA, 18 bp, Homo sapiens
ccctgaggctagcatgct

SEQ ID NO: 8359950 - DNA, 22 bp, Homo sapiens
agggggtgatcaaggtgcggcg

SEQ ID NO: 8359951 - DNA, 22 bp, Homo sapiens
agggggtgtctctgattgggtt

SEQ ID NO: 8359952 - DNA, 22 bp, Homo sapiens
aggggtcttgaggactccagca

SEQ ID NO: 8359953 - DNA, 22 bp, Homo sapiens
aggggtctatcctgagatggtc

SEQ ID NO: 8359954 - DNA, 20 bp, Homo sapiens
aggggtctagcagcagtgct

SEQ ID NO: 8359955 - DNA, 20 bp, Homo sapiens
aggggtctagcagcagtgct

SEQ ID NO: 8359956 - DNA, 22 bp, Homo sapiens
cctctgtgtcctggtcattgaa

SEQ ID NO: 8359957 - DNA, 22 bp, Homo sapiens
cctcttaattgtactccttcag

SEQ ID NO: 8359958 - DNA, 22 bp, Homo sapiens
agggggctgccaaggaatgtaa

SEQ ID NO: 8359959 - DNA, 22 bp, Homo sapiens
agggggtcgtccggaagacctg

SEQ ID NO: 8359960 - DNA, 22 bp, Homo sapiens
aggggggtggatcacctgaggt

SEQ ID NO: 8359961 - DNA, 22 bp, Homo sapiens
aggggctcaaagtgtgcaggga

SEQ ID NO: 8359962 - DNA, 22 bp, Homo sapiens
aggggctccaaggaagtttggg

SEQ ID NO: 8359963 - DNA, 22 bp, Homo sapiens
aggggctcagttactttggcag

SEQ ID NO: 8359964 - DNA, 22 bp, Homo sapiens
aggggctcctttgtgctgcgtc

SEQ ID NO: 8359965 - DNA, 22 bp, Homo sapiens
aggggctctgagtgggccagga

SEQ ID NO: 8359966 - DNA, 22 bp, Homo sapiens
aggggctctgagtgggccagga

SEQ ID NO: 8359967 - DNA, 22 bp, Homo sapiens
cctccttcctgggacagagctg

SEQ ID NO: 8359968 - DNA, 22 bp, Homo sapiens
cctcctggttgcaatgaaatgg

SEQ ID NO: 8359969 - DNA, 22 bp, Homo sapiens
cctcctggtgggcgcttctggc

SEQ ID NO: 8359970 - DNA, 22 bp, Homo sapiens
cctcctggtgacaaggcaaagc

SEQ ID NO: 8359971 - DNA, 22 bp, Homo sapiens
aggggaatgggtagactgttga

SEQ ID NO: 8359972 - DNA, 22 bp, Homo sapiens
aggggaaggccagcctgtagag

SEQ ID NO: 8359973 - DNA, 22 bp, Homo sapiens
ccctggcacatgcgctgtgtgg

SEQ ID NO: 8359974 - DNA, 22 bp, Homo sapiens
ccctggcagagggggcaggtgc

SEQ ID NO: 8359975 - DNA, 22 bp, Homo sapiens
agggctgggctgcttgttgtca

SEQ ID NO: 8359976 - DNA, 22 bp, Homo sapiens
agggctttgcaatgcacagtgg

SEQ ID NO: 8359977 - DNA, 22 bp, Homo sapiens
agggctttgatgtccatgagga

SEQ ID NO: 8359978 - DNA, 22 bp, Homo sapiens
agggcttttgcaatccaagtct

SEQ ID NO: 8359979 - DNA, 22 bp, Homo sapiens
agggctttgtttaggtgaccac

SEQ ID NO: 8359980 - DNA, 22 bp, Homo sapiens
agggcttttgagcgcacgtctg

SEQ ID NO: 8359981 - DNA, 22 bp, Homo sapiens
agggctttgtggcagtcactat

SEQ ID NO: 8359982 - DNA, 19 bp, Homo sapiens
agggctttgtgtgctgctc

SEQ ID NO: 8359983 - DNA, 22 bp, Homo sapiens
agggctttggccccctgctgca

SEQ ID NO: 8359984 - DNA, 22 bp, Homo sapiens
agggctgagactaaggccagat

SEQ ID NO: 8359985 - DNA, 22 bp, Homo sapiens
cctacagttatattcttgattg

SEQ ID NO: 8359986 - DNA, 22 bp, Homo sapiens
cctacataacactgccaaactg

SEQ ID NO: 8359987 - DNA, 22 bp, Homo sapiens
catgagatttgggaggggccag

SEQ ID NO: 8359988 - DNA, 22 bp, Homo sapiens
catgaggtgataaagctgggat

SEQ ID NO: 8359989 - DNA, 22 bp, Homo sapiens
catgaggtcagggggagccggt

SEQ ID NO: 8359990 - DNA, 22 bp, Homo sapiens
catgagataatttttctccagt

SEQ ID NO: 8359991 - DNA, 22 bp, Homo sapiens
catgagatttgggaggggccag

SEQ ID NO: 8359992 - DNA, 22 bp, Homo sapiens
catgagataatttttctccagt

SEQ ID NO: 8359993 - DNA, 22 bp, Homo sapiens
catcttgctgttatgtttatgt

SEQ ID NO: 8359994 - DNA, 22 bp, Homo sapiens
catcttgctgggttttatcata

SEQ ID NO: 8359995 - DNA, 22 bp, Homo sapiens
catcttgcctgctattctgttg

SEQ ID NO: 8359996 - DNA, 22 bp, Homo sapiens
catcttgctgacttgcattatt

SEQ ID NO: 8359997 - DNA, 22 bp, Homo sapiens
catcttgccctacacatttatc

SEQ ID NO: 8359998 - DNA, 17 bp, Homo sapiens
catctttaaaatcctga

SEQ ID NO: 8359999 - DNA, 22 bp, Homo sapiens
catcttgcttcatctgctgtgt

SEQ ID NO: 8360000 - DNA, 22 bp, Homo sapiens
catcttgcttgtctttagtaag

SEQ ID NO: 8360001 - DNA, 22 bp, Homo sapiens
catcttctgggacttctcagtt

SEQ ID NO: 8360002 - DNA, 22 bp, Homo sapiens
aggatggggtctgcagcctggt

SEQ ID NO: 8360003 - DNA, 22 bp, Homo sapiens
aggatggggtctgcagcctggt

SEQ ID NO: 8360004 - DNA, 23 bp, Homo sapiens
aggatgtaggatgtatggcagag

SEQ ID NO: 8360005 - DNA, 23 bp, Homo sapiens
aggatgtaggatgtatggcagag

SEQ ID NO: 8360006 - DNA, 22 bp, Homo sapiens
aggatggcttgcaggaggctgt

SEQ ID NO: 8360007 - DNA, 22 bp, Homo sapiens
aggatgagagatacatggagca

SEQ ID NO: 8360008 - DNA, 22 bp, Homo sapiens
catcttaatttctaacaggcac

SEQ ID NO: 8360009 - DNA, 22 bp, Homo sapiens
catcttaatttctaacaggcac

SEQ ID NO: 8360010 - DNA, 22 bp, Homo sapiens
catccaataccagtttgcaggc

SEQ ID NO: 8360011 - DNA, 22 bp, Homo sapiens
catctccaggtttagggagcac

SEQ ID NO: 8360012 - DNA, 22 bp, Homo sapiens
catctccaggtttagggagcac

SEQ ID NO: 8360013 - DNA, 22 bp, Homo sapiens
catctccaggagttctactcat

SEQ ID NO: 8360014 - DNA, 22 bp, Homo sapiens
catacagtcactgtggtaccac

SEQ ID NO: 8360015 - DNA, 22 bp, Homo sapiens
catacagtgtggcatgtagtct

SEQ ID NO: 8360016 - DNA, 22 bp, Homo sapiens
catacagttttccctagatgtg

SEQ ID NO: 8360017 - DNA, 22 bp, Homo sapiens
catacagagaaggataataaag

SEQ ID NO: 8360018 - DNA, 22 bp, Homo sapiens
catacagttttccctagatgtg

SEQ ID NO: 8360019 - DNA, 22 bp, Homo sapiens
catacaaatgtgtccaggctct

SEQ ID NO: 8360020 - DNA, 22 bp, Homo sapiens
catacaaatgtgtccaggctct

SEQ ID NO: 8360021 - DNA, 22 bp, Homo sapiens
catacaagcgttcaatagatgt

SEQ ID NO: 8360022 - DNA, 22 bp, Homo sapiens
catacaatcaagttctttatta

SEQ ID NO: 8360023 - DNA, 22 bp, Homo sapiens
aggaggcctgtgtttgtctgta

SEQ ID NO: 8360024 - DNA, 22 bp, Homo sapiens
aggaggctgaactagggtctgg

SEQ ID NO: 8360025 - DNA, 22 bp, Homo sapiens
aggaggctgaactagggtctgg

SEQ ID NO: 8360026 - DNA, 22 bp, Homo sapiens
cataatttttttaagtcagaac

SEQ ID NO: 8360027 - DNA, 22 bp, Homo sapiens
catacaaatgtgtccaggctct

SEQ ID NO: 8360028 - DNA, 22 bp, Homo sapiens
aggagctgggttcctttggtgg

SEQ ID NO: 8360029 - DNA, 16 bp, Homo sapiens
aggagctgggtaggag

SEQ ID NO: 8360030 - DNA, 22 bp, Homo sapiens
aggagctggtagtctcattggg

SEQ ID NO: 8360031 - DNA, 22 bp, Homo sapiens
aggagctgtcagagtgccagag

SEQ ID NO: 8360032 - DNA, 22 bp, Homo sapiens
aggagctgtcagagtgccagag

SEQ ID NO: 8360033 - DNA, 23 bp, Homo sapiens
aggaggcctgaaactgaggctga

SEQ ID NO: 8360034 - DNA, 22 bp, Homo sapiens
aggaggcagatgcttggctgta

SEQ ID NO: 8360035 - DNA, 22 bp, Homo sapiens
aggaggcaggaagtctatggga

SEQ ID NO: 8360036 - DNA, 22 bp, Homo sapiens
cataactggggacacttctcta

SEQ ID NO: 8360037 - DNA, 22 bp, Homo sapiens
cataagttgggtaatataatga

SEQ ID NO: 8360038 - DNA, 22 bp, Homo sapiens
cataagaatatttagtggcagc

SEQ ID NO: 8360039 - DNA, 22 bp, Homo sapiens
cataatatactacattgatgaa

SEQ ID NO: 8360040 - DNA, 22 bp, Homo sapiens
cataatatactacattgatgaa

SEQ ID NO: 8360041 - DNA, 22 bp, Homo sapiens
cataacatccttgctactttga

SEQ ID NO: 8360042 - DNA, 22 bp, Homo sapiens
cagttttattggttgaaatctg

SEQ ID NO: 8360043 - DNA, 22 bp, Homo sapiens
cataacatgtacatataaatgc

SEQ ID NO: 8360044 - DNA, 22 bp, Homo sapiens
cataacattaagcctctatttc

SEQ ID NO: 8360045 - DNA, 22 bp, Homo sapiens
cataacattaagcctctatttc

SEQ ID NO: 8360046 - DNA, 22 bp, Homo sapiens
aggagccatgagcaggaggcaa

SEQ ID NO: 8360047 - DNA, 22 bp, Homo sapiens
aggagccatccccatgagaggt

SEQ ID NO: 8360048 - DNA, 22 bp, Homo sapiens
cagtgttccctgaacatatgtt

SEQ ID NO: 8360049 - DNA, 21 bp, Homo sapiens
cagtgtggtgaccagggtctc

SEQ ID NO: 8360050 - DNA, 22 bp, Homo sapiens
aggagccagcgttcctcaggat

SEQ ID NO: 8360051 - DNA, 22 bp, Homo sapiens
aggagccagcgttcctcaggat

SEQ ID NO: 8360052 - DNA, 22 bp, Homo sapiens
aggagccagaatccagactcgg

SEQ ID NO: 8360053 - DNA, 22 bp, Homo sapiens
aggagccaggccccatggggct

SEQ ID NO: 8360054 - DNA, 20 bp, Homo sapiens
cagtccaggctagaaaacaa

SEQ ID NO: 8360055 - DNA, 22 bp, Homo sapiens
cagtccagtccaatcctcaatg

SEQ ID NO: 8360056 - DNA, 22 bp, Homo sapiens
cagtccagtccaatcctcaatg

SEQ ID NO: 8360057 - DNA, 22 bp, Homo sapiens
cagtggttcctgttcttctggg

SEQ ID NO: 8360058 - DNA, 22 bp, Homo sapiens
cagtccagtgatttttccagtt

SEQ ID NO: 8360059 - DNA, 22 bp, Homo sapiens
cagtggttctcaatcaggaatg

SEQ ID NO: 8360060 - DNA, 22 bp, Homo sapiens
cagtggttgaacccaaatactt

SEQ ID NO: 8360061 - DNA, 21 bp, Homo sapiens
cagtggttgctgaattagtgg

SEQ ID NO: 8360062 - DNA, 22 bp, Homo sapiens
cagtgtggagggagagagcctg

SEQ ID NO: 8360063 - DNA, 22 bp, Homo sapiens
cagtgtgggtttgggaggagta

SEQ ID NO: 8360064 - DNA, 22 bp, Homo sapiens
cagtccagccccctgctaaaag

SEQ ID NO: 8360065 - DNA, 22 bp, Homo sapiens
cagtccagctcatcagtggcac

SEQ ID NO: 8360066 - DNA, 22 bp, Homo sapiens
cagtccaggcctggaggagcca

SEQ ID NO: 8360067 - DNA, 22 bp, Homo sapiens
catttctgttctcttcctgtac

SEQ ID NO: 8360068 - DNA, 22 bp, Homo sapiens
ccaatgaaaggtcaattctata

SEQ ID NO: 8360069 - DNA, 23 bp, Homo sapiens
catttctgggagatttataaaat

SEQ ID NO: 8360070 - DNA, 22 bp, Homo sapiens
catttctgcagaattgctcttc

SEQ ID NO: 8360071 - DNA, 22 bp, Homo sapiens
catttctgtcacgttcttttat

SEQ ID NO: 8360072 - DNA, 23 bp, Homo sapiens
ccacagagctgccaattcctgtg

SEQ ID NO: 8360073 - DNA, 22 bp, Homo sapiens
aggcaggaaaatcgcttgaacc

SEQ ID NO: 8360074 - DNA, 19 bp, Homo sapiens
ccacagagcatgctgaggc

SEQ ID NO: 8360075 - DNA, 22 bp, Homo sapiens
aggcaggagcaagccctacaag

SEQ ID NO: 8360076 - DNA, 22 bp, Homo sapiens
aggcaggagcaagccctacaag

SEQ ID NO: 8360077 - DNA, 17 bp, Homo sapiens
aggcaggagattggaga

SEQ ID NO: 8360078 - DNA, 17 bp, Homo sapiens
aggcaggagattggaga

SEQ ID NO: 8360079 - DNA, 22 bp, Homo sapiens
aggcaggaaccctgtgtgcgcc

SEQ ID NO: 8360080 - DNA, 22 bp, Homo sapiens
aggcaggagtgaccctgacagg

SEQ ID NO: 8360081 - DNA, 22 bp, Homo sapiens
aggcaggagtgaccctgacagg

SEQ ID NO: 8360082 - DNA, 22 bp, Homo sapiens
aggcaggagtgaccctgacagg

SEQ ID NO: 8360083 - DNA, 22 bp, Homo sapiens
aggcaggaggatcatggatgca

SEQ ID NO: 8360084 - DNA, 22 bp, Homo sapiens
aggcaggaggatcatggatgca

SEQ ID NO: 8360085 - DNA, 22 bp, Homo sapiens
aggcaggaggatcatggatgca

SEQ ID NO: 8360086 - DNA, 23 bp, Homo sapiens
ccacaggcacagaggcttgcatc

SEQ ID NO: 8360087 - DNA, 18 bp, Homo sapiens
aggcaggatcctggcctc

SEQ ID NO: 8360088 - DNA, 18 bp, Homo sapiens
aggcaggatcctggcctc

SEQ ID NO: 8360089 - DNA, 22 bp, Homo sapiens
ccaccatgggaagagagactaa

SEQ ID NO: 8360090 - DNA, 22 bp, Homo sapiens
ccacccacaaccagctggctgt

SEQ ID NO: 8360091 - DNA, 22 bp, Homo sapiens
ccaccaggcactcacagggaag

SEQ ID NO: 8360092 - DNA, 22 bp, Homo sapiens
ccacatcagaaatgtttactca

SEQ ID NO: 8360093 - DNA, 22 bp, Homo sapiens
ccacatcatggatacagttatg

SEQ ID NO: 8360094 - DNA, 22 bp, Homo sapiens
ccacatcatggatacagttatg

SEQ ID NO: 8360095 - DNA, 22 bp, Homo sapiens
ccacagtgttttgtcacattag

SEQ ID NO: 8360096 - DNA, 23 bp, Homo sapiens
ccacagttcatcgttcactcacc

SEQ ID NO: 8360097 - DNA, 22 bp, Homo sapiens
ccacagtttcttcatctataaa

SEQ ID NO: 8360098 - DNA, 22 bp, Homo sapiens
ccacagtttaggaagtcactct

SEQ ID NO: 8360099 - DNA, 20 bp, Homo sapiens
ccacagtggagactggagac

SEQ ID NO: 8360100 - DNA, 20 bp, Homo sapiens
ccacagtggagactggagac

SEQ ID NO: 8360101 - DNA, 22 bp, Homo sapiens
ccacagtgggcacagcaggact

SEQ ID NO: 8360102 - DNA, 22 bp, Homo sapiens
ccacagtgtggcataaactgta

SEQ ID NO: 8360103 - DNA, 22 bp, Homo sapiens
ccacagtgtggcataaactgta

SEQ ID NO: 8360104 - DNA, 22 bp, Homo sapiens
ccacagtggttctcaaccaggg

SEQ ID NO: 8360105 - DNA, 22 bp, Homo sapiens
ccacagtggttctcaaccaggg

SEQ ID NO: 8360106 - DNA, 22 bp, Homo sapiens
ccactcagcacagtggatgcag

SEQ ID NO: 8360107 - DNA, 22 bp, Homo sapiens
ccacgagggaaccaggtggggt

SEQ ID NO: 8360108 - DNA, 19 bp, Homo sapiens
ccacgaggttagcagccac

SEQ ID NO: 8360109 - DNA, 22 bp, Homo sapiens
ccacgaggctatcctgctaggg

SEQ ID NO: 8360110 - DNA, 22 bp, Homo sapiens
ccacggccacccgctcatgggc

SEQ ID NO: 8360111 - DNA, 22 bp, Homo sapiens
ccacccagaccagggatctggg

SEQ ID NO: 8360112 - DNA, 22 bp, Homo sapiens
ccacccagcagaggaggcaaga

SEQ ID NO: 8360113 - DNA, 22 bp, Homo sapiens
ccacccagccagatgcaggaag

SEQ ID NO: 8360114 - DNA, 22 bp, Homo sapiens
ccacccagccagatgcaggaag

SEQ ID NO: 8360115 - DNA, 20 bp, Homo sapiens
aggcactgttgtctgtatcc

SEQ ID NO: 8360116 - DNA, 22 bp, Homo sapiens
aggcactgttcccagttatcct

SEQ ID NO: 8360117 - DNA, 21 bp, Homo sapiens
aggcactgtttgtggtttggg

SEQ ID NO: 8360118 - DNA, 22 bp, Homo sapiens
aggcactgtgggtgtggccgga

SEQ ID NO: 8360119 - DNA, 22 bp, Homo sapiens
aggcactgtgggtgtggccgga

SEQ ID NO: 8360120 - DNA, 22 bp, Homo sapiens
cattgtaagctgttgaatcctc

SEQ ID NO: 8360121 - DNA, 22 bp, Homo sapiens
cattggcacaagtagcttcatc

SEQ ID NO: 8360122 - DNA, 22 bp, Homo sapiens
cattggccttttatcctagagg

SEQ ID NO: 8360123 - DNA, 22 bp, Homo sapiens
cattgtaagaggctttgcagca

SEQ ID NO: 8360124 - DNA, 22 bp, Homo sapiens
catttacctttaattaaaacac

SEQ ID NO: 8360125 - DNA, 22 bp, Homo sapiens
catttactgtaaaagattctct

SEQ ID NO: 8360126 - DNA, 22 bp, Homo sapiens
catttacttaaatctttacaag

SEQ ID NO: 8360127 - DNA, 22 bp, Homo sapiens
catttcaagcattgacttctat

SEQ ID NO: 8360128 - DNA, 22 bp, Homo sapiens
catttcaagcattgacttctat

SEQ ID NO: 8360129 - DNA, 22 bp, Homo sapiens
catttcaatgccttcaacatag

SEQ ID NO: 8360130 - DNA, 22 bp, Homo sapiens
catttctcctgggtgataaatt

SEQ ID NO: 8360131 - DNA, 22 bp, Homo sapiens
catttctcctgggtgataaatt

SEQ ID NO: 8360132 - DNA, 22 bp, Homo sapiens
catttctcataatattagcact

SEQ ID NO: 8360133 - DNA, 22 bp, Homo sapiens
catttctccgccgagatcactg

SEQ ID NO: 8360134 - DNA, 22 bp, Homo sapiens
catttcacacataaacttgggt

SEQ ID NO: 8360135 - DNA, 22 bp, Homo sapiens
aggcaatgcagatagatgaatg

SEQ ID NO: 8360136 - DNA, 22 bp, Homo sapiens
aggcaatcccctgaggatactt

SEQ ID NO: 8360137 - DNA, 22 bp, Homo sapiens
aggcaaggtgctacagacagtg

SEQ ID NO: 8360138 - DNA, 22 bp, Homo sapiens
aggcaaggtgctacagacagtg

SEQ ID NO: 8360139 - DNA, 22 bp, Homo sapiens
cattgcttcctatgtcccttct

SEQ ID NO: 8360140 - DNA, 22 bp, Homo sapiens
aggcaagcagtcagtctatgag

SEQ ID NO: 8360141 - DNA, 22 bp, Homo sapiens
aggcaagattaggaccagaaga

SEQ ID NO: 8360142 - DNA, 22 bp, Homo sapiens
aggcaagattaggaccagaaga

SEQ ID NO: 8360143 - DNA, 23 bp, Homo sapiens
aggcaagggtgtaaaggaaatga

SEQ ID NO: 8360144 - DNA, 23 bp, Homo sapiens
aggcaagggtgtaaaggaaatga

SEQ ID NO: 8360145 - DNA, 23 bp, Homo sapiens
aggcaagggtgtaaaggaaatga

SEQ ID NO: 8360146 - DNA, 22 bp, Homo sapiens
aggcaagagtgactacgtgaaa

SEQ ID NO: 8360147 - DNA, 22 bp, Homo sapiens
caggtgtcaaaatactaagtgg

SEQ ID NO: 8360148 - DNA, 22 bp, Homo sapiens
aggaagtgcagggggaagtact

SEQ ID NO: 8360149 - DNA, 22 bp, Homo sapiens
caggtgggattttgctgcttga

SEQ ID NO: 8360150 - DNA, 22 bp, Homo sapiens
aggaatcccgcaccagctgctg

SEQ ID NO: 8360151 - DNA, 22 bp, Homo sapiens
aggacagagcctgtgcagaccg

SEQ ID NO: 8360152 - DNA, 22 bp, Homo sapiens
aggacagagcctgtgcagaccg

SEQ ID NO: 8360153 - DNA, 22 bp, Homo sapiens
aggacagacctaggactggagc

SEQ ID NO: 8360154 - DNA, 22 bp, Homo sapiens
aggacagacctaggactggagc

SEQ ID NO: 8360155 - DNA, 22 bp, Homo sapiens
aggacagagggaccagagccca

SEQ ID NO: 8360156 - DNA, 22 bp, Homo sapiens
aggacagagggaccagagccca

SEQ ID NO: 8360157 - DNA, 22 bp, Homo sapiens
aggacagagggaccagagccca

SEQ ID NO: 8360158 - DNA, 23 bp, Homo sapiens
aggacagcaaaccccgcctcccc

SEQ ID NO: 8360159 - DNA, 22 bp, Homo sapiens
cagtaaacactagcattcttgg

SEQ ID NO: 8360160 - DNA, 22 bp, Homo sapiens
cagtatgtttgggagacatgac

SEQ ID NO: 8360161 - DNA, 22 bp, Homo sapiens
cagtatcttatgaaccctgatc

SEQ ID NO: 8360162 - DNA, 22 bp, Homo sapiens
cagtatctgtcagtaatcaggt

SEQ ID NO: 8360163 - DNA, 22 bp, Homo sapiens
cagggcagtaacgggaacatct

SEQ ID NO: 8360164 - DNA, 22 bp, Homo sapiens
cagggcagtaacgggaacatct

SEQ ID NO: 8360165 - DNA, 22 bp, Homo sapiens
cagggcagggccacaccccctg

SEQ ID NO: 8360166 - DNA, 22 bp, Homo sapiens
cagggcagggatgttgcggcag

SEQ ID NO: 8360167 - DNA, 22 bp, Homo sapiens
caggctcttttggtggcaagga

SEQ ID NO: 8360168 - DNA, 22 bp, Homo sapiens
caggctcttttggtggcaagga

SEQ ID NO: 8360169 - DNA, 20 bp, Homo sapiens
cagggctctgggcctggcct

SEQ ID NO: 8360170 - DNA, 22 bp, Homo sapiens
agctttggcttctgttgaacct

SEQ ID NO: 8360171 - DNA, 22 bp, Homo sapiens
agctttgcattcaaactgatgt

SEQ ID NO: 8360172 - DNA, 19 bp, Homo sapiens
agctttgccaaaaacttag

SEQ ID NO: 8360173 - DNA, 22 bp, Homo sapiens
agctttcttctagttgtacagt

SEQ ID NO: 8360174 - DNA, 22 bp, Homo sapiens
agctttcttctagttgtacagt

SEQ ID NO: 8360175 - DNA, 22 bp, Homo sapiens
aggaaaggattggcttctctgt

SEQ ID NO: 8360176 - DNA, 22 bp, Homo sapiens
aggaaaggattggcttctctgt

SEQ ID NO: 8360177 - DNA, 22 bp, Homo sapiens
aggaaaggattggcttctctgt

SEQ ID NO: 8360178 - DNA, 19 bp, Homo sapiens
aggaaaggatcaaaatagc

SEQ ID NO: 8360179 - DNA, 22 bp, Homo sapiens
aggaaaggcctcagcagaaacc

SEQ ID NO: 8360180 - DNA, 22 bp, Homo sapiens
aggaaaggcctcagcagaaacc

SEQ ID NO: 8360181 - DNA, 22 bp, Homo sapiens
aggaaaggcctcagcagaaacc

SEQ ID NO: 8360182 - DNA, 22 bp, Homo sapiens
aggaaaggcctcagcagaaacc

SEQ ID NO: 8360183 - DNA, 21 bp, Homo sapiens
aggaaaggccagcacgtaggg

SEQ ID NO: 8360184 - DNA, 21 bp, Homo sapiens
aggaaaggccagcacgtaggg

SEQ ID NO: 8360185 - DNA, 22 bp, Homo sapiens
aggaagaaaactaattagatgg

SEQ ID NO: 8360186 - DNA, 22 bp, Homo sapiens
aggaagaaacctactagagttt

SEQ ID NO: 8360187 - DNA, 22 bp, Homo sapiens
aggaaaggcctttgcatttggt

SEQ ID NO: 8360188 - DNA, 22 bp, Homo sapiens
aggaaaggcctttgcatttggt

SEQ ID NO: 8360189 - DNA, 22 bp, Homo sapiens
aggaaaggcctttgcatttggt

SEQ ID NO: 8360190 - DNA, 23 bp, Homo sapiens
aggaagaggcaatttctcttaga

SEQ ID NO: 8360191 - DNA, 18 bp, Homo sapiens
cagggctgtggggtcact

SEQ ID NO: 8360192 - DNA, 22 bp, Homo sapiens
aggaagagctggaccagaggac

SEQ ID NO: 8360193 - DNA, 23 bp, Homo sapiens
aggaagaggcaatttctcttaga

SEQ ID NO: 8360194 - DNA, 22 bp, Homo sapiens
aggaagagcattcacatggtag

SEQ ID NO: 8360195 - DNA, 22 bp, Homo sapiens
aggaagagctggaccagaggac

SEQ ID NO: 8360196 - DNA, 22 bp, Homo sapiens
aggaagagctggaccagaggac

SEQ ID NO: 8360197 - DNA, 22 bp, Homo sapiens
aggaagagctggaccagaggac

SEQ ID NO: 8360198 - DNA, 22 bp, Homo sapiens
caggctcttccatcctgctgag

SEQ ID NO: 8360199 - DNA, 21 bp, Homo sapiens
caggctctgctagaggagcct

SEQ ID NO: 8360200 - DNA, 22 bp, Homo sapiens
agcttctagcccatccagcagg

SEQ ID NO: 8360201 - DNA, 22 bp, Homo sapiens
agcttctcagaagagtcctgta

SEQ ID NO: 8360202 - DNA, 22 bp, Homo sapiens
agcttctcagatggactgttag

SEQ ID NO: 8360203 - DNA, 22 bp, Homo sapiens
agcttccctagcagttctaaac

SEQ ID NO: 8360204 - DNA, 22 bp, Homo sapiens
agcttcccggcaggcacgtcct

SEQ ID NO: 8360205 - DNA, 18 bp, Homo sapiens
agcttccctctgagaggg

SEQ ID NO: 8360206 - DNA, 22 bp, Homo sapiens
agcttcccggcaggcacgtcct

SEQ ID NO: 8360207 - DNA, 22 bp, Homo sapiens
agcttcccaggagaatcaggga

SEQ ID NO: 8360208 - DNA, 22 bp, Homo sapiens
agcttcccacactctagtttcc

SEQ ID NO: 8360209 - DNA, 22 bp, Homo sapiens
agcttcccaaggttggaaggtt

SEQ ID NO: 8360210 - DNA, 22 bp, Homo sapiens
agctgtctgtgaacacagcatt

SEQ ID NO: 8360211 - DNA, 22 bp, Homo sapiens
agctgtctttcattacctcatt

SEQ ID NO: 8360212 - DNA, 21 bp, Homo sapiens
agcttacattaccattgttgc

SEQ ID NO: 8360213 - DNA, 22 bp, Homo sapiens
agcttagaagtgtgctgagagg

SEQ ID NO: 8360214 - DNA, 22 bp, Homo sapiens
caggcccatttgtagccacttt

SEQ ID NO: 8360215 - DNA, 22 bp, Homo sapiens
caggcagggagctggaaaggat

SEQ ID NO: 8360216 - DNA, 22 bp, Homo sapiens
caggcagggagctggaaaggat

SEQ ID NO: 8360217 - DNA, 22 bp, Homo sapiens
caggcaggtcagtgaagaagga

SEQ ID NO: 8360218 - DNA, 22 bp, Homo sapiens
caggcaggtcagtgaagaagga

SEQ ID NO: 8360219 - DNA, 22 bp, Homo sapiens
caggcagggagctggaaaggat

SEQ ID NO: 8360220 - DNA, 22 bp, Homo sapiens
caggcagctcaaccttgggagc

SEQ ID NO: 8360221 - DNA, 22 bp, Homo sapiens
caggcagcctgcggtctgcaca

SEQ ID NO: 8360222 - DNA, 22 bp, Homo sapiens
caggcagccttctcgtctcaca

SEQ ID NO: 8360223 - DNA, 22 bp, Homo sapiens
caggcagtgtcccaggaagcca

SEQ ID NO: 8360224 - DNA, 22 bp, Homo sapiens
caggcagtggctcacagcaacc

SEQ ID NO: 8360225 - DNA, 22 bp, Homo sapiens
agctggttgacttcaggcaagt

SEQ ID NO: 8360226 - DNA, 22 bp, Homo sapiens
agctgtatgcccaagatgctat

SEQ ID NO: 8360227 - DNA, 22 bp, Homo sapiens
agctgtcctggctcaggctgtg

SEQ ID NO: 8360228 - DNA, 22 bp, Homo sapiens
agctgtcagtgctgtgcctgta

SEQ ID NO: 8360229 - DNA, 22 bp, Homo sapiens
caggactcttgtcatcatcagt

SEQ ID NO: 8360230 - DNA, 22 bp, Homo sapiens
caggagcaaggagcagtgggat

SEQ ID NO: 8360231 - DNA, 22 bp, Homo sapiens
caggactggaagtctcaagaga

SEQ ID NO: 8360232 - DNA, 22 bp, Homo sapiens
caggactggctcgcagtgggtg

SEQ ID NO: 8360233 - DNA, 22 bp, Homo sapiens
cagctggtgtcaggcactgcag

SEQ ID NO: 8360234 - DNA, 23 bp, Homo sapiens
cagctggttgtgggagtggctgc

SEQ ID NO: 8360235 - DNA, 22 bp, Homo sapiens
cagctgggtttagtggggtgtg

SEQ ID NO: 8360236 - DNA, 22 bp, Homo sapiens
cagctgggtttagtggggtgtg

SEQ ID NO: 8360237 - DNA, 22 bp, Homo sapiens
cagctgtgtctaattatggctg

SEQ ID NO: 8360238 - DNA, 22 bp, Homo sapiens
cagctgtcagccggtgcaggct

SEQ ID NO: 8360239 - DNA, 22 bp, Homo sapiens
cagctgtccaaacacattaact

SEQ ID NO: 8360240 - DNA, 22 bp, Homo sapiens
cagctgtccttcctggtgggcg

SEQ ID NO: 8360241 - DNA, 22 bp, Homo sapiens
cagctgttcacatttccaaaac

SEQ ID NO: 8360242 - DNA, 22 bp, Homo sapiens
caggatgggtgtcggccagcac

SEQ ID NO: 8360243 - DNA, 22 bp, Homo sapiens
caggatgggatgtagtgggccc

SEQ ID NO: 8360244 - DNA, 22 bp, Homo sapiens
caggatgggatgtagtgggccc

SEQ ID NO: 8360245 - DNA, 22 bp, Homo sapiens
caggatggtctcgatctcctga

SEQ ID NO: 8360246 - DNA, 22 bp, Homo sapiens
caggcacacagcacatggcctg

SEQ ID NO: 8360247 - DNA, 22 bp, Homo sapiens
caggcacacaggctccctgggc

SEQ ID NO: 8360248 - DNA, 22 bp, Homo sapiens
caggcacacatccgtgagagat

SEQ ID NO: 8360249 - DNA, 22 bp, Homo sapiens
caggcacacatccgtgagagat

SEQ ID NO: 8360250 - DNA, 22 bp, Homo sapiens
caggcacacatccgtgagagat

SEQ ID NO: 8360251 - DNA, 22 bp, Homo sapiens
caggcacacccactggtgcaga

SEQ ID NO: 8360252 - DNA, 22 bp, Homo sapiens
caggcacacccactggtgcaga

SEQ ID NO: 8360253 - DNA, 22 bp, Homo sapiens
caggcagagtgaggtggtctaa

SEQ ID NO: 8360254 - DNA, 22 bp, Homo sapiens
caggcagagtgaggtggtctaa

SEQ ID NO: 8360255 - DNA, 22 bp, Homo sapiens
caggagtgaaatgaggcccagg

SEQ ID NO: 8360256 - DNA, 22 bp, Homo sapiens
caggagcccagagtcctcagct

SEQ ID NO: 8360257 - DNA, 22 bp, Homo sapiens
caggagccagctgtcccaacca

SEQ ID NO: 8360258 - DNA, 22 bp, Homo sapiens
caggatggcagagaaaagggtg

SEQ ID NO: 8360259 - DNA, 22 bp, Homo sapiens
caggagcatgctgatgccagaa

SEQ ID NO: 8360260 - DNA, 22 bp, Homo sapiens
caggagcatgctgatgccagaa

SEQ ID NO: 8360261 - DNA, 22 bp, Homo sapiens
caggagcaggcccaaggacaca

SEQ ID NO: 8360262 - DNA, 22 bp, Homo sapiens
caggagccacattccaccttga

SEQ ID NO: 8360263 - DNA, 22 bp, Homo sapiens
acaggctctctattgagtgcag

SEQ ID NO: 8360264 - DNA, 21 bp, Homo sapiens
acagggcatgcagctggctgt

SEQ ID NO: 8360265 - DNA, 22 bp, Homo sapiens
acagggcatgtgcaagagacat

SEQ ID NO: 8360266 - DNA, 22 bp, Homo sapiens
acagggcatgtgcaagagacat

SEQ ID NO: 8360267 - DNA, 23 bp, Homo sapiens
acagggcattgctggcctcgagg

SEQ ID NO: 8360268 - DNA, 23 bp, Homo sapiens
acagggcattgctggcctcgagg

SEQ ID NO: 8360269 - DNA, 22 bp, Homo sapiens
aggaaaggttcagtgattgaaa

SEQ ID NO: 8360270 - DNA, 22 bp, Homo sapiens
aggaaaggttcagtgattgaaa

SEQ ID NO: 8360271 - DNA, 19 bp, Homo sapiens
aggaaaggtggccttagca

SEQ ID NO: 8360272 - DNA, 22 bp, Homo sapiens
aggaaaggtgagagcggccgcg

SEQ ID NO: 8360273 - DNA, 22 bp, Homo sapiens
aggaaaggggtaggtgtggacg

SEQ ID NO: 8360274 - DNA, 22 bp, Homo sapiens
aggaaaggtagcgtgccagcag

SEQ ID NO: 8360275 - DNA, 22 bp, Homo sapiens
aggaaagtggtgggaaatcagg

SEQ ID NO: 8360276 - DNA, 22 bp, Homo sapiens
aggaaataagggacaagacaaa

SEQ ID NO: 8360277 - DNA, 22 bp, Homo sapiens
aggaaataagggcacttcagat

SEQ ID NO: 8360278 - DNA, 22 bp, Homo sapiens
aggaaataggaccagacaaagc

SEQ ID NO: 8360279 - DNA, 22 bp, Homo sapiens
acaggcctggtgctgctgacag

SEQ ID NO: 8360280 - DNA, 22 bp, Homo sapiens
acaggcctgtgtgcacacgagg

SEQ ID NO: 8360281 - DNA, 22 bp, Homo sapiens
acaggccttggtcctgacctaa

SEQ ID NO: 8360282 - DNA, 21 bp, Homo sapiens
acaggccttaggggccattca

SEQ ID NO: 8360283 - DNA, 22 bp, Homo sapiens
acaggccttggcaggcatgtga

SEQ ID NO: 8360284 - DNA, 22 bp, Homo sapiens
acaggccttaggagagatgggg

SEQ ID NO: 8360285 - DNA, 22 bp, Homo sapiens
aggacaggtgtagtgggctctg

SEQ ID NO: 8360286 - DNA, 22 bp, Homo sapiens
aggacacaggtaagccagtgga

SEQ ID NO: 8360287 - DNA, 22 bp, Homo sapiens
acagggccaggtgagaggtgct

SEQ ID NO: 8360288 - DNA, 22 bp, Homo sapiens
acagggcctcagccagggcaga

SEQ ID NO: 8360289 - DNA, 22 bp, Homo sapiens
aggactggtgccagacaaggta

SEQ ID NO: 8360290 - DNA, 22 bp, Homo sapiens
aggactggtgtgtgatcagcat

SEQ ID NO: 8360291 - DNA, 22 bp, Homo sapiens
aggactgggtgcagagggcatc

SEQ ID NO: 8360292 - DNA, 22 bp, Homo sapiens
aggactggcagtgtgaggggtc

SEQ ID NO: 8360293 - DNA, 22 bp, Homo sapiens
aggacaggtgtagtgggctctg

SEQ ID NO: 8360294 - DNA, 22 bp, Homo sapiens
aggacagtccggggtcctccac

SEQ ID NO: 8360295 - DNA, 22 bp, Homo sapiens
aggacagtggtgttctggagtg

SEQ ID NO: 8360296 - DNA, 22 bp, Homo sapiens
aggacatgaagaaagggcaagg

SEQ ID NO: 8360297 - DNA, 22 bp, Homo sapiens
aggacagttagttaggaagttt

SEQ ID NO: 8360298 - DNA, 22 bp, Homo sapiens
acaggacatgtaccaggtggtc

SEQ ID NO: 8360299 - DNA, 22 bp, Homo sapiens
acaggacagtctagtaacagta

SEQ ID NO: 8360300 - DNA, 22 bp, Homo sapiens
acaggacagtctagtaacagta

SEQ ID NO: 8360301 - DNA, 22 bp, Homo sapiens
acaggacaggtaggattcgcag

SEQ ID NO: 8360302 - DNA, 22 bp, Homo sapiens
acaggacaggctgggctagact

SEQ ID NO: 8360303 - DNA, 22 bp, Homo sapiens
agcttcttggctcagcacttgg

SEQ ID NO: 8360304 - DNA, 22 bp, Homo sapiens
agcttcttgggctttacacaaa

SEQ ID NO: 8360305 - DNA, 22 bp, Homo sapiens
agcttcttggctcagcacttgg

SEQ ID NO: 8360306 - DNA, 22 bp, Homo sapiens
agcttcttctgatttgtcagtc

SEQ ID NO: 8360307 - DNA, 22 bp, Homo sapiens
agcttcttagttcacttttaat

SEQ ID NO: 8360308 - DNA, 22 bp, Homo sapiens
aggaaagaagtacattctcatg

SEQ ID NO: 8360309 - DNA, 22 bp, Homo sapiens
acaggcaaacacagaaagtagg

SEQ ID NO: 8360310 - DNA, 22 bp, Homo sapiens
acaggcaaggccagtgagaaat

SEQ ID NO: 8360311 - DNA, 22 bp, Homo sapiens
acaggcaagaggaaagcaagta

SEQ ID NO: 8360312 - DNA, 22 bp, Homo sapiens
acaggatgataaaggatggcca

SEQ ID NO: 8360313 - DNA, 20 bp, Homo sapiens
acaggatgcctgccatttca

SEQ ID NO: 8360314 - DNA, 22 bp, Homo sapiens
acaggatggccagctgatattg

SEQ ID NO: 8360315 - DNA, 22 bp, Homo sapiens
acaggatgggcgcacagagcta

SEQ ID NO: 8360316 - DNA, 22 bp, Homo sapiens
acaggatgggcgcacagagcta

SEQ ID NO: 8360317 - DNA, 22 bp, Homo sapiens
acaggatgagaatatcatattt

SEQ ID NO: 8360318 - DNA, 22 bp, Homo sapiens
agcttcttttacagctcatgct

SEQ ID NO: 8360319 - DNA, 19 bp, Homo sapiens
agcttctttggaaacattt

SEQ ID NO: 8360320 - DNA, 22 bp, Homo sapiens
acaggaagtgggaagaaacagg

SEQ ID NO: 8360321 - DNA, 22 bp, Homo sapiens
acaggaagtgggaagaaacagg

SEQ ID NO: 8360322 - DNA, 22 bp, Homo sapiens
acaggaagtgctggcacttaca

SEQ ID NO: 8360323 - DNA, 22 bp, Homo sapiens
acaggaagtgctggcacttaca

SEQ ID NO: 8360324 - DNA, 22 bp, Homo sapiens
acaggacaactcagcagccagc

SEQ ID NO: 8360325 - DNA, 22 bp, Homo sapiens
acaggacaactcagcagccagc

SEQ ID NO: 8360326 - DNA, 22 bp, Homo sapiens
acaggaagtttggaaagcctca

SEQ ID NO: 8360327 - DNA, 22 bp, Homo sapiens
acaggaagtttggaaagcctca

SEQ ID NO: 8360328 - DNA, 22 bp, Homo sapiens
acaggaagtgggaagaaacagg

SEQ ID NO: 8360329 - DNA, 22 bp, Homo sapiens
acaggacaaaaatctggatggc

SEQ ID NO: 8360330 - DNA, 22 bp, Homo sapiens
acagcagtgggttgccagtggg

SEQ ID NO: 8360331 - DNA, 22 bp, Homo sapiens
acagcagtggtgcactgagcca

SEQ ID NO: 8360332 - DNA, 22 bp, Homo sapiens
acagcagttaacgatcagactc

SEQ ID NO: 8360333 - DNA, 22 bp, Homo sapiens
acagcagtgtctggtactgagt

SEQ ID NO: 8360334 - DNA, 22 bp, Homo sapiens
acagcagttaacgatcagactc

SEQ ID NO: 8360335 - DNA, 22 bp, Homo sapiens
acagccagaagtcagggtggga

SEQ ID NO: 8360336 - DNA, 22 bp, Homo sapiens
acagccaacgtctttcttactt

SEQ ID NO: 8360337 - DNA, 21 bp, Homo sapiens
acagcatgtttgtgtgtttgc

SEQ ID NO: 8360338 - DNA, 22 bp, Homo sapiens
acagcatttaaagaaaatgaac

SEQ ID NO: 8360339 - DNA, 22 bp, Homo sapiens
aggcagcaaagaaatgatgctg

SEQ ID NO: 8360340 - DNA, 22 bp, Homo sapiens
aggcagattttctttactcagt

SEQ ID NO: 8360341 - DNA, 22 bp, Homo sapiens
aggcaggggagctggaagggta

SEQ ID NO: 8360342 - DNA, 18 bp, Homo sapiens
aggcaggtgctggaagtc

SEQ ID NO: 8360343 - DNA, 22 bp, Homo sapiens
acatagttagcttagagatact

SEQ ID NO: 8360344 - DNA, 22 bp, Homo sapiens
aggcagatgggagctggaagtt

SEQ ID NO: 8360345 - DNA, 22 bp, Homo sapiens
aggcagattacttgaggccagg

SEQ ID NO: 8360346 - DNA, 22 bp, Homo sapiens
aggcagagaaaaaccagatatg

SEQ ID NO: 8360347 - DNA, 22 bp, Homo sapiens
aggcagagaaaaaccagatatg

SEQ ID NO: 8360348 - DNA, 22 bp, Homo sapiens
aggcagagaaaaaccagatatg

SEQ ID NO: 8360349 - DNA, 22 bp, Homo sapiens
aggcagatcagtacagggttaa

SEQ ID NO: 8360350 - DNA, 22 bp, Homo sapiens
aggcagatcacaggagggcctg

SEQ ID NO: 8360351 - DNA, 22 bp, Homo sapiens
aggcagatcacttgaggccagg

SEQ ID NO: 8360352 - DNA, 22 bp, Homo sapiens
aggcagatatttcagttcacat

SEQ ID NO: 8360353 - DNA, 21 bp, Homo sapiens
aggcagaaagagcccaggctg

SEQ ID NO: 8360354 - DNA, 22 bp, Homo sapiens
aggcagaagccagccagggtcc

SEQ ID NO: 8360355 - DNA, 22 bp, Homo sapiens
aggcagaagccagccagggtcc

SEQ ID NO: 8360356 - DNA, 22 bp, Homo sapiens
aggcagtggtgtttgctggtgg

SEQ ID NO: 8360357 - DNA, 20 bp, Homo sapiens
aggcagtgtagagatgagta

SEQ ID NO: 8360358 - DNA, 20 bp, Homo sapiens
aggcagtgtagagatgagta

SEQ ID NO: 8360359 - DNA, 22 bp, Homo sapiens
aggcagtgtattgctagcggct

SEQ ID NO: 8360360 - DNA, 22 bp, Homo sapiens
aggcagtgtgtagctggaagag

SEQ ID NO: 8360361 - DNA, 22 bp, Homo sapiens
acatatatgtaaagtactttgt

SEQ ID NO: 8360362 - DNA, 22 bp, Homo sapiens
acatataagggatcagtgacag

SEQ ID NO: 8360363 - DNA, 22 bp, Homo sapiens
acatataagggatcagtgacag

SEQ ID NO: 8360364 - DNA, 22 bp, Homo sapiens
acatctctccaaaggaaggtgc

SEQ ID NO: 8360365 - DNA, 22 bp, Homo sapiens
acatctgaccattacaagacat

SEQ ID NO: 8360366 - DNA, 22 bp, Homo sapiens
acagtgttcacttaacaatgga

SEQ ID NO: 8360367 - DNA, 22 bp, Homo sapiens
aggcactggtccattttctgca

SEQ ID NO: 8360368 - DNA, 22 bp, Homo sapiens
aggcactttttgcattttagaa

SEQ ID NO: 8360369 - DNA, 22 bp, Homo sapiens
aggcagaaaatagtcatccaaa

SEQ ID NO: 8360370 - DNA, 22 bp, Homo sapiens
aggcagaaaatagtcatccaaa

SEQ ID NO: 8360371 - DNA, 22 bp, Homo sapiens
aggcaccttgcggtccagtgaa

SEQ ID NO: 8360372 - DNA, 22 bp, Homo sapiens
aggcaccttgagagcaggagct

SEQ ID NO: 8360373 - DNA, 19 bp, Homo sapiens
aggcaccttgatggcttcc

SEQ ID NO: 8360374 - DNA, 22 bp, Homo sapiens
aggcacctggatcttggaattc

SEQ ID NO: 8360375 - DNA, 22 bp, Homo sapiens
aggcacctgaggtggccagcct

SEQ ID NO: 8360376 - DNA, 20 bp, Homo sapiens
aggcacctgtcacaggtgag

SEQ ID NO: 8360377 - DNA, 22 bp, Homo sapiens
aggcacctggccagttgtcttg

SEQ ID NO: 8360378 - DNA, 22 bp, Homo sapiens
acagtggcagtcgtgttctcta

SEQ ID NO: 8360379 - DNA, 22 bp, Homo sapiens
acagtggcatctacttaatctg

SEQ ID NO: 8360380 - DNA, 22 bp, Homo sapiens
acagtggcctcaaagaaagaga

SEQ ID NO: 8360381 - DNA, 22 bp, Homo sapiens
aggcacagcacacctggccccc

SEQ ID NO: 8360382 - DNA, 22 bp, Homo sapiens
aggcacagcacacctggccccc

SEQ ID NO: 8360383 - DNA, 17 bp, Homo sapiens
aggcacctcttcctgct

SEQ ID NO: 8360384 - DNA, 22 bp, Homo sapiens
aggcacctcttaggctgctact

SEQ ID NO: 8360385 - DNA, 22 bp, Homo sapiens
aggcacctcatagccagccccc

SEQ ID NO: 8360386 - DNA, 22 bp, Homo sapiens
aggcacctcagctgagcctggg

SEQ ID NO: 8360387 - DNA, 22 bp, Homo sapiens
acagtggaaagaacatggattt

SEQ ID NO: 8360388 - DNA, 17 bp, Homo sapiens
aggaggccctggcgttt

SEQ ID NO: 8360389 - DNA, 22 bp, Homo sapiens
acagtgcagggcgggaagaagg

SEQ ID NO: 8360390 - DNA, 22 bp, Homo sapiens
acagtgcagggtgggaagaagg

SEQ ID NO: 8360391 - DNA, 22 bp, Homo sapiens
aggaggccctagagctctagag

SEQ ID NO: 8360392 - DNA, 22 bp, Homo sapiens
aggaggcccctcctgggttgct

SEQ ID NO: 8360393 - DNA, 19 bp, Homo sapiens
aggaggccatgccactaga

SEQ ID NO: 8360394 - DNA, 22 bp, Homo sapiens
aggaggccaggccctcaagcct

SEQ ID NO: 8360395 - DNA, 20 bp, Homo sapiens
aggaggcatagtctggaaag

SEQ ID NO: 8360396 - DNA, 22 bp, Homo sapiens
aggactgttttttcttctaggg

SEQ ID NO: 8360397 - DNA, 22 bp, Homo sapiens
aggacttagaacattatgtact

SEQ ID NO: 8360398 - DNA, 22 bp, Homo sapiens
acagtctttgcaggagaaagga

SEQ ID NO: 8360399 - DNA, 22 bp, Homo sapiens
acagtgaatccaaattcctacc

SEQ ID NO: 8360400 - DNA, 23 bp, Homo sapiens
acagtgaaacacgcagtaagagt

SEQ ID NO: 8360401 - DNA, 23 bp, Homo sapiens
acagtgaaacacgcagtaagagt

SEQ ID NO: 8360402 - DNA, 22 bp, Homo sapiens
acagtgaaaattctattgattt

SEQ ID NO: 8360403 - DNA, 22 bp, Homo sapiens
acagtgaaaagaatattagaat

SEQ ID NO: 8360404 - DNA, 17 bp, Homo sapiens
acagtgagaagtcatct

SEQ ID NO: 8360405 - DNA, 22 bp, Homo sapiens
acagtgaatgagaatggagaaa

SEQ ID NO: 8360406 - DNA, 22 bp, Homo sapiens
acagtgaatgcccaagaaaagt

SEQ ID NO: 8360407 - DNA, 22 bp, Homo sapiens
acatttctcctacttgttattt

SEQ ID NO: 8360408 - DNA, 18 bp, Homo sapiens
acatttctccttctgacc

SEQ ID NO: 8360409 - DNA, 22 bp, Homo sapiens
acatttctcattctcccctaac

SEQ ID NO: 8360410 - DNA, 22 bp, Homo sapiens
acatttctccctgcatgcctgc

SEQ ID NO: 8360411 - DNA, 22 bp, Homo sapiens
aggctggcttggctctcctgtg

SEQ ID NO: 8360412 - DNA, 22 bp, Homo sapiens
aggctggcttcccaagcgtcct

SEQ ID NO: 8360413 - DNA, 22 bp, Homo sapiens
aggctggcttcccaagcgtcct

SEQ ID NO: 8360414 - DNA, 22 bp, Homo sapiens
aggctggcttcccaagcgtcct

SEQ ID NO: 8360415 - DNA, 23 bp, Homo sapiens
aggctggcttcaggagcctctcc

SEQ ID NO: 8360416 - DNA, 22 bp, Homo sapiens
aggctggccagtgctgcagtgg

SEQ ID NO: 8360417 - DNA, 22 bp, Homo sapiens
aggctggccagtgctgcagtgg

SEQ ID NO: 8360418 - DNA, 23 bp, Homo sapiens
aggctgctgagatgggtgtgtca

SEQ ID NO: 8360419 - DNA, 22 bp, Homo sapiens
aggctgctggcaggcgtggacg

SEQ ID NO: 8360420 - DNA, 21 bp, Homo sapiens
aggctgctggctcagggtcct

SEQ ID NO: 8360421 - DNA, 22 bp, Homo sapiens
aggctgctgccttggagagtgt

SEQ ID NO: 8360422 - DNA, 22 bp, Homo sapiens
aggctgctgctctacagttgct

SEQ ID NO: 8360423 - DNA, 22 bp, Homo sapiens
aggctggctttggtagcatggt

SEQ ID NO: 8360424 - DNA, 22 bp, Homo sapiens
aggctggctttggtagcatggt

SEQ ID NO: 8360425 - DNA, 22 bp, Homo sapiens
aggctgggaaacctgaagttgt

SEQ ID NO: 8360426 - DNA, 22 bp, Homo sapiens
aggctgggaaatgtagtcttcc

SEQ ID NO: 8360427 - DNA, 22 bp, Homo sapiens
aggctgtgagaagtccttcagt

SEQ ID NO: 8360428 - DNA, 22 bp, Homo sapiens
aggctgtgagaggtggctccca

SEQ ID NO: 8360429 - DNA, 19 bp, Homo sapiens
aggctgtgagggaggactc

SEQ ID NO: 8360430 - DNA, 19 bp, Homo sapiens
aggctgtgaggggaaggaa

SEQ ID NO: 8360431 - DNA, 22 bp, Homo sapiens
accagaagttctccaaaaagat

SEQ ID NO: 8360432 - DNA, 22 bp, Homo sapiens
accagacactgtgaagacaggc

SEQ ID NO: 8360433 - DNA, 22 bp, Homo sapiens
accagaaaggaataatagaatt

SEQ ID NO: 8360434 - DNA, 22 bp, Homo sapiens
accactgtctacacattgactc

SEQ ID NO: 8360435 - DNA, 17 bp, Homo sapiens
accactttgccaagttg

SEQ ID NO: 8360436 - DNA, 22 bp, Homo sapiens
accactttggtatttcaatttt

SEQ ID NO: 8360437 - DNA, 22 bp, Homo sapiens
accactttacagaaatggaaag

SEQ ID NO: 8360438 - DNA, 22 bp, Homo sapiens
accactgtatctccagcacatt

SEQ ID NO: 8360439 - DNA, 22 bp, Homo sapiens
accactgtactatttgagtggc

SEQ ID NO: 8360440 - DNA, 22 bp, Homo sapiens
accactgtacagcagatatagt

SEQ ID NO: 8360441 - DNA, 21 bp, Homo sapiens
accactgcctccaaggttcag

SEQ ID NO: 8360442 - DNA, 22 bp, Homo sapiens
accactgcccatggtgaaaact

SEQ ID NO: 8360443 - DNA, 22 bp, Homo sapiens
accacaggaattgctctgtggt

SEQ ID NO: 8360444 - DNA, 22 bp, Homo sapiens
aggctgtgatgagcctcatgga

SEQ ID NO: 8360445 - DNA, 20 bp, Homo sapiens
acatgtactaatgaatacag

SEQ ID NO: 8360446 - DNA, 22 bp, Homo sapiens
acatgtactgttggtgaagagg

SEQ ID NO: 8360447 - DNA, 22 bp, Homo sapiens
acatgtacatacacatatgtaa

SEQ ID NO: 8360448 - DNA, 21 bp, Homo sapiens
acatgtacacatgtatgcaca

SEQ ID NO: 8360449 - DNA, 21 bp, Homo sapiens
acatgtaagagagtttcaaga

SEQ ID NO: 8360450 - DNA, 20 bp, Homo sapiens
acatgtacagacaggtttct

SEQ ID NO: 8360451 - DNA, 22 bp, Homo sapiens
acatgtctacacattctgcaat

SEQ ID NO: 8360452 - DNA, 22 bp, Homo sapiens
acatgtctccacccatcttaaa

SEQ ID NO: 8360453 - DNA, 21 bp, Homo sapiens
acatgtcccctatgcttaagg

SEQ ID NO: 8360454 - DNA, 22 bp, Homo sapiens
acatgtctcatggcagaatttt

SEQ ID NO: 8360455 - DNA, 22 bp, Homo sapiens
acatgtctacacattctgcaat

SEQ ID NO: 8360456 - DNA, 22 bp, Homo sapiens
acatgtattgacattatattct

SEQ ID NO: 8360457 - DNA, 22 bp, Homo sapiens
acatgtaaaagataaattaaca

SEQ ID NO: 8360458 - DNA, 22 bp, Homo sapiens
acatgtaaaagataaattaaca

SEQ ID NO: 8360459 - DNA, 22 bp, Homo sapiens
acatgtaagactagcttaaagt

SEQ ID NO: 8360460 - DNA, 21 bp, Homo sapiens
acatgtaagagagtttcaaga

SEQ ID NO: 8360461 - DNA, 22 bp, Homo sapiens
acatgtaacatatatgtagcat

SEQ ID NO: 8360462 - DNA, 22 bp, Homo sapiens
acatgtaaaaggaacatgcatg

SEQ ID NO: 8360463 - DNA, 22 bp, Homo sapiens
acatgtaaacatttacagtatt

SEQ ID NO: 8360464 - DNA, 22 bp, Homo sapiens
acatgtctcttgtggttttcaa

SEQ ID NO: 8360465 - DNA, 22 bp, Homo sapiens
acatgtctcttctgaaagacaa

SEQ ID NO: 8360466 - DNA, 21 bp, Homo sapiens
acatgtctctaatctcagtga

SEQ ID NO: 8360467 - DNA, 22 bp, Homo sapiens
acatgtctccacccatcttaaa

SEQ ID NO: 8360468 - DNA, 21 bp, Homo sapiens
acatgtctctaatctcagtga

SEQ ID NO: 8360469 - DNA, 22 bp, Homo sapiens
acatgtcttttaaagtctaata

SEQ ID NO: 8360470 - DNA, 22 bp, Homo sapiens
aggctctggacagtgaggagtt

SEQ ID NO: 8360471 - DNA, 22 bp, Homo sapiens
aggctctcctccccaggaccat

SEQ ID NO: 8360472 - DNA, 21 bp, Homo sapiens
aggctctcatccagggaccca

SEQ ID NO: 8360473 - DNA, 22 bp, Homo sapiens
aggctctcagatcagccacatt

SEQ ID NO: 8360474 - DNA, 22 bp, Homo sapiens
acattaaatttcatagtgatta

SEQ ID NO: 8360475 - DNA, 22 bp, Homo sapiens
aggctccagtctcctctggcag

SEQ ID NO: 8360476 - DNA, 22 bp, Homo sapiens
aggctcctttaccattctggag

SEQ ID NO: 8360477 - DNA, 22 bp, Homo sapiens
aggctctataccgctgggagtt

SEQ ID NO: 8360478 - DNA, 22 bp, Homo sapiens
acatgttttgtgccttgactag

SEQ ID NO: 8360479 - DNA, 19 bp, Homo sapiens
acatgttttgcagaacagc

SEQ ID NO: 8360480 - DNA, 22 bp, Homo sapiens
aggctcaggtctcaggtctggc

SEQ ID NO: 8360481 - DNA, 22 bp, Homo sapiens
acctccagctttttagagacat

SEQ ID NO: 8360482 - DNA, 22 bp, Homo sapiens
acctcaggatgtggacacagaa

SEQ ID NO: 8360483 - DNA, 22 bp, Homo sapiens
aggggccacctgtggcaccctg

SEQ ID NO: 8360484 - DNA, 22 bp, Homo sapiens
aggggcatcagttgcacatttt

SEQ ID NO: 8360485 - DNA, 19 bp, Homo sapiens
agggtacacgagagaagag

SEQ ID NO: 8360486 - DNA, 22 bp, Homo sapiens
agggctcagttgcctggagccc

SEQ ID NO: 8360487 - DNA, 22 bp, Homo sapiens
agggctcagggtcaccatctgt

SEQ ID NO: 8360488 - DNA, 22 bp, Homo sapiens
agggctcagtaaacggtggatt

SEQ ID NO: 8360489 - DNA, 22 bp, Homo sapiens
agggctttctttgtaaaagaag

SEQ ID NO: 8360490 - DNA, 22 bp, Homo sapiens
agggctcagccagcctgtgtgc

SEQ ID NO: 8360491 - DNA, 22 bp, Homo sapiens
agggctcagcatctcattctgt

SEQ ID NO: 8360492 - DNA, 22 bp, Homo sapiens
agggctcaggggccccaagctg

SEQ ID NO: 8360493 - DNA, 22 bp, Homo sapiens
agggctcagggcacgtcatcca

SEQ ID NO: 8360494 - DNA, 22 bp, Homo sapiens
agggctcagcctcctcctcagc

SEQ ID NO: 8360495 - DNA, 22 bp, Homo sapiens
agggctcagagtagttcggttt

SEQ ID NO: 8360496 - DNA, 22 bp, Homo sapiens
agggctcagagcaaaagggcac

SEQ ID NO: 8360497 - DNA, 22 bp, Homo sapiens
agggctcagaaatgtctacggg

SEQ ID NO: 8360498 - DNA, 22 bp, Homo sapiens
agggctcagaacaatgagtgta

SEQ ID NO: 8360499 - DNA, 22 bp, Homo sapiens
agggctcagaaagcaggttttc

SEQ ID NO: 8360500 - DNA, 22 bp, Homo sapiens
agggctcactgggaggctataa

SEQ ID NO: 8360501 - DNA, 22 bp, Homo sapiens
agggctcactacaaccctggga

SEQ ID NO: 8360502 - DNA, 22 bp, Homo sapiens
aggggcaggtgctgcacttaga

SEQ ID NO: 8360503 - DNA, 22 bp, Homo sapiens
aggggagcttgcctggtcaccc

SEQ ID NO: 8360504 - DNA, 22 bp, Homo sapiens
aggggagcccctggtcctggtg

SEQ ID NO: 8360505 - DNA, 22 bp, Homo sapiens
agggctttgagaatagtggaac

SEQ ID NO: 8360506 - DNA, 22 bp, Homo sapiens
agggctttgatggcattctcat

SEQ ID NO: 8360507 - DNA, 22 bp, Homo sapiens
agggatgtgggaactgcaggtt

SEQ ID NO: 8360508 - DNA, 22 bp, Homo sapiens
agggatgttagttgtgagctca

SEQ ID NO: 8360509 - DNA, 22 bp, Homo sapiens
agggcacagcctaaagcctatg

SEQ ID NO: 8360510 - DNA, 21 bp, Homo sapiens
agggcacccccgctgcctacc

SEQ ID NO: 8360511 - DNA, 22 bp, Homo sapiens
agggaggatctgctccttgtct

SEQ ID NO: 8360512 - DNA, 20 bp, Homo sapiens
accagagctctcagtatgtg

SEQ ID NO: 8360513 - DNA, 20 bp, Homo sapiens
accagagctctcagtatgtg

SEQ ID NO: 8360514 - DNA, 22 bp, Homo sapiens
accagagaatttagccaagaaa

SEQ ID NO: 8360515 - DNA, 22 bp, Homo sapiens
accagagactgcatttctctga

SEQ ID NO: 8360516 - DNA, 22 bp, Homo sapiens
accagagatggggcttctctgt

SEQ ID NO: 8360517 - DNA, 22 bp, Homo sapiens
agggccagatgaagccacaagc

SEQ ID NO: 8360518 - DNA, 21 bp, Homo sapiens
agggccagatcaccaaggagc

SEQ ID NO: 8360519 - DNA, 22 bp, Homo sapiens
agggcactggcttgcaaactca

SEQ ID NO: 8360520 - DNA, 22 bp, Homo sapiens
agggcactctgcagggaccacc

SEQ ID NO: 8360521 - DNA, 22 bp, Homo sapiens
agggcactccttggcagctctg

SEQ ID NO: 8360522 - DNA, 22 bp, Homo sapiens
agggcactccttggcagctctg

SEQ ID NO: 8360523 - DNA, 22 bp, Homo sapiens
agggccagcccataatgccaaa

SEQ ID NO: 8360524 - DNA, 22 bp, Homo sapiens
agggccagcccataatgccaaa

SEQ ID NO: 8360525 - DNA, 22 bp, Homo sapiens
agggccagccaggccctacaaa

SEQ ID NO: 8360526 - DNA, 22 bp, Homo sapiens
agggcctgtcagcggtgtcctg

SEQ ID NO: 8360527 - DNA, 22 bp, Homo sapiens
agggctcaagaaagtgtacctc

SEQ ID NO: 8360528 - DNA, 22 bp, Homo sapiens
agggctcaagggcatgctacgt

SEQ ID NO: 8360529 - DNA, 22 bp, Homo sapiens
agggctcaatggtgggcatgta

SEQ ID NO: 8360530 - DNA, 22 bp, Homo sapiens
agggctcaccactgtgcactcc

SEQ ID NO: 8360531 - DNA, 22 bp, Homo sapiens
agggccagtaaatgtttcctca

SEQ ID NO: 8360532 - DNA, 22 bp, Homo sapiens
agggccagttcagaggacatgg

SEQ ID NO: 8360533 - DNA, 22 bp, Homo sapiens
agaaatgttacagttgttattt

SEQ ID NO: 8360534 - DNA, 22 bp, Homo sapiens
agaaatgtggatcgttttaaaa

SEQ ID NO: 8360535 - DNA, 22 bp, Homo sapiens
agaaatgttgaatacacaaaat

SEQ ID NO: 8360536 - DNA, 22 bp, Homo sapiens
agaaatgttacagttgttattt

SEQ ID NO: 8360537 - DNA, 22 bp, Homo sapiens
agaaatgttacagttgttattt

SEQ ID NO: 8360538 - DNA, 22 bp, Homo sapiens
agaaatgttcttcatttgccat

SEQ ID NO: 8360539 - DNA, 22 bp, Homo sapiens
agaaatgtgaatttcatttcct

SEQ ID NO: 8360540 - DNA, 22 bp, Homo sapiens
agaaatgtggaggaacagggct

SEQ ID NO: 8360541 - DNA, 22 bp, Homo sapiens
agaaatgtaggcatataaggaa

SEQ ID NO: 8360542 - DNA, 22 bp, Homo sapiens
agaaatgtacacgacacccaga

SEQ ID NO: 8360543 - DNA, 22 bp, Homo sapiens
agaaatggaaatccaagcaact

SEQ ID NO: 8360544 - DNA, 22 bp, Homo sapiens
agaaatggtgagtgagagcccc

SEQ ID NO: 8360545 - DNA, 22 bp, Homo sapiens
agaaatgtattctgtatgtttt

SEQ ID NO: 8360546 - DNA, 21 bp, Homo sapiens
agaaatgtatcattcttttcc

SEQ ID NO: 8360547 - DNA, 21 bp, Homo sapiens
agaaatgtatcattcttttcc

SEQ ID NO: 8360548 - DNA, 21 bp, Homo sapiens
agaaatgtatcattcttttcc

SEQ ID NO: 8360549 - DNA, 22 bp, Homo sapiens
agaaatgtcaagtgttcttgtt

SEQ ID NO: 8360550 - DNA, 22 bp, Homo sapiens
agaaatgtcaggaaagaagtcc

SEQ ID NO: 8360551 - DNA, 22 bp, Homo sapiens
agaaatgtttactcaccccctt

SEQ ID NO: 8360552 - DNA, 22 bp, Homo sapiens
agaaatgttgaatacacaaaat

SEQ ID NO: 8360553 - DNA, 22 bp, Homo sapiens
agaaatgttgtgggttttgtta

SEQ ID NO: 8360554 - DNA, 22 bp, Homo sapiens
agaagcagggcagggaaaagca

SEQ ID NO: 8360555 - DNA, 20 bp, Homo sapiens
agaagcattcaaagaaaact

SEQ ID NO: 8360556 - DNA, 22 bp, Homo sapiens
agaagcagttattttttgcaca

SEQ ID NO: 8360557 - DNA, 18 bp, Homo sapiens
agaagcaggtaaaattct

SEQ ID NO: 8360558 - DNA, 18 bp, Homo sapiens
agaagcaggtaaaattct

SEQ ID NO: 8360559 - DNA, 22 bp, Homo sapiens
agaagcattataacatgcaagg

SEQ ID NO: 8360560 - DNA, 22 bp, Homo sapiens
agaagccatggggtcaccagag

SEQ ID NO: 8360561 - DNA, 22 bp, Homo sapiens
atcctgcttgttacttatagag

SEQ ID NO: 8360562 - DNA, 22 bp, Homo sapiens
atcctgaggaaggtgcagagat

SEQ ID NO: 8360563 - DNA, 22 bp, Homo sapiens
atcctgagttcctgcctctaaa

SEQ ID NO: 8360564 - DNA, 22 bp, Homo sapiens
atcctgagctacacctgctcct

SEQ ID NO: 8360565 - DNA, 22 bp, Homo sapiens
agaagctggaggaagactaagc

SEQ ID NO: 8360566 - DNA, 22 bp, Homo sapiens
agaagctataacaacaattata

SEQ ID NO: 8360567 - DNA, 21 bp, Homo sapiens
agaagctagtcactaaatcca

SEQ ID NO: 8360568 - DNA, 22 bp, Homo sapiens
agaagctgacagatgcagcagg

SEQ ID NO: 8360569 - DNA, 22 bp, Homo sapiens
agaagctaggctagacaagtga

SEQ ID NO: 8360570 - DNA, 22 bp, Homo sapiens
agaagctgacagatgcagcagg

SEQ ID NO: 8360571 - DNA, 22 bp, Homo sapiens
agaagctgagaatgaattaaga

SEQ ID NO: 8360572 - DNA, 19 bp, Homo sapiens
agaagcccagatcccagcc

SEQ ID NO: 8360573 - DNA, 22 bp, Homo sapiens
atcaagcagtgaaaaatgctag

SEQ ID NO: 8360574 - DNA, 22 bp, Homo sapiens
atcaagagttatatttcatagt

SEQ ID NO: 8360575 - DNA, 22 bp, Homo sapiens
agaaatgcagtttcaagacaaa

SEQ ID NO: 8360576 - DNA, 22 bp, Homo sapiens
agaaatgcagtcattgtatagt

SEQ ID NO: 8360577 - DNA, 22 bp, Homo sapiens
agaaatgcaaattttcatagag

SEQ ID NO: 8360578 - DNA, 22 bp, Homo sapiens
agaaatcttggagtctgtggta

SEQ ID NO: 8360579 - DNA, 19 bp, Homo sapiens
agaaatagccttccttgtc

SEQ ID NO: 8360580 - DNA, 22 bp, Homo sapiens
agaaatagtcacattggaggaa

SEQ ID NO: 8360581 - DNA, 22 bp, Homo sapiens
agaaatatgctgattagatgaa

SEQ ID NO: 8360582 - DNA, 22 bp, Homo sapiens
agaaatatgctgattagatgaa

SEQ ID NO: 8360583 - DNA, 22 bp, Homo sapiens
agaaatatgctgattagatgaa

SEQ ID NO: 8360584 - DNA, 22 bp, Homo sapiens
atattaattatttacacatgag

SEQ ID NO: 8360585 - DNA, 22 bp, Homo sapiens
atattaattatttacacatgag

SEQ ID NO: 8360586 - DNA, 20 bp, Homo sapiens
agaaatattgagttcagagg

SEQ ID NO: 8360587 - DNA, 20 bp, Homo sapiens
agaaatattgagttcagagg

SEQ ID NO: 8360588 - DNA, 22 bp, Homo sapiens
agaaatatgctgattagatgaa

SEQ ID NO: 8360589 - DNA, 22 bp, Homo sapiens
agaaatcaatatctatatgttg

SEQ ID NO: 8360590 - DNA, 22 bp, Homo sapiens
agaaatcaatatctatatgttg

SEQ ID NO: 8360591 - DNA, 22 bp, Homo sapiens
agaaagaggatgcagatctcat

SEQ ID NO: 8360592 - DNA, 22 bp, Homo sapiens
agaaagagatgaatgctttaag

SEQ ID NO: 8360593 - DNA, 22 bp, Homo sapiens
agaaagacgtgatgaagaagta

SEQ ID NO: 8360594 - DNA, 22 bp, Homo sapiens
agaaagagctcgggattaacag

SEQ ID NO: 8360595 - DNA, 22 bp, Homo sapiens
agaaagaacgttggttatctta

SEQ ID NO: 8360596 - DNA, 22 bp, Homo sapiens
agaaagaacgttggttatctta

SEQ ID NO: 8360597 - DNA, 22 bp, Homo sapiens
agaaagacgtgatgaagaagta

SEQ ID NO: 8360598 - DNA, 22 bp, Homo sapiens
atattaatgagcaagtaagtga

SEQ ID NO: 8360599 - DNA, 22 bp, Homo sapiens
atattaatgggatttagtcagg

SEQ ID NO: 8360600 - DNA, 22 bp, Homo sapiens
atattaaatggattttgggagc

SEQ ID NO: 8360601 - DNA, 22 bp, Homo sapiens
atattaaatggattttgggagc

SEQ ID NO: 8360602 - DNA, 22 bp, Homo sapiens
atattaaaactatggttttcag

SEQ ID NO: 8360603 - DNA, 21 bp, Homo sapiens
agaaactgactcctagaggca

SEQ ID NO: 8360604 - DNA, 20 bp, Homo sapiens
agaaacatttcttgagaact

SEQ ID NO: 8360605 - DNA, 20 bp, Homo sapiens
agaaacatttcttgagaact

SEQ ID NO: 8360606 - DNA, 22 bp, Homo sapiens
atatagttgggtttcattctac

SEQ ID NO: 8360607 - DNA, 17 bp, Homo sapiens
agaaactgaggctcagt

SEQ ID NO: 8360608 - DNA, 20 bp, Homo sapiens
agaaacatttcttgagaact

SEQ ID NO: 8360609 - DNA, 17 bp, Homo sapiens
agaaactgaggctcagt

SEQ ID NO: 8360610 - DNA, 22 bp, Homo sapiens
agaaagaacgcacttgtgctgc

SEQ ID NO: 8360611 - DNA, 22 bp, Homo sapiens
agaaacttcagctattcttttg

SEQ ID NO: 8360612 - DNA, 22 bp, Homo sapiens
ataaggaacctgggcttaagag

SEQ ID NO: 8360613 - DNA, 22 bp, Homo sapiens
ataaggaaaattggagaaattg

SEQ ID NO: 8360614 - DNA, 22 bp, Homo sapiens
ataaggaaaattggagaaattg

SEQ ID NO: 8360615 - DNA, 22 bp, Homo sapiens
ataaggaatgatgtatcagttt

SEQ ID NO: 8360616 - DNA, 22 bp, Homo sapiens
ataaggacacccttctctttac

SEQ ID NO: 8360617 - DNA, 22 bp, Homo sapiens
ataaggaagttgcagaagtgga

SEQ ID NO: 8360618 - DNA, 22 bp, Homo sapiens
ataaggtaagggtattgtcaga

SEQ ID NO: 8360619 - DNA, 22 bp, Homo sapiens
atacaagttgtgataatgtaaa

SEQ ID NO: 8360620 - DNA, 22 bp, Homo sapiens
atacaagttgtgataatgtaaa

SEQ ID NO: 8360621 - DNA, 22 bp, Homo sapiens
atacaatctagtctgtcagcaa

SEQ ID NO: 8360622 - DNA, 22 bp, Homo sapiens
atacaatagtgtttgttttgag

SEQ ID NO: 8360623 - DNA, 22 bp, Homo sapiens
atacaatccagccattgccaca

SEQ ID NO: 8360624 - DNA, 20 bp, Homo sapiens
atacaatcatgaggaaaaag

SEQ ID NO: 8360625 - DNA, 22 bp, Homo sapiens
atacacatttgctagagatggg

SEQ ID NO: 8360626 - DNA, 22 bp, Homo sapiens
ataacagactgatttttaaatg

SEQ ID NO: 8360627 - DNA, 22 bp, Homo sapiens
ataacactaaatgtatgtaaca

SEQ ID NO: 8360628 - DNA, 22 bp, Homo sapiens
ataacactaaatgtatgtaaca

SEQ ID NO: 8360629 - DNA, 22 bp, Homo sapiens
ataaatttataattgtttcctg

SEQ ID NO: 8360630 - DNA, 22 bp, Homo sapiens
ataaattttcttgctgtactta

SEQ ID NO: 8360631 - DNA, 22 bp, Homo sapiens
ataaattgtgcttttgacatct

SEQ ID NO: 8360632 - DNA, 22 bp, Homo sapiens
ataaattctctgatgtatagta

SEQ ID NO: 8360633 - DNA, 19 bp, Homo sapiens
ataaataaaaagtgggaga

SEQ ID NO: 8360634 - DNA, 22 bp, Homo sapiens
agttcttttgtgaacatatgct

SEQ ID NO: 8360635 - DNA, 22 bp, Homo sapiens
agttctttgtcatctctggagt

SEQ ID NO: 8360636 - DNA, 22 bp, Homo sapiens
agttcacagcaaagtggggacc

SEQ ID NO: 8360637 - DNA, 22 bp, Homo sapiens
agttcacaatagaagaggtggc

SEQ ID NO: 8360638 - DNA, 22 bp, Homo sapiens
agttcagtagtccttcattgta

SEQ ID NO: 8360639 - DNA, 20 bp, Homo sapiens
ataggaaagggaggggcttt

SEQ ID NO: 8360640 - DNA, 22 bp, Homo sapiens
atagctttcttaaatatataaa

SEQ ID NO: 8360641 - DNA, 22 bp, Homo sapiens
atagtgtgttagtgacataggc

SEQ ID NO: 8360642 - DNA, 22 bp, Homo sapiens
atagtgttagagccagtatgtt

SEQ ID NO: 8360643 - DNA, 22 bp, Homo sapiens
atagtgttgatagcagtggagt

SEQ ID NO: 8360644 - DNA, 22 bp, Homo sapiens
atagtgttgatagcagtggagt

SEQ ID NO: 8360645 - DNA, 22 bp, Homo sapiens
atagttcctactttgcactaat

SEQ ID NO: 8360646 - DNA, 22 bp, Homo sapiens
atagttcactaatagcaaaagc

SEQ ID NO: 8360647 - DNA, 22 bp, Homo sapiens
atagttctggatgtacttatag

SEQ ID NO: 8360648 - DNA, 22 bp, Homo sapiens
agaaaactgggaggagagcttc

SEQ ID NO: 8360649 - DNA, 22 bp, Homo sapiens
agaaaacttgtcacagctctca

SEQ ID NO: 8360650 - DNA, 17 bp, Homo sapiens
agaaaagagaccagcag

SEQ ID NO: 8360651 - DNA, 23 bp, Homo sapiens
agaaaagcttggacacatggcct

SEQ ID NO: 8360652 - DNA, 22 bp, Homo sapiens
agaaaaggattgatggatcaga

SEQ ID NO: 8360653 - DNA, 17 bp, Homo sapiens
agaaaagagaccagcag

SEQ ID NO: 8360654 - DNA, 22 bp, Homo sapiens
agaaaagaggctttctaagcat

SEQ ID NO: 8360655 - DNA, 23 bp, Homo sapiens
agaaaagcttggacacatggcct

SEQ ID NO: 8360656 - DNA, 22 bp, Homo sapiens
agaaaagcggtcaggaccctca

SEQ ID NO: 8360657 - DNA, 22 bp, Homo sapiens
agaaaagaggctttctaagcat

SEQ ID NO: 8360658 - DNA, 22 bp, Homo sapiens
atagaaatgtattttggactag

SEQ ID NO: 8360659 - DNA, 22 bp, Homo sapiens
atactgtttctcttctacatga

SEQ ID NO: 8360660 - DNA, 22 bp, Homo sapiens
atactgttggctttggtgatgg

SEQ ID NO: 8360661 - DNA, 22 bp, Homo sapiens
atacactggtttatgatattgt

SEQ ID NO: 8360662 - DNA, 22 bp, Homo sapiens
atacactggacatcattgcatt

SEQ ID NO: 8360663 - DNA, 20 bp, Homo sapiens
actttacagagaagactgac

SEQ ID NO: 8360664 - DNA, 22 bp, Homo sapiens
actttactacatccacagatgg

SEQ ID NO: 8360665 - DNA, 22 bp, Homo sapiens
actttagatattcctctgtaca

SEQ ID NO: 8360666 - DNA, 22 bp, Homo sapiens
actttagaaaagcatccataga

SEQ ID NO: 8360667 - DNA, 22 bp, Homo sapiens
agtgcaaactttattgtgacct

SEQ ID NO: 8360668 - DNA, 22 bp, Homo sapiens
agtccttgaatgttttgaaatc

SEQ ID NO: 8360669 - DNA, 21 bp, Homo sapiens
agtccttgaaactctttcttg

SEQ ID NO: 8360670 - DNA, 22 bp, Homo sapiens
agtgaatgtccccgcgggtcag

SEQ ID NO: 8360671 - DNA, 22 bp, Homo sapiens
agtgagacagtatactgagcag

SEQ ID NO: 8360672 - DNA, 17 bp, Homo sapiens
agtgagaatgtcatgta

SEQ ID NO: 8360673 - DNA, 22 bp, Homo sapiens
agtgagagtattaatgtgaact

SEQ ID NO: 8360674 - DNA, 20 bp, Homo sapiens
agtgaggcagttcagtgggc

SEQ ID NO: 8360675 - DNA, 22 bp, Homo sapiens
agtgaggcaaagtgagaggcag

SEQ ID NO: 8360676 - DNA, 22 bp, Homo sapiens
agtgaggcaaagtgagaggcag

SEQ ID NO: 8360677 - DNA, 19 bp, Homo sapiens
agtgagcatccagagaggt

SEQ ID NO: 8360678 - DNA, 22 bp, Homo sapiens
agtgagcatcttcaggagccaa

SEQ ID NO: 8360679 - DNA, 22 bp, Homo sapiens
agtgcttctggtgggcgtgagg

SEQ ID NO: 8360680 - DNA, 22 bp, Homo sapiens
agtggcagacacaatgtgggca

SEQ ID NO: 8360681 - DNA, 22 bp, Homo sapiens
agtggcagagcaggtgctggaa

SEQ ID NO: 8360682 - DNA, 22 bp, Homo sapiens
agtggcagacagagacagtacc

SEQ ID NO: 8360683 - DNA, 22 bp, Homo sapiens
agtggcagagccagggttggga

SEQ ID NO: 8360684 - DNA, 22 bp, Homo sapiens
agtggcagagccaagatatgat

SEQ ID NO: 8360685 - DNA, 22 bp, Homo sapiens
agtggcagagccaagtagagcc

SEQ ID NO: 8360686 - DNA, 22 bp, Homo sapiens
agtgggagccagcagcttgggg

SEQ ID NO: 8360687 - DNA, 22 bp, Homo sapiens
agtgtcttagtccatttgggct

SEQ ID NO: 8360688 - DNA, 22 bp, Homo sapiens
agtgtctttatagactgacaat

SEQ ID NO: 8360689 - DNA, 22 bp, Homo sapiens
agtgtctttcatatcctccatc

SEQ ID NO: 8360690 - DNA, 22 bp, Homo sapiens
agtgtcttacatgaattgattt

SEQ ID NO: 8360691 - DNA, 22 bp, Homo sapiens
agtgtctgttgttcagaactct

SEQ ID NO: 8360692 - DNA, 22 bp, Homo sapiens
agtgtctgttgagtttcaaaag

SEQ ID NO: 8360693 - DNA, 23 bp, Homo sapiens
actgggctgaaattaaaggtgtc

SEQ ID NO: 8360694 - DNA, 20 bp, Homo sapiens
agtgtctggtgcagggcctc

SEQ ID NO: 8360695 - DNA, 22 bp, Homo sapiens
agtgtctgaaccaccggggcat

SEQ ID NO: 8360696 - DNA, 22 bp, Homo sapiens
agtgtctgttacgcttgcagaa

SEQ ID NO: 8360697 - DNA, 22 bp, Homo sapiens
agtgtctgttgagtttcaaaag

SEQ ID NO: 8360698 - DNA, 22 bp, Homo sapiens
agtgtctgtgatgaggtcagga

SEQ ID NO: 8360699 - DNA, 22 bp, Homo sapiens
actggtttcctagaataagact

SEQ ID NO: 8360700 - DNA, 22 bp, Homo sapiens
actggtttcccggaactacagt

SEQ ID NO: 8360701 - DNA, 22 bp, Homo sapiens
agttacaaacactatcagttct

SEQ ID NO: 8360702 - DNA, 22 bp, Homo sapiens
agttaatgagcattttggaatg

SEQ ID NO: 8360703 - DNA, 23 bp, Homo sapiens
agttaatgtgcatgaagtgctgc

SEQ ID NO: 8360704 - DNA, 22 bp, Homo sapiens
actggggcaggaaagtatgctg

SEQ ID NO: 8360705 - DNA, 22 bp, Homo sapiens
actggggcctcctccatgctct

SEQ ID NO: 8360706 - DNA, 22 bp, Homo sapiens
actgggtgtattagtggtgttt

SEQ ID NO: 8360707 - DNA, 19 bp, Homo sapiens
agttatttctaaatttacc

SEQ ID NO: 8360708 - DNA, 22 bp, Homo sapiens
agttattttggaaaatgagtca

SEQ ID NO: 8360709 - DNA, 19 bp, Homo sapiens
agttatttctaaatttacc

SEQ ID NO: 8360710 - DNA, 22 bp, Homo sapiens
agttcaatagaaaaatatatta

SEQ ID NO: 8360711 - DNA, 22 bp, Homo sapiens
agttcaaagtcaaggaaactgt

SEQ ID NO: 8360712 - DNA, 22 bp, Homo sapiens
agttcaaaaaggtaaagtttat

SEQ ID NO: 8360713 - DNA, 22 bp, Homo sapiens
agttcaaactctataagaactt

SEQ ID NO: 8360714 - DNA, 22 bp, Homo sapiens
actcagagtgcatctcctattt

SEQ ID NO: 8360715 - DNA, 22 bp, Homo sapiens
actcagagcttggctccttgct

SEQ ID NO: 8360716 - DNA, 22 bp, Homo sapiens
agtaaggcaatgccactaagat

SEQ ID NO: 8360717 - DNA, 22 bp, Homo sapiens
agtcagtgggcttggcacagaa

SEQ ID NO: 8360718 - DNA, 22 bp, Homo sapiens
agtaaggcatttttcatgttta

SEQ ID NO: 8360719 - DNA, 22 bp, Homo sapiens
agtcacttcctgcttgacctga

SEQ ID NO: 8360720 - DNA, 22 bp, Homo sapiens
agtcacttgattctcctgagct

SEQ ID NO: 8360721 - DNA, 21 bp, Homo sapiens
agtccaggaggaggccaggtt

SEQ ID NO: 8360722 - DNA, 21 bp, Homo sapiens
agtccaggaggaggccaggtt

SEQ ID NO: 8360723 - DNA, 21 bp, Homo sapiens
agtccaggagtcacccaagcc

SEQ ID NO: 8360724 - DNA, 22 bp, Homo sapiens
agtccaggaagcatcatggtct

SEQ ID NO: 8360725 - DNA, 22 bp, Homo sapiens
agtccaggaagcatcatggtct

SEQ ID NO: 8360726 - DNA, 22 bp, Homo sapiens
agtccagaccccggcagctggt

SEQ ID NO: 8360727 - DNA, 22 bp, Homo sapiens
actctgggcccaccctcagagt

SEQ ID NO: 8360728 - DNA, 22 bp, Homo sapiens
agtcctgggtgtgcaaggcaga

SEQ ID NO: 8360729 - DNA, 23 bp, Homo sapiens
aggttcccccgccaggaccctgc

SEQ ID NO: 8360730 - DNA, 22 bp, Homo sapiens
aggtgggttcccgactctggct

SEQ ID NO: 8360731 - DNA, 22 bp, Homo sapiens
agggtgcagtcacaggaaatgt

SEQ ID NO: 8360732 - DNA, 22 bp, Homo sapiens
agggtgagggtctggccttgag

SEQ ID NO: 8360733 - DNA, 22 bp, Homo sapiens
agggtgcaaaagcaaggacagt

SEQ ID NO: 8360734 - DNA, 21 bp, Homo sapiens
aggtgccaaggagaagcaggc

SEQ ID NO: 8360735 - DNA, 22 bp, Homo sapiens
aggtgccaattttcagtgaaca

SEQ ID NO: 8360736 - DNA, 22 bp, Homo sapiens
aggtggaaatggctttcctagg

SEQ ID NO: 8360737 - DNA, 22 bp, Homo sapiens
aggtgccagcagggttgatgac

SEQ ID NO: 8360738 - DNA, 22 bp, Homo sapiens
agggtgcagtcacaggaaatgt

SEQ ID NO: 8360739 - DNA, 22 bp, Homo sapiens
aggtgaggataggtggccaagg

SEQ ID NO: 8360740 - DNA, 22 bp, Homo sapiens
attatttctcactcacataata

SEQ ID NO: 8360741 - DNA, 22 bp, Homo sapiens
attatttctcactcacataata

SEQ ID NO: 8360742 - DNA, 22 bp, Homo sapiens
attatttctcactcacataata

SEQ ID NO: 8360743 - DNA, 22 bp, Homo sapiens
attatttggaataggcattgca

SEQ ID NO: 8360744 - DNA, 22 bp, Homo sapiens
attatttgtgtccacagaatac

SEQ ID NO: 8360745 - DNA, 22 bp, Homo sapiens
attattttatgtgcggcctgat

SEQ ID NO: 8360746 - DNA, 22 bp, Homo sapiens
agaggcctcaaaccagacctga

SEQ ID NO: 8360747 - DNA, 22 bp, Homo sapiens
agaggaagattttattaaccag

SEQ ID NO: 8360748 - DNA, 22 bp, Homo sapiens
agaggaaatggataaagggtga

SEQ ID NO: 8360749 - DNA, 22 bp, Homo sapiens
agaggaaatggataaagggtga

SEQ ID NO: 8360750 - DNA, 22 bp, Homo sapiens
agaggaacccagacagggcttt

SEQ ID NO: 8360751 - DNA, 21 bp, Homo sapiens
agaggaagaagagtgtattat

SEQ ID NO: 8360752 - DNA, 22 bp, Homo sapiens
agaggaaaatgagttccagaat

SEQ ID NO: 8360753 - DNA, 22 bp, Homo sapiens
agaggaaacataggtttttaaa

SEQ ID NO: 8360754 - DNA, 22 bp, Homo sapiens
attaataaaataccactttgtt

SEQ ID NO: 8360755 - DNA, 22 bp, Homo sapiens
agagcttcactggagagcacat

SEQ ID NO: 8360756 - DNA, 22 bp, Homo sapiens
agagctgtttgtctagagagtg

SEQ ID NO: 8360757 - DNA, 23 bp, Homo sapiens
agagctttctaaaatgtaaatct

SEQ ID NO: 8360758 - DNA, 23 bp, Homo sapiens
agagctttctaaaatgtaaatct

SEQ ID NO: 8360759 - DNA, 22 bp, Homo sapiens
agagcttttacttacattctat

SEQ ID NO: 8360760 - DNA, 22 bp, Homo sapiens
agagcttttctgtaataacatc

SEQ ID NO: 8360761 - DNA, 22 bp, Homo sapiens
attctccttattctgaaaaaag

SEQ ID NO: 8360762 - DNA, 22 bp, Homo sapiens
attctctgggttccagtaaatg

SEQ ID NO: 8360763 - DNA, 22 bp, Homo sapiens
attgaaaaatgactattgctta

SEQ ID NO: 8360764 - DNA, 22 bp, Homo sapiens
attcttctgcctactttcatcc

SEQ ID NO: 8360765 - DNA, 22 bp, Homo sapiens
attcttctgcctactttcatcc

SEQ ID NO: 8360766 - DNA, 22 bp, Homo sapiens
attcctttggactcctccttgc

SEQ ID NO: 8360767 - DNA, 22 bp, Homo sapiens
attcaaagaacctttagcattg

SEQ ID NO: 8360768 - DNA, 21 bp, Homo sapiens
attcaaagaagaggaaggccc

SEQ ID NO: 8360769 - DNA, 20 bp, Homo sapiens
attctaaagctctgctcttt

SEQ ID NO: 8360770 - DNA, 20 bp, Homo sapiens
attctaaagctctgctcttt

SEQ ID NO: 8360771 - DNA, 22 bp, Homo sapiens
attctaaagcttgtggagctta

SEQ ID NO: 8360772 - DNA, 22 bp, Homo sapiens
attctaaatgtaatttagaatt

SEQ ID NO: 8360773 - DNA, 22 bp, Homo sapiens
attctaaatcagagagctctgt

SEQ ID NO: 8360774 - DNA, 22 bp, Homo sapiens
attctacaaaagaactggatct

SEQ ID NO: 8360775 - DNA, 22 bp, Homo sapiens
attgtggctagacagtcacaat

SEQ ID NO: 8360776 - DNA, 22 bp, Homo sapiens
attgtggccacagagatccaat

SEQ ID NO: 8360777 - DNA, 22 bp, Homo sapiens
attgttaaagtaataaccatgg

SEQ ID NO: 8360778 - DNA, 22 bp, Homo sapiens
attgttaaactgaagcattact

SEQ ID NO: 8360779 - DNA, 22 bp, Homo sapiens
attgtattagcacaatacaatt

SEQ ID NO: 8360780 - DNA, 22 bp, Homo sapiens
attgtattagcacaatacaatt

SEQ ID NO: 8360781 - DNA, 22 bp, Homo sapiens
attgtatttccagcttgaatgt

SEQ ID NO: 8360782 - DNA, 22 bp, Homo sapiens
attgtgctgctgctgacgttta

SEQ ID NO: 8360783 - DNA, 22 bp, Homo sapiens
attgtgcttcctgaaatttgat

SEQ ID NO: 8360784 - DNA, 22 bp, Homo sapiens
agatacaactgtttaaacatta

SEQ ID NO: 8360785 - DNA, 22 bp, Homo sapiens
agataatttgagtaaattaatt

SEQ ID NO: 8360786 - DNA, 22 bp, Homo sapiens
agataattatttacttcaaagt

SEQ ID NO: 8360787 - DNA, 22 bp, Homo sapiens
attgttaataactattacattg

SEQ ID NO: 8360788 - DNA, 22 bp, Homo sapiens
agatacacagagcatcttcaga

SEQ ID NO: 8360789 - DNA, 22 bp, Homo sapiens
atttacagatgatgctatttga

SEQ ID NO: 8360790 - DNA, 22 bp, Homo sapiens
agatacagacctcttattaagg

SEQ ID NO: 8360791 - DNA, 22 bp, Homo sapiens
agatacacttgttccttccact

SEQ ID NO: 8360792 - DNA, 22 bp, Homo sapiens
attgagaatgcaatctactatg

SEQ ID NO: 8360793 - DNA, 22 bp, Homo sapiens
attggtctgtgagctgttgaca

SEQ ID NO: 8360794 - DNA, 22 bp, Homo sapiens
attgtatgcagcattaagcaat

SEQ ID NO: 8360795 - DNA, 22 bp, Homo sapiens
attgtataagtctatttacaat

SEQ ID NO: 8360796 - DNA, 22 bp, Homo sapiens
attgagaagaaaatctaatata

SEQ ID NO: 8360797 - DNA, 22 bp, Homo sapiens
attgagaaaggcttatgtttgc

SEQ ID NO: 8360798 - DNA, 22 bp, Homo sapiens
attgaaaatataattctaggag

SEQ ID NO: 8360799 - DNA, 22 bp, Homo sapiens
attgaaaataaggccagaaaca

SEQ ID NO: 8360800 - DNA, 22 bp, Homo sapiens
caaagttttagtaaacatatat

SEQ ID NO: 8360801 - DNA, 22 bp, Homo sapiens
agcaatgactttgaaatcatga

SEQ ID NO: 8360802 - DNA, 22 bp, Homo sapiens
agcaatgaccagtgatcttgta

SEQ ID NO: 8360803 - DNA, 22 bp, Homo sapiens
agcaatcatgacaaattatctt

SEQ ID NO: 8360804 - DNA, 22 bp, Homo sapiens
agcaatcaaataaatgtcctgg

SEQ ID NO: 8360805 - DNA, 16 bp, Homo sapiens
agcaatcagaaatatc

SEQ ID NO: 8360806 - DNA, 22 bp, Homo sapiens
caaacattgctaccagaggttt

SEQ ID NO: 8360807 - DNA, 22 bp, Homo sapiens
caaacattgcactttctgctat

SEQ ID NO: 8360808 - DNA, 22 bp, Homo sapiens
agcaatatgacattgctacatc

SEQ ID NO: 8360809 - DNA, 22 bp, Homo sapiens
agcaataagggatcctctataa

SEQ ID NO: 8360810 - DNA, 22 bp, Homo sapiens
agcaatagacacaagatggata

SEQ ID NO: 8360811 - DNA, 22 bp, Homo sapiens
agcaataatttaggcctttcct

SEQ ID NO: 8360812 - DNA, 22 bp, Homo sapiens
caaacattgggggcttcaacac

SEQ ID NO: 8360813 - DNA, 22 bp, Homo sapiens
caaacattgggggcttcaacac

SEQ ID NO: 8360814 - DNA, 22 bp, Homo sapiens
caaacatttgacttctctcagg

SEQ ID NO: 8360815 - DNA, 22 bp, Homo sapiens
caaacattgggggcttcaacac

SEQ ID NO: 8360816 - DNA, 22 bp, Homo sapiens
caaacatttgttggaacccctg

SEQ ID NO: 8360817 - DNA, 22 bp, Homo sapiens
caaacatttgttggaacccctg

SEQ ID NO: 8360818 - DNA, 22 bp, Homo sapiens
caaacattttctacttccagga

SEQ ID NO: 8360819 - DNA, 22 bp, Homo sapiens
caaacattttgagtggtttctg

SEQ ID NO: 8360820 - DNA, 22 bp, Homo sapiens
caaagggctctagactcagcag

SEQ ID NO: 8360821 - DNA, 20 bp, Homo sapiens
agcaagagtgtacctggcca

SEQ ID NO: 8360822 - DNA, 22 bp, Homo sapiens
agcaaggctcggtcagggtgat

SEQ ID NO: 8360823 - DNA, 20 bp, Homo sapiens
agcaaggctaaatcatgatt

SEQ ID NO: 8360824 - DNA, 22 bp, Homo sapiens
agcaaggctaaatttcagttat

SEQ ID NO: 8360825 - DNA, 22 bp, Homo sapiens
agcaataaccactctaatttat

SEQ ID NO: 8360826 - DNA, 22 bp, Homo sapiens
agcaaggggcagtgaaagtgtg

SEQ ID NO: 8360827 - DNA, 19 bp, Homo sapiens
agcaaggtgcctcctcccc

SEQ ID NO: 8360828 - DNA, 22 bp, Homo sapiens
agcaaggtgacatcatgctgag

SEQ ID NO: 8360829 - DNA, 22 bp, Homo sapiens
agcaaggctcttaatgcccaaa

SEQ ID NO: 8360830 - DNA, 22 bp, Homo sapiens
attttttagccaagactctgca

SEQ ID NO: 8360831 - DNA, 22 bp, Homo sapiens
attttttatataccaaggtggg

SEQ ID NO: 8360832 - DNA, 22 bp, Homo sapiens
attttttatataccaaggtggg

SEQ ID NO: 8360833 - DNA, 22 bp, Homo sapiens
attttttagccaagactctgca

SEQ ID NO: 8360834 - DNA, 22 bp, Homo sapiens
attttgttgatggtggagtagc

SEQ ID NO: 8360835 - DNA, 22 bp, Homo sapiens
attttgttgaggtaattgtcaa

SEQ ID NO: 8360836 - DNA, 22 bp, Homo sapiens
attttgttgaggtaattgtcaa

SEQ ID NO: 8360837 - DNA, 22 bp, Homo sapiens
attttgttgaggtaattgtcaa

SEQ ID NO: 8360838 - DNA, 22 bp, Homo sapiens
attttgtgggttctgctgatgt

SEQ ID NO: 8360839 - DNA, 22 bp, Homo sapiens
attttgtggcagatgcagaacc

SEQ ID NO: 8360840 - DNA, 21 bp, Homo sapiens
attttgtacatagaatttgtc

SEQ ID NO: 8360841 - DNA, 22 bp, Homo sapiens
agatgagaatttttagagtgct

SEQ ID NO: 8360842 - DNA, 23 bp, Homo sapiens
atttgaaactttcttgtttccag

SEQ ID NO: 8360843 - DNA, 19 bp, Homo sapiens
atttgaaagctgtgcttgc

SEQ ID NO: 8360844 - DNA, 22 bp, Homo sapiens
atttgaaatcccttctactgta

SEQ ID NO: 8360845 - DNA, 22 bp, Homo sapiens
atttgaaatctgggttactctg

SEQ ID NO: 8360846 - DNA, 22 bp, Homo sapiens
atttacaggacagcttggcatt

SEQ ID NO: 8360847 - DNA, 22 bp, Homo sapiens
atttacagccttgaaaacagca

SEQ ID NO: 8360848 - DNA, 22 bp, Homo sapiens
atttacagatgatgctatttga

SEQ ID NO: 8360849 - DNA, 22 bp, Homo sapiens
atttctttctggccacggtttt

SEQ ID NO: 8360850 - DNA, 22 bp, Homo sapiens
atttacaggtagaattttaagt

SEQ ID NO: 8360851 - DNA, 22 bp, Homo sapiens
agattccaggcctggggccaag

SEQ ID NO: 8360852 - DNA, 22 bp, Homo sapiens
agattgggattagagatctgta

SEQ ID NO: 8360853 - DNA, 22 bp, Homo sapiens
agattgggtttgcttctgtgcc

SEQ ID NO: 8360854 - DNA, 22 bp, Homo sapiens
agattcagttaaggctggtaga

SEQ ID NO: 8360855 - DNA, 22 bp, Homo sapiens
agatgtttataactcatgagtg

SEQ ID NO: 8360856 - DNA, 22 bp, Homo sapiens
agatgtttcagtaatttatctt

SEQ ID NO: 8360857 - DNA, 22 bp, Homo sapiens
agatgagtaggtagcattagta

SEQ ID NO: 8360858 - DNA, 22 bp, Homo sapiens
agatttcaatggatattgcaag

SEQ ID NO: 8360859 - DNA, 21 bp, Homo sapiens
attttgtacatagaatttgtc

SEQ ID NO: 8360860 - DNA, 21 bp, Homo sapiens
attttgtacatagaatttgtc

SEQ ID NO: 8360861 - DNA, 22 bp, Homo sapiens
attttgctttatgtaaatatgt

SEQ ID NO: 8360862 - DNA, 22 bp, Homo sapiens
agagagaagcaatcagtggcca

SEQ ID NO: 8360863 - DNA, 22 bp, Homo sapiens
atgtacatactgcattttcaaa

SEQ ID NO: 8360864 - DNA, 22 bp, Homo sapiens
agagactgcgtgtcagcgctgg

SEQ ID NO: 8360865 - DNA, 19 bp, Homo sapiens
agagactgccaccagctgt

SEQ ID NO: 8360866 - DNA, 22 bp, Homo sapiens
agagactggagatgggcagtgt

SEQ ID NO: 8360867 - DNA, 22 bp, Homo sapiens
agagactgtaatgagaggtaca

SEQ ID NO: 8360868 - DNA, 22 bp, Homo sapiens
agagactggagttacgagttca

SEQ ID NO: 8360869 - DNA, 22 bp, Homo sapiens
atgtatatgaagctagtatttt

SEQ ID NO: 8360870 - DNA, 18 bp, Homo sapiens
agagatgggagttggaaa

SEQ ID NO: 8360871 - DNA, 22 bp, Homo sapiens
agagatggtagaacagtcataa

SEQ ID NO: 8360872 - DNA, 22 bp, Homo sapiens
agagatggcgtctcagagcctg

SEQ ID NO: 8360873 - DNA, 17 bp, Homo sapiens
atgtatattaactctga

SEQ ID NO: 8360874 - DNA, 17 bp, Homo sapiens
atgtatattaactctga

SEQ ID NO: 8360875 - DNA, 22 bp, Homo sapiens
atggacagagctgagctccacc

SEQ ID NO: 8360876 - DNA, 22 bp, Homo sapiens
atggacagctggcctcaaggga

SEQ ID NO: 8360877 - DNA, 22 bp, Homo sapiens
atggaatttgcaataacaggat

SEQ ID NO: 8360878 - DNA, 22 bp, Homo sapiens
agagaacattagcaaaaacagc

SEQ ID NO: 8360879 - DNA, 21 bp, Homo sapiens
atgggccagggatacagagag

SEQ ID NO: 8360880 - DNA, 22 bp, Homo sapiens
atgggccacacacgattgggtg

SEQ ID NO: 8360881 - DNA, 22 bp, Homo sapiens
atgggcagttaggaggccagga

SEQ ID NO: 8360882 - DNA, 22 bp, Homo sapiens
atgggcagttaggaggccagga

SEQ ID NO: 8360883 - DNA, 22 bp, Homo sapiens
atgggcagtgtattggaaggaa

SEQ ID NO: 8360884 - DNA, 23 bp, Homo sapiens
atggacagggtttcagggtcaca

SEQ ID NO: 8360885 - DNA, 22 bp, Homo sapiens
atggacaggtactgcagtgggt

SEQ ID NO: 8360886 - DNA, 22 bp, Homo sapiens
atgggcagtaacagtggcagtc

SEQ ID NO: 8360887 - DNA, 22 bp, Homo sapiens
atgggcagtaacagtggcagtc

SEQ ID NO: 8360888 - DNA, 22 bp, Homo sapiens
attaagtgtgacatgctgctct

SEQ ID NO: 8360889 - DNA, 22 bp, Homo sapiens
attaagtgttttacatacatta

SEQ ID NO: 8360890 - DNA, 22 bp, Homo sapiens
attaaggaagcctattctctcc

SEQ ID NO: 8360891 - DNA, 18 bp, Homo sapiens
attaaggaattctttaga

SEQ ID NO: 8360892 - DNA, 22 bp, Homo sapiens
agagctcaagacgctcacagta

SEQ ID NO: 8360893 - DNA, 22 bp, Homo sapiens
attaaatactgcaggctaagca

SEQ ID NO: 8360894 - DNA, 22 bp, Homo sapiens
agagctctggcctattggggcc

SEQ ID NO: 8360895 - DNA, 22 bp, Homo sapiens
atgttctacagatggaaagggg

SEQ ID NO: 8360896 - DNA, 22 bp, Homo sapiens
atgttcctgatcctcgttctat

SEQ ID NO: 8360897 - DNA, 22 bp, Homo sapiens
atgttcctggtatatcatgacc

SEQ ID NO: 8360898 - DNA, 22 bp, Homo sapiens
atgttattttggaaaatacaaa

SEQ ID NO: 8360899 - DNA, 22 bp, Homo sapiens
atgtgcaaagggacttgcacat

SEQ ID NO: 8360900 - DNA, 22 bp, Homo sapiens
atgtgcacacagtgtcatgcaa

SEQ ID NO: 8360901 - DNA, 23 bp, Homo sapiens
atgtgcacatctccttgtccacc

SEQ ID NO: 8360902 - DNA, 22 bp, Homo sapiens
atgtgcagacctgggttagaac

SEQ ID NO: 8360903 - DNA, 21 bp, Homo sapiens
atgtgcagcaagcagcatgct

SEQ ID NO: 8360904 - DNA, 22 bp, Homo sapiens
atgtgcagcttttctagagaag

SEQ ID NO: 8360905 - DNA, 22 bp, Homo sapiens
atgtgcagttggtggccaggag

SEQ ID NO: 8360906 - DNA, 22 bp, Homo sapiens
atgtgcaggatccaggctccta

SEQ ID NO: 8360907 - DNA, 18 bp, Homo sapiens
agagatggtgtagagttt

SEQ ID NO: 8360908 - DNA, 22 bp, Homo sapiens
agagatggtagaacagtcataa

SEQ ID NO: 8360909 - DNA, 22 bp, Homo sapiens
agagatgtctgaccactagact

SEQ ID NO: 8360910 - DNA, 22 bp, Homo sapiens
atgtcttgggtttcagtttact

SEQ ID NO: 8360911 - DNA, 22 bp, Homo sapiens
agagccagcatttgggccctgc

SEQ ID NO: 8360912 - DNA, 22 bp, Homo sapiens
agagccaggaagtggcgtgggg

SEQ ID NO: 8360913 - DNA, 22 bp, Homo sapiens
agagccaggactgtgtctcact

SEQ ID NO: 8360914 - DNA, 22 bp, Homo sapiens
agagccaggactgtgtctcact

SEQ ID NO: 8360915 - DNA, 22 bp, Homo sapiens
atgttattttggaaaatacaaa

SEQ ID NO: 8360916 - DNA, 22 bp, Homo sapiens
atgttacagaaagcaaagatga

SEQ ID NO: 8360917 - DNA, 22 bp, Homo sapiens
agagccaggatgtcttctgggg

SEQ ID NO: 8360918 - DNA, 22 bp, Homo sapiens
atctggcttttaccccacggcc

SEQ ID NO: 8360919 - DNA, 22 bp, Homo sapiens
atctggctttcttaatgactta

SEQ ID NO: 8360920 - DNA, 22 bp, Homo sapiens
atctggcttgggtgtgggtagc

SEQ ID NO: 8360921 - DNA, 22 bp, Homo sapiens
atctggcttgactttgcgactt

SEQ ID NO: 8360922 - DNA, 22 bp, Homo sapiens
atctggcttacgaagcactggt

SEQ ID NO: 8360923 - DNA, 22 bp, Homo sapiens
atctggcttacgaagcactggt

SEQ ID NO: 8360924 - DNA, 22 bp, Homo sapiens
atctggctgactttgtgggaca

SEQ ID NO: 8360925 - DNA, 22 bp, Homo sapiens
atctggctgagcgaggcccaca

SEQ ID NO: 8360926 - DNA, 22 bp, Homo sapiens
atctggcttacctagggtgcct

SEQ ID NO: 8360927 - DNA, 22 bp, Homo sapiens
atctggctggattcttagcgtt

SEQ ID NO: 8360928 - DNA, 17 bp, Homo sapiens
atctggctgcttctaga

SEQ ID NO: 8360929 - DNA, 17 bp, Homo sapiens
atctggctgcttctaga

SEQ ID NO: 8360930 - DNA, 22 bp, Homo sapiens
atctggcttttactgaattgct

SEQ ID NO: 8360931 - DNA, 22 bp, Homo sapiens
atctgggccagccccaagagac

SEQ ID NO: 8360932 - DNA, 23 bp, Homo sapiens
atctgggcatctggagtggtcct

SEQ ID NO: 8360933 - DNA, 21 bp, Homo sapiens
atcttaaaaggtcttaacttt

SEQ ID NO: 8360934 - DNA, 22 bp, Homo sapiens
atcttaaacagaggaatgactt

SEQ ID NO: 8360935 - DNA, 22 bp, Homo sapiens
atcttaaacagaggaatgactt

SEQ ID NO: 8360936 - DNA, 21 bp, Homo sapiens
atcttaaaaggtcttaacttt

SEQ ID NO: 8360937 - DNA, 22 bp, Homo sapiens
atctgggctcgaatcctagctc

SEQ ID NO: 8360938 - DNA, 22 bp, Homo sapiens
atctggggccccggaagttcct

SEQ ID NO: 8360939 - DNA, 22 bp, Homo sapiens
atctggggaggtatctgtagtc

SEQ ID NO: 8360940 - DNA, 22 bp, Homo sapiens
atctgggggagctgctcatgga

SEQ ID NO: 8360941 - DNA, 18 bp, Homo sapiens
atcttaacttgatggagt

SEQ ID NO: 8360942 - DNA, 22 bp, Homo sapiens
atcttacaattacaagacactc

SEQ ID NO: 8360943 - DNA, 22 bp, Homo sapiens
atcttacacgataactgttagt

SEQ ID NO: 8360944 - DNA, 19 bp, Homo sapiens
atcttacagagcagagtac

SEQ ID NO: 8360945 - DNA, 22 bp, Homo sapiens
atcttacactgttgggtttctc

SEQ ID NO: 8360946 - DNA, 22 bp, Homo sapiens
atcttacagcagcaaggaagta

SEQ ID NO: 8360947 - DNA, 22 bp, Homo sapiens
atcttacacgataactgttagt

SEQ ID NO: 8360948 - DNA, 22 bp, Homo sapiens
atcttacattccctcaccattt

SEQ ID NO: 8360949 - DNA, 23 bp, Homo sapiens
atcttacatatttagcacctgaa

SEQ ID NO: 8360950 - DNA, 22 bp, Homo sapiens
atcttacattccctcaccattt

SEQ ID NO: 8360951 - DNA, 22 bp, Homo sapiens
atgactgattacccaagcctct

SEQ ID NO: 8360952 - DNA, 22 bp, Homo sapiens
atgactgctctgggctcccatg

SEQ ID NO: 8360953 - DNA, 22 bp, Homo sapiens
atgacctgaggccttactctag

SEQ ID NO: 8360954 - DNA, 22 bp, Homo sapiens
atgacctacaacctagcatgat

SEQ ID NO: 8360955 - DNA, 22 bp, Homo sapiens
atgatttaaagtcattgtgaac

SEQ ID NO: 8360956 - DNA, 22 bp, Homo sapiens
atgcaaatgtcaccacttctaa

SEQ ID NO: 8360957 - DNA, 22 bp, Homo sapiens
atgattctggcaaatttattat

SEQ ID NO: 8360958 - DNA, 22 bp, Homo sapiens
atgattcaggattgaaccattt

SEQ ID NO: 8360959 - DNA, 20 bp, Homo sapiens
atgattctgggctacactgg

SEQ ID NO: 8360960 - DNA, 22 bp, Homo sapiens
atgaggaggccagtaagagcct

SEQ ID NO: 8360961 - DNA, 22 bp, Homo sapiens
atgagaaagagttgtatctaga

SEQ ID NO: 8360962 - DNA, 22 bp, Homo sapiens
atgactttcctggcaaaagttg

SEQ ID NO: 8360963 - DNA, 22 bp, Homo sapiens
atgactttcctggcaaaagttg

SEQ ID NO: 8360964 - DNA, 22 bp, Homo sapiens
atgacttttaggagcagtgctc

SEQ ID NO: 8360965 - DNA, 22 bp, Homo sapiens
atgactttcctggcaaaagttg

SEQ ID NO: 8360966 - DNA, 22 bp, Homo sapiens
atgactttgttgttttccagcg

SEQ ID NO: 8360967 - DNA, 22 bp, Homo sapiens
atgaggcaaaggtggaggtggg

SEQ ID NO: 8360968 - DNA, 22 bp, Homo sapiens
atgaggcaaggctggccgtgtt

SEQ ID NO: 8360969 - DNA, 22 bp, Homo sapiens
atgaggcaaggctggccgtgtt

SEQ ID NO: 8360970 - DNA, 22 bp, Homo sapiens
atgccatttcaaaataagattt

SEQ ID NO: 8360971 - DNA, 22 bp, Homo sapiens
atgccatttcaaaataagattt

SEQ ID NO: 8360972 - DNA, 22 bp, Homo sapiens
atgccatttgcatcagcggttt

SEQ ID NO: 8360973 - DNA, 22 bp, Homo sapiens
atgccatctgaaatctgtcata

SEQ ID NO: 8360974 - DNA, 23 bp, Homo sapiens
agacagtggccgagaggtactag

SEQ ID NO: 8360975 - DNA, 22 bp, Homo sapiens
atgccaggtacaggggtagggt

SEQ ID NO: 8360976 - DNA, 22 bp, Homo sapiens
atgccagtaagtctcagctagg

SEQ ID NO: 8360977 - DNA, 22 bp, Homo sapiens
atgccagggtcccttcagagat

SEQ ID NO: 8360978 - DNA, 22 bp, Homo sapiens
atgccagggtcacagtcatatt

SEQ ID NO: 8360979 - DNA, 22 bp, Homo sapiens
agacataaacttactgaaatac

SEQ ID NO: 8360980 - DNA, 20 bp, Homo sapiens
agacagtgtggagattcctt

SEQ ID NO: 8360981 - DNA, 22 bp, Homo sapiens
agacagtgtggttggtggttcc

SEQ ID NO: 8360982 - DNA, 20 bp, Homo sapiens
agacagtggggagctcctag

SEQ ID NO: 8360983 - DNA, 22 bp, Homo sapiens
agacataagtgctatgacattg

SEQ ID NO: 8360984 - DNA, 22 bp, Homo sapiens
atgccacttctctaagtcatgt

SEQ ID NO: 8360985 - DNA, 22 bp, Homo sapiens
atgccaggaacaaacagtggtg

SEQ ID NO: 8360986 - DNA, 22 bp, Homo sapiens
atgcaacacccctatggatgga

SEQ ID NO: 8360987 - DNA, 19 bp, Homo sapiens
atgcaacaaaagtgtaaga

SEQ ID NO: 8360988 - DNA, 22 bp, Homo sapiens
atgcaacaaattgtgtgcaata

SEQ ID NO: 8360989 - DNA, 22 bp, Homo sapiens
atgcttccaacagttctgtgaa

SEQ ID NO: 8360990 - DNA, 22 bp, Homo sapiens
atgcttccactgttctgctctc

SEQ ID NO: 8360991 - DNA, 23 bp, Homo sapiens
atgcttccacagagcttgcagcc

SEQ ID NO: 8360992 - DNA, 22 bp, Homo sapiens
atgcttccaatattctcccttt

SEQ ID NO: 8360993 - DNA, 22 bp, Homo sapiens
atgcttccctttgctccacatg

SEQ ID NO: 8360994 - DNA, 22 bp, Homo sapiens
atgcttccatgaacgttcttgt

SEQ ID NO: 8360995 - DNA, 22 bp, Homo sapiens
atgcttccctcacatatcctgg

SEQ ID NO: 8360996 - DNA, 22 bp, Homo sapiens
atgcttcccctctcatttcagc

SEQ ID NO: 8360997 - DNA, 22 bp, Homo sapiens
atgcttctgctcatatttcatt

SEQ ID NO: 8360998 - DNA, 22 bp, Homo sapiens
atgcttctgctcatatttcatt

SEQ ID NO: 8360999 - DNA, 22 bp, Homo sapiens
atgcttctgaagaagaaaagac

SEQ ID NO: 8361000 - DNA, 18 bp, Homo sapiens
atgcttctgatagaagca

SEQ ID NO: 8361001 - DNA, 18 bp, Homo sapiens
atgcttctgatagaagca

SEQ ID NO: 8361002 - DNA, 22 bp, Homo sapiens
atgcttctgaagaagaaaagac

SEQ ID NO: 8361003 - DNA, 22 bp, Homo sapiens
atgcttcctctacggcctctga

SEQ ID NO: 8361004 - DNA, 22 bp, Homo sapiens
atgcttccttaccagaagatga

SEQ ID NO: 8361005 - DNA, 22 bp, Homo sapiens
atgcttcctcccttccactcaa

SEQ ID NO: 8361006 - DNA, 22 bp, Homo sapiens
atgcttctgaagaagaaaagac

SEQ ID NO: 8361007 - DNA, 22 bp, Homo sapiens
atgcttctcctgaacatccctg

SEQ ID NO: 8361008 - DNA, 22 bp, Homo sapiens
atgcttctcctgaacatccctg

SEQ ID NO: 8361009 - DNA, 22 bp, Homo sapiens
atgcttcctttttcccttaagg

SEQ ID NO: 8361010 - DNA, 22 bp, Homo sapiens
atgcttctcagctcaaggcaaa

SEQ ID NO: 8361011 - DNA, 22 bp, Homo sapiens
agagaacacgtgcatctgcaat

SEQ ID NO: 8361012 - DNA, 22 bp, Homo sapiens
agagaaacaggtcagctgggag

SEQ ID NO: 8361013 - DNA, 22 bp, Homo sapiens
agagaacagcattgcagctttg

SEQ ID NO: 8361014 - DNA, 22 bp, Homo sapiens
atgcttctgtaatgtgggaatg

SEQ ID NO: 8361015 - DNA, 22 bp, Homo sapiens
atgcttctggtataagaaaaat

SEQ ID NO: 8361016 - DNA, 22 bp, Homo sapiens
atgcttctggtataagaaaaat

SEQ ID NO: 8361017 - DNA, 22 bp, Homo sapiens
atgcttctgttgcttaggaggt

SEQ ID NO: 8361018 - DNA, 22 bp, Homo sapiens
atgcttctgtgtatgtttcagg

SEQ ID NO: 8361019 - DNA, 22 bp, Homo sapiens
atgcttctggtataagaaaaat

SEQ ID NO: 8361020 - DNA, 22 bp, Homo sapiens
atgcttctgttgcttaggaggt

SEQ ID NO: 8361021 - DNA, 22 bp, Homo sapiens
atgcttcttgagatagaaacac

SEQ ID NO: 8361022 - DNA, 22 bp, Homo sapiens
atgcttcttgagatagaaacac

SEQ ID NO: 8361023 - DNA, 22 bp, Homo sapiens
atgctaaaaacttgatcattat

SEQ ID NO: 8361024 - DNA, 22 bp, Homo sapiens
cagccatgagtctaagcagttt

SEQ ID NO: 8361025 - DNA, 22 bp, Homo sapiens
cagcccacctggcacgtgtgtt

SEQ ID NO: 8361026 - DNA, 22 bp, Homo sapiens
cagccagtggttgaagatgcag

SEQ ID NO: 8361027 - DNA, 22 bp, Homo sapiens
cagccagtgtgaccgaggagga

SEQ ID NO: 8361028 - DNA, 21 bp, Homo sapiens
cagcccagagcagtggggcca

SEQ ID NO: 8361029 - DNA, 19 bp, Homo sapiens
cagcccagggtgctaccaa

SEQ ID NO: 8361030 - DNA, 22 bp, Homo sapiens
cagcccagacaccatcattcta

SEQ ID NO: 8361031 - DNA, 22 bp, Homo sapiens
cagcccacttcccagcacctac

SEQ ID NO: 8361032 - DNA, 22 bp, Homo sapiens
cagcccagaactcacgtctcca

SEQ ID NO: 8361033 - DNA, 22 bp, Homo sapiens
cagccctggtgaggttggctat

SEQ ID NO: 8361034 - DNA, 22 bp, Homo sapiens
cagcctctctgtatctcaggat

SEQ ID NO: 8361035 - DNA, 22 bp, Homo sapiens
cagcccaggtggcggaggttgc

SEQ ID NO: 8361036 - DNA, 22 bp, Homo sapiens
cagcccaggtctctcttccagt

SEQ ID NO: 8361037 - DNA, 22 bp, Homo sapiens
cagcacttggtgccattgagtg

SEQ ID NO: 8361038 - DNA, 22 bp, Homo sapiens
cagcacttggtgccattgagtg

SEQ ID NO: 8361039 - DNA, 22 bp, Homo sapiens
cagcactttgagggctcttaat

SEQ ID NO: 8361040 - DNA, 22 bp, Homo sapiens
cagcactggggggattcggagc

SEQ ID NO: 8361041 - DNA, 22 bp, Homo sapiens
cagcactgtgataactgagcca

SEQ ID NO: 8361042 - DNA, 22 bp, Homo sapiens
cagcactggggccactggagtt

SEQ ID NO: 8361043 - DNA, 22 bp, Homo sapiens
cagcatggagacaaagtgggca

SEQ ID NO: 8361044 - DNA, 22 bp, Homo sapiens
cagcatggagacaaagtgggca

SEQ ID NO: 8361045 - DNA, 22 bp, Homo sapiens
cagcatggacaggggtggcgtt

SEQ ID NO: 8361046 - DNA, 22 bp, Homo sapiens
cagcagaaaatgtgggtgattt

SEQ ID NO: 8361047 - DNA, 22 bp, Homo sapiens
cagcatggttgggttctgggga

SEQ ID NO: 8361048 - DNA, 22 bp, Homo sapiens
cagcatgtatctttcaggtgtg

SEQ ID NO: 8361049 - DNA, 22 bp, Homo sapiens
cagcatggggcttggagtcagc

SEQ ID NO: 8361050 - DNA, 22 bp, Homo sapiens
cagcatggggcttggagtcagc

SEQ ID NO: 8361051 - DNA, 22 bp, Homo sapiens
cagcatgggttccgggggcctg

SEQ ID NO: 8361052 - DNA, 22 bp, Homo sapiens
agcgccactgcactccagcctg

SEQ ID NO: 8361053 - DNA, 22 bp, Homo sapiens
agcgcaggaacacgtctgcctt

SEQ ID NO: 8361054 - DNA, 22 bp, Homo sapiens
agcgaggtgagtcctccagctc

SEQ ID NO: 8361055 - DNA, 22 bp, Homo sapiens
agcgagtgggtcagcgttgcag

SEQ ID NO: 8361056 - DNA, 22 bp, Homo sapiens
agctgagccagcagcaacagga

SEQ ID NO: 8361057 - DNA, 22 bp, Homo sapiens
agctgaggacgtgaagggcggc

SEQ ID NO: 8361058 - DNA, 22 bp, Homo sapiens
agctgaggaggaatgatgggta

SEQ ID NO: 8361059 - DNA, 17 bp, Homo sapiens
agctgagctggccaggg

SEQ ID NO: 8361060 - DNA, 22 bp, Homo sapiens
cagctggactgggatgtagcga

SEQ ID NO: 8361061 - DNA, 22 bp, Homo sapiens
cagctgctttcagcaggaggga

SEQ ID NO: 8361062 - DNA, 22 bp, Homo sapiens
cagctgggtgatcttgggcagg

SEQ ID NO: 8361063 - DNA, 22 bp, Homo sapiens
cagctggcagccctggccctgc

SEQ ID NO: 8361064 - DNA, 22 bp, Homo sapiens
cagctggcagccctggccctgc

SEQ ID NO: 8361065 - DNA, 22 bp, Homo sapiens
cagctggcaagtggagcagggt

SEQ ID NO: 8361066 - DNA, 22 bp, Homo sapiens
cagctggcaagtggagcagggt

SEQ ID NO: 8361067 - DNA, 22 bp, Homo sapiens
cagctggcaagtggagcagggt

SEQ ID NO: 8361068 - DNA, 21 bp, Homo sapiens
agctctggagcagcaatcaag

SEQ ID NO: 8361069 - DNA, 22 bp, Homo sapiens
cagctgccccataaatcacagt

SEQ ID NO: 8361070 - DNA, 18 bp, Homo sapiens
cagctgccagctcatgga

SEQ ID NO: 8361071 - DNA, 22 bp, Homo sapiens
cagctgcccaggccacctggag

SEQ ID NO: 8361072 - DNA, 22 bp, Homo sapiens
cagctgcccaagccccagatgt

SEQ ID NO: 8361073 - DNA, 22 bp, Homo sapiens
cagctgccagcttctctccatc

SEQ ID NO: 8361074 - DNA, 22 bp, Homo sapiens
cagcctcttgcactttgaaggc

SEQ ID NO: 8361075 - DNA, 22 bp, Homo sapiens
cagcctcttgcactttgaaggc

SEQ ID NO: 8361076 - DNA, 22 bp, Homo sapiens
cagccttgatggatgaggaagt

SEQ ID NO: 8361077 - DNA, 22 bp, Homo sapiens
cagccttgatggatgaggaagt

SEQ ID NO: 8361078 - DNA, 22 bp, Homo sapiens
cagcctttatggaaaggcctgg

SEQ ID NO: 8361079 - DNA, 22 bp, Homo sapiens
cagcctttctgtttcctaaggt

SEQ ID NO: 8361080 - DNA, 22 bp, Homo sapiens
cagcctctgagccttggcagat

SEQ ID NO: 8361081 - DNA, 18 bp, Homo sapiens
cagcctctgattggttgc

SEQ ID NO: 8361082 - DNA, 22 bp, Homo sapiens
cagcctctgagccttggcagat

SEQ ID NO: 8361083 - DNA, 22 bp, Homo sapiens
cagcctctgacaccacagtcgt

SEQ ID NO: 8361084 - DNA, 22 bp, Homo sapiens
cagcctctgacaccacagtcgt

SEQ ID NO: 8361085 - DNA, 22 bp, Homo sapiens
cagcgtctcgttgtgggcctcg

SEQ ID NO: 8361086 - DNA, 22 bp, Homo sapiens
cagcgctgtgggaacagggcta

SEQ ID NO: 8361087 - DNA, 22 bp, Homo sapiens
cagcgctggggtaggagcacct

SEQ ID NO: 8361088 - DNA, 22 bp, Homo sapiens
cagcctttgggtcagaagattc

SEQ ID NO: 8361089 - DNA, 22 bp, Homo sapiens
cagcgcaggcgtgtgaaggcgc

SEQ ID NO: 8361090 - DNA, 22 bp, Homo sapiens
cagagcagtagaaaacagcctt

SEQ ID NO: 8361091 - DNA, 22 bp, Homo sapiens
cagagcagtagaaaacagcctt

SEQ ID NO: 8361092 - DNA, 22 bp, Homo sapiens
cagagcagtaaatctggggcac

SEQ ID NO: 8361093 - DNA, 22 bp, Homo sapiens
cagagcagtccttgtcaatcag

SEQ ID NO: 8361094 - DNA, 22 bp, Homo sapiens
cagagcagtccttgtcaatcag

SEQ ID NO: 8361095 - DNA, 18 bp, Homo sapiens
cagagcagtatgaatgtt

SEQ ID NO: 8361096 - DNA, 18 bp, Homo sapiens
cagagcagtatgaatgtt

SEQ ID NO: 8361097 - DNA, 18 bp, Homo sapiens
cagagcagtatgaatgtt

SEQ ID NO: 8361098 - DNA, 22 bp, Homo sapiens
cagagcagtagaaaacagcctt

SEQ ID NO: 8361099 - DNA, 18 bp, Homo sapiens
cagagcagtatgaatgtt

SEQ ID NO: 8361100 - DNA, 22 bp, Homo sapiens
cagagccaggtcttgaactcag

SEQ ID NO: 8361101 - DNA, 22 bp, Homo sapiens
cagagccaggtctaggagtctc

SEQ ID NO: 8361102 - DNA, 22 bp, Homo sapiens
cagagcagtctggagatccagc

SEQ ID NO: 8361103 - DNA, 22 bp, Homo sapiens
cagagccatcatgatatggagt

SEQ ID NO: 8361104 - DNA, 22 bp, Homo sapiens
cagagccataaaggtgaaagag

SEQ ID NO: 8361105 - DNA, 22 bp, Homo sapiens
cagagccataaaggtgaaagag

SEQ ID NO: 8361106 - DNA, 22 bp, Homo sapiens
cagagctgtcatttgccagtga

SEQ ID NO: 8361107 - DNA, 22 bp, Homo sapiens
cagagctgtgataaatagatat

SEQ ID NO: 8361108 - DNA, 22 bp, Homo sapiens
cagagctgttgcggggcttggc

SEQ ID NO: 8361109 - DNA, 22 bp, Homo sapiens
cagagctgttactattcatgaa

SEQ ID NO: 8361110 - DNA, 22 bp, Homo sapiens
agccagggatggcagtgcccag

SEQ ID NO: 8361111 - DNA, 22 bp, Homo sapiens
agccagggctctccttcgcgtg

SEQ ID NO: 8361112 - DNA, 23 bp, Homo sapiens
agccagggcactggtggagattg

SEQ ID NO: 8361113 - DNA, 22 bp, Homo sapiens
agccagggatgcagcacagtga

SEQ ID NO: 8361114 - DNA, 22 bp, Homo sapiens
cagagcaccagtgggagacaag

SEQ ID NO: 8361115 - DNA, 22 bp, Homo sapiens
cagagcacccaaggagcatttg

SEQ ID NO: 8361116 - DNA, 22 bp, Homo sapiens
cagagcaccagtgggagacaag

SEQ ID NO: 8361117 - DNA, 22 bp, Homo sapiens
cagagcaggggtttcccaggtt

SEQ ID NO: 8361118 - DNA, 22 bp, Homo sapiens
agccaggggagtcagctgctgg

SEQ ID NO: 8361119 - DNA, 22 bp, Homo sapiens
agccagggctgcgagcagacag

SEQ ID NO: 8361120 - DNA, 22 bp, Homo sapiens
agccagggacgctgcaggctac

SEQ ID NO: 8361121 - DNA, 22 bp, Homo sapiens
agccagggacgctgcaggctac

SEQ ID NO: 8361122 - DNA, 22 bp, Homo sapiens
agccagggaagaggcctacctc

SEQ ID NO: 8361123 - DNA, 22 bp, Homo sapiens
agccaggccttttctcaaggtt

SEQ ID NO: 8361124 - DNA, 22 bp, Homo sapiens
agccaggccttttctcaaggtt

SEQ ID NO: 8361125 - DNA, 18 bp, Homo sapiens
cagaggagagacattcag

SEQ ID NO: 8361126 - DNA, 18 bp, Homo sapiens
cagaggagagacattcag

SEQ ID NO: 8361127 - DNA, 17 bp, Homo sapiens
cagaggagctttggggg

SEQ ID NO: 8361128 - DNA, 22 bp, Homo sapiens
cagaggaggccaccgcataggc

SEQ ID NO: 8361129 - DNA, 22 bp, Homo sapiens
cagaggaggccaccgcataggc

SEQ ID NO: 8361130 - DNA, 21 bp, Homo sapiens
cagaggtggcctgacctctga

SEQ ID NO: 8361131 - DNA, 22 bp, Homo sapiens
cagaggtgctggagtgagtcct

SEQ ID NO: 8361132 - DNA, 22 bp, Homo sapiens
cagaggagttcagtacacagcc

SEQ ID NO: 8361133 - DNA, 22 bp, Homo sapiens
agccctcctggggccacgctgg

SEQ ID NO: 8361134 - DNA, 22 bp, Homo sapiens
agccctcctttgttcatgctgc

SEQ ID NO: 8361135 - DNA, 22 bp, Homo sapiens
agcctgcttgagagtcctggct

SEQ ID NO: 8361136 - DNA, 22 bp, Homo sapiens
agcctgagtgcttaggactgtt

SEQ ID NO: 8361137 - DNA, 22 bp, Homo sapiens
agcctgcttggcagccctccca

SEQ ID NO: 8361138 - DNA, 22 bp, Homo sapiens
cagatctctgtgtagttcagtc

SEQ ID NO: 8361139 - DNA, 22 bp, Homo sapiens
agcctggacagctacggagaac

SEQ ID NO: 8361140 - DNA, 22 bp, Homo sapiens
agcctggaggccaggagacagt

SEQ ID NO: 8361141 - DNA, 22 bp, Homo sapiens
cagcactgctgctgtacacaca

SEQ ID NO: 8361142 - DNA, 22 bp, Homo sapiens
cagcactgcttcgcagccaggg

SEQ ID NO: 8361143 - DNA, 22 bp, Homo sapiens
agcccttagtacatttctcaag

SEQ ID NO: 8361144 - DNA, 22 bp, Homo sapiens
agcctattccaggatgagctca

SEQ ID NO: 8361145 - DNA, 22 bp, Homo sapiens
agcctattccaggatgagctca

SEQ ID NO: 8361146 - DNA, 22 bp, Homo sapiens
cagatcctttatagcagtgtcc

SEQ ID NO: 8361147 - DNA, 22 bp, Homo sapiens
cagatcatgggactgtctcagc

SEQ ID NO: 8361148 - DNA, 22 bp, Homo sapiens
caagctttccattacacacatt

SEQ ID NO: 8361149 - DNA, 22 bp, Homo sapiens
caaggaaaaagcgagctcgggg

SEQ ID NO: 8361150 - DNA, 22 bp, Homo sapiens
caagctttatccgccatgtagg

SEQ ID NO: 8361151 - DNA, 22 bp, Homo sapiens
caaggaaaagaagtatttcaga

SEQ ID NO: 8361152 - DNA, 22 bp, Homo sapiens
caaggaaacatgaaatgcattg

SEQ ID NO: 8361153 - DNA, 22 bp, Homo sapiens
caaggaaaagaagtatttcaga

SEQ ID NO: 8361154 - DNA, 22 bp, Homo sapiens
caaggaaaacagatgatcaaca

SEQ ID NO: 8361155 - DNA, 22 bp, Homo sapiens
caagcagaggtttatgtattag

SEQ ID NO: 8361156 - DNA, 22 bp, Homo sapiens
agcaattattgtataagaacaa

SEQ ID NO: 8361157 - DNA, 22 bp, Homo sapiens
agcagagaagacacaggcttca

SEQ ID NO: 8361158 - DNA, 22 bp, Homo sapiens
agcagacatggcttggatgtgg

SEQ ID NO: 8361159 - DNA, 22 bp, Homo sapiens
agcagacatggcttggatgtgg

SEQ ID NO: 8361160 - DNA, 22 bp, Homo sapiens
agcagagaccatatagcccaga

SEQ ID NO: 8361161 - DNA, 22 bp, Homo sapiens
agcagagacatgaaatatgctt

SEQ ID NO: 8361162 - DNA, 22 bp, Homo sapiens
agcagagaccatatagcccaga

SEQ ID NO: 8361163 - DNA, 22 bp, Homo sapiens
caagggaaggctaagggcaaca

SEQ ID NO: 8361164 - DNA, 22 bp, Homo sapiens
agcagacatatctcatgtcaca

SEQ ID NO: 8361165 - DNA, 21 bp, Homo sapiens
agcagacagcccaagaaaatc

SEQ ID NO: 8361166 - DNA, 22 bp, Homo sapiens
agcagacaggtaggaggataaa

SEQ ID NO: 8361167 - DNA, 22 bp, Homo sapiens
agcagacaggctgccacagtgc

SEQ ID NO: 8361168 - DNA, 22 bp, Homo sapiens
caaggaaacatgaaatgcattg

SEQ ID NO: 8361169 - DNA, 21 bp, Homo sapiens
agcagacagatgcacgcacac

SEQ ID NO: 8361170 - DNA, 21 bp, Homo sapiens
agcagacacttgtgaccttcc

SEQ ID NO: 8361171 - DNA, 22 bp, Homo sapiens
caattattcagtgacttaagag

SEQ ID NO: 8361172 - DNA, 22 bp, Homo sapiens
caagggcagatagctggtccaa

SEQ ID NO: 8361173 - DNA, 22 bp, Homo sapiens
caagggaattgtgtgtgagagg

SEQ ID NO: 8361174 - DNA, 22 bp, Homo sapiens
caagtccaagatcaagaagcca

SEQ ID NO: 8361175 - DNA, 22 bp, Homo sapiens
caagtccatcctactgccttct

SEQ ID NO: 8361176 - DNA, 22 bp, Homo sapiens
caagggctgctatcagctactg

SEQ ID NO: 8361177 - DNA, 22 bp, Homo sapiens
cacagctgccctactccatgtg

SEQ ID NO: 8361178 - DNA, 22 bp, Homo sapiens
cacagctgccatgcagtcagtg

SEQ ID NO: 8361179 - DNA, 22 bp, Homo sapiens
cacagctgccatgcagtcagtg

SEQ ID NO: 8361180 - DNA, 22 bp, Homo sapiens
cacagcagcgttcctccgtgtg

SEQ ID NO: 8361181 - DNA, 22 bp, Homo sapiens
cacagaaatattgtgtcccttg

SEQ ID NO: 8361182 - DNA, 20 bp, Homo sapiens
cacagaacaaattgcaggac

SEQ ID NO: 8361183 - DNA, 22 bp, Homo sapiens
cacagaaattattaggatgctt

SEQ ID NO: 8361184 - DNA, 22 bp, Homo sapiens
cacaggaaaaatgggtccttta

SEQ ID NO: 8361185 - DNA, 22 bp, Homo sapiens
cacaggaaagtcagccagaaga

SEQ ID NO: 8361186 - DNA, 22 bp, Homo sapiens
cacaggaaatattaggagggat

SEQ ID NO: 8361187 - DNA, 22 bp, Homo sapiens
cacaggaaaataaaagatctaa

SEQ ID NO: 8361188 - DNA, 20 bp, Homo sapiens
cacaggaaagctactcagtt

SEQ ID NO: 8361189 - DNA, 22 bp, Homo sapiens
cacaggaagaggtatacaattc

SEQ ID NO: 8361190 - DNA, 22 bp, Homo sapiens
cacaggaagatctcccagaggt

SEQ ID NO: 8361191 - DNA, 22 bp, Homo sapiens
cacaggaagcaagcctggggcc

SEQ ID NO: 8361192 - DNA, 22 bp, Homo sapiens
cacaggaaatgattctgcagca

SEQ ID NO: 8361193 - DNA, 22 bp, Homo sapiens
cacaggaacttactggccactt

SEQ ID NO: 8361194 - DNA, 22 bp, Homo sapiens
cacaggaacaaagaagacaatt

SEQ ID NO: 8361195 - DNA, 22 bp, Homo sapiens
caattcaatggcaaagtattgt

SEQ ID NO: 8361196 - DNA, 22 bp, Homo sapiens
caattcaacttgcctttgtagc

SEQ ID NO: 8361197 - DNA, 22 bp, Homo sapiens
caatttctggaactaattctga

SEQ ID NO: 8361198 - DNA, 22 bp, Homo sapiens
caatttttgtacttatagtact

SEQ ID NO: 8361199 - DNA, 22 bp, Homo sapiens
caatttttgtacttatagtact

SEQ ID NO: 8361200 - DNA, 22 bp, Homo sapiens
cacacagaaccgctcgccactt

SEQ ID NO: 8361201 - DNA, 22 bp, Homo sapiens
caatttttgtacttatagtact

SEQ ID NO: 8361202 - DNA, 22 bp, Homo sapiens
caatttttgtacttatagtact

SEQ ID NO: 8361203 - DNA, 22 bp, Homo sapiens
caatttttaaactatgaagttg

SEQ ID NO: 8361204 - DNA, 22 bp, Homo sapiens
caattttcaattccttcagata

SEQ ID NO: 8361205 - DNA, 22 bp, Homo sapiens
caatttttaaactatgaagttg

SEQ ID NO: 8361206 - DNA, 22 bp, Homo sapiens
caattttattggtccaaataca

SEQ ID NO: 8361207 - DNA, 22 bp, Homo sapiens
caattttactcttcctcttcca

SEQ ID NO: 8361208 - DNA, 18 bp, Homo sapiens
caattttacccagtccct

SEQ ID NO: 8361209 - DNA, 22 bp, Homo sapiens
cacacatgcatgtaagacctct

SEQ ID NO: 8361210 - DNA, 22 bp, Homo sapiens
cacacatggtagcaggtacaag

SEQ ID NO: 8361211 - DNA, 22 bp, Homo sapiens
cacagaaaaaggcttgaaaatc

SEQ ID NO: 8361212 - DNA, 22 bp, Homo sapiens
cacagaaaaaggcttgaaaatc

SEQ ID NO: 8361213 - DNA, 22 bp, Homo sapiens
cacagaaaggctcaaatcccaa

SEQ ID NO: 8361214 - DNA, 22 bp, Homo sapiens
cacagaaaaaggcttgaaaatc

SEQ ID NO: 8361215 - DNA, 22 bp, Homo sapiens
cacactttgtgctaatctattt

SEQ ID NO: 8361216 - DNA, 22 bp, Homo sapiens
cacacatgtgtgcagcttagaa

SEQ ID NO: 8361217 - DNA, 22 bp, Homo sapiens
cactggggtgggcctggtagag

SEQ ID NO: 8361218 - DNA, 22 bp, Homo sapiens
cactgggcgtgtcctgggtgag

SEQ ID NO: 8361219 - DNA, 23 bp, Homo sapiens
cactgggcccagggtgtggaggc

SEQ ID NO: 8361220 - DNA, 23 bp, Homo sapiens
cactgggcccagggtgtggaggc

SEQ ID NO: 8361221 - DNA, 20 bp, Homo sapiens
agcattttatggtaggaaac

SEQ ID NO: 8361222 - DNA, 22 bp, Homo sapiens
cactgggcacttgggttgcttc

SEQ ID NO: 8361223 - DNA, 22 bp, Homo sapiens
agccaaagtccaaatgcagtgt

SEQ ID NO: 8361224 - DNA, 22 bp, Homo sapiens
agccaaatacaaactggggtgg

SEQ ID NO: 8361225 - DNA, 22 bp, Homo sapiens
agccaaaggcaccagagacact

SEQ ID NO: 8361226 - DNA, 22 bp, Homo sapiens
cagaaagacctgggctcaagag

SEQ ID NO: 8361227 - DNA, 22 bp, Homo sapiens
cagaaagacctgattggcagtt

SEQ ID NO: 8361228 - DNA, 22 bp, Homo sapiens
cagaaagacctgattggcagtt

SEQ ID NO: 8361229 - DNA, 22 bp, Homo sapiens
cagaaactagatttagacacaa

SEQ ID NO: 8361230 - DNA, 22 bp, Homo sapiens
cagaaactagatttagacacaa

SEQ ID NO: 8361231 - DNA, 22 bp, Homo sapiens
cagaaactatgtaagaaagtga

SEQ ID NO: 8361232 - DNA, 22 bp, Homo sapiens
cagaaactatgtaagaaagtga

SEQ ID NO: 8361233 - DNA, 20 bp, Homo sapiens
cagaaagaaggtagattttt

SEQ ID NO: 8361234 - DNA, 22 bp, Homo sapiens
cagaaactttctttactgagca

SEQ ID NO: 8361235 - DNA, 22 bp, Homo sapiens
cagaaactgtttgttaatattt

SEQ ID NO: 8361236 - DNA, 22 bp, Homo sapiens
cagaaacttctggtgtcaaata

SEQ ID NO: 8361237 - DNA, 22 bp, Homo sapiens
cagaaacttctggtgtcaaata

SEQ ID NO: 8361238 - DNA, 22 bp, Homo sapiens
cagaaacttctggtgtcaaata

SEQ ID NO: 8361239 - DNA, 22 bp, Homo sapiens
cactgcactccatcctgggaaa

SEQ ID NO: 8361240 - DNA, 22 bp, Homo sapiens
cactgcactccatcctgggaaa

SEQ ID NO: 8361241 - DNA, 22 bp, Homo sapiens
cactgcaagctctgccacctgg

SEQ ID NO: 8361242 - DNA, 22 bp, Homo sapiens
cactgcacaggtgagatgtggg

SEQ ID NO: 8361243 - DNA, 22 bp, Homo sapiens
cactgcaacctctgccacctgg

SEQ ID NO: 8361244 - DNA, 22 bp, Homo sapiens
cactgcacttcagcctgggtga

SEQ ID NO: 8361245 - DNA, 22 bp, Homo sapiens
cactaattaacacgtcgtctct

SEQ ID NO: 8361246 - DNA, 22 bp, Homo sapiens
cactaattaatgaaattccagg

SEQ ID NO: 8361247 - DNA, 22 bp, Homo sapiens
cactaattctggagacaactca

SEQ ID NO: 8361248 - DNA, 22 bp, Homo sapiens
cactacaggggtccacagctga

SEQ ID NO: 8361249 - DNA, 22 bp, Homo sapiens
cactagaaaggtacagattatg

SEQ ID NO: 8361250 - DNA, 22 bp, Homo sapiens
cactgaaatcgaaaaatgtagg

SEQ ID NO: 8361251 - DNA, 22 bp, Homo sapiens
cactgaaatcgaaaaatgtagg

SEQ ID NO: 8361252 - DNA, 22 bp, Homo sapiens
agcaggtgggatcaagctggca

SEQ ID NO: 8361253 - DNA, 22 bp, Homo sapiens
cacctgcaaggagctttcattt

SEQ ID NO: 8361254 - DNA, 22 bp, Homo sapiens
cacattgtattgtggaaagtta

SEQ ID NO: 8361255 - DNA, 22 bp, Homo sapiens
cacattgtattgtggaaagtta

SEQ ID NO: 8361256 - DNA, 22 bp, Homo sapiens
cacattgtagagattagaaaga

SEQ ID NO: 8361257 - DNA, 22 bp, Homo sapiens
cacattggcaaacggggttgca

SEQ ID NO: 8361258 - DNA, 22 bp, Homo sapiens
cacatttaaaaaatccacgatc

SEQ ID NO: 8361259 - DNA, 22 bp, Homo sapiens
agcaggcctcatgcaccagcta

SEQ ID NO: 8361260 - DNA, 20 bp, Homo sapiens
agcaggccttggggagagga

SEQ ID NO: 8361261 - DNA, 22 bp, Homo sapiens
agcaggctaatcttgctgaaca

SEQ ID NO: 8361262 - DNA, 22 bp, Homo sapiens
agcaggctactcctgtgttcgt

SEQ ID NO: 8361263 - DNA, 22 bp, Homo sapiens
agcaggctactcctgtgttcgt

SEQ ID NO: 8361264 - DNA, 19 bp, Homo sapiens
agcaggctaggctgcctct

SEQ ID NO: 8361265 - DNA, 19 bp, Homo sapiens
agcaggctaggctgcctct

SEQ ID NO: 8361266 - DNA, 22 bp, Homo sapiens
agcaggctaggaacctcactgc

SEQ ID NO: 8361267 - DNA, 22 bp, Homo sapiens
agcaggctaggaacctcactgc

SEQ ID NO: 8361268 - DNA, 19 bp, Homo sapiens
agcaggctaggctgcctct

SEQ ID NO: 8361269 - DNA, 22 bp, Homo sapiens
cacaggctccggccttgcagcc

SEQ ID NO: 8361270 - DNA, 18 bp, Homo sapiens
cacaggctcccagtgagg

SEQ ID NO: 8361271 - DNA, 20 bp, Homo sapiens
cacaggctatatgagagcca

SEQ ID NO: 8361272 - DNA, 23 bp, Homo sapiens
cacatggattaaatgagaccaca

SEQ ID NO: 8361273 - DNA, 22 bp, Homo sapiens
cacatggcagaatcatgcatct

SEQ ID NO: 8361274 - DNA, 22 bp, Homo sapiens
cacatggcctgtgtggccagac

SEQ ID NO: 8361275 - DNA, 22 bp, Homo sapiens
cacatgggcacagagaacttgg

SEQ ID NO: 8361276 - DNA, 22 bp, Homo sapiens
cacatgggtgtgcctggaggaa

SEQ ID NO: 8361277 - DNA, 22 bp, Homo sapiens
cacaggctgcccgcagctggga

SEQ ID NO: 8361278 - DNA, 22 bp, Homo sapiens
aagatacacgttgtattgaata

SEQ ID NO: 8361279 - DNA, 22 bp, Homo sapiens
aagatacacgttgtattgaata

SEQ ID NO: 8361280 - DNA, 22 bp, Homo sapiens
acacataagcctaatcatctcc

SEQ ID NO: 8361281 - DNA, 22 bp, Homo sapiens
acacataagcctaatcatctcc

SEQ ID NO: 8361282 - DNA, 22 bp, Homo sapiens
aagatacataaaggtagagtct

SEQ ID NO: 8361283 - DNA, 22 bp, Homo sapiens
acacataagcctaatcatctcc

SEQ ID NO: 8361284 - DNA, 22 bp, Homo sapiens
acagaaagatgatttgaaatgg

SEQ ID NO: 8361285 - DNA, 20 bp, Homo sapiens
acagaaagctgccttgtccc

SEQ ID NO: 8361286 - DNA, 23 bp, Homo sapiens
acagaaagttctgctggacagag

SEQ ID NO: 8361287 - DNA, 22 bp, Homo sapiens
acacttctttgtcacctgcttc

SEQ ID NO: 8361288 - DNA, 22 bp, Homo sapiens
acagagatgtcagattggcagc

SEQ ID NO: 8361289 - DNA, 22 bp, Homo sapiens
acagagcaacttgagtatcctc

SEQ ID NO: 8361290 - DNA, 22 bp, Homo sapiens
acagaaatgatgtttggcaata

SEQ ID NO: 8361291 - DNA, 22 bp, Homo sapiens
acagaaataactttttatgttt

SEQ ID NO: 8361292 - DNA, 23 bp, Homo sapiens
acagacattgtacatcttgtttt

SEQ ID NO: 8361293 - DNA, 23 bp, Homo sapiens
acagacattccataatgtacacc

SEQ ID NO: 8361294 - DNA, 23 bp, Homo sapiens
acagacattccataatgtacacc

SEQ ID NO: 8361295 - DNA, 23 bp, Homo sapiens
acagacaacactgatgagagaaa

SEQ ID NO: 8361296 - DNA, 22 bp, Homo sapiens
acagacattttaagacacttta

SEQ ID NO: 8361297 - DNA, 22 bp, Homo sapiens
acagacattttaagacacttta

SEQ ID NO: 8361298 - DNA, 22 bp, Homo sapiens
acagctgctgtggaggttttca

SEQ ID NO: 8361299 - DNA, 22 bp, Homo sapiens
acagctgctgcttctcactggg

SEQ ID NO: 8361300 - DNA, 22 bp, Homo sapiens
acagctgctttctcttactatg

SEQ ID NO: 8361301 - DNA, 23 bp, Homo sapiens
aagccctgaaggtttcaggccct

SEQ ID NO: 8361302 - DNA, 22 bp, Homo sapiens
aagccctgacctgagagtccgt

SEQ ID NO: 8361303 - DNA, 22 bp, Homo sapiens
aagcccagcatccctgcaccag

SEQ ID NO: 8361304 - DNA, 22 bp, Homo sapiens
aagcccagctctgcctgctctg

SEQ ID NO: 8361305 - DNA, 22 bp, Homo sapiens
acagcaggttacagtggcacag

SEQ ID NO: 8361306 - DNA, 19 bp, Homo sapiens
acagcaggtgtggggataa

SEQ ID NO: 8361307 - DNA, 19 bp, Homo sapiens
acagcaggtgtggggataa

SEQ ID NO: 8361308 - DNA, 22 bp, Homo sapiens
acagcaggttacagtggcacag

SEQ ID NO: 8361309 - DNA, 22 bp, Homo sapiens
acagcaggttacagtggcacag

SEQ ID NO: 8361310 - DNA, 21 bp, Homo sapiens
acagccaggaacatgaggggc

SEQ ID NO: 8361311 - DNA, 22 bp, Homo sapiens
acagccagggacatacaatggt

SEQ ID NO: 8361312 - DNA, 22 bp, Homo sapiens
acagccagggacatacaatggt

SEQ ID NO: 8361313 - DNA, 22 bp, Homo sapiens
acagccagggacatacaatggt

SEQ ID NO: 8361314 - DNA, 22 bp, Homo sapiens
aagccaggttccatggaggagc

SEQ ID NO: 8361315 - DNA, 22 bp, Homo sapiens
aagccaggtttgaaatatccca

SEQ ID NO: 8361316 - DNA, 22 bp, Homo sapiens
acagccaggaggaactcagtga

SEQ ID NO: 8361317 - DNA, 22 bp, Homo sapiens
acagccaggagccatgggcagg

SEQ ID NO: 8361318 - DNA, 22 bp, Homo sapiens
acagcagggggagctgttggac

SEQ ID NO: 8361319 - DNA, 21 bp, Homo sapiens
acagcagggctggcatgacag

SEQ ID NO: 8361320 - DNA, 22 bp, Homo sapiens
acagcagggggagctgttggac

SEQ ID NO: 8361321 - DNA, 22 bp, Homo sapiens
acagcaggggtggaataaacgt

SEQ ID NO: 8361322 - DNA, 22 bp, Homo sapiens
acagcagggggagctgttggac

SEQ ID NO: 8361323 - DNA, 22 bp, Homo sapiens
acagcagggtcacattccctct

SEQ ID NO: 8361324 - DNA, 22 bp, Homo sapiens
acagcaggggtggaataaacgt

SEQ ID NO: 8361325 - DNA, 22 bp, Homo sapiens
acagcagggtcacattccctct

SEQ ID NO: 8361326 - DNA, 22 bp, Homo sapiens
acagcaggtagctttgtgcctc

SEQ ID NO: 8361327 - DNA, 22 bp, Homo sapiens
acagcaggtagctttgtgcctc

SEQ ID NO: 8361328 - DNA, 19 bp, Homo sapiens
acagcaggtgtggggataa

SEQ ID NO: 8361329 - DNA, 22 bp, Homo sapiens
aagcagtgactctcagaggcag

SEQ ID NO: 8361330 - DNA, 22 bp, Homo sapiens
aagcagtgcgctcatctaaggg

SEQ ID NO: 8361331 - DNA, 22 bp, Homo sapiens
aagcagttactatttactatta

SEQ ID NO: 8361332 - DNA, 22 bp, Homo sapiens
aagcagtgttcccagctggccc

SEQ ID NO: 8361333 - DNA, 22 bp, Homo sapiens
acagcaggaagctggagggaaa

SEQ ID NO: 8361334 - DNA, 22 bp, Homo sapiens
acagcaggaagctggagggaaa

SEQ ID NO: 8361335 - DNA, 22 bp, Homo sapiens
acagcaggaagctggagggaaa

SEQ ID NO: 8361336 - DNA, 22 bp, Homo sapiens
aagcataaaacgttacaacatg

SEQ ID NO: 8361337 - DNA, 22 bp, Homo sapiens
aagcagtttttcaactgtttag

SEQ ID NO: 8361338 - DNA, 21 bp, Homo sapiens
aagcagggactgcccaggtcc

SEQ ID NO: 8361339 - DNA, 23 bp, Homo sapiens
aagcagggagattcttagctgag

SEQ ID NO: 8361340 - DNA, 22 bp, Homo sapiens
aagcaggcttggtgtggccgct

SEQ ID NO: 8361341 - DNA, 22 bp, Homo sapiens
aagcaggttacatacattatct

SEQ ID NO: 8361342 - DNA, 22 bp, Homo sapiens
aagcaggttatgaaatatagaa

SEQ ID NO: 8361343 - DNA, 22 bp, Homo sapiens
aagcaggttatgaaatatagaa

SEQ ID NO: 8361344 - DNA, 22 bp, Homo sapiens
aagcagggctccctggggactc

SEQ ID NO: 8361345 - DNA, 22 bp, Homo sapiens
aagcagggctagaccaagaaga

SEQ ID NO: 8361346 - DNA, 18 bp, Homo sapiens
aagcagggtccattgtgc

SEQ ID NO: 8361347 - DNA, 22 bp, Homo sapiens
aagcagggtcttcctcagttgg

SEQ ID NO: 8361348 - DNA, 22 bp, Homo sapiens
acaaaaccagaaaatctctacc

SEQ ID NO: 8361349 - DNA, 21 bp, Homo sapiens
acaaaagaagctgccttttaa

SEQ ID NO: 8361350 - DNA, 22 bp, Homo sapiens
acaaaagtgagtgtgtctcaga

SEQ ID NO: 8361351 - DNA, 22 bp, Homo sapiens
aagaatcatcctgcaagagtct

SEQ ID NO: 8361352 - DNA, 22 bp, Homo sapiens
aagaatatagattttttgaagt

SEQ ID NO: 8361353 - DNA, 19 bp, Homo sapiens
acaaattgtcctcatcaag

SEQ ID NO: 8361354 - DNA, 22 bp, Homo sapiens
acaaatgactatttggtacagg

SEQ ID NO: 8361355 - DNA, 22 bp, Homo sapiens
acaaatgaacatataagcttga

SEQ ID NO: 8361356 - DNA, 22 bp, Homo sapiens
acaaatccagtgaactccagtg

SEQ ID NO: 8361357 - DNA, 22 bp, Homo sapiens
acaaatctgttttatagacttt

SEQ ID NO: 8361358 - DNA, 22 bp, Homo sapiens
acaaagctagagaagagaattg

SEQ ID NO: 8361359 - DNA, 22 bp, Homo sapiens
aagaatctctgatcaggcttta

SEQ ID NO: 8361360 - DNA, 22 bp, Homo sapiens
acaaagctctggaaggctcgtc

SEQ ID NO: 8361361 - DNA, 22 bp, Homo sapiens
acaaatatttactgaatccact

SEQ ID NO: 8361362 - DNA, 22 bp, Homo sapiens
acaaatatttactgaatccact

SEQ ID NO: 8361363 - DNA, 22 bp, Homo sapiens
aagaacattttgtagaatgaca

SEQ ID NO: 8361364 - DNA, 23 bp, Homo sapiens
aagaactgcgaatggagaaagta

SEQ ID NO: 8361365 - DNA, 22 bp, Homo sapiens
aatgtacaataagacaaagagg

SEQ ID NO: 8361366 - DNA, 22 bp, Homo sapiens
aagaacaggttctagaaccatt

SEQ ID NO: 8361367 - DNA, 22 bp, Homo sapiens
aagaagaattattccctaatca

SEQ ID NO: 8361368 - DNA, 22 bp, Homo sapiens
aagaagaagtgttatttttaga

SEQ ID NO: 8361369 - DNA, 22 bp, Homo sapiens
aagaagaagtgttatttttaga

SEQ ID NO: 8361370 - DNA, 23 bp, Homo sapiens
aagaactttggtcctgcagagtc

SEQ ID NO: 8361371 - DNA, 22 bp, Homo sapiens
aagaacttttggcaagtgttat

SEQ ID NO: 8361372 - DNA, 22 bp, Homo sapiens
aagaacttgggctgagtgaaag

SEQ ID NO: 8361373 - DNA, 22 bp, Homo sapiens
aagaactttgatttcattgcat

SEQ ID NO: 8361374 - DNA, 19 bp, Homo sapiens
aagaagcaataagctgtga

SEQ ID NO: 8361375 - DNA, 22 bp, Homo sapiens
aagaagatggttaactttcagt

SEQ ID NO: 8361376 - DNA, 22 bp, Homo sapiens
acaaaaattagctgggcatggt

SEQ ID NO: 8361377 - DNA, 22 bp, Homo sapiens
aagataagtaacgagcctcagt

SEQ ID NO: 8361378 - DNA, 22 bp, Homo sapiens
aagagtttatgatataacatgt

SEQ ID NO: 8361379 - DNA, 22 bp, Homo sapiens
aagagtttccagttgtggctca

SEQ ID NO: 8361380 - DNA, 17 bp, Homo sapiens
acacagccaggttctcc

SEQ ID NO: 8361381 - DNA, 22 bp, Homo sapiens
acacagccccacggtgagcaaa

SEQ ID NO: 8361382 - DNA, 22 bp, Homo sapiens
acacagccccacggtgagcaaa

SEQ ID NO: 8361383 - DNA, 22 bp, Homo sapiens
acacagcaacttgcagtatgga

SEQ ID NO: 8361384 - DNA, 22 bp, Homo sapiens
acacagcaaggtctgactttgg

SEQ ID NO: 8361385 - DNA, 22 bp, Homo sapiens
acacagagctggaactgcttca

SEQ ID NO: 8361386 - DNA, 22 bp, Homo sapiens
acacagagcttctcaactggga

SEQ ID NO: 8361387 - DNA, 22 bp, Homo sapiens
acacagagccaaaccatatcac

SEQ ID NO: 8361388 - DNA, 22 bp, Homo sapiens
acacagagccagggaatacagt

SEQ ID NO: 8361389 - DNA, 22 bp, Homo sapiens
acaatgttctacatatacataa

SEQ ID NO: 8361390 - DNA, 22 bp, Homo sapiens
acaatgttctacatatacataa

SEQ ID NO: 8361391 - DNA, 22 bp, Homo sapiens
acacagaagctttttctattcc

SEQ ID NO: 8361392 - DNA, 22 bp, Homo sapiens
acacacatgcctttcctaagta

SEQ ID NO: 8361393 - DNA, 17 bp, Homo sapiens
acacagacaggcagaca

SEQ ID NO: 8361394 - DNA, 22 bp, Homo sapiens
acaaattgttgcttcatgaatg

SEQ ID NO: 8361395 - DNA, 22 bp, Homo sapiens
acaaatttgaatcctgacttct

SEQ ID NO: 8361396 - DNA, 22 bp, Homo sapiens
acaaatttgtgtagttatggca

SEQ ID NO: 8361397 - DNA, 22 bp, Homo sapiens
acaaggcttcacacagtatgaa

SEQ ID NO: 8361398 - DNA, 22 bp, Homo sapiens
acaatgtgggcatgagaaacca

SEQ ID NO: 8361399 - DNA, 22 bp, Homo sapiens
acaatgtaggctgaaaaagctt

SEQ ID NO: 8361400 - DNA, 22 bp, Homo sapiens
acaatgtaggctgaaaaagctt

SEQ ID NO: 8361401 - DNA, 22 bp, Homo sapiens
acaatatgggatatacatttta

SEQ ID NO: 8361402 - DNA, 22 bp, Homo sapiens
acaatatttgggggcagtttgt

SEQ ID NO: 8361403 - DNA, 20 bp, Homo sapiens
acaatatgtagatgaatagc

SEQ ID NO: 8361404 - DNA, 22 bp, Homo sapiens
aatgcttccaaaataccaagcc

SEQ ID NO: 8361405 - DNA, 22 bp, Homo sapiens
aatgcttcctcctcacctcagg

SEQ ID NO: 8361406 - DNA, 22 bp, Homo sapiens
aatgcttattattaatagaatg

SEQ ID NO: 8361407 - DNA, 22 bp, Homo sapiens
aatgcttcaacctcccacatgt

SEQ ID NO: 8361408 - DNA, 22 bp, Homo sapiens
aatgcttattattaatagaatg

SEQ ID NO: 8361409 - DNA, 22 bp, Homo sapiens
aatgcttatgggttccataata

SEQ ID NO: 8361410 - DNA, 22 bp, Homo sapiens
aatgctttagaaaaccagcttt

SEQ ID NO: 8361411 - DNA, 22 bp, Homo sapiens
aatgctttcaaaaatgtgcagt

SEQ ID NO: 8361412 - DNA, 22 bp, Homo sapiens
aacttgtaatgaaaggcaatag

SEQ ID NO: 8361413 - DNA, 22 bp, Homo sapiens
aacttggctttgccatttatcg

SEQ ID NO: 8361414 - DNA, 22 bp, Homo sapiens
aatgcagtgagccattaaatgg

SEQ ID NO: 8361415 - DNA, 22 bp, Homo sapiens
aatgctgtatatcttagctaat

SEQ ID NO: 8361416 - DNA, 22 bp, Homo sapiens
aatgcataatggtttgtgacaa

SEQ ID NO: 8361417 - DNA, 22 bp, Homo sapiens
aatgcataatggtttgtgacaa

SEQ ID NO: 8361418 - DNA, 22 bp, Homo sapiens
aatgctgtccaataggaacata

SEQ ID NO: 8361419 - DNA, 22 bp, Homo sapiens
aatgcttaattcaatactgtgt

SEQ ID NO: 8361420 - DNA, 22 bp, Homo sapiens
aatgctgtcttttctacttcat

SEQ ID NO: 8361421 - DNA, 19 bp, Homo sapiens
aatgcttaggacagtgcct

SEQ ID NO: 8361422 - DNA, 22 bp, Homo sapiens
aatgcttataacgttagaatgt

SEQ ID NO: 8361423 - DNA, 21 bp, Homo sapiens
aacttgtatttctccttattc

SEQ ID NO: 8361424 - DNA, 22 bp, Homo sapiens
aacttgtatatgttattcagag

SEQ ID NO: 8361425 - DNA, 22 bp, Homo sapiens
aactttaaaaaatatgtctgtt

SEQ ID NO: 8361426 - DNA, 22 bp, Homo sapiens
aactttaaagaggaggcttggg

SEQ ID NO: 8361427 - DNA, 22 bp, Homo sapiens
aactttacactgctttacatga

SEQ ID NO: 8361428 - DNA, 22 bp, Homo sapiens
aactttaaggctataaattatg

SEQ ID NO: 8361429 - DNA, 22 bp, Homo sapiens
aactttaaggctataaattatg

SEQ ID NO: 8361430 - DNA, 22 bp, Homo sapiens
aatgtacaaaagtcagccaact

SEQ ID NO: 8361431 - DNA, 22 bp, Homo sapiens
aatgtaaacagcaagagaaggg

SEQ ID NO: 8361432 - DNA, 22 bp, Homo sapiens
aatgtaaacagcaagagaaggg

SEQ ID NO: 8361433 - DNA, 22 bp, Homo sapiens
aatgtaaacagcaagagaaggg

SEQ ID NO: 8361434 - DNA, 22 bp, Homo sapiens
aatgtaaagctcaggtcaggag

SEQ ID NO: 8361435 - DNA, 22 bp, Homo sapiens
aatgcagagtaaatatttaatt

SEQ ID NO: 8361436 - DNA, 22 bp, Homo sapiens
aatgcagaccagtatgaaaaac

SEQ ID NO: 8361437 - DNA, 22 bp, Homo sapiens
aatgcacatgtcttggcctcac

SEQ ID NO: 8361438 - DNA, 22 bp, Homo sapiens
aatgaaatgtagcttatccata

SEQ ID NO: 8361439 - DNA, 22 bp, Homo sapiens
aatgaaatgtagcttatccata

SEQ ID NO: 8361440 - DNA, 18 bp, Homo sapiens
aatgaaatgtacaccttt

SEQ ID NO: 8361441 - DNA, 18 bp, Homo sapiens
aatgaaatgtacaccttt

SEQ ID NO: 8361442 - DNA, 22 bp, Homo sapiens
aatgaaatgaagatatgatcag

SEQ ID NO: 8361443 - DNA, 22 bp, Homo sapiens
aatctcttcccagtaaaaatgg

SEQ ID NO: 8361444 - DNA, 22 bp, Homo sapiens
aatctccatttaccctgcatct

SEQ ID NO: 8361445 - DNA, 22 bp, Homo sapiens
aatctctttggctcaaggatcc

SEQ ID NO: 8361446 - DNA, 22 bp, Homo sapiens
aatctggctcagaagaagatga

SEQ ID NO: 8361447 - DNA, 22 bp, Homo sapiens
aatctggcatttgagagtagga

SEQ ID NO: 8361448 - DNA, 15 bp, Homo sapiens
aatctggcggcaagt

SEQ ID NO: 8361449 - DNA, 22 bp, Homo sapiens
aatctggtctaagtgaggatag

SEQ ID NO: 8361450 - DNA, 23 bp, Homo sapiens
aatctggctgatgttttttctct

SEQ ID NO: 8361451 - DNA, 22 bp, Homo sapiens
aatctggagagtcatctctgac

SEQ ID NO: 8361452 - DNA, 22 bp, Homo sapiens
aatctggcatgtaagcttagag

SEQ ID NO: 8361453 - DNA, 22 bp, Homo sapiens
aatctggacttgtctgtgaaga

SEQ ID NO: 8361454 - DNA, 22 bp, Homo sapiens
aatctggacacagttctcatgc

SEQ ID NO: 8361455 - DNA, 22 bp, Homo sapiens
aatctgcttttgtcatttatga

SEQ ID NO: 8361456 - DNA, 22 bp, Homo sapiens
aatgaaatagttggctgtagag

SEQ ID NO: 8361457 - DNA, 22 bp, Homo sapiens
aatgaaatagttggctgtagag

SEQ ID NO: 8361458 - DNA, 22 bp, Homo sapiens
aatgaaatctgctgggtaaaga

SEQ ID NO: 8361459 - DNA, 22 bp, Homo sapiens
aataatgtacatacatatttcg

SEQ ID NO: 8361460 - DNA, 22 bp, Homo sapiens
aataatgtctttggcttgacca

SEQ ID NO: 8361461 - DNA, 22 bp, Homo sapiens
aataatgtctgctattttaaaa

SEQ ID NO: 8361462 - DNA, 22 bp, Homo sapiens
aataatgtctgctattttaaaa

SEQ ID NO: 8361463 - DNA, 22 bp, Homo sapiens
aataatgataatggttatagct

SEQ ID NO: 8361464 - DNA, 19 bp, Homo sapiens
aataatgccagatgtctgt

SEQ ID NO: 8361465 - DNA, 22 bp, Homo sapiens
aataatgataatggttatagct

SEQ ID NO: 8361466 - DNA, 22 bp, Homo sapiens
aataatgagacagcttatttaa

SEQ ID NO: 8361467 - DNA, 22 bp, Homo sapiens
aataatgagacagcttatttaa

SEQ ID NO: 8361468 - DNA, 22 bp, Homo sapiens
aataatgagcttgtctaattgt

SEQ ID NO: 8361469 - DNA, 22 bp, Homo sapiens
aataatatttgaagcttcaaag

SEQ ID NO: 8361470 - DNA, 22 bp, Homo sapiens
aataatatttgaagcttcaaag

SEQ ID NO: 8361471 - DNA, 22 bp, Homo sapiens
aataagaacttgtctctggcag

SEQ ID NO: 8361472 - DNA, 22 bp, Homo sapiens
aagttacagttattatttaaaa

SEQ ID NO: 8361473 - DNA, 22 bp, Homo sapiens
aacagtttatgataaattctta

SEQ ID NO: 8361474 - DNA, 22 bp, Homo sapiens
aacagtttatgagatatgctat

SEQ ID NO: 8361475 - DNA, 22 bp, Homo sapiens
aacagtttatcaagtttttaca

SEQ ID NO: 8361476 - DNA, 22 bp, Homo sapiens
aacagttgatgtagctttggag

SEQ ID NO: 8361477 - DNA, 19 bp, Homo sapiens
aatacagtgttatagaatt

SEQ ID NO: 8361478 - DNA, 21 bp, Homo sapiens
aatacagtgaagaatttcttt

SEQ ID NO: 8361479 - DNA, 22 bp, Homo sapiens
aatacataataagttttgtctg

SEQ ID NO: 8361480 - DNA, 22 bp, Homo sapiens
aatacagtcttactagaaaatc

SEQ ID NO: 8361481 - DNA, 22 bp, Homo sapiens
aatacagtgaaagtgagcaagg

SEQ ID NO: 8361482 - DNA, 22 bp, Homo sapiens
aatacagtaattttgatgagtt

SEQ ID NO: 8361483 - DNA, 22 bp, Homo sapiens
aatacagtaggtaatagttcat

SEQ ID NO: 8361484 - DNA, 22 bp, Homo sapiens
aatatctggagatgctttttgt

SEQ ID NO: 8361485 - DNA, 22 bp, Homo sapiens
aatatctcaccatgacaaagca

SEQ ID NO: 8361486 - DNA, 22 bp, Homo sapiens
aatatcccttgaagtggtgctg

SEQ ID NO: 8361487 - DNA, 22 bp, Homo sapiens
aatacatatggaattccatgtt

SEQ ID NO: 8361488 - DNA, 22 bp, Homo sapiens
aatatcagtatattgtatcagt

SEQ ID NO: 8361489 - DNA, 22 bp, Homo sapiens
aatatctgtctctaatgcatat

SEQ ID NO: 8361490 - DNA, 22 bp, Homo sapiens
aatatcttctaaggatagaact

SEQ ID NO: 8361491 - DNA, 22 bp, Homo sapiens
aatattgagaaccagcatgttt

SEQ ID NO: 8361492 - DNA, 22 bp, Homo sapiens
aatatttatgacaggaagtagc

SEQ ID NO: 8361493 - DNA, 22 bp, Homo sapiens
aatattgtttcaagatcacaga

SEQ ID NO: 8361494 - DNA, 22 bp, Homo sapiens
aatattgagaaccagcatgttt

SEQ ID NO: 8361495 - DNA, 22 bp, Homo sapiens
aatatttctgtagctatgttct

SEQ ID NO: 8361496 - DNA, 22 bp, Homo sapiens
aatatttctgtagctatgttct

SEQ ID NO: 8361497 - DNA, 22 bp, Homo sapiens
aatatttcaaaaggaaacacag

SEQ ID NO: 8361498 - DNA, 22 bp, Homo sapiens
aatatttcaaaaggaaacacag

SEQ ID NO: 8361499 - DNA, 22 bp, Homo sapiens
aatatttctgcagaatggtttt

SEQ ID NO: 8361500 - DNA, 22 bp, Homo sapiens
aatatttctggtgcttctcact

SEQ ID NO: 8361501 - DNA, 22 bp, Homo sapiens
aatatttctccttcgttatagc

SEQ ID NO: 8361502 - DNA, 22 bp, Homo sapiens
aaggtgtgaactgattcattgg

SEQ ID NO: 8361503 - DNA, 22 bp, Homo sapiens
aagggcagggagtttgtgtcta

SEQ ID NO: 8361504 - DNA, 22 bp, Homo sapiens
aagggcagggagtttgtgtcta

SEQ ID NO: 8361505 - DNA, 22 bp, Homo sapiens
aagggcaggtgggcatttctgg

SEQ ID NO: 8361506 - DNA, 22 bp, Homo sapiens
aagggcaggtgggcatttctgg

SEQ ID NO: 8361507 - DNA, 22 bp, Homo sapiens
aagtgaaacatgtatctcttta

SEQ ID NO: 8361508 - DNA, 22 bp, Homo sapiens
aagtgcccagtgaagcagtggt

SEQ ID NO: 8361509 - DNA, 22 bp, Homo sapiens
aagtcttaggcattttatttct

SEQ ID NO: 8361510 - DNA, 22 bp, Homo sapiens
aagtgcttaaaagggtggtcta

SEQ ID NO: 8361511 - DNA, 22 bp, Homo sapiens
aacagttattatcacattagtg

SEQ ID NO: 8361512 - DNA, 22 bp, Homo sapiens
aacagttacccttaagatcttt

SEQ ID NO: 8361513 - DNA, 22 bp, Homo sapiens
aaggcactgtactagttagtta

SEQ ID NO: 8361514 - DNA, 23 bp, Homo sapiens
aaggccagagagaggctagtgtc

SEQ ID NO: 8361515 - DNA, 22 bp, Homo sapiens
aaggccaggtccctgcagtgca

SEQ ID NO: 8361516 - DNA, 22 bp, Homo sapiens
aaggccattgtaatgtaaatat

SEQ ID NO: 8361517 - DNA, 22 bp, Homo sapiens
aaggcccacagaactgtctcca

SEQ ID NO: 8361518 - DNA, 22 bp, Homo sapiens
aaggccatctacttacggaatt

SEQ ID NO: 8361519 - DNA, 22 bp, Homo sapiens
aaggccctagaatctatattgc

SEQ ID NO: 8361520 - DNA, 22 bp, Homo sapiens
aaggccctaatagagcacatat

SEQ ID NO: 8361521 - DNA, 22 bp, Homo sapiens
aaggcccagcgtgacctcagtg

SEQ ID NO: 8361522 - DNA, 22 bp, Homo sapiens
aaggcccttccaccagtcctcg

SEQ ID NO: 8361523 - DNA, 22 bp, Homo sapiens
aaggctgactcaacagggggcc

SEQ ID NO: 8361524 - DNA, 22 bp, Homo sapiens
aagggcaggcagagatcatata

SEQ ID NO: 8361525 - DNA, 22 bp, Homo sapiens
aagggcaggcagagatcatata

SEQ ID NO: 8361526 - DNA, 22 bp, Homo sapiens
aagggcaggcacccaccctcac

SEQ ID NO: 8361527 - DNA, 22 bp, Homo sapiens
aagggcaggaaaagatggatgt

SEQ ID NO: 8361528 - DNA, 22 bp, Homo sapiens
aagggcaggagaagacggatat

SEQ ID NO: 8361529 - DNA, 22 bp, Homo sapiens
aagggcaggagaagacggatat

SEQ ID NO: 8361530 - DNA, 22 bp, Homo sapiens
aaggaggttatcccagtggact

SEQ ID NO: 8361531 - DNA, 22 bp, Homo sapiens
aaggagtctgggccattcagag

SEQ ID NO: 8361532 - DNA, 22 bp, Homo sapiens
aaggagtctgggccattcagag

SEQ ID NO: 8361533 - DNA, 22 bp, Homo sapiens
aaggagtgatatatgggtgcta

SEQ ID NO: 8361534 - DNA, 22 bp, Homo sapiens
aaggagtgcatgactcagagta

SEQ ID NO: 8361535 - DNA, 22 bp, Homo sapiens
aaggcactgactgtgcagggga

SEQ ID NO: 8361536 - DNA, 22 bp, Homo sapiens
aaggatatttggctacagaagc

SEQ ID NO: 8361537 - DNA, 22 bp, Homo sapiens
aaggagaagggtaatcaacaca

SEQ ID NO: 8361538 - DNA, 22 bp, Homo sapiens
aaatggatgttgagttaaatgt

SEQ ID NO: 8361539 - DNA, 22 bp, Homo sapiens
aaatggcaatttagtttattta

SEQ ID NO: 8361540 - DNA, 22 bp, Homo sapiens
aaatggaagctatttatgattc

SEQ ID NO: 8361541 - DNA, 22 bp, Homo sapiens
aaatgtctttgagtttttataa

SEQ ID NO: 8361542 - DNA, 22 bp, Homo sapiens
aaatgtctttgagtatttctgc

SEQ ID NO: 8361543 - DNA, 22 bp, Homo sapiens
aaatgtctttgagtatttctgc

SEQ ID NO: 8361544 - DNA, 22 bp, Homo sapiens
aaatgtctttgagtatttctgc

SEQ ID NO: 8361545 - DNA, 22 bp, Homo sapiens
aaatgtctttcaatagagaaat

SEQ ID NO: 8361546 - DNA, 22 bp, Homo sapiens
aaatgtctttatctcatgtaac

SEQ ID NO: 8361547 - DNA, 22 bp, Homo sapiens
aaagacatcagaaccagctgag

SEQ ID NO: 8361548 - DNA, 22 bp, Homo sapiens
aaatgtctttatctcatgtaac

SEQ ID NO: 8361549 - DNA, 22 bp, Homo sapiens
aaatgtctgttagtcatatcat

SEQ ID NO: 8361550 - DNA, 23 bp, Homo sapiens
aaatgtcttctagctcttgagaa

SEQ ID NO: 8361551 - DNA, 23 bp, Homo sapiens
aaatgtcttctagctcttgagaa

SEQ ID NO: 8361552 - DNA, 22 bp, Homo sapiens
aaatgtctgtatgagaaagaga

SEQ ID NO: 8361553 - DNA, 22 bp, Homo sapiens
aaatgtctgagacttctgaact

SEQ ID NO: 8361554 - DNA, 22 bp, Homo sapiens
aaatgtctgagacttctgaact

SEQ ID NO: 8361555 - DNA, 22 bp, Homo sapiens
aaatgtctgtaggggctgcagg

SEQ ID NO: 8361556 - DNA, 22 bp, Homo sapiens
aaatgtctgtatgagaaagaga

SEQ ID NO: 8361557 - DNA, 22 bp, Homo sapiens
aaatgtctatctggcatattcc

SEQ ID NO: 8361558 - DNA, 22 bp, Homo sapiens
aaacttcagtgaatgacttatg

SEQ ID NO: 8361559 - DNA, 22 bp, Homo sapiens
aaacttcatggataatataaag

SEQ ID NO: 8361560 - DNA, 22 bp, Homo sapiens
aaacttcaaggatttgcaaatc

SEQ ID NO: 8361561 - DNA, 22 bp, Homo sapiens
aaacttcagggaataaaagagt

SEQ ID NO: 8361562 - DNA, 22 bp, Homo sapiens
aaatccagtgttcaaagtttga

SEQ ID NO: 8361563 - DNA, 21 bp, Homo sapiens
aaatgaatgtggtagtgcaag

SEQ ID NO: 8361564 - DNA, 21 bp, Homo sapiens
aaatgaatgtggtagtgcaag

SEQ ID NO: 8361565 - DNA, 22 bp, Homo sapiens
aaactgttatagcagaaaggac

SEQ ID NO: 8361566 - DNA, 22 bp, Homo sapiens
aaactgttgtggtttatcatta

SEQ ID NO: 8361567 - DNA, 22 bp, Homo sapiens
aaactgtgagctagtaaatagg

SEQ ID NO: 8361568 - DNA, 21 bp, Homo sapiens
aaatacagaaacttgttttca

SEQ ID NO: 8361569 - DNA, 22 bp, Homo sapiens
aaatacagagttgcttaaaagc

SEQ ID NO: 8361570 - DNA, 21 bp, Homo sapiens
aaatacagatgcaaatctgtt

SEQ ID NO: 8361571 - DNA, 21 bp, Homo sapiens
aaatacagatgcaaatctgtt

SEQ ID NO: 8361572 - DNA, 22 bp, Homo sapiens
aaataaaggaactgttttccca

SEQ ID NO: 8361573 - DNA, 22 bp, Homo sapiens
aaataaactgaagcacagagag

SEQ ID NO: 8361574 - DNA, 22 bp, Homo sapiens
aaataaaggtccactttagggc

SEQ ID NO: 8361575 - DNA, 22 bp, Homo sapiens
aaaggagaaaacatacaggact

SEQ ID NO: 8361576 - DNA, 22 bp, Homo sapiens
aaaggagagtgagtcagatgcc

SEQ ID NO: 8361577 - DNA, 22 bp, Homo sapiens
aaaggaggaatggagagatgct

SEQ ID NO: 8361578 - DNA, 22 bp, Homo sapiens
aaaggaatgagcttctgttagg

SEQ ID NO: 8361579 - DNA, 22 bp, Homo sapiens
aaaggaatgagcttctgttagg

SEQ ID NO: 8361580 - DNA, 22 bp, Homo sapiens
aaaggacatgtcaatatcaggc

SEQ ID NO: 8361581 - DNA, 22 bp, Homo sapiens
aaaattgtcgaacagtagtaac

SEQ ID NO: 8361582 - DNA, 22 bp, Homo sapiens
aaaattgtcgaacagtagtaac

SEQ ID NO: 8361583 - DNA, 22 bp, Homo sapiens
aaaattgtcgaacagtagtaac

SEQ ID NO: 8361584 - DNA, 22 bp, Homo sapiens
aaaattgtgaaggtttctgaaa

SEQ ID NO: 8361585 - DNA, 22 bp, Homo sapiens
aaaattgtgaaggtttctgaaa

SEQ ID NO: 8361586 - DNA, 22 bp, Homo sapiens
aaaattttcagcttgacttgat

SEQ ID NO: 8361587 - DNA, 22 bp, Homo sapiens
aaaattttcagcttgacttgat

SEQ ID NO: 8361588 - DNA, 22 bp, Homo sapiens
aaaattttgccctatccttcat

SEQ ID NO: 8361589 - DNA, 22 bp, Homo sapiens
aaaattttcagcttgacttgat

SEQ ID NO: 8361590 - DNA, 22 bp, Homo sapiens
aaaattttactggtgtttcctt

SEQ ID NO: 8361591 - DNA, 22 bp, Homo sapiens
aaaattttactggtgtttcctt

SEQ ID NO: 8361592 - DNA, 22 bp, Homo sapiens
aaagctatttgtgagttataga

SEQ ID NO: 8361593 - DNA, 22 bp, Homo sapiens
aaagtcatccaaatttttatgt

SEQ ID NO: 8361594 - DNA, 22 bp, Homo sapiens
aaagtcatctaggagcagattt

SEQ ID NO: 8361595 - DNA, 22 bp, Homo sapiens
aaagtcattgctgttatcaatg

SEQ ID NO: 8361596 - DNA, 22 bp, Homo sapiens
aaagtcattgctgttatcaatg

SEQ ID NO: 8361597 - DNA, 22 bp, Homo sapiens
aaagttttattcaagcattagt

SEQ ID NO: 8361598 - DNA, 22 bp, Homo sapiens
aaagttttctgccttcattaga

SEQ ID NO: 8361599 - DNA, 22 bp, Homo sapiens
aaagtacagccacatccaagta

SEQ ID NO: 8361600 - DNA, 22 bp, Homo sapiens
aaagtacagccacatccaagta

SEQ ID NO: 8361601 - DNA, 22 bp, Homo sapiens
aaaggttaatgttgtcatgtta

SEQ ID NO: 8361602 - DNA, 22 bp, Homo sapiens
aaagtacatagcatattccaac

SEQ ID NO: 8361603 - DNA, 22 bp, Homo sapiens
aaagtcatcatttcttttcaaa

SEQ ID NO: 8361604 - DNA, 22 bp, Homo sapiens
aaagtcagttggccagatcact

SEQ ID NO: 8361605 - DNA, 22 bp, Homo sapiens
aaagcagggtccaaggagatgt

SEQ ID NO: 8361606 - DNA, 22 bp, Homo sapiens
aaagcagggtccaaggagatgt

SEQ ID NO: 8361607 - DNA, 22 bp, Homo sapiens
aaagcagggatgaggctagagg

SEQ ID NO: 8361608 - DNA, 22 bp, Homo sapiens
aaagcagggatgaggctagagg

SEQ ID NO: 8361609 - DNA, 22 bp, Homo sapiens
aaagcaggcagcaggctggatt

SEQ ID NO: 8361610 - DNA, 22 bp, Homo sapiens
aaagcagctgctctggccttga

SEQ ID NO: 8361611 - DNA, 22 bp, Homo sapiens
aaagcagctgtttgactttcca

SEQ ID NO: 8361612 - DNA, 22 bp, Homo sapiens
aaagcagcggtgtctttactgc

SEQ ID NO: 8361613 - DNA, 21 bp, Homo sapiens
aaaatgtagacttttccctga

SEQ ID NO: 8361614 - DNA, 22 bp, Homo sapiens
aaagcaatggatgagaatctgt

SEQ ID NO: 8361615 - DNA, 22 bp, Homo sapiens
aaaatgtaaagcttgagtgtag

SEQ ID NO: 8361616 - DNA, 22 bp, Homo sapiens
aaaatggtctcagctggcacca

SEQ ID NO: 8361617 - DNA, 22 bp, Homo sapiens
aaaatggctgtggtctggcaag

SEQ ID NO: 8361618 - DNA, 18 bp, Homo sapiens
aaaatgcaggcgacatgg

SEQ ID NO: 8361619 - DNA, 20 bp, Homo sapiens
aaaatgatgggcagggcagg

SEQ ID NO: 8361620 - DNA, 22 bp, Homo sapiens
aaaatgaggaacggatcatggc

SEQ ID NO: 8361621 - DNA, 22 bp, Homo sapiens
aaaatgatatcctgacttttat

SEQ ID NO: 8361622 - DNA, 19 bp, Homo sapiens
aaaaggaatattctttggg

SEQ ID NO: 8361623 - DNA, 22 bp, Homo sapiens
aaaagtattttgagcactttat

SEQ ID NO: 8361624 - DNA, 22 bp, Homo sapiens
aaaagtgttcaggaagaataat

SEQ ID NO: 8361625 - DNA, 22 bp, Homo sapiens
aaaagtgtccagattatgaaga

SEQ ID NO: 8361626 - DNA, 22 bp, Homo sapiens
aaaagctctttctgctgtagat

SEQ ID NO: 8361627 - DNA, 21 bp, Homo sapiens
aaaaggaaggtctgtttgggg

SEQ ID NO: 8361628 - DNA, 19 bp, Homo sapiens
aaaaggaatattctttggg

SEQ ID NO: 8361629 - DNA, 22 bp, Homo sapiens
aaaagtttaagactcattctag

SEQ ID NO: 8361630 - DNA, 22 bp, Homo sapiens
aaaagtttaagactcattctag

SEQ ID NO: 8361631 - DNA, 22 bp, Homo sapiens
aaaagttccctggttagaaaag

SEQ ID NO: 8361632 - DNA, 22 bp, Homo sapiens
aaaagttacctctgtaatataa

SEQ ID NO: 8361633 - DNA, 22 bp, Homo sapiens
aaaagttagctattagtaggtg

SEQ ID NO: 8361634 - DNA, 22 bp, Homo sapiens
aaaagttacctctgtaatataa

SEQ ID NO: 8361635 - DNA, 18 bp, Homo sapiens
aaaataacaaagttggct

SEQ ID NO: 8361636 - DNA, 22 bp, Homo sapiens
aaaagtttgtgcaaacactcag

SEQ ID NO: 8361637 - DNA, 22 bp, Homo sapiens
aaaataacttctactatttgca

SEQ ID NO: 8361638 - DNA, 22 bp, Homo sapiens
aaaataacttctactatttgca

SEQ ID NO: 8361639 - DNA, 22 bp, Homo sapiens
aaaatacacatactaggggaaa

SEQ ID NO: 8361640 - DNA, 22 bp, Homo sapiens
aaaatgagacacatgtgactcc

SEQ ID NO: 8361641 - DNA, 22 bp, Homo sapiens
aaaatgagcatattgatccttt

SEQ ID NO: 8361642 - DNA, 22 bp, Homo sapiens
aaaatactactgtcttcttccc

SEQ ID NO: 8361643 - DNA, 22 bp, Homo sapiens
aaaatactactgtcttcttccc

SEQ ID NO: 8361644 - DNA, 22 bp, Homo sapiens
aaaatactactgtcttcttccc

SEQ ID NO: 8361645 - DNA, 22 bp, Homo sapiens
aaaagagccacttatgacctca

SEQ ID NO: 8361646 - DNA, 22 bp, Homo sapiens
aaaacagacagccagtgtagag

SEQ ID NO: 8361647 - DNA, 22 bp, Homo sapiens
aaaacagaggtgcctgggccca

SEQ ID NO: 8361648 - DNA, 22 bp, Homo sapiens
aaaacagaggtgcctgggccca

SEQ ID NO: 8361649 - DNA, 22 bp, Homo sapiens
aaaacacaagaagcagggtaca

SEQ ID NO: 8361650 - DNA, 22 bp, Homo sapiens
aaaacactgcaaagctgattgg

SEQ ID NO: 8361651 - DNA, 22 bp, Homo sapiens
aaaacacactggaccaatttaa

SEQ ID NO: 8361652 - DNA, 22 bp, Homo sapiens
aaaagcaagttgcctaggttga

SEQ ID NO: 8361653 - DNA, 22 bp, Homo sapiens
aaaagcagagactctggagcta

SEQ ID NO: 8361654 - DNA, 22 bp, Homo sapiens
aaaagcagaccacgctttgtgg

SEQ ID NO: 8361655 - DNA, 22 bp, Homo sapiens
aaaagcactacaatttcgcttc

SEQ ID NO: 8361656 - DNA, 22 bp, Homo sapiens
aaaagcagagactctggagcta

SEQ ID NO: 8361657 - DNA, 22 bp, Homo sapiens
aaaagccaaggtcctcttcaga

SEQ ID NO: 8361658 - DNA, 22 bp, Homo sapiens
aaaagccaaggtcctcttcaga

SEQ ID NO: 8361659 - DNA, 22 bp, Homo sapiens
aaaagcagttatctgggaggaa

SEQ ID NO: 8361660 - DNA, 20 bp, Homo sapiens
aaaagcagccagagatggta

SEQ ID NO: 8361661 - DNA, 22 bp, Homo sapiens
aaaagcaggtactcagcttggg

SEQ ID NO: 8361662 - DNA, 22 bp, Homo sapiens
aaaagagtcttaggcagtcata

SEQ ID NO: 8361663 - DNA, 22 bp, Homo sapiens
aaaagagtgactgataagtata

SEQ ID NO: 8361664 - DNA, 22 bp, Homo sapiens
aaaagagtgactgataagtata

SEQ ID NO: 8361665 - DNA, 22 bp, Homo sapiens
aaaaccacaatgacttttgcag

SEQ ID NO: 8361666 - DNA, 22 bp, Homo sapiens
aaaaccacaatgacttttgcac

SEQ ID NO: 8361667 - DNA, 22 bp, Homo sapiens
aaaaccacagttacttttgcac

SEQ ID NO: 8361668 - DNA, 22 bp, Homo sapiens
aaaaccacaattacttttgcac

SEQ ID NO: 8361669 - DNA, 22 bp, Homo sapiens
aaaaccacttccttgctattgg

SEQ ID NO: 8361670 - DNA, 22 bp, Homo sapiens
aaaacattttactgccatctca

SEQ ID NO: 8361671 - DNA, 22 bp, Homo sapiens
aaaacattttactgccatctca

SEQ ID NO: 8361672 - DNA, 22 bp, Homo sapiens
aaaacattgaattgcacactat

SEQ ID NO: 8361673 - DNA, 22 bp, Homo sapiens
aaaacattttactgccatctca

SEQ ID NO: 8361674 - DNA, 22 bp, Homo sapiens
aaaacattctgtgaactctcaa

SEQ ID NO: 8361675 - DNA, 22 bp, Homo sapiens
aaaagcaagttgcctaggttga

SEQ ID NO: 8361676 - DNA, 22 bp, Homo sapiens
aaaagagtgtttcaactttggc

SEQ ID NO: 8361677 - DNA, 22 bp, Homo sapiens
aaaaatctatgactgcttctcc

SEQ ID NO: 8361678 - DNA, 22 bp, Homo sapiens
aaaaatgtgaccacagggtgtt

SEQ ID NO: 8361679 - DNA, 22 bp, Homo sapiens
aaaaatgttatctactgtccga

SEQ ID NO: 8361680 - DNA, 22 bp, Homo sapiens
aaaaatgttatctactgtccga

SEQ ID NO: 8361681 - DNA, 22 bp, Homo sapiens
aaaaatttatggttcttctctg

SEQ ID NO: 8361682 - DNA, 22 bp, Homo sapiens
aaaaatttatggttcttctctg

SEQ ID NO: 8361683 - DNA, 22 bp, Homo sapiens
aaaaatttatggttcttctctg

SEQ ID NO: 8361684 - DNA, 22 bp, Homo sapiens
aaaaatttatggttcttctctg

SEQ ID NO: 8361685 - DNA, 22 bp, Homo sapiens
aacatgaagttttctatagtga

SEQ ID NO: 8361686 - DNA, 22 bp, Homo sapiens
aacatgatgtgaagcatgaact

SEQ ID NO: 8361687 - DNA, 22 bp, Homo sapiens
aacatgattggaaaatgctgtc

SEQ ID NO: 8361688 - DNA, 22 bp, Homo sapiens
aacatgatttagtataatgcag

SEQ ID NO: 8361689 - DNA, 22 bp, Homo sapiens
aacatgatttagtataatgcag

SEQ ID NO: 8361690 - DNA, 22 bp, Homo sapiens
aaaggcttctttgctccatgtc

SEQ ID NO: 8361691 - DNA, 22 bp, Homo sapiens
aaaggctttaaaatgtacatat

SEQ ID NO: 8361692 - DNA, 22 bp, Homo sapiens
aaagggaaaatatttagacata

SEQ ID NO: 8361693 - DNA, 22 bp, Homo sapiens
aaagggaactctaattatcttc

SEQ ID NO: 8361694 - DNA, 22 bp, Homo sapiens
aaagggaactctaattatcttc

SEQ ID NO: 8361695 - DNA, 22 bp, Homo sapiens
aaagggaagttgcacatgttcc

SEQ ID NO: 8361696 - DNA, 22 bp, Homo sapiens
aaagggaatgtgtaggacatgt

SEQ ID NO: 8361697 - DNA, 22 bp, Homo sapiens
aaagggagcatggctgcaggga

SEQ ID NO: 8361698 - DNA, 22 bp, Homo sapiens
aacttccagctttctgtctaat

SEQ ID NO: 8361699 - DNA, 22 bp, Homo sapiens
aacttccaccaaatagtatata

SEQ ID NO: 8361700 - DNA, 22 bp, Homo sapiens
aacttgaaaacctcatgaattg

SEQ ID NO: 8361701 - DNA, 22 bp, Homo sapiens
aacttctgacctcaagaactgt

SEQ ID NO: 8361702 - DNA, 22 bp, Homo sapiens
aaagcatagttcatctgtccat

SEQ ID NO: 8361703 - DNA, 22 bp, Homo sapiens
aaagcatagaattagagttagg

SEQ ID NO: 8361704 - DNA, 22 bp, Homo sapiens
aaagcatattaggactgaatta

SEQ ID NO: 8361705 - DNA, 22 bp, Homo sapiens
aaagcatgtgaatagaatatgg

SEQ ID NO: 8361706 - DNA, 22 bp, Homo sapiens
aaagcatgactcaagaattact

SEQ ID NO: 8361707 - DNA, 22 bp, Homo sapiens
aaaggaagtgccactcttcttc

SEQ ID NO: 8361708 - DNA, 22 bp, Homo sapiens
aaagccaaatgaaagatggttc

SEQ ID NO: 8361709 - DNA, 22 bp, Homo sapiens
aaagccaaatgaaagatggttc

SEQ ID NO: 8361710 - DNA, 22 bp, Homo sapiens
aaagcattgtttcaagattaac

SEQ ID NO: 8361711 - DNA, 22 bp, Homo sapiens
aaagcatttcatgtctagaaag

SEQ ID NO: 8361712 - DNA, 20 bp, Homo sapiens
aaagcatttacttgtgattg

SEQ ID NO: 8361713 - DNA, 22 bp, Homo sapiens
aaaggataaggttatcaatttt

SEQ ID NO: 8361714 - DNA, 22 bp, Homo sapiens
aaaggaggccacatggctagga

SEQ ID NO: 8361715 - DNA, 22 bp, Homo sapiens
aaaggaatattcaaaacagtca

SEQ ID NO: 8361716 - DNA, 22 bp, Homo sapiens
aaaggattagagataccatgcc

SEQ ID NO: 8361717 - DNA, 22 bp, Homo sapiens
aaaggcaagcatttatatagga

SEQ ID NO: 8361718 - DNA, 22 bp, Homo sapiens
aaaggcaaaggctggtatggct

SEQ ID NO: 8361719 - DNA, 22 bp, Homo sapiens
aacatgaaagttgctaagtgca

SEQ ID NO: 8361720 - DNA, 22 bp, Homo sapiens
aaaggcagagtgctcagctggc

SEQ ID NO: 8361721 - DNA, 22 bp, Homo sapiens
aacatgaaacccaaacagaata

SEQ ID NO: 8361722 - DNA, 22 bp, Homo sapiens
aaaggcactagaagttaccttt

SEQ ID NO: 8361723 - DNA, 23 bp, Homo sapiens
aaaggcacagcattgtctagcag

SEQ ID NO: 8361724 - DNA, 22 bp, Homo sapiens
aaaggcagagtgctcagctggc

SEQ ID NO: 8361725 - DNA, 22 bp, Homo sapiens
aaaggcactgatcttatccagt

SEQ ID NO: 8361726 - DNA, 22 bp, Homo sapiens
aaagcagcaagtatttgttact

SEQ ID NO: 8361727 - DNA, 22 bp, Homo sapiens
aaattgtctctattttgattcg

SEQ ID NO: 8361728 - DNA, 22 bp, Homo sapiens
aaattgtaggatcacatgacct

SEQ ID NO: 8361729 - DNA, 22 bp, Homo sapiens
aaattgtaatgacttcacttga

SEQ ID NO: 8361730 - DNA, 22 bp, Homo sapiens
aaattgtaatgacttcacttga

SEQ ID NO: 8361731 - DNA, 22 bp, Homo sapiens
aaagcaggttatgaccatggcc

SEQ ID NO: 8361732 - DNA, 22 bp, Homo sapiens
aaagcaggttatgaccatggcc

SEQ ID NO: 8361733 - DNA, 22 bp, Homo sapiens
aaagcagtgcaccttaattgat

SEQ ID NO: 8361734 - DNA, 22 bp, Homo sapiens
aaagcagtctgttttaacctga

SEQ ID NO: 8361735 - DNA, 22 bp, Homo sapiens
aaattccagcaacaccttttta

SEQ ID NO: 8361736 - DNA, 22 bp, Homo sapiens
aaattccagttcttttacctgc

SEQ ID NO: 8361737 - DNA, 22 bp, Homo sapiens
aaattccattatgataatttcg

SEQ ID NO: 8361738 - DNA, 22 bp, Homo sapiens
aaattccattatgataatttcg

SEQ ID NO: 8361739 - DNA, 22 bp, Homo sapiens
aaattagatcagtggattttct

SEQ ID NO: 8361740 - DNA, 22 bp, Homo sapiens
aaattcatttttcttagtgtgc

SEQ ID NO: 8361741 - DNA, 22 bp, Homo sapiens
aaattccaccagaatcagtaat

SEQ ID NO: 8361742 - DNA, 22 bp, Homo sapiens
aaattcatttttcttagtgtgc

SEQ ID NO: 8361743 - DNA, 22 bp, Homo sapiens
aaattcatttttcttagtgtgc

SEQ ID NO: 8361744 - DNA, 22 bp, Homo sapiens
aaattcatttttcttagtgtgc

SEQ ID NO: 8361745 - DNA, 22 bp, Homo sapiens
aaattcatatgttgaaatgcta

SEQ ID NO: 8361746 - DNA, 22 bp, Homo sapiens
aaattcatatgttgaaatgcta

SEQ ID NO: 8361747 - DNA, 22 bp, Homo sapiens
aaagttgactactaaggaatgt

SEQ ID NO: 8361748 - DNA, 22 bp, Homo sapiens
aagaagcatggctgtagattcc

SEQ ID NO: 8361749 - DNA, 22 bp, Homo sapiens
aaatacagattcttgtgtctat

SEQ ID NO: 8361750 - DNA, 19 bp, Homo sapiens
aaatacagcagctgtttcc

SEQ ID NO: 8361751 - DNA, 22 bp, Homo sapiens
aaatacagcagactcctgttgt

SEQ ID NO: 8361752 - DNA, 22 bp, Homo sapiens
aaatacaaaaattagccaggca

SEQ ID NO: 8361753 - DNA, 22 bp, Homo sapiens
aaatataccagttgcctgcatc

SEQ ID NO: 8361754 - DNA, 22 bp, Homo sapiens
aaatatagcaattatgcctact

SEQ ID NO: 8361755 - DNA, 22 bp, Homo sapiens
aaatatagcaattatgcctact

SEQ ID NO: 8361756 - DNA, 22 bp, Homo sapiens
aaatatagtaaatgcatagttc

SEQ ID NO: 8361757 - DNA, 22 bp, Homo sapiens
aaatagtcctgggaatagtact

SEQ ID NO: 8361758 - DNA, 22 bp, Homo sapiens
aagagagagcattcttctgtta

SEQ ID NO: 8361759 - DNA, 22 bp, Homo sapiens
aagagagagtgcgctcacagaa

SEQ ID NO: 8361760 - DNA, 22 bp, Homo sapiens
aagagagacaataggtagcatt

SEQ ID NO: 8361761 - DNA, 22 bp, Homo sapiens
aagagagacaataggtagcatt

SEQ ID NO: 8361762 - DNA, 22 bp, Homo sapiens
aagagagaagtctctctggttc

SEQ ID NO: 8361763 - DNA, 22 bp, Homo sapiens
aaatatagtgacacttatagtc

SEQ ID NO: 8361764 - DNA, 22 bp, Homo sapiens
aaatatagtaaatgcatagttc

SEQ ID NO: 8361765 - DNA, 22 bp, Homo sapiens
aagagtttcttactggcatcta

SEQ ID NO: 8361766 - DNA, 22 bp, Homo sapiens
aagagtttccatgctctgtgct

SEQ ID NO: 8361767 - DNA, 22 bp, Homo sapiens
aagagttttctctgatggcatt

SEQ ID NO: 8361768 - DNA, 22 bp, Homo sapiens
aagagtttttaatgggtactgg

SEQ ID NO: 8361769 - DNA, 22 bp, Homo sapiens
aagagtttttggagtgtgagtt

SEQ ID NO: 8361770 - DNA, 22 bp, Homo sapiens
aaatatgagatgttctctttcg

SEQ ID NO: 8361771 - DNA, 22 bp, Homo sapiens
aagagttttagacaaactgatt

SEQ ID NO: 8361772 - DNA, 22 bp, Homo sapiens
aagagtttgtcagatctgcacg

SEQ ID NO: 8361773 - DNA, 22 bp, Homo sapiens
aagagtttctttattaaccttt

SEQ ID NO: 8361774 - DNA, 22 bp, Homo sapiens
aaatgcttgtaaattttccatg

SEQ ID NO: 8361775 - DNA, 22 bp, Homo sapiens
aaatgcttgtaaattttccatg

SEQ ID NO: 8361776 - DNA, 22 bp, Homo sapiens
aaatgcttgcaacatcccaggt

SEQ ID NO: 8361777 - DNA, 22 bp, Homo sapiens
aaatgcttagaggtgttcaaat

SEQ ID NO: 8361778 - DNA, 22 bp, Homo sapiens
aaatgcttattagtgtcacaaa

SEQ ID NO: 8361779 - DNA, 22 bp, Homo sapiens
aaatgcttagaggtgttcaaat

SEQ ID NO: 8361780 - DNA, 22 bp, Homo sapiens
aaatgctgagtgtttagagatc

SEQ ID NO: 8361781 - DNA, 18 bp, Homo sapiens
aaatgctgctcaaattcc

SEQ ID NO: 8361782 - DNA, 22 bp, Homo sapiens
aaatgattgtcaaagttctgtt

SEQ ID NO: 8361783 - DNA, 22 bp, Homo sapiens
aaatcaaggagggattatattt

SEQ ID NO: 8361784 - DNA, 22 bp, Homo sapiens
aaatcagaaaatatggagagga

SEQ ID NO: 8361785 - DNA, 22 bp, Homo sapiens
aaatattgttttggtaagcttc

SEQ ID NO: 8361786 - DNA, 22 bp, Homo sapiens
aaatattggtaggatgcttgtt

SEQ ID NO: 8361787 - DNA, 22 bp, Homo sapiens
aaatattggtaggatgcttgtt

SEQ ID NO: 8361788 - DNA, 23 bp, Homo sapiens
aaatattcttttttagtaagtgc

SEQ ID NO: 8361789 - DNA, 23 bp, Homo sapiens
aaatattcttttttagtaagtgc

SEQ ID NO: 8361790 - DNA, 23 bp, Homo sapiens
aaatattcttttttagtaagtgc

SEQ ID NO: 8361791 - DNA, 22 bp, Homo sapiens
aaatatttgtctgaggcggttg

SEQ ID NO: 8361792 - DNA, 22 bp, Homo sapiens
aaatcagacacagtgaaagtta

SEQ ID NO: 8361793 - DNA, 22 bp, Homo sapiens
aaatcagacttgaattttcatc

SEQ ID NO: 8361794 - DNA, 22 bp, Homo sapiens
aaatcagagtctgattttaagg

SEQ ID NO: 8361795 - DNA, 23 bp, Homo sapiens
aaatgactaaatgttcttataga

SEQ ID NO: 8361796 - DNA, 22 bp, Homo sapiens
aaatgatcatgtaatttcagaa

SEQ ID NO: 8361797 - DNA, 22 bp, Homo sapiens
agccagctggagaccactgttt

SEQ ID NO: 8361798 - DNA, 22 bp, Homo sapiens
agccagctgctcgggggaaaca

SEQ ID NO: 8361799 - DNA, 22 bp, Homo sapiens
agccagaggtcatgagcacagg

SEQ ID NO: 8361800 - DNA, 22 bp, Homo sapiens
agccagaggtcatgagcacagg

SEQ ID NO: 8361801 - DNA, 22 bp, Homo sapiens
agccagctgtactgcctgctca

SEQ ID NO: 8361802 - DNA, 22 bp, Homo sapiens
agccagctggtgggtcagctgg

SEQ ID NO: 8361803 - DNA, 22 bp, Homo sapiens
agccagctgtactgcctgctca

SEQ ID NO: 8361804 - DNA, 22 bp, Homo sapiens
agccagctgtcctccctttcct

SEQ ID NO: 8361805 - DNA, 22 bp, Homo sapiens
agccagctgtggctatggctcc

SEQ ID NO: 8361806 - DNA, 22 bp, Homo sapiens
agccagctgttctggggcagca

SEQ ID NO: 8361807 - DNA, 22 bp, Homo sapiens
agccaggaaccagctacagtct

SEQ ID NO: 8361808 - DNA, 22 bp, Homo sapiens
agccagctttcacaaatgaaga

SEQ ID NO: 8361809 - DNA, 22 bp, Homo sapiens
agccagcttctttacggtggca

SEQ ID NO: 8361810 - DNA, 22 bp, Homo sapiens
agccaggaagagaggcctcacc

SEQ ID NO: 8361811 - DNA, 22 bp, Homo sapiens
agccaggaagagaggcctcacc

SEQ ID NO: 8361812 - DNA, 22 bp, Homo sapiens
agccagagattgagatgcaggc

SEQ ID NO: 8361813 - DNA, 22 bp, Homo sapiens
acacttaacttctgagaataaa

SEQ ID NO: 8361814 - DNA, 22 bp, Homo sapiens
acacttaagcatgaagtataaa

SEQ ID NO: 8361815 - DNA, 22 bp, Homo sapiens
acactgttttagggaagaaaat

SEQ ID NO: 8361816 - DNA, 22 bp, Homo sapiens
acactgttctttgcactgagaa

SEQ ID NO: 8361817 - DNA, 22 bp, Homo sapiens
acacttcaaagggtgacttgat

SEQ ID NO: 8361818 - DNA, 22 bp, Homo sapiens
acacttaatcttactgaggatc

SEQ ID NO: 8361819 - DNA, 20 bp, Homo sapiens
acactgttcttcacacattt

SEQ ID NO: 8361820 - DNA, 22 bp, Homo sapiens
acactgttgctggcacagacag

SEQ ID NO: 8361821 - DNA, 22 bp, Homo sapiens
acacccagctgggccacctcca

SEQ ID NO: 8361822 - DNA, 22 bp, Homo sapiens
acacccagctgggccacctcca

SEQ ID NO: 8361823 - DNA, 22 bp, Homo sapiens
agccaaggagtgcaggtggctt

SEQ ID NO: 8361824 - DNA, 22 bp, Homo sapiens
agccaaggcagctagagctctg

SEQ ID NO: 8361825 - DNA, 22 bp, Homo sapiens
agccaaggcagctagagctctg

SEQ ID NO: 8361826 - DNA, 22 bp, Homo sapiens
agccaagggtcagctgcacaga

SEQ ID NO: 8361827 - DNA, 22 bp, Homo sapiens
agccaaggtatcatgagaggca

SEQ ID NO: 8361828 - DNA, 22 bp, Homo sapiens
acacccagagcgccagtgccga

SEQ ID NO: 8361829 - DNA, 22 bp, Homo sapiens
agcaggtgtcactttcactcca

SEQ ID NO: 8361830 - DNA, 22 bp, Homo sapiens
agcaggtgtcactttcactcca

SEQ ID NO: 8361831 - DNA, 22 bp, Homo sapiens
acaccagtttcttaagaatatt

SEQ ID NO: 8361832 - DNA, 22 bp, Homo sapiens
acaccatactcatgttggttcc

SEQ ID NO: 8361833 - DNA, 22 bp, Homo sapiens
acaccatactcatgttggttcc

SEQ ID NO: 8361834 - DNA, 22 bp, Homo sapiens
agcaggtggtaggcagtcagca

SEQ ID NO: 8361835 - DNA, 22 bp, Homo sapiens
agcaggtggtaggcagtcagca

SEQ ID NO: 8361836 - DNA, 21 bp, Homo sapiens
agcaggtgtaaaggaggaaat

SEQ ID NO: 8361837 - DNA, 22 bp, Homo sapiens
acacagttcttagcaggtgtct

SEQ ID NO: 8361838 - DNA, 22 bp, Homo sapiens
acacagttcaggatcaaatagc

SEQ ID NO: 8361839 - DNA, 22 bp, Homo sapiens
acacagttggtggctcagtctg

SEQ ID NO: 8361840 - DNA, 22 bp, Homo sapiens
acacagttctttcactgttggt

SEQ ID NO: 8361841 - DNA, 22 bp, Homo sapiens
acacagttgattgtcactcagg

SEQ ID NO: 8361842 - DNA, 22 bp, Homo sapiens
agcagggaagcctccagaacct

SEQ ID NO: 8361843 - DNA, 21 bp, Homo sapiens
agcaggctttggagtggggct

SEQ ID NO: 8361844 - DNA, 22 bp, Homo sapiens
agcaggctttccacagaaggag

SEQ ID NO: 8361845 - DNA, 22 bp, Homo sapiens
acacataagaaactacaaagag

SEQ ID NO: 8361846 - DNA, 22 bp, Homo sapiens
agcaggcttggtccccagcctc

SEQ ID NO: 8361847 - DNA, 22 bp, Homo sapiens
acacatcatgccaagtttcacc

SEQ ID NO: 8361848 - DNA, 22 bp, Homo sapiens
agcaggtgagcacagccaggct

SEQ ID NO: 8361849 - DNA, 22 bp, Homo sapiens
acacatctatctctacacaagg

SEQ ID NO: 8361850 - DNA, 22 bp, Homo sapiens
acacatctcaggggacactctc

SEQ ID NO: 8361851 - DNA, 22 bp, Homo sapiens
acacatctatctctacacaagg

SEQ ID NO: 8361852 - DNA, 22 bp, Homo sapiens
acacatctatattgcatctgca

SEQ ID NO: 8361853 - DNA, 22 bp, Homo sapiens
acacatcatgccaagtttcacc

SEQ ID NO: 8361854 - DNA, 22 bp, Homo sapiens
acacatatgtcattgaaaaatc

SEQ ID NO: 8361855 - DNA, 22 bp, Homo sapiens
agcagggactgagccagtggga

SEQ ID NO: 8361856 - DNA, 22 bp, Homo sapiens
agcagggactacgtgaaagtga

SEQ ID NO: 8361857 - DNA, 22 bp, Homo sapiens
agcagggactgagccagtggga

SEQ ID NO: 8361858 - DNA, 19 bp, Homo sapiens
agcagggacatggaacttt

SEQ ID NO: 8361859 - DNA, 19 bp, Homo sapiens
acacagggctagagttaca

SEQ ID NO: 8361860 - DNA, 22 bp, Homo sapiens
acacagggcggaaagcatgaga

SEQ ID NO: 8361861 - DNA, 19 bp, Homo sapiens
acacagggctagagttaca

SEQ ID NO: 8361862 - DNA, 20 bp, Homo sapiens
acacagtgacaggaaagaga

SEQ ID NO: 8361863 - DNA, 20 bp, Homo sapiens
acacagtgacaggaaagaga

SEQ ID NO: 8361864 - DNA, 22 bp, Homo sapiens
acacagtggtgtttacaaaatt

SEQ ID NO: 8361865 - DNA, 22 bp, Homo sapiens
acacaatttcataaacaccatg

SEQ ID NO: 8361866 - DNA, 22 bp, Homo sapiens
acacaatttcctgtccatatgt

SEQ ID NO: 8361867 - DNA, 22 bp, Homo sapiens
acacacaaatctattagtgaat

SEQ ID NO: 8361868 - DNA, 22 bp, Homo sapiens
acacacaactcattgtgtaata

SEQ ID NO: 8361869 - DNA, 22 bp, Homo sapiens
acacaatttcataaacaccatg

SEQ ID NO: 8361870 - DNA, 22 bp, Homo sapiens
acacaatgtcatcataatgtca

SEQ ID NO: 8361871 - DNA, 19 bp, Homo sapiens
acacaatgacacatatata

SEQ ID NO: 8361872 - DNA, 22 bp, Homo sapiens
acacaagattgtgtattgaatt

SEQ ID NO: 8361873 - DNA, 22 bp, Homo sapiens
acagcagcgtgaagtgtgttat

SEQ ID NO: 8361874 - DNA, 21 bp, Homo sapiens
agctgaggtaaggcaagagag

SEQ ID NO: 8361875 - DNA, 22 bp, Homo sapiens
agctgagttaattcatcactta

SEQ ID NO: 8361876 - DNA, 22 bp, Homo sapiens
acagcaggcatgaatgacactg

SEQ ID NO: 8361877 - DNA, 21 bp, Homo sapiens
agctgaggtaaggcaagagag

SEQ ID NO: 8361878 - DNA, 22 bp, Homo sapiens
acagcaggcccatactggaagg

SEQ ID NO: 8361879 - DNA, 22 bp, Homo sapiens
acagcaggcccatactggaagg

SEQ ID NO: 8361880 - DNA, 17 bp, Homo sapiens
acagcaggcccggaggg

SEQ ID NO: 8361881 - DNA, 17 bp, Homo sapiens
acagcaggcccggaggg

SEQ ID NO: 8361882 - DNA, 17 bp, Homo sapiens
acagcagggaagtgttg

SEQ ID NO: 8361883 - DNA, 17 bp, Homo sapiens
acagcagggaagtgttg

SEQ ID NO: 8361884 - DNA, 22 bp, Homo sapiens
acagcagggaatatgggaattg

SEQ ID NO: 8361885 - DNA, 19 bp, Homo sapiens
acagcagggatttttggag

SEQ ID NO: 8361886 - DNA, 22 bp, Homo sapiens
acagcagggaatatgggaattg

SEQ ID NO: 8361887 - DNA, 22 bp, Homo sapiens
acagcagggaatatgggaattg

SEQ ID NO: 8361888 - DNA, 18 bp, Homo sapiens
acagcaggtttcattctt

SEQ ID NO: 8361889 - DNA, 22 bp, Homo sapiens
acagcaggttttaactttgaag

SEQ ID NO: 8361890 - DNA, 22 bp, Homo sapiens
acagcaggttttaactttgaag

SEQ ID NO: 8361891 - DNA, 18 bp, Homo sapiens
acagcaggtttcattctt

SEQ ID NO: 8361892 - DNA, 22 bp, Homo sapiens
acagcaggttattgttatggca

SEQ ID NO: 8361893 - DNA, 22 bp, Homo sapiens
acagcaggttacagtggcacag

SEQ ID NO: 8361894 - DNA, 22 bp, Homo sapiens
acagcaggttattgttatggca

SEQ ID NO: 8361895 - DNA, 19 bp, Homo sapiens
acagcagggatttttggag

SEQ ID NO: 8361896 - DNA, 21 bp, Homo sapiens
acagcagggctggcatgacag

SEQ ID NO: 8361897 - DNA, 22 bp, Homo sapiens
acagcagcctgcagccctgtgt

SEQ ID NO: 8361898 - DNA, 22 bp, Homo sapiens
acagcagccagccactgtgagc

SEQ ID NO: 8361899 - DNA, 22 bp, Homo sapiens
acagcagcactattgacatttt

SEQ ID NO: 8361900 - DNA, 22 bp, Homo sapiens
acagcagcataaactgactaag

SEQ ID NO: 8361901 - DNA, 22 bp, Homo sapiens
acagcagcaatagcagtgacat

SEQ ID NO: 8361902 - DNA, 22 bp, Homo sapiens
acagcagatttccctgggctcc

SEQ ID NO: 8361903 - DNA, 21 bp, Homo sapiens
acagcagcaatctgtctttcc

SEQ ID NO: 8361904 - DNA, 22 bp, Homo sapiens
acagcagattacattctgctat

SEQ ID NO: 8361905 - DNA, 22 bp, Homo sapiens
acagcagatttccctgggctcc

SEQ ID NO: 8361906 - DNA, 22 bp, Homo sapiens
acagcagatttccctgggctcc

SEQ ID NO: 8361907 - DNA, 22 bp, Homo sapiens
acagcagatttccctgggctcc

SEQ ID NO: 8361908 - DNA, 22 bp, Homo sapiens
acagcagatgacaactatttat

SEQ ID NO: 8361909 - DNA, 22 bp, Homo sapiens
acagcagagtgtgagatagcca

SEQ ID NO: 8361910 - DNA, 22 bp, Homo sapiens
agcgtgaattagttggtacaca

SEQ ID NO: 8361911 - DNA, 22 bp, Homo sapiens
acagataattagcataaatgct

SEQ ID NO: 8361912 - DNA, 22 bp, Homo sapiens
agctaaatgtgaaatgtcaacc

SEQ ID NO: 8361913 - DNA, 22 bp, Homo sapiens
acagaggtaggacatgagatat

SEQ ID NO: 8361914 - DNA, 22 bp, Homo sapiens
acagagggtctgggcacaggac

SEQ ID NO: 8361915 - DNA, 22 bp, Homo sapiens
acagaggccatgagctgccacc

SEQ ID NO: 8361916 - DNA, 22 bp, Homo sapiens
acagaggcagtgtgagatactg

SEQ ID NO: 8361917 - DNA, 17 bp, Homo sapiens
acagaggcaggagtgga

SEQ ID NO: 8361918 - DNA, 22 bp, Homo sapiens
acagaatattggttactgttgc

SEQ ID NO: 8361919 - DNA, 22 bp, Homo sapiens
acagaatattttatttagatca

SEQ ID NO: 8361920 - DNA, 23 bp, Homo sapiens
acagaagccaggagccgctgggc

SEQ ID NO: 8361921 - DNA, 22 bp, Homo sapiens
acagaagtccccatgaagaagc

SEQ ID NO: 8361922 - DNA, 22 bp, Homo sapiens
acagaagctcaagagagcagtg

SEQ ID NO: 8361923 - DNA, 22 bp, Homo sapiens
acagaagctcaagagagcagtg

SEQ ID NO: 8361924 - DNA, 21 bp, Homo sapiens
acagaagtggcttggtctcag

SEQ ID NO: 8361925 - DNA, 22 bp, Homo sapiens
acagaataaggtttatctctcc

SEQ ID NO: 8361926 - DNA, 22 bp, Homo sapiens
acaacagggtaaggcaggccat

SEQ ID NO: 8361927 - DNA, 22 bp, Homo sapiens
acaacagggtaaggcaggccat

SEQ ID NO: 8361928 - DNA, 23 bp, Homo sapiens
acaacaggaaatcagacctgaac

SEQ ID NO: 8361929 - DNA, 22 bp, Homo sapiens
acaacagagctggactgagagg

SEQ ID NO: 8361930 - DNA, 22 bp, Homo sapiens
acaacagtaggaaaacatgtct

SEQ ID NO: 8361931 - DNA, 22 bp, Homo sapiens
agatgctgctccacaggccagg

SEQ ID NO: 8361932 - DNA, 22 bp, Homo sapiens
agatgctgaattattgtgcttt

SEQ ID NO: 8361933 - DNA, 22 bp, Homo sapiens
agatgcagtggttaacaataca

SEQ ID NO: 8361934 - DNA, 22 bp, Homo sapiens
acaaagtttgtggtattccaag

SEQ ID NO: 8361935 - DNA, 20 bp, Homo sapiens
acaaagtattgaggacaagt

SEQ ID NO: 8361936 - DNA, 22 bp, Homo sapiens
aatttggagagagattaatgtt

SEQ ID NO: 8361937 - DNA, 22 bp, Homo sapiens
aatttggagagaaacaagtagg

SEQ ID NO: 8361938 - DNA, 22 bp, Homo sapiens
aatttggaggtatttagctgtc

SEQ ID NO: 8361939 - DNA, 22 bp, Homo sapiens
aatttggagctttgtttctaga

SEQ ID NO: 8361940 - DNA, 21 bp, Homo sapiens
aatttgctaagcaaaggagca

SEQ ID NO: 8361941 - DNA, 22 bp, Homo sapiens
aatttggacttgggtgctagag

SEQ ID NO: 8361942 - DNA, 22 bp, Homo sapiens
aatttggaagatgttgtttatc

SEQ ID NO: 8361943 - DNA, 23 bp, Homo sapiens
aatttggaaatgaggctaccaag

SEQ ID NO: 8361944 - DNA, 22 bp, Homo sapiens
aatttgattttcttaaaccata

SEQ ID NO: 8361945 - DNA, 22 bp, Homo sapiens
aatttgcatgatgagaacaata

SEQ ID NO: 8361946 - DNA, 18 bp, Homo sapiens
aatttctttgacaactta

SEQ ID NO: 8361947 - DNA, 18 bp, Homo sapiens
aatttctttgacaactta

SEQ ID NO: 8361948 - DNA, 18 bp, Homo sapiens
aatttctttgacaactta

SEQ ID NO: 8361949 - DNA, 22 bp, Homo sapiens
aatttcttcagctctaaaatgg

SEQ ID NO: 8361950 - DNA, 22 bp, Homo sapiens
agagtgtttcagtcttcctaga

SEQ ID NO: 8361951 - DNA, 22 bp, Homo sapiens
agagttatggacttaatgcagg

SEQ ID NO: 8361952 - DNA, 22 bp, Homo sapiens
aatttgtatacatgttacattt

SEQ ID NO: 8361953 - DNA, 22 bp, Homo sapiens
aatttgtatacatgttacattt

SEQ ID NO: 8361954 - DNA, 22 bp, Homo sapiens
aatttggcagtgtcttgaagta

SEQ ID NO: 8361955 - DNA, 22 bp, Homo sapiens
aatttgtacaaaatgtttataa

SEQ ID NO: 8361956 - DNA, 22 bp, Homo sapiens
agagtgggttataggcagactt

SEQ ID NO: 8361957 - DNA, 22 bp, Homo sapiens
agagtgggttataggcagactt

SEQ ID NO: 8361958 - DNA, 20 bp, Homo sapiens
agagtgggtgtcacaggctg

SEQ ID NO: 8361959 - DNA, 22 bp, Homo sapiens
agcaaatacatttttagcataa

SEQ ID NO: 8361960 - DNA, 19 bp, Homo sapiens
agcaaatataatagtgttc

SEQ ID NO: 8361961 - DNA, 22 bp, Homo sapiens
acaagtttcattgtttagaacc

SEQ ID NO: 8361962 - DNA, 22 bp, Homo sapiens
acaatactattttcagtatcct

SEQ ID NO: 8361963 - DNA, 22 bp, Homo sapiens
acaatacttaccaatgtttttg

SEQ ID NO: 8361964 - DNA, 22 bp, Homo sapiens
acaacattcttaaatacactga

SEQ ID NO: 8361965 - DNA, 22 bp, Homo sapiens
acaacattcttaaatacactga

SEQ ID NO: 8361966 - DNA, 22 bp, Homo sapiens
agattttgtctcaatacttctg

SEQ ID NO: 8361967 - DNA, 22 bp, Homo sapiens
acaacagtttaggtatttgtag

SEQ ID NO: 8361968 - DNA, 22 bp, Homo sapiens
acaacagtccagtatagactgt

SEQ ID NO: 8361969 - DNA, 22 bp, Homo sapiens
acaacagtccagtatagactgt

SEQ ID NO: 8361970 - DNA, 22 bp, Homo sapiens
acaacattatacatagaaagct

SEQ ID NO: 8361971 - DNA, 22 bp, Homo sapiens
acaacattatacatagaaagct

SEQ ID NO: 8361972 - DNA, 22 bp, Homo sapiens
agcaaataaagacaattatgtc

SEQ ID NO: 8361973 - DNA, 22 bp, Homo sapiens
agcaaataattgtctttgaggg

SEQ ID NO: 8361974 - DNA, 22 bp, Homo sapiens
agcacaggacgtagagcttgga

SEQ ID NO: 8361975 - DNA, 22 bp, Homo sapiens
agcacaggacgtagagcttgga

SEQ ID NO: 8361976 - DNA, 22 bp, Homo sapiens
agcacaggacgtagagcttgga

SEQ ID NO: 8361977 - DNA, 22 bp, Homo sapiens
agcacaggaccaaggaagctgt

SEQ ID NO: 8361978 - DNA, 22 bp, Homo sapiens
agcacaggctttggtgtgaggg

SEQ ID NO: 8361979 - DNA, 22 bp, Homo sapiens
agcacaggctttggtgtgaggg

SEQ ID NO: 8361980 - DNA, 22 bp, Homo sapiens
agcacagggcccagcctaggcc

SEQ ID NO: 8361981 - DNA, 22 bp, Homo sapiens
agcacagggcccagcctaggcc

SEQ ID NO: 8361982 - DNA, 22 bp, Homo sapiens
agcacagggcccagcctaggcc

SEQ ID NO: 8361983 - DNA, 22 bp, Homo sapiens
agcacagggacaatgccaggtg

SEQ ID NO: 8361984 - DNA, 21 bp, Homo sapiens
acacaacaggcagtcattttc

SEQ ID NO: 8361985 - DNA, 22 bp, Homo sapiens
acacaagaagttaatgggcaaa

SEQ ID NO: 8361986 - DNA, 22 bp, Homo sapiens
agcacaggaacatggagatggg

SEQ ID NO: 8361987 - DNA, 22 bp, Homo sapiens
agcacaagtttctggcagacag

SEQ ID NO: 8361988 - DNA, 22 bp, Homo sapiens
agcaaggccgagaggatgctat

SEQ ID NO: 8361989 - DNA, 22 bp, Homo sapiens
agcacacaggacttgattcatg

SEQ ID NO: 8361990 - DNA, 22 bp, Homo sapiens
agagatgaaaagggtactgagg

SEQ ID NO: 8361991 - DNA, 22 bp, Homo sapiens
agagatgaaaagtggagactgg

SEQ ID NO: 8361992 - DNA, 23 bp, Homo sapiens
agagcaaggaaatgaggtgtgat

SEQ ID NO: 8361993 - DNA, 22 bp, Homo sapiens
agagcaaatagagaagccagct

SEQ ID NO: 8361994 - DNA, 22 bp, Homo sapiens
agagcaaagggacatggaagag

SEQ ID NO: 8361995 - DNA, 22 bp, Homo sapiens
agagcaagtgacagaaacaggg

SEQ ID NO: 8361996 - DNA, 23 bp, Homo sapiens
agagcaaggaaatgaggtgtgat

SEQ ID NO: 8361997 - DNA, 22 bp, Homo sapiens
agagcaagtgacagaaacaggg

SEQ ID NO: 8361998 - DNA, 22 bp, Homo sapiens
agagaaattctcagtggaagat

SEQ ID NO: 8361999 - DNA, 22 bp, Homo sapiens
agagaaatggggtaatctttca

SEQ ID NO: 8362000 - DNA, 22 bp, Homo sapiens
agagaaatttccctgccttctg

SEQ ID NO: 8362001 - DNA, 21 bp, Homo sapiens
agagaagggactcttccagtc

SEQ ID NO: 8362002 - DNA, 22 bp, Homo sapiens
agagaagggggaaagatctcac

SEQ ID NO: 8362003 - DNA, 22 bp, Homo sapiens
agagaagggcctgtatgtaatc

SEQ ID NO: 8362004 - DNA, 22 bp, Homo sapiens
agagaaggggtaaagagtcctg

SEQ ID NO: 8362005 - DNA, 22 bp, Homo sapiens
aatgtattatacataatttgtg

SEQ ID NO: 8362006 - DNA, 21 bp, Homo sapiens
aatgtatgtttatctcacagt

SEQ ID NO: 8362007 - DNA, 22 bp, Homo sapiens
aatgtatgtgcatcatttacat

SEQ ID NO: 8362008 - DNA, 22 bp, Homo sapiens
aatgtataatatttaatgcttt

SEQ ID NO: 8362009 - DNA, 22 bp, Homo sapiens
aatgtataatatttaatgcttt

SEQ ID NO: 8362010 - DNA, 22 bp, Homo sapiens
aatgtataaccataggaaattt

SEQ ID NO: 8362011 - DNA, 22 bp, Homo sapiens
agacattatgctgagtgaaaga

SEQ ID NO: 8362012 - DNA, 22 bp, Homo sapiens
aatgccttggagagcctagagg

SEQ ID NO: 8362013 - DNA, 22 bp, Homo sapiens
aatgccttgcctgctacaactt

SEQ ID NO: 8362014 - DNA, 22 bp, Homo sapiens
aatgccttgcctgctacaactt

SEQ ID NO: 8362015 - DNA, 22 bp, Homo sapiens
aatgcctttccactgggtatca

SEQ ID NO: 8362016 - DNA, 22 bp, Homo sapiens
aatgccttggagagcctagagg

SEQ ID NO: 8362017 - DNA, 22 bp, Homo sapiens
aatgctctctgccatagctaac

SEQ ID NO: 8362018 - DNA, 22 bp, Homo sapiens
aatgctctttaacctattctga

SEQ ID NO: 8362019 - DNA, 22 bp, Homo sapiens
aatgctctgtctctgacagtgg

SEQ ID NO: 8362020 - DNA, 22 bp, Homo sapiens
agacatcagcttgtgtgcaggg

SEQ ID NO: 8362021 - DNA, 22 bp, Homo sapiens
agacatcaatgatcagaggtag

SEQ ID NO: 8362022 - DNA, 19 bp, Homo sapiens
agacatgagacacaggatg

SEQ ID NO: 8362023 - DNA, 22 bp, Homo sapiens
aattaattttgttcattcagtc

SEQ ID NO: 8362024 - DNA, 22 bp, Homo sapiens
aattaattttgttcattcagtc

SEQ ID NO: 8362025 - DNA, 22 bp, Homo sapiens
aattacaaatgtagactctcat

SEQ ID NO: 8362026 - DNA, 23 bp, Homo sapiens
aattacaaccaagaactggaagg

SEQ ID NO: 8362027 - DNA, 22 bp, Homo sapiens
aattaatggaaagtaaggaagg

SEQ ID NO: 8362028 - DNA, 22 bp, Homo sapiens
agagcacactgacgtcagtctg

SEQ ID NO: 8362029 - DNA, 22 bp, Homo sapiens
agagcacagaagaataggtgct

SEQ ID NO: 8362030 - DNA, 22 bp, Homo sapiens
agagcacaaattagttggtctt

SEQ ID NO: 8362031 - DNA, 22 bp, Homo sapiens
agagcacaaattttaaggaggc

SEQ ID NO: 8362032 - DNA, 22 bp, Homo sapiens
aattccaaatcaactagtctag

SEQ ID NO: 8362033 - DNA, 22 bp, Homo sapiens
aattcattgccagaatctatga

SEQ ID NO: 8362034 - DNA, 22 bp, Homo sapiens
aattcattgccagaatctatga

SEQ ID NO: 8362035 - DNA, 22 bp, Homo sapiens
aattcatactctatattgcttt

SEQ ID NO: 8362036 - DNA, 22 bp, Homo sapiens
aattcatagcaacaaagaccca

SEQ ID NO: 8362037 - DNA, 22 bp, Homo sapiens
aattcatatggatatgctagta

SEQ ID NO: 8362038 - DNA, 22 bp, Homo sapiens
aattcatagcaacaaagaccca

SEQ ID NO: 8362039 - DNA, 21 bp, Homo sapiens
agaggaagtgattggtctggc

SEQ ID NO: 8362040 - DNA, 22 bp, Homo sapiens
agaggaagtaatcaggacctgc

SEQ ID NO: 8362041 - DNA, 22 bp, Homo sapiens
aattccaacagacaaagttaga

SEQ ID NO: 8362042 - DNA, 22 bp, Homo sapiens
agaggaaggatgcatatccaaa

SEQ ID NO: 8362043 - DNA, 22 bp, Homo sapiens
agagctgggtggtggtgactca

SEQ ID NO: 8362044 - DNA, 22 bp, Homo sapiens
agaggacaaaatgagaagtgct

SEQ ID NO: 8362045 - DNA, 22 bp, Homo sapiens
agaggagtgggaagcagtgcaa

SEQ ID NO: 8362046 - DNA, 22 bp, Homo sapiens
agaggagtttgctggtgtgtgc

SEQ ID NO: 8362047 - DNA, 22 bp, Homo sapiens
aatttccagatcagatgactca

SEQ ID NO: 8362048 - DNA, 18 bp, Homo sapiens
aatttccatatgaattgc

SEQ ID NO: 8362049 - DNA, 18 bp, Homo sapiens
aatttccatatgaattgc

SEQ ID NO: 8362050 - DNA, 22 bp, Homo sapiens
acatgaatgaagactttacaat

SEQ ID NO: 8362051 - DNA, 22 bp, Homo sapiens
acatgaagtggtcagatcaaac

SEQ ID NO: 8362052 - DNA, 22 bp, Homo sapiens
acatctcagaactgagtaaccg

SEQ ID NO: 8362053 - DNA, 22 bp, Homo sapiens
acatctcatgaatgataaatca

SEQ ID NO: 8362054 - DNA, 20 bp, Homo sapiens
acatgaacagggctacagca

SEQ ID NO: 8362055 - DNA, 22 bp, Homo sapiens
acatgaaattctagctgaaccc

SEQ ID NO: 8362056 - DNA, 22 bp, Homo sapiens
acatcctcccgatctactggct

SEQ ID NO: 8362057 - DNA, 22 bp, Homo sapiens
acatcctcccgatctactggct

SEQ ID NO: 8362058 - DNA, 22 bp, Homo sapiens
acatcccatgcgcatctggcaa

SEQ ID NO: 8362059 - DNA, 22 bp, Homo sapiens
acatcccacagaaacatacata

SEQ ID NO: 8362060 - DNA, 22 bp, Homo sapiens
acatcgtgtatcactgaacctt

SEQ ID NO: 8362061 - DNA, 22 bp, Homo sapiens
acatctatgaacatttaagtag

SEQ ID NO: 8362062 - DNA, 22 bp, Homo sapiens
aaggcaatagtattaaactgga

SEQ ID NO: 8362063 - DNA, 22 bp, Homo sapiens
aaggcaagttttagttttctgg

SEQ ID NO: 8362064 - DNA, 22 bp, Homo sapiens
aaggcaatgtaaattacagctt

SEQ ID NO: 8362065 - DNA, 22 bp, Homo sapiens
aaggcaatgttagcaacataat

SEQ ID NO: 8362066 - DNA, 22 bp, Homo sapiens
aaggcaatgactgatttagaat

SEQ ID NO: 8362067 - DNA, 22 bp, Homo sapiens
aaggcaattggcttgtataaga

SEQ ID NO: 8362068 - DNA, 22 bp, Homo sapiens
aaggccagagttgaactgctcc

SEQ ID NO: 8362069 - DNA, 22 bp, Homo sapiens
aaggccagattctctctagggg

SEQ ID NO: 8362070 - DNA, 22 bp, Homo sapiens
aaggccagattctctctagggg

SEQ ID NO: 8362071 - DNA, 22 bp, Homo sapiens
aaggccagccctaatgatgctc

SEQ ID NO: 8362072 - DNA, 22 bp, Homo sapiens
aaggccagccctaatgatgctc

SEQ ID NO: 8362073 - DNA, 22 bp, Homo sapiens
acatccattttgttcaaaagca

SEQ ID NO: 8362074 - DNA, 22 bp, Homo sapiens
aaggccagagtactagaggctg

SEQ ID NO: 8362075 - DNA, 22 bp, Homo sapiens
aaggccagagtactagaggctg

SEQ ID NO: 8362076 - DNA, 22 bp, Homo sapiens
aaggccagagtactagaggctg

SEQ ID NO: 8362077 - DNA, 22 bp, Homo sapiens
aaggccagagcagactggagtt

SEQ ID NO: 8362078 - DNA, 22 bp, Homo sapiens
aaggcaccataggcaaatccag

SEQ ID NO: 8362079 - DNA, 22 bp, Homo sapiens
aagctgtgcaggaactgcttgc

SEQ ID NO: 8362080 - DNA, 22 bp, Homo sapiens
aagctgtgcaggaactgcttgc

SEQ ID NO: 8362081 - DNA, 22 bp, Homo sapiens
aagctgtgaaatctctagtgca

SEQ ID NO: 8362082 - DNA, 22 bp, Homo sapiens
aagctgtgtgcagatgatctca

SEQ ID NO: 8362083 - DNA, 21 bp, Homo sapiens
aagctgtgttccactgatagc

SEQ ID NO: 8362084 - DNA, 22 bp, Homo sapiens
aagctggagagtttcacagatg

SEQ ID NO: 8362085 - DNA, 22 bp, Homo sapiens
aagctggcaaacaagcatcatt

SEQ ID NO: 8362086 - DNA, 23 bp, Homo sapiens
aagcttctatctctgcagaagga

SEQ ID NO: 8362087 - DNA, 22 bp, Homo sapiens
aaggaagaagggaagttactta

SEQ ID NO: 8362088 - DNA, 22 bp, Homo sapiens
aagcttcaatgagataattgtt

SEQ ID NO: 8362089 - DNA, 22 bp, Homo sapiens
aagctgtttttaggtggaggta

SEQ ID NO: 8362090 - DNA, 22 bp, Homo sapiens
aagctgttttggccttagttga

SEQ ID NO: 8362091 - DNA, 22 bp, Homo sapiens
aagctgttaatggcttgcagct

SEQ ID NO: 8362092 - DNA, 22 bp, Homo sapiens
aagctgttagggagtggtaggt

SEQ ID NO: 8362093 - DNA, 22 bp, Homo sapiens
aagctgttatcttctggcggac

SEQ ID NO: 8362094 - DNA, 22 bp, Homo sapiens
aagctgttctccagtgactcag

SEQ ID NO: 8362095 - DNA, 22 bp, Homo sapiens
aaggatctgacagactatagaa

SEQ ID NO: 8362096 - DNA, 22 bp, Homo sapiens
aaggatgaacattaatacatca

SEQ ID NO: 8362097 - DNA, 22 bp, Homo sapiens
aaggatttgtccaaagtcacac

SEQ ID NO: 8362098 - DNA, 22 bp, Homo sapiens
aaggacacctgcagagggacca

SEQ ID NO: 8362099 - DNA, 22 bp, Homo sapiens
aaggaagatgctggcctgggga

SEQ ID NO: 8362100 - DNA, 22 bp, Homo sapiens
aaggaagatgctggcctgggga

SEQ ID NO: 8362101 - DNA, 22 bp, Homo sapiens
aaggaagcagcaatgcatgatt

SEQ ID NO: 8362102 - DNA, 22 bp, Homo sapiens
aaggaagcagcaatgcatgatt

SEQ ID NO: 8362103 - DNA, 19 bp, Homo sapiens
aaggaatggctttaagtag

SEQ ID NO: 8362104 - DNA, 22 bp, Homo sapiens
aaggaatcacttctttaaatga

SEQ ID NO: 8362105 - DNA, 22 bp, Homo sapiens
aaggacaaagcagagctggatg

SEQ ID NO: 8362106 - DNA, 22 bp, Homo sapiens
aaggaattccctttctgacaga

SEQ ID NO: 8362107 - DNA, 19 bp, Homo sapiens
aagggctgggcacctcact

SEQ ID NO: 8362108 - DNA, 22 bp, Homo sapiens
acatttcagtgagctattgaag

SEQ ID NO: 8362109 - DNA, 22 bp, Homo sapiens
acatttcagtgagctattgaag

SEQ ID NO: 8362110 - DNA, 22 bp, Homo sapiens
acatttcagcgtgcatgacatg

SEQ ID NO: 8362111 - DNA, 22 bp, Homo sapiens
acatttcagcgtgcatgacatg

SEQ ID NO: 8362112 - DNA, 22 bp, Homo sapiens
acatttcagtaagtgttaattt

SEQ ID NO: 8362113 - DNA, 20 bp, Homo sapiens
aagggcagagggaacagact

SEQ ID NO: 8362114 - DNA, 22 bp, Homo sapiens
aagggcagagggaatcccacat

SEQ ID NO: 8362115 - DNA, 22 bp, Homo sapiens
acatttcagatgtaatgtgatg

SEQ ID NO: 8362116 - DNA, 22 bp, Homo sapiens
acatttcagatgtaatgtgatg

SEQ ID NO: 8362117 - DNA, 22 bp, Homo sapiens
aagggcagaatagagaagatgg

SEQ ID NO: 8362118 - DNA, 22 bp, Homo sapiens
aagggcagaatagagaagatgg

SEQ ID NO: 8362119 - DNA, 22 bp, Homo sapiens
aagggtggtgtaggagatcaaa

SEQ ID NO: 8362120 - DNA, 22 bp, Homo sapiens
aagggtgggccctggcagccat

SEQ ID NO: 8362121 - DNA, 22 bp, Homo sapiens
aaggtaatccataatagttact

SEQ ID NO: 8362122 - DNA, 22 bp, Homo sapiens
aaggtaatgaaacagcagctaa

SEQ ID NO: 8362123 - DNA, 22 bp, Homo sapiens
aaggtaatcagcctttccacaa

SEQ ID NO: 8362124 - DNA, 22 bp, Homo sapiens
aaggtaatatttttctctctaa

SEQ ID NO: 8362125 - DNA, 22 bp, Homo sapiens
aagggtttgtctccctcaaggc

SEQ ID NO: 8362126 - DNA, 22 bp, Homo sapiens
aaggtacagggtattagattat

SEQ ID NO: 8362127 - DNA, 22 bp, Homo sapiens
aaggtagatgttgtcatgccca

SEQ ID NO: 8362128 - DNA, 22 bp, Homo sapiens
aaggtacaaagtattatttaaa

SEQ ID NO: 8362129 - DNA, 22 bp, Homo sapiens
aaggtacaaagttatacagcgt

SEQ ID NO: 8362130 - DNA, 22 bp, Homo sapiens
accagagcttacatgctagaaa

SEQ ID NO: 8362131 - DNA, 22 bp, Homo sapiens
accagagctggctctgagcacc

SEQ ID NO: 8362132 - DNA, 20 bp, Homo sapiens
accagaggaaagagcagtga

SEQ ID NO: 8362133 - DNA, 22 bp, Homo sapiens
accagagcttacatgctagaaa

SEQ ID NO: 8362134 - DNA, 22 bp, Homo sapiens
accagcaagattttgctttgca

SEQ ID NO: 8362135 - DNA, 22 bp, Homo sapiens
aagggggccacacctggtgtga

SEQ ID NO: 8362136 - DNA, 22 bp, Homo sapiens
aagggggcccagcactaagttg

SEQ ID NO: 8362137 - DNA, 22 bp, Homo sapiens
aagggggcacagtcactgtaat

SEQ ID NO: 8362138 - DNA, 22 bp, Homo sapiens
aaggggaaaaagtgttaggagt

SEQ ID NO: 8362139 - DNA, 22 bp, Homo sapiens
aagggggcgaagacgtgattga

SEQ ID NO: 8362140 - DNA, 22 bp, Homo sapiens
aagggggcggcagccagtggaa

SEQ ID NO: 8362141 - DNA, 22 bp, Homo sapiens
acctctggacactgcatccttc

SEQ ID NO: 8362142 - DNA, 22 bp, Homo sapiens
acctctggcaccccctggcttg

SEQ ID NO: 8362143 - DNA, 22 bp, Homo sapiens
acctctggacactgcatccttc

SEQ ID NO: 8362144 - DNA, 22 bp, Homo sapiens
acctcctggcctcaagcaatcc

SEQ ID NO: 8362145 - DNA, 22 bp, Homo sapiens
acctcctggctgctcatggaac

SEQ ID NO: 8362146 - DNA, 22 bp, Homo sapiens
acctcctggctgctcatggaac

SEQ ID NO: 8362147 - DNA, 22 bp, Homo sapiens
acctcctggtgcccaagtgttt

SEQ ID NO: 8362148 - DNA, 22 bp, Homo sapiens
acctctcaggtcttcctcatat

SEQ ID NO: 8362149 - DNA, 22 bp, Homo sapiens
acctcctggcttatcatggaca

SEQ ID NO: 8362150 - DNA, 22 bp, Homo sapiens
acctcctggcttatcatggaca

SEQ ID NO: 8362151 - DNA, 22 bp, Homo sapiens
acctcctggtgcccaagtgttt

SEQ ID NO: 8362152 - DNA, 22 bp, Homo sapiens
acctatttatgcaattatgaaa

SEQ ID NO: 8362153 - DNA, 20 bp, Homo sapiens
acctcctggaagcaggtgcc

SEQ ID NO: 8362154 - DNA, 22 bp, Homo sapiens
acccaggccattggcaagagtc

SEQ ID NO: 8362155 - DNA, 22 bp, Homo sapiens
acccagggtagaacctcagagc

SEQ ID NO: 8362156 - DNA, 22 bp, Homo sapiens
aaggtggtgcttctgctcctct

SEQ ID NO: 8362157 - DNA, 22 bp, Homo sapiens
aaggtggttgtaggctggtctg

SEQ ID NO: 8362158 - DNA, 22 bp, Homo sapiens
acctctggccaagactcgtgtt

SEQ ID NO: 8362159 - DNA, 22 bp, Homo sapiens
aagtagatgatctttctgcata

SEQ ID NO: 8362160 - DNA, 22 bp, Homo sapiens
aagtaggaatccgaatgagtag

SEQ ID NO: 8362161 - DNA, 22 bp, Homo sapiens
aagtccatgatcaagatgtggc

SEQ ID NO: 8362162 - DNA, 18 bp, Homo sapiens
aagtccatgggtttggga

SEQ ID NO: 8362163 - DNA, 22 bp, Homo sapiens
aagtccatgatcaagatgtggc

SEQ ID NO: 8362164 - DNA, 22 bp, Homo sapiens
aagtccattcttccagccagct

SEQ ID NO: 8362165 - DNA, 22 bp, Homo sapiens
aagtccatagtttgcattaggg

SEQ ID NO: 8362166 - DNA, 22 bp, Homo sapiens
aagtccataggtttcatgaggg

SEQ ID NO: 8362167 - DNA, 22 bp, Homo sapiens
aagtatctcaaaaacagtaatc

SEQ ID NO: 8362168 - DNA, 22 bp, Homo sapiens
aagtccattcttccagccagct

SEQ ID NO: 8362169 - DNA, 22 bp, Homo sapiens
acctgcctatggagccacatgg

SEQ ID NO: 8362170 - DNA, 22 bp, Homo sapiens
acctgcctatcagctgcctgct

SEQ ID NO: 8362171 - DNA, 22 bp, Homo sapiens
acctgcctagttggttctgccc

SEQ ID NO: 8362172 - DNA, 22 bp, Homo sapiens
aagtccttctttatatgagagt

SEQ ID NO: 8362173 - DNA, 22 bp, Homo sapiens
aagtccttgaagaaacagttct

SEQ ID NO: 8362174 - DNA, 18 bp, Homo sapiens
aagtccttcctttgcttt

SEQ ID NO: 8362175 - DNA, 22 bp, Homo sapiens
agaagcagctttcaaggtgatt

SEQ ID NO: 8362176 - DNA, 18 bp, Homo sapiens
agaagccacgaggagtcc

SEQ ID NO: 8362177 - DNA, 22 bp, Homo sapiens
aatgaagaaatggacatcttta

SEQ ID NO: 8362178 - DNA, 22 bp, Homo sapiens
agaacacactgggggaaacaag

SEQ ID NO: 8362179 - DNA, 22 bp, Homo sapiens
agaacaattgccccaaagcttg

SEQ ID NO: 8362180 - DNA, 22 bp, Homo sapiens
agaactgtcacgagtgacaaag

SEQ ID NO: 8362181 - DNA, 21 bp, Homo sapiens
agaactgattaaataagcagt

SEQ ID NO: 8362182 - DNA, 22 bp, Homo sapiens
agaagaaactgtcggggatatt

SEQ ID NO: 8362183 - DNA, 22 bp, Homo sapiens
agaacttttggagacttttagt

SEQ ID NO: 8362184 - DNA, 22 bp, Homo sapiens
agaagaaatgaggccgttctgc

SEQ ID NO: 8362185 - DNA, 22 bp, Homo sapiens
agaagaaagattgaaggttcct

SEQ ID NO: 8362186 - DNA, 22 bp, Homo sapiens
agaaggaaaacctgtcttatgt

SEQ ID NO: 8362187 - DNA, 22 bp, Homo sapiens
agaaggaaacagctgtgctttg

SEQ ID NO: 8362188 - DNA, 22 bp, Homo sapiens
agaaggaaaacctgtcttatgt

SEQ ID NO: 8362189 - DNA, 22 bp, Homo sapiens
agaaggaaaacctgtcttatgt

SEQ ID NO: 8362190 - DNA, 22 bp, Homo sapiens
agaaggaaaacctgtcttatgt

SEQ ID NO: 8362191 - DNA, 22 bp, Homo sapiens
agaagccagccttgcctccttt

SEQ ID NO: 8362192 - DNA, 22 bp, Homo sapiens
agaaggaaggaagcattctgtt

SEQ ID NO: 8362193 - DNA, 22 bp, Homo sapiens
agaaggaaggaagcattctgtt

SEQ ID NO: 8362194 - DNA, 22 bp, Homo sapiens
agaaggaaggataactgcatta

SEQ ID NO: 8362195 - DNA, 22 bp, Homo sapiens
agaaggaaggaagcattctgtt

SEQ ID NO: 8362196 - DNA, 22 bp, Homo sapiens
agaaggaagccaggagggtgca

SEQ ID NO: 8362197 - DNA, 22 bp, Homo sapiens
agaaggaagccaggagggtgca

SEQ ID NO: 8362198 - DNA, 22 bp, Homo sapiens
agaaggaagccaggagggtgca

SEQ ID NO: 8362199 - DNA, 22 bp, Homo sapiens
agaaggaagccaggagggtgca

SEQ ID NO: 8362200 - DNA, 22 bp, Homo sapiens
agaaggaaacagctgtgctttg

SEQ ID NO: 8362201 - DNA, 22 bp, Homo sapiens
agaaggaaggctgagtgctgat

SEQ ID NO: 8362202 - DNA, 22 bp, Homo sapiens
agaaggaaggctgagtgctgat

SEQ ID NO: 8362203 - DNA, 22 bp, Homo sapiens
aatgcattctcggtttgtgtgt

SEQ ID NO: 8362204 - DNA, 22 bp, Homo sapiens
aatgcattccactgagatttgt

SEQ ID NO: 8362205 - DNA, 22 bp, Homo sapiens
aatgcattagctacatatgtct

SEQ ID NO: 8362206 - DNA, 21 bp, Homo sapiens
aatgcattaacataaagctga

SEQ ID NO: 8362207 - DNA, 22 bp, Homo sapiens
aatgcatatgtaggcaagcagt

SEQ ID NO: 8362208 - DNA, 22 bp, Homo sapiens
aatgccattttctataaaaaga

SEQ ID NO: 8362209 - DNA, 22 bp, Homo sapiens
aatgccttcaagtatctgagga

SEQ ID NO: 8362210 - DNA, 22 bp, Homo sapiens
aatgcattttattatatgtgac

SEQ ID NO: 8362211 - DNA, 22 bp, Homo sapiens
aatgccatcagagaaaactctt

SEQ ID NO: 8362212 - DNA, 23 bp, Homo sapiens
aatgccatattggatttcttcag

SEQ ID NO: 8362213 - DNA, 22 bp, Homo sapiens
aatcacagccacaacctggggg

SEQ ID NO: 8362214 - DNA, 22 bp, Homo sapiens
aatcacaattacttttgcacca

SEQ ID NO: 8362215 - DNA, 20 bp, Homo sapiens
aatcacagttaactctttct

SEQ ID NO: 8362216 - DNA, 22 bp, Homo sapiens
aatcacagtttcaagtaatgca

SEQ ID NO: 8362217 - DNA, 22 bp, Homo sapiens
aatcacatcactgagaatgagg

SEQ ID NO: 8362218 - DNA, 22 bp, Homo sapiens
agaaaggaggaagaatgacctc

SEQ ID NO: 8362219 - DNA, 22 bp, Homo sapiens
agaaaggattagtttggtataa

SEQ ID NO: 8362220 - DNA, 22 bp, Homo sapiens
agaaaggacatctccctttaag

SEQ ID NO: 8362221 - DNA, 22 bp, Homo sapiens
agaaaggacatctccctttaag

SEQ ID NO: 8362222 - DNA, 22 bp, Homo sapiens
agaaaggagaccagctctgccc

SEQ ID NO: 8362223 - DNA, 22 bp, Homo sapiens
agaaactgacaggaaatgaatt

SEQ ID NO: 8362224 - DNA, 22 bp, Homo sapiens
agaaactgaacacaagagtcgg

SEQ ID NO: 8362225 - DNA, 22 bp, Homo sapiens
agaaagctggagtcaagcagag

SEQ ID NO: 8362226 - DNA, 22 bp, Homo sapiens
agaaaggaagggaggagtttat

SEQ ID NO: 8362227 - DNA, 17 bp, Homo sapiens
agaaaggcagttcctct

SEQ ID NO: 8362228 - DNA, 17 bp, Homo sapiens
agaaaggcagttcctct

SEQ ID NO: 8362229 - DNA, 22 bp, Homo sapiens
aatcgcttggtaattttaaaag

SEQ ID NO: 8362230 - DNA, 22 bp, Homo sapiens
agaaagggatgaggtagctgct

SEQ ID NO: 8362231 - DNA, 20 bp, Homo sapiens
aatcctgggacagaggcagg

SEQ ID NO: 8362232 - DNA, 22 bp, Homo sapiens
aatcctggcctagctgggctca

SEQ ID NO: 8362233 - DNA, 22 bp, Homo sapiens
aatctacatgcaatatttttag

SEQ ID NO: 8362234 - DNA, 22 bp, Homo sapiens
aatctacatgcaatatttttag

SEQ ID NO: 8362235 - DNA, 22 bp, Homo sapiens
aatctaagccaccagtagtttc

SEQ ID NO: 8362236 - DNA, 22 bp, Homo sapiens
aatctaaggacttagcattgct

SEQ ID NO: 8362237 - DNA, 22 bp, Homo sapiens
aatagcatcttctgagacaaag

SEQ ID NO: 8362238 - DNA, 22 bp, Homo sapiens
aatagcatgttcatgataaaat

SEQ ID NO: 8362239 - DNA, 22 bp, Homo sapiens
aatagcatgttcatgataaaat

SEQ ID NO: 8362240 - DNA, 22 bp, Homo sapiens
aatagcttagtcctgattctgt

SEQ ID NO: 8362241 - DNA, 22 bp, Homo sapiens
aatagctgattaatgtactacc

SEQ ID NO: 8362242 - DNA, 22 bp, Homo sapiens
aataggctcaaatgttcttctc

SEQ ID NO: 8362243 - DNA, 22 bp, Homo sapiens
aataggctgagccatttcaagt

SEQ ID NO: 8362244 - DNA, 22 bp, Homo sapiens
aataggctgagaggaagattta

SEQ ID NO: 8362245 - DNA, 22 bp, Homo sapiens
aatagtaaaagatacagctaat

SEQ ID NO: 8362246 - DNA, 22 bp, Homo sapiens
aatagctttggtcaccatctgg

SEQ ID NO: 8362247 - DNA, 22 bp, Homo sapiens
aatagctttctcatgacttcac

SEQ ID NO: 8362248 - DNA, 22 bp, Homo sapiens
aatagcttggacccattgcttt

SEQ ID NO: 8362249 - DNA, 22 bp, Homo sapiens
aataggaaaatatttaacaaga

SEQ ID NO: 8362250 - DNA, 22 bp, Homo sapiens
actttgttttcatgaaacagct

SEQ ID NO: 8362251 - DNA, 22 bp, Homo sapiens
actttgttttatagcacataag

SEQ ID NO: 8362252 - DNA, 22 bp, Homo sapiens
actttgtttccatatttgtagc

SEQ ID NO: 8362253 - DNA, 22 bp, Homo sapiens
actttgttgaagaatatgttag

SEQ ID NO: 8362254 - DNA, 22 bp, Homo sapiens
actttgttgatgaaatagtttt

SEQ ID NO: 8362255 - DNA, 22 bp, Homo sapiens
acttttatcaaggaagtgatct

SEQ ID NO: 8362256 - DNA, 22 bp, Homo sapiens
acttttatgataatcaatgttc

SEQ ID NO: 8362257 - DNA, 22 bp, Homo sapiens
acttttatgataatcaatgttc

SEQ ID NO: 8362258 - DNA, 22 bp, Homo sapiens
aataatacatgagattaatgtt

SEQ ID NO: 8362259 - DNA, 22 bp, Homo sapiens
actgggagggtcttgaagaggg

SEQ ID NO: 8362260 - DNA, 22 bp, Homo sapiens
actgggagtcatgaggaaggag

SEQ ID NO: 8362261 - DNA, 22 bp, Homo sapiens
actgggagttctccatgtccct

SEQ ID NO: 8362262 - DNA, 22 bp, Homo sapiens
actgggaggcatctggagctga

SEQ ID NO: 8362263 - DNA, 22 bp, Homo sapiens
aatagcaaacagacatgcacaa

SEQ ID NO: 8362264 - DNA, 22 bp, Homo sapiens
aatagcaaagttatcaaattaa

SEQ ID NO: 8362265 - DNA, 22 bp, Homo sapiens
aatagcaaagttatcaaattaa

SEQ ID NO: 8362266 - DNA, 18 bp, Homo sapiens
actgtctctgagagtggt

SEQ ID NO: 8362267 - DNA, 22 bp, Homo sapiens
actgtacatatggattctaaga

SEQ ID NO: 8362268 - DNA, 22 bp, Homo sapiens
actgtacacgtgtcatttacag

SEQ ID NO: 8362269 - DNA, 22 bp, Homo sapiens
actgtacacgtgtcatttacag

SEQ ID NO: 8362270 - DNA, 22 bp, Homo sapiens
actgtcatgcattatggcatgt

SEQ ID NO: 8362271 - DNA, 22 bp, Homo sapiens
actgtaattggattgtctgact

SEQ ID NO: 8362272 - DNA, 22 bp, Homo sapiens
acctgcctcagtgcagctggat

SEQ ID NO: 8362273 - DNA, 22 bp, Homo sapiens
acctgcctctaagcagcaggtg

SEQ ID NO: 8362274 - DNA, 22 bp, Homo sapiens
aagtgggtcagggacagatctt

SEQ ID NO: 8362275 - DNA, 22 bp, Homo sapiens
aagtgtctgcaaaatgacagag

SEQ ID NO: 8362276 - DNA, 22 bp, Homo sapiens
actcttgaactgattaagaatg

SEQ ID NO: 8362277 - DNA, 22 bp, Homo sapiens
actcttgaactgattaagaatg

SEQ ID NO: 8362278 - DNA, 22 bp, Homo sapiens
actcttgaaaatagatccacat

SEQ ID NO: 8362279 - DNA, 22 bp, Homo sapiens
actcttgacgggtgaggatatg

SEQ ID NO: 8362280 - DNA, 22 bp, Homo sapiens
actcttgaaggtggtgggagtg

SEQ ID NO: 8362281 - DNA, 22 bp, Homo sapiens
actcttggccactcttggtgtc

SEQ ID NO: 8362282 - DNA, 22 bp, Homo sapiens
actcttgattgatttagtcttt

SEQ ID NO: 8362283 - DNA, 22 bp, Homo sapiens
actcttgactccatggtgttag

SEQ ID NO: 8362284 - DNA, 22 bp, Homo sapiens
actcttgaactgattaagaatg

SEQ ID NO: 8362285 - DNA, 20 bp, Homo sapiens
actcttgagaaattctctgt

SEQ ID NO: 8362286 - DNA, 22 bp, Homo sapiens
actcttgactccatggtgttag

SEQ ID NO: 8362287 - DNA, 22 bp, Homo sapiens
aagtgtttacttaaagtcatgg

SEQ ID NO: 8362288 - DNA, 22 bp, Homo sapiens
aagtgtttacttaaagtcatgg

SEQ ID NO: 8362289 - DNA, 22 bp, Homo sapiens
actgaaaaagacatcttggtaa

SEQ ID NO: 8362290 - DNA, 19 bp, Homo sapiens
actcttttccttttgaatc

SEQ ID NO: 8362291 - DNA, 22 bp, Homo sapiens
aagttcacagaagattccaatt

SEQ ID NO: 8362292 - DNA, 22 bp, Homo sapiens
aagttcaatcagatgaaaaagc

SEQ ID NO: 8362293 - DNA, 22 bp, Homo sapiens
actgcatctgaactgtgaatgg

SEQ ID NO: 8362294 - DNA, 22 bp, Homo sapiens
actgcatctgaaacatgggtca

SEQ ID NO: 8362295 - DNA, 22 bp, Homo sapiens
actgcatctgaactgtgaatgg

SEQ ID NO: 8362296 - DNA, 22 bp, Homo sapiens
actgcaggccttggtgccagca

SEQ ID NO: 8362297 - DNA, 22 bp, Homo sapiens
actgcagggcatcctggccaag

SEQ ID NO: 8362298 - DNA, 19 bp, Homo sapiens
actgcagggaggaggtgtg

SEQ ID NO: 8362299 - DNA, 22 bp, Homo sapiens
actgcaggatgtgctcctattg

SEQ ID NO: 8362300 - DNA, 22 bp, Homo sapiens
actgcaggagacacagctgctg

SEQ ID NO: 8362301 - DNA, 22 bp, Homo sapiens
actgcagcctttgggctcataa

SEQ ID NO: 8362302 - DNA, 22 bp, Homo sapiens
actgcagctggtggtggctctg

SEQ ID NO: 8362303 - DNA, 22 bp, Homo sapiens
actgcagctggtggtggctctg

SEQ ID NO: 8362304 - DNA, 22 bp, Homo sapiens
aagttcctgggtgatcctgatg

SEQ ID NO: 8362305 - DNA, 22 bp, Homo sapiens
actgcagccttgaactctgggc

SEQ ID NO: 8362306 - DNA, 22 bp, Homo sapiens
tatgagaactgacagagtgcca

SEQ ID NO: 8362307 - DNA, 22 bp, Homo sapiens
tatgagaaaggagaatgacttt

SEQ ID NO: 8362308 - DNA, 22 bp, Homo sapiens
tatgacaccattttggtcagtg

SEQ ID NO: 8362309 - DNA, 22 bp, Homo sapiens
tatgacattgctttttagaact

SEQ ID NO: 8362310 - DNA, 22 bp, Homo sapiens
tatgacatttctctgatttgtg

SEQ ID NO: 8362311 - DNA, 22 bp, Homo sapiens
tatgacattgctttttagaact

SEQ ID NO: 8362312 - DNA, 22 bp, Homo sapiens
tatctacagttaatatgtcatc

SEQ ID NO: 8362313 - DNA, 20 bp, Homo sapiens
tatctaaatgcttacattac

SEQ ID NO: 8362314 - DNA, 22 bp, Homo sapiens
tatctaaaggatttaatttagt

SEQ ID NO: 8362315 - DNA, 22 bp, Homo sapiens
tatctaaaggatttaatttagt

SEQ ID NO: 8362316 - DNA, 22 bp, Homo sapiens
tatctaaggtatatgaggaatc

SEQ ID NO: 8362317 - DNA, 22 bp, Homo sapiens
tatctaagaattccagagaaag

SEQ ID NO: 8362318 - DNA, 22 bp, Homo sapiens
tatagcactgcaatatttccct

SEQ ID NO: 8362319 - DNA, 22 bp, Homo sapiens
tatagcaattcagaatacatgt

SEQ ID NO: 8362320 - DNA, 22 bp, Homo sapiens
tatagtatacttaaagtctatt

SEQ ID NO: 8362321 - DNA, 22 bp, Homo sapiens
tatatatgggggaagctggatg

SEQ ID NO: 8362322 - DNA, 22 bp, Homo sapiens
tatagttagtttcataatcatg

SEQ ID NO: 8362323 - DNA, 22 bp, Homo sapiens
tataggtacttggaaaataagg

SEQ ID NO: 8362324 - DNA, 22 bp, Homo sapiens
tataggcttttgcctgaagcta

SEQ ID NO: 8362325 - DNA, 22 bp, Homo sapiens
tataggcttttgttgcagaaca

SEQ ID NO: 8362326 - DNA, 21 bp, Homo sapiens
tataggcttccatatgaaggg

SEQ ID NO: 8362327 - DNA, 21 bp, Homo sapiens
tataggcttccatatgaaggg

SEQ ID NO: 8362328 - DNA, 22 bp, Homo sapiens
tataggctgatggcttcctgag

SEQ ID NO: 8362329 - DNA, 22 bp, Homo sapiens
tataggctgctgagatcccttt

SEQ ID NO: 8362330 - DNA, 22 bp, Homo sapiens
tataggctgtgcttgtgtcttt

SEQ ID NO: 8362331 - DNA, 22 bp, Homo sapiens
tataggctcttgttaacctttt

SEQ ID NO: 8362332 - DNA, 22 bp, Homo sapiens
tatagtaaaattttcatttatg

SEQ ID NO: 8362333 - DNA, 22 bp, Homo sapiens
tatatcagcaaagcatttaaaa

SEQ ID NO: 8362334 - DNA, 22 bp, Homo sapiens
tatatattcttaagtagtgtag

SEQ ID NO: 8362335 - DNA, 22 bp, Homo sapiens
tatatcatggagattaacattc

SEQ ID NO: 8362336 - DNA, 22 bp, Homo sapiens
tatatccatttgtctgctaatt

SEQ ID NO: 8362337 - DNA, 22 bp, Homo sapiens
tatccacactgggatgttttga

SEQ ID NO: 8362338 - DNA, 22 bp, Homo sapiens
tatccacactcaaggggagggg

SEQ ID NO: 8362339 - DNA, 22 bp, Homo sapiens
tatccaaagtggcatattatag

SEQ ID NO: 8362340 - DNA, 22 bp, Homo sapiens
tatacacacctccaaagcagga

SEQ ID NO: 8362341 - DNA, 22 bp, Homo sapiens
tatacacaaggtgtgcatttgt

SEQ ID NO: 8362342 - DNA, 22 bp, Homo sapiens
tataattttaagtggtaaatta

SEQ ID NO: 8362343 - DNA, 22 bp, Homo sapiens
tatacaagtgagaagaagagtt

SEQ ID NO: 8362344 - DNA, 22 bp, Homo sapiens
tataatttggggaaagtggtgt

SEQ ID NO: 8362345 - DNA, 22 bp, Homo sapiens
tataatttatcatgtcacagtt

SEQ ID NO: 8362346 - DNA, 17 bp, Homo sapiens
tatacacagacagactg

SEQ ID NO: 8362347 - DNA, 22 bp, Homo sapiens
tatacacatcctccaaagatag

SEQ ID NO: 8362348 - DNA, 22 bp, Homo sapiens
tatagcaaggacataatatgct

SEQ ID NO: 8362349 - DNA, 22 bp, Homo sapiens
tatacacatttttacctatagt

SEQ ID NO: 8362350 - DNA, 22 bp, Homo sapiens
taggggtgaggccaggcatcag

SEQ ID NO: 8362351 - DNA, 22 bp, Homo sapiens
taggggtgtttcgagagaggtt

SEQ ID NO: 8362352 - DNA, 22 bp, Homo sapiens
taggtgagtttggggaagatag

SEQ ID NO: 8362353 - DNA, 22 bp, Homo sapiens
tataaatgcacttttgaaatat

SEQ ID NO: 8362354 - DNA, 22 bp, Homo sapiens
tataaagtttcgaaagatgtat

SEQ ID NO: 8362355 - DNA, 22 bp, Homo sapiens
tataaagtttcgaaagatgtat

SEQ ID NO: 8362356 - DNA, 22 bp, Homo sapiens
tataaattaatgtgcccatgag

SEQ ID NO: 8362357 - DNA, 22 bp, Homo sapiens
tataaattattaggctgctaaa

SEQ ID NO: 8362358 - DNA, 22 bp, Homo sapiens
tataacaggaagtattcaaaca

SEQ ID NO: 8362359 - DNA, 20 bp, Homo sapiens
tataaattcagagctttggt

SEQ ID NO: 8362360 - DNA, 22 bp, Homo sapiens
tatgtcttaatccttccttagg

SEQ ID NO: 8362361 - DNA, 22 bp, Homo sapiens
tatgtcttcgtcacctatctca

SEQ ID NO: 8362362 - DNA, 22 bp, Homo sapiens
tatgtcttgtgtttgctaatct

SEQ ID NO: 8362363 - DNA, 22 bp, Homo sapiens
tatgtctttagtatcttttgga

SEQ ID NO: 8362364 - DNA, 22 bp, Homo sapiens
tatgtgcatatgcatacacaca

SEQ ID NO: 8362365 - DNA, 22 bp, Homo sapiens
tatgtgcactttgggtctggga

SEQ ID NO: 8362366 - DNA, 22 bp, Homo sapiens
tatgtgcaaaatgctagactag

SEQ ID NO: 8362367 - DNA, 22 bp, Homo sapiens
tattagaaaggctattgcatag

SEQ ID NO: 8362368 - DNA, 22 bp, Homo sapiens
tattagaaaggctattgcatag

SEQ ID NO: 8362369 - DNA, 22 bp, Homo sapiens
tattagaaaggctattgcatag

SEQ ID NO: 8362370 - DNA, 22 bp, Homo sapiens
tattagcagttgtatgtgtctg

SEQ ID NO: 8362371 - DNA, 22 bp, Homo sapiens
tattagcacaaagcaaggtatt

SEQ ID NO: 8362372 - DNA, 22 bp, Homo sapiens
tattacagaatcaggcataact

SEQ ID NO: 8362373 - DNA, 22 bp, Homo sapiens
tattacagctttgattatctgg

SEQ ID NO: 8362374 - DNA, 22 bp, Homo sapiens
tatgtgtggcagctgggagtgt

SEQ ID NO: 8362375 - DNA, 19 bp, Homo sapiens
tatgtgtgcatttgtgcat

SEQ ID NO: 8362376 - DNA, 22 bp, Homo sapiens
tatgtacaatttgttgtatgtc

SEQ ID NO: 8362377 - DNA, 22 bp, Homo sapiens
tatgtacaatcagcagttcata

SEQ ID NO: 8362378 - DNA, 22 bp, Homo sapiens
tatgtacacacacatgcatgta

SEQ ID NO: 8362379 - DNA, 22 bp, Homo sapiens
tatgtacacacacatgcatgta

SEQ ID NO: 8362380 - DNA, 22 bp, Homo sapiens
tatgtacaatcagcagttcata

SEQ ID NO: 8362381 - DNA, 22 bp, Homo sapiens
tatgtacaagcacacatgtgac

SEQ ID NO: 8362382 - DNA, 22 bp, Homo sapiens
tatgtacaagcacacatgtgac

SEQ ID NO: 8362383 - DNA, 21 bp, Homo sapiens
tatgagatatacttattcttt

SEQ ID NO: 8362384 - DNA, 22 bp, Homo sapiens
tatgagcaagagtttgtgaagg

SEQ ID NO: 8362385 - DNA, 22 bp, Homo sapiens
tatgagaatctgcagtatgctt

SEQ ID NO: 8362386 - DNA, 22 bp, Homo sapiens
tatgtacagggatagaacttga

SEQ ID NO: 8362387 - DNA, 22 bp, Homo sapiens
tatgtacaccggggaaggtggg

SEQ ID NO: 8362388 - DNA, 22 bp, Homo sapiens
tatgtacacatacacttgtaat

SEQ ID NO: 8362389 - DNA, 22 bp, Homo sapiens
tatgtacacacacatgcatgta

SEQ ID NO: 8362390 - DNA, 22 bp, Homo sapiens
tatgtacataacatgaaatgca

SEQ ID NO: 8362391 - DNA, 22 bp, Homo sapiens
tatgtacagggatagaacttga

SEQ ID NO: 8362392 - DNA, 22 bp, Homo sapiens
tatgtacagtccttaacttaaa

SEQ ID NO: 8362393 - DNA, 22 bp, Homo sapiens
tatttattcattcagcaagcat

SEQ ID NO: 8362394 - DNA, 22 bp, Homo sapiens
tatttattctttgtactgcctt

SEQ ID NO: 8362395 - DNA, 22 bp, Homo sapiens
tatttattggacagtgttgctg

SEQ ID NO: 8362396 - DNA, 22 bp, Homo sapiens
tatttattggacagtgttgctg

SEQ ID NO: 8362397 - DNA, 22 bp, Homo sapiens
tatttattggacagtgttgctg

SEQ ID NO: 8362398 - DNA, 22 bp, Homo sapiens
tatttctctcacggttgcctgg

SEQ ID NO: 8362399 - DNA, 22 bp, Homo sapiens
tatttctcagcattttacatcc

SEQ ID NO: 8362400 - DNA, 22 bp, Homo sapiens
tatttctcttcaaaattgatgt

SEQ ID NO: 8362401 - DNA, 22 bp, Homo sapiens
tatttctaagctgtaagtctga

SEQ ID NO: 8362402 - DNA, 22 bp, Homo sapiens
tatttctcagcattttacatcc

SEQ ID NO: 8362403 - DNA, 22 bp, Homo sapiens
tatttaattagtgattgtagag

SEQ ID NO: 8362404 - DNA, 22 bp, Homo sapiens
tatttaatttgctcattgtgat

SEQ ID NO: 8362405 - DNA, 22 bp, Homo sapiens
tatttataacagtgagaacggg

SEQ ID NO: 8362406 - DNA, 22 bp, Homo sapiens
tatttaattagtgattgtagag

SEQ ID NO: 8362407 - DNA, 22 bp, Homo sapiens
tatttataccaggtgatcggag

SEQ ID NO: 8362408 - DNA, 22 bp, Homo sapiens
tatttatcaaggtaggagaata

SEQ ID NO: 8362409 - DNA, 22 bp, Homo sapiens
tatttataatctgccaaagaga

SEQ ID NO: 8362410 - DNA, 22 bp, Homo sapiens
tatttatgtggaccataagcct

SEQ ID NO: 8362411 - DNA, 22 bp, Homo sapiens
tatttatgtctctgcagagaat

SEQ ID NO: 8362412 - DNA, 22 bp, Homo sapiens
tattctcattagtctgtattcc

SEQ ID NO: 8362413 - DNA, 22 bp, Homo sapiens
tattctctccccaatcttgctt

SEQ ID NO: 8362414 - DNA, 22 bp, Homo sapiens
tattctctccccaatcttgctt

SEQ ID NO: 8362415 - DNA, 22 bp, Homo sapiens
tattctactagcattgttcact

SEQ ID NO: 8362416 - DNA, 22 bp, Homo sapiens
tattctcagcaacacacatgga

SEQ ID NO: 8362417 - DNA, 22 bp, Homo sapiens
tattcttactctcgactgcatt

SEQ ID NO: 8362418 - DNA, 22 bp, Homo sapiens
tattcttgtaccttaaatgatt

SEQ ID NO: 8362419 - DNA, 22 bp, Homo sapiens
tattgaaattcttcatgtcctc

SEQ ID NO: 8362420 - DNA, 22 bp, Homo sapiens
tattattaaatggcagaatttt

SEQ ID NO: 8362421 - DNA, 22 bp, Homo sapiens
tattattaaatggcagaatttt

SEQ ID NO: 8362422 - DNA, 22 bp, Homo sapiens
tattattatgcatagcatgaaa

SEQ ID NO: 8362423 - DNA, 22 bp, Homo sapiens
tattattatgcatagcatgaaa

SEQ ID NO: 8362424 - DNA, 22 bp, Homo sapiens
tattattttagcactgaggatt

SEQ ID NO: 8362425 - DNA, 22 bp, Homo sapiens
tattattttagcactgaggatt

SEQ ID NO: 8362426 - DNA, 19 bp, Homo sapiens
tattatttgtagcaaggcc

SEQ ID NO: 8362427 - DNA, 22 bp, Homo sapiens
tattcatgggaggtcacaactt

SEQ ID NO: 8362428 - DNA, 22 bp, Homo sapiens
tattcaaagtaccttcattgcc

SEQ ID NO: 8362429 - DNA, 22 bp, Homo sapiens
tattcaaagtaccttcattgcc

SEQ ID NO: 8362430 - DNA, 22 bp, Homo sapiens
tattccaaaatcccaaactgcc

SEQ ID NO: 8362431 - DNA, 22 bp, Homo sapiens
tattcatgtcggctgaaaaagc

SEQ ID NO: 8362432 - DNA, 22 bp, Homo sapiens
tagacacatcaaggatcagttt

SEQ ID NO: 8362433 - DNA, 21 bp, Homo sapiens
tagaggcaggagggactgcag

SEQ ID NO: 8362434 - DNA, 22 bp, Homo sapiens
tagaggggaaaatgcgtattaa

SEQ ID NO: 8362435 - DNA, 22 bp, Homo sapiens
tagaggctgggaattattttca

SEQ ID NO: 8362436 - DNA, 22 bp, Homo sapiens
tagaggcataagagggaagcag

SEQ ID NO: 8362437 - DNA, 22 bp, Homo sapiens
tagacaatatttgaaagtagtg

SEQ ID NO: 8362438 - DNA, 22 bp, Homo sapiens
tagaattttctgctttgatagt

SEQ ID NO: 8362439 - DNA, 22 bp, Homo sapiens
tagacacaagagaagggtataa

SEQ ID NO: 8362440 - DNA, 22 bp, Homo sapiens
tagacacatacccttgcccaaa

SEQ ID NO: 8362441 - DNA, 22 bp, Homo sapiens
tagaatgtagtgcttcaagatt

SEQ ID NO: 8362442 - DNA, 22 bp, Homo sapiens
tagaatgttaagaatatgtata

SEQ ID NO: 8362443 - DNA, 23 bp, Homo sapiens
tagaattcaatctgttccacatc

SEQ ID NO: 8362444 - DNA, 22 bp, Homo sapiens
tagaaaggaagctacttagggg

SEQ ID NO: 8362445 - DNA, 22 bp, Homo sapiens
tagaaaggaacaggtcagcgtt

SEQ ID NO: 8362446 - DNA, 22 bp, Homo sapiens
tagaaaggagcattttagacta

SEQ ID NO: 8362447 - DNA, 22 bp, Homo sapiens
tagaaaggagcattttagacta

SEQ ID NO: 8362448 - DNA, 22 bp, Homo sapiens
tagaaaggatattgagatgaat

SEQ ID NO: 8362449 - DNA, 22 bp, Homo sapiens
tagaaaggcaagcgtgaaatat

SEQ ID NO: 8362450 - DNA, 22 bp, Homo sapiens
tagaaagcgttaaatctacaga

SEQ ID NO: 8362451 - DNA, 22 bp, Homo sapiens
tagaaagaacttcatgtaaaac

SEQ ID NO: 8362452 - DNA, 21 bp, Homo sapiens
tagaaagtcaaagctatcagc

SEQ ID NO: 8362453 - DNA, 22 bp, Homo sapiens
tagaaaggctgctgccaaccca

SEQ ID NO: 8362454 - DNA, 22 bp, Homo sapiens
tagaaaggcaatcattcttgga

SEQ ID NO: 8362455 - DNA, 22 bp, Homo sapiens
tagaaagtactaaatttaactg

SEQ ID NO: 8362456 - DNA, 22 bp, Homo sapiens
tagaaatcttgttactatgtgt

SEQ ID NO: 8362457 - DNA, 22 bp, Homo sapiens
tagaaatgattggttgagctct

SEQ ID NO: 8362458 - DNA, 22 bp, Homo sapiens
tagaaatgcagtgtactgtgtc

SEQ ID NO: 8362459 - DNA, 22 bp, Homo sapiens
tagaaatcacagaaaatcaggg

SEQ ID NO: 8362460 - DNA, 22 bp, Homo sapiens
tagaaatcacaaaccagtagtt

SEQ ID NO: 8362461 - DNA, 22 bp, Homo sapiens
tagaaatcacaaaccagtagtt

SEQ ID NO: 8362462 - DNA, 22 bp, Homo sapiens
tagaaataaatctgcagctggg

SEQ ID NO: 8362463 - DNA, 22 bp, Homo sapiens
tagaaagtggttgagagtttag

SEQ ID NO: 8362464 - DNA, 20 bp, Homo sapiens
tagaaatcttataaaagact

SEQ ID NO: 8362465 - DNA, 22 bp, Homo sapiens
tagaaatccccagtctcatagt

SEQ ID NO: 8362466 - DNA, 22 bp, Homo sapiens
tagaaatctacttagactttct

SEQ ID NO: 8362467 - DNA, 17 bp, Homo sapiens
tagaaatcatagggttg

SEQ ID NO: 8362468 - DNA, 22 bp, Homo sapiens
tagaaatcatttagaagtattg

SEQ ID NO: 8362469 - DNA, 22 bp, Homo sapiens
tagaaatcaggtttttagaaag

SEQ ID NO: 8362470 - DNA, 22 bp, Homo sapiens
tacttttatgtgatgaaatctg

SEQ ID NO: 8362471 - DNA, 22 bp, Homo sapiens
tacttttagcctatttgattct

SEQ ID NO: 8362472 - DNA, 22 bp, Homo sapiens
tactttttatgataagaactga

SEQ ID NO: 8362473 - DNA, 22 bp, Homo sapiens
tactttttatgataagaactga

SEQ ID NO: 8362474 - DNA, 22 bp, Homo sapiens
tacttttctttgtcatgcatct

SEQ ID NO: 8362475 - DNA, 22 bp, Homo sapiens
tactttttgtctctttgaatgt

SEQ ID NO: 8362476 - DNA, 22 bp, Homo sapiens
tactttttgtctctttgaatgt

SEQ ID NO: 8362477 - DNA, 22 bp, Homo sapiens
tagaaaactaatacatgcttga

SEQ ID NO: 8362478 - DNA, 22 bp, Homo sapiens
tagaaaagaagtctggccggga

SEQ ID NO: 8362479 - DNA, 22 bp, Homo sapiens
tagaaaagaattttatttgata

SEQ ID NO: 8362480 - DNA, 22 bp, Homo sapiens
tagaaaagaattttatttgata

SEQ ID NO: 8362481 - DNA, 22 bp, Homo sapiens
tagaaaagataacattctgtgc

SEQ ID NO: 8362482 - DNA, 22 bp, Homo sapiens
taccaaagatacataaatgtga

SEQ ID NO: 8362483 - DNA, 22 bp, Homo sapiens
taccaaaagcttgtttcataca

SEQ ID NO: 8362484 - DNA, 22 bp, Homo sapiens
tacattttctaggggaccaaga

SEQ ID NO: 8362485 - DNA, 22 bp, Homo sapiens
tacattttctaggggaccaaga

SEQ ID NO: 8362486 - DNA, 22 bp, Homo sapiens
tacattttctaggggaccaaga

SEQ ID NO: 8362487 - DNA, 22 bp, Homo sapiens
tactttggggacaatatggaat

SEQ ID NO: 8362488 - DNA, 22 bp, Homo sapiens
tactttggggacaatatggaat

SEQ ID NO: 8362489 - DNA, 22 bp, Homo sapiens
tacttttaaaattcacaggtat

SEQ ID NO: 8362490 - DNA, 22 bp, Homo sapiens
tacttttaaaattcacaggtat

SEQ ID NO: 8362491 - DNA, 22 bp, Homo sapiens
tactttgtggagattaaaaata

SEQ ID NO: 8362492 - DNA, 22 bp, Homo sapiens
tagaaacatgttctgttctgtt

SEQ ID NO: 8362493 - DNA, 22 bp, Homo sapiens
tagaaacatgttctgttctgtt

SEQ ID NO: 8362494 - DNA, 22 bp, Homo sapiens
tagaaacatcagctaaccaaaa

SEQ ID NO: 8362495 - DNA, 22 bp, Homo sapiens
tagaaacatatgtttgagacat

SEQ ID NO: 8362496 - DNA, 22 bp, Homo sapiens
tagaaacatatgtttgagacat

SEQ ID NO: 8362497 - DNA, 22 bp, Homo sapiens
tagaaacatatgtttgagacat

SEQ ID NO: 8362498 - DNA, 22 bp, Homo sapiens
tagaaactgatagtcttgtgct

SEQ ID NO: 8362499 - DNA, 22 bp, Homo sapiens
tagaaagaaattcagattggct

SEQ ID NO: 8362500 - DNA, 22 bp, Homo sapiens
tagaaactcacgttatcattgc

SEQ ID NO: 8362501 - DNA, 22 bp, Homo sapiens
tagaaactcacgttatcattgc

SEQ ID NO: 8362502 - DNA, 22 bp, Homo sapiens
tagaaactcacgttatcattgc

SEQ ID NO: 8362503 - DNA, 22 bp, Homo sapiens
tagaaactcacgttatcattgc

SEQ ID NO: 8362504 - DNA, 22 bp, Homo sapiens
tagaaacattcagttgcagtcc

SEQ ID NO: 8362505 - DNA, 22 bp, Homo sapiens
tagaaacattcagttgcagtcc

SEQ ID NO: 8362506 - DNA, 22 bp, Homo sapiens
tagaaacaagtttctctttggg

SEQ ID NO: 8362507 - DNA, 22 bp, Homo sapiens
tagaaaagccccagctggaggg

SEQ ID NO: 8362508 - DNA, 22 bp, Homo sapiens
tagaaacaatgacatgcttgta

SEQ ID NO: 8362509 - DNA, 22 bp, Homo sapiens
tagaaacaatgacatgcttgta

SEQ ID NO: 8362510 - DNA, 22 bp, Homo sapiens
tagaaacagatgtttttgaaga

SEQ ID NO: 8362511 - DNA, 22 bp, Homo sapiens
tagaaacagatgtttttgaaga

SEQ ID NO: 8362512 - DNA, 22 bp, Homo sapiens
tagaaacagcatatattagccc

SEQ ID NO: 8362513 - DNA, 22 bp, Homo sapiens
tagctgtttatcaagttcttga

SEQ ID NO: 8362514 - DNA, 22 bp, Homo sapiens
tagctgttgcaataaacagttc

SEQ ID NO: 8362515 - DNA, 22 bp, Homo sapiens
tagctgttggcttacatctgtt

SEQ ID NO: 8362516 - DNA, 22 bp, Homo sapiens
tagctgttcccagctctgtgta

SEQ ID NO: 8362517 - DNA, 22 bp, Homo sapiens
tagctgttttttgtgaggaaat

SEQ ID NO: 8362518 - DNA, 22 bp, Homo sapiens
tagcctctctcctccacaacct

SEQ ID NO: 8362519 - DNA, 19 bp, Homo sapiens
tagctctgtcttattccaa

SEQ ID NO: 8362520 - DNA, 22 bp, Homo sapiens
tagctctgtgctctggatctgt

SEQ ID NO: 8362521 - DNA, 22 bp, Homo sapiens
tagctctggagtcttctcagaa

SEQ ID NO: 8362522 - DNA, 22 bp, Homo sapiens
tagctctggcattctttccaaa

SEQ ID NO: 8362523 - DNA, 22 bp, Homo sapiens
tagccctgtccttggcctgtgc

SEQ ID NO: 8362524 - DNA, 22 bp, Homo sapiens
tagccctggagcagggaaatac

SEQ ID NO: 8362525 - DNA, 19 bp, Homo sapiens
tagccctggccatcatgag

SEQ ID NO: 8362526 - DNA, 22 bp, Homo sapiens
tagccctgctgtgatgtgaagt

SEQ ID NO: 8362527 - DNA, 23 bp, Homo sapiens
tagcagcatttttagcctctgtc

SEQ ID NO: 8362528 - DNA, 22 bp, Homo sapiens
tagcagcatttttgtagagtat

SEQ ID NO: 8362529 - DNA, 22 bp, Homo sapiens
tagcagcatcctgtggtgatgg

SEQ ID NO: 8362530 - DNA, 22 bp, Homo sapiens
tagcagcatgtaagtgagtaga

SEQ ID NO: 8362531 - DNA, 17 bp, Homo sapiens
tagcagcagtaattgtg

SEQ ID NO: 8362532 - DNA, 22 bp, Homo sapiens
tagcagagcagggatcagagcc

SEQ ID NO: 8362533 - DNA, 22 bp, Homo sapiens
tagcagaggaaaagagaacatt

SEQ ID NO: 8362534 - DNA, 22 bp, Homo sapiens
tagcagaggaaaagagaacatt

SEQ ID NO: 8362535 - DNA, 22 bp, Homo sapiens
tagaggtgacactgagaccata

SEQ ID NO: 8362536 - DNA, 22 bp, Homo sapiens
tagaggtgttgacgccaaggta

SEQ ID NO: 8362537 - DNA, 22 bp, Homo sapiens
taggaaaagcacaggatgttct

SEQ ID NO: 8362538 - DNA, 22 bp, Homo sapiens
tagctttgctggcaagcatgtc

SEQ ID NO: 8362539 - DNA, 22 bp, Homo sapiens
tagctttaggcacgtttgaatt

SEQ ID NO: 8362540 - DNA, 22 bp, Homo sapiens
tagctttaggatggttctcttg

SEQ ID NO: 8362541 - DNA, 21 bp, Homo sapiens
taggatgaaagtgagtgagaa

SEQ ID NO: 8362542 - DNA, 22 bp, Homo sapiens
taggatggtacaaggcaggggt

SEQ ID NO: 8362543 - DNA, 22 bp, Homo sapiens
taggatggtacaaggcaggggt

SEQ ID NO: 8362544 - DNA, 22 bp, Homo sapiens
taggatgaggggtggccaagta

SEQ ID NO: 8362545 - DNA, 22 bp, Homo sapiens
taggaaacatttgaagaggatt

SEQ ID NO: 8362546 - DNA, 22 bp, Homo sapiens
tagggcagagcttgtacacgat

SEQ ID NO: 8362547 - DNA, 22 bp, Homo sapiens
taggcagaaaggaaggcaagtt

SEQ ID NO: 8362548 - DNA, 22 bp, Homo sapiens
taggcacttggcgtgttggaga

SEQ ID NO: 8362549 - DNA, 22 bp, Homo sapiens
taggcacttaataaatggtata

SEQ ID NO: 8362550 - DNA, 22 bp, Homo sapiens
taggcactggggaggcagcatg

SEQ ID NO: 8362551 - DNA, 22 bp, Homo sapiens
taggcactggttgtggatagtt

SEQ ID NO: 8362552 - DNA, 22 bp, Homo sapiens
taggcactggttgtggatagtt

SEQ ID NO: 8362553 - DNA, 22 bp, Homo sapiens
taggcactgtgtttgtaggagt

SEQ ID NO: 8362554 - DNA, 22 bp, Homo sapiens
taggctgggcattctggccagg

SEQ ID NO: 8362555 - DNA, 22 bp, Homo sapiens
tagggacactgctcatgagttc

SEQ ID NO: 8362556 - DNA, 22 bp, Homo sapiens
tagggacactgctcatgagttc

SEQ ID NO: 8362557 - DNA, 22 bp, Homo sapiens
tagggagatgcaagggacggag

SEQ ID NO: 8362558 - DNA, 22 bp, Homo sapiens
tagggagaggaagcaggccgct

SEQ ID NO: 8362559 - DNA, 22 bp, Homo sapiens
taggcactgaccttctcagatt

SEQ ID NO: 8362560 - DNA, 22 bp, Homo sapiens
taggcactgaccttctcagatt

SEQ ID NO: 8362561 - DNA, 22 bp, Homo sapiens
taggcactgaggggagcaaggt

SEQ ID NO: 8362562 - DNA, 22 bp, Homo sapiens
taggcactgggctaggacaggt

SEQ ID NO: 8362563 - DNA, 22 bp, Homo sapiens
taggcactgggctaggacaggt

SEQ ID NO: 8362564 - DNA, 22 bp, Homo sapiens
taggcactggatgaccgaagag

SEQ ID NO: 8362565 - DNA, 22 bp, Homo sapiens
taggcactgagtacatattggt

SEQ ID NO: 8362566 - DNA, 22 bp, Homo sapiens
taggcactagacatggttacca

SEQ ID NO: 8362567 - DNA, 22 bp, Homo sapiens
tacaaagtcagaataacaggtg

SEQ ID NO: 8362568 - DNA, 22 bp, Homo sapiens
tacaaagtcccattgccatgga

SEQ ID NO: 8362569 - DNA, 22 bp, Homo sapiens
tacaaagtgctttagaaatgaa

SEQ ID NO: 8362570 - DNA, 22 bp, Homo sapiens
tacaaagtttgagaatgctttc

SEQ ID NO: 8362571 - DNA, 22 bp, Homo sapiens
tacaaagttttcttggattgag

SEQ ID NO: 8362572 - DNA, 22 bp, Homo sapiens
tacaacaatttccacattagaa

SEQ ID NO: 8362573 - DNA, 22 bp, Homo sapiens
tacaacaatttccacattagaa

SEQ ID NO: 8362574 - DNA, 22 bp, Homo sapiens
tacaacagaagtgtttatttag

SEQ ID NO: 8362575 - DNA, 22 bp, Homo sapiens
tacaacagacaggaataagatt

SEQ ID NO: 8362576 - DNA, 22 bp, Homo sapiens
tacaacagacctagatgaatga

SEQ ID NO: 8362577 - DNA, 21 bp, Homo sapiens
tacaacaggttttatttcgat

SEQ ID NO: 8362578 - DNA, 22 bp, Homo sapiens
tacaacaggaatttcaactttg

SEQ ID NO: 8362579 - DNA, 22 bp, Homo sapiens
tacaacagttcatgaaatgaaa

SEQ ID NO: 8362580 - DNA, 22 bp, Homo sapiens
tacaacagtaatcaaggttttt

SEQ ID NO: 8362581 - DNA, 22 bp, Homo sapiens
tacacttttctggttactcttg

SEQ ID NO: 8362582 - DNA, 22 bp, Homo sapiens
tacagcaatgcctgaaatagta

SEQ ID NO: 8362583 - DNA, 22 bp, Homo sapiens
tacagattttgtgaagaagtgt

SEQ ID NO: 8362584 - DNA, 21 bp, Homo sapiens
tacagatgaggagaccaaggc

SEQ ID NO: 8362585 - DNA, 22 bp, Homo sapiens
tacagatttggggagtaaagtt

SEQ ID NO: 8362586 - DNA, 22 bp, Homo sapiens
tacagagtatttttaatatggt

SEQ ID NO: 8362587 - DNA, 22 bp, Homo sapiens
tacagagtatttttaatatggt

SEQ ID NO: 8362588 - DNA, 22 bp, Homo sapiens
tacagagttttcctgccaagaa

SEQ ID NO: 8362589 - DNA, 22 bp, Homo sapiens
tacagtaagatgaaatagcaat

SEQ ID NO: 8362590 - DNA, 22 bp, Homo sapiens
tacagtaatctggacatgattt

SEQ ID NO: 8362591 - DNA, 22 bp, Homo sapiens
tacagtaataaaatgagctaca

SEQ ID NO: 8362592 - DNA, 19 bp, Homo sapiens
tacatacttattctaaaag

SEQ ID NO: 8362593 - DNA, 20 bp, Homo sapiens
tacaggagtgagtgggtggg

SEQ ID NO: 8362594 - DNA, 22 bp, Homo sapiens
tacaggcatgtagcatggtgat

SEQ ID NO: 8362595 - DNA, 22 bp, Homo sapiens
tacaggcccatagtccctgctt

SEQ ID NO: 8362596 - DNA, 22 bp, Homo sapiens
tacagggactcccgcagagata

SEQ ID NO: 8362597 - DNA, 22 bp, Homo sapiens
tacagggactcccgcagagata

SEQ ID NO: 8362598 - DNA, 22 bp, Homo sapiens
tacatttcctgtcagagatata

SEQ ID NO: 8362599 - DNA, 22 bp, Homo sapiens
tacatttggatgtgcttaagtg

SEQ ID NO: 8362600 - DNA, 19 bp, Homo sapiens
tacatcctcttcctctttg

SEQ ID NO: 8362601 - DNA, 22 bp, Homo sapiens
tacatctagccttacaattatt

SEQ ID NO: 8362602 - DNA, 22 bp, Homo sapiens
tacatcattttggagatgagca

SEQ ID NO: 8362603 - DNA, 22 bp, Homo sapiens
tacatctgatttacctactgaa

SEQ ID NO: 8362604 - DNA, 22 bp, Homo sapiens
tacatagctcctagtgatgcat

SEQ ID NO: 8362605 - DNA, 22 bp, Homo sapiens
tacatcatggcttcatgctgca

SEQ ID NO: 8362606 - DNA, 22 bp, Homo sapiens
taaggcattctcatgctgtgaa

SEQ ID NO: 8362607 - DNA, 18 bp, Homo sapiens
taaggcattcttatgtga

SEQ ID NO: 8362608 - DNA, 23 bp, Homo sapiens
taaggcattttttctgtatcagt

SEQ ID NO: 8362609 - DNA, 22 bp, Homo sapiens
taaggcattatagagacagcct

SEQ ID NO: 8362610 - DNA, 22 bp, Homo sapiens
taaggcattatagagacagcct

SEQ ID NO: 8362611 - DNA, 22 bp, Homo sapiens
taaggcattagagtgaaagcaa

SEQ ID NO: 8362612 - DNA, 22 bp, Homo sapiens
taaggcatgctagcagtatgaa

SEQ ID NO: 8362613 - DNA, 22 bp, Homo sapiens
taaggcataaggccagaggcta

SEQ ID NO: 8362614 - DNA, 20 bp, Homo sapiens
taaggcatcaagtttgggta

SEQ ID NO: 8362615 - DNA, 22 bp, Homo sapiens
taaggcatgagtttatttcata

SEQ ID NO: 8362616 - DNA, 22 bp, Homo sapiens
taaggcataaggaagatttgga

SEQ ID NO: 8362617 - DNA, 22 bp, Homo sapiens
taaggcagttttgcctgagata

SEQ ID NO: 8362618 - DNA, 22 bp, Homo sapiens
taaggcagtgagaagaaacagg

SEQ ID NO: 8362619 - DNA, 22 bp, Homo sapiens
taaggcagtgaaactattctgt

SEQ ID NO: 8362620 - DNA, 22 bp, Homo sapiens
taaggcagtagtgtctgtaggg

SEQ ID NO: 8362621 - DNA, 22 bp, Homo sapiens
taaggcaaaggggaagttatca

SEQ ID NO: 8362622 - DNA, 22 bp, Homo sapiens
taaggcaaagaaccatagtaat

SEQ ID NO: 8362623 - DNA, 22 bp, Homo sapiens
taaggcaaagaaccatagtaat

SEQ ID NO: 8362624 - DNA, 22 bp, Homo sapiens
taaggcaggactggatagctat

SEQ ID NO: 8362625 - DNA, 22 bp, Homo sapiens
taaggcaggtagatgactacgg

SEQ ID NO: 8362626 - DNA, 22 bp, Homo sapiens
taaggcaggctttcatccagag

SEQ ID NO: 8362627 - DNA, 22 bp, Homo sapiens
taaggcaggctttcatccagag

SEQ ID NO: 8362628 - DNA, 22 bp, Homo sapiens
taaggcaggtatggtaccaggc

SEQ ID NO: 8362629 - DNA, 22 bp, Homo sapiens
taaggctcatgtaattagagat

SEQ ID NO: 8362630 - DNA, 22 bp, Homo sapiens
taagggaacagcttcaaactca

SEQ ID NO: 8362631 - DNA, 22 bp, Homo sapiens
taaggcccgtgagtttcatatc

SEQ ID NO: 8362632 - DNA, 22 bp, Homo sapiens
taaggccttgaaaggatgtcct

SEQ ID NO: 8362633 - DNA, 22 bp, Homo sapiens
taagtgtctctcgaattatgct

SEQ ID NO: 8362634 - DNA, 22 bp, Homo sapiens
taatacagggcactttgagtga

SEQ ID NO: 8362635 - DNA, 22 bp, Homo sapiens
taatacagtagcttttacacag

SEQ ID NO: 8362636 - DNA, 22 bp, Homo sapiens
taatacagtttccaagccagct

SEQ ID NO: 8362637 - DNA, 22 bp, Homo sapiens
taataattaacagtgatgggtc

SEQ ID NO: 8362638 - DNA, 22 bp, Homo sapiens
taataatagcagtagctgccac

SEQ ID NO: 8362639 - DNA, 22 bp, Homo sapiens
taatactgaaaggagtatcagc

SEQ ID NO: 8362640 - DNA, 22 bp, Homo sapiens
taatactgaaagggaaatgtcc

SEQ ID NO: 8362641 - DNA, 22 bp, Homo sapiens
taatactgaaggtaaaatttct

SEQ ID NO: 8362642 - DNA, 21 bp, Homo sapiens
taatactgaaagtgacatctg

SEQ ID NO: 8362643 - DNA, 22 bp, Homo sapiens
taatactgactaaagatatcaa

SEQ ID NO: 8362644 - DNA, 22 bp, Homo sapiens
taatacatcattcatctaagga

SEQ ID NO: 8362645 - DNA, 22 bp, Homo sapiens
taagtgagctagcagaagtgac

SEQ ID NO: 8362646 - DNA, 22 bp, Homo sapiens
taagtgagatctgaaatgaaat

SEQ ID NO: 8362647 - DNA, 22 bp, Homo sapiens
taagtgaatactaaggatggag

SEQ ID NO: 8362648 - DNA, 22 bp, Homo sapiens
taagtgaatccttgagaagaaa

SEQ ID NO: 8362649 - DNA, 22 bp, Homo sapiens
taaggttttgagaccagaacgt

SEQ ID NO: 8362650 - DNA, 22 bp, Homo sapiens
taattagagtttggtaaacaat

SEQ ID NO: 8362651 - DNA, 22 bp, Homo sapiens
taattagagtcacaagtaacca

SEQ ID NO: 8362652 - DNA, 22 bp, Homo sapiens
taattataacagttacatctta

SEQ ID NO: 8362653 - DNA, 22 bp, Homo sapiens
taattataacagttacatctta

SEQ ID NO: 8362654 - DNA, 22 bp, Homo sapiens
taattatagccgctattttgct

SEQ ID NO: 8362655 - DNA, 22 bp, Homo sapiens
taattacaggtccaaaacaatc

SEQ ID NO: 8362656 - DNA, 22 bp, Homo sapiens
taattacaggtccaaaacaatc

SEQ ID NO: 8362657 - DNA, 22 bp, Homo sapiens
taattacagaggtttgccagtt

SEQ ID NO: 8362658 - DNA, 22 bp, Homo sapiens
taatgtttccagtctatgatgg

SEQ ID NO: 8362659 - DNA, 22 bp, Homo sapiens
taatgtttttctcaacattgct

SEQ ID NO: 8362660 - DNA, 22 bp, Homo sapiens
taatggctaaaattcagaagaa

SEQ ID NO: 8362661 - DNA, 22 bp, Homo sapiens
taatgtttagaagcagacagct

SEQ ID NO: 8362662 - DNA, 23 bp, Homo sapiens
taatactgcttcagaggcttaga

SEQ ID NO: 8362663 - DNA, 19 bp, Homo sapiens
taatactggctgtagctgg

SEQ ID NO: 8362664 - DNA, 22 bp, Homo sapiens
taatactgatgtctgagcccca

SEQ ID NO: 8362665 - DNA, 22 bp, Homo sapiens
taatactgagccaccaggtagg

SEQ ID NO: 8362666 - DNA, 22 bp, Homo sapiens
taatactgctgtgcttgagttg

SEQ ID NO: 8362667 - DNA, 22 bp, Homo sapiens
taatactgtgcttcattttcct

SEQ ID NO: 8362668 - DNA, 22 bp, Homo sapiens
taatactgtatactgcaaattt

SEQ ID NO: 8362669 - DNA, 22 bp, Homo sapiens
taatactgggaaatacttgggt

SEQ ID NO: 8362670 - DNA, 22 bp, Homo sapiens
taatactgtaacttggtgggtc

SEQ ID NO: 8362671 - DNA, 22 bp, Homo sapiens
taatacttttgccttgtattca

SEQ ID NO: 8362672 - DNA, 22 bp, Homo sapiens
taatagaaaggtattttttgca

SEQ ID NO: 8362673 - DNA, 22 bp, Homo sapiens
tacaaaggagtagagaaggctt

SEQ ID NO: 8362674 - DNA, 22 bp, Homo sapiens
tacaaagtaatgtataatatcg

SEQ ID NO: 8362675 - DNA, 22 bp, Homo sapiens
tacaaagtaatgtataatatcg

SEQ ID NO: 8362676 - DNA, 22 bp, Homo sapiens
tacaaagtcacattgaaatgaa

SEQ ID NO: 8362677 - DNA, 22 bp, Homo sapiens
tacaaagtagaaattcagtaaa

SEQ ID NO: 8362678 - DNA, 22 bp, Homo sapiens
tacaaagatagtgttagagtaa

SEQ ID NO: 8362679 - DNA, 22 bp, Homo sapiens
tacaaagatggaaggttatgtt

SEQ ID NO: 8362680 - DNA, 22 bp, Homo sapiens
tacaaagcctggtagatatctg

SEQ ID NO: 8362681 - DNA, 22 bp, Homo sapiens
tacaaaggagaatagggtagca

SEQ ID NO: 8362682 - DNA, 20 bp, Homo sapiens
tacaaagagcccctctcttc

SEQ ID NO: 8362683 - DNA, 20 bp, Homo sapiens
tacaaagaatgaggttcagg

SEQ ID NO: 8362684 - DNA, 20 bp, Homo sapiens
tacaaagagcccctctcttc

SEQ ID NO: 8362685 - DNA, 22 bp, Homo sapiens
tacaaagagtttggtctctaga

SEQ ID NO: 8362686 - DNA, 22 bp, Homo sapiens
tacaaagagtttggtctctaga

SEQ ID NO: 8362687 - DNA, 22 bp, Homo sapiens
tacaaagaggtaattgcatata

SEQ ID NO: 8362688 - DNA, 22 bp, Homo sapiens
tacaaaaaattgatactgacga

SEQ ID NO: 8362689 - DNA, 22 bp, Homo sapiens
taattatagccgctattttgct

SEQ ID NO: 8362690 - DNA, 22 bp, Homo sapiens
taattattatgacaacaattgc

SEQ ID NO: 8362691 - DNA, 22 bp, Homo sapiens
tacaaaaaattgatactgacga

SEQ ID NO: 8362692 - DNA, 22 bp, Homo sapiens
gttcatgtggaaatttaaaaca

SEQ ID NO: 8362693 - DNA, 20 bp, Homo sapiens
gttcatgtctcaaatagaaa

SEQ ID NO: 8362694 - DNA, 22 bp, Homo sapiens
gttcatttaggaaaggaagagt

SEQ ID NO: 8362695 - DNA, 22 bp, Homo sapiens
gttcatttatgatgtaacatgt

SEQ ID NO: 8362696 - DNA, 22 bp, Homo sapiens
gttgaggtgatgccagccctgc

SEQ ID NO: 8362697 - DNA, 22 bp, Homo sapiens
gttgaggtgatgccagccctgc

SEQ ID NO: 8362698 - DNA, 22 bp, Homo sapiens
gttcagtcacgtgcccaagttc

SEQ ID NO: 8362699 - DNA, 22 bp, Homo sapiens
gttcagtgccagttctaagact

SEQ ID NO: 8362700 - DNA, 22 bp, Homo sapiens
gttcagtcacgtgcccaagttc

SEQ ID NO: 8362701 - DNA, 22 bp, Homo sapiens
gttcagtgtttttattgacagg

SEQ ID NO: 8362702 - DNA, 22 bp, Homo sapiens
gttcagtgtttacatgattgtt

SEQ ID NO: 8362703 - DNA, 22 bp, Homo sapiens
gttcacagttttatacctgaga

SEQ ID NO: 8362704 - DNA, 22 bp, Homo sapiens
gttcacatcacttcactgaacc

SEQ ID NO: 8362705 - DNA, 22 bp, Homo sapiens
gttcacatcccagaaagagcat

SEQ ID NO: 8362706 - DNA, 22 bp, Homo sapiens
gttcacatcctgctttttccct

SEQ ID NO: 8362707 - DNA, 22 bp, Homo sapiens
gttcacatgctctcatgctttt

SEQ ID NO: 8362708 - DNA, 22 bp, Homo sapiens
gttcacatccttgtgaggattt

SEQ ID NO: 8362709 - DNA, 22 bp, Homo sapiens
gttcacatcctggctgtgccac

SEQ ID NO: 8362710 - DNA, 22 bp, Homo sapiens
gttacaaaggactgggggccac

SEQ ID NO: 8362711 - DNA, 22 bp, Homo sapiens
gttacaaaggactgggggccac

SEQ ID NO: 8362712 - DNA, 22 bp, Homo sapiens
gttcagcaatagatctagaggc

SEQ ID NO: 8362713 - DNA, 22 bp, Homo sapiens
gttcagctcaagcaataatttt

SEQ ID NO: 8362714 - DNA, 22 bp, Homo sapiens
gttcagcagcagtgattttgtg

SEQ ID NO: 8362715 - DNA, 21 bp, Homo sapiens
gttcagagattattgagtcat

SEQ ID NO: 8362716 - DNA, 22 bp, Homo sapiens
gttcagagaaagagacacctta

SEQ ID NO: 8362717 - DNA, 22 bp, Homo sapiens
gttcacatgtggtcatgctgtc

SEQ ID NO: 8362718 - DNA, 22 bp, Homo sapiens
gttcacatgtgttatcttcttt

SEQ ID NO: 8362719 - DNA, 22 bp, Homo sapiens
gttcacatggcattttcacatc

SEQ ID NO: 8362720 - DNA, 22 bp, Homo sapiens
gttcacatggcattttcacatc

SEQ ID NO: 8362721 - DNA, 22 bp, Homo sapiens
gttcacattaactcaccggtgc

SEQ ID NO: 8362722 - DNA, 22 bp, Homo sapiens
gttggggaaggtgggagaatgt

SEQ ID NO: 8362723 - DNA, 22 bp, Homo sapiens
gttgggttaaccaggatgtcaa

SEQ ID NO: 8362724 - DNA, 22 bp, Homo sapiens
gttgcagacactccacagtcga

SEQ ID NO: 8362725 - DNA, 22 bp, Homo sapiens
gttgcacagttcctcaagcagg

SEQ ID NO: 8362726 - DNA, 22 bp, Homo sapiens
gttgcacactggctataacaag

SEQ ID NO: 8362727 - DNA, 22 bp, Homo sapiens
gtttcatacagattattcatgg

SEQ ID NO: 8362728 - DNA, 18 bp, Homo sapiens
gtttcatgcatgtgaaac

SEQ ID NO: 8362729 - DNA, 22 bp, Homo sapiens
gtttcatgccatttccagattg

SEQ ID NO: 8362730 - DNA, 22 bp, Homo sapiens
gtttcatggagagctgaatatt

SEQ ID NO: 8362731 - DNA, 22 bp, Homo sapiens
gtgctcctggccacatgaagct

SEQ ID NO: 8362732 - DNA, 22 bp, Homo sapiens
gtgctcctcacagtgtggccct

SEQ ID NO: 8362733 - DNA, 22 bp, Homo sapiens
gtgctctaggaccttagaagtg

SEQ ID NO: 8362734 - DNA, 22 bp, Homo sapiens
gtgctctgcctggggtcatggc

SEQ ID NO: 8362735 - DNA, 22 bp, Homo sapiens
gtgctcaggaagctgttcctgc

SEQ ID NO: 8362736 - DNA, 22 bp, Homo sapiens
gtgctccctccttcctcaagga

SEQ ID NO: 8362737 - DNA, 21 bp, Homo sapiens
gtgctctgggcagcagagggc

SEQ ID NO: 8362738 - DNA, 22 bp, Homo sapiens
gtgctctgtgtattaggatgtc

SEQ ID NO: 8362739 - DNA, 22 bp, Homo sapiens
gtgctctgtgtattaggatgtc

SEQ ID NO: 8362740 - DNA, 22 bp, Homo sapiens
gtgtgcatgtgcttgcacagat

SEQ ID NO: 8362741 - DNA, 22 bp, Homo sapiens
gtgtgcatgcatagacaccaca

SEQ ID NO: 8362742 - DNA, 23 bp, Homo sapiens
gtgtgccaagcactgtgccagga

SEQ ID NO: 8362743 - DNA, 22 bp, Homo sapiens
gtgtgccaacaaaagacagtgc

SEQ ID NO: 8362744 - DNA, 22 bp, Homo sapiens
gtgtgccaccactgacaggatt

SEQ ID NO: 8362745 - DNA, 22 bp, Homo sapiens
gtgtgggaatggcggtcgtgca

SEQ ID NO: 8362746 - DNA, 22 bp, Homo sapiens
gtgtgggaatggcggtcgtgca

SEQ ID NO: 8362747 - DNA, 22 bp, Homo sapiens
gtgtgggacgggtgagtggcca

SEQ ID NO: 8362748 - DNA, 22 bp, Homo sapiens
gtgtgggaaggctaggatgctg

SEQ ID NO: 8362749 - DNA, 22 bp, Homo sapiens
gtgtgggaaggctaggatgctg

SEQ ID NO: 8362750 - DNA, 22 bp, Homo sapiens
gttaagaagctagagatgaaca

SEQ ID NO: 8362751 - DNA, 22 bp, Homo sapiens
gttaacatttctaggtgcaggg

SEQ ID NO: 8362752 - DNA, 22 bp, Homo sapiens
gttaagaacttgttgaaggtct

SEQ ID NO: 8362753 - DNA, 22 bp, Homo sapiens
gttacaaagcacttcaagtgaa

SEQ ID NO: 8362754 - DNA, 22 bp, Homo sapiens
gttacaaagcacttcaagtgaa

SEQ ID NO: 8362755 - DNA, 22 bp, Homo sapiens
gttacaaagcacttcaagtgaa

SEQ ID NO: 8362756 - DNA, 22 bp, Homo sapiens
gttacaaaggaagcttcactgc

SEQ ID NO: 8362757 - DNA, 22 bp, Homo sapiens
gttacaaaggaagcttcactgc

SEQ ID NO: 8362758 - DNA, 22 bp, Homo sapiens
gttacaaaggaagcttcactgc

SEQ ID NO: 8362759 - DNA, 22 bp, Homo sapiens
gttacaaactcaggtgccaaaa

SEQ ID NO: 8362760 - DNA, 22 bp, Homo sapiens
gttacaaactcaggtgccaaaa

SEQ ID NO: 8362761 - DNA, 18 bp, Homo sapiens
gttaattttgaagttcat

SEQ ID NO: 8362762 - DNA, 22 bp, Homo sapiens
gttaatttgcagctttcgagct

SEQ ID NO: 8362763 - DNA, 22 bp, Homo sapiens
gttaatgtcttcctattctaca

SEQ ID NO: 8362764 - DNA, 22 bp, Homo sapiens
gttaatatttacctgtcaagaa

SEQ ID NO: 8362765 - DNA, 22 bp, Homo sapiens
gttaatgtgatataaagtattt

SEQ ID NO: 8362766 - DNA, 22 bp, Homo sapiens
gttaatgtgtctgacacaatgg

SEQ ID NO: 8362767 - DNA, 22 bp, Homo sapiens
gttaatgtgtctgacacaatgg

SEQ ID NO: 8362768 - DNA, 22 bp, Homo sapiens
gttaatgttatctgaagacagt

SEQ ID NO: 8362769 - DNA, 22 bp, Homo sapiens
gttaatttagtagagtccagat

SEQ ID NO: 8362770 - DNA, 22 bp, Homo sapiens
gttaagtgaatgtcatgtcagg

SEQ ID NO: 8362771 - DNA, 22 bp, Homo sapiens
taaattatggctggcagagcag

SEQ ID NO: 8362772 - DNA, 22 bp, Homo sapiens
taaattatgttccatgtccttt

SEQ ID NO: 8362773 - DNA, 22 bp, Homo sapiens
taaattatgtcacatgactctg

SEQ ID NO: 8362774 - DNA, 22 bp, Homo sapiens
taaattatgtcacatgactctg

SEQ ID NO: 8362775 - DNA, 22 bp, Homo sapiens
taaattatgttccatgtccttt

SEQ ID NO: 8362776 - DNA, 22 bp, Homo sapiens
taaattatgttccatgtccttt

SEQ ID NO: 8362777 - DNA, 22 bp, Homo sapiens
taaattatgttccatgtccttt

SEQ ID NO: 8362778 - DNA, 22 bp, Homo sapiens
taaagtagcaagtttagactga

SEQ ID NO: 8362779 - DNA, 22 bp, Homo sapiens
taaagtaatccttcataaggag

SEQ ID NO: 8362780 - DNA, 22 bp, Homo sapiens
taaaggtagcatgaaactgcaa

SEQ ID NO: 8362781 - DNA, 22 bp, Homo sapiens
taaaggtaacatgaactgcttt

SEQ ID NO: 8362782 - DNA, 22 bp, Homo sapiens
taaaggtagtgtgacatattgt

SEQ ID NO: 8362783 - DNA, 22 bp, Homo sapiens
taaaggtagtgtgacatattgt

SEQ ID NO: 8362784 - DNA, 22 bp, Homo sapiens
taaattgcataagtacaaatga

SEQ ID NO: 8362785 - DNA, 22 bp, Homo sapiens
taaattcagtgagtaatttctg

SEQ ID NO: 8362786 - DNA, 22 bp, Homo sapiens
taaattctacaacttcaaagat

SEQ ID NO: 8362787 - DNA, 22 bp, Homo sapiens
taacctcagaaacataatcttt

SEQ ID NO: 8362788 - DNA, 22 bp, Homo sapiens
taacctcaatttaattatctgt

SEQ ID NO: 8362789 - DNA, 22 bp, Homo sapiens
taaccatgcatgtctctagttt

SEQ ID NO: 8362790 - DNA, 22 bp, Homo sapiens
taacattaaaagagataattga

SEQ ID NO: 8362791 - DNA, 22 bp, Homo sapiens
taaatttacccaaggaacatgt

SEQ ID NO: 8362792 - DNA, 22 bp, Homo sapiens
taaatttttgttaacagcctct

SEQ ID NO: 8362793 - DNA, 22 bp, Homo sapiens
taactaactagtgttcaaaata

SEQ ID NO: 8362794 - DNA, 22 bp, Homo sapiens
taacctgactgctctttagaat

SEQ ID NO: 8362795 - DNA, 22 bp, Homo sapiens
taactcatggagaggcggagtt

SEQ ID NO: 8362796 - DNA, 22 bp, Homo sapiens
taactcaaatacttatgttact

SEQ ID NO: 8362797 - DNA, 22 bp, Homo sapiens
taactcaacttggagggttctt

SEQ ID NO: 8362798 - DNA, 22 bp, Homo sapiens
taactcaaatatgttgtctgaa

SEQ ID NO: 8362799 - DNA, 22 bp, Homo sapiens
taactcaaaatgcacctgctga

SEQ ID NO: 8362800 - DNA, 22 bp, Homo sapiens
taactctgaatcctcacagcag

SEQ ID NO: 8362801 - DNA, 22 bp, Homo sapiens
taactccatctctgtgtctgct

SEQ ID NO: 8362802 - DNA, 22 bp, Homo sapiens
taactccacacccctcttggtg

SEQ ID NO: 8362803 - DNA, 22 bp, Homo sapiens
taactgattcctttttgaaaat

SEQ ID NO: 8362804 - DNA, 22 bp, Homo sapiens
taactgaatgtattacaacaga

SEQ ID NO: 8362805 - DNA, 22 bp, Homo sapiens
taactgatattgaaaaacatca

SEQ ID NO: 8362806 - DNA, 22 bp, Homo sapiens
gtttccaactagtatgatcagg

SEQ ID NO: 8362807 - DNA, 22 bp, Homo sapiens
gtttccaggcactttttctgct

SEQ ID NO: 8362808 - DNA, 22 bp, Homo sapiens
gttttggagtcaggcttagatg

SEQ ID NO: 8362809 - DNA, 18 bp, Homo sapiens
gttttgaattgtcttaca

SEQ ID NO: 8362810 - DNA, 22 bp, Homo sapiens
gttttgcagagtgcaataaatc

SEQ ID NO: 8362811 - DNA, 19 bp, Homo sapiens
gttttgcaggcagagggga

SEQ ID NO: 8362812 - DNA, 22 bp, Homo sapiens
gtttttatatcctgtggagtgt

SEQ ID NO: 8362813 - DNA, 22 bp, Homo sapiens
gtttttacagcagcaaaatact

SEQ ID NO: 8362814 - DNA, 22 bp, Homo sapiens
taaaagttttagttgtacataa

SEQ ID NO: 8362815 - DNA, 22 bp, Homo sapiens
taaaagttagctaggacaaagt

SEQ ID NO: 8362816 - DNA, 22 bp, Homo sapiens
gtttttatctaatagcagttat

SEQ ID NO: 8362817 - DNA, 22 bp, Homo sapiens
gtttttattgtgtaaatgtggg

SEQ ID NO: 8362818 - DNA, 22 bp, Homo sapiens
taaaagttttagttgtacataa

SEQ ID NO: 8362819 - DNA, 22 bp, Homo sapiens
taaaagttttagttgtacataa

SEQ ID NO: 8362820 - DNA, 22 bp, Homo sapiens
taaaatagaggatgtcatgcta

SEQ ID NO: 8362821 - DNA, 19 bp, Homo sapiens
taaaatgtctgtggtcagt

SEQ ID NO: 8362822 - DNA, 19 bp, Homo sapiens
taaaatgtctgtggtcagt

SEQ ID NO: 8362823 - DNA, 22 bp, Homo sapiens
taaaatggtaactttcatttgc

SEQ ID NO: 8362824 - DNA, 22 bp, Homo sapiens
taaaatgtagcttctaggctgg

SEQ ID NO: 8362825 - DNA, 22 bp, Homo sapiens
taaagggtaggttttactgtaa

SEQ ID NO: 8362826 - DNA, 22 bp, Homo sapiens
taaacaattcctctctaggcat

SEQ ID NO: 8362827 - DNA, 22 bp, Homo sapiens
taaacaattcctctctaggcat

SEQ ID NO: 8362828 - DNA, 22 bp, Homo sapiens
taaaattgcggtgaatatttcc

SEQ ID NO: 8362829 - DNA, 22 bp, Homo sapiens
taaaattgcggtgaatatttcc

SEQ ID NO: 8362830 - DNA, 22 bp, Homo sapiens
taaaattgcggtgaatatttcc

SEQ ID NO: 8362831 - DNA, 22 bp, Homo sapiens
taaaatttgtccctgagtgttg

SEQ ID NO: 8362832 - DNA, 22 bp, Homo sapiens
taaaatttgtccctgagtgttg

SEQ ID NO: 8362833 - DNA, 22 bp, Homo sapiens
taaaattgcggtgaatatttcc

SEQ ID NO: 8362834 - DNA, 18 bp, Homo sapiens
taaaattcaaggcagggt

SEQ ID NO: 8362835 - DNA, 22 bp, Homo sapiens
taaaatgtgtttctgtatggtt

SEQ ID NO: 8362836 - DNA, 22 bp, Homo sapiens
taaaatgtgtttctgtatggtt

SEQ ID NO: 8362837 - DNA, 22 bp, Homo sapiens
taaaatgtgtttctgtatggtt

SEQ ID NO: 8362838 - DNA, 22 bp, Homo sapiens
tcactgagaagagtaacagcag

SEQ ID NO: 8362839 - DNA, 22 bp, Homo sapiens
tcactgtgcacatatgataggt

SEQ ID NO: 8362840 - DNA, 22 bp, Homo sapiens
tcactctgtggcccaggcagtg

SEQ ID NO: 8362841 - DNA, 22 bp, Homo sapiens
tcacttgcctagcccagttcag

SEQ ID NO: 8362842 - DNA, 19 bp, Homo sapiens
tcacttgtgccaggcactg

SEQ ID NO: 8362843 - DNA, 22 bp, Homo sapiens
tcacttgctaacagatattgag

SEQ ID NO: 8362844 - DNA, 22 bp, Homo sapiens
tcacttgagatgtaccacaaac

SEQ ID NO: 8362845 - DNA, 22 bp, Homo sapiens
tcactttaaactactgtggtct

SEQ ID NO: 8362846 - DNA, 22 bp, Homo sapiens
tcactttactttgttaatctgg

SEQ ID NO: 8362847 - DNA, 22 bp, Homo sapiens
tcactttagaggaaacattgag

SEQ ID NO: 8362848 - DNA, 22 bp, Homo sapiens
tcacattttttactggacttaa

SEQ ID NO: 8362849 - DNA, 22 bp, Homo sapiens
tcaccaaggcattttcacagca

SEQ ID NO: 8362850 - DNA, 22 bp, Homo sapiens
tcaccagacagttactgcatgt

SEQ ID NO: 8362851 - DNA, 23 bp, Homo sapiens
tcaccagaaggggtcaataaaga

SEQ ID NO: 8362852 - DNA, 22 bp, Homo sapiens
tcaccaggactgagaccttggg

SEQ ID NO: 8362853 - DNA, 22 bp, Homo sapiens
tcaccagatgatttttcttcag

SEQ ID NO: 8362854 - DNA, 22 bp, Homo sapiens
tcaccagatctctctgtaatgg

SEQ ID NO: 8362855 - DNA, 22 bp, Homo sapiens
tcaccaggattgggctgtaggc

SEQ ID NO: 8362856 - DNA, 22 bp, Homo sapiens
tcacccagcagctgcttctgct

SEQ ID NO: 8362857 - DNA, 22 bp, Homo sapiens
tcacattttcatattctctgag

SEQ ID NO: 8362858 - DNA, 22 bp, Homo sapiens
tcacattttccttggtatctgt

SEQ ID NO: 8362859 - DNA, 22 bp, Homo sapiens
tcacattttctactactgtacg

SEQ ID NO: 8362860 - DNA, 22 bp, Homo sapiens
tcacattttctactactgtacg

SEQ ID NO: 8362861 - DNA, 22 bp, Homo sapiens
tcacattttctactactgtacg

SEQ ID NO: 8362862 - DNA, 22 bp, Homo sapiens
tcacattttctactactgtacg

SEQ ID NO: 8362863 - DNA, 22 bp, Homo sapiens
tcacattttcttaggaaactta

SEQ ID NO: 8362864 - DNA, 22 bp, Homo sapiens
tcacattttgttcaaggctagt

SEQ ID NO: 8362865 - DNA, 22 bp, Homo sapiens
tcacattttgttcaaggctagt

SEQ ID NO: 8362866 - DNA, 22 bp, Homo sapiens
tcacattttcaaaagctggtgc

SEQ ID NO: 8362867 - DNA, 22 bp, Homo sapiens
tcacattttatctgagattgac

SEQ ID NO: 8362868 - DNA, 22 bp, Homo sapiens
tcactataatatgtcaaaatac

SEQ ID NO: 8362869 - DNA, 22 bp, Homo sapiens
tcactctgacttggcctccaac

SEQ ID NO: 8362870 - DNA, 22 bp, Homo sapiens
tcactctgctgcccgagggctg

SEQ ID NO: 8362871 - DNA, 22 bp, Homo sapiens
tcactctggagtccgctaccag

SEQ ID NO: 8362872 - DNA, 22 bp, Homo sapiens
tcacccaggctggagtgcagtg

SEQ ID NO: 8362873 - DNA, 19 bp, Homo sapiens
tcacccaggctgctggctc

SEQ ID NO: 8362874 - DNA, 22 bp, Homo sapiens
tcacccaggctggactgcagtg

SEQ ID NO: 8362875 - DNA, 20 bp, Homo sapiens
tcagagcagttggcttgtct

SEQ ID NO: 8362876 - DNA, 20 bp, Homo sapiens
tcagagcagttggcttgtct

SEQ ID NO: 8362877 - DNA, 22 bp, Homo sapiens
tcagagcagactttgaaggagg

SEQ ID NO: 8362878 - DNA, 22 bp, Homo sapiens
tcagagcatgtgggctgcagtt

SEQ ID NO: 8362879 - DNA, 22 bp, Homo sapiens
tcagagcactggtgctaccttg

SEQ ID NO: 8362880 - DNA, 20 bp, Homo sapiens
tcagagctgcaggagagaaa

SEQ ID NO: 8362881 - DNA, 22 bp, Homo sapiens
tcagagcccctccgctgtccca

SEQ ID NO: 8362882 - DNA, 22 bp, Homo sapiens
tcagagccctgctcctccccaa

SEQ ID NO: 8362883 - DNA, 22 bp, Homo sapiens
tcagagctaaggggagagcaaa

SEQ ID NO: 8362884 - DNA, 22 bp, Homo sapiens
tcagagctcatgagcagagcca

SEQ ID NO: 8362885 - DNA, 22 bp, Homo sapiens
tcagaggaaaggtcagatggct

SEQ ID NO: 8362886 - DNA, 22 bp, Homo sapiens
tcagaggaactggactaaagcc

SEQ ID NO: 8362887 - DNA, 22 bp, Homo sapiens
tcagcaagtggaccatcctggg

SEQ ID NO: 8362888 - DNA, 20 bp, Homo sapiens
tcagcacagctgacaaggtt

SEQ ID NO: 8362889 - DNA, 22 bp, Homo sapiens
tcagcaatcctcccacaggtgg

SEQ ID NO: 8362890 - DNA, 22 bp, Homo sapiens
tcagcaccagttatcctcaggg

SEQ ID NO: 8362891 - DNA, 20 bp, Homo sapiens
tcagagaaggagctttcctg

SEQ ID NO: 8362892 - DNA, 20 bp, Homo sapiens
tcagagaaggagctttcctg

SEQ ID NO: 8362893 - DNA, 22 bp, Homo sapiens
tcagagaaggaggcacgagggc

SEQ ID NO: 8362894 - DNA, 20 bp, Homo sapiens
tcagagaagggactgagatt

SEQ ID NO: 8362895 - DNA, 22 bp, Homo sapiens
tcagagaaggctgagtcacggc

SEQ ID NO: 8362896 - DNA, 22 bp, Homo sapiens
tcagagaaggcaattttatggt

SEQ ID NO: 8362897 - DNA, 22 bp, Homo sapiens
tcagagaaggaggcacgagggc

SEQ ID NO: 8362898 - DNA, 22 bp, Homo sapiens
tcagagaagctgccaggcgagc

SEQ ID NO: 8362899 - DNA, 22 bp, Homo sapiens
tcagagaagcttaagctgtaat

SEQ ID NO: 8362900 - DNA, 22 bp, Homo sapiens
tcagagaagcttaagctgtaat

SEQ ID NO: 8362901 - DNA, 22 bp, Homo sapiens
tcagagaagacatcattgtgaa

SEQ ID NO: 8362902 - DNA, 22 bp, Homo sapiens
tcagagaactgcagcccttcct

SEQ ID NO: 8362903 - DNA, 23 bp, Homo sapiens
tcagagaactcgggcagatgacc

SEQ ID NO: 8362904 - DNA, 22 bp, Homo sapiens
tcagacagtttgcagtgtgcct

SEQ ID NO: 8362905 - DNA, 22 bp, Homo sapiens
tcagagaactccacaccttagg

SEQ ID NO: 8362906 - DNA, 23 bp, Homo sapiens
tcagagaactcgggcagatgacc

SEQ ID NO: 8362907 - DNA, 17 bp, Homo sapiens
tcagaccctgtgtcagg

SEQ ID NO: 8362908 - DNA, 20 bp, Homo sapiens
tcagacccagattagcaggt

SEQ ID NO: 8362909 - DNA, 20 bp, Homo sapiens
tcagaccctacattcctcag

SEQ ID NO: 8362910 - DNA, 22 bp, Homo sapiens
tcagaccctgcggtgtttggat

SEQ ID NO: 8362911 - DNA, 22 bp, Homo sapiens
tcagacaggcttctttctccct

SEQ ID NO: 8362912 - DNA, 22 bp, Homo sapiens
tcagacagggcttctcaaactt

SEQ ID NO: 8362913 - DNA, 22 bp, Homo sapiens
tcagacaggcctctccagcctc

SEQ ID NO: 8362914 - DNA, 22 bp, Homo sapiens
tcagaaaaggtagctgtgacaa

SEQ ID NO: 8362915 - DNA, 22 bp, Homo sapiens
tcagacagattttgacacttgc

SEQ ID NO: 8362916 - DNA, 22 bp, Homo sapiens
tcagaaaagaccacattattct

SEQ ID NO: 8362917 - DNA, 22 bp, Homo sapiens
tcagaaaagagaaaatcttata

SEQ ID NO: 8362918 - DNA, 22 bp, Homo sapiens
tcagaaaagagaaaatcttata

SEQ ID NO: 8362919 - DNA, 22 bp, Homo sapiens
tcagaaaagaccacattattct

SEQ ID NO: 8362920 - DNA, 22 bp, Homo sapiens
tcacttttgatccctatgcagt

SEQ ID NO: 8362921 - DNA, 22 bp, Homo sapiens
tcacttttgggtttccagtaga

SEQ ID NO: 8362922 - DNA, 22 bp, Homo sapiens
tcaagagattgaataataactg

SEQ ID NO: 8362923 - DNA, 22 bp, Homo sapiens
tcaagacatattaaatgtgcga

SEQ ID NO: 8362924 - DNA, 22 bp, Homo sapiens
tcaaggaagggatattcttgaa

SEQ ID NO: 8362925 - DNA, 22 bp, Homo sapiens
tatttctgtcagccagatatgg

SEQ ID NO: 8362926 - DNA, 20 bp, Homo sapiens
tatttctgggcaaccattta

SEQ ID NO: 8362927 - DNA, 22 bp, Homo sapiens
tatttctgtcagccagatatgg

SEQ ID NO: 8362928 - DNA, 22 bp, Homo sapiens
tatttctgggagttcagaaatt

SEQ ID NO: 8362929 - DNA, 22 bp, Homo sapiens
tatttctgattgctcatgaggc

SEQ ID NO: 8362930 - DNA, 20 bp, Homo sapiens
tcaagacagacatggagttt

SEQ ID NO: 8362931 - DNA, 22 bp, Homo sapiens
tcaagaagtctgtaccatttga

SEQ ID NO: 8362932 - DNA, 22 bp, Homo sapiens
tatttcttgagtggtcagtttc

SEQ ID NO: 8362933 - DNA, 22 bp, Homo sapiens
tatttcttcgggattcaagcta

SEQ ID NO: 8362934 - DNA, 22 bp, Homo sapiens
tcaaggttgttgaggcctgact

SEQ ID NO: 8362935 - DNA, 22 bp, Homo sapiens
tcaataaaattgttttcctatc

SEQ ID NO: 8362936 - DNA, 20 bp, Homo sapiens
tcaagttttgcttgacaaga

SEQ ID NO: 8362937 - DNA, 22 bp, Homo sapiens
tcaataaatagcttggctcagc

SEQ ID NO: 8362938 - DNA, 22 bp, Homo sapiens
tcaataaaattgttttcctatc

SEQ ID NO: 8362939 - DNA, 22 bp, Homo sapiens
tcaatttcaacagctgataaga

SEQ ID NO: 8362940 - DNA, 22 bp, Homo sapiens
tcaattttatgaaacaaagtga

SEQ ID NO: 8362941 - DNA, 22 bp, Homo sapiens
tcaataatggcaggataaattt

SEQ ID NO: 8362942 - DNA, 22 bp, Homo sapiens
tcaataagtaggatatcaagat

SEQ ID NO: 8362943 - DNA, 22 bp, Homo sapiens
tcacaagagtaagttcatgcct

SEQ ID NO: 8362944 - DNA, 22 bp, Homo sapiens
tcacaagagctggactgtcttt

SEQ ID NO: 8362945 - DNA, 22 bp, Homo sapiens
tcacaagagctggactgtcttt

SEQ ID NO: 8362946 - DNA, 22 bp, Homo sapiens
tcacaaagggagggatagctgg

SEQ ID NO: 8362947 - DNA, 22 bp, Homo sapiens
tcacaagatggctgctgcagcc

SEQ ID NO: 8362948 - DNA, 22 bp, Homo sapiens
tcacaagatatttcagtccttt

SEQ ID NO: 8362949 - DNA, 22 bp, Homo sapiens
tcacaagatacagttagaagca

SEQ ID NO: 8362950 - DNA, 22 bp, Homo sapiens
tcacaagagtaagttcatgcct

SEQ ID NO: 8362951 - DNA, 22 bp, Homo sapiens
tcacaagataaacatagctcca

SEQ ID NO: 8362952 - DNA, 20 bp, Homo sapiens
tcaattttctacaacatttg

SEQ ID NO: 8362953 - DNA, 20 bp, Homo sapiens
tcaattttctacaacatttg

SEQ ID NO: 8362954 - DNA, 20 bp, Homo sapiens
tcaattttctacaacatttg

SEQ ID NO: 8362955 - DNA, 22 bp, Homo sapiens
tcacaaaaggccatgtggcttc

SEQ ID NO: 8362956 - DNA, 22 bp, Homo sapiens
tcacaaagctttgataagcaga

SEQ ID NO: 8362957 - DNA, 22 bp, Homo sapiens
tcacaaaggatgatgaattctg

SEQ ID NO: 8362958 - DNA, 22 bp, Homo sapiens
tcacagaacaagcctggtggag

SEQ ID NO: 8362959 - DNA, 22 bp, Homo sapiens
tcacagaacaagcctggtggag

SEQ ID NO: 8362960 - DNA, 22 bp, Homo sapiens
tcacagaaatctgttttttcta

SEQ ID NO: 8362961 - DNA, 22 bp, Homo sapiens
tcacagaaataagatagttatt

SEQ ID NO: 8362962 - DNA, 22 bp, Homo sapiens
tcacagaaagctgtgtcctgac

SEQ ID NO: 8362963 - DNA, 22 bp, Homo sapiens
tcacagaagagatattgacaga

SEQ ID NO: 8362964 - DNA, 22 bp, Homo sapiens
tcacagaacaatgtttagttct

SEQ ID NO: 8362965 - DNA, 22 bp, Homo sapiens
tcacagggtatctgggatggat

SEQ ID NO: 8362966 - DNA, 23 bp, Homo sapiens
tcacagggcactggctggggttg

SEQ ID NO: 8362967 - DNA, 22 bp, Homo sapiens
tcacaggctggtctccgaggac

SEQ ID NO: 8362968 - DNA, 22 bp, Homo sapiens
tcacaggctccagggcctggat

SEQ ID NO: 8362969 - DNA, 22 bp, Homo sapiens
tcacaggcctggggcagagggc

SEQ ID NO: 8362970 - DNA, 22 bp, Homo sapiens
tcacagctggacacgttggcat

SEQ ID NO: 8362971 - DNA, 22 bp, Homo sapiens
tcacaggataaggtggcatcac

SEQ ID NO: 8362972 - DNA, 22 bp, Homo sapiens
tcacagctccagactgcaactc

SEQ ID NO: 8362973 - DNA, 22 bp, Homo sapiens
tcacagaataaatgtactggcc

SEQ ID NO: 8362974 - DNA, 22 bp, Homo sapiens
tcacagaaggaccttgtttcat

SEQ ID NO: 8362975 - DNA, 22 bp, Homo sapiens
tcacagaagtgtagtgaggaaa

SEQ ID NO: 8362976 - DNA, 22 bp, Homo sapiens
tcacagaagttgaatttgcatg

SEQ ID NO: 8362977 - DNA, 22 bp, Homo sapiens
tcaggccacggctcactgagac

SEQ ID NO: 8362978 - DNA, 20 bp, Homo sapiens
tcaggcagtggggaaaggca

SEQ ID NO: 8362979 - DNA, 22 bp, Homo sapiens
tcaggcagtggtaaatgagtta

SEQ ID NO: 8362980 - DNA, 19 bp, Homo sapiens
tcaggcagttattcacaaa

SEQ ID NO: 8362981 - DNA, 22 bp, Homo sapiens
tcaggcctgcaaggagagtccc

SEQ ID NO: 8362982 - DNA, 22 bp, Homo sapiens
tcaggcctgcaggcttcctgga

SEQ ID NO: 8362983 - DNA, 22 bp, Homo sapiens
tcaggcctgcagtgccaaccca

SEQ ID NO: 8362984 - DNA, 22 bp, Homo sapiens
tcaggcctgctgtatgatggat

SEQ ID NO: 8362985 - DNA, 22 bp, Homo sapiens
tcaggcctgccctgaaagcaca

SEQ ID NO: 8362986 - DNA, 22 bp, Homo sapiens
tcaggccacttcacaggtgatt

SEQ ID NO: 8362987 - DNA, 22 bp, Homo sapiens
tcaggcctgcaaatgaatggta

SEQ ID NO: 8362988 - DNA, 22 bp, Homo sapiens
tcaggccaggagatcagattga

SEQ ID NO: 8362989 - DNA, 22 bp, Homo sapiens
tcaggatggcacccaagctctt

SEQ ID NO: 8362990 - DNA, 22 bp, Homo sapiens
tcaggatggcacccaagctctt

SEQ ID NO: 8362991 - DNA, 22 bp, Homo sapiens
tcaggatggtgtggaggaaata

SEQ ID NO: 8362992 - DNA, 22 bp, Homo sapiens
tcaggatggtgtggaggaaata

SEQ ID NO: 8362993 - DNA, 22 bp, Homo sapiens
tcaggatggagtctatccagtg

SEQ ID NO: 8362994 - DNA, 22 bp, Homo sapiens
tcaggatggagggaagcacaga

SEQ ID NO: 8362995 - DNA, 22 bp, Homo sapiens
tcaggatggagggaagcacaga

SEQ ID NO: 8362996 - DNA, 22 bp, Homo sapiens
tcaggatgagtcatcaagctgc

SEQ ID NO: 8362997 - DNA, 22 bp, Homo sapiens
tcaggatgacttcaaggaggaa

SEQ ID NO: 8362998 - DNA, 22 bp, Homo sapiens
tcaggatgagctcataactatg

SEQ ID NO: 8362999 - DNA, 20 bp, Homo sapiens
tcaggcagtggggaaaggca

SEQ ID NO: 8363000 - DNA, 21 bp, Homo sapiens
tcaggcagtgcaaatacatgg

SEQ ID NO: 8363001 - DNA, 22 bp, Homo sapiens
tcaggcagtagaattgcttgaa

SEQ ID NO: 8363002 - DNA, 22 bp, Homo sapiens
tcaggatgttaatatagcatta

SEQ ID NO: 8363003 - DNA, 20 bp, Homo sapiens
tcaggatgtgctgagtgaag

SEQ ID NO: 8363004 - DNA, 22 bp, Homo sapiens
tcaggatgaagtcagaggggtc

SEQ ID NO: 8363005 - DNA, 22 bp, Homo sapiens
tcaggatgacttcaaggaggaa

SEQ ID NO: 8363006 - DNA, 22 bp, Homo sapiens
tcaggatgaccacgagcctcta

SEQ ID NO: 8363007 - DNA, 22 bp, Homo sapiens
tcaggatgaccacgagcctcta

SEQ ID NO: 8363008 - DNA, 22 bp, Homo sapiens
tcaggatgaccacgagcctcta

SEQ ID NO: 8363009 - DNA, 22 bp, Homo sapiens
tcaggccttcagacctggcccg

SEQ ID NO: 8363010 - DNA, 22 bp, Homo sapiens
tcaggctgaggtcatctgcatc

SEQ ID NO: 8363011 - DNA, 22 bp, Homo sapiens
tcaggcctggagaaaggaatga

SEQ ID NO: 8363012 - DNA, 16 bp, Homo sapiens
tcaggcctggacgagc

SEQ ID NO: 8363013 - DNA, 22 bp, Homo sapiens
tcaggcctgctgtatgatggat

SEQ ID NO: 8363014 - DNA, 22 bp, Homo sapiens
tcaggcctgtgctggaggagat

SEQ ID NO: 8363015 - DNA, 22 bp, Homo sapiens
tcaggctgctggccagcaggct

SEQ ID NO: 8363016 - DNA, 22 bp, Homo sapiens
tcaggctggaatgcagtggggc

SEQ ID NO: 8363017 - DNA, 22 bp, Homo sapiens
tcaggctgctttcatgcttaga

SEQ ID NO: 8363018 - DNA, 22 bp, Homo sapiens
tcaggctgctgtactgtgaatg

SEQ ID NO: 8363019 - DNA, 22 bp, Homo sapiens
tcaggctgggctcctctcccca

SEQ ID NO: 8363020 - DNA, 22 bp, Homo sapiens
tcaggctggggtgctaaggtgt

SEQ ID NO: 8363021 - DNA, 22 bp, Homo sapiens
tcagggaaaacatcccgcctaa

SEQ ID NO: 8363022 - DNA, 22 bp, Homo sapiens
tcaggctttttctcaacctctt

SEQ ID NO: 8363023 - DNA, 22 bp, Homo sapiens
tcaggctgggagacaatcactg

SEQ ID NO: 8363024 - DNA, 18 bp, Homo sapiens
tcaggctgggcctccttc

SEQ ID NO: 8363025 - DNA, 22 bp, Homo sapiens
tcaggctggagtgcagtggcgc

SEQ ID NO: 8363026 - DNA, 22 bp, Homo sapiens
tcagggaaaagtcacactgggt

SEQ ID NO: 8363027 - DNA, 22 bp, Homo sapiens
tcagggaaacaggttttccctt

SEQ ID NO: 8363028 - DNA, 22 bp, Homo sapiens
tcagggaaacctaaggaagcca

SEQ ID NO: 8363029 - DNA, 22 bp, Homo sapiens
tcagggaaacctaaggaagcca

SEQ ID NO: 8363030 - DNA, 22 bp, Homo sapiens
tcagggaaaggggagagtcatt

SEQ ID NO: 8363031 - DNA, 22 bp, Homo sapiens
tcagggaaaggggagagtcatt

SEQ ID NO: 8363032 - DNA, 22 bp, Homo sapiens
tcagggaaaggggagagtcatt

SEQ ID NO: 8363033 - DNA, 22 bp, Homo sapiens
tcagggaaacctaaggaagcca

SEQ ID NO: 8363034 - DNA, 22 bp, Homo sapiens
tcagggaaatagcagggctgaa

SEQ ID NO: 8363035 - DNA, 22 bp, Homo sapiens
tcagggaaattcaagggagatt

SEQ ID NO: 8363036 - DNA, 22 bp, Homo sapiens
tcagggaacaatgttatggctt

SEQ ID NO: 8363037 - DNA, 22 bp, Homo sapiens
tcagggaaatttccatgtgttt

SEQ ID NO: 8363038 - DNA, 22 bp, Homo sapiens
tcagggaacaatgttatggctt

SEQ ID NO: 8363039 - DNA, 22 bp, Homo sapiens
tcagggaacatcgttaaactag

SEQ ID NO: 8363040 - DNA, 22 bp, Homo sapiens
tcagggaacatcgttaaactag

SEQ ID NO: 8363041 - DNA, 22 bp, Homo sapiens
tcaggaacccccgctgggtgaa

SEQ ID NO: 8363042 - DNA, 22 bp, Homo sapiens
tcaggaacataatgtgagtcag

SEQ ID NO: 8363043 - DNA, 22 bp, Homo sapiens
tcaggaagaagacggggcagga

SEQ ID NO: 8363044 - DNA, 22 bp, Homo sapiens
tcaggaagaaagaagggagtgt

SEQ ID NO: 8363045 - DNA, 21 bp, Homo sapiens
tcaggaagagccagttcatgc

SEQ ID NO: 8363046 - DNA, 21 bp, Homo sapiens
tcaggaagagccagttcatgc

SEQ ID NO: 8363047 - DNA, 22 bp, Homo sapiens
tcaggaagcatcctgaggtgtc

SEQ ID NO: 8363048 - DNA, 22 bp, Homo sapiens
tcaggaagggctcagtctgtgc

SEQ ID NO: 8363049 - DNA, 22 bp, Homo sapiens
tcaggaaggagctggcctgcca

SEQ ID NO: 8363050 - DNA, 22 bp, Homo sapiens
tcaggaaggagctggcctgcca

SEQ ID NO: 8363051 - DNA, 22 bp, Homo sapiens
tcagcaggcacaccaaaaactg

SEQ ID NO: 8363052 - DNA, 21 bp, Homo sapiens
tcagcaggcaccagaaggctg

SEQ ID NO: 8363053 - DNA, 21 bp, Homo sapiens
tcagcaggcaccagaaggctg

SEQ ID NO: 8363054 - DNA, 21 bp, Homo sapiens
tcagcaggcaccagaaggctg

SEQ ID NO: 8363055 - DNA, 21 bp, Homo sapiens
tcagcaggcaccagaaggctg

SEQ ID NO: 8363056 - DNA, 22 bp, Homo sapiens
tcagcaggcaccggaagtgttt

SEQ ID NO: 8363057 - DNA, 22 bp, Homo sapiens
tcagcaggcacggacaggctgc

SEQ ID NO: 8363058 - DNA, 22 bp, Homo sapiens
tcagcaggcaccggaagtgttt

SEQ ID NO: 8363059 - DNA, 22 bp, Homo sapiens
tcagcaggcacggacaggctgc

SEQ ID NO: 8363060 - DNA, 22 bp, Homo sapiens
tcagcaggcagaaatctgcaga

SEQ ID NO: 8363061 - DNA, 21 bp, Homo sapiens
tcagcagaaggaccactaggg

SEQ ID NO: 8363062 - DNA, 22 bp, Homo sapiens
tcagcagaacaaggaagcttaa

SEQ ID NO: 8363063 - DNA, 22 bp, Homo sapiens
tcagcagaagtatagaggccat

SEQ ID NO: 8363064 - DNA, 22 bp, Homo sapiens
tcagcagaagtatagaggccat

SEQ ID NO: 8363065 - DNA, 22 bp, Homo sapiens
tcagcaggcacaccaaaaactg

SEQ ID NO: 8363066 - DNA, 22 bp, Homo sapiens
tcagcagaaaggcactagatga

SEQ ID NO: 8363067 - DNA, 22 bp, Homo sapiens
tcagcagaaaggcactagatga

SEQ ID NO: 8363068 - DNA, 21 bp, Homo sapiens
tcagcagaaagcaaggtcagt

SEQ ID NO: 8363069 - DNA, 22 bp, Homo sapiens
tcagcactttgaagcagaagga

SEQ ID NO: 8363070 - DNA, 22 bp, Homo sapiens
tcagctctaagttttatgcaaa

SEQ ID NO: 8363071 - DNA, 22 bp, Homo sapiens
tcagctctacctgggagctgtc

SEQ ID NO: 8363072 - DNA, 22 bp, Homo sapiens
tcagctctcacagatctcaacc

SEQ ID NO: 8363073 - DNA, 18 bp, Homo sapiens
tcagcctgttgtctgcct

SEQ ID NO: 8363074 - DNA, 20 bp, Homo sapiens
tcagccttgaatgcttgaaa

SEQ ID NO: 8363075 - DNA, 22 bp, Homo sapiens
tcatgctcatcattagagtgac

SEQ ID NO: 8363076 - DNA, 22 bp, Homo sapiens
tcatgctctggtttagctgttt

SEQ ID NO: 8363077 - DNA, 19 bp, Homo sapiens
tcatgcatttctaagtgca

SEQ ID NO: 8363078 - DNA, 21 bp, Homo sapiens
tcatatttctcttgctattgt

SEQ ID NO: 8363079 - DNA, 22 bp, Homo sapiens
tcatatttagttcacgctcaat

SEQ ID NO: 8363080 - DNA, 22 bp, Homo sapiens
tcatatttaggcctttaattca

SEQ ID NO: 8363081 - DNA, 22 bp, Homo sapiens
tcatatttagttcacgctcaat

SEQ ID NO: 8363082 - DNA, 22 bp, Homo sapiens
tcatatttaggcctttaattca

SEQ ID NO: 8363083 - DNA, 22 bp, Homo sapiens
tcatattagggtaatgataaga

SEQ ID NO: 8363084 - DNA, 22 bp, Homo sapiens
tcatataagtttaaaactatct

SEQ ID NO: 8363085 - DNA, 22 bp, Homo sapiens
tcatataactggatattttcaa

SEQ ID NO: 8363086 - DNA, 18 bp, Homo sapiens
tcatagattcaagagtat

SEQ ID NO: 8363087 - DNA, 22 bp, Homo sapiens
tcatataccagagagtttatat

SEQ ID NO: 8363088 - DNA, 22 bp, Homo sapiens
tcatataagtttaaaactatct

SEQ ID NO: 8363089 - DNA, 22 bp, Homo sapiens
tcatatattttggcagtgatca

SEQ ID NO: 8363090 - DNA, 21 bp, Homo sapiens
tcatatctgctttgctgtctg

SEQ ID NO: 8363091 - DNA, 22 bp, Homo sapiens
tcatatgattgtaatgagaata

SEQ ID NO: 8363092 - DNA, 22 bp, Homo sapiens
tcatggccaaagtcaggagtgt

SEQ ID NO: 8363093 - DNA, 22 bp, Homo sapiens
tcatggaaacagcaatgctaat

SEQ ID NO: 8363094 - DNA, 22 bp, Homo sapiens
tcatggaaacagcaatgctaat

SEQ ID NO: 8363095 - DNA, 22 bp, Homo sapiens
tcatggaaacagcaatgctaat

SEQ ID NO: 8363096 - DNA, 22 bp, Homo sapiens
tcatgcttattgcatatttgga

SEQ ID NO: 8363097 - DNA, 23 bp, Homo sapiens
tcatggaactgggcaatcttgaa

SEQ ID NO: 8363098 - DNA, 23 bp, Homo sapiens
tcatggaactgggcaatcttgaa

SEQ ID NO: 8363099 - DNA, 18 bp, Homo sapiens
tcattagggattgcaaag

SEQ ID NO: 8363100 - DNA, 22 bp, Homo sapiens
tcattacacagttcagtggaaa

SEQ ID NO: 8363101 - DNA, 20 bp, Homo sapiens
tcattacagtgctaagatgt

SEQ ID NO: 8363102 - DNA, 20 bp, Homo sapiens
tcattacagtgctaagatgt

SEQ ID NO: 8363103 - DNA, 22 bp, Homo sapiens
tcattatagagttgtattttag

SEQ ID NO: 8363104 - DNA, 22 bp, Homo sapiens
tcattattctctttaatgttct

SEQ ID NO: 8363105 - DNA, 22 bp, Homo sapiens
tcattcatactcttttctatta

SEQ ID NO: 8363106 - DNA, 22 bp, Homo sapiens
tcattcataaaaattagttggc

SEQ ID NO: 8363107 - DNA, 23 bp, Homo sapiens
tcagtcttccctgtcagtaatag

SEQ ID NO: 8363108 - DNA, 22 bp, Homo sapiens
tcagtcttctagcaaatccagg

SEQ ID NO: 8363109 - DNA, 22 bp, Homo sapiens
tcagtcttctagcaaatccagg

SEQ ID NO: 8363110 - DNA, 22 bp, Homo sapiens
tcaggtggccaaatgggagcgc

SEQ ID NO: 8363111 - DNA, 22 bp, Homo sapiens
tcagggacccctctgagtggag

SEQ ID NO: 8363112 - DNA, 22 bp, Homo sapiens
tcagggaatgatgcacacagtt

SEQ ID NO: 8363113 - DNA, 22 bp, Homo sapiens
tcagggaatgggcccagtccct

SEQ ID NO: 8363114 - DNA, 22 bp, Homo sapiens
tcagggaatgggcccagtccct

SEQ ID NO: 8363115 - DNA, 22 bp, Homo sapiens
tcagggaatgtgatacaggaag

SEQ ID NO: 8363116 - DNA, 18 bp, Homo sapiens
tcagggaagagaatatga

SEQ ID NO: 8363117 - DNA, 18 bp, Homo sapiens
tcagggaagagaatatga

SEQ ID NO: 8363118 - DNA, 21 bp, Homo sapiens
tcagggaagtgtgcagaaggg

SEQ ID NO: 8363119 - DNA, 22 bp, Homo sapiens
tcagggaagagagatctcctag

SEQ ID NO: 8363120 - DNA, 22 bp, Homo sapiens
tcagggaagagagatctcctag

SEQ ID NO: 8363121 - DNA, 22 bp, Homo sapiens
tcagggaagagagatctcctag

SEQ ID NO: 8363122 - DNA, 22 bp, Homo sapiens
tcagggaagacttcttagagga

SEQ ID NO: 8363123 - DNA, 22 bp, Homo sapiens
tcagggaagaaatgggacttta

SEQ ID NO: 8363124 - DNA, 22 bp, Homo sapiens
tcagggaagaaatgggacttta

SEQ ID NO: 8363125 - DNA, 22 bp, Homo sapiens
tcagggaacctctcctgtttct

SEQ ID NO: 8363126 - DNA, 22 bp, Homo sapiens
tcagggaactacttctccctat

SEQ ID NO: 8363127 - DNA, 22 bp, Homo sapiens
tcagggaacctctcctgtttct

SEQ ID NO: 8363128 - DNA, 22 bp, Homo sapiens
tcagggaataagtagatgagtg

SEQ ID NO: 8363129 - DNA, 21 bp, Homo sapiens
tcagggaagtgtgcagaaggg

SEQ ID NO: 8363130 - DNA, 19 bp, Homo sapiens
tcagggaagttcaaagctc

SEQ ID NO: 8363131 - DNA, 22 bp, Homo sapiens
tcagggaatcagactctgcagc

SEQ ID NO: 8363132 - DNA, 18 bp, Homo sapiens
tcagggaatcttggcctt

SEQ ID NO: 8363133 - DNA, 17 bp, Homo sapiens
tcagggaatgaggttgt

SEQ ID NO: 8363134 - DNA, 17 bp, Homo sapiens
tcagggaatgaggttgt

SEQ ID NO: 8363135 - DNA, 22 bp, Homo sapiens
tcagtctttcgaattcagccag

SEQ ID NO: 8363136 - DNA, 22 bp, Homo sapiens
tcagtctttgcttatgacaata

SEQ ID NO: 8363137 - DNA, 22 bp, Homo sapiens
tcagtgaaatgcatattcttcg

SEQ ID NO: 8363138 - DNA, 22 bp, Homo sapiens
tcagtgaaatgcatattcttcg

SEQ ID NO: 8363139 - DNA, 22 bp, Homo sapiens
tcagtgaaatgcatattcttcg

SEQ ID NO: 8363140 - DNA, 22 bp, Homo sapiens
tcagtgactgggtattaaatca

SEQ ID NO: 8363141 - DNA, 22 bp, Homo sapiens
tcagtgacaactatgaatattt

SEQ ID NO: 8363142 - DNA, 22 bp, Homo sapiens
tcagtgcagactgtaagttgga

SEQ ID NO: 8363143 - DNA, 22 bp, Homo sapiens
tcagtgtctgtgggcaggatgg

SEQ ID NO: 8363144 - DNA, 22 bp, Homo sapiens
tcagtgtctcatatgaggtttc

SEQ ID NO: 8363145 - DNA, 22 bp, Homo sapiens
tcagtgtctatagataaggttt

SEQ ID NO: 8363146 - DNA, 22 bp, Homo sapiens
tcagtgttacattatatagaac

SEQ ID NO: 8363147 - DNA, 22 bp, Homo sapiens
tcagtgtcctgtgcggtgcagc

SEQ ID NO: 8363148 - DNA, 23 bp, Homo sapiens
tcagtgtctagttgtggaattga

SEQ ID NO: 8363149 - DNA, 22 bp, Homo sapiens
tcagtgtctagggacagtaatc

SEQ ID NO: 8363150 - DNA, 22 bp, Homo sapiens
tcagtgtccttcgttcttgttg

SEQ ID NO: 8363151 - DNA, 22 bp, Homo sapiens
tcagtgtccataaataaagttt

SEQ ID NO: 8363152 - DNA, 22 bp, Homo sapiens
tcagtgtccaaaaagaggcaag

SEQ ID NO: 8363153 - DNA, 22 bp, Homo sapiens
tcagtgtccaaaaagaggcaag

SEQ ID NO: 8363154 - DNA, 22 bp, Homo sapiens
tcagtgtccggagcctgagtgc

SEQ ID NO: 8363155 - DNA, 19 bp, Homo sapiens
tcagtgtccctgttaatat

SEQ ID NO: 8363156 - DNA, 22 bp, Homo sapiens
tcagtgtcccgtctcttaactc

SEQ ID NO: 8363157 - DNA, 21 bp, Homo sapiens
tcagtgtatttaagaatgttg

SEQ ID NO: 8363158 - DNA, 22 bp, Homo sapiens
tcagtgtcacaggatgctatgc

SEQ ID NO: 8363159 - DNA, 16 bp, Homo sapiens
tcagtgtcagctcctg

SEQ ID NO: 8363160 - DNA, 22 bp, Homo sapiens
tcagtgtcatatcaagaagatg

SEQ ID NO: 8363161 - DNA, 22 bp, Homo sapiens
tcagtgtcagtcttttagatat

SEQ ID NO: 8363162 - DNA, 20 bp, Homo sapiens
tcagtgtcagtagccactac

SEQ ID NO: 8363163 - DNA, 20 bp, Homo sapiens
tcagtgtcagtagccactac

SEQ ID NO: 8363164 - DNA, 22 bp, Homo sapiens
tcagtgtcatcacttaatataa

SEQ ID NO: 8363165 - DNA, 18 bp, Homo sapiens
tcagtgtagatctgtgta

SEQ ID NO: 8363166 - DNA, 22 bp, Homo sapiens
tcagtgtaagttatgtagatgt

SEQ ID NO: 8363167 - DNA, 22 bp, Homo sapiens
tcagtggtctaggcaatatata

SEQ ID NO: 8363168 - DNA, 22 bp, Homo sapiens
tcagtggtctaggcaatatata

SEQ ID NO: 8363169 - DNA, 22 bp, Homo sapiens
tcagtggtggaagcagcaaacc

SEQ ID NO: 8363170 - DNA, 22 bp, Homo sapiens
tccagctctgctgtgcgccggt

SEQ ID NO: 8363171 - DNA, 22 bp, Homo sapiens
tccagctctgcttcacagtctc

SEQ ID NO: 8363172 - DNA, 18 bp, Homo sapiens
tccagctctgccacttac

SEQ ID NO: 8363173 - DNA, 22 bp, Homo sapiens
tccagctctgattctcactagc

SEQ ID NO: 8363174 - DNA, 22 bp, Homo sapiens
tccagctctaacatgctgggcc

SEQ ID NO: 8363175 - DNA, 22 bp, Homo sapiens
tccagctctaaggctgatagcc

SEQ ID NO: 8363176 - DNA, 22 bp, Homo sapiens
tccagctctaaggctgatagcc

SEQ ID NO: 8363177 - DNA, 22 bp, Homo sapiens
tccagctcctgagttcactgct

SEQ ID NO: 8363178 - DNA, 22 bp, Homo sapiens
tccagctcctgagttcactgct

SEQ ID NO: 8363179 - DNA, 22 bp, Homo sapiens
tccagctctggcttggctagct

SEQ ID NO: 8363180 - DNA, 21 bp, Homo sapiens
tccagctcttatgttcatgaa

SEQ ID NO: 8363181 - DNA, 19 bp, Homo sapiens
tccagctggtatgcccaga

SEQ ID NO: 8363182 - DNA, 22 bp, Homo sapiens
tccagctggggccgaagtggat

SEQ ID NO: 8363183 - DNA, 22 bp, Homo sapiens
tccagctgtactttgtcctggc

SEQ ID NO: 8363184 - DNA, 22 bp, Homo sapiens
tccaggaaacagcatctcagca

SEQ ID NO: 8363185 - DNA, 22 bp, Homo sapiens
tccaggaaacactcaagccatg

SEQ ID NO: 8363186 - DNA, 22 bp, Homo sapiens
tccaggaaagcactgggctggg

SEQ ID NO: 8363187 - DNA, 22 bp, Homo sapiens
tccagctttcacgctcctgcct

SEQ ID NO: 8363188 - DNA, 22 bp, Homo sapiens
tccagctgttgttttatctcag

SEQ ID NO: 8363189 - DNA, 18 bp, Homo sapiens
tccagctcacagatgggc

SEQ ID NO: 8363190 - DNA, 22 bp, Homo sapiens
tccagctcacagatagcgtggg

SEQ ID NO: 8363191 - DNA, 18 bp, Homo sapiens
tccagctcacagatgggc

SEQ ID NO: 8363192 - DNA, 22 bp, Homo sapiens
tccagctcagggttggctcaag

SEQ ID NO: 8363193 - DNA, 22 bp, Homo sapiens
tccagctcaaagtgctcctgtc

SEQ ID NO: 8363194 - DNA, 22 bp, Homo sapiens
tccagcctttctactcactgag

SEQ ID NO: 8363195 - DNA, 23 bp, Homo sapiens
tccagctcccttcaatggcactg

SEQ ID NO: 8363196 - DNA, 22 bp, Homo sapiens
tccagctcccactctcactgct

SEQ ID NO: 8363197 - DNA, 23 bp, Homo sapiens
tccagctcccttcaatggcactg

SEQ ID NO: 8363198 - DNA, 22 bp, Homo sapiens
tccagctcctctacccgatgcg

SEQ ID NO: 8363199 - DNA, 17 bp, Homo sapiens
tccagctcctcattgtt

SEQ ID NO: 8363200 - DNA, 20 bp, Homo sapiens
tccagctccgtgttcttcct

SEQ ID NO: 8363201 - DNA, 22 bp, Homo sapiens
tccagctcatctgtctccatta

SEQ ID NO: 8363202 - DNA, 22 bp, Homo sapiens
tccagctcccactctcactgct

SEQ ID NO: 8363203 - DNA, 22 bp, Homo sapiens
tccagccaatcaactattgttt

SEQ ID NO: 8363204 - DNA, 22 bp, Homo sapiens
tccagcagtgctcaggactcac

SEQ ID NO: 8363205 - DNA, 22 bp, Homo sapiens
tccagcagtgctcaggactcac

SEQ ID NO: 8363206 - DNA, 22 bp, Homo sapiens
tccagcagtgctctagagcgtg

SEQ ID NO: 8363207 - DNA, 22 bp, Homo sapiens
tccagcagtgctctagagcgtg

SEQ ID NO: 8363208 - DNA, 22 bp, Homo sapiens
tccagcaggttggtcaggtgca

SEQ ID NO: 8363209 - DNA, 22 bp, Homo sapiens
tccagcaggttggtcaggtgca

SEQ ID NO: 8363210 - DNA, 22 bp, Homo sapiens
tccagcaggttggtcaggtgca

SEQ ID NO: 8363211 - DNA, 22 bp, Homo sapiens
tccagcagtccatgtgagacac

SEQ ID NO: 8363212 - DNA, 22 bp, Homo sapiens
tccagcagtccatgtgagacac

SEQ ID NO: 8363213 - DNA, 22 bp, Homo sapiens
tccagcagtccatgtgagacac

SEQ ID NO: 8363214 - DNA, 20 bp, Homo sapiens
tccagcagtatgctatactt

SEQ ID NO: 8363215 - DNA, 22 bp, Homo sapiens
tccagaggcagctgcggtcagg

SEQ ID NO: 8363216 - DNA, 22 bp, Homo sapiens
tccagaggcagctgcggtcagg

SEQ ID NO: 8363217 - DNA, 20 bp, Homo sapiens
tccagaggccacatccagtg

SEQ ID NO: 8363218 - DNA, 22 bp, Homo sapiens
tccagaggtatgtagagagtat

SEQ ID NO: 8363219 - DNA, 21 bp, Homo sapiens
tccagaggaggacagactcag

SEQ ID NO: 8363220 - DNA, 22 bp, Homo sapiens
tccagcaggtccgagacaagtt

SEQ ID NO: 8363221 - DNA, 18 bp, Homo sapiens
tccagcaggtctgaggtg

SEQ ID NO: 8363222 - DNA, 22 bp, Homo sapiens
tccagcaggtgtttgccaactt

SEQ ID NO: 8363223 - DNA, 22 bp, Homo sapiens
tccagcaggtgtttgccaactt

SEQ ID NO: 8363224 - DNA, 22 bp, Homo sapiens
tccagcagccacacctctggac

SEQ ID NO: 8363225 - DNA, 22 bp, Homo sapiens
tccagcagccacacctctggac

SEQ ID NO: 8363226 - DNA, 22 bp, Homo sapiens
tccagcagccacacctctggac

SEQ ID NO: 8363227 - DNA, 22 bp, Homo sapiens
tccagcagcccgaaggcccatc

SEQ ID NO: 8363228 - DNA, 22 bp, Homo sapiens
tccagcagcccgaaggcccatc

SEQ ID NO: 8363229 - DNA, 22 bp, Homo sapiens
tccagcagagtctctgaggggg

SEQ ID NO: 8363230 - DNA, 22 bp, Homo sapiens
tccagcagagtctctgaggggg

SEQ ID NO: 8363231 - DNA, 23 bp, Homo sapiens
tccagcagccaagaagggtagaa

SEQ ID NO: 8363232 - DNA, 23 bp, Homo sapiens
tccagcagccaagaagggtagaa

SEQ ID NO: 8363233 - DNA, 22 bp, Homo sapiens
tccagcagccacacctctggac

SEQ ID NO: 8363234 - DNA, 22 bp, Homo sapiens
tccagcagactcatcagcaagg

SEQ ID NO: 8363235 - DNA, 22 bp, Homo sapiens
tccagcagaccatcaaggctca

SEQ ID NO: 8363236 - DNA, 22 bp, Homo sapiens
tccagcagaccatcaaggctca

SEQ ID NO: 8363237 - DNA, 23 bp, Homo sapiens
tccagcagagccttccaggaggg

SEQ ID NO: 8363238 - DNA, 22 bp, Homo sapiens
tccagcagaggttgataatacc

SEQ ID NO: 8363239 - DNA, 23 bp, Homo sapiens
tccagcagagccttccaggaggg

SEQ ID NO: 8363240 - DNA, 22 bp, Homo sapiens
tccagagctaattcagcagctg

SEQ ID NO: 8363241 - DNA, 23 bp, Homo sapiens
tccagagctcatgctctcaacca

SEQ ID NO: 8363242 - DNA, 22 bp, Homo sapiens
tccagagatccaaagaatatga

SEQ ID NO: 8363243 - DNA, 22 bp, Homo sapiens
tccagagatcacactgggcagg

SEQ ID NO: 8363244 - DNA, 22 bp, Homo sapiens
tcattgaatttggttcaatatg

SEQ ID NO: 8363245 - DNA, 22 bp, Homo sapiens
tcattgaagtgactgaaagatt

SEQ ID NO: 8363246 - DNA, 22 bp, Homo sapiens
tcattgcagttgagttgtgtta

SEQ ID NO: 8363247 - DNA, 22 bp, Homo sapiens
tcattgcagactaacaatctca

SEQ ID NO: 8363248 - DNA, 22 bp, Homo sapiens
tccagagaggtttctccatgct

SEQ ID NO: 8363249 - DNA, 20 bp, Homo sapiens
tccagagagtggcaaagctc

SEQ ID NO: 8363250 - DNA, 22 bp, Homo sapiens
tccaggccaatgtagcaggccc

SEQ ID NO: 8363251 - DNA, 23 bp, Homo sapiens
tccaggcatgagctctggatgga

SEQ ID NO: 8363252 - DNA, 23 bp, Homo sapiens
tccaggcatgagctctggatgga

SEQ ID NO: 8363253 - DNA, 22 bp, Homo sapiens
tccaggcatgtctgagtccttc

SEQ ID NO: 8363254 - DNA, 22 bp, Homo sapiens
tccaggcatcccccaggacaga

SEQ ID NO: 8363255 - DNA, 23 bp, Homo sapiens
tccaggcatgagctctggatgga

SEQ ID NO: 8363256 - DNA, 22 bp, Homo sapiens
tccaggctcagcacttgctact

SEQ ID NO: 8363257 - DNA, 22 bp, Homo sapiens
tccaggctctcaggtgtcagca

SEQ ID NO: 8363258 - DNA, 19 bp, Homo sapiens
tccaggctgagagtcagct

SEQ ID NO: 8363259 - DNA, 21 bp, Homo sapiens
tccaggagttctaataggtgt

SEQ ID NO: 8363260 - DNA, 22 bp, Homo sapiens
tccaggattgcaggtgcacaac

SEQ ID NO: 8363261 - DNA, 22 bp, Homo sapiens
tccaggattgtcagccagaagg

SEQ ID NO: 8363262 - DNA, 22 bp, Homo sapiens
tccaggcagggcagccatcaag

SEQ ID NO: 8363263 - DNA, 22 bp, Homo sapiens
tccaggcagggcagccatcaag

SEQ ID NO: 8363264 - DNA, 22 bp, Homo sapiens
tccaggcataagccttgagtgt

SEQ ID NO: 8363265 - DNA, 22 bp, Homo sapiens
tccaggagggattgggctgtgg

SEQ ID NO: 8363266 - DNA, 22 bp, Homo sapiens
tccaggaggtgaggggaccaaa

SEQ ID NO: 8363267 - DNA, 22 bp, Homo sapiens
tccaggagtcctgggagtgatt

SEQ ID NO: 8363268 - DNA, 22 bp, Homo sapiens
tccaggaggttgagtgagttcc

SEQ ID NO: 8363269 - DNA, 22 bp, Homo sapiens
tccatccacattaacagatacg

SEQ ID NO: 8363270 - DNA, 22 bp, Homo sapiens
tccatcagcatgcaggctgttc

SEQ ID NO: 8363271 - DNA, 22 bp, Homo sapiens
tccagtttcctgtggctgccta

SEQ ID NO: 8363272 - DNA, 22 bp, Homo sapiens
tccagtttattatgcatttaca

SEQ ID NO: 8363273 - DNA, 22 bp, Homo sapiens
tccagtttatttttggcagggt

SEQ ID NO: 8363274 - DNA, 22 bp, Homo sapiens
tccagtttcatagctaaggaac

SEQ ID NO: 8363275 - DNA, 22 bp, Homo sapiens
tccagtttccaatcactgcacg

SEQ ID NO: 8363276 - DNA, 22 bp, Homo sapiens
tccagtttacagggttgctttt

SEQ ID NO: 8363277 - DNA, 22 bp, Homo sapiens
tccatccatggatggaaatgtg

SEQ ID NO: 8363278 - DNA, 22 bp, Homo sapiens
tccatccatgtaggaagatggt

SEQ ID NO: 8363279 - DNA, 20 bp, Homo sapiens
tccatgagttagagactata

SEQ ID NO: 8363280 - DNA, 20 bp, Homo sapiens
tccatcttgggcagaagcag

SEQ ID NO: 8363281 - DNA, 21 bp, Homo sapiens
tcccacagcgccagctcctgt

SEQ ID NO: 8363282 - DNA, 22 bp, Homo sapiens
tcccaagtgtcttggaccaggg

SEQ ID NO: 8363283 - DNA, 21 bp, Homo sapiens
tcccacagaaactgcgaaatt

SEQ ID NO: 8363284 - DNA, 22 bp, Homo sapiens
tcccaagccctggatgcctcag

SEQ ID NO: 8363285 - DNA, 21 bp, Homo sapiens
tcccaagctgctggctcagct

SEQ ID NO: 8363286 - DNA, 22 bp, Homo sapiens
tcccaagcttagggctctcagt

SEQ ID NO: 8363287 - DNA, 22 bp, Homo sapiens
tcccaagcttagggctctcagt

SEQ ID NO: 8363288 - DNA, 22 bp, Homo sapiens
tcccaaggtgctcggcaacagg

SEQ ID NO: 8363289 - DNA, 22 bp, Homo sapiens
tcccagggttacagccagggca

SEQ ID NO: 8363290 - DNA, 22 bp, Homo sapiens
tcccaggtgatgctgaggccac

SEQ ID NO: 8363291 - DNA, 22 bp, Homo sapiens
tcccagggtgaaatgcagtagg

SEQ ID NO: 8363292 - DNA, 21 bp, Homo sapiens
tcccagggtcttatgggatgt

SEQ ID NO: 8363293 - DNA, 22 bp, Homo sapiens
tcccacagcttcgtgcttcccc

SEQ ID NO: 8363294 - DNA, 20 bp, Homo sapiens
tcccatcacgcctgtgccag

SEQ ID NO: 8363295 - DNA, 22 bp, Homo sapiens
tcccatcatctgttctggctac

SEQ ID NO: 8363296 - DNA, 22 bp, Homo sapiens
tcccagtgaggtcctggctgtc

SEQ ID NO: 8363297 - DNA, 22 bp, Homo sapiens
tcccagtgtggcaggccatgga

SEQ ID NO: 8363298 - DNA, 22 bp, Homo sapiens
tccccaccccagaactactagg

SEQ ID NO: 8363299 - DNA, 22 bp, Homo sapiens
tccccacctaagatacccatct

SEQ ID NO: 8363300 - DNA, 22 bp, Homo sapiens
tccccacctaagatacccatct

SEQ ID NO: 8363301 - DNA, 22 bp, Homo sapiens
tccccacctacacactgctcct

SEQ ID NO: 8363302 - DNA, 22 bp, Homo sapiens
tccccacctacacactgctcct

SEQ ID NO: 8363303 - DNA, 19 bp, Homo sapiens
tccccaagagttctagctc

SEQ ID NO: 8363304 - DNA, 22 bp, Homo sapiens
gccccaccgagggtgcagtcct

SEQ ID NO: 8363305 - DNA, 22 bp, Homo sapiens
gccccacctgctaccttccagc

SEQ ID NO: 8363306 - DNA, 22 bp, Homo sapiens
gccccaagtccctatgtttcca

SEQ ID NO: 8363307 - DNA, 22 bp, Homo sapiens
gccccaagggagcccagcacac

SEQ ID NO: 8363308 - DNA, 22 bp, Homo sapiens
gcccatggtccaggaagacaga

SEQ ID NO: 8363309 - DNA, 22 bp, Homo sapiens
gcccaggaggagaggctgcagt

SEQ ID NO: 8363310 - DNA, 22 bp, Homo sapiens
gcccaggaagttgaggctgccg

SEQ ID NO: 8363311 - DNA, 22 bp, Homo sapiens
gcccagctggcttccagcacat

SEQ ID NO: 8363312 - DNA, 22 bp, Homo sapiens
gcccagcacctctctcagggtt

SEQ ID NO: 8363313 - DNA, 22 bp, Homo sapiens
gcccagcactcctctctgacat

SEQ ID NO: 8363314 - DNA, 22 bp, Homo sapiens
gcccagccctgaggtcacagct

SEQ ID NO: 8363315 - DNA, 22 bp, Homo sapiens
gcccagccctgaggtcacagct

SEQ ID NO: 8363316 - DNA, 22 bp, Homo sapiens
gcccagcctccaagctccaagg

SEQ ID NO: 8363317 - DNA, 22 bp, Homo sapiens
gcccagcctccaagctccaagg

SEQ ID NO: 8363318 - DNA, 22 bp, Homo sapiens
gcccagcgagcagaggtggacg

SEQ ID NO: 8363319 - DNA, 22 bp, Homo sapiens
gcccagctcctctgcagaccct

SEQ ID NO: 8363320 - DNA, 22 bp, Homo sapiens
gccagggtgtgcagggacagga

SEQ ID NO: 8363321 - DNA, 22 bp, Homo sapiens
gccagggtggcagaaggcccca

SEQ ID NO: 8363322 - DNA, 21 bp, Homo sapiens
gcccagcaaggtgagaaggcc

SEQ ID NO: 8363323 - DNA, 22 bp, Homo sapiens
gcccagcacagctggaagagtc

SEQ ID NO: 8363324 - DNA, 22 bp, Homo sapiens
gccaggtcacctcactcatcca

SEQ ID NO: 8363325 - DNA, 23 bp, Homo sapiens
gccaggtattctgataggcactg

SEQ ID NO: 8363326 - DNA, 22 bp, Homo sapiens
gccagggttgccaatgggggca

SEQ ID NO: 8363327 - DNA, 22 bp, Homo sapiens
gccagggttgccaatgggggca

SEQ ID NO: 8363328 - DNA, 22 bp, Homo sapiens
gcctcctggcctttgctcctca

SEQ ID NO: 8363329 - DNA, 22 bp, Homo sapiens
gcctcctggggtgccatcatct

SEQ ID NO: 8363330 - DNA, 22 bp, Homo sapiens
gcctcctgagtagctgggattg

SEQ ID NO: 8363331 - DNA, 22 bp, Homo sapiens
gcctcctgagaagccacaggct

SEQ ID NO: 8363332 - DNA, 22 bp, Homo sapiens
gcctcctgacttacactgagct

SEQ ID NO: 8363333 - DNA, 22 bp, Homo sapiens
gcctcctggattttagtgccat

SEQ ID NO: 8363334 - DNA, 22 bp, Homo sapiens
gcctcctgagtagctgggattg

SEQ ID NO: 8363335 - DNA, 22 bp, Homo sapiens
gcctcctgcccagatgagtgat

SEQ ID NO: 8363336 - DNA, 22 bp, Homo sapiens
gcctcctgaagtgctgggatta

SEQ ID NO: 8363337 - DNA, 22 bp, Homo sapiens
gcctcctgaagtgctgggatta

SEQ ID NO: 8363338 - DNA, 22 bp, Homo sapiens
gcctcctgaaaggaagagctcc

SEQ ID NO: 8363339 - DNA, 22 bp, Homo sapiens
gcctcctcacaatgtacccacg

SEQ ID NO: 8363340 - DNA, 22 bp, Homo sapiens
gccctgggcaaggttctggcca

SEQ ID NO: 8363341 - DNA, 22 bp, Homo sapiens
gccctgggattgggtggaggct

SEQ ID NO: 8363342 - DNA, 22 bp, Homo sapiens
gccctggcctcctggaacaggc

SEQ ID NO: 8363343 - DNA, 22 bp, Homo sapiens
gccccagcctgggaactggagg

SEQ ID NO: 8363344 - DNA, 22 bp, Homo sapiens
gccccaggggaggtgccctgca

SEQ ID NO: 8363345 - DNA, 22 bp, Homo sapiens
gccccagccctgtggaccatgg

SEQ ID NO: 8363346 - DNA, 22 bp, Homo sapiens
gccccagccctgtggaccatgg

SEQ ID NO: 8363347 - DNA, 22 bp, Homo sapiens
gccccagcctcccgagtagctg

SEQ ID NO: 8363348 - DNA, 22 bp, Homo sapiens
gccccagatggaggaagctggg

SEQ ID NO: 8363349 - DNA, 22 bp, Homo sapiens
gccccagatggaggaagctggg

SEQ ID NO: 8363350 - DNA, 21 bp, Homo sapiens
gccagggagttaaagagtctt

SEQ ID NO: 8363351 - DNA, 22 bp, Homo sapiens
gccagggaacccaagggcctca

SEQ ID NO: 8363352 - DNA, 22 bp, Homo sapiens
gccaggcatgggcttctgggcg

SEQ ID NO: 8363353 - DNA, 22 bp, Homo sapiens
gccaggcatgtcctctgcagaa

SEQ ID NO: 8363354 - DNA, 22 bp, Homo sapiens
gccaggcatgtcctctgcagaa

SEQ ID NO: 8363355 - DNA, 21 bp, Homo sapiens
gccagggaagagagttggctg

SEQ ID NO: 8363356 - DNA, 17 bp, Homo sapiens
gccagggagaggaagcc

SEQ ID NO: 8363357 - DNA, 22 bp, Homo sapiens
gccagggaggctgtagggtcct

SEQ ID NO: 8363358 - DNA, 22 bp, Homo sapiens
gccaggcaggccacgctgtgtt

SEQ ID NO: 8363359 - DNA, 22 bp, Homo sapiens
gccaggcagctagcaacccctg

SEQ ID NO: 8363360 - DNA, 22 bp, Homo sapiens
gccaggcagctgggagggtgcc

SEQ ID NO: 8363361 - DNA, 18 bp, Homo sapiens
gccaggcagggtggggaa

SEQ ID NO: 8363362 - DNA, 22 bp, Homo sapiens
gccaggcaggtgtcggagccct

SEQ ID NO: 8363363 - DNA, 22 bp, Homo sapiens
gccaggcagccaccctctgcga

SEQ ID NO: 8363364 - DNA, 22 bp, Homo sapiens
gccaggcagccaccctctgcga

SEQ ID NO: 8363365 - DNA, 22 bp, Homo sapiens
gccaggcagatatgtgagctta

SEQ ID NO: 8363366 - DNA, 22 bp, Homo sapiens
gccaggcagatatgtgagctta

SEQ ID NO: 8363367 - DNA, 22 bp, Homo sapiens
gccaggcagatatgtgagctta

SEQ ID NO: 8363368 - DNA, 22 bp, Homo sapiens
gccaggcagcagcgaggatggt

SEQ ID NO: 8363369 - DNA, 22 bp, Homo sapiens
gccaggcagcagcgaggatggt

SEQ ID NO: 8363370 - DNA, 22 bp, Homo sapiens
gccagctgaagccctggtggaa

SEQ ID NO: 8363371 - DNA, 22 bp, Homo sapiens
gccagctgaatttccaactgtt

SEQ ID NO: 8363372 - DNA, 22 bp, Homo sapiens
gccaggcactgctctaagccct

SEQ ID NO: 8363373 - DNA, 22 bp, Homo sapiens
gccagctgacaccttgattttg

SEQ ID NO: 8363374 - DNA, 20 bp, Homo sapiens
gccaggcactgttctcaata

SEQ ID NO: 8363375 - DNA, 22 bp, Homo sapiens
gccaggcagacaggtcatcagg

SEQ ID NO: 8363376 - DNA, 22 bp, Homo sapiens
gccaggcagagccccgtgcagc

SEQ ID NO: 8363377 - DNA, 22 bp, Homo sapiens
gccagctcagatgcaggaagga

SEQ ID NO: 8363378 - DNA, 21 bp, Homo sapiens
gccagcggccgccctccagga

SEQ ID NO: 8363379 - DNA, 22 bp, Homo sapiens
gccagctcagatgcaggaagga

SEQ ID NO: 8363380 - DNA, 22 bp, Homo sapiens
gccagctcagtttcaaagtagg

SEQ ID NO: 8363381 - DNA, 22 bp, Homo sapiens
gccagctccgcaggatggcgcg

SEQ ID NO: 8363382 - DNA, 22 bp, Homo sapiens
gccagctctgtggctgtacttg

SEQ ID NO: 8363383 - DNA, 22 bp, Homo sapiens
gccagctctgtggctgtacttg

SEQ ID NO: 8363384 - DNA, 22 bp, Homo sapiens
gccagcctgtgggggctctgtg

SEQ ID NO: 8363385 - DNA, 21 bp, Homo sapiens
gccagcctgtttacctgtggt

SEQ ID NO: 8363386 - DNA, 21 bp, Homo sapiens
gccagcctgtttacctgtggt

SEQ ID NO: 8363387 - DNA, 21 bp, Homo sapiens
gccacccctggcacaggtgct

SEQ ID NO: 8363388 - DNA, 22 bp, Homo sapiens
gcatgcatgtgtgcagacagtc

SEQ ID NO: 8363389 - DNA, 22 bp, Homo sapiens
gcatgcagtaaaattcagcaac

SEQ ID NO: 8363390 - DNA, 22 bp, Homo sapiens
gcatgctgctgaggctggaata

SEQ ID NO: 8363391 - DNA, 21 bp, Homo sapiens
gcatgcctgcatcttagtgtt

SEQ ID NO: 8363392 - DNA, 22 bp, Homo sapiens
gcatggctattatgaggcagaa

SEQ ID NO: 8363393 - DNA, 22 bp, Homo sapiens
gcatggccttgctgtagtggta

SEQ ID NO: 8363394 - DNA, 22 bp, Homo sapiens
gcatggccttgctgtagtggta

SEQ ID NO: 8363395 - DNA, 22 bp, Homo sapiens
gccaccagcagaaaaggggcca

SEQ ID NO: 8363396 - DNA, 22 bp, Homo sapiens
gccaccagggggctccagtgag

SEQ ID NO: 8363397 - DNA, 22 bp, Homo sapiens
gccaccagtgggggcctgggca

SEQ ID NO: 8363398 - DNA, 22 bp, Homo sapiens
gcagtggatccaatggtatctt

SEQ ID NO: 8363399 - DNA, 22 bp, Homo sapiens
gcagtggatggccagcaggggc

SEQ ID NO: 8363400 - DNA, 22 bp, Homo sapiens
gcagtgggagcttaggcagtgc

SEQ ID NO: 8363401 - DNA, 22 bp, Homo sapiens
gcagtgggagcttaggcagtgc

SEQ ID NO: 8363402 - DNA, 22 bp, Homo sapiens
gcagtgggagcttaggcagtgc

SEQ ID NO: 8363403 - DNA, 22 bp, Homo sapiens
gcagtgggagcttaggcagtgc

SEQ ID NO: 8363404 - DNA, 22 bp, Homo sapiens
gcagtggccacatggaggagga

SEQ ID NO: 8363405 - DNA, 22 bp, Homo sapiens
gcatgcagggagggtctggctg

SEQ ID NO: 8363406 - DNA, 21 bp, Homo sapiens
gcaaagtgtgggcataaacag

SEQ ID NO: 8363407 - DNA, 22 bp, Homo sapiens
gcaaagcaatcaggagtagcat

SEQ ID NO: 8363408 - DNA, 22 bp, Homo sapiens
gcaaagcatcagtagaaatgtt

SEQ ID NO: 8363409 - DNA, 22 bp, Homo sapiens
gcaaactggtagctcgcctgcc

SEQ ID NO: 8363410 - DNA, 22 bp, Homo sapiens
gcaaagaaatgtcagtgagagg

SEQ ID NO: 8363411 - DNA, 22 bp, Homo sapiens
gcaaagaaagttttaatgaggt

SEQ ID NO: 8363412 - DNA, 22 bp, Homo sapiens
gcaaagaaagttttaatgaggt

SEQ ID NO: 8363413 - DNA, 22 bp, Homo sapiens
gcaaagaaagccaaggtctaac

SEQ ID NO: 8363414 - DNA, 22 bp, Homo sapiens
gcacagggctgccaggcggctt

SEQ ID NO: 8363415 - DNA, 22 bp, Homo sapiens
gcacaggctccggaggagagct

SEQ ID NO: 8363416 - DNA, 22 bp, Homo sapiens
gcacagtacctgtcacagaggc

SEQ ID NO: 8363417 - DNA, 22 bp, Homo sapiens
gcacaggtcaggagatgagatt

SEQ ID NO: 8363418 - DNA, 22 bp, Homo sapiens
gcacactgcggtgatgtgagtc

SEQ ID NO: 8363419 - DNA, 22 bp, Homo sapiens
gcacagaaatgtctacacatgt

SEQ ID NO: 8363420 - DNA, 22 bp, Homo sapiens
gcacacattcggattcttaacc

SEQ ID NO: 8363421 - DNA, 22 bp, Homo sapiens
gcacacatgcgtgtatatgggt

SEQ ID NO: 8363422 - DNA, 22 bp, Homo sapiens
gcacacatcttgtaatcctgag

SEQ ID NO: 8363423 - DNA, 22 bp, Homo sapiens
gcacacatatatatgagcatgt

SEQ ID NO: 8363424 - DNA, 22 bp, Homo sapiens
gcaaatattcaagacttttcca

SEQ ID NO: 8363425 - DNA, 22 bp, Homo sapiens
gcacacagtagggattcaatga

SEQ ID NO: 8363426 - DNA, 22 bp, Homo sapiens
gcacacagtagggattcaatga

SEQ ID NO: 8363427 - DNA, 22 bp, Homo sapiens
gcacagtggtgaaagcatgggt

SEQ ID NO: 8363428 - DNA, 22 bp, Homo sapiens
gcacagtgataggcagttgtgc

SEQ ID NO: 8363429 - DNA, 17 bp, Homo sapiens
gcacagtgatattattt

SEQ ID NO: 8363430 - DNA, 20 bp, Homo sapiens
gcacagtttgggaaccatgg

SEQ ID NO: 8363431 - DNA, 22 bp, Homo sapiens
gcacagttgtgacaaccatcgc

SEQ ID NO: 8363432 - DNA, 22 bp, Homo sapiens
gcacatccaatgattgttttga

SEQ ID NO: 8363433 - DNA, 22 bp, Homo sapiens
gcagactgtacctggaagaggg

SEQ ID NO: 8363434 - DNA, 22 bp, Homo sapiens
gcagactgcgagcgtgctggtg

SEQ ID NO: 8363435 - DNA, 22 bp, Homo sapiens
gcagagcaccctgcagtggtat

SEQ ID NO: 8363436 - DNA, 22 bp, Homo sapiens
gcagagcaccaaagtgaaagat

SEQ ID NO: 8363437 - DNA, 22 bp, Homo sapiens
gcagagaaagttttgtcctcag

SEQ ID NO: 8363438 - DNA, 22 bp, Homo sapiens
gcagaggatagcatatgaacct

SEQ ID NO: 8363439 - DNA, 22 bp, Homo sapiens
gcagaggatagcatatgaacct

SEQ ID NO: 8363440 - DNA, 22 bp, Homo sapiens
gcagaggagtgattatgccgtg

SEQ ID NO: 8363441 - DNA, 22 bp, Homo sapiens
gcagagcagtactctcttgact

SEQ ID NO: 8363442 - DNA, 22 bp, Homo sapiens
gcagagcagcaaatggaaagga

SEQ ID NO: 8363443 - DNA, 22 bp, Homo sapiens
gcagaggatcaggctctggaaa

SEQ ID NO: 8363444 - DNA, 22 bp, Homo sapiens
gcagaggatcaggctctggaaa

SEQ ID NO: 8363445 - DNA, 21 bp, Homo sapiens
gcagaggcacggcaccaaggg

SEQ ID NO: 8363446 - DNA, 22 bp, Homo sapiens
gcagagtggtttcagagttgag

SEQ ID NO: 8363447 - DNA, 22 bp, Homo sapiens
gcagaggtgaccagcagcaggg

SEQ ID NO: 8363448 - DNA, 22 bp, Homo sapiens
gcagaggtgaccagcagcaggg

SEQ ID NO: 8363449 - DNA, 22 bp, Homo sapiens
gcagatggagataaatggaact

SEQ ID NO: 8363450 - DNA, 22 bp, Homo sapiens
gcagaggtcctagccaggagtc

SEQ ID NO: 8363451 - DNA, 22 bp, Homo sapiens
gcagaggcatttctgacgctgc

SEQ ID NO: 8363452 - DNA, 22 bp, Homo sapiens
gcaggcagatcacctgtcagga

SEQ ID NO: 8363453 - DNA, 22 bp, Homo sapiens
gcaggcagatcacctgtcagga

SEQ ID NO: 8363454 - DNA, 22 bp, Homo sapiens
gcaggcagatcacctgtcagga

SEQ ID NO: 8363455 - DNA, 19 bp, Homo sapiens
gcaggcagctggggtatcc

SEQ ID NO: 8363456 - DNA, 22 bp, Homo sapiens
gcaggcagccacgattcccttg

SEQ ID NO: 8363457 - DNA, 16 bp, Homo sapiens
gcaggcagatcacatg

SEQ ID NO: 8363458 - DNA, 16 bp, Homo sapiens
gcaggacactcagaca

SEQ ID NO: 8363459 - DNA, 22 bp, Homo sapiens
gcaggacacagatgcaaggcca

SEQ ID NO: 8363460 - DNA, 22 bp, Homo sapiens
gcaggacacagatgcaaggcca

SEQ ID NO: 8363461 - DNA, 22 bp, Homo sapiens
gcagggaagtttgatctttttc

SEQ ID NO: 8363462 - DNA, 22 bp, Homo sapiens
gcagggaaggggcatgctggag

SEQ ID NO: 8363463 - DNA, 22 bp, Homo sapiens
gcagggaagtttgatctttttc

SEQ ID NO: 8363464 - DNA, 22 bp, Homo sapiens
gcagggaagttgtaatgtaatg

SEQ ID NO: 8363465 - DNA, 22 bp, Homo sapiens
gcagggaaggggcatgctggag

SEQ ID NO: 8363466 - DNA, 22 bp, Homo sapiens
gcagggaagatcttggagctgc

SEQ ID NO: 8363467 - DNA, 22 bp, Homo sapiens
gcagggaagatcttggagctgc

SEQ ID NO: 8363468 - DNA, 22 bp, Homo sapiens
gcagggaagggaaacagagacc

SEQ ID NO: 8363469 - DNA, 22 bp, Homo sapiens
gcaggcaggtggcatcttgtga

SEQ ID NO: 8363470 - DNA, 19 bp, Homo sapiens
gcaggcagtggcattcgga

SEQ ID NO: 8363471 - DNA, 19 bp, Homo sapiens
gcaggcagtggcattcgga

SEQ ID NO: 8363472 - DNA, 22 bp, Homo sapiens
gcaggcagttatttagtagaat

SEQ ID NO: 8363473 - DNA, 22 bp, Homo sapiens
gcagggaagacccggagcagcg

SEQ ID NO: 8363474 - DNA, 22 bp, Homo sapiens
gcagggacatcttcagatcact

SEQ ID NO: 8363475 - DNA, 22 bp, Homo sapiens
gcagggacagggcagggccttt

SEQ ID NO: 8363476 - DNA, 22 bp, Homo sapiens
gcagggacagggcagggccttt

SEQ ID NO: 8363477 - DNA, 22 bp, Homo sapiens
gcagggacctgccactgctgtc

SEQ ID NO: 8363478 - DNA, 22 bp, Homo sapiens
gcagggaccaaaagaggcagta

SEQ ID NO: 8363479 - DNA, 22 bp, Homo sapiens
gcagggaccaaaagaggcagta

SEQ ID NO: 8363480 - DNA, 22 bp, Homo sapiens
gcagggctgggtgggagacaga

SEQ ID NO: 8363481 - DNA, 22 bp, Homo sapiens
gcagggctgtggacactttggt

SEQ ID NO: 8363482 - DNA, 22 bp, Homo sapiens
gcagggctgttcaggagggtgg

SEQ ID NO: 8363483 - DNA, 22 bp, Homo sapiens
gcagggcttagaaatggtggct

SEQ ID NO: 8363484 - DNA, 22 bp, Homo sapiens
gcagatggcgcagtggaagttc

SEQ ID NO: 8363485 - DNA, 22 bp, Homo sapiens
gcagatggctcagacactgggg

SEQ ID NO: 8363486 - DNA, 23 bp, Homo sapiens
gcagatggccccagagtgctgcc

SEQ ID NO: 8363487 - DNA, 22 bp, Homo sapiens
gcagatggatcacctgaggtcg

SEQ ID NO: 8363488 - DNA, 22 bp, Homo sapiens
gcagatggcagcccaggctggg

SEQ ID NO: 8363489 - DNA, 22 bp, Homo sapiens
gcagatggtgccatgtcttgtg

SEQ ID NO: 8363490 - DNA, 21 bp, Homo sapiens
gcagatgggagtcatcaggct

SEQ ID NO: 8363491 - DNA, 22 bp, Homo sapiens
gcagatggtgggggaggagtac

SEQ ID NO: 8363492 - DNA, 22 bp, Homo sapiens
gcagatggtggaggcaagaggc

SEQ ID NO: 8363493 - DNA, 22 bp, Homo sapiens
gcagatgggagccccaggggag

SEQ ID NO: 8363494 - DNA, 22 bp, Homo sapiens
gcagatggctgagcctgcagat

SEQ ID NO: 8363495 - DNA, 21 bp, Homo sapiens
gcagatgggaagagacgaggc

SEQ ID NO: 8363496 - DNA, 22 bp, Homo sapiens
gcagccctcttggtcactaggc

SEQ ID NO: 8363497 - DNA, 22 bp, Homo sapiens
gcagccctcttggtcactaggc

SEQ ID NO: 8363498 - DNA, 22 bp, Homo sapiens
gcagcccaggtggagtaatcta

SEQ ID NO: 8363499 - DNA, 22 bp, Homo sapiens
gcagcccaggtggagtaatcta

SEQ ID NO: 8363500 - DNA, 22 bp, Homo sapiens
gcagcccaggaccctggacaga

SEQ ID NO: 8363501 - DNA, 22 bp, Homo sapiens
gcagcccaggaccctggacaga

SEQ ID NO: 8363502 - DNA, 22 bp, Homo sapiens
gcagatgtaatggctggaggtc

SEQ ID NO: 8363503 - DNA, 19 bp, Homo sapiens
gcaggaaatgagtgattgc

SEQ ID NO: 8363504 - DNA, 22 bp, Homo sapiens
gcaggaaaggttgagactttgc

SEQ ID NO: 8363505 - DNA, 22 bp, Homo sapiens
gcaggaaaaccttcccatgttt

SEQ ID NO: 8363506 - DNA, 22 bp, Homo sapiens
gcaggaaaaccttcccatgttt

SEQ ID NO: 8363507 - DNA, 23 bp, Homo sapiens
gcaggaactcagggtaggcagca

SEQ ID NO: 8363508 - DNA, 22 bp, Homo sapiens
gcaggaagcatagaagaatgcc

SEQ ID NO: 8363509 - DNA, 23 bp, Homo sapiens
gcaggacaacagagtgggaaggc

SEQ ID NO: 8363510 - DNA, 22 bp, Homo sapiens
gcaggacaaaatttccagggtg

SEQ ID NO: 8363511 - DNA, 23 bp, Homo sapiens
gcaggacaacagagtgggaaggc

SEQ ID NO: 8363512 - DNA, 23 bp, Homo sapiens
gcaggacaacagagtgggaaggc

SEQ ID NO: 8363513 - DNA, 22 bp, Homo sapiens
gcagccctgcaggcagctccag

SEQ ID NO: 8363514 - DNA, 20 bp, Homo sapiens
gcagcctcaacaggcacagc

SEQ ID NO: 8363515 - DNA, 22 bp, Homo sapiens
gcagcctcagggcactcagatg

SEQ ID NO: 8363516 - DNA, 22 bp, Homo sapiens
gcagctgtcatttacaacaggg

SEQ ID NO: 8363517 - DNA, 22 bp, Homo sapiens
gctggctggaactagcagttgg

SEQ ID NO: 8363518 - DNA, 22 bp, Homo sapiens
gctggctgcgtcatcacagggc

SEQ ID NO: 8363519 - DNA, 22 bp, Homo sapiens
gctggagaaactgcagctgagg

SEQ ID NO: 8363520 - DNA, 22 bp, Homo sapiens
gctggagaaactgcagctgagg

SEQ ID NO: 8363521 - DNA, 22 bp, Homo sapiens
gctggctggaggtgaggaagaa

SEQ ID NO: 8363522 - DNA, 22 bp, Homo sapiens
gctggctggagtaaggagggag

SEQ ID NO: 8363523 - DNA, 19 bp, Homo sapiens
gctggctggaggagggaca

SEQ ID NO: 8363524 - DNA, 22 bp, Homo sapiens
gctggctggaggagggaggttg

SEQ ID NO: 8363525 - DNA, 22 bp, Homo sapiens
gctggctggaatgggagaagaa

SEQ ID NO: 8363526 - DNA, 22 bp, Homo sapiens
gctgggctggaaggccaaggca

SEQ ID NO: 8363527 - DNA, 22 bp, Homo sapiens
gctgggaacacagccatgagag

SEQ ID NO: 8363528 - DNA, 23 bp, Homo sapiens
gctgggcttactctttcagtgag

SEQ ID NO: 8363529 - DNA, 22 bp, Homo sapiens
gctgggctgtagtttgctgacc

SEQ ID NO: 8363530 - DNA, 22 bp, Homo sapiens
gctggctgtggcttaagcaaac

SEQ ID NO: 8363531 - DNA, 22 bp, Homo sapiens
gctggctgtgttccttctgcca

SEQ ID NO: 8363532 - DNA, 22 bp, Homo sapiens
gctggcttgacagaggcctggg

SEQ ID NO: 8363533 - DNA, 22 bp, Homo sapiens
gctggcttgtcccaggacaaag

SEQ ID NO: 8363534 - DNA, 21 bp, Homo sapiens
gctggcttcctgagggctgag

SEQ ID NO: 8363535 - DNA, 21 bp, Homo sapiens
gctggcttcctgagggctgag

SEQ ID NO: 8363536 - DNA, 22 bp, Homo sapiens
gctggcttccatcagagggtga

SEQ ID NO: 8363537 - DNA, 22 bp, Homo sapiens
gctggggaggcagcagagaaca

SEQ ID NO: 8363538 - DNA, 22 bp, Homo sapiens
gctgggcttggtttccctgctt

SEQ ID NO: 8363539 - DNA, 22 bp, Homo sapiens
gctgtgctatatctctgagtgt

SEQ ID NO: 8363540 - DNA, 22 bp, Homo sapiens
gctggggcctgaacagtcagct

SEQ ID NO: 8363541 - DNA, 22 bp, Homo sapiens
gctgtggcttgcagctggggct

SEQ ID NO: 8363542 - DNA, 19 bp, Homo sapiens
gctgtgggacagcagggtg

SEQ ID NO: 8363543 - DNA, 22 bp, Homo sapiens
gctgtggctttctgtttctgtt

SEQ ID NO: 8363544 - DNA, 22 bp, Homo sapiens
gctgtgggtttccaatcctgga

SEQ ID NO: 8363545 - DNA, 22 bp, Homo sapiens
gctgtgggtgctggctccaccc

SEQ ID NO: 8363546 - DNA, 22 bp, Homo sapiens
gctgtgggtacaaatacacaat

SEQ ID NO: 8363547 - DNA, 22 bp, Homo sapiens
gctgtgggtaaacgctgagggt

SEQ ID NO: 8363548 - DNA, 22 bp, Homo sapiens
gctgtggggagagaacacacaa

SEQ ID NO: 8363549 - DNA, 22 bp, Homo sapiens
gctgtgggccacacggctgagt

SEQ ID NO: 8363550 - DNA, 22 bp, Homo sapiens
gctgtgggccatggccaagtga

SEQ ID NO: 8363551 - DNA, 22 bp, Homo sapiens
gctgtgggtaaacgctgagggt

SEQ ID NO: 8363552 - DNA, 22 bp, Homo sapiens
gcttctggtgaggcctcaggaa

SEQ ID NO: 8363553 - DNA, 22 bp, Homo sapiens
gctgtgtgaccctagccagtag

SEQ ID NO: 8363554 - DNA, 22 bp, Homo sapiens
gctgtgtcagaaactctgggga

SEQ ID NO: 8363555 - DNA, 20 bp, Homo sapiens
gctgtgtagcagtgtgcagt

SEQ ID NO: 8363556 - DNA, 22 bp, Homo sapiens
gcttctgtcttagctacctccc

SEQ ID NO: 8363557 - DNA, 18 bp, Homo sapiens
gctttatttcttggggaa

SEQ ID NO: 8363558 - DNA, 22 bp, Homo sapiens
gcttgcagtggttggcatgacc

SEQ ID NO: 8363559 - DNA, 22 bp, Homo sapiens
ggaagaggctctcattgagggc

SEQ ID NO: 8363560 - DNA, 22 bp, Homo sapiens
ggaagaggctctcattgagggc

SEQ ID NO: 8363561 - DNA, 22 bp, Homo sapiens
ggaagaggctgagccaggtccc

SEQ ID NO: 8363562 - DNA, 22 bp, Homo sapiens
ggaagaggctgaggccatgctg

SEQ ID NO: 8363563 - DNA, 22 bp, Homo sapiens
ggaagaggctgagccaggtccc

SEQ ID NO: 8363564 - DNA, 22 bp, Homo sapiens
ggaagaggaggagccaggcttt

SEQ ID NO: 8363565 - DNA, 22 bp, Homo sapiens
ggaagaggaggagccaggcttt

SEQ ID NO: 8363566 - DNA, 22 bp, Homo sapiens
ggaagacagaagcctacagctt

SEQ ID NO: 8363567 - DNA, 22 bp, Homo sapiens
ggaagacaagcagtggctgagc

SEQ ID NO: 8363568 - DNA, 22 bp, Homo sapiens
gctttggagggcaagagctgtt

SEQ ID NO: 8363569 - DNA, 22 bp, Homo sapiens
gctttggagtcagaaagaccta

SEQ ID NO: 8363570 - DNA, 22 bp, Homo sapiens
gctttggagttaggactcggcc

SEQ ID NO: 8363571 - DNA, 22 bp, Homo sapiens
gctttggagttaggactcggcc

SEQ ID NO: 8363572 - DNA, 22 bp, Homo sapiens
gctttggagcctgtgttctgcc

SEQ ID NO: 8363573 - DNA, 22 bp, Homo sapiens
gctttggacaataactgctttt

SEQ ID NO: 8363574 - DNA, 22 bp, Homo sapiens
gctttggaatctgcatcctctt

SEQ ID NO: 8363575 - DNA, 22 bp, Homo sapiens
gctttgctggcttgaaatgctg

SEQ ID NO: 8363576 - DNA, 22 bp, Homo sapiens
gctttgctgggtgcttcatgta

SEQ ID NO: 8363577 - DNA, 22 bp, Homo sapiens
gctttgcttcctgttctagcct

SEQ ID NO: 8363578 - DNA, 22 bp, Homo sapiens
gctttgcttccttccccttcaa

SEQ ID NO: 8363579 - DNA, 22 bp, Homo sapiens
gctttggaaactggccctgcgc

SEQ ID NO: 8363580 - DNA, 22 bp, Homo sapiens
gctttggaaactggccctgcgc

SEQ ID NO: 8363581 - DNA, 22 bp, Homo sapiens
gctttggaacttaaatccttgg

SEQ ID NO: 8363582 - DNA, 22 bp, Homo sapiens
gctttggaaatatagactcaag

SEQ ID NO: 8363583 - DNA, 22 bp, Homo sapiens
gctttggaaataagaggctaaa

SEQ ID NO: 8363584 - DNA, 17 bp, Homo sapiens
gctttggaaagccttcc

SEQ ID NO: 8363585 - DNA, 22 bp, Homo sapiens
gctttgctatgactcaccagca

SEQ ID NO: 8363586 - DNA, 22 bp, Homo sapiens
gctttgctgaggtctgaggatt

SEQ ID NO: 8363587 - DNA, 22 bp, Homo sapiens
gctttctgcctgggctccattt

SEQ ID NO: 8363588 - DNA, 22 bp, Homo sapiens
gctttccctgccctcagaagga

SEQ ID NO: 8363589 - DNA, 22 bp, Homo sapiens
gctttcagccactgtgtttctg

SEQ ID NO: 8363590 - DNA, 21 bp, Homo sapiens
gctttcagaagtctcatagtt

SEQ ID NO: 8363591 - DNA, 22 bp, Homo sapiens
gctttattttgtgagggattac

SEQ ID NO: 8363592 - DNA, 22 bp, Homo sapiens
ggaagcaaattccagaaccaca

SEQ ID NO: 8363593 - DNA, 22 bp, Homo sapiens
ggaatctcagcttctgccctga

SEQ ID NO: 8363594 - DNA, 22 bp, Homo sapiens
ggaatcagatgaggggcagagc

SEQ ID NO: 8363595 - DNA, 22 bp, Homo sapiens
ggaagagggaaccacgactgta

SEQ ID NO: 8363596 - DNA, 22 bp, Homo sapiens
ggaagaggctggtagtgcccgt

SEQ ID NO: 8363597 - DNA, 22 bp, Homo sapiens
ggaagaggctggtagtgcccgt

SEQ ID NO: 8363598 - DNA, 22 bp, Homo sapiens
ggaagaggctggtagtgcccgt

SEQ ID NO: 8363599 - DNA, 22 bp, Homo sapiens
ggaagagtgcaggtttgtttca

SEQ ID NO: 8363600 - DNA, 22 bp, Homo sapiens
ggaagatgagaagtggggctcc

SEQ ID NO: 8363601 - DNA, 22 bp, Homo sapiens
ggaagagtaacaggaggtggaa

SEQ ID NO: 8363602 - DNA, 22 bp, Homo sapiens
ggaagattcagcatatatgagt

SEQ ID NO: 8363603 - DNA, 22 bp, Homo sapiens
ggaagattcagttatctcatga

SEQ ID NO: 8363604 - DNA, 22 bp, Homo sapiens
ggaagcaaaatcatcagtcatt

SEQ ID NO: 8363605 - DNA, 22 bp, Homo sapiens
ggaatgttgtcatttacattat

SEQ ID NO: 8363606 - DNA, 17 bp, Homo sapiens
ggacacagctcatggct

SEQ ID NO: 8363607 - DNA, 22 bp, Homo sapiens
ggacacagccacttagggtacc

SEQ ID NO: 8363608 - DNA, 18 bp, Homo sapiens
ggacacagataggtacag

SEQ ID NO: 8363609 - DNA, 22 bp, Homo sapiens
ggagagaaattgaggtagcaag

SEQ ID NO: 8363610 - DNA, 22 bp, Homo sapiens
ggagagaaattgaggtagcaag

SEQ ID NO: 8363611 - DNA, 22 bp, Homo sapiens
ggagagaaattgaggtagcaag

SEQ ID NO: 8363612 - DNA, 22 bp, Homo sapiens
ggagagaactgacctgaaagga

SEQ ID NO: 8363613 - DNA, 22 bp, Homo sapiens
ggagagaattccatggacatgt

SEQ ID NO: 8363614 - DNA, 22 bp, Homo sapiens
ggagccagaaatgctgtggttg

SEQ ID NO: 8363615 - DNA, 22 bp, Homo sapiens
ggagccagagcactggggagcc

SEQ ID NO: 8363616 - DNA, 22 bp, Homo sapiens
ggagcagcactgccacacagag

SEQ ID NO: 8363617 - DNA, 22 bp, Homo sapiens
ggagagagagctcattagctgc

SEQ ID NO: 8363618 - DNA, 22 bp, Homo sapiens
ggagagagagctcattagctgc

SEQ ID NO: 8363619 - DNA, 22 bp, Homo sapiens
ggagagagacctccatgcccag

SEQ ID NO: 8363620 - DNA, 22 bp, Homo sapiens
ggagagagacctccatgcccag

SEQ ID NO: 8363621 - DNA, 22 bp, Homo sapiens
ggaccaggggcgcactccctgc

SEQ ID NO: 8363622 - DNA, 17 bp, Homo sapiens
ggaccaggggttgccat

SEQ ID NO: 8363623 - DNA, 19 bp, Homo sapiens
ggaccaggtcctgggcagc

SEQ ID NO: 8363624 - DNA, 20 bp, Homo sapiens
ggaccaggtggggcggtggc

SEQ ID NO: 8363625 - DNA, 22 bp, Homo sapiens
ggagacagtatggcttgtagct

SEQ ID NO: 8363626 - DNA, 22 bp, Homo sapiens
ggaccaggccagcctccctgcg

SEQ ID NO: 8363627 - DNA, 22 bp, Homo sapiens
ggaccaggctgagcacctgcct

SEQ ID NO: 8363628 - DNA, 22 bp, Homo sapiens
ggaccaggagctcagagccctc

SEQ ID NO: 8363629 - DNA, 22 bp, Homo sapiens
ggaccaggactggtggtatctc

SEQ ID NO: 8363630 - DNA, 20 bp, Homo sapiens
ggaccagctgtctgaggggc

SEQ ID NO: 8363631 - DNA, 22 bp, Homo sapiens
ggacatggaaatcggcttgctc

SEQ ID NO: 8363632 - DNA, 22 bp, Homo sapiens
ggacacaggtaaataccactga

SEQ ID NO: 8363633 - DNA, 22 bp, Homo sapiens
ggacacagtggaagacagcttg

SEQ ID NO: 8363634 - DNA, 22 bp, Homo sapiens
ggacacagggctcactctctct

SEQ ID NO: 8363635 - DNA, 22 bp, Homo sapiens
ggacacaggcagctgggtgggt

SEQ ID NO: 8363636 - DNA, 22 bp, Homo sapiens
ggacacagctgcagccacaccc

SEQ ID NO: 8363637 - DNA, 19 bp, Homo sapiens
ggacagtctcagcctcatg

SEQ ID NO: 8363638 - DNA, 20 bp, Homo sapiens
ggacagtgagacatatctca

SEQ ID NO: 8363639 - DNA, 22 bp, Homo sapiens
ggacagtgcgagacacagtaac

SEQ ID NO: 8363640 - DNA, 22 bp, Homo sapiens
gctcagagggaacaaggggctg

SEQ ID NO: 8363641 - DNA, 22 bp, Homo sapiens
gctcagagggaacaaggggctg

SEQ ID NO: 8363642 - DNA, 22 bp, Homo sapiens
gctacagtgataggaaacacat

SEQ ID NO: 8363643 - DNA, 22 bp, Homo sapiens
gctactgattgaccttggagag

SEQ ID NO: 8363644 - DNA, 23 bp, Homo sapiens
gctcagaggtttttctctggatg

SEQ ID NO: 8363645 - DNA, 23 bp, Homo sapiens
gctcagaggtttttctctggatg

SEQ ID NO: 8363646 - DNA, 22 bp, Homo sapiens
gctcagagggttttggccaagt

SEQ ID NO: 8363647 - DNA, 22 bp, Homo sapiens
gctcagagtggcctggctaggg

SEQ ID NO: 8363648 - DNA, 22 bp, Homo sapiens
gctcagctacttacaggtggct

SEQ ID NO: 8363649 - DNA, 22 bp, Homo sapiens
gctcagctctatggacacaaag

SEQ ID NO: 8363650 - DNA, 22 bp, Homo sapiens
gctcagctgagcgaaggacatg

SEQ ID NO: 8363651 - DNA, 22 bp, Homo sapiens
gctcagagttaaatatagtgct

SEQ ID NO: 8363652 - DNA, 22 bp, Homo sapiens
gctcagagttaattggatgggt

SEQ ID NO: 8363653 - DNA, 22 bp, Homo sapiens
gctccagggtcagctcagaact

SEQ ID NO: 8363654 - DNA, 22 bp, Homo sapiens
gctccagggtcagctcagaact

SEQ ID NO: 8363655 - DNA, 22 bp, Homo sapiens
gctccaggcagagcctctttcg

SEQ ID NO: 8363656 - DNA, 20 bp, Homo sapiens
gctccaggtcagagaggacg

SEQ ID NO: 8363657 - DNA, 22 bp, Homo sapiens
gctccaggtgaatcctctcacc

SEQ ID NO: 8363658 - DNA, 22 bp, Homo sapiens
gctcccagaaccaaggctgggg

SEQ ID NO: 8363659 - DNA, 23 bp, Homo sapiens
gctccctgtccctgcacttaggc

SEQ ID NO: 8363660 - DNA, 22 bp, Homo sapiens
gctccctggaatgttggctgcc

SEQ ID NO: 8363661 - DNA, 22 bp, Homo sapiens
gctccctggtagccatgctctc

SEQ ID NO: 8363662 - DNA, 22 bp, Homo sapiens
gctccctggtagccatgctctc

SEQ ID NO: 8363663 - DNA, 22 bp, Homo sapiens
gctccctgactcagttcctgag

SEQ ID NO: 8363664 - DNA, 21 bp, Homo sapiens
gctccctgctcagctcctggg

SEQ ID NO: 8363665 - DNA, 22 bp, Homo sapiens
gcctgaggaatgctcctgactt

SEQ ID NO: 8363666 - DNA, 22 bp, Homo sapiens
gccttgggccagctgctctgga

SEQ ID NO: 8363667 - DNA, 22 bp, Homo sapiens
gccttgggaaagtgggaggaga

SEQ ID NO: 8363668 - DNA, 22 bp, Homo sapiens
gccttgggattcttggatgctc

SEQ ID NO: 8363669 - DNA, 22 bp, Homo sapiens
gcctctgtcatagctcatgtga

SEQ ID NO: 8363670 - DNA, 22 bp, Homo sapiens
gcctctggtccctcatgctgtg

SEQ ID NO: 8363671 - DNA, 22 bp, Homo sapiens
gcctctgtggctcagccttgct

SEQ ID NO: 8363672 - DNA, 18 bp, Homo sapiens
gcctctgttgcttgcctg

SEQ ID NO: 8363673 - DNA, 22 bp, Homo sapiens
gcctgagcaggcgtggaccatg

SEQ ID NO: 8363674 - DNA, 22 bp, Homo sapiens
gcctctggtccctcatgctgtg

SEQ ID NO: 8363675 - DNA, 22 bp, Homo sapiens
gcctctggggtggagcccagca

SEQ ID NO: 8363676 - DNA, 22 bp, Homo sapiens
gcggtgggggaaaggagcggtt

SEQ ID NO: 8363677 - DNA, 22 bp, Homo sapiens
gcggtggggaaaggaggtgctg

SEQ ID NO: 8363678 - DNA, 22 bp, Homo sapiens
gctacagatttatcatgttata

SEQ ID NO: 8363679 - DNA, 22 bp, Homo sapiens
gctacagagctctgtgaagaga

SEQ ID NO: 8363680 - DNA, 22 bp, Homo sapiens
gctacaggtatatagatgaaac

SEQ ID NO: 8363681 - DNA, 22 bp, Homo sapiens
gctacaggagctgtcacatgct

SEQ ID NO: 8363682 - DNA, 22 bp, Homo sapiens
gcggggttccgtgccccagagt

SEQ ID NO: 8363683 - DNA, 22 bp, Homo sapiens
gcctttcctgctctggcattca

SEQ ID NO: 8363684 - DNA, 22 bp, Homo sapiens
gccttgtttcattacacgtggt

SEQ ID NO: 8363685 - DNA, 22 bp, Homo sapiens
gctgagactgacatgaagaggt

SEQ ID NO: 8363686 - DNA, 17 bp, Homo sapiens
gctgagaaggggaagag

SEQ ID NO: 8363687 - DNA, 22 bp, Homo sapiens
gctgacacttagaagtgccctg

SEQ ID NO: 8363688 - DNA, 22 bp, Homo sapiens
gctgagaatgttcctactggta

SEQ ID NO: 8363689 - DNA, 22 bp, Homo sapiens
gctgagaatgttcctactggta

SEQ ID NO: 8363690 - DNA, 22 bp, Homo sapiens
gctgagaatcaagatggagagg

SEQ ID NO: 8363691 - DNA, 22 bp, Homo sapiens
gctgaggctcctcgggaggaca

SEQ ID NO: 8363692 - DNA, 22 bp, Homo sapiens
gctgaggctgggagcagcctgt

SEQ ID NO: 8363693 - DNA, 22 bp, Homo sapiens
gctgagggatagctgctcactg

SEQ ID NO: 8363694 - DNA, 22 bp, Homo sapiens
gctgaggcctcagaaggctgag

SEQ ID NO: 8363695 - DNA, 22 bp, Homo sapiens
gctctggggatgcttctgccgt

SEQ ID NO: 8363696 - DNA, 22 bp, Homo sapiens
gctctgggccatcctggccggg

SEQ ID NO: 8363697 - DNA, 22 bp, Homo sapiens
gctctgggattaccagccttag

SEQ ID NO: 8363698 - DNA, 22 bp, Homo sapiens
gctctgggaactgactgccttc

SEQ ID NO: 8363699 - DNA, 22 bp, Homo sapiens
gctctgggaactgactgccttc

SEQ ID NO: 8363700 - DNA, 22 bp, Homo sapiens
gctctgggaagtcctttaccat

SEQ ID NO: 8363701 - DNA, 22 bp, Homo sapiens
gctctgggaactgactgccttc

SEQ ID NO: 8363702 - DNA, 22 bp, Homo sapiens
gctccctgttctcagccatgat

SEQ ID NO: 8363703 - DNA, 22 bp, Homo sapiens
gctccctgtgctctgagtgata

SEQ ID NO: 8363704 - DNA, 22 bp, Homo sapiens
gctctggctagttacctcttac

SEQ ID NO: 8363705 - DNA, 22 bp, Homo sapiens
gctgctgtgaattttttaaatg

SEQ ID NO: 8363706 - DNA, 22 bp, Homo sapiens
gctgctgtgccccatctgcaga

SEQ ID NO: 8363707 - DNA, 22 bp, Homo sapiens
gctgctcatttgtatcctttgt

SEQ ID NO: 8363708 - DNA, 22 bp, Homo sapiens
gctgctgtgtgggagacaggcg

SEQ ID NO: 8363709 - DNA, 22 bp, Homo sapiens
gctgctgttgatttagtccaat

SEQ ID NO: 8363710 - DNA, 22 bp, Homo sapiens
gctgcttcagggacgtgccagc

SEQ ID NO: 8363711 - DNA, 22 bp, Homo sapiens
gctgcctgtgtggccactcact

SEQ ID NO: 8363712 - DNA, 22 bp, Homo sapiens
gctgcctgtggcccttctgggt

SEQ ID NO: 8363713 - DNA, 22 bp, Homo sapiens
gctgcctgtggcccttctgggt

SEQ ID NO: 8363714 - DNA, 22 bp, Homo sapiens
gctgcctgtgcactttctcgta

SEQ ID NO: 8363715 - DNA, 22 bp, Homo sapiens
gctgcctgtctgtttcttttat

SEQ ID NO: 8363716 - DNA, 20 bp, Homo sapiens
gctgcctgtttctgtaagta

SEQ ID NO: 8363717 - DNA, 22 bp, Homo sapiens
gctgcgccggatcccacgttcc

SEQ ID NO: 8363718 - DNA, 22 bp, Homo sapiens
gctgctcagtgggcctgagcct

SEQ ID NO: 8363719 - DNA, 22 bp, Homo sapiens
gctgcccagttctgctgctgcc

SEQ ID NO: 8363720 - DNA, 22 bp, Homo sapiens
gctgcccagggctgagtgtcct

SEQ ID NO: 8363721 - DNA, 22 bp, Homo sapiens
gctgcccagacattgaatcagg

SEQ ID NO: 8363722 - DNA, 22 bp, Homo sapiens
gctgcctcactccagcccaata

SEQ ID NO: 8363723 - DNA, 22 bp, Homo sapiens
gctgcctccaatctgtgccccg

SEQ ID NO: 8363724 - DNA, 22 bp, Homo sapiens
gctgccctgtggtccagcaggt

SEQ ID NO: 8363725 - DNA, 22 bp, Homo sapiens
gctgccctgtggtagagggtgg

SEQ ID NO: 8363726 - DNA, 22 bp, Homo sapiens
gctgccctgtctgcagcaggac

SEQ ID NO: 8363727 - DNA, 22 bp, Homo sapiens
gctgccctgtctgcagcaggac

SEQ ID NO: 8363728 - DNA, 22 bp, Homo sapiens
gctgccctagaagtacagagag

SEQ ID NO: 8363729 - DNA, 22 bp, Homo sapiens
gggaggagctgagtgtgtgtgc

SEQ ID NO: 8363730 - DNA, 22 bp, Homo sapiens
gggaggagcttggagattcact

SEQ ID NO: 8363731 - DNA, 22 bp, Homo sapiens
gggaggaaatgtgcagcgaatt

SEQ ID NO: 8363732 - DNA, 21 bp, Homo sapiens
gggaggaagctgcttctctct

SEQ ID NO: 8363733 - DNA, 22 bp, Homo sapiens
gggaggaaagagaagtggtcca

SEQ ID NO: 8363734 - DNA, 22 bp, Homo sapiens
gggcacagcctaactatggaga

SEQ ID NO: 8363735 - DNA, 22 bp, Homo sapiens
gggcacagcctaactatggaga

SEQ ID NO: 8363736 - DNA, 22 bp, Homo sapiens
gggcacagctgctacccagtgc

SEQ ID NO: 8363737 - DNA, 22 bp, Homo sapiens
gggcaagaagctggaagcattc

SEQ ID NO: 8363738 - DNA, 22 bp, Homo sapiens
gggcaagaagctggaagcattc

SEQ ID NO: 8363739 - DNA, 22 bp, Homo sapiens
gggcaaagtggtggaggcagtt

SEQ ID NO: 8363740 - DNA, 22 bp, Homo sapiens
gggcaagcagtgaggacagcac

SEQ ID NO: 8363741 - DNA, 22 bp, Homo sapiens
gggcaggaggctaattctgcat

SEQ ID NO: 8363742 - DNA, 22 bp, Homo sapiens
gggcaggagagggccacctgga

SEQ ID NO: 8363743 - DNA, 22 bp, Homo sapiens
gggcaggagagaacagtcatgg

SEQ ID NO: 8363744 - DNA, 22 bp, Homo sapiens
gggcaggagaaggtggatgtcc

SEQ ID NO: 8363745 - DNA, 16 bp, Homo sapiens
gggcaggaatcagggt

SEQ ID NO: 8363746 - DNA, 16 bp, Homo sapiens
gggcaggaatcagggt

SEQ ID NO: 8363747 - DNA, 22 bp, Homo sapiens
gggcaggaacaaatcaaatgat

SEQ ID NO: 8363748 - DNA, 22 bp, Homo sapiens
gggcaggagaaggtggatgtcc

SEQ ID NO: 8363749 - DNA, 23 bp, Homo sapiens
gggcatggagtgtaggtggaagg

SEQ ID NO: 8363750 - DNA, 18 bp, Homo sapiens
gggcatggatgcagcatc

SEQ ID NO: 8363751 - DNA, 19 bp, Homo sapiens
gggcatggatgagcttacc

SEQ ID NO: 8363752 - DNA, 22 bp, Homo sapiens
gggcaggctgagcatgtcacct

SEQ ID NO: 8363753 - DNA, 22 bp, Homo sapiens
gggcaggatgcagtttcagaga

SEQ ID NO: 8363754 - DNA, 22 bp, Homo sapiens
gggcatgcctgcgcagtgcatg

SEQ ID NO: 8363755 - DNA, 22 bp, Homo sapiens
gggcacaggagaaggatctggc

SEQ ID NO: 8363756 - DNA, 22 bp, Homo sapiens
gggcacaggaatttgggatgtg

SEQ ID NO: 8363757 - DNA, 22 bp, Homo sapiens
gggcagctctggctgtgggaag

SEQ ID NO: 8363758 - DNA, 22 bp, Homo sapiens
gggcagctctggctgtgggaag

SEQ ID NO: 8363759 - DNA, 22 bp, Homo sapiens
gggcagctctgcccatcagagg

SEQ ID NO: 8363760 - DNA, 22 bp, Homo sapiens
gggcagctgccagaggccatgg

SEQ ID NO: 8363761 - DNA, 22 bp, Homo sapiens
gggacaggctgagacttgagct

SEQ ID NO: 8363762 - DNA, 22 bp, Homo sapiens
gggaccagaggctgtgcacaat

SEQ ID NO: 8363763 - DNA, 23 bp, Homo sapiens
gggaccagctagggctgtgacct

SEQ ID NO: 8363764 - DNA, 22 bp, Homo sapiens
gggaccagaagaaggatggtga

SEQ ID NO: 8363765 - DNA, 22 bp, Homo sapiens
gggaccactccgacatgtaggg

SEQ ID NO: 8363766 - DNA, 22 bp, Homo sapiens
gggacatggctaggattccaat

SEQ ID NO: 8363767 - DNA, 17 bp, Homo sapiens
ggctttagggacaccac

SEQ ID NO: 8363768 - DNA, 22 bp, Homo sapiens
gggagagcgggaggtgccacag

SEQ ID NO: 8363769 - DNA, 22 bp, Homo sapiens
gggagacacgctgcaggcataa

SEQ ID NO: 8363770 - DNA, 19 bp, Homo sapiens
gggagacagctctgggctg

SEQ ID NO: 8363771 - DNA, 22 bp, Homo sapiens
gggagacaagaagtagcctgct

SEQ ID NO: 8363772 - DNA, 22 bp, Homo sapiens
gggagagaattattgccagacc

SEQ ID NO: 8363773 - DNA, 22 bp, Homo sapiens
gggagagaattattgccagacc

SEQ ID NO: 8363774 - DNA, 22 bp, Homo sapiens
gggagctgtaagggacaggtag

SEQ ID NO: 8363775 - DNA, 22 bp, Homo sapiens
gggagaggttacccgagcaact

SEQ ID NO: 8363776 - DNA, 22 bp, Homo sapiens
ggctgaagtgtagtggctcact

SEQ ID NO: 8363777 - DNA, 22 bp, Homo sapiens
ggctcttctgtttcacaggcca

SEQ ID NO: 8363778 - DNA, 22 bp, Homo sapiens
ggctcttctgtttcacaggcca

SEQ ID NO: 8363779 - DNA, 22 bp, Homo sapiens
ggctcttctgtggcagccaagg

SEQ ID NO: 8363780 - DNA, 22 bp, Homo sapiens
ggctcttctgtggcagccaagg

SEQ ID NO: 8363781 - DNA, 22 bp, Homo sapiens
ggctcttctggttgtcacattt

SEQ ID NO: 8363782 - DNA, 22 bp, Homo sapiens
ggctcttctacttcagatgggg

SEQ ID NO: 8363783 - DNA, 22 bp, Homo sapiens
ggcgggaagttcttgcccactt

SEQ ID NO: 8363784 - DNA, 22 bp, Homo sapiens
ggctccagatgtctcctggcaa

SEQ ID NO: 8363785 - DNA, 22 bp, Homo sapiens
ggctccagatgtcccctggcaa

SEQ ID NO: 8363786 - DNA, 22 bp, Homo sapiens
ggctccagatgtcccctggcaa

SEQ ID NO: 8363787 - DNA, 22 bp, Homo sapiens
ggctctgctcacagcccgcagc

SEQ ID NO: 8363788 - DNA, 22 bp, Homo sapiens
ggctctgctcctggtgccagtg

SEQ ID NO: 8363789 - DNA, 22 bp, Homo sapiens
ggctctgctgcaagtcttcctc

SEQ ID NO: 8363790 - DNA, 22 bp, Homo sapiens
ggctccaggagggccttggcca

SEQ ID NO: 8363791 - DNA, 22 bp, Homo sapiens
ggctccaggagatgctgggcag

SEQ ID NO: 8363792 - DNA, 22 bp, Homo sapiens
ggctccaggagatgctgggcag

SEQ ID NO: 8363793 - DNA, 22 bp, Homo sapiens
ggctccaggagggccttggcca

SEQ ID NO: 8363794 - DNA, 22 bp, Homo sapiens
ggctccagatgtctcctggcaa

SEQ ID NO: 8363795 - DNA, 22 bp, Homo sapiens
ggctccagccctggctcttcac

SEQ ID NO: 8363796 - DNA, 22 bp, Homo sapiens
ggctccaggagatgctgggcag

SEQ ID NO: 8363797 - DNA, 18 bp, Homo sapiens
ggctccaggacctaccca

SEQ ID NO: 8363798 - DNA, 22 bp, Homo sapiens
ggctccaggaacctcctctcct

SEQ ID NO: 8363799 - DNA, 22 bp, Homo sapiens
ggctggcttggtgagctgtcac

SEQ ID NO: 8363800 - DNA, 22 bp, Homo sapiens
ggctggcttggtgagctgtcac

SEQ ID NO: 8363801 - DNA, 22 bp, Homo sapiens
ggctgctgcccacccctgcatg

SEQ ID NO: 8363802 - DNA, 22 bp, Homo sapiens
ggctgctgacaaacatgatcat

SEQ ID NO: 8363803 - DNA, 22 bp, Homo sapiens
ggctgagcactttaggcaggag

SEQ ID NO: 8363804 - DNA, 22 bp, Homo sapiens
ggcttctgccacgagagggaag

SEQ ID NO: 8363805 - DNA, 22 bp, Homo sapiens
ggcttctgagtgctctgctgtt

SEQ ID NO: 8363806 - DNA, 22 bp, Homo sapiens
ggcttctgaaatctctgtgcgt

SEQ ID NO: 8363807 - DNA, 22 bp, Homo sapiens
ggcttctgtcctctggatctgt

SEQ ID NO: 8363808 - DNA, 22 bp, Homo sapiens
ggcttctggtgggagcatgact

SEQ ID NO: 8363809 - DNA, 18 bp, Homo sapiens
ggcttctgggacatttta

SEQ ID NO: 8363810 - DNA, 22 bp, Homo sapiens
ggcttctgctcagcctgcacgc

SEQ ID NO: 8363811 - DNA, 22 bp, Homo sapiens
ggcttctgccacgagagggaag

SEQ ID NO: 8363812 - DNA, 22 bp, Homo sapiens
ggcttctgccttgccagttctt

SEQ ID NO: 8363813 - DNA, 22 bp, Homo sapiens
ggctgggctgctgggtcagagc

SEQ ID NO: 8363814 - DNA, 22 bp, Homo sapiens
ggctgggcaggtctgcacaggg

SEQ ID NO: 8363815 - DNA, 22 bp, Homo sapiens
ggctgggctccgggagcatgcg

SEQ ID NO: 8363816 - DNA, 22 bp, Homo sapiens
ggcaggcaacggaccactagtc

SEQ ID NO: 8363817 - DNA, 22 bp, Homo sapiens
ggcaggcaaggcagcctggtga

SEQ ID NO: 8363818 - DNA, 22 bp, Homo sapiens
ggcaggcaaggcagcctggtga

SEQ ID NO: 8363819 - DNA, 22 bp, Homo sapiens
ggcaggcaagtctgctctgtga

SEQ ID NO: 8363820 - DNA, 22 bp, Homo sapiens
ggcaggcaagtctgctctgtga

SEQ ID NO: 8363821 - DNA, 22 bp, Homo sapiens
ggcaggcactgtgttttgtgtt

SEQ ID NO: 8363822 - DNA, 22 bp, Homo sapiens
ggcaggcagaaaaatagaatat

SEQ ID NO: 8363823 - DNA, 22 bp, Homo sapiens
ggcaggcactgtgctaggcgct

SEQ ID NO: 8363824 - DNA, 22 bp, Homo sapiens
ggcaggcactgtgctaggcgct

SEQ ID NO: 8363825 - DNA, 22 bp, Homo sapiens
ggcaggcaatgaggatgggaag

SEQ ID NO: 8363826 - DNA, 22 bp, Homo sapiens
ggcaggcacatttgggggccgt

SEQ ID NO: 8363827 - DNA, 22 bp, Homo sapiens
ggcaggcaccagctcagcaata

SEQ ID NO: 8363828 - DNA, 22 bp, Homo sapiens
ggcaggagggcggacaatgacc

SEQ ID NO: 8363829 - DNA, 22 bp, Homo sapiens
ggcaggagggcggacaatgacc

SEQ ID NO: 8363830 - DNA, 20 bp, Homo sapiens
ggcagagggcctgggagaag

SEQ ID NO: 8363831 - DNA, 22 bp, Homo sapiens
ggcagaggtagctggaaccagg

SEQ ID NO: 8363832 - DNA, 22 bp, Homo sapiens
ggcagaggtagctggaaccagg

SEQ ID NO: 8363833 - DNA, 22 bp, Homo sapiens
ggcagaggtagctggaaccagg

SEQ ID NO: 8363834 - DNA, 22 bp, Homo sapiens
ggcagaggagctggaaacatgg

SEQ ID NO: 8363835 - DNA, 20 bp, Homo sapiens
ggcagagggcctgggagaag

SEQ ID NO: 8363836 - DNA, 20 bp, Homo sapiens
ggcagagggcctgggagaag

SEQ ID NO: 8363837 - DNA, 22 bp, Homo sapiens
ggcagaggaggggtgaatttgc

SEQ ID NO: 8363838 - DNA, 22 bp, Homo sapiens
ggcaccaggacatgactcccag

SEQ ID NO: 8363839 - DNA, 22 bp, Homo sapiens
ggcaccaggatcagtctgtcat

SEQ ID NO: 8363840 - DNA, 23 bp, Homo sapiens
ggcaccaggccatggagcgggag

SEQ ID NO: 8363841 - DNA, 20 bp, Homo sapiens
ggcaccaggctaggattgga

SEQ ID NO: 8363842 - DNA, 22 bp, Homo sapiens
ggcacagctcaggtcccagctc

SEQ ID NO: 8363843 - DNA, 22 bp, Homo sapiens
ggcacagcgactaccatcgaaa

SEQ ID NO: 8363844 - DNA, 22 bp, Homo sapiens
ggcacaggaatctgtgaagtgc

SEQ ID NO: 8363845 - DNA, 22 bp, Homo sapiens
ggcacagctgatgcagacacac

SEQ ID NO: 8363846 - DNA, 17 bp, Homo sapiens
ggcaccagacggagagt

SEQ ID NO: 8363847 - DNA, 22 bp, Homo sapiens
ggcaccagccacctatttctag

SEQ ID NO: 8363848 - DNA, 22 bp, Homo sapiens
ggcaccagccacctatttctag

SEQ ID NO: 8363849 - DNA, 22 bp, Homo sapiens
ggcaccagcaggcaccgatgcc

SEQ ID NO: 8363850 - DNA, 22 bp, Homo sapiens
ggcaccagcacttgggatggct

SEQ ID NO: 8363851 - DNA, 22 bp, Homo sapiens
ggcaagaacctcaattaccttt

SEQ ID NO: 8363852 - DNA, 22 bp, Homo sapiens
ggcaacaactggacatagctgg

SEQ ID NO: 8363853 - DNA, 20 bp, Homo sapiens
ggcaagcaactgagggagga

SEQ ID NO: 8363854 - DNA, 22 bp, Homo sapiens
ggcaaggaagaagccatgatgt

SEQ ID NO: 8363855 - DNA, 19 bp, Homo sapiens
ggcaagcacaaaagctttg

SEQ ID NO: 8363856 - DNA, 22 bp, Homo sapiens
ggcaagaggtccaagaggtctc

SEQ ID NO: 8363857 - DNA, 22 bp, Homo sapiens
ggagtgagtggccttgtcactg

SEQ ID NO: 8363858 - DNA, 22 bp, Homo sapiens
ggagtgagtactggagtagctg

SEQ ID NO: 8363859 - DNA, 22 bp, Homo sapiens
ggagtgagtactggagtagctg

SEQ ID NO: 8363860 - DNA, 23 bp, Homo sapiens
ggagtgcaatggcgccatctcgg

SEQ ID NO: 8363861 - DNA, 23 bp, Homo sapiens
ggagtgcaatggcgccatctcgg

SEQ ID NO: 8363862 - DNA, 22 bp, Homo sapiens
ggagtgccgaggtgttcaagga

SEQ ID NO: 8363863 - DNA, 22 bp, Homo sapiens
ggagtgcggtggcaccatctca

SEQ ID NO: 8363864 - DNA, 22 bp, Homo sapiens
ggcaaaaaccacaattactttt

SEQ ID NO: 8363865 - DNA, 22 bp, Homo sapiens
ggcaaaaacagcaatgactttt

SEQ ID NO: 8363866 - DNA, 22 bp, Homo sapiens
ggagtgctccgcgagagggatg

SEQ ID NO: 8363867 - DNA, 22 bp, Homo sapiens
ggcaaaaaccataattactttt

SEQ ID NO: 8363868 - DNA, 22 bp, Homo sapiens
ggcaaaaaccgcaataacttct

SEQ ID NO: 8363869 - DNA, 22 bp, Homo sapiens
ggcaaacaggagagtaaagaga

SEQ ID NO: 8363870 - DNA, 22 bp, Homo sapiens
ggagtgaggcatttgtagctga

SEQ ID NO: 8363871 - DNA, 22 bp, Homo sapiens
ggagtcaccaagtaggagtctt

SEQ ID NO: 8363872 - DNA, 22 bp, Homo sapiens
ggagtcacctgggaggactggg

SEQ ID NO: 8363873 - DNA, 22 bp, Homo sapiens
ggagccagagtctgcagtgtaa

SEQ ID NO: 8363874 - DNA, 22 bp, Homo sapiens
ggagccagagtctgcagtgtaa

SEQ ID NO: 8363875 - DNA, 22 bp, Homo sapiens
ggagccagagtttaatgtggag

SEQ ID NO: 8363876 - DNA, 22 bp, Homo sapiens
ggagccagaggctgctgctgtg

SEQ ID NO: 8363877 - DNA, 22 bp, Homo sapiens
ggagccagaggctgctgctgtg

SEQ ID NO: 8363878 - DNA, 19 bp, Homo sapiens
ggagccagctgtggaaggc

SEQ ID NO: 8363879 - DNA, 22 bp, Homo sapiens
ggagtaggccccgggagagagt

SEQ ID NO: 8363880 - DNA, 19 bp, Homo sapiens
ggagccagctgtggaaggc

SEQ ID NO: 8363881 - DNA, 22 bp, Homo sapiens
ggagccagcagggtgacactga

SEQ ID NO: 8363882 - DNA, 22 bp, Homo sapiens
ggagccagcagggtgacactga

SEQ ID NO: 8363883 - DNA, 22 bp, Homo sapiens
ggcctcagagaaggctgtgcgg

SEQ ID NO: 8363884 - DNA, 22 bp, Homo sapiens
ggcctcagggttgggcccatta

SEQ ID NO: 8363885 - DNA, 18 bp, Homo sapiens
ggcctcagcctggccgga

SEQ ID NO: 8363886 - DNA, 21 bp, Homo sapiens
ggcctcagccacctggctctg

SEQ ID NO: 8363887 - DNA, 22 bp, Homo sapiens
ggcctcagtgggccgctgcagg

SEQ ID NO: 8363888 - DNA, 22 bp, Homo sapiens
ggcctcagggttgggcccatta

SEQ ID NO: 8363889 - DNA, 22 bp, Homo sapiens
ggcctcagggttgggcccatta

SEQ ID NO: 8363890 - DNA, 22 bp, Homo sapiens
ggcctcatcacagtgcattagt

SEQ ID NO: 8363891 - DNA, 22 bp, Homo sapiens
ggcctctgttctgcattcctcc

SEQ ID NO: 8363892 - DNA, 22 bp, Homo sapiens
ggccttgggatgtggctgcagc

SEQ ID NO: 8363893 - DNA, 22 bp, Homo sapiens
ggccttgggcagacacgtcaca

SEQ ID NO: 8363894 - DNA, 17 bp, Homo sapiens
ggccttggggcctcagt

SEQ ID NO: 8363895 - DNA, 22 bp, Homo sapiens
ggccttggggtggccttgtccc

SEQ ID NO: 8363896 - DNA, 22 bp, Homo sapiens
ggccttgggcgagtccctcagt

SEQ ID NO: 8363897 - DNA, 22 bp, Homo sapiens
ggccttggtactgtaaaccgag

SEQ ID NO: 8363898 - DNA, 22 bp, Homo sapiens
ggccttggtgccatggccagtt

SEQ ID NO: 8363899 - DNA, 20 bp, Homo sapiens
ggccttgggtttcgcctgtt

SEQ ID NO: 8363900 - DNA, 22 bp, Homo sapiens
ggccttggttctgtcacagccg

SEQ ID NO: 8363901 - DNA, 22 bp, Homo sapiens
ggcaggtggaagttggcagagc

SEQ ID NO: 8363902 - DNA, 22 bp, Homo sapiens
ggcaggcagaggctgagacagg

SEQ ID NO: 8363903 - DNA, 22 bp, Homo sapiens
ggcaggtgggaaccctccccac

SEQ ID NO: 8363904 - DNA, 22 bp, Homo sapiens
ggcagtcatttaatccctgcat

SEQ ID NO: 8363905 - DNA, 22 bp, Homo sapiens
ggcagtcccagcccagaggcgc

SEQ ID NO: 8363906 - DNA, 22 bp, Homo sapiens
ggcagtcagtttggagatggat

SEQ ID NO: 8363907 - DNA, 22 bp, Homo sapiens
ggcagtcagtgtggttcataaa

SEQ ID NO: 8363908 - DNA, 22 bp, Homo sapiens
ggcagtcatcccacttggaacc

SEQ ID NO: 8363909 - DNA, 22 bp, Homo sapiens
ggcaggtggtaaggatttcata

SEQ ID NO: 8363910 - DNA, 22 bp, Homo sapiens
ggcaggtgtgagatcgaggcca

SEQ ID NO: 8363911 - DNA, 22 bp, Homo sapiens
ggcatggacgtctctgaggcca

SEQ ID NO: 8363912 - DNA, 22 bp, Homo sapiens
ggcagtgaatctgagagcctgg

SEQ ID NO: 8363913 - DNA, 22 bp, Homo sapiens
ggcagtgaatgaaacagaggct

SEQ ID NO: 8363914 - DNA, 22 bp, Homo sapiens
ggcagtcccaggctgcatgttg

SEQ ID NO: 8363915 - DNA, 22 bp, Homo sapiens
ggcagtccccatttggtgtttt

SEQ ID NO: 8363916 - DNA, 22 bp, Homo sapiens
ggcatggggtgtatgtggcacg

SEQ ID NO: 8363917 - DNA, 22 bp, Homo sapiens
ggcatggggtgtatgtggcacg

SEQ ID NO: 8363918 - DNA, 18 bp, Homo sapiens
ggcatgtgagtgctgagg

SEQ ID NO: 8363919 - DNA, 22 bp, Homo sapiens
ggcatgtgcctgaggtcacaca

SEQ ID NO: 8363920 - DNA, 19 bp, Homo sapiens
ggccaggctgactgtggtc

SEQ ID NO: 8363921 - DNA, 22 bp, Homo sapiens
ggccacactctggtagaggtga

SEQ ID NO: 8363922 - DNA, 22 bp, Homo sapiens
ggccacacggagaggctggtct

SEQ ID NO: 8363923 - DNA, 22 bp, Homo sapiens
ggccatgcaggtcagaggtggg

SEQ ID NO: 8363924 - DNA, 21 bp, Homo sapiens
ggccatcctgggaagggctgc

SEQ ID NO: 8363925 - DNA, 22 bp, Homo sapiens
ggccagggggcttcagactcca

SEQ ID NO: 8363926 - DNA, 22 bp, Homo sapiens
ggccaggtgcggtggctcacac

SEQ ID NO: 8363927 - DNA, 22 bp, Homo sapiens
gggcttcttgcaggggcaacat

SEQ ID NO: 8363928 - DNA, 22 bp, Homo sapiens
gggcttggcacatgggctcagc

SEQ ID NO: 8363929 - DNA, 22 bp, Homo sapiens
gggctgcctttcttctgggagc

SEQ ID NO: 8363930 - DNA, 22 bp, Homo sapiens
gggctgagggccaattcctact

SEQ ID NO: 8363931 - DNA, 22 bp, Homo sapiens
gggcatggccaggtgaggggtc

SEQ ID NO: 8363932 - DNA, 22 bp, Homo sapiens
gggcatggtggcaggcacctgt

SEQ ID NO: 8363933 - DNA, 22 bp, Homo sapiens
gggccaaggggagctggaaggg

SEQ ID NO: 8363934 - DNA, 22 bp, Homo sapiens
gggccaagggtgcgtggcagga

SEQ ID NO: 8363935 - DNA, 22 bp, Homo sapiens
gggctgagccatttgaaccttg

SEQ ID NO: 8363936 - DNA, 22 bp, Homo sapiens
gggctgagctaagctgggttga

SEQ ID NO: 8363937 - DNA, 22 bp, Homo sapiens
gggctgagagctggaatctgag

SEQ ID NO: 8363938 - DNA, 22 bp, Homo sapiens
ggggtggggttactcattgtgc

SEQ ID NO: 8363939 - DNA, 22 bp, Homo sapiens
ggggtgtggacggctgtgccag

SEQ ID NO: 8363940 - DNA, 22 bp, Homo sapiens
ggggtgggcgtgcagggacacc

SEQ ID NO: 8363941 - DNA, 22 bp, Homo sapiens
ggggtgggcgtgcagggacacc

SEQ ID NO: 8363942 - DNA, 22 bp, Homo sapiens
ggggctggtggtggtttctcca

SEQ ID NO: 8363943 - DNA, 22 bp, Homo sapiens
gggtggagtagaaagatgaatt

SEQ ID NO: 8363944 - DNA, 20 bp, Homo sapiens
ggggctgcatgcagagaaga

SEQ ID NO: 8363945 - DNA, 22 bp, Homo sapiens
ggggctcatgctgtttggtctt

SEQ ID NO: 8363946 - DNA, 22 bp, Homo sapiens
ggggctcagttcggacagcctg

SEQ ID NO: 8363947 - DNA, 22 bp, Homo sapiens
ggggctcaggggaagtgtccag

SEQ ID NO: 8363948 - DNA, 22 bp, Homo sapiens
ggggctctgctctgagccgtgt

SEQ ID NO: 8363949 - DNA, 22 bp, Homo sapiens
ggggctcacacctccctaaggg

SEQ ID NO: 8363950 - DNA, 22 bp, Homo sapiens
ggggcctccagcactaggcagc

SEQ ID NO: 8363951 - DNA, 22 bp, Homo sapiens
ggggaaggatatgattagacta

SEQ ID NO: 8363952 - DNA, 22 bp, Homo sapiens
ggggaaggatatgattagacta

SEQ ID NO: 8363953 - DNA, 22 bp, Homo sapiens
ggggaaggaaagttattagcag

SEQ ID NO: 8363954 - DNA, 22 bp, Homo sapiens
ggggaaggaaagttattagcag

SEQ ID NO: 8363955 - DNA, 22 bp, Homo sapiens
ggggaagatggccctccatgtg

SEQ ID NO: 8363956 - DNA, 22 bp, Homo sapiens
ggggaagatggccctccatgtg

SEQ ID NO: 8363957 - DNA, 22 bp, Homo sapiens
gggtggcatctctctgagctgt

SEQ ID NO: 8363958 - DNA, 22 bp, Homo sapiens
gggtggcatagggtgatggctt

SEQ ID NO: 8363959 - DNA, 22 bp, Homo sapiens
gggtggctaggtatcccccatt

SEQ ID NO: 8363960 - DNA, 22 bp, Homo sapiens
gggtggcaaaggcgctgaaagg

SEQ ID NO: 8363961 - DNA, 22 bp, Homo sapiens
gggtggcacaggtgcagagggt

SEQ ID NO: 8363962 - DNA, 22 bp, Homo sapiens
gggtggcacaggtgcagagggt

SEQ ID NO: 8363963 - DNA, 22 bp, Homo sapiens
gggtggcaggattggcaggagt

SEQ ID NO: 8363964 - DNA, 23 bp, Homo sapiens
ggtcactggcaagcagtgcagag

SEQ ID NO: 8363965 - DNA, 22 bp, Homo sapiens
ggtcagagggtgggctgcctgt

SEQ ID NO: 8363966 - DNA, 22 bp, Homo sapiens
ggtcagaggggattccttggga

SEQ ID NO: 8363967 - DNA, 22 bp, Homo sapiens
ggtcagagccgttagcattcag

SEQ ID NO: 8363968 - DNA, 22 bp, Homo sapiens
ggtctcagcagttgctttgact

SEQ ID NO: 8363969 - DNA, 22 bp, Homo sapiens
ggtctcagccctcgccagcagc

SEQ ID NO: 8363970 - DNA, 22 bp, Homo sapiens
ggtctcagaggtttctgctcag

SEQ ID NO: 8363971 - DNA, 22 bp, Homo sapiens
ggtctcagatctttattaaggc

SEQ ID NO: 8363972 - DNA, 22 bp, Homo sapiens
ggtctcagctggagtccttggt

SEQ ID NO: 8363973 - DNA, 22 bp, Homo sapiens
ggtctcaggagactggagagca

SEQ ID NO: 8363974 - DNA, 22 bp, Homo sapiens
ggtctcaggtagggcctaggaa

SEQ ID NO: 8363975 - DNA, 19 bp, Homo sapiens
ggtctcagtgcagctgcag

SEQ ID NO: 8363976 - DNA, 22 bp, Homo sapiens
ggtctcagtgaaggagtgtgct

SEQ ID NO: 8363977 - DNA, 22 bp, Homo sapiens
ggtctctgttgcctccatcaag

SEQ ID NO: 8363978 - DNA, 20 bp, Homo sapiens
ggtctctgacagctggttgc

SEQ ID NO: 8363979 - DNA, 22 bp, Homo sapiens
ggtctctgaacttccactgcgc

SEQ ID NO: 8363980 - DNA, 22 bp, Homo sapiens
ggtctccattccttcatctcac

SEQ ID NO: 8363981 - DNA, 22 bp, Homo sapiens
ggtctcagactggcaggcagtg

SEQ ID NO: 8363982 - DNA, 22 bp, Homo sapiens
ggtcgctgtgtaggttcagcta

SEQ ID NO: 8363983 - DNA, 22 bp, Homo sapiens
ggtcagcagtgcagggcagagc

SEQ ID NO: 8363984 - DNA, 22 bp, Homo sapiens
ggtcagcaggtccagccagtgc

SEQ ID NO: 8363985 - DNA, 18 bp, Homo sapiens
ggtcctgggcctggctca

SEQ ID NO: 8363986 - DNA, 22 bp, Homo sapiens
ggtggctcagtgtcaggccctg

SEQ ID NO: 8363987 - DNA, 22 bp, Homo sapiens
ggtggctcatttgatcttcata

SEQ ID NO: 8363988 - DNA, 22 bp, Homo sapiens
ggtggctcccacccagctttga

SEQ ID NO: 8363989 - DNA, 22 bp, Homo sapiens
ggtggctcagggctccaagcat

SEQ ID NO: 8363990 - DNA, 19 bp, Homo sapiens
ggtggctcagggcccagcc

SEQ ID NO: 8363991 - DNA, 18 bp, Homo sapiens
ggtggctcagtcatgggg

SEQ ID NO: 8363992 - DNA, 18 bp, Homo sapiens
ggtggcggggatggaggt

SEQ ID NO: 8363993 - DNA, 22 bp, Homo sapiens
ggtggctcacgcctgtaagccc

SEQ ID NO: 8363994 - DNA, 21 bp, Homo sapiens
ggtggctcacctgattggata

SEQ ID NO: 8363995 - DNA, 22 bp, Homo sapiens
ggtggctcaaagagagcacaga

SEQ ID NO: 8363996 - DNA, 22 bp, Homo sapiens
ggtggcctccagggcataggtg

SEQ ID NO: 8363997 - DNA, 22 bp, Homo sapiens
ggtggcctcggtggtgcacagg

SEQ ID NO: 8363998 - DNA, 22 bp, Homo sapiens
ggtggctctcttaagggcagcg

SEQ ID NO: 8363999 - DNA, 22 bp, Homo sapiens
ggtggctctccctggactcagc

SEQ ID NO: 8364000 - DNA, 22 bp, Homo sapiens
ggtggctctctgtcagtgacag

SEQ ID NO: 8364001 - DNA, 22 bp, Homo sapiens
ggtggctccgcttccatgggct

SEQ ID NO: 8364002 - DNA, 17 bp, Homo sapiens
ggtggctcgggcgcggc

SEQ ID NO: 8364003 - DNA, 22 bp, Homo sapiens
ggtggctcgtttttcttgaaag

SEQ ID NO: 8364004 - DNA, 22 bp, Homo sapiens
ggtggctcgtttttcttgaaag

SEQ ID NO: 8364005 - DNA, 22 bp, Homo sapiens
ggtggctcggccagtgcaggcc

SEQ ID NO: 8364006 - DNA, 19 bp, Homo sapiens
ggtggctctccctcaggga

SEQ ID NO: 8364007 - DNA, 19 bp, Homo sapiens
ggtggctctccctcaggga

SEQ ID NO: 8364008 - DNA, 22 bp, Homo sapiens
ggtggctctcaggcttctcgga

SEQ ID NO: 8364009 - DNA, 22 bp, Homo sapiens
ggtgtgtgaggagtcacttagt

SEQ ID NO: 8364010 - DNA, 22 bp, Homo sapiens
ggtgtgtagcatgtttaagacc

SEQ ID NO: 8364011 - DNA, 22 bp, Homo sapiens
ggtgtgtggtcctctcacttag

SEQ ID NO: 8364012 - DNA, 20 bp, Homo sapiens
ggtgtgttggttcagcatgg

SEQ ID NO: 8364013 - DNA, 22 bp, Homo sapiens
ggtttattaatgtgaactgtat

SEQ ID NO: 8364014 - DNA, 22 bp, Homo sapiens
ggtttattgaaggccaccccac

SEQ ID NO: 8364015 - DNA, 22 bp, Homo sapiens
ggtttattgttaataagtttga

SEQ ID NO: 8364016 - DNA, 22 bp, Homo sapiens
ggtgttgtacattctgtggatt

SEQ ID NO: 8364017 - DNA, 22 bp, Homo sapiens
ggtgttaacttgtttatgacaa

SEQ ID NO: 8364018 - DNA, 22 bp, Homo sapiens
ggtgttcttagtggcactggca

SEQ ID NO: 8364019 - DNA, 22 bp, Homo sapiens
ggtgttgcagttgaagactggt

SEQ ID NO: 8364020 - DNA, 22 bp, Homo sapiens
gtacatttctcccaacactaaa

SEQ ID NO: 8364021 - DNA, 22 bp, Homo sapiens
gtacatttctcccaacactaaa

SEQ ID NO: 8364022 - DNA, 22 bp, Homo sapiens
gtacatttctcttgttcttatt

SEQ ID NO: 8364023 - DNA, 22 bp, Homo sapiens
gtacattttactttgtttgaat

SEQ ID NO: 8364024 - DNA, 22 bp, Homo sapiens
gtacatttctcttgttcttatt

SEQ ID NO: 8364025 - DNA, 22 bp, Homo sapiens
gtacattttgaggttaaaacaa

SEQ ID NO: 8364026 - DNA, 22 bp, Homo sapiens
gtacattttgaggttaaaacaa

SEQ ID NO: 8364027 - DNA, 22 bp, Homo sapiens
gtacattttgaggttaaaacaa

SEQ ID NO: 8364028 - DNA, 20 bp, Homo sapiens
gtacattttcaggaggggat

SEQ ID NO: 8364029 - DNA, 23 bp, Homo sapiens
gtaaaatacgcagtgcagtgtga

SEQ ID NO: 8364030 - DNA, 22 bp, Homo sapiens
gtacatttaggattcattgaaa

SEQ ID NO: 8364031 - DNA, 22 bp, Homo sapiens
gtaaaactgtctaatggtatat

SEQ ID NO: 8364032 - DNA, 22 bp, Homo sapiens
gtacatttcatttaaatgatgt

SEQ ID NO: 8364033 - DNA, 22 bp, Homo sapiens
gtacatttcatttaaatgatgt

SEQ ID NO: 8364034 - DNA, 22 bp, Homo sapiens
gtacatttatttttgcagcata

SEQ ID NO: 8364035 - DNA, 22 bp, Homo sapiens
gtacatttcagtttccttaaga

SEQ ID NO: 8364036 - DNA, 22 bp, Homo sapiens
ggttttatagcagtactatcag

SEQ ID NO: 8364037 - DNA, 22 bp, Homo sapiens
gtaaaaaggccaagcccttgtg

SEQ ID NO: 8364038 - DNA, 22 bp, Homo sapiens
gtaaaacaagctttatggttcc

SEQ ID NO: 8364039 - DNA, 22 bp, Homo sapiens
gtatttataggggaatgagagt

SEQ ID NO: 8364040 - DNA, 22 bp, Homo sapiens
gtattattgtcatgaaataata

SEQ ID NO: 8364041 - DNA, 22 bp, Homo sapiens
gtattattaagtgtatttgacc

SEQ ID NO: 8364042 - DNA, 22 bp, Homo sapiens
gtagacaagcacaggactcaga

SEQ ID NO: 8364043 - DNA, 22 bp, Homo sapiens
gtagacaagcacaggactcaga

SEQ ID NO: 8364044 - DNA, 22 bp, Homo sapiens
gtagaatatatggttagtattg

SEQ ID NO: 8364045 - DNA, 22 bp, Homo sapiens
gtagaaatgtaaccaggagata

SEQ ID NO: 8364046 - DNA, 21 bp, Homo sapiens
gtccacaggggtttgtcctgg

SEQ ID NO: 8364047 - DNA, 22 bp, Homo sapiens
gtccacagggatggccacacat

SEQ ID NO: 8364048 - DNA, 22 bp, Homo sapiens
gtccacagagggctgggcaggc

SEQ ID NO: 8364049 - DNA, 18 bp, Homo sapiens
gtccacagccctcacagc

SEQ ID NO: 8364050 - DNA, 22 bp, Homo sapiens
gtccacagctctgaggtctccc

SEQ ID NO: 8364051 - DNA, 22 bp, Homo sapiens
gtccccagaaaggtgaggcagg

SEQ ID NO: 8364052 - DNA, 22 bp, Homo sapiens
gtccccagaaaggtgaggcagg

SEQ ID NO: 8364053 - DNA, 22 bp, Homo sapiens
gtccccagaaaggtgaggcagg

SEQ ID NO: 8364054 - DNA, 22 bp, Homo sapiens
gtccccagagctggtggtggtt

SEQ ID NO: 8364055 - DNA, 22 bp, Homo sapiens
gtccccagagctggtggtggtt

SEQ ID NO: 8364056 - DNA, 22 bp, Homo sapiens
gtccccagctaatctctttgcc

SEQ ID NO: 8364057 - DNA, 22 bp, Homo sapiens
gtatttcatcttgaaaaccagt

SEQ ID NO: 8364058 - DNA, 22 bp, Homo sapiens
gtcattttctagaattatttga

SEQ ID NO: 8364059 - DNA, 22 bp, Homo sapiens
gtcattttctagaattatttga

SEQ ID NO: 8364060 - DNA, 22 bp, Homo sapiens
gtcatttttgactttgaagtga

SEQ ID NO: 8364061 - DNA, 22 bp, Homo sapiens
gtcatttttttcgtaatagtgg

SEQ ID NO: 8364062 - DNA, 22 bp, Homo sapiens
gtccacaaaattactatcttac

SEQ ID NO: 8364063 - DNA, 22 bp, Homo sapiens
gtccacaacatcagactaactg

SEQ ID NO: 8364064 - DNA, 22 bp, Homo sapiens
gtccacaagcaggaagtgagcc

SEQ ID NO: 8364065 - DNA, 22 bp, Homo sapiens
gtcctgggaaggaagccaggga

SEQ ID NO: 8364066 - DNA, 22 bp, Homo sapiens
gtccctgcatcaccacgggact

SEQ ID NO: 8364067 - DNA, 22 bp, Homo sapiens
gtccctgccctcctgggactca

SEQ ID NO: 8364068 - DNA, 22 bp, Homo sapiens
gtcctgggaggggctggtcctg

SEQ ID NO: 8364069 - DNA, 22 bp, Homo sapiens
gtccccagctgtgacgagagcc

SEQ ID NO: 8364070 - DNA, 22 bp, Homo sapiens
gtccccagctgtgacgagagcc

SEQ ID NO: 8364071 - DNA, 22 bp, Homo sapiens
gtcccctcaaaattcatatgtt

SEQ ID NO: 8364072 - DNA, 22 bp, Homo sapiens
gtcccctcagccacccatgggg

SEQ ID NO: 8364073 - DNA, 22 bp, Homo sapiens
gtcccctcattttagagaaaga

SEQ ID NO: 8364074 - DNA, 22 bp, Homo sapiens
gtccctcagtagtgcacagtgg

SEQ ID NO: 8364075 - DNA, 22 bp, Homo sapiens
gtccctctgctctagagagcca

SEQ ID NO: 8364076 - DNA, 22 bp, Homo sapiens
gtccctctgtgtccctgcagtc

SEQ ID NO: 8364077 - DNA, 22 bp, Homo sapiens
gtccctgacacccgggtggagg

SEQ ID NO: 8364078 - DNA, 22 bp, Homo sapiens
gtctgctggtgcctggcctgcg

SEQ ID NO: 8364079 - DNA, 22 bp, Homo sapiens
gtctgctgtgccttggggaaaa

SEQ ID NO: 8364080 - DNA, 22 bp, Homo sapiens
gtctgctgcagtcgtggctcta

SEQ ID NO: 8364081 - DNA, 22 bp, Homo sapiens
gtctgctggtgcctggcctgcg

SEQ ID NO: 8364082 - DNA, 22 bp, Homo sapiens
gtctgctcatgctaccgcgggc

SEQ ID NO: 8364083 - DNA, 22 bp, Homo sapiens
gtctgctgcagagcatggcttt

SEQ ID NO: 8364084 - DNA, 22 bp, Homo sapiens
gtctgctgcagagcatggcttt

SEQ ID NO: 8364085 - DNA, 22 bp, Homo sapiens
gtctgcctctattgcctacctg

SEQ ID NO: 8364086 - DNA, 22 bp, Homo sapiens
gtctgcctggaggcagctgctg

SEQ ID NO: 8364087 - DNA, 22 bp, Homo sapiens
gtcctggggaatacagaagccg

SEQ ID NO: 8364088 - DNA, 22 bp, Homo sapiens
gtcctgggcggagggctgctgt

SEQ ID NO: 8364089 - DNA, 22 bp, Homo sapiens
gtgaacaaaatagcacatatta

SEQ ID NO: 8364090 - DNA, 22 bp, Homo sapiens
gtgaaagagatgcagcataatg

SEQ ID NO: 8364091 - DNA, 18 bp, Homo sapiens
gtgaaagagacagggcag

SEQ ID NO: 8364092 - DNA, 22 bp, Homo sapiens
gtgaaagacagcattaatggct

SEQ ID NO: 8364093 - DNA, 22 bp, Homo sapiens
gtgaaaataaggctggttcttg

SEQ ID NO: 8364094 - DNA, 22 bp, Homo sapiens
gtgaaacaccctccaatgcaca

SEQ ID NO: 8364095 - DNA, 22 bp, Homo sapiens
gtgaaacagaagctcctggaat

SEQ ID NO: 8364096 - DNA, 22 bp, Homo sapiens
gtgaccatttgacatatccttg

SEQ ID NO: 8364097 - DNA, 22 bp, Homo sapiens
gtgaccatcctggtaatgaatc

SEQ ID NO: 8364098 - DNA, 22 bp, Homo sapiens
gtgaccataatagattatgagt

SEQ ID NO: 8364099 - DNA, 22 bp, Homo sapiens
gtgaccatcagagaataacaaa

SEQ ID NO: 8364100 - DNA, 18 bp, Homo sapiens
gtgaagctttattgaatg

SEQ ID NO: 8364101 - DNA, 22 bp, Homo sapiens
gtgcaggtggatttgggctcaa

SEQ ID NO: 8364102 - DNA, 22 bp, Homo sapiens
gtgcaggtggctggtggcaccc

SEQ ID NO: 8364103 - DNA, 22 bp, Homo sapiens
gtgcaggtgttttggctgccag

SEQ ID NO: 8364104 - DNA, 22 bp, Homo sapiens
gtgcagtgaccctggagagctg

SEQ ID NO: 8364105 - DNA, 22 bp, Homo sapiens
gtgcagaggacgtggcggcctc

SEQ ID NO: 8364106 - DNA, 22 bp, Homo sapiens
gtgcagaggacgtggcggcctc

SEQ ID NO: 8364107 - DNA, 21 bp, Homo sapiens
gtgcagaggaatgtagggggc

SEQ ID NO: 8364108 - DNA, 22 bp, Homo sapiens
gtgcagagcaagggctgagggc

SEQ ID NO: 8364109 - DNA, 20 bp, Homo sapiens
gtgcagaggcagcctgtggg

SEQ ID NO: 8364110 - DNA, 22 bp, Homo sapiens
gtgcagattcccgggcctctcc

SEQ ID NO: 8364111 - DNA, 22 bp, Homo sapiens
gtgcagatcctgattgcagttc

SEQ ID NO: 8364112 - DNA, 22 bp, Homo sapiens
gtgcagagtgtctgtggactga

SEQ ID NO: 8364113 - DNA, 22 bp, Homo sapiens
gtgcagttgaagcatggggaga

SEQ ID NO: 8364114 - DNA, 22 bp, Homo sapiens
gtgctagggacaaagcagtgaa

SEQ ID NO: 8364115 - DNA, 22 bp, Homo sapiens
gtgctaggattacaggcatggg

SEQ ID NO: 8364116 - DNA, 22 bp, Homo sapiens
gtgccacagaccaccgtgctgg

SEQ ID NO: 8364117 - DNA, 22 bp, Homo sapiens
gtgagaagataagtattgcaaa

SEQ ID NO: 8364118 - DNA, 22 bp, Homo sapiens
gtgagactcgcctttgtgtagc

SEQ ID NO: 8364119 - DNA, 23 bp, Homo sapiens
gtgagcagcccactaggaatgcc

SEQ ID NO: 8364120 - DNA, 21 bp, Homo sapiens
gtgcacagtcctgcacacagg

SEQ ID NO: 8364121 - DNA, 22 bp, Homo sapiens
gtgcagagaggaccttggggag

SEQ ID NO: 8364122 - DNA, 22 bp, Homo sapiens
gtgcagagaaggagcagtagtt

SEQ ID NO: 8364123 - DNA, 22 bp, Homo sapiens
gtgcagacccacgtccagggcc

SEQ ID NO: 8364124 - DNA, 22 bp, Homo sapiens
ctttcagatagtctgagatata

SEQ ID NO: 8364125 - DNA, 22 bp, Homo sapiens
ctttcagggcaacacttctttt

SEQ ID NO: 8364126 - DNA, 22 bp, Homo sapiens
ctttcaggttctataggaagcc

SEQ ID NO: 8364127 - DNA, 22 bp, Homo sapiens
ctttcaggttctataggaagcc

SEQ ID NO: 8364128 - DNA, 22 bp, Homo sapiens
ctttcaggtcacataacgccaa

SEQ ID NO: 8364129 - DNA, 22 bp, Homo sapiens
ctttcagtcagttaactcagaa

SEQ ID NO: 8364130 - DNA, 22 bp, Homo sapiens
ctttcagtctttacaaggttgc

SEQ ID NO: 8364131 - DNA, 22 bp, Homo sapiens
ctttcacagccttcgttctgaa

SEQ ID NO: 8364132 - DNA, 22 bp, Homo sapiens
ctttcacagctgtgcttatgat

SEQ ID NO: 8364133 - DNA, 22 bp, Homo sapiens
ctttcacagcttgaaaagtatt

SEQ ID NO: 8364134 - DNA, 22 bp, Homo sapiens
gaaatcaaacccttttctgata

SEQ ID NO: 8364135 - DNA, 22 bp, Homo sapiens
gaaatcaaggctacattcaggt

SEQ ID NO: 8364136 - DNA, 22 bp, Homo sapiens
gaaatatttctcttgagcccct

SEQ ID NO: 8364137 - DNA, 22 bp, Homo sapiens
ctttccaactctagtgaaattt

SEQ ID NO: 8364138 - DNA, 22 bp, Homo sapiens
ctttcatttgataagaatgcca

SEQ ID NO: 8364139 - DNA, 22 bp, Homo sapiens
gaacagggttgggtgagagagg

SEQ ID NO: 8364140 - DNA, 22 bp, Homo sapiens
gaacagggagtacggcacattt

SEQ ID NO: 8364141 - DNA, 22 bp, Homo sapiens
gaacagcctcaataacatcctt

SEQ ID NO: 8364142 - DNA, 22 bp, Homo sapiens
gaacagccctgttaagtctgtt

SEQ ID NO: 8364143 - DNA, 22 bp, Homo sapiens
gaacatttgatgatgacattgg

SEQ ID NO: 8364144 - DNA, 22 bp, Homo sapiens
gaacatttggatttgtaaattt

SEQ ID NO: 8364145 - DNA, 22 bp, Homo sapiens
gaacatttggatttgtaaattt

SEQ ID NO: 8364146 - DNA, 22 bp, Homo sapiens
gaaatgattttagtttatcatg

SEQ ID NO: 8364147 - DNA, 22 bp, Homo sapiens
gaaatcattagcaaagatatgt

SEQ ID NO: 8364148 - DNA, 22 bp, Homo sapiens
gaagaggatgacaggagccggt

SEQ ID NO: 8364149 - DNA, 22 bp, Homo sapiens
gaagagctccaaaaacagtgag

SEQ ID NO: 8364150 - DNA, 22 bp, Homo sapiens
gaagagctgtcagaaaagctaa

SEQ ID NO: 8364151 - DNA, 22 bp, Homo sapiens
gaagagctgctcagaacatgat

SEQ ID NO: 8364152 - DNA, 22 bp, Homo sapiens
gaagagctgtagcctgctcttt

SEQ ID NO: 8364153 - DNA, 22 bp, Homo sapiens
gaagagcttagacagaatcaaa

SEQ ID NO: 8364154 - DNA, 22 bp, Homo sapiens
gaagagctgtgattcaggctta

SEQ ID NO: 8364155 - DNA, 22 bp, Homo sapiens
gaagagaaaggcaaggagtttt

SEQ ID NO: 8364156 - DNA, 22 bp, Homo sapiens
gaagagaaaggcaaggagtttt

SEQ ID NO: 8364157 - DNA, 22 bp, Homo sapiens
gaagagaagcatcaataggtaa

SEQ ID NO: 8364158 - DNA, 22 bp, Homo sapiens
gaagagaaaggcaaggagtttt

SEQ ID NO: 8364159 - DNA, 22 bp, Homo sapiens
gaagagaagcatcaataggtaa

SEQ ID NO: 8364160 - DNA, 22 bp, Homo sapiens
gaagagaagcatcaataggtaa

SEQ ID NO: 8364161 - DNA, 22 bp, Homo sapiens
gaagagaaggtgtaggccatcc

SEQ ID NO: 8364162 - DNA, 22 bp, Homo sapiens
gaagagaaggtgtaggccatcc

SEQ ID NO: 8364163 - DNA, 22 bp, Homo sapiens
gaagagctatgtccagggagca

SEQ ID NO: 8364164 - DNA, 22 bp, Homo sapiens
gaacatttggcatgagaatttg

SEQ ID NO: 8364165 - DNA, 20 bp, Homo sapiens
gaacatttggccatactgag

SEQ ID NO: 8364166 - DNA, 20 bp, Homo sapiens
gaacatttggccatactgag

SEQ ID NO: 8364167 - DNA, 22 bp, Homo sapiens
gaaccacacagtgcagtcagga

SEQ ID NO: 8364168 - DNA, 22 bp, Homo sapiens
gaaccatttctgaatagtttgt

SEQ ID NO: 8364169 - DNA, 22 bp, Homo sapiens
gaaccattgttgaaaagaatag

SEQ ID NO: 8364170 - DNA, 22 bp, Homo sapiens
gaaccagcagttgcctgaaaaa

SEQ ID NO: 8364171 - DNA, 22 bp, Homo sapiens
gaaccagcagttgcctgaaaaa

SEQ ID NO: 8364172 - DNA, 22 bp, Homo sapiens
gaagacatcatggagaggatag

SEQ ID NO: 8364173 - DNA, 22 bp, Homo sapiens
gaagacatcgtgtggactaaca

SEQ ID NO: 8364174 - DNA, 22 bp, Homo sapiens
gaagacagaaacctgtttggct

SEQ ID NO: 8364175 - DNA, 22 bp, Homo sapiens
gaagccagcagtggagaaagga

SEQ ID NO: 8364176 - DNA, 22 bp, Homo sapiens
gaagccagcagtggagaaagga

SEQ ID NO: 8364177 - DNA, 22 bp, Homo sapiens
gaagattttctcctttaaatga

SEQ ID NO: 8364178 - DNA, 22 bp, Homo sapiens
gaagatttttcttaatgctccg

SEQ ID NO: 8364179 - DNA, 22 bp, Homo sapiens
gaagccaggggcctgacaggca

SEQ ID NO: 8364180 - DNA, 22 bp, Homo sapiens
gaagcccagcaaactgtgatca

SEQ ID NO: 8364181 - DNA, 22 bp, Homo sapiens
gaagcccaagcttcacagctat

SEQ ID NO: 8364182 - DNA, 22 bp, Homo sapiens
gaagccccaaaccctcgccatc

SEQ ID NO: 8364183 - DNA, 22 bp, Homo sapiens
gaagccccatggatatatgtga

SEQ ID NO: 8364184 - DNA, 22 bp, Homo sapiens
gaagaggctttcctagggcaag

SEQ ID NO: 8364185 - DNA, 22 bp, Homo sapiens
gaagaggtagcattggcaggtg

SEQ ID NO: 8364186 - DNA, 22 bp, Homo sapiens
gaagatgttatggagagctcag

SEQ ID NO: 8364187 - DNA, 22 bp, Homo sapiens
gaccctgtggctctgtggcaga

SEQ ID NO: 8364188 - DNA, 22 bp, Homo sapiens
gaccctggtgggcactggcacc

SEQ ID NO: 8364189 - DNA, 22 bp, Homo sapiens
gaccctggctggagctggcctg

SEQ ID NO: 8364190 - DNA, 22 bp, Homo sapiens
gacctcagattttcccaggcca

SEQ ID NO: 8364191 - DNA, 22 bp, Homo sapiens
gacagtagtccttgctattcat

SEQ ID NO: 8364192 - DNA, 22 bp, Homo sapiens
gacaggttgaagtatcaaaggt

SEQ ID NO: 8364193 - DNA, 22 bp, Homo sapiens
gacaggtaaagatggtggcagg

SEQ ID NO: 8364194 - DNA, 22 bp, Homo sapiens
gacacagaaggtcacatgttca

SEQ ID NO: 8364195 - DNA, 22 bp, Homo sapiens
gacaataaaatgatcttacagt

SEQ ID NO: 8364196 - DNA, 22 bp, Homo sapiens
gacacagaatgggtgctcagta

SEQ ID NO: 8364197 - DNA, 22 bp, Homo sapiens
gacaagctcttgtttcatggtt

SEQ ID NO: 8364198 - DNA, 22 bp, Homo sapiens
gacaaggcgcccagcctgccaa

SEQ ID NO: 8364199 - DNA, 22 bp, Homo sapiens
gacaaggcagaaagcttaaagg

SEQ ID NO: 8364200 - DNA, 22 bp, Homo sapiens
gacaagtcatctggggcctgtg

SEQ ID NO: 8364201 - DNA, 22 bp, Homo sapiens
gacacagacagttagaggtaat

SEQ ID NO: 8364202 - DNA, 22 bp, Homo sapiens
gacacagagacttgcagttgta

SEQ ID NO: 8364203 - DNA, 22 bp, Homo sapiens
gacaggccccctcaggactgat

SEQ ID NO: 8364204 - DNA, 21 bp, Homo sapiens
gacaggggaagaagcaaggag

SEQ ID NO: 8364205 - DNA, 22 bp, Homo sapiens
gacagggctgtgggaggagcag

SEQ ID NO: 8364206 - DNA, 19 bp, Homo sapiens
gaatacagataataagcag

SEQ ID NO: 8364207 - DNA, 19 bp, Homo sapiens
gaatacagataataagcag

SEQ ID NO: 8364208 - DNA, 22 bp, Homo sapiens
gaatacatatcagatgtgtttc

SEQ ID NO: 8364209 - DNA, 22 bp, Homo sapiens
gaatacaggcaggtggctgtgc

SEQ ID NO: 8364210 - DNA, 23 bp, Homo sapiens
gaatacagagataaatagaacac

SEQ ID NO: 8364211 - DNA, 22 bp, Homo sapiens
gaatacacgaatagagcatggt

SEQ ID NO: 8364212 - DNA, 23 bp, Homo sapiens
gaatacagagataaatagaacac

SEQ ID NO: 8364213 - DNA, 22 bp, Homo sapiens
gaaggaaaacagatctgcctga

SEQ ID NO: 8364214 - DNA, 22 bp, Homo sapiens
gaaggaaaacagatctgcctga

SEQ ID NO: 8364215 - DNA, 22 bp, Homo sapiens
gaaggaaaaatactctgtaagg

SEQ ID NO: 8364216 - DNA, 22 bp, Homo sapiens
gaaggaaaaatactctgtaagg

SEQ ID NO: 8364217 - DNA, 22 bp, Homo sapiens
gaaggaaaaatactctgtaagg

SEQ ID NO: 8364218 - DNA, 22 bp, Homo sapiens
gaagcctcaacatctctgcgtc

SEQ ID NO: 8364219 - DNA, 22 bp, Homo sapiens
gaagctgtgtgaagctctgaag

SEQ ID NO: 8364220 - DNA, 22 bp, Homo sapiens
gaagctgtgttgatggcatgga

SEQ ID NO: 8364221 - DNA, 22 bp, Homo sapiens
gaagctttgagagcagaagccc

SEQ ID NO: 8364222 - DNA, 22 bp, Homo sapiens
gaaggaaaggtctcatgccttt

SEQ ID NO: 8364223 - DNA, 22 bp, Homo sapiens
gaaggaaatctgtgatttatgc

SEQ ID NO: 8364224 - DNA, 22 bp, Homo sapiens
gacaagcaggctcctgaagaaa

SEQ ID NO: 8364225 - DNA, 22 bp, Homo sapiens
gaatatcccgctatgcaaagta

SEQ ID NO: 8364226 - DNA, 18 bp, Homo sapiens
gaatatctagcacatagt

SEQ ID NO: 8364227 - DNA, 18 bp, Homo sapiens
gaatactgagagcacaaa

SEQ ID NO: 8364228 - DNA, 22 bp, Homo sapiens
gaatactgatgctcagccccct

SEQ ID NO: 8364229 - DNA, 22 bp, Homo sapiens
gaatacttgggtctggagtcaa

SEQ ID NO: 8364230 - DNA, 22 bp, Homo sapiens
gaatactggaaaactcatttta

SEQ ID NO: 8364231 - DNA, 22 bp, Homo sapiens
gaatacattggaaatcagaata

SEQ ID NO: 8364232 - DNA, 22 bp, Homo sapiens
gaatactgacactcaggtggga

SEQ ID NO: 8364233 - DNA, 22 bp, Homo sapiens
gaatacatgtgtgtatagaggt

SEQ ID NO: 8364234 - DNA, 22 bp, Homo sapiens
gaatacttttgttaggaaaacg

SEQ ID NO: 8364235 - DNA, 22 bp, Homo sapiens
gaatagcttagattccttagtg

SEQ ID NO: 8364236 - DNA, 22 bp, Homo sapiens
gaatagcttccttttttccaaa

SEQ ID NO: 8364237 - DNA, 22 bp, Homo sapiens
gagcttcagctgccatgactgt

SEQ ID NO: 8364238 - DNA, 22 bp, Homo sapiens
gagcttaaaacatagccagact

SEQ ID NO: 8364239 - DNA, 21 bp, Homo sapiens
gagctgttactctctctggag

SEQ ID NO: 8364240 - DNA, 22 bp, Homo sapiens
gagctgaacatcatggaaaggc

SEQ ID NO: 8364241 - DNA, 22 bp, Homo sapiens
gagctgaagcgctacagcatcc

SEQ ID NO: 8364242 - DNA, 22 bp, Homo sapiens
gagctgaattacggtgagtcat

SEQ ID NO: 8364243 - DNA, 22 bp, Homo sapiens
gagctgaaggagaaagcagggg

SEQ ID NO: 8364244 - DNA, 22 bp, Homo sapiens
gagctgaatcagagatattatt

SEQ ID NO: 8364245 - DNA, 18 bp, Homo sapiens
gagctgagaagaggatgc

SEQ ID NO: 8364246 - DNA, 19 bp, Homo sapiens
gagctgagagtagcactgg

SEQ ID NO: 8364247 - DNA, 22 bp, Homo sapiens
gagctgtgttcatgaggagaaa

SEQ ID NO: 8364248 - DNA, 22 bp, Homo sapiens
gagctatttgaatgtatatgtt

SEQ ID NO: 8364249 - DNA, 22 bp, Homo sapiens
gagctcttatagttctagcagt

SEQ ID NO: 8364250 - DNA, 22 bp, Homo sapiens
gagctctgttctcgtcctgctg

SEQ ID NO: 8364251 - DNA, 22 bp, Homo sapiens
gagctacaggcagctgagccct

SEQ ID NO: 8364252 - DNA, 22 bp, Homo sapiens
gagctacactgattcatttgtt

SEQ ID NO: 8364253 - DNA, 22 bp, Homo sapiens
gagctacagagtttggtgttca

SEQ ID NO: 8364254 - DNA, 22 bp, Homo sapiens
gagctaagctatgttatgcagc

SEQ ID NO: 8364255 - DNA, 22 bp, Homo sapiens
gagctacaagggagactttttt

SEQ ID NO: 8364256 - DNA, 20 bp, Homo sapiens
gagctacacaaatgctgctt

SEQ ID NO: 8364257 - DNA, 22 bp, Homo sapiens
gagctagtagaacaagtgagga

SEQ ID NO: 8364258 - DNA, 22 bp, Homo sapiens
gagctacaagggagactttttt

SEQ ID NO: 8364259 - DNA, 22 bp, Homo sapiens
gagccaggtttgaatctcagtc

SEQ ID NO: 8364260 - DNA, 22 bp, Homo sapiens
gagccctgttcaggcctcctca

SEQ ID NO: 8364261 - DNA, 22 bp, Homo sapiens
gagcctggattgaagtgggtgg

SEQ ID NO: 8364262 - DNA, 22 bp, Homo sapiens
gagcctggagctggaacgaagc

SEQ ID NO: 8364263 - DNA, 22 bp, Homo sapiens
gaggcagaggaaggtggtctct

SEQ ID NO: 8364264 - DNA, 22 bp, Homo sapiens
gaggcagaagttgcagtgagca

SEQ ID NO: 8364265 - DNA, 22 bp, Homo sapiens
gaggcagaagttgcagtgagca

SEQ ID NO: 8364266 - DNA, 22 bp, Homo sapiens
gaggcagagaccttcaggacct

SEQ ID NO: 8364267 - DNA, 22 bp, Homo sapiens
gaggcagagactccaccttcag

SEQ ID NO: 8364268 - DNA, 22 bp, Homo sapiens
gaggcagagaccttcaggacct

SEQ ID NO: 8364269 - DNA, 22 bp, Homo sapiens
gaggcagagaccttcaggacct

SEQ ID NO: 8364270 - DNA, 22 bp, Homo sapiens
gaggcacatcacttggtgcatt

SEQ ID NO: 8364271 - DNA, 22 bp, Homo sapiens
gaggcaccagacatggcctcat

SEQ ID NO: 8364272 - DNA, 22 bp, Homo sapiens
gaggcactgaatacttgagggt

SEQ ID NO: 8364273 - DNA, 23 bp, Homo sapiens
gaggcactcaggaaatgtgagtg

SEQ ID NO: 8364274 - DNA, 22 bp, Homo sapiens
gaggaaaatattcagggaggtt

SEQ ID NO: 8364275 - DNA, 22 bp, Homo sapiens
gaggaaaataacaactaagggc

SEQ ID NO: 8364276 - DNA, 22 bp, Homo sapiens
gaggaaaataacaactaagggc

SEQ ID NO: 8364277 - DNA, 22 bp, Homo sapiens
gaggaaaatattcagggaggtt

SEQ ID NO: 8364278 - DNA, 22 bp, Homo sapiens
gaggaaaagagacaggttattg

SEQ ID NO: 8364279 - DNA, 22 bp, Homo sapiens
gaggaaaagagacaggttattg

SEQ ID NO: 8364280 - DNA, 22 bp, Homo sapiens
gaggaaaataacaactaagggc

SEQ ID NO: 8364281 - DNA, 22 bp, Homo sapiens
gaggaaaataacaactaagggc

SEQ ID NO: 8364282 - DNA, 22 bp, Homo sapiens
gaggagcttgaggctaggagcc

SEQ ID NO: 8364283 - DNA, 22 bp, Homo sapiens
gaggaggcactagttagtgaca

SEQ ID NO: 8364284 - DNA, 22 bp, Homo sapiens
gaggaggaggaagtggaaccca

SEQ ID NO: 8364285 - DNA, 22 bp, Homo sapiens
gaggaggaagttctctgtaggc

SEQ ID NO: 8364286 - DNA, 22 bp, Homo sapiens
gaggaggaaaggagttgaaatg

SEQ ID NO: 8364287 - DNA, 22 bp, Homo sapiens
gaggaggaaaccctgttcctct

SEQ ID NO: 8364288 - DNA, 19 bp, Homo sapiens
gaggaggaaaactagtgta

SEQ ID NO: 8364289 - DNA, 22 bp, Homo sapiens
gaggaggccagtggaaggaagc

SEQ ID NO: 8364290 - DNA, 22 bp, Homo sapiens
gaggaggccagtggaaggaagc

SEQ ID NO: 8364291 - DNA, 22 bp, Homo sapiens
gaggaggctaagtgggctctgg

SEQ ID NO: 8364292 - DNA, 22 bp, Homo sapiens
gagaagggatatgccactctcg

SEQ ID NO: 8364293 - DNA, 22 bp, Homo sapiens
gagaagggatatggcttcttga

SEQ ID NO: 8364294 - DNA, 22 bp, Homo sapiens
gagaagggcttgggagtcaaca

SEQ ID NO: 8364295 - DNA, 22 bp, Homo sapiens
gagaaggccaggaacccagtgt

SEQ ID NO: 8364296 - DNA, 22 bp, Homo sapiens
gagaaggcttcttttcctctga

SEQ ID NO: 8364297 - DNA, 22 bp, Homo sapiens
gagaaggcttcttttcctctga

SEQ ID NO: 8364298 - DNA, 22 bp, Homo sapiens
gagaattagggcgtaattcaga

SEQ ID NO: 8364299 - DNA, 22 bp, Homo sapiens
gacctctcaggaatctcacatg

SEQ ID NO: 8364300 - DNA, 22 bp, Homo sapiens
gacctccgtgtacacctcccag

SEQ ID NO: 8364301 - DNA, 22 bp, Homo sapiens
gacctcatgatccacctgcctt

SEQ ID NO: 8364302 - DNA, 22 bp, Homo sapiens
gacctccagcggccctgcagag

SEQ ID NO: 8364303 - DNA, 22 bp, Homo sapiens
gacctcaggtttgtaatggaca

SEQ ID NO: 8364304 - DNA, 22 bp, Homo sapiens
gacctctgggtgatgcccaggc

SEQ ID NO: 8364305 - DNA, 22 bp, Homo sapiens
gacctctgggtgatgcccaggc

SEQ ID NO: 8364306 - DNA, 22 bp, Homo sapiens
gacctctgttggacccctgggg

SEQ ID NO: 8364307 - DNA, 22 bp, Homo sapiens
gacctgaaagagattaaatgac

SEQ ID NO: 8364308 - DNA, 22 bp, Homo sapiens
gacctgaaagtgtgggcgacct

SEQ ID NO: 8364309 - DNA, 22 bp, Homo sapiens
gagaaggactacggaaaacaga

SEQ ID NO: 8364310 - DNA, 22 bp, Homo sapiens
gacctgaaatttgtggtagaac

SEQ ID NO: 8364311 - DNA, 22 bp, Homo sapiens
gacctgaaatgggggcctgtcc

SEQ ID NO: 8364312 - DNA, 22 bp, Homo sapiens
gagaaggatgaggaaatggtat

SEQ ID NO: 8364313 - DNA, 22 bp, Homo sapiens
gagaaggatgtggctcatagct

SEQ ID NO: 8364314 - DNA, 22 bp, Homo sapiens
gagaaggagctcaaatatggct

SEQ ID NO: 8364315 - DNA, 22 bp, Homo sapiens
gagatcggtaaagagcatgcac

SEQ ID NO: 8364316 - DNA, 22 bp, Homo sapiens
gagatgaagaggcccttggagt

SEQ ID NO: 8364317 - DNA, 22 bp, Homo sapiens
gagatgaatcattccatggtca

SEQ ID NO: 8364318 - DNA, 22 bp, Homo sapiens
gagatgaatgtaaacaaaggca

SEQ ID NO: 8364319 - DNA, 22 bp, Homo sapiens
gagaggcttaagggctgtgaag

SEQ ID NO: 8364320 - DNA, 22 bp, Homo sapiens
gagagggagccagccaggaacc

SEQ ID NO: 8364321 - DNA, 22 bp, Homo sapiens
gagaggcttaagggctgtgaag

SEQ ID NO: 8364322 - DNA, 22 bp, Homo sapiens
gagaggctgggttggagatcga

SEQ ID NO: 8364323 - DNA, 22 bp, Homo sapiens
gagaggctgggttggagatcga

SEQ ID NO: 8364324 - DNA, 22 bp, Homo sapiens
gagaggccctgtggtcccagct

SEQ ID NO: 8364325 - DNA, 21 bp, Homo sapiens
gagaggcctgggcccgtgagc

SEQ ID NO: 8364326 - DNA, 22 bp, Homo sapiens
gagaggcctgggcccgtgagct

SEQ ID NO: 8364327 - DNA, 22 bp, Homo sapiens
gagacacaaacacatttagagg

SEQ ID NO: 8364328 - DNA, 22 bp, Homo sapiens
gagacacaaacacatttagagg

SEQ ID NO: 8364329 - DNA, 22 bp, Homo sapiens
gagaggcatggaacagattctt

SEQ ID NO: 8364330 - DNA, 22 bp, Homo sapiens
gagaggcaggcgctgcaatggt

SEQ ID NO: 8364331 - DNA, 22 bp, Homo sapiens
gagaggccatggctgtgcagtg

SEQ ID NO: 8364332 - DNA, 22 bp, Homo sapiens
gagaggccacctgacgagcagt

SEQ ID NO: 8364333 - DNA, 22 bp, Homo sapiens
gagcagctgtggggttgaccat

SEQ ID NO: 8364334 - DNA, 22 bp, Homo sapiens
gagcagctgtccccaaagcttc

SEQ ID NO: 8364335 - DNA, 22 bp, Homo sapiens
gagcagctggtaggtgaaccca

SEQ ID NO: 8364336 - DNA, 22 bp, Homo sapiens
gagcagctggacaggcctccct

SEQ ID NO: 8364337 - DNA, 22 bp, Homo sapiens
gagcagctggctgtattggttt

SEQ ID NO: 8364338 - DNA, 22 bp, Homo sapiens
gagcagctgcagtgcagaccct

SEQ ID NO: 8364339 - DNA, 22 bp, Homo sapiens
gagcagccctagggcataagca

SEQ ID NO: 8364340 - DNA, 22 bp, Homo sapiens
gagccacagcaacctcaaagga

SEQ ID NO: 8364341 - DNA, 22 bp, Homo sapiens
gagccacagactgtatttggga

SEQ ID NO: 8364342 - DNA, 22 bp, Homo sapiens
gagccacagaaggaaattgggg

SEQ ID NO: 8364343 - DNA, 22 bp, Homo sapiens
gagccacagtggtggcccacgt

SEQ ID NO: 8364344 - DNA, 22 bp, Homo sapiens
gagccacagtggattgattcca

SEQ ID NO: 8364345 - DNA, 22 bp, Homo sapiens
gagccacagtggattgattcca

SEQ ID NO: 8364346 - DNA, 22 bp, Homo sapiens
gagccaagatcgcaccactgca

SEQ ID NO: 8364347 - DNA, 22 bp, Homo sapiens
gagcagcttatgtcaagccaga

SEQ ID NO: 8364348 - DNA, 22 bp, Homo sapiens
gagccaggggtcagctccgagg

SEQ ID NO: 8364349 - DNA, 22 bp, Homo sapiens
gagccaggggtcagctccgagg

SEQ ID NO: 8364350 - DNA, 22 bp, Homo sapiens
gagccaggttggaggctgcagt

SEQ ID NO: 8364351 - DNA, 22 bp, Homo sapiens
gagccaggtcgggccgcggcga

SEQ ID NO: 8364352 - DNA, 22 bp, Homo sapiens
gagccagcaggacttaagccag

SEQ ID NO: 8364353 - DNA, 22 bp, Homo sapiens
gagccagccgcaagagctgtga

SEQ ID NO: 8364354 - DNA, 22 bp, Homo sapiens
gagccagcagccggcaccacca

SEQ ID NO: 8364355 - DNA, 22 bp, Homo sapiens
gagatggagtctttttctgtca

SEQ ID NO: 8364356 - DNA, 22 bp, Homo sapiens
gagatggagtctttttctgtca

SEQ ID NO: 8364357 - DNA, 22 bp, Homo sapiens
gagatggagtctttttctgtca

SEQ ID NO: 8364358 - DNA, 22 bp, Homo sapiens
gagatggagtctttttctgtca

SEQ ID NO: 8364359 - DNA, 22 bp, Homo sapiens
gagatggagtctttttctgtca

SEQ ID NO: 8364360 - DNA, 20 bp, Homo sapiens
gagatggacagatgaagggg

SEQ ID NO: 8364361 - DNA, 22 bp, Homo sapiens
gagatgtttagatgtttgtcca

SEQ ID NO: 8364362 - DNA, 20 bp, Homo sapiens
gagattaactgagaatctag

SEQ ID NO: 8364363 - DNA, 22 bp, Homo sapiens
gagatgttaactacatagctac

SEQ ID NO: 8364364 - DNA, 22 bp, Homo sapiens
gagatgttgttcaaagatttta

SEQ ID NO: 8364365 - DNA, 22 bp, Homo sapiens
gagatgttgtgggtagttttgg

SEQ ID NO: 8364366 - DNA, 22 bp, Homo sapiens
gagatgttattcttcagtgtgt

SEQ ID NO: 8364367 - DNA, 22 bp, Homo sapiens
gagatgttctgattaggtttcc

SEQ ID NO: 8364368 - DNA, 22 bp, Homo sapiens
gagcagatctcaggccttctgt

SEQ ID NO: 8364369 - DNA, 22 bp, Homo sapiens
gagcagagtctatttccacact

SEQ ID NO: 8364370 - DNA, 22 bp, Homo sapiens
gagcagcacttgaggcatgtca

SEQ ID NO: 8364371 - DNA, 22 bp, Homo sapiens
gagcagcaaagggagggtaaat

SEQ ID NO: 8364372 - DNA, 22 bp, Homo sapiens
gagcagcaggtggctgtgatgg

SEQ ID NO: 8364373 - DNA, 22 bp, Homo sapiens
gagcagcaggtggggctggctt

SEQ ID NO: 8364374 - DNA, 22 bp, Homo sapiens
gagcagcaggtggggctggctt

SEQ ID NO: 8364375 - DNA, 22 bp, Homo sapiens
gagcagcagctgggccaggttc

SEQ ID NO: 8364376 - DNA, 22 bp, Homo sapiens
gagcagcagctgggccaggttc

SEQ ID NO: 8364377 - DNA, 22 bp, Homo sapiens
gagcagcagctgggccaggttc

SEQ ID NO: 8364378 - DNA, 18 bp, Homo sapiens
gagcagcaggatcaagaa

SEQ ID NO: 8364379 - DNA, 22 bp, Homo sapiens
gagcagcaggccaggttgcagg

SEQ ID NO: 8364380 - DNA, 22 bp, Homo sapiens
cttcagtatcctccacatgtta

SEQ ID NO: 8364381 - DNA, 22 bp, Homo sapiens
cttcagtgaatgttgagtaagg

SEQ ID NO: 8364382 - DNA, 22 bp, Homo sapiens
cttcagtgattgcagaaagcct

SEQ ID NO: 8364383 - DNA, 22 bp, Homo sapiens
cttcagtgcatgtttataatca

SEQ ID NO: 8364384 - DNA, 22 bp, Homo sapiens
cttcaggaaaatctctaaggat

SEQ ID NO: 8364385 - DNA, 22 bp, Homo sapiens
cttcaggagtagttacctagca

SEQ ID NO: 8364386 - DNA, 22 bp, Homo sapiens
cttcaggatttaggaagatgaa

SEQ ID NO: 8364387 - DNA, 22 bp, Homo sapiens
cttcctgagcaaggaactatag

SEQ ID NO: 8364388 - DNA, 22 bp, Homo sapiens
cttcctctgtgtcctgggcttc

SEQ ID NO: 8364389 - DNA, 22 bp, Homo sapiens
cttcctctgtgtcctgggcttg

SEQ ID NO: 8364390 - DNA, 22 bp, Homo sapiens
cttcagtgttcccatctgtaaa

SEQ ID NO: 8364391 - DNA, 22 bp, Homo sapiens
cttcagtgtcctctctagtaga

SEQ ID NO: 8364392 - DNA, 23 bp, Homo sapiens
cttcagtgtgggactgcagcgtg

SEQ ID NO: 8364393 - DNA, 22 bp, Homo sapiens
cttcagaagagttaagtgtgag

SEQ ID NO: 8364394 - DNA, 22 bp, Homo sapiens
cttcagaagcctgcagcctttg

SEQ ID NO: 8364395 - DNA, 22 bp, Homo sapiens
cttcagaaccagccagaagagg

SEQ ID NO: 8364396 - DNA, 22 bp, Homo sapiens
cttcagaactataaaaagtact

SEQ ID NO: 8364397 - DNA, 22 bp, Homo sapiens
cttattttgctgatgacccagg

SEQ ID NO: 8364398 - DNA, 22 bp, Homo sapiens
cttattttaagtcagtttgggt

SEQ ID NO: 8364399 - DNA, 22 bp, Homo sapiens
cttatttgcccatgtttcttta

SEQ ID NO: 8364400 - DNA, 22 bp, Homo sapiens
cttatttctccatccagagtca

SEQ ID NO: 8364401 - DNA, 22 bp, Homo sapiens
cttatatttgtcaactttacaa

SEQ ID NO: 8364402 - DNA, 22 bp, Homo sapiens
ctgttgtattattcaatattat

SEQ ID NO: 8364403 - DNA, 22 bp, Homo sapiens
ctgttgttcatcatctgtcatt

SEQ ID NO: 8364404 - DNA, 22 bp, Homo sapiens
cttgccagtgttgcagaagctc

SEQ ID NO: 8364405 - DNA, 22 bp, Homo sapiens
cttgccagcacttggccagctg

SEQ ID NO: 8364406 - DNA, 22 bp, Homo sapiens
cttgccagggactcagtcaggg

SEQ ID NO: 8364407 - DNA, 22 bp, Homo sapiens
cttgtagaattgaaatggtctc

SEQ ID NO: 8364408 - DNA, 22 bp, Homo sapiens
cttgtagaattgaaatggtctc

SEQ ID NO: 8364409 - DNA, 22 bp, Homo sapiens
cttgtcctttacttgagactca

SEQ ID NO: 8364410 - DNA, 22 bp, Homo sapiens
ctttatgtccaccagactgcaa

SEQ ID NO: 8364411 - DNA, 22 bp, Homo sapiens
cttgtctgggcagcttgggagt

SEQ ID NO: 8364412 - DNA, 21 bp, Homo sapiens
cttgtcttgcttagaatagac

SEQ ID NO: 8364413 - DNA, 22 bp, Homo sapiens
cttgtcagccaattgtggattt

SEQ ID NO: 8364414 - DNA, 22 bp, Homo sapiens
cttgtcactctggctccagagc

SEQ ID NO: 8364415 - DNA, 22 bp, Homo sapiens
cttgtattcagagtggacatga

SEQ ID NO: 8364416 - DNA, 22 bp, Homo sapiens
cttgacactgtcactcaggcca

SEQ ID NO: 8364417 - DNA, 19 bp, Homo sapiens
cttcctggaggagagcctc

SEQ ID NO: 8364418 - DNA, 22 bp, Homo sapiens
cttgatctacatagtgaaaccc

SEQ ID NO: 8364419 - DNA, 22 bp, Homo sapiens
cttgcacgtcagatcttcctca

SEQ ID NO: 8364420 - DNA, 20 bp, Homo sapiens
cttgcaggagtgggtagagt

SEQ ID NO: 8364421 - DNA, 23 bp, Homo sapiens
cttgcaggaagcagatggcacac

SEQ ID NO: 8364422 - DNA, 22 bp, Homo sapiens
cttgcagggctgatgggaagtg

SEQ ID NO: 8364423 - DNA, 23 bp, Homo sapiens
cttgcagggctggaggcttagaa

SEQ ID NO: 8364424 - DNA, 22 bp, Homo sapiens
cttgcaggcctttctagctcta

SEQ ID NO: 8364425 - DNA, 22 bp, Homo sapiens
cttgcaggctacatggaacctg

SEQ ID NO: 8364426 - DNA, 22 bp, Homo sapiens
cttgcaggcagggacactgtct

SEQ ID NO: 8364427 - DNA, 22 bp, Homo sapiens
cttgcaggattttgctgctgta

SEQ ID NO: 8364428 - DNA, 22 bp, Homo sapiens
cttgcaggcagggcctcctgga

SEQ ID NO: 8364429 - DNA, 22 bp, Homo sapiens
cttgcaggcccagccttacaag

SEQ ID NO: 8364430 - DNA, 19 bp, Homo sapiens
ctgtgccctatgacttgta

SEQ ID NO: 8364431 - DNA, 22 bp, Homo sapiens
ctgtggccagatggtgccagtt

SEQ ID NO: 8364432 - DNA, 22 bp, Homo sapiens
ctgtgagggtcacagccatgcc

SEQ ID NO: 8364433 - DNA, 22 bp, Homo sapiens
ctgtgcagtggggctctgggtt

SEQ ID NO: 8364434 - DNA, 22 bp, Homo sapiens
ctgtgcagtgtggggtaggcct

SEQ ID NO: 8364435 - DNA, 22 bp, Homo sapiens
ctgtgcattgtcttgtctgtag

SEQ ID NO: 8364436 - DNA, 22 bp, Homo sapiens
ctgtcctgatggtgccactggt

SEQ ID NO: 8364437 - DNA, 22 bp, Homo sapiens
ctgtcctgagataaagatgagg

SEQ ID NO: 8364438 - DNA, 22 bp, Homo sapiens
ctgtcctgaggcaggtggcctg

SEQ ID NO: 8364439 - DNA, 22 bp, Homo sapiens
ctgtcctggggaaagccagccc

SEQ ID NO: 8364440 - DNA, 22 bp, Homo sapiens
ctgtcctgggggtggtccttgc

SEQ ID NO: 8364441 - DNA, 22 bp, Homo sapiens
ctgggtgcgtgagcgcatgcgt

SEQ ID NO: 8364442 - DNA, 22 bp, Homo sapiens
ctgtccctgagcaactcctgtt

SEQ ID NO: 8364443 - DNA, 22 bp, Homo sapiens
ctgggtgctgtgggctcagagg

SEQ ID NO: 8364444 - DNA, 22 bp, Homo sapiens
ctgtcctctgtcctcagcagga

SEQ ID NO: 8364445 - DNA, 22 bp, Homo sapiens
ctgggtcttcagcagcaggcgg

SEQ ID NO: 8364446 - DNA, 22 bp, Homo sapiens
ctgggtctttttcttccattga

SEQ ID NO: 8364447 - DNA, 22 bp, Homo sapiens
ctgtggctctcagaggctgctg

SEQ ID NO: 8364448 - DNA, 22 bp, Homo sapiens
ctgtgtcctgtctcctaaggtg

SEQ ID NO: 8364449 - DNA, 22 bp, Homo sapiens
ctgtgtagtcaggtggtcccac

SEQ ID NO: 8364450 - DNA, 22 bp, Homo sapiens
ctgtggctggctcatcataggt

SEQ ID NO: 8364451 - DNA, 22 bp, Homo sapiens
ctgttattttcctctgaactct

SEQ ID NO: 8364452 - DNA, 22 bp, Homo sapiens
ctgttcagatggcacattcagt

SEQ ID NO: 8364453 - DNA, 22 bp, Homo sapiens
ctgttcatggaaaaatagttgg

SEQ ID NO: 8364454 - DNA, 22 bp, Homo sapiens
ctgttctgaactgcctgcatgc

SEQ ID NO: 8364455 - DNA, 22 bp, Homo sapiens
ctgttctgaactgcctgcatgc

SEQ ID NO: 8364456 - DNA, 22 bp, Homo sapiens
ctgttctgtaagctgctgttgt

SEQ ID NO: 8364457 - DNA, 22 bp, Homo sapiens
ctgttctgtctcatgttgcaca

SEQ ID NO: 8364458 - DNA, 22 bp, Homo sapiens
ctgttctgtaagctgctgttgt

SEQ ID NO: 8364459 - DNA, 22 bp, Homo sapiens
ctgttctgaccagtgcagggat

SEQ ID NO: 8364460 - DNA, 22 bp, Homo sapiens
ctgttctggagacactgatgaa

SEQ ID NO: 8364461 - DNA, 22 bp, Homo sapiens
ctgttctgctgcataaaaactt

SEQ ID NO: 8364462 - DNA, 22 bp, Homo sapiens
ctgttcttctgggaatggccct

SEQ ID NO: 8364463 - DNA, 22 bp, Homo sapiens
ctgttcttctagtccactgaca

SEQ ID NO: 8364464 - DNA, 22 bp, Homo sapiens
ctgttcttatcgtcttaatatc

SEQ ID NO: 8364465 - DNA, 22 bp, Homo sapiens
ctgttctttagttccactgcaa

SEQ ID NO: 8364466 - DNA, 22 bp, Homo sapiens
ctgttgctctgaacaggtcttg

SEQ ID NO: 8364467 - DNA, 22 bp, Homo sapiens
ctgttgctaagtagtgcaggta

SEQ ID NO: 8364468 - DNA, 18 bp, Homo sapiens
ctgttgagatgtggctga

SEQ ID NO: 8364469 - DNA, 22 bp, Homo sapiens
ctgtgtctcatccgcctctggc

SEQ ID NO: 8364470 - DNA, 22 bp, Homo sapiens
ctgttacaagagagagacatga

SEQ ID NO: 8364471 - DNA, 22 bp, Homo sapiens
ctgttacatagcttttcttaac

SEQ ID NO: 8364472 - DNA, 23 bp, Homo sapiens
ctgttaaattccttaagagcagg

SEQ ID NO: 8364473 - DNA, 22 bp, Homo sapiens
ctgttaatggaggactacagga

SEQ ID NO: 8364474 - DNA, 22 bp, Homo sapiens
ctgggcatggacagctgcacag

SEQ ID NO: 8364475 - DNA, 22 bp, Homo sapiens
ctgggcatgaaaaggatgccag

SEQ ID NO: 8364476 - DNA, 22 bp, Homo sapiens
ctgggccacaagcctgtgtgat

SEQ ID NO: 8364477 - DNA, 22 bp, Homo sapiens
ctgggccacatcagatgaagac

SEQ ID NO: 8364478 - DNA, 22 bp, Homo sapiens
ctgggccactccagatgcccac

SEQ ID NO: 8364479 - DNA, 22 bp, Homo sapiens
ctgggccacttcctcaggggaa

SEQ ID NO: 8364480 - DNA, 22 bp, Homo sapiens
ctgggaggcggagcttgcagtg

SEQ ID NO: 8364481 - DNA, 22 bp, Homo sapiens
ctgggaggcggagcttgcagtg

SEQ ID NO: 8364482 - DNA, 22 bp, Homo sapiens
ctgggaggcactattcaggagg

SEQ ID NO: 8364483 - DNA, 22 bp, Homo sapiens
ctgggaggattcattgaggtga

SEQ ID NO: 8364484 - DNA, 22 bp, Homo sapiens
ctgggaggcaccgcgtcgtgct

SEQ ID NO: 8364485 - DNA, 22 bp, Homo sapiens
ctgggagctgaggctgacgctg

SEQ ID NO: 8364486 - DNA, 22 bp, Homo sapiens
ctgggagctcagccctggggtg

SEQ ID NO: 8364487 - DNA, 22 bp, Homo sapiens
ctgggagctcagccctggggtg

SEQ ID NO: 8364488 - DNA, 22 bp, Homo sapiens
ctgggagctagctctgagctga

SEQ ID NO: 8364489 - DNA, 22 bp, Homo sapiens
ctgggaagaaattgtgggaggc

SEQ ID NO: 8364490 - DNA, 22 bp, Homo sapiens
ctggcttttagtgtgaagactt

SEQ ID NO: 8364491 - DNA, 22 bp, Homo sapiens
ctgggaaattgacactgataaa

SEQ ID NO: 8364492 - DNA, 22 bp, Homo sapiens
ctgggaaagcaaggttgtggat

SEQ ID NO: 8364493 - DNA, 22 bp, Homo sapiens
ctgggaaagtgtgctcccctcc

SEQ ID NO: 8364494 - DNA, 22 bp, Homo sapiens
ctgggaaatataataaagtggt

SEQ ID NO: 8364495 - DNA, 22 bp, Homo sapiens
ctgggaaatggcttcgagctca

SEQ ID NO: 8364496 - DNA, 22 bp, Homo sapiens
ctggcttttggaaacaggctca

SEQ ID NO: 8364497 - DNA, 22 bp, Homo sapiens
ctgggaaaactgtgacccctgt

SEQ ID NO: 8364498 - DNA, 22 bp, Homo sapiens
ctggctttctgcaaatctccat

SEQ ID NO: 8364499 - DNA, 22 bp, Homo sapiens
ctggctttgcgtctttgccaca

SEQ ID NO: 8364500 - DNA, 22 bp, Homo sapiens
ctggctttgatcagagtgacct

SEQ ID NO: 8364501 - DNA, 22 bp, Homo sapiens
ctggctttccctggacaacagc

SEQ ID NO: 8364502 - DNA, 22 bp, Homo sapiens
ctggctttcatttcaagcacgt

SEQ ID NO: 8364503 - DNA, 22 bp, Homo sapiens
ctggctttaggttggagagctg

SEQ ID NO: 8364504 - DNA, 20 bp, Homo sapiens
ctggggaggaggatgtgttc

SEQ ID NO: 8364505 - DNA, 22 bp, Homo sapiens
ctgggctgctgtccactagggt

SEQ ID NO: 8364506 - DNA, 22 bp, Homo sapiens
ctgggctgctgtccactagggt

SEQ ID NO: 8364507 - DNA, 22 bp, Homo sapiens
ctgggctgcttgctgaaggggt

SEQ ID NO: 8364508 - DNA, 23 bp, Homo sapiens
ctgggctgcttgagtccctggct

SEQ ID NO: 8364509 - DNA, 20 bp, Homo sapiens
ctgggctgcccagctatggg

SEQ ID NO: 8364510 - DNA, 22 bp, Homo sapiens
ctgggctgcgggcgcccctcca

SEQ ID NO: 8364511 - DNA, 22 bp, Homo sapiens
ctgggctgcgggcgcccctcca

SEQ ID NO: 8364512 - DNA, 22 bp, Homo sapiens
ctgggctgcggttctctgaagc

SEQ ID NO: 8364513 - DNA, 22 bp, Homo sapiens
ctgggctgctcagccccctcgc

SEQ ID NO: 8364514 - DNA, 22 bp, Homo sapiens
ctgggccagaccttgtggtctt

SEQ ID NO: 8364515 - DNA, 19 bp, Homo sapiens
ctgggccagagctgtcctc

SEQ ID NO: 8364516 - DNA, 19 bp, Homo sapiens
ctgggccagagctgtcctc

SEQ ID NO: 8364517 - DNA, 22 bp, Homo sapiens
ctgggccagatccagcctcaca

SEQ ID NO: 8364518 - DNA, 22 bp, Homo sapiens
ctgggctgcaggagtggggcaa

SEQ ID NO: 8364519 - DNA, 22 bp, Homo sapiens
ctgggctgcagcgggagcgacg

SEQ ID NO: 8364520 - DNA, 22 bp, Homo sapiens
ctggggctgcggtggaggagcc

SEQ ID NO: 8364521 - DNA, 22 bp, Homo sapiens
ctggggctgcggtggaggagcc

SEQ ID NO: 8364522 - DNA, 22 bp, Homo sapiens
ctggggctgcggacgggagccc

SEQ ID NO: 8364523 - DNA, 22 bp, Homo sapiens
ctgggtctggccacaggaagta

SEQ ID NO: 8364524 - DNA, 22 bp, Homo sapiens
ctgggtctggctactgcttcct

SEQ ID NO: 8364525 - DNA, 22 bp, Homo sapiens
ctgggtctggccacaggaagta

SEQ ID NO: 8364526 - DNA, 22 bp, Homo sapiens
ctgggtctggctactgcttcct

SEQ ID NO: 8364527 - DNA, 20 bp, Homo sapiens
ctgggtctccttctgcttaa

SEQ ID NO: 8364528 - DNA, 22 bp, Homo sapiens
ctgggtaaaggctgcttttcta

SEQ ID NO: 8364529 - DNA, 22 bp, Homo sapiens
ctggggctcactccagccctgg

SEQ ID NO: 8364530 - DNA, 22 bp, Homo sapiens
ctggggcccgagccttgggcca

SEQ ID NO: 8364531 - DNA, 22 bp, Homo sapiens
ctggggccacaacggcgcacgc

SEQ ID NO: 8364532 - DNA, 22 bp, Homo sapiens
ctggggccacaacggcgcacgc

SEQ ID NO: 8364533 - DNA, 22 bp, Homo sapiens
ctggggcattgggagaggcctg

SEQ ID NO: 8364534 - DNA, 22 bp, Homo sapiens
ctggggccagtgaggaggcttt

SEQ ID NO: 8364535 - DNA, 22 bp, Homo sapiens
ctggcaggaagaggaaaggtca

SEQ ID NO: 8364536 - DNA, 19 bp, Homo sapiens
ctggcagcctgtctgtgtc

SEQ ID NO: 8364537 - DNA, 22 bp, Homo sapiens
ctggcagcccaacctagagtct

SEQ ID NO: 8364538 - DNA, 22 bp, Homo sapiens
ctggcagccaagtgggatactc

SEQ ID NO: 8364539 - DNA, 22 bp, Homo sapiens
ctggcagcccaacctagagtct

SEQ ID NO: 8364540 - DNA, 22 bp, Homo sapiens
ctgccagctcaaagcgcagcta

SEQ ID NO: 8364541 - DNA, 22 bp, Homo sapiens
ctgccagagatctgggcagagt

SEQ ID NO: 8364542 - DNA, 22 bp, Homo sapiens
ctgccactctgggtgggcctgg

SEQ ID NO: 8364543 - DNA, 21 bp, Homo sapiens
ctgccacctgctccatcagca

SEQ ID NO: 8364544 - DNA, 22 bp, Homo sapiens
ctgccaccatgccccagcagag

SEQ ID NO: 8364545 - DNA, 22 bp, Homo sapiens
ctgccacaggggagcaggcaga

SEQ ID NO: 8364546 - DNA, 22 bp, Homo sapiens
ctgcatcagtggatatgatggt

SEQ ID NO: 8364547 - DNA, 20 bp, Homo sapiens
ctggcaggagcgagtctacc

SEQ ID NO: 8364548 - DNA, 22 bp, Homo sapiens
ctggcaggcagacttctgcaag

SEQ ID NO: 8364549 - DNA, 22 bp, Homo sapiens
ctggcaggcggaggttgcagtg

SEQ ID NO: 8364550 - DNA, 22 bp, Homo sapiens
ctggcaggctctctggtcggtt

SEQ ID NO: 8364551 - DNA, 22 bp, Homo sapiens
ctggctgcgtctgctctgacag

SEQ ID NO: 8364552 - DNA, 20 bp, Homo sapiens
ctggctggaaacttagcctt

SEQ ID NO: 8364553 - DNA, 22 bp, Homo sapiens
ctggctcatccaggtgttgctc

SEQ ID NO: 8364554 - DNA, 22 bp, Homo sapiens
ctggctcatagagcagctccaa

SEQ ID NO: 8364555 - DNA, 22 bp, Homo sapiens
ctggctcatagagcagctccaa

SEQ ID NO: 8364556 - DNA, 22 bp, Homo sapiens
ctggctcagttcttggttttca

SEQ ID NO: 8364557 - DNA, 22 bp, Homo sapiens
ctggctcagttcttggttttca

SEQ ID NO: 8364558 - DNA, 22 bp, Homo sapiens
ctggctcagtgccttcagaagt

SEQ ID NO: 8364559 - DNA, 22 bp, Homo sapiens
ctggctcattttagcatcaggt

SEQ ID NO: 8364560 - DNA, 22 bp, Homo sapiens
ctggctcattttagcatcaggt

SEQ ID NO: 8364561 - DNA, 22 bp, Homo sapiens
ctggctcatgtgatgagggcaa

SEQ ID NO: 8364562 - DNA, 23 bp, Homo sapiens
ctggctcatcctggttgcagtgg

SEQ ID NO: 8364563 - DNA, 22 bp, Homo sapiens
ctggctccaaggaagaggtttt

SEQ ID NO: 8364564 - DNA, 22 bp, Homo sapiens
ctggcctggtctggcctctcca

SEQ ID NO: 8364565 - DNA, 22 bp, Homo sapiens
ctggctcaggaaagttgctgct

SEQ ID NO: 8364566 - DNA, 22 bp, Homo sapiens
ctggctcagggtggtctgggtc

SEQ ID NO: 8364567 - DNA, 22 bp, Homo sapiens
ctggctcactagccctgccctg

SEQ ID NO: 8364568 - DNA, 22 bp, Homo sapiens
ctggctcactagccctgccctg

SEQ ID NO: 8364569 - DNA, 22 bp, Homo sapiens
ctggctcagacagctgtgcagt

SEQ ID NO: 8364570 - DNA, 22 bp, Homo sapiens
ctggctcagacagctgtgcagt

SEQ ID NO: 8364571 - DNA, 22 bp, Homo sapiens
ctggctcacctccgctccagca

SEQ ID NO: 8364572 - DNA, 22 bp, Homo sapiens
ctggctcacctccgctccagca

SEQ ID NO: 8364573 - DNA, 22 bp, Homo sapiens
ctggcctgtcctgacccagcct

SEQ ID NO: 8364574 - DNA, 22 bp, Homo sapiens
ctggccctggagggctgtgcga

SEQ ID NO: 8364575 - DNA, 22 bp, Homo sapiens
ctggcccaggtggtcgttgagg

SEQ ID NO: 8364576 - DNA, 22 bp, Homo sapiens
ctggcccagtctcagagtgtca

SEQ ID NO: 8364577 - DNA, 22 bp, Homo sapiens
ttcatgaagggtgaatatagtc

SEQ ID NO: 8364578 - DNA, 22 bp, Homo sapiens
ttcatgaatatattgaattagc

SEQ ID NO: 8364579 - DNA, 22 bp, Homo sapiens
ctaaaattacctaccagtttag

SEQ ID NO: 8364580 - DNA, 22 bp, Homo sapiens
ttcatgaatgttccatgtgagt

SEQ ID NO: 8364581 - DNA, 22 bp, Homo sapiens
ttcatgaatgttccatgtgagt

SEQ ID NO: 8364582 - DNA, 22 bp, Homo sapiens
ctaaatactagccttcagattt

SEQ ID NO: 8364583 - DNA, 22 bp, Homo sapiens
ctaaagaattttgcttgaccag

SEQ ID NO: 8364584 - DNA, 22 bp, Homo sapiens
ctaaagaagctagcaatctata

SEQ ID NO: 8364585 - DNA, 22 bp, Homo sapiens
ctaaagagaagatgtttgctga

SEQ ID NO: 8364586 - DNA, 22 bp, Homo sapiens
ctaaagagagttcaagactcct

SEQ ID NO: 8364587 - DNA, 22 bp, Homo sapiens
cgtaggtggctcagcacctggg

SEQ ID NO: 8364588 - DNA, 19 bp, Homo sapiens
cggtggcttgcagggaggt

SEQ ID NO: 8364589 - DNA, 21 bp, Homo sapiens
cggtggctcccgggatggctc

SEQ ID NO: 8364590 - DNA, 22 bp, Homo sapiens
cggtctcccgtgtgtgtgcgct

SEQ ID NO: 8364591 - DNA, 22 bp, Homo sapiens
ttcatgaaacttaactgttggg

SEQ ID NO: 8364592 - DNA, 22 bp, Homo sapiens
ttcatgaaagacagcaactgtg

SEQ ID NO: 8364593 - DNA, 22 bp, Homo sapiens
cgtatttagaaggctgctgaaa

SEQ ID NO: 8364594 - DNA, 22 bp, Homo sapiens
ttcagattttttaataggtaat

SEQ ID NO: 8364595 - DNA, 22 bp, Homo sapiens
ttcagcaaacacgatgcttgtt

SEQ ID NO: 8364596 - DNA, 22 bp, Homo sapiens
ttcaggcagctgaggagaaagt

SEQ ID NO: 8364597 - DNA, 22 bp, Homo sapiens
ttcaggcctaatttctagcccc

SEQ ID NO: 8364598 - DNA, 22 bp, Homo sapiens
ttcaggcctctaaagggaaagc

SEQ ID NO: 8364599 - DNA, 22 bp, Homo sapiens
ttcagataaattgttttgtgat

SEQ ID NO: 8364600 - DNA, 22 bp, Homo sapiens
ttcagataaactacaaataatt

SEQ ID NO: 8364601 - DNA, 20 bp, Homo sapiens
ttcagagtcagcaaatgcag

SEQ ID NO: 8364602 - DNA, 18 bp, Homo sapiens
ttcagagtctggtgagga

SEQ ID NO: 8364603 - DNA, 22 bp, Homo sapiens
ttcagagtggtatgaagtgatg

SEQ ID NO: 8364604 - DNA, 22 bp, Homo sapiens
ttcagaggtttccgggccatgc

SEQ ID NO: 8364605 - DNA, 22 bp, Homo sapiens
ttcagagtacacagagatcttc

SEQ ID NO: 8364606 - DNA, 22 bp, Homo sapiens
ttcagagtacacagagatcttc

SEQ ID NO: 8364607 - DNA, 22 bp, Homo sapiens
ttcagaggtagagaggatcttg

SEQ ID NO: 8364608 - DNA, 22 bp, Homo sapiens
ttcagagggttttagggtcaga

SEQ ID NO: 8364609 - DNA, 22 bp, Homo sapiens
ttcagaaagtgaatcttgttat

SEQ ID NO: 8364610 - DNA, 21 bp, Homo sapiens
ttcagaggatgccaaggtcca

SEQ ID NO: 8364611 - DNA, 22 bp, Homo sapiens
ttcacacagcaactgtatgaat

SEQ ID NO: 8364612 - DNA, 16 bp, Homo sapiens
cctttctctgccttcc

SEQ ID NO: 8364613 - DNA, 22 bp, Homo sapiens
cctttctctatcgacccatcgc

SEQ ID NO: 8364614 - DNA, 22 bp, Homo sapiens
cctttctacagatgcctcttgc

SEQ ID NO: 8364615 - DNA, 22 bp, Homo sapiens
cctttcctgtgtccttttaagg

SEQ ID NO: 8364616 - DNA, 22 bp, Homo sapiens
cctttcctgcctcaggaagtag

SEQ ID NO: 8364617 - DNA, 22 bp, Homo sapiens
cctttcaaaacagaacactagc

SEQ ID NO: 8364618 - DNA, 22 bp, Homo sapiens
cctttccccgcgggaggtgcca

SEQ ID NO: 8364619 - DNA, 22 bp, Homo sapiens
cctttcccgctttgagggcaag

SEQ ID NO: 8364620 - DNA, 22 bp, Homo sapiens
cctttctctggcagcaggacag

SEQ ID NO: 8364621 - DNA, 17 bp, Homo sapiens
cctttctctttcatctc

SEQ ID NO: 8364622 - DNA, 23 bp, Homo sapiens
cgcccagcctcagtgacctgggc

SEQ ID NO: 8364623 - DNA, 22 bp, Homo sapiens
cgccagtggcagctggaacagg

SEQ ID NO: 8364624 - DNA, 22 bp, Homo sapiens
cgcatccagggcgcaggatctg

SEQ ID NO: 8364625 - DNA, 22 bp, Homo sapiens
cgcatcgggtagaggagctgga

SEQ ID NO: 8364626 - DNA, 22 bp, Homo sapiens
cgcaggtgggcccttcattgat

SEQ ID NO: 8364627 - DNA, 22 bp, Homo sapiens
cgcaggtgaactgttctgcagt

SEQ ID NO: 8364628 - DNA, 22 bp, Homo sapiens
cgcagctgtccatgtgtggggg

SEQ ID NO: 8364629 - DNA, 22 bp, Homo sapiens
cgccccggacgtctgaccaaac

SEQ ID NO: 8364630 - DNA, 21 bp, Homo sapiens
ttcaagtctctaggacttctc

SEQ ID NO: 8364631 - DNA, 22 bp, Homo sapiens
ttcaaatttggtatgcaagcca

SEQ ID NO: 8364632 - DNA, 22 bp, Homo sapiens
ttcaaattaccacatttgctta

SEQ ID NO: 8364633 - DNA, 22 bp, Homo sapiens
cgcccaggctggagagcagtgg

SEQ ID NO: 8364634 - DNA, 22 bp, Homo sapiens
cgcccaggctggagtgcagtga

SEQ ID NO: 8364635 - DNA, 22 bp, Homo sapiens
cgcccaggctggagagcagtgg

SEQ ID NO: 8364636 - DNA, 22 bp, Homo sapiens
cgcccagctgaaatctccaggc

SEQ ID NO: 8364637 - DNA, 22 bp, Homo sapiens
cgcccagggcaggaggccgctc

SEQ ID NO: 8364638 - DNA, 22 bp, Homo sapiens
cgcccaggctggagtgcagtgg

SEQ ID NO: 8364639 - DNA, 22 bp, Homo sapiens
cgccccagtctgtaggtgcccc

SEQ ID NO: 8364640 - DNA, 22 bp, Homo sapiens
ttcacacacagcttcctattgt

SEQ ID NO: 8364641 - DNA, 22 bp, Homo sapiens
ttcacaatttcccttcatcagg

SEQ ID NO: 8364642 - DNA, 22 bp, Homo sapiens
ttcaataggatgcatgatataa

SEQ ID NO: 8364643 - DNA, 19 bp, Homo sapiens
ttcacaattatgaaattag

SEQ ID NO: 8364644 - DNA, 22 bp, Homo sapiens
ttcaatagaaagtccctagtta

SEQ ID NO: 8364645 - DNA, 22 bp, Homo sapiens
ttcaatagaaatgacattcttt

SEQ ID NO: 8364646 - DNA, 22 bp, Homo sapiens
ttcaatagcatacttttgctct

SEQ ID NO: 8364647 - DNA, 22 bp, Homo sapiens
ttcaagtttgtatttctgtatt

SEQ ID NO: 8364648 - DNA, 22 bp, Homo sapiens
ctagcatcagatgagaagctgt

SEQ ID NO: 8364649 - DNA, 22 bp, Homo sapiens
ctagcatctcactgatttactg

SEQ ID NO: 8364650 - DNA, 22 bp, Homo sapiens
ctagcaccagcctgagagtttt

SEQ ID NO: 8364651 - DNA, 22 bp, Homo sapiens
ctagcaccagcctgagagtttt

SEQ ID NO: 8364652 - DNA, 22 bp, Homo sapiens
ttctctggcctgaggcgaggcc

SEQ ID NO: 8364653 - DNA, 22 bp, Homo sapiens
ctattaaatactcttcaaattg

SEQ ID NO: 8364654 - DNA, 22 bp, Homo sapiens
ctattacaatctgctactatga

SEQ ID NO: 8364655 - DNA, 22 bp, Homo sapiens
ctattacagggaagccttggga

SEQ ID NO: 8364656 - DNA, 22 bp, Homo sapiens
ctattacaattctgcaaggagt

SEQ ID NO: 8364657 - DNA, 18 bp, Homo sapiens
ctattacaatgcagtggt

SEQ ID NO: 8364658 - DNA, 22 bp, Homo sapiens
ctattacaatctgctactatga

SEQ ID NO: 8364659 - DNA, 22 bp, Homo sapiens
ctattaaacactactgtgcact

SEQ ID NO: 8364660 - DNA, 22 bp, Homo sapiens
ctattaaacactactgtgcact

SEQ ID NO: 8364661 - DNA, 22 bp, Homo sapiens
ctattaaatactcttcaaattg

SEQ ID NO: 8364662 - DNA, 22 bp, Homo sapiens
ctatggctcaattctagtggtt

SEQ ID NO: 8364663 - DNA, 22 bp, Homo sapiens
ctcacaggcatctcatcaggct

SEQ ID NO: 8364664 - DNA, 22 bp, Homo sapiens
ctcacagcatggaattttctgg

SEQ ID NO: 8364665 - DNA, 22 bp, Homo sapiens
ctcacagcagccagtctgcctt

SEQ ID NO: 8364666 - DNA, 22 bp, Homo sapiens
ctcacagatgctgtgggtcagg

SEQ ID NO: 8364667 - DNA, 22 bp, Homo sapiens
ctcacagatgtcctggcacttc

SEQ ID NO: 8364668 - DNA, 22 bp, Homo sapiens
ctcacagagctcatactgggag

SEQ ID NO: 8364669 - DNA, 22 bp, Homo sapiens
ctcaagactgatcgcagtggaa

SEQ ID NO: 8364670 - DNA, 22 bp, Homo sapiens
ctattattatgttaactggact

SEQ ID NO: 8364671 - DNA, 22 bp, Homo sapiens
ctactgccattgtctctgccat

SEQ ID NO: 8364672 - DNA, 22 bp, Homo sapiens
ctactgtaatagatgaatttga

SEQ ID NO: 8364673 - DNA, 22 bp, Homo sapiens
ctacatttacacagttaggctt

SEQ ID NO: 8364674 - DNA, 22 bp, Homo sapiens
ctacatttcatccagggagagc

SEQ ID NO: 8364675 - DNA, 22 bp, Homo sapiens
ttcctgggctttcccctctggt

SEQ ID NO: 8364676 - DNA, 22 bp, Homo sapiens
ttcctgggctgcagagagcacc

SEQ ID NO: 8364677 - DNA, 21 bp, Homo sapiens
ctaccctctcctgctcatatc

SEQ ID NO: 8364678 - DNA, 21 bp, Homo sapiens
ctaccctcactcccattcctc

SEQ ID NO: 8364679 - DNA, 22 bp, Homo sapiens
ttctcctttgtaattctcatcc

SEQ ID NO: 8364680 - DNA, 22 bp, Homo sapiens
ttctctaaacatattggatctg

SEQ ID NO: 8364681 - DNA, 22 bp, Homo sapiens
ttctctaaaattaagtgaggta

SEQ ID NO: 8364682 - DNA, 22 bp, Homo sapiens
ttctctaaagagttaggccaag

SEQ ID NO: 8364683 - DNA, 22 bp, Homo sapiens
ttctctaaagagttaggccaag

SEQ ID NO: 8364684 - DNA, 22 bp, Homo sapiens
ttctctaaatgtgaaccggctt

SEQ ID NO: 8364685 - DNA, 21 bp, Homo sapiens
ttctctggataggccagtcct

SEQ ID NO: 8364686 - DNA, 20 bp, Homo sapiens
ttctctggatagccagatgt

SEQ ID NO: 8364687 - DNA, 22 bp, Homo sapiens
ctagaaaaatactttattgtga

SEQ ID NO: 8364688 - DNA, 22 bp, Homo sapiens
ctacagaggacacaaagatctt

SEQ ID NO: 8364689 - DNA, 22 bp, Homo sapiens
ctacagagaactcagctgccct

SEQ ID NO: 8364690 - DNA, 22 bp, Homo sapiens
ttccaggactcgttctggctca

SEQ ID NO: 8364691 - DNA, 22 bp, Homo sapiens
ctacagtactggatgctcagcc

SEQ ID NO: 8364692 - DNA, 22 bp, Homo sapiens
ttcctgggactggagcagccca

SEQ ID NO: 8364693 - DNA, 22 bp, Homo sapiens
tgtgtattaatgtttgtatatg

SEQ ID NO: 8364694 - DNA, 22 bp, Homo sapiens
tgtgtattaccattttacagct

SEQ ID NO: 8364695 - DNA, 22 bp, Homo sapiens
tgtgtattaatgtttgtatatg

SEQ ID NO: 8364696 - DNA, 22 bp, Homo sapiens
tgtgtatgtgtatacactatat

SEQ ID NO: 8364697 - DNA, 20 bp, Homo sapiens
tgtgtatgtgcacatgcgaa

SEQ ID NO: 8364698 - DNA, 22 bp, Homo sapiens
tgtgtatgtctgtatgcacaca

SEQ ID NO: 8364699 - DNA, 22 bp, Homo sapiens
tgtgtatgcatacacacataga

SEQ ID NO: 8364700 - DNA, 22 bp, Homo sapiens
tgtgtatgtaagcatgtgcata

SEQ ID NO: 8364701 - DNA, 23 bp, Homo sapiens
tgtgtatgtatctatgcataggt

SEQ ID NO: 8364702 - DNA, 22 bp, Homo sapiens
tggggctgtggattctcacgaa

SEQ ID NO: 8364703 - DNA, 22 bp, Homo sapiens
tggggctgtggattctcacgaa

SEQ ID NO: 8364704 - DNA, 23 bp, Homo sapiens
tggggccaagtgaggaagggtct

SEQ ID NO: 8364705 - DNA, 22 bp, Homo sapiens
tggggcatggatgataagctgg

SEQ ID NO: 8364706 - DNA, 22 bp, Homo sapiens
tggggccacacatctctttcta

SEQ ID NO: 8364707 - DNA, 22 bp, Homo sapiens
tggggcagccacatagacaaca

SEQ ID NO: 8364708 - DNA, 19 bp, Homo sapiens
cctgggagtcagctgaagg

SEQ ID NO: 8364709 - DNA, 22 bp, Homo sapiens
cctgggaggctgaggctgcagt

SEQ ID NO: 8364710 - DNA, 22 bp, Homo sapiens
tgggggaaattcagccagatat

SEQ ID NO: 8364711 - DNA, 22 bp, Homo sapiens
cctgggagtgtcagacttgctt

SEQ ID NO: 8364712 - DNA, 22 bp, Homo sapiens
cctgggagtggcactcacagca

SEQ ID NO: 8364713 - DNA, 22 bp, Homo sapiens
tgttacaaggaagaatgtaggt

SEQ ID NO: 8364714 - DNA, 22 bp, Homo sapiens
tgttacaaactgttgtttctat

SEQ ID NO: 8364715 - DNA, 17 bp, Homo sapiens
tgttaattccaatgata

SEQ ID NO: 8364716 - DNA, 22 bp, Homo sapiens
tgttaatttctttagaagtgga

SEQ ID NO: 8364717 - DNA, 22 bp, Homo sapiens
tgttaatgtgctttgaaagact

SEQ ID NO: 8364718 - DNA, 22 bp, Homo sapiens
tgttaatatactaaaatccact

SEQ ID NO: 8364719 - DNA, 22 bp, Homo sapiens
tgtgttctcctacagataagga

SEQ ID NO: 8364720 - DNA, 22 bp, Homo sapiens
cctgggctgttgcatcatcctt

SEQ ID NO: 8364721 - DNA, 22 bp, Homo sapiens
cctgggcttccacgagcagagg

SEQ ID NO: 8364722 - DNA, 22 bp, Homo sapiens
cctgggctctgaggagggagtc

SEQ ID NO: 8364723 - DNA, 22 bp, Homo sapiens
cctgggctctgaggagggagtc

SEQ ID NO: 8364724 - DNA, 22 bp, Homo sapiens
cctgggctctgaggagggagtc

SEQ ID NO: 8364725 - DNA, 22 bp, Homo sapiens
cctgggctctatcctgacccag

SEQ ID NO: 8364726 - DNA, 22 bp, Homo sapiens
tgtgtctgcccttagtacatct

SEQ ID NO: 8364727 - DNA, 22 bp, Homo sapiens
cctgggctggagtacagcagtg

SEQ ID NO: 8364728 - DNA, 22 bp, Homo sapiens
cctgggctgctcatggggatga

SEQ ID NO: 8364729 - DNA, 22 bp, Homo sapiens
cctgggctgcatgatggcattt

SEQ ID NO: 8364730 - DNA, 22 bp, Homo sapiens
cctgggctgcatgatggcattt

SEQ ID NO: 8364731 - DNA, 22 bp, Homo sapiens
cctgggctgcatgatggcattt

SEQ ID NO: 8364732 - DNA, 22 bp, Homo sapiens
cctggtggagaggggcggagcg

SEQ ID NO: 8364733 - DNA, 22 bp, Homo sapiens
cctggtggcttctgggtggacg

SEQ ID NO: 8364734 - DNA, 22 bp, Homo sapiens
tgtttacttaaatgttttcata

SEQ ID NO: 8364735 - DNA, 22 bp, Homo sapiens
cctggtttcaggaacataatct

SEQ ID NO: 8364736 - DNA, 22 bp, Homo sapiens
tgtttacttatgtgggtcacat

SEQ ID NO: 8364737 - DNA, 22 bp, Homo sapiens
tgtttacttcatcgagtacttc

SEQ ID NO: 8364738 - DNA, 22 bp, Homo sapiens
cctggtttaatgctcactgttg

SEQ ID NO: 8364739 - DNA, 22 bp, Homo sapiens
cctggtttatgccagatcctgt

SEQ ID NO: 8364740 - DNA, 22 bp, Homo sapiens
tgttacaatattatcaactgag

SEQ ID NO: 8364741 - DNA, 22 bp, Homo sapiens
tgttacaatattatcaactgag

SEQ ID NO: 8364742 - DNA, 22 bp, Homo sapiens
tgttcattctgtgacctggttc

SEQ ID NO: 8364743 - DNA, 22 bp, Homo sapiens
tgttccagggcgcgaaggtggt

SEQ ID NO: 8364744 - DNA, 22 bp, Homo sapiens
tgttccagattcggcgtgggac

SEQ ID NO: 8364745 - DNA, 23 bp, Homo sapiens
tgttccagatacgccttttcctc

SEQ ID NO: 8364746 - DNA, 23 bp, Homo sapiens
tgttccagatacgccttttcctc

SEQ ID NO: 8364747 - DNA, 22 bp, Homo sapiens
cctgtgccttccttaggcacct

SEQ ID NO: 8364748 - DNA, 22 bp, Homo sapiens
ttaaaggatctttgtcattaat

SEQ ID NO: 8364749 - DNA, 22 bp, Homo sapiens
ttaaaggaattgagtttcttgt

SEQ ID NO: 8364750 - DNA, 22 bp, Homo sapiens
cctgtgcttcagctggaggagg

SEQ ID NO: 8364751 - DNA, 20 bp, Homo sapiens
cctgtgcttatcacttgctg

SEQ ID NO: 8364752 - DNA, 22 bp, Homo sapiens
cctgtgctggacagggctgggc

SEQ ID NO: 8364753 - DNA, 22 bp, Homo sapiens
cctgtggcttccacgacctaat

SEQ ID NO: 8364754 - DNA, 19 bp, Homo sapiens
ttaaagtgcgagaagtctt

SEQ ID NO: 8364755 - DNA, 22 bp, Homo sapiens
ttaaagtatagaggacaaaaac

SEQ ID NO: 8364756 - DNA, 22 bp, Homo sapiens
ttaaagtatagaggacaaaaac

SEQ ID NO: 8364757 - DNA, 22 bp, Homo sapiens
ttaaagtaatctgtgtgaattt

SEQ ID NO: 8364758 - DNA, 22 bp, Homo sapiens
ttaaaggctgatcttaatatta

SEQ ID NO: 8364759 - DNA, 22 bp, Homo sapiens
cctgtgtccagttccaggttgt

SEQ ID NO: 8364760 - DNA, 22 bp, Homo sapiens
cctgtgtcagcccctgcctcca

SEQ ID NO: 8364761 - DNA, 22 bp, Homo sapiens
cctgtggtttacgtacagctcc

SEQ ID NO: 8364762 - DNA, 22 bp, Homo sapiens
cctgtggttacgcctgtttcca

SEQ ID NO: 8364763 - DNA, 22 bp, Homo sapiens
cctgtgggttttctgtagaaat

SEQ ID NO: 8364764 - DNA, 22 bp, Homo sapiens
cctgtgggtcacatgggtgact

SEQ ID NO: 8364765 - DNA, 22 bp, Homo sapiens
cctgtgggagcccaggcagata

SEQ ID NO: 8364766 - DNA, 22 bp, Homo sapiens
cctgtgggtcacatgggtgact

SEQ ID NO: 8364767 - DNA, 22 bp, Homo sapiens
cctgtgggttttcaagatgcta

SEQ ID NO: 8364768 - DNA, 22 bp, Homo sapiens
tgtttactttccttctcacagg

SEQ ID NO: 8364769 - DNA, 22 bp, Homo sapiens
tgtttagagtctctgtcaacat

SEQ ID NO: 8364770 - DNA, 22 bp, Homo sapiens
cctgtctgcatgagtgagcata

SEQ ID NO: 8364771 - DNA, 22 bp, Homo sapiens
cctgtctgaaggcagggggatg

SEQ ID NO: 8364772 - DNA, 17 bp, Homo sapiens
cctgtcttgtttctgcc

SEQ ID NO: 8364773 - DNA, 22 bp, Homo sapiens
cctgtgccatcctgagcatccc

SEQ ID NO: 8364774 - DNA, 22 bp, Homo sapiens
cctgtctggccaccagggcgat

SEQ ID NO: 8364775 - DNA, 22 bp, Homo sapiens
ccttccccagtgattctctcag

SEQ ID NO: 8364776 - DNA, 22 bp, Homo sapiens
ccttccccaggtgctcactgtc

SEQ ID NO: 8364777 - DNA, 22 bp, Homo sapiens
ccttcccatgcagcctgtctga

SEQ ID NO: 8364778 - DNA, 22 bp, Homo sapiens
cctgtgtcttccccactggtgt

SEQ ID NO: 8364779 - DNA, 22 bp, Homo sapiens
cctgtgtggccaggctggagtc

SEQ ID NO: 8364780 - DNA, 20 bp, Homo sapiens
cctgtgtggccagctgaggc

SEQ ID NO: 8364781 - DNA, 22 bp, Homo sapiens
ttagaaaatggaggtgggaggg

SEQ ID NO: 8364782 - DNA, 22 bp, Homo sapiens
ttagaaaatttgcttctttgga

SEQ ID NO: 8364783 - DNA, 22 bp, Homo sapiens
ttagaagtgaaatagctgtaca

SEQ ID NO: 8364784 - DNA, 22 bp, Homo sapiens
ttagaaaacataagtggtaaag

SEQ ID NO: 8364785 - DNA, 22 bp, Homo sapiens
ttagaaaaaggctgtggtctta

SEQ ID NO: 8364786 - DNA, 22 bp, Homo sapiens
ttagaatcagaagagaggtatt

SEQ ID NO: 8364787 - DNA, 22 bp, Homo sapiens
ttagaatctaacattcttatct

SEQ ID NO: 8364788 - DNA, 22 bp, Homo sapiens
ttagaatttctgctcactttga

SEQ ID NO: 8364789 - DNA, 23 bp, Homo sapiens
ttagacaatcctcaaaaggtaat

SEQ ID NO: 8364790 - DNA, 22 bp, Homo sapiens
cctttacagtatggttgtatca

SEQ ID NO: 8364791 - DNA, 22 bp, Homo sapiens
cctttacatctgacttctttca

SEQ ID NO: 8364792 - DNA, 22 bp, Homo sapiens
ttagaaaaaacgtcttctagtg

SEQ ID NO: 8364793 - DNA, 22 bp, Homo sapiens
ttagaaaaaacgtcttctagtg

SEQ ID NO: 8364794 - DNA, 21 bp, Homo sapiens
ttacttttgcagcaacctaat

SEQ ID NO: 8364795 - DNA, 22 bp, Homo sapiens
ttagaaaaaacgtcttctagtg

SEQ ID NO: 8364796 - DNA, 21 bp, Homo sapiens
ttacttttgcaccaacctaat

SEQ ID NO: 8364797 - DNA, 23 bp, Homo sapiens
ttacttttgcaccaacctaatat

SEQ ID NO: 8364798 - DNA, 21 bp, Homo sapiens
ttacttttgcagcaacctaat

SEQ ID NO: 8364799 - DNA, 23 bp, Homo sapiens
ttacttttgcaccaacctaatat

SEQ ID NO: 8364800 - DNA, 22 bp, Homo sapiens
ttacttttgcaccaaactaata

SEQ ID NO: 8364801 - DNA, 21 bp, Homo sapiens
ttacttttgcaccaacctaat

SEQ ID NO: 8364802 - DNA, 22 bp, Homo sapiens
ttacttttgcaccaaactaata

SEQ ID NO: 8364803 - DNA, 22 bp, Homo sapiens
ttacttttgcaccaaactaata

SEQ ID NO: 8364804 - DNA, 22 bp, Homo sapiens
ttacttttgcaccaaactaata

SEQ ID NO: 8364805 - DNA, 22 bp, Homo sapiens
ttacttttctattcgatatgtg

SEQ ID NO: 8364806 - DNA, 21 bp, Homo sapiens
ttactaaacaaaacatgcagg

SEQ ID NO: 8364807 - DNA, 21 bp, Homo sapiens
ccttctccacagggtctccgg

SEQ ID NO: 8364808 - DNA, 22 bp, Homo sapiens
ccttctagcaaatcaacataaa

SEQ ID NO: 8364809 - DNA, 22 bp, Homo sapiens
ctcttattcctacagtaacagg

SEQ ID NO: 8364810 - DNA, 22 bp, Homo sapiens
ctcttattttatggcatttgtg

SEQ ID NO: 8364811 - DNA, 22 bp, Homo sapiens
ctcttagtttgtaaaaataatt

SEQ ID NO: 8364812 - DNA, 21 bp, Homo sapiens
ctctgtgttgagggtgttgag

SEQ ID NO: 8364813 - DNA, 22 bp, Homo sapiens
ctcttcagcctatttgagtgca

SEQ ID NO: 8364814 - DNA, 22 bp, Homo sapiens
ctcttcagtaaatgacactgtt

SEQ ID NO: 8364815 - DNA, 22 bp, Homo sapiens
ctcttcaggatggcttgtgatg

SEQ ID NO: 8364816 - DNA, 22 bp, Homo sapiens
ctctttagtctgtgtggagaag

SEQ ID NO: 8364817 - DNA, 22 bp, Homo sapiens
ctctttagtcacagggcttcat

SEQ ID NO: 8364818 - DNA, 22 bp, Homo sapiens
ttttcagttatagaatggtaga

SEQ ID NO: 8364819 - DNA, 22 bp, Homo sapiens
ttttcagttactgtttatgtga

SEQ ID NO: 8364820 - DNA, 22 bp, Homo sapiens
ttttcagtggcttgcatatgtt

SEQ ID NO: 8364821 - DNA, 22 bp, Homo sapiens
ttttcacttaaggaatttcatg

SEQ ID NO: 8364822 - DNA, 22 bp, Homo sapiens
ctcttcccagctccacgagagg

SEQ ID NO: 8364823 - DNA, 22 bp, Homo sapiens
ttttcacattgtcccagcacta

SEQ ID NO: 8364824 - DNA, 22 bp, Homo sapiens
ttttcacttaaggaatttcatg

SEQ ID NO: 8364825 - DNA, 22 bp, Homo sapiens
ttttaagaactgttctgtgctt

SEQ ID NO: 8364826 - DNA, 22 bp, Homo sapiens
ttttaagaggaggctgtttgaa

SEQ ID NO: 8364827 - DNA, 22 bp, Homo sapiens
ttttaagaaatgtatgactgtc

SEQ ID NO: 8364828 - DNA, 22 bp, Homo sapiens
tttgttctgaaaactcaagtcc

SEQ ID NO: 8364829 - DNA, 22 bp, Homo sapiens
tttgtacatataaatcttgtat

SEQ ID NO: 8364830 - DNA, 22 bp, Homo sapiens
tttgtacatatttgtggggcac

SEQ ID NO: 8364831 - DNA, 22 bp, Homo sapiens
tttgttctattttagagatgaa

SEQ ID NO: 8364832 - DNA, 22 bp, Homo sapiens
tttgtacactgtctactatgaa

SEQ ID NO: 8364833 - DNA, 22 bp, Homo sapiens
tttgtacacaggatgttataat

SEQ ID NO: 8364834 - DNA, 22 bp, Homo sapiens
tttgtacacaggatgttataat

SEQ ID NO: 8364835 - DNA, 22 bp, Homo sapiens
ttttagcactaagtgatatgct

SEQ ID NO: 8364836 - DNA, 22 bp, Homo sapiens
ttttaatactgctattgtagga

SEQ ID NO: 8364837 - DNA, 22 bp, Homo sapiens
ttttaagatgctagtatttcag

SEQ ID NO: 8364838 - DNA, 22 bp, Homo sapiens
ttttaagcaaaagaatggtgtg

SEQ ID NO: 8364839 - DNA, 22 bp, Homo sapiens
ctctggaaatggccatagtcat

SEQ ID NO: 8364840 - DNA, 20 bp, Homo sapiens
ctctggaagagtttaaatgg

SEQ ID NO: 8364841 - DNA, 22 bp, Homo sapiens
tttgctatttttctgtgcagct

SEQ ID NO: 8364842 - DNA, 22 bp, Homo sapiens
tttgctctgctgttgccaggtg

SEQ ID NO: 8364843 - DNA, 22 bp, Homo sapiens
tttgctctgacagtgccagaga

SEQ ID NO: 8364844 - DNA, 20 bp, Homo sapiens
ctctgctttccacctttcag

SEQ ID NO: 8364845 - DNA, 22 bp, Homo sapiens
ctctgctttcctcttacacact

SEQ ID NO: 8364846 - DNA, 22 bp, Homo sapiens
ctctgctttcctcttacacact

SEQ ID NO: 8364847 - DNA, 20 bp, Homo sapiens
tttgctatgcatatctgacc

SEQ ID NO: 8364848 - DNA, 22 bp, Homo sapiens
tttgctattgtgaatagtgcca

SEQ ID NO: 8364849 - DNA, 22 bp, Homo sapiens
tttgcctgggaattctagtgta

SEQ ID NO: 8364850 - DNA, 22 bp, Homo sapiens
tttgcctgggaattctagtgta

SEQ ID NO: 8364851 - DNA, 22 bp, Homo sapiens
tttgccatgtaggttaatcatt

SEQ ID NO: 8364852 - DNA, 22 bp, Homo sapiens
tttgcaaataaataagtgctcg

SEQ ID NO: 8364853 - DNA, 22 bp, Homo sapiens
tttgcattttgataagatcact

SEQ ID NO: 8364854 - DNA, 19 bp, Homo sapiens
ctctgcctccctcctgggt

SEQ ID NO: 8364855 - DNA, 22 bp, Homo sapiens
ctctgccctcgcacatctgcca

SEQ ID NO: 8364856 - DNA, 22 bp, Homo sapiens
ctctgcccgcggatgccacgtc

SEQ ID NO: 8364857 - DNA, 22 bp, Homo sapiens
ctctgcccgtgcctttcccagt

SEQ ID NO: 8364858 - DNA, 22 bp, Homo sapiens
ctctgccctcacttggggcctg

SEQ ID NO: 8364859 - DNA, 22 bp, Homo sapiens
ctctgcccagtgcccacaggag

SEQ ID NO: 8364860 - DNA, 22 bp, Homo sapiens
ctctgcccagtgcccacaggag

SEQ ID NO: 8364861 - DNA, 22 bp, Homo sapiens
ctctgcccccagctggtgcttg

SEQ ID NO: 8364862 - DNA, 22 bp, Homo sapiens
ctctgccaagatgacaggtaag

SEQ ID NO: 8364863 - DNA, 20 bp, Homo sapiens
ctctgcagcaaggcctgggt

SEQ ID NO: 8364864 - DNA, 22 bp, Homo sapiens
ctctgcagaggcccaaggctga

SEQ ID NO: 8364865 - DNA, 22 bp, Homo sapiens
tttcctttccaaaattctgcct

SEQ ID NO: 8364866 - DNA, 22 bp, Homo sapiens
tttcctttatgacatcaccact

SEQ ID NO: 8364867 - DNA, 20 bp, Homo sapiens
tttcctttcattttagtacc

SEQ ID NO: 8364868 - DNA, 21 bp, Homo sapiens
ctctgcccagggcctcctgcc

SEQ ID NO: 8364869 - DNA, 22 bp, Homo sapiens
ctctgcccacgtcttgcccaga

SEQ ID NO: 8364870 - DNA, 22 bp, Homo sapiens
ctgagccatccataccagctta

SEQ ID NO: 8364871 - DNA, 22 bp, Homo sapiens
ctgactcactgtggctcttaat

SEQ ID NO: 8364872 - DNA, 22 bp, Homo sapiens
ctgaggcagagagaacccgggc

SEQ ID NO: 8364873 - DNA, 21 bp, Homo sapiens
ctgaggcatgcaggcctgggc

SEQ ID NO: 8364874 - DNA, 22 bp, Homo sapiens
ctgaggcagagggcagaccaga

SEQ ID NO: 8364875 - DNA, 22 bp, Homo sapiens
ctgaggcagagggcagaccaga

SEQ ID NO: 8364876 - DNA, 22 bp, Homo sapiens
ctgagccatgggtctaagcact

SEQ ID NO: 8364877 - DNA, 17 bp, Homo sapiens
ctctttataaagagtta

SEQ ID NO: 8364878 - DNA, 22 bp, Homo sapiens
ctctttagtttgaaatccacat

SEQ ID NO: 8364879 - DNA, 22 bp, Homo sapiens
ctctttagtggtgatgatgcta

SEQ ID NO: 8364880 - DNA, 21 bp, Homo sapiens
ctctttatatagtaaagatat

SEQ ID NO: 8364881 - DNA, 22 bp, Homo sapiens
ctctttccagggtaccccaggt

SEQ ID NO: 8364882 - DNA, 22 bp, Homo sapiens
ctctttcagttctgatagtctc

SEQ ID NO: 8364883 - DNA, 22 bp, Homo sapiens
ctctttcctcagccacagtcta

SEQ ID NO: 8364884 - DNA, 22 bp, Homo sapiens
ctctttcctcgatgggctcctg

SEQ ID NO: 8364885 - DNA, 22 bp, Homo sapiens
ctctttctgattcgctgggacc

SEQ ID NO: 8364886 - DNA, 22 bp, Homo sapiens
ctctttgaaatccatcactgct

SEQ ID NO: 8364887 - DNA, 22 bp, Homo sapiens
ctctttctggaaggcagagtgg

SEQ ID NO: 8364888 - DNA, 22 bp, Homo sapiens
ctctttggagaagcacgtatta

SEQ ID NO: 8364889 - DNA, 22 bp, Homo sapiens
ctctttggagaagcacgtatta

SEQ ID NO: 8364890 - DNA, 19 bp, Homo sapiens
ctctttggagatccttgga

SEQ ID NO: 8364891 - DNA, 19 bp, Homo sapiens
ctctttggagatccttgga

SEQ ID NO: 8364892 - DNA, 22 bp, Homo sapiens
ctctttggatagaattacaaag

SEQ ID NO: 8364893 - DNA, 22 bp, Homo sapiens
ctctttggatagaattacaaag

SEQ ID NO: 8364894 - DNA, 22 bp, Homo sapiens
ctctttggatagaattacaaag

SEQ ID NO: 8364895 - DNA, 22 bp, Homo sapiens
ctctttggatgtttatgataag

SEQ ID NO: 8364896 - DNA, 22 bp, Homo sapiens
ctctttggatgtttatgataag

SEQ ID NO: 8364897 - DNA, 22 bp, Homo sapiens
ctctttggccagaaaatgtttt

SEQ ID NO: 8364898 - DNA, 22 bp, Homo sapiens
ctctttggatagaattacaaag

SEQ ID NO: 8364899 - DNA, 22 bp, Homo sapiens
ctctttggatgtttatgataag

SEQ ID NO: 8364900 - DNA, 22 bp, Homo sapiens
ctctttggccagaaaatgtttt

SEQ ID NO: 8364901 - DNA, 22 bp, Homo sapiens
ctgacatggggatccaccttag

SEQ ID NO: 8364902 - DNA, 22 bp, Homo sapiens
ctgaccacaggcctctaacagc

SEQ ID NO: 8364903 - DNA, 19 bp, Homo sapiens
ctgacccaggacaccacgg

SEQ ID NO: 8364904 - DNA, 22 bp, Homo sapiens
ctgacagctgttgcagtgaatg

SEQ ID NO: 8364905 - DNA, 22 bp, Homo sapiens
ctgacagctgctgccgccgcat

SEQ ID NO: 8364906 - DNA, 22 bp, Homo sapiens
ctgacagggtagacagagggca

SEQ ID NO: 8364907 - DNA, 22 bp, Homo sapiens
ctgacagcaaaggccagtggct

SEQ ID NO: 8364908 - DNA, 22 bp, Homo sapiens
ctgacagcagcaaatggagata

SEQ ID NO: 8364909 - DNA, 22 bp, Homo sapiens
ctgacagcagcaaatggagata

SEQ ID NO: 8364910 - DNA, 22 bp, Homo sapiens
ctgacagccatgttttagagaa

SEQ ID NO: 8364911 - DNA, 22 bp, Homo sapiens
ctgacagcgagagagttgcccc

SEQ ID NO: 8364912 - DNA, 19 bp, Homo sapiens
ctgacagcgcctgataaga

SEQ ID NO: 8364913 - DNA, 22 bp, Homo sapiens
ctgacagctcctagtgctcact

SEQ ID NO: 8364914 - DNA, 22 bp, Homo sapiens
ctgacagctatttttgtagata

SEQ ID NO: 8364915 - DNA, 22 bp, Homo sapiens
ctgacagctgaagggtcccaga

SEQ ID NO: 8364916 - DNA, 22 bp, Homo sapiens
ctgacagctctggctagtagaa

SEQ ID NO: 8364917 - DNA, 22 bp, Homo sapiens
ctgacagatgctgctggcagta

SEQ ID NO: 8364918 - DNA, 22 bp, Homo sapiens
ctgaggccagagtgggcctctt

SEQ ID NO: 8364919 - DNA, 22 bp, Homo sapiens
ctgaggcatgttacaggacata

SEQ ID NO: 8364920 - DNA, 22 bp, Homo sapiens
ctgaggcatgttacaggacata

SEQ ID NO: 8364921 - DNA, 22 bp, Homo sapiens
ctgaggcatgttacaggacata

SEQ ID NO: 8364922 - DNA, 22 bp, Homo sapiens
ctgaggcatgggaagttgggtg

SEQ ID NO: 8364923 - DNA, 21 bp, Homo sapiens
ctgaggcatgcaggcctgggc

SEQ ID NO: 8364924 - DNA, 22 bp, Homo sapiens
ctgcacagggatatggggagct

SEQ ID NO: 8364925 - DNA, 22 bp, Homo sapiens
ctgcacaggggatgagggcagt

SEQ ID NO: 8364926 - DNA, 22 bp, Homo sapiens
ctgcacccatgagctcaaggga

SEQ ID NO: 8364927 - DNA, 22 bp, Homo sapiens
ctgcaccctcaaactcctgggc

SEQ ID NO: 8364928 - DNA, 22 bp, Homo sapiens
ctgcaccctcaaactcctgggc

SEQ ID NO: 8364929 - DNA, 22 bp, Homo sapiens
ctgcactgagaccctctttgct

SEQ ID NO: 8364930 - DNA, 22 bp, Homo sapiens
ctgcactgaagaaaggagctct

SEQ ID NO: 8364931 - DNA, 22 bp, Homo sapiens
ctgcagggaggttccttgttct

SEQ ID NO: 8364932 - DNA, 22 bp, Homo sapiens
ctgcaggcatttattcatgcaa

SEQ ID NO: 8364933 - DNA, 22 bp, Homo sapiens
ctgcactgtgtaacagataact

SEQ ID NO: 8364934 - DNA, 22 bp, Homo sapiens
tttaggttttttcacgtggcta

SEQ ID NO: 8364935 - DNA, 22 bp, Homo sapiens
tttagtgataagaattatgaaa

SEQ ID NO: 8364936 - DNA, 23 bp, Homo sapiens
tttagtcagttgacagccatata

SEQ ID NO: 8364937 - DNA, 20 bp, Homo sapiens
ctcccctctacagagggctg

SEQ ID NO: 8364938 - DNA, 22 bp, Homo sapiens
ctcccctccttaggtcttctag

SEQ ID NO: 8364939 - DNA, 22 bp, Homo sapiens
tttagagaagttaggaaataaa

SEQ ID NO: 8364940 - DNA, 22 bp, Homo sapiens
ctcccccttagctcttgtcttt

SEQ ID NO: 8364941 - DNA, 22 bp, Homo sapiens
tttaatcataagaaggaaaata

SEQ ID NO: 8364942 - DNA, 22 bp, Homo sapiens
ctcctggcagttccccttgtca

SEQ ID NO: 8364943 - DNA, 17 bp, Homo sapiens
ctcctggcagcctcagg

SEQ ID NO: 8364944 - DNA, 17 bp, Homo sapiens
ctcctggcagcctcagg

SEQ ID NO: 8364945 - DNA, 22 bp, Homo sapiens
tttatttaccttatgtcctcca

SEQ ID NO: 8364946 - DNA, 22 bp, Homo sapiens
tttatttaccttatgtcctcca

SEQ ID NO: 8364947 - DNA, 22 bp, Homo sapiens
tttatttaaagtcgtgtgttaa

SEQ ID NO: 8364948 - DNA, 22 bp, Homo sapiens
tttatttaaagtcgtgtgttaa

SEQ ID NO: 8364949 - DNA, 22 bp, Homo sapiens
ctcctggcactcagtgtggaag

SEQ ID NO: 8364950 - DNA, 22 bp, Homo sapiens
tttattctaacttgctgctcta

SEQ ID NO: 8364951 - DNA, 22 bp, Homo sapiens
tttattgttatcatgggtgagt

SEQ ID NO: 8364952 - DNA, 22 bp, Homo sapiens
ctcctcccaattgccaagtgct

SEQ ID NO: 8364953 - DNA, 22 bp, Homo sapiens
ctcctccagtgggtccctcagg

SEQ ID NO: 8364954 - DNA, 23 bp, Homo sapiens
tttcaaattactctgcagatgac

SEQ ID NO: 8364955 - DNA, 22 bp, Homo sapiens
tttcaaatggagtcgtgaaatg

SEQ ID NO: 8364956 - DNA, 22 bp, Homo sapiens
tttcaaatggagtcgtgaaatg

SEQ ID NO: 8364957 - DNA, 22 bp, Homo sapiens
ctcctggccctgagctcccagg

SEQ ID NO: 8364958 - DNA, 22 bp, Homo sapiens
tttcacaaagcatagcacttta

SEQ ID NO: 8364959 - DNA, 22 bp, Homo sapiens
tttcacaaatgtctttaacttg

SEQ ID NO: 8364960 - DNA, 22 bp, Homo sapiens
tttcacaacacaatctcgttaa

SEQ ID NO: 8364961 - DNA, 22 bp, Homo sapiens
tttcacaaactgaggagacaat

SEQ ID NO: 8364962 - DNA, 22 bp, Homo sapiens
tttcacaaactgaggagacaat

SEQ ID NO: 8364963 - DNA, 22 bp, Homo sapiens
tttcacatacagtgtatagtag

SEQ ID NO: 8364964 - DNA, 22 bp, Homo sapiens
tttcacatagaaagtgatttac

SEQ ID NO: 8364965 - DNA, 22 bp, Homo sapiens
tttcacataaatggagtaaaga

SEQ ID NO: 8364966 - DNA, 22 bp, Homo sapiens
tttcacataaatggagtaaaga

SEQ ID NO: 8364967 - DNA, 22 bp, Homo sapiens
tttcacataaatattatgccta

SEQ ID NO: 8364968 - DNA, 22 bp, Homo sapiens
tttcacagtagaaatcattatg

SEQ ID NO: 8364969 - DNA, 20 bp, Homo sapiens
tttcacagtccctgtttcct

SEQ ID NO: 8364970 - DNA, 22 bp, Homo sapiens
tttcctaaggtagtgataattt

SEQ ID NO: 8364971 - DNA, 22 bp, Homo sapiens
ctctctgaaactggagagtctc

SEQ ID NO: 8364972 - DNA, 20 bp, Homo sapiens
ctctctctccattcccaggg

SEQ ID NO: 8364973 - DNA, 22 bp, Homo sapiens
tttccttgggtctcttagtggc

SEQ ID NO: 8364974 - DNA, 22 bp, Homo sapiens
ctctctgagtgagggacaagct

SEQ ID NO: 8364975 - DNA, 22 bp, Homo sapiens
ctctccaggagctcagagtcta

SEQ ID NO: 8364976 - DNA, 22 bp, Homo sapiens
tttcctcactcatgtcatcagt

SEQ ID NO: 8364977 - DNA, 22 bp, Homo sapiens
tttcctagttctaagaaatgta

SEQ ID NO: 8364978 - DNA, 22 bp, Homo sapiens
tttcctcacacagaagatcttg

SEQ ID NO: 8364979 - DNA, 22 bp, Homo sapiens
ctctccaggctgggacaggacc

SEQ ID NO: 8364980 - DNA, 22 bp, Homo sapiens
ctctccaggcgaggtcctactg

SEQ ID NO: 8364981 - DNA, 22 bp, Homo sapiens
ctctccaggggtagatgccttc

SEQ ID NO: 8364982 - DNA, 22 bp, Homo sapiens
ctctccagggaagcagtgtact

SEQ ID NO: 8364983 - DNA, 22 bp, Homo sapiens
ctctccagtcatattctcagtc

SEQ ID NO: 8364984 - DNA, 22 bp, Homo sapiens
ctccacagctcaggctcagagt

SEQ ID NO: 8364985 - DNA, 22 bp, Homo sapiens
ctccacagcccctccagtggca

SEQ ID NO: 8364986 - DNA, 22 bp, Homo sapiens
ctccacagcccctccagtggca

SEQ ID NO: 8364987 - DNA, 22 bp, Homo sapiens
ctccacaggtgtactgtacctt

SEQ ID NO: 8364988 - DNA, 22 bp, Homo sapiens
ctccacaggtggtgtttgcttc

SEQ ID NO: 8364989 - DNA, 19 bp, Homo sapiens
ctccacagggattgtgatt

SEQ ID NO: 8364990 - DNA, 22 bp, Homo sapiens
ctccacagctgtaaatataggg

SEQ ID NO: 8364991 - DNA, 22 bp, Homo sapiens
ctccacagagcatgcttatagg

SEQ ID NO: 8364992 - DNA, 22 bp, Homo sapiens
ctccacagagatgctgattgta

SEQ ID NO: 8364993 - DNA, 23 bp, Homo sapiens
ctccaaggcccaactgtctaggc

SEQ ID NO: 8364994 - DNA, 22 bp, Homo sapiens
ctccaaattcagtcacagtctg

SEQ ID NO: 8364995 - DNA, 22 bp, Homo sapiens
ctccaccacacatctgtccacc

SEQ ID NO: 8364996 - DNA, 22 bp, Homo sapiens
ttggtcagctaataaggacagg

SEQ ID NO: 8364997 - DNA, 22 bp, Homo sapiens
ctccacagttgctgcttttaat

SEQ ID NO: 8364998 - DNA, 22 bp, Homo sapiens
ttgtacaaagatttcacagctc

SEQ ID NO: 8364999 - DNA, 22 bp, Homo sapiens
ttgtacaaagatttcacagctc

SEQ ID NO: 8365000 - DNA, 22 bp, Homo sapiens
ttgtacaaaggatttggaagag

SEQ ID NO: 8365001 - DNA, 22 bp, Homo sapiens
ctccagcagaaagggcgagtgg

SEQ ID NO: 8365002 - DNA, 22 bp, Homo sapiens
ctccagattccgtttattcagg

SEQ ID NO: 8365003 - DNA, 22 bp, Homo sapiens
ttgtacaaatgcatattcctgg

SEQ ID NO: 8365004 - DNA, 22 bp, Homo sapiens
ttgtacaaatgcatattcctgg

SEQ ID NO: 8365005 - DNA, 22 bp, Homo sapiens
ttgtacaaataggaacctctga

SEQ ID NO: 8365006 - DNA, 22 bp, Homo sapiens
ttgtacaacgttttaaatttga

SEQ ID NO: 8365007 - DNA, 22 bp, Homo sapiens
ttgtacaacacatattctacag

SEQ ID NO: 8365008 - DNA, 22 bp, Homo sapiens
ctcatttgtaattagttctcag

SEQ ID NO: 8365009 - DNA, 22 bp, Homo sapiens
ctcatttatttctcccaaaaca

SEQ ID NO: 8365010 - DNA, 22 bp, Homo sapiens
ctcatttactcatctgcaaaac

SEQ ID NO: 8365011 - DNA, 22 bp, Homo sapiens
ctcatttaacagattaaaaagt

SEQ ID NO: 8365012 - DNA, 22 bp, Homo sapiens
ctcatttaacagattaaaaagt

SEQ ID NO: 8365013 - DNA, 22 bp, Homo sapiens
ctcatttacctttgcaatcaag

SEQ ID NO: 8365014 - DNA, 22 bp, Homo sapiens
ctcatttacctttgcaatcaag

SEQ ID NO: 8365015 - DNA, 22 bp, Homo sapiens
ttgaaatactgcattgttcagt

SEQ ID NO: 8365016 - DNA, 22 bp, Homo sapiens
ctcatctgtatatagtgaatga

SEQ ID NO: 8365017 - DNA, 22 bp, Homo sapiens
ctcatttaacagattaaaaagt

SEQ ID NO: 8365018 - DNA, 22 bp, Homo sapiens
ttgaaagtttatggagtctgca

SEQ ID NO: 8365019 - DNA, 22 bp, Homo sapiens
ttgaaagttatctagattctga

SEQ ID NO: 8365020 - DNA, 22 bp, Homo sapiens
ttgaaagttaggatttagctgg

SEQ ID NO: 8365021 - DNA, 22 bp, Homo sapiens
ttgaaagtctctgcatgtagga

SEQ ID NO: 8365022 - DNA, 22 bp, Homo sapiens
ttgaaagtgatggggaagatgg

SEQ ID NO: 8365023 - DNA, 22 bp, Homo sapiens
ttgaaagtgccaagtcctagtg

SEQ ID NO: 8365024 - DNA, 22 bp, Homo sapiens
ttgaaagtagcagctgcatatg

SEQ ID NO: 8365025 - DNA, 22 bp, Homo sapiens
ttgaaagtcacaatggcattaa

SEQ ID NO: 8365026 - DNA, 22 bp, Homo sapiens
ttgaaagtaataactttgttca

SEQ ID NO: 8365027 - DNA, 22 bp, Homo sapiens
ttgaaagtagaatgtatgtgga

SEQ ID NO: 8365028 - DNA, 22 bp, Homo sapiens
ttgaaagtctaggcttacagta

SEQ ID NO: 8365029 - DNA, 22 bp, Homo sapiens
ttgaaagtccttcttgagttac

SEQ ID NO: 8365030 - DNA, 22 bp, Homo sapiens
ttcttttcctacacagcgattt

SEQ ID NO: 8365031 - DNA, 22 bp, Homo sapiens
ttcttttcccaatattttgctg

SEQ ID NO: 8365032 - DNA, 21 bp, Homo sapiens
ttgaaagtaaattcagcagct

SEQ ID NO: 8365033 - DNA, 22 bp, Homo sapiens
ttcttttagtcattcagggaag

SEQ ID NO: 8365034 - DNA, 22 bp, Homo sapiens
ttcttttacattaagatttcag

SEQ ID NO: 8365035 - DNA, 22 bp, Homo sapiens
ttcttttacattaagatttcag

SEQ ID NO: 8365036 - DNA, 22 bp, Homo sapiens
ttcttttacattaagatttcag

SEQ ID NO: 8365037 - DNA, 22 bp, Homo sapiens
ttcttttaatttctgtctgcag

SEQ ID NO: 8365038 - DNA, 22 bp, Homo sapiens
ttgtcttttgtgggaaatatgg

SEQ ID NO: 8365039 - DNA, 22 bp, Homo sapiens
ttgtggttaaccgcacattttt

SEQ ID NO: 8365040 - DNA, 20 bp, Homo sapiens
ttgtggtttagattatctga

SEQ ID NO: 8365041 - DNA, 22 bp, Homo sapiens
ctccatggaaccggggctgctt

SEQ ID NO: 8365042 - DNA, 22 bp, Homo sapiens
ttgtcttaaatggatggacaat

SEQ ID NO: 8365043 - DNA, 19 bp, Homo sapiens
ttgtcttagctgcataaga

SEQ ID NO: 8365044 - DNA, 22 bp, Homo sapiens
ttgtctttcccagcttctagag

SEQ ID NO: 8365045 - DNA, 22 bp, Homo sapiens
ttgtcttttgtgggaaatatgg

SEQ ID NO: 8365046 - DNA, 22 bp, Homo sapiens
ttgtctttggaaatttaatgtt

SEQ ID NO: 8365047 - DNA, 23 bp, Homo sapiens
ttgtatttttagtagagacaggg

SEQ ID NO: 8365048 - DNA, 22 bp, Homo sapiens
ctccagccagagtgcctctgtt

SEQ ID NO: 8365049 - DNA, 20 bp, Homo sapiens
ctccagcccctgccctggtc

SEQ ID NO: 8365050 - DNA, 22 bp, Homo sapiens
tttaatatccagtggatacaaa

SEQ ID NO: 8365051 - DNA, 22 bp, Homo sapiens
tttaatatctcacacttccatg

SEQ ID NO: 8365052 - DNA, 22 bp, Homo sapiens
tttaatatttctttcctgaagc

SEQ ID NO: 8365053 - DNA, 22 bp, Homo sapiens
ctcccaggccatgctctagcca

SEQ ID NO: 8365054 - DNA, 22 bp, Homo sapiens
tttaacagatgctatgtctacc

SEQ ID NO: 8365055 - DNA, 22 bp, Homo sapiens
ctcccaggccatgctctagcca

SEQ ID NO: 8365056 - DNA, 22 bp, Homo sapiens
ctcccaggcagggctgcccact

SEQ ID NO: 8365057 - DNA, 22 bp, Homo sapiens
ctcccaggactggctctaactg

SEQ ID NO: 8365058 - DNA, 22 bp, Homo sapiens
ctccatgtccaaagtttccttg

SEQ ID NO: 8365059 - DNA, 22 bp, Homo sapiens
ctccatggggaaatgaaggtgg

SEQ ID NO: 8365060 - DNA, 22 bp, Homo sapiens
ctccatgggggctggcctgtgt

SEQ ID NO: 8365061 - DNA, 22 bp, Homo sapiens
ctcccaagctgtgctgaactgt

SEQ ID NO: 8365062 - DNA, 22 bp, Homo sapiens
ctcccacatggaatagcaggga

SEQ ID NO: 8365063 - DNA, 22 bp, Homo sapiens
ctcccactcctggctcaccaca

SEQ ID NO: 8365064 - DNA, 22 bp, Homo sapiens
ctcccagattcctgctgtggga

SEQ ID NO: 8365065 - DNA, 22 bp, Homo sapiens
caggtagggatatgatggtgat

SEQ ID NO: 8365066 - DNA, 22 bp, Homo sapiens
caggtcagaggtagatgagatg

SEQ ID NO: 8365067 - DNA, 22 bp, Homo sapiens
cagggtggggctggctatcaaa

SEQ ID NO: 8365068 - DNA, 22 bp, Homo sapiens
caggtaaggtcacattctgaag

SEQ ID NO: 8365069 - DNA, 22 bp, Homo sapiens
caggtacattcgtagacccatt

SEQ ID NO: 8365070 - DNA, 22 bp, Homo sapiens
caggtaggaaaagggtgtcagg

SEQ ID NO: 8365071 - DNA, 22 bp, Homo sapiens
caggtgcccagctcctgctgtg

SEQ ID NO: 8365072 - DNA, 22 bp, Homo sapiens
caggtgccgggaatgcagcaat

SEQ ID NO: 8365073 - DNA, 16 bp, Homo sapiens
caggtgcctctcccga

SEQ ID NO: 8365074 - DNA, 22 bp, Homo sapiens
caggtgcctcaggatgagacaa

SEQ ID NO: 8365075 - DNA, 22 bp, Homo sapiens
tattatgcaaatattcctacct

SEQ ID NO: 8365076 - DNA, 22 bp, Homo sapiens
tattatctagtaactgatagtg

SEQ ID NO: 8365077 - DNA, 22 bp, Homo sapiens
tattattaaatggcagaatttt

SEQ ID NO: 8365078 - DNA, 22 bp, Homo sapiens
caggtgggtacatcacagagac

SEQ ID NO: 8365079 - DNA, 18 bp, Homo sapiens
caggtgggtctcctgccc

SEQ ID NO: 8365080 - DNA, 22 bp, Homo sapiens
caggtggccttgccatctcctg

SEQ ID NO: 8365081 - DNA, 19 bp, Homo sapiens
caggtggcgctctacaggg

SEQ ID NO: 8365082 - DNA, 19 bp, Homo sapiens
caggtggcgctctacaggg

SEQ ID NO: 8365083 - DNA, 23 bp, Homo sapiens
caggtggctccacgaggggtggg

SEQ ID NO: 8365084 - DNA, 22 bp, Homo sapiens
caggtggctaacggcctcatag

SEQ ID NO: 8365085 - DNA, 22 bp, Homo sapiens
caggtggctaacggcctcatag

SEQ ID NO: 8365086 - DNA, 22 bp, Homo sapiens
tattaaatgttatttgggttgt

SEQ ID NO: 8365087 - DNA, 22 bp, Homo sapiens
tattaaatatatctgttagttg

SEQ ID NO: 8365088 - DNA, 22 bp, Homo sapiens
caggtggcaaatgagtagcatt

SEQ ID NO: 8365089 - DNA, 22 bp, Homo sapiens
caggtggcagtgcctgcattct

SEQ ID NO: 8365090 - DNA, 22 bp, Homo sapiens
caggtggcagaggtctctggaa

SEQ ID NO: 8365091 - DNA, 22 bp, Homo sapiens
caggtggcagtgcctgcattct

SEQ ID NO: 8365092 - DNA, 22 bp, Homo sapiens
caggtggcattgtcccgccagc

SEQ ID NO: 8365093 - DNA, 22 bp, Homo sapiens
caggtggcattgtcccgccagc

SEQ ID NO: 8365094 - DNA, 22 bp, Homo sapiens
caggtggcatgactgcctacaa

SEQ ID NO: 8365095 - DNA, 22 bp, Homo sapiens
caggtggcatgactgcctacaa

SEQ ID NO: 8365096 - DNA, 22 bp, Homo sapiens
caggtggccttgccatctcctg

SEQ ID NO: 8365097 - DNA, 22 bp, Homo sapiens
caggtggccagtactcaaggat

SEQ ID NO: 8365098 - DNA, 23 bp, Homo sapiens
tcaagcaataattggtaatagtg

SEQ ID NO: 8365099 - DNA, 22 bp, Homo sapiens
tcaagcagcagatcaagagcta

SEQ ID NO: 8365100 - DNA, 22 bp, Homo sapiens
tcaagcagagtcaaaagtacca

SEQ ID NO: 8365101 - DNA, 22 bp, Homo sapiens
tcaagcagcagatcaagagcta

SEQ ID NO: 8365102 - DNA, 22 bp, Homo sapiens
tcaagcagcttttacagaagag

SEQ ID NO: 8365103 - DNA, 20 bp, Homo sapiens
tcaagctagtttccaaagtt

SEQ ID NO: 8365104 - DNA, 22 bp, Homo sapiens
tcaatagataaagctacataaa

SEQ ID NO: 8365105 - DNA, 22 bp, Homo sapiens
tcaatagataaagctacataaa

SEQ ID NO: 8365106 - DNA, 22 bp, Homo sapiens
tcaatagagccttctttcaggt

SEQ ID NO: 8365107 - DNA, 22 bp, Homo sapiens
tcaagcaactgaattctaaaag

SEQ ID NO: 8365108 - DNA, 22 bp, Homo sapiens
tcaaaacactattacctttaat

SEQ ID NO: 8365109 - DNA, 22 bp, Homo sapiens
tcaaaacccagccatcaggact

SEQ ID NO: 8365110 - DNA, 22 bp, Homo sapiens
tcaacaaatacttaaagcagag

SEQ ID NO: 8365111 - DNA, 22 bp, Homo sapiens
tcaaaacaatcattggatgtgc

SEQ ID NO: 8365112 - DNA, 19 bp, Homo sapiens
tcaaaacacaaatggttga

SEQ ID NO: 8365113 - DNA, 19 bp, Homo sapiens
tcaaaacacaaatggttga

SEQ ID NO: 8365114 - DNA, 19 bp, Homo sapiens
tcaaaacacaaatggttga

SEQ ID NO: 8365115 - DNA, 22 bp, Homo sapiens
tcaaaaatgttttatattggta

SEQ ID NO: 8365116 - DNA, 22 bp, Homo sapiens
tcaaaaatgttttatattggta

SEQ ID NO: 8365117 - DNA, 22 bp, Homo sapiens
tattttatctgccagagtggag

SEQ ID NO: 8365118 - DNA, 22 bp, Homo sapiens
tattttatctgccagagtggag

SEQ ID NO: 8365119 - DNA, 22 bp, Homo sapiens
tattttatctgccagagtggag

SEQ ID NO: 8365120 - DNA, 22 bp, Homo sapiens
tattttaggtaatatccattgt

SEQ ID NO: 8365121 - DNA, 22 bp, Homo sapiens
tattttaggtaatatccattgt

SEQ ID NO: 8365122 - DNA, 22 bp, Homo sapiens
cagtcacttacaaaaatataat

SEQ ID NO: 8365123 - DNA, 20 bp, Homo sapiens
cagtccaatcagaggccacc

SEQ ID NO: 8365124 - DNA, 22 bp, Homo sapiens
tattttaaagtgaagggtcttg

SEQ ID NO: 8365125 - DNA, 22 bp, Homo sapiens
caggtgggtgtatgaatgcaaa

SEQ ID NO: 8365126 - DNA, 22 bp, Homo sapiens
cagggtagggcaagggaacctg

SEQ ID NO: 8365127 - DNA, 22 bp, Homo sapiens
cagggtggggctggctatcaaa

SEQ ID NO: 8365128 - DNA, 22 bp, Homo sapiens
cagggggctgtggctgtccagt

SEQ ID NO: 8365129 - DNA, 22 bp, Homo sapiens
cagggggctcaaaggagagtgc

SEQ ID NO: 8365130 - DNA, 22 bp, Homo sapiens
cagggggcagcgtagaaaatga

SEQ ID NO: 8365131 - DNA, 22 bp, Homo sapiens
taggctgggcctgccttccagg

SEQ ID NO: 8365132 - DNA, 22 bp, Homo sapiens
taggctgggctgagctggacgg

SEQ ID NO: 8365133 - DNA, 18 bp, Homo sapiens
taggctgggggctgtagt

SEQ ID NO: 8365134 - DNA, 22 bp, Homo sapiens
taggctgggggtaggaattgag

SEQ ID NO: 8365135 - DNA, 22 bp, Homo sapiens
cagggctcttccggagcaggga

SEQ ID NO: 8365136 - DNA, 22 bp, Homo sapiens
cagggctcttccggagcaggga

SEQ ID NO: 8365137 - DNA, 22 bp, Homo sapiens
cagggctgaactgagcttgtga

SEQ ID NO: 8365138 - DNA, 22 bp, Homo sapiens
cagggctgaactgagcttgtga

SEQ ID NO: 8365139 - DNA, 22 bp, Homo sapiens
tagggaaatatagatttagggc

SEQ ID NO: 8365140 - DNA, 22 bp, Homo sapiens
tagggaaaagacttcactgttt

SEQ ID NO: 8365141 - DNA, 22 bp, Homo sapiens
taggctttcacagctggactcc

SEQ ID NO: 8365142 - DNA, 22 bp, Homo sapiens
taggcttgcaattaggatggaa

SEQ ID NO: 8365143 - DNA, 22 bp, Homo sapiens
taggcttgttacaaaacagtca

SEQ ID NO: 8365144 - DNA, 22 bp, Homo sapiens
cagggctccatgcagggactcc

SEQ ID NO: 8365145 - DNA, 22 bp, Homo sapiens
cagggctccatgcagggactcc

SEQ ID NO: 8365146 - DNA, 22 bp, Homo sapiens
taggccagaggagcagctttgg

SEQ ID NO: 8365147 - DNA, 22 bp, Homo sapiens
taggcagtagcttgagatataa

SEQ ID NO: 8365148 - DNA, 22 bp, Homo sapiens
taggcagtagcaggatctgcca

SEQ ID NO: 8365149 - DNA, 22 bp, Homo sapiens
tagctttaagacatggtgaatg

SEQ ID NO: 8365150 - DNA, 22 bp, Homo sapiens
tagctttaaaaatcatcaaagc

SEQ ID NO: 8365151 - DNA, 22 bp, Homo sapiens
tagcttgactattctatgatgt

SEQ ID NO: 8365152 - DNA, 22 bp, Homo sapiens
tagcttctggagtgtttgaaaa

SEQ ID NO: 8365153 - DNA, 22 bp, Homo sapiens
tagcttctcttttcaacatctt

SEQ ID NO: 8365154 - DNA, 22 bp, Homo sapiens
tagcttctgggagtgtttacta

SEQ ID NO: 8365155 - DNA, 22 bp, Homo sapiens
tagcttctaatacttaccaatt

SEQ ID NO: 8365156 - DNA, 22 bp, Homo sapiens
tagcttctatacaacttcagca

SEQ ID NO: 8365157 - DNA, 22 bp, Homo sapiens
tagcttcagggaaaccactgct

SEQ ID NO: 8365158 - DNA, 22 bp, Homo sapiens
tagcttatctatacagactttt

SEQ ID NO: 8365159 - DNA, 22 bp, Homo sapiens
cagggccatgaggcacagggtc

SEQ ID NO: 8365160 - DNA, 22 bp, Homo sapiens
tagcttaatatgaaacacataa

SEQ ID NO: 8365161 - DNA, 22 bp, Homo sapiens
tagcttaaggcaggcccttgtc

SEQ ID NO: 8365162 - DNA, 22 bp, Homo sapiens
tagcttaaggagtaccagatca

SEQ ID NO: 8365163 - DNA, 22 bp, Homo sapiens
cagggccactgcatgaggttca

SEQ ID NO: 8365164 - DNA, 22 bp, Homo sapiens
cagggagccccaattccatgcc

SEQ ID NO: 8365165 - DNA, 22 bp, Homo sapiens
cagggagccccaattccatgcc

SEQ ID NO: 8365166 - DNA, 22 bp, Homo sapiens
cagggagcaggctctgtccatc

SEQ ID NO: 8365167 - DNA, 22 bp, Homo sapiens
cagggagcactgcgagcggcag

SEQ ID NO: 8365168 - DNA, 23 bp, Homo sapiens
tagattgctacaagtcattgaat

SEQ ID NO: 8365169 - DNA, 22 bp, Homo sapiens
tagattgcatatggaatgtatt

SEQ ID NO: 8365170 - DNA, 22 bp, Homo sapiens
cagggaaagttcttgtccactc

SEQ ID NO: 8365171 - DNA, 22 bp, Homo sapiens
cagggaaagttcttgtccactc

SEQ ID NO: 8365172 - DNA, 22 bp, Homo sapiens
cagggaaattaagtgacgatga

SEQ ID NO: 8365173 - DNA, 22 bp, Homo sapiens
cagggaacaagatgagaatgga

SEQ ID NO: 8365174 - DNA, 22 bp, Homo sapiens
cagggaagaatagttagcaaag

SEQ ID NO: 8365175 - DNA, 22 bp, Homo sapiens
cagggaagagccgatgctgcag

SEQ ID NO: 8365176 - DNA, 22 bp, Homo sapiens
cagggaaggctgcaaatgttaa

SEQ ID NO: 8365177 - DNA, 22 bp, Homo sapiens
cagggaagagccgatgctgcag

SEQ ID NO: 8365178 - DNA, 22 bp, Homo sapiens
cagggaaactaggaaataagct

SEQ ID NO: 8365179 - DNA, 22 bp, Homo sapiens
caggctttttctgctgtcctct

SEQ ID NO: 8365180 - DNA, 22 bp, Homo sapiens
cagggaaagtcccaccccacac

SEQ ID NO: 8365181 - DNA, 22 bp, Homo sapiens
cagggaaagtcccaccccacac

SEQ ID NO: 8365182 - DNA, 22 bp, Homo sapiens
tagattcttctaggtctttagc

SEQ ID NO: 8365183 - DNA, 22 bp, Homo sapiens
tagattcttcttttgagtctct

SEQ ID NO: 8365184 - DNA, 22 bp, Homo sapiens
tagattatccctgatttgtcca

SEQ ID NO: 8365185 - DNA, 22 bp, Homo sapiens
cagggacaatggcagagcctga

SEQ ID NO: 8365186 - DNA, 22 bp, Homo sapiens
cagggacaaggaataagattag

SEQ ID NO: 8365187 - DNA, 22 bp, Homo sapiens
cagggacaatggcagagcctga

SEQ ID NO: 8365188 - DNA, 22 bp, Homo sapiens
cagggacaaggaataagattag

SEQ ID NO: 8365189 - DNA, 22 bp, Homo sapiens
cagggacaaacaaggttgggga

SEQ ID NO: 8365190 - DNA, 22 bp, Homo sapiens
cagggacaaagtgagaaaggaa

SEQ ID NO: 8365191 - DNA, 22 bp, Homo sapiens
cagggacagcactaaactcttg

SEQ ID NO: 8365192 - DNA, 22 bp, Homo sapiens
cagggacagcactaaactcttg

SEQ ID NO: 8365193 - DNA, 22 bp, Homo sapiens
cagggacagacagatatatttg

SEQ ID NO: 8365194 - DNA, 22 bp, Homo sapiens
cagggacagagactgcaccttg

SEQ ID NO: 8365195 - DNA, 22 bp, Homo sapiens
cagggacagagactgcaccttg

SEQ ID NO: 8365196 - DNA, 22 bp, Homo sapiens
cagggacagagactgcaccttg

SEQ ID NO: 8365197 - DNA, 22 bp, Homo sapiens
caggctgcagtgcagtggctat

SEQ ID NO: 8365198 - DNA, 22 bp, Homo sapiens
caggctgcccggcaagttgcgc

SEQ ID NO: 8365199 - DNA, 22 bp, Homo sapiens
caggctggagtgcagtggtgcc

SEQ ID NO: 8365200 - DNA, 22 bp, Homo sapiens
caggctggagttcagtggtgtg

SEQ ID NO: 8365201 - DNA, 22 bp, Homo sapiens
caggctggcaatgcgtcaagca

SEQ ID NO: 8365202 - DNA, 22 bp, Homo sapiens
caggctgggaacgccacccgct

SEQ ID NO: 8365203 - DNA, 22 bp, Homo sapiens
tagaaaagctctaaggcctctc

SEQ ID NO: 8365204 - DNA, 22 bp, Homo sapiens
caggctgggactgacccctgct

SEQ ID NO: 8365205 - DNA, 22 bp, Homo sapiens
tagaaaagtatgggactgacat

SEQ ID NO: 8365206 - DNA, 22 bp, Homo sapiens
tagaaaatggccaagcaggact

SEQ ID NO: 8365207 - DNA, 22 bp, Homo sapiens
tagaaaatgttccactgccatt

SEQ ID NO: 8365208 - DNA, 22 bp, Homo sapiens
tagaaaatgttccactgccatt

SEQ ID NO: 8365209 - DNA, 18 bp, Homo sapiens
caggcctttgagacagaa

SEQ ID NO: 8365210 - DNA, 18 bp, Homo sapiens
caggcctttgagacagaa

SEQ ID NO: 8365211 - DNA, 22 bp, Homo sapiens
caggcctttctggggaagtgag

SEQ ID NO: 8365212 - DNA, 22 bp, Homo sapiens
tacatttcctgtcagagatata

SEQ ID NO: 8365213 - DNA, 22 bp, Homo sapiens
caggccttttttcctgcagtgt

SEQ ID NO: 8365214 - DNA, 22 bp, Homo sapiens
tacattgtgatgtttcaataca

SEQ ID NO: 8365215 - DNA, 22 bp, Homo sapiens
tacattgtttgagatagtttgt

SEQ ID NO: 8365216 - DNA, 22 bp, Homo sapiens
tactttattgtaaatgctgatg

SEQ ID NO: 8365217 - DNA, 22 bp, Homo sapiens
tactttaaagaggtgtaatgag

SEQ ID NO: 8365218 - DNA, 22 bp, Homo sapiens
tactttaaaaactgataattca

SEQ ID NO: 8365219 - DNA, 22 bp, Homo sapiens
tacatgttcaaatttgtctttc

SEQ ID NO: 8365220 - DNA, 18 bp, Homo sapiens
caggcctcttgatcttcc

SEQ ID NO: 8365221 - DNA, 19 bp, Homo sapiens
caggcctcttaccctctct

SEQ ID NO: 8365222 - DNA, 19 bp, Homo sapiens
caggcctcttaccctctct

SEQ ID NO: 8365223 - DNA, 22 bp, Homo sapiens
caggcccagcccttagccaggt

SEQ ID NO: 8365224 - DNA, 22 bp, Homo sapiens
caggcctcctatgagcactagc

SEQ ID NO: 8365225 - DNA, 22 bp, Homo sapiens
caggcctcgaggagacagctac

SEQ ID NO: 8365226 - DNA, 22 bp, Homo sapiens
caggcctcctatgagcactagc

SEQ ID NO: 8365227 - DNA, 20 bp, Homo sapiens
caggcctctgggggccctgg

SEQ ID NO: 8365228 - DNA, 22 bp, Homo sapiens
caggcctctccttagtctggca

SEQ ID NO: 8365229 - DNA, 19 bp, Homo sapiens
caggcctctggtctgctgt

SEQ ID NO: 8365230 - DNA, 19 bp, Homo sapiens
caggcctctggtctgctgt

SEQ ID NO: 8365231 - DNA, 22 bp, Homo sapiens
caggcctctatggtcagctgag

SEQ ID NO: 8365232 - DNA, 22 bp, Homo sapiens
caggcctctatggtcagctgag

SEQ ID NO: 8365233 - DNA, 22 bp, Homo sapiens
caggcagatttgctgccctcca

SEQ ID NO: 8365234 - DNA, 22 bp, Homo sapiens
taataattagttattgatcgtg

SEQ ID NO: 8365235 - DNA, 22 bp, Homo sapiens
taataattagttattgatcgtg

SEQ ID NO: 8365236 - DNA, 21 bp, Homo sapiens
taataattccactacagagta

SEQ ID NO: 8365237 - DNA, 21 bp, Homo sapiens
taataattccactacagagta

SEQ ID NO: 8365238 - DNA, 21 bp, Homo sapiens
taataattccactacagagta

SEQ ID NO: 8365239 - DNA, 22 bp, Homo sapiens
taatacagaagtgtattaaaat

SEQ ID NO: 8365240 - DNA, 22 bp, Homo sapiens
taataattggctaaccctggga

SEQ ID NO: 8365241 - DNA, 22 bp, Homo sapiens
taataattttaaagaaggctag

SEQ ID NO: 8365242 - DNA, 22 bp, Homo sapiens
taataattggcaatgttgagca

SEQ ID NO: 8365243 - DNA, 22 bp, Homo sapiens
caggcacctgtgtgtctcaggg

SEQ ID NO: 8365244 - DNA, 22 bp, Homo sapiens
caggcacctcacgtgggtccca

SEQ ID NO: 8365245 - DNA, 22 bp, Homo sapiens
caggcaccccaggtgagcactg

SEQ ID NO: 8365246 - DNA, 22 bp, Homo sapiens
caggcacccagcccagtcgcac

SEQ ID NO: 8365247 - DNA, 22 bp, Homo sapiens
caggcagagttagagcaactgg

SEQ ID NO: 8365248 - DNA, 22 bp, Homo sapiens
caggcagagttagagcaactgg

SEQ ID NO: 8365249 - DNA, 22 bp, Homo sapiens
caggcagagttagagcaactgg

SEQ ID NO: 8365250 - DNA, 22 bp, Homo sapiens
caggcagagctgaagatagatg

SEQ ID NO: 8365251 - DNA, 22 bp, Homo sapiens
caggcagagccaatcgtggggt

SEQ ID NO: 8365252 - DNA, 22 bp, Homo sapiens
caggcagagccaatcgtggggt

SEQ ID NO: 8365253 - DNA, 22 bp, Homo sapiens
caggcagatgctgacaagagtt

SEQ ID NO: 8365254 - DNA, 22 bp, Homo sapiens
caggcagatgctgacaagagtt

SEQ ID NO: 8365255 - DNA, 22 bp, Homo sapiens
caggcagatgctgacaagagtt

SEQ ID NO: 8365256 - DNA, 22 bp, Homo sapiens
caggcagatgctgacaagagtt

SEQ ID NO: 8365257 - DNA, 22 bp, Homo sapiens
caggcagagttagtgatttagg

SEQ ID NO: 8365258 - DNA, 22 bp, Homo sapiens
caggcagatatgttcgctttaa

SEQ ID NO: 8365259 - DNA, 22 bp, Homo sapiens
gtgcttaaaacagaaaacattg

SEQ ID NO: 8365260 - DNA, 19 bp, Homo sapiens
gtgcttaacattttattgt

SEQ ID NO: 8365261 - DNA, 22 bp, Homo sapiens
gtgcttaagcttctgctttatg

SEQ ID NO: 8365262 - DNA, 22 bp, Homo sapiens
gtgcttatccccattctggagg

SEQ ID NO: 8365263 - DNA, 22 bp, Homo sapiens
gtgcttatgtgggagggagagg

SEQ ID NO: 8365264 - DNA, 22 bp, Homo sapiens
gtgcttatgtgggagggagagg

SEQ ID NO: 8365265 - DNA, 22 bp, Homo sapiens
gtgcttctccgttctgcagcac

SEQ ID NO: 8365266 - DNA, 22 bp, Homo sapiens
gtgcttctccgttctgcagcac

SEQ ID NO: 8365267 - DNA, 22 bp, Homo sapiens
cagctcacagccacgccattcc

SEQ ID NO: 8365268 - DNA, 22 bp, Homo sapiens
taaggcaggaactggctgtttt

SEQ ID NO: 8365269 - DNA, 22 bp, Homo sapiens
taaggcagcctcagggtagggt

SEQ ID NO: 8365270 - DNA, 22 bp, Homo sapiens
taaggcagctgagcttctaaca

SEQ ID NO: 8365271 - DNA, 22 bp, Homo sapiens
taagtgaaatggtgcatcaaat

SEQ ID NO: 8365272 - DNA, 22 bp, Homo sapiens
taagtgaaataagtcagataca

SEQ ID NO: 8365273 - DNA, 22 bp, Homo sapiens
taagtgaaaatggtttcccagc

SEQ ID NO: 8365274 - DNA, 22 bp, Homo sapiens
caggccaggtgctctagaatca

SEQ ID NO: 8365275 - DNA, 22 bp, Homo sapiens
caggccaggtggcaggcaaaac

SEQ ID NO: 8365276 - DNA, 22 bp, Homo sapiens
caggccagtgggaaatagggat

SEQ ID NO: 8365277 - DNA, 19 bp, Homo sapiens
caggccagtgtcagggggc

SEQ ID NO: 8365278 - DNA, 19 bp, Homo sapiens
caggccagtgtcagggggc

SEQ ID NO: 8365279 - DNA, 22 bp, Homo sapiens
caggcatttcgcaaaggctgag

SEQ ID NO: 8365280 - DNA, 22 bp, Homo sapiens
tacaaaaaattgatactgacga

SEQ ID NO: 8365281 - DNA, 22 bp, Homo sapiens
tacaaaaggaagagggatctta

SEQ ID NO: 8365282 - DNA, 22 bp, Homo sapiens
tacaaaaaattgatactgacga

SEQ ID NO: 8365283 - DNA, 22 bp, Homo sapiens
caggccagagcgcgtggttggg

SEQ ID NO: 8365284 - DNA, 22 bp, Homo sapiens
caggccagggttgagaagagaa

SEQ ID NO: 8365285 - DNA, 22 bp, Homo sapiens
taatgtctatgggccagataat

SEQ ID NO: 8365286 - DNA, 22 bp, Homo sapiens
taatgtctccagggttgaccta

SEQ ID NO: 8365287 - DNA, 22 bp, Homo sapiens
taatgtctatgggccagataat

SEQ ID NO: 8365288 - DNA, 22 bp, Homo sapiens
taatgtctgatagtgatggctc

SEQ ID NO: 8365289 - DNA, 22 bp, Homo sapiens
taatgtcttagtaccttaattt

SEQ ID NO: 8365290 - DNA, 22 bp, Homo sapiens
caggcagggagctggaaaggat

SEQ ID NO: 8365291 - DNA, 22 bp, Homo sapiens
taatgtgaagacataaatcaga

SEQ ID NO: 8365292 - DNA, 22 bp, Homo sapiens
taatgtgaagacataaatcaga

SEQ ID NO: 8365293 - DNA, 22 bp, Homo sapiens
caggcagggagctggaaaggat

SEQ ID NO: 8365294 - DNA, 22 bp, Homo sapiens
caggcatgagccaggcccctcc

SEQ ID NO: 8365295 - DNA, 22 bp, Homo sapiens
caggcatggatctggaatcatt

SEQ ID NO: 8365296 - DNA, 22 bp, Homo sapiens
caggcatggagaggcagagact

SEQ ID NO: 8365297 - DNA, 22 bp, Homo sapiens
taatatttctaccctgctgcct

SEQ ID NO: 8365298 - DNA, 22 bp, Homo sapiens
taatcacaattcagatgtctta

SEQ ID NO: 8365299 - DNA, 22 bp, Homo sapiens
catggcagctttgggaggagga

SEQ ID NO: 8365300 - DNA, 22 bp, Homo sapiens
catggcagctttgggaggagga

SEQ ID NO: 8365301 - DNA, 22 bp, Homo sapiens
catggcagctttgggaggagga

SEQ ID NO: 8365302 - DNA, 22 bp, Homo sapiens
catggcaggaaggacatgcact

SEQ ID NO: 8365303 - DNA, 22 bp, Homo sapiens
catggcagagcctgcaggtggg

SEQ ID NO: 8365304 - DNA, 23 bp, Homo sapiens
catggcagcaagagctcatggcc

SEQ ID NO: 8365305 - DNA, 22 bp, Homo sapiens
catgcatttctaccaaggaata

SEQ ID NO: 8365306 - DNA, 22 bp, Homo sapiens
catgcattcagaatctctcaca

SEQ ID NO: 8365307 - DNA, 22 bp, Homo sapiens
catgcatgccgggctgacagag

SEQ ID NO: 8365308 - DNA, 22 bp, Homo sapiens
catggcattgcataacggggct

SEQ ID NO: 8365309 - DNA, 22 bp, Homo sapiens
catggcagtgattcagcctttg

SEQ ID NO: 8365310 - DNA, 22 bp, Homo sapiens
catggcagtgattcagcctttg

SEQ ID NO: 8365311 - DNA, 22 bp, Homo sapiens
catggcagggctgtgggcaggt

SEQ ID NO: 8365312 - DNA, 22 bp, Homo sapiens
catggcaggatctgggcccaca

SEQ ID NO: 8365313 - DNA, 22 bp, Homo sapiens
catggcaggcttcttcagcctt

SEQ ID NO: 8365314 - DNA, 22 bp, Homo sapiens
catggcaggaggctgctggcag

SEQ ID NO: 8365315 - DNA, 22 bp, Homo sapiens
catggcaggaggctgctggcag

SEQ ID NO: 8365316 - DNA, 22 bp, Homo sapiens
catggccacatctagctgcaag

SEQ ID NO: 8365317 - DNA, 22 bp, Homo sapiens
catggccagattctttcttctc

SEQ ID NO: 8365318 - DNA, 22 bp, Homo sapiens
catggccagcccccagttcctc

SEQ ID NO: 8365319 - DNA, 22 bp, Homo sapiens
catggccagcccccagttcctc

SEQ ID NO: 8365320 - DNA, 22 bp, Homo sapiens
catggccaaagaattatatttt

SEQ ID NO: 8365321 - DNA, 22 bp, Homo sapiens
tccagctggggacatgggcttc

SEQ ID NO: 8365322 - DNA, 22 bp, Homo sapiens
catgcaggcctatggagcagtg

SEQ ID NO: 8365323 - DNA, 20 bp, Homo sapiens
catgagaagggcagtgtgag

SEQ ID NO: 8365324 - DNA, 22 bp, Homo sapiens
catgagaaggggtggagttaga

SEQ ID NO: 8365325 - DNA, 22 bp, Homo sapiens
catgacatctgcttagtatgaa

SEQ ID NO: 8365326 - DNA, 22 bp, Homo sapiens
catgaattatttttcacaagat

SEQ ID NO: 8365327 - DNA, 22 bp, Homo sapiens
catgcagtcaataaacatgtgt

SEQ ID NO: 8365328 - DNA, 22 bp, Homo sapiens
catgcagggactagagaacagg

SEQ ID NO: 8365329 - DNA, 22 bp, Homo sapiens
catctggcagaccctgcctccg

SEQ ID NO: 8365330 - DNA, 22 bp, Homo sapiens
catctggctagctatcattgtg

SEQ ID NO: 8365331 - DNA, 22 bp, Homo sapiens
catctggcagaccctgcctccg

SEQ ID NO: 8365332 - DNA, 22 bp, Homo sapiens
catctgagggaaaacatgtagt

SEQ ID NO: 8365333 - DNA, 22 bp, Homo sapiens
catctgcaggggaagccagttt

SEQ ID NO: 8365334 - DNA, 22 bp, Homo sapiens
catctgccactctctcccacca

SEQ ID NO: 8365335 - DNA, 22 bp, Homo sapiens
catctgcctaagtggccctgtt

SEQ ID NO: 8365336 - DNA, 22 bp, Homo sapiens
catgaacaccaggcatgaacaa

SEQ ID NO: 8365337 - DNA, 22 bp, Homo sapiens
catgaacattcagaaatacagc

SEQ ID NO: 8365338 - DNA, 22 bp, Homo sapiens
catgaaatttgaagtacagcaa

SEQ ID NO: 8365339 - DNA, 22 bp, Homo sapiens
catgaaatttgaagtacagcaa

SEQ ID NO: 8365340 - DNA, 22 bp, Homo sapiens
catgaaattgtattggcctcaa

SEQ ID NO: 8365341 - DNA, 22 bp, Homo sapiens
catgaaattgctcctttggtgc

SEQ ID NO: 8365342 - DNA, 22 bp, Homo sapiens
catgaaaataacattgttgtga

SEQ ID NO: 8365343 - DNA, 22 bp, Homo sapiens
catctgttgagttctccgtgct

SEQ ID NO: 8365344 - DNA, 22 bp, Homo sapiens
catcttaaattaaagcttaagg

SEQ ID NO: 8365345 - DNA, 22 bp, Homo sapiens
catcttaaaatgtgtcataact

SEQ ID NO: 8365346 - DNA, 22 bp, Homo sapiens
catcttaaaatgtgtcataact

SEQ ID NO: 8365347 - DNA, 22 bp, Homo sapiens
catctgtgccgggtgtttgtca

SEQ ID NO: 8365348 - DNA, 22 bp, Homo sapiens
catctgttctatccacgttgct

SEQ ID NO: 8365349 - DNA, 22 bp, Homo sapiens
catctcagtgtacagggagtct

SEQ ID NO: 8365350 - DNA, 22 bp, Homo sapiens
catctattttctgtgaggtatc

SEQ ID NO: 8365351 - DNA, 22 bp, Homo sapiens
tcagtgctcctaaagtgaatgc

SEQ ID NO: 8365352 - DNA, 22 bp, Homo sapiens
tcagtgccatgggcagacaggc

SEQ ID NO: 8365353 - DNA, 22 bp, Homo sapiens
tcagggaggtgtctgccagaga

SEQ ID NO: 8365354 - DNA, 22 bp, Homo sapiens
tcagggagtagtttgtgctatg

SEQ ID NO: 8365355 - DNA, 22 bp, Homo sapiens
tcagggagtgttggcaggatca

SEQ ID NO: 8365356 - DNA, 19 bp, Homo sapiens
tcagggagtttacagcatg

SEQ ID NO: 8365357 - DNA, 22 bp, Homo sapiens
tcagggagatttggggactcaa

SEQ ID NO: 8365358 - DNA, 22 bp, Homo sapiens
tcagggagggacctgaggctgg

SEQ ID NO: 8365359 - DNA, 22 bp, Homo sapiens
tcagtattgctagagttcactg

SEQ ID NO: 8365360 - DNA, 22 bp, Homo sapiens
tcagtatttctaaacattggct

SEQ ID NO: 8365361 - DNA, 22 bp, Homo sapiens
cataatatctccgattacttgc

SEQ ID NO: 8365362 - DNA, 22 bp, Homo sapiens
cataatatctccgattacttgc

SEQ ID NO: 8365363 - DNA, 22 bp, Homo sapiens
cataacatccttgctactttga

SEQ ID NO: 8365364 - DNA, 22 bp, Homo sapiens
cataatcctggtgtagccctct

SEQ ID NO: 8365365 - DNA, 22 bp, Homo sapiens
cataatcccaggcttgcattca

SEQ ID NO: 8365366 - DNA, 22 bp, Homo sapiens
cataatgaacattagctactgt

SEQ ID NO: 8365367 - DNA, 22 bp, Homo sapiens
cataatccttgattcaaataat

SEQ ID NO: 8365368 - DNA, 22 bp, Homo sapiens
tcagcagggtttgacttctaat

SEQ ID NO: 8365369 - DNA, 22 bp, Homo sapiens
tcagcaggtctgaggcggggcc

SEQ ID NO: 8365370 - DNA, 22 bp, Homo sapiens
tcagcaggggccgttgggtgga

SEQ ID NO: 8365371 - DNA, 22 bp, Homo sapiens
tcagcagggtttgacttctaat

SEQ ID NO: 8365372 - DNA, 22 bp, Homo sapiens
tcagcagggtttgacttctaat

SEQ ID NO: 8365373 - DNA, 22 bp, Homo sapiens
tcagcaggtctgaggcggggcc

SEQ ID NO: 8365374 - DNA, 22 bp, Homo sapiens
tcagcaggtgaacatcatgcca

SEQ ID NO: 8365375 - DNA, 22 bp, Homo sapiens
tcagcaggtgaacatcatgcca

SEQ ID NO: 8365376 - DNA, 22 bp, Homo sapiens
tcagcaggtgaacatcatgcca

SEQ ID NO: 8365377 - DNA, 22 bp, Homo sapiens
tcagcaggtgcctcagattctt

SEQ ID NO: 8365378 - DNA, 22 bp, Homo sapiens
tcagcaggtgctttgtttactc

SEQ ID NO: 8365379 - DNA, 22 bp, Homo sapiens
tcagcaggtgcctcagattctt

SEQ ID NO: 8365380 - DNA, 22 bp, Homo sapiens
tcagcaggtgctttgtttactc

SEQ ID NO: 8365381 - DNA, 22 bp, Homo sapiens
tcagcaggtgctttgtttactc

SEQ ID NO: 8365382 - DNA, 22 bp, Homo sapiens
tcagcaggtgctttgtttactc

SEQ ID NO: 8365383 - DNA, 22 bp, Homo sapiens
tcagcagtagagggggcacagt

SEQ ID NO: 8365384 - DNA, 22 bp, Homo sapiens
tcagcaggtggtgggcaggtga

SEQ ID NO: 8365385 - DNA, 22 bp, Homo sapiens
tcagcaggtggtgggcaggtga

SEQ ID NO: 8365386 - DNA, 22 bp, Homo sapiens
tcagcaggtggtgggcaggtga

SEQ ID NO: 8365387 - DNA, 22 bp, Homo sapiens
tcagcaggtggtgggcaggtga

SEQ ID NO: 8365388 - DNA, 22 bp, Homo sapiens
cataatttctgtatcagcacca

SEQ ID NO: 8365389 - DNA, 18 bp, Homo sapiens
cataattttctttcttta

SEQ ID NO: 8365390 - DNA, 22 bp, Homo sapiens
cataattactgatatgctgatt

SEQ ID NO: 8365391 - DNA, 22 bp, Homo sapiens
cataattagagaattcatgtta

SEQ ID NO: 8365392 - DNA, 22 bp, Homo sapiens
cataattaggcagttgatcatt

SEQ ID NO: 8365393 - DNA, 22 bp, Homo sapiens
cataattaggcagttgatcatt

SEQ ID NO: 8365394 - DNA, 22 bp, Homo sapiens
cataatttcccaagagattgaa

SEQ ID NO: 8365395 - DNA, 22 bp, Homo sapiens
tcaggcctagaacacagcagat

SEQ ID NO: 8365396 - DNA, 22 bp, Homo sapiens
tcaggcctagggagccacacca

SEQ ID NO: 8365397 - DNA, 22 bp, Homo sapiens
tcaggcctagggagaaaattca

SEQ ID NO: 8365398 - DNA, 22 bp, Homo sapiens
tcaggcctcaagctgctttaag

SEQ ID NO: 8365399 - DNA, 22 bp, Homo sapiens
tcaggcctcagaaattgcactg

SEQ ID NO: 8365400 - DNA, 22 bp, Homo sapiens
tcaggcctcagcagcccacagg

SEQ ID NO: 8365401 - DNA, 22 bp, Homo sapiens
tcaggcctccaggttaccattt

SEQ ID NO: 8365402 - DNA, 22 bp, Homo sapiens
tcaggcctccaggttaccattt

SEQ ID NO: 8365403 - DNA, 22 bp, Homo sapiens
tcaggccccatcccagacttat

SEQ ID NO: 8365404 - DNA, 22 bp, Homo sapiens
catagaaatcaggtgagaatct

SEQ ID NO: 8365405 - DNA, 22 bp, Homo sapiens
catagaaatcaggtgagaatct

SEQ ID NO: 8365406 - DNA, 22 bp, Homo sapiens
catagaaactgagacaaggatt

SEQ ID NO: 8365407 - DNA, 22 bp, Homo sapiens
catagaaactgagacaaggatt

SEQ ID NO: 8365408 - DNA, 22 bp, Homo sapiens
catagaaaagagtaggtaatgt

SEQ ID NO: 8365409 - DNA, 22 bp, Homo sapiens
catagaaaagagtaggtaatgt

SEQ ID NO: 8365410 - DNA, 22 bp, Homo sapiens
tcaggcctgagaaaaatccttt

SEQ ID NO: 8365411 - DNA, 22 bp, Homo sapiens
tcaggctgcctatcagactgtg

SEQ ID NO: 8365412 - DNA, 22 bp, Homo sapiens
tcaggctgtatatcttgcactc

SEQ ID NO: 8365413 - DNA, 21 bp, Homo sapiens
tcaggctgtctgctggttcca

SEQ ID NO: 8365414 - DNA, 22 bp, Homo sapiens
tcaggctgtggcttcagttctt

SEQ ID NO: 8365415 - DNA, 17 bp, Homo sapiens
tcaggctgtgcctggta

SEQ ID NO: 8365416 - DNA, 22 bp, Homo sapiens
tcagggagagtgacccatccac

SEQ ID NO: 8365417 - DNA, 22 bp, Homo sapiens
tcagggagaggtgagagcctgt

SEQ ID NO: 8365418 - DNA, 22 bp, Homo sapiens
tcaggctgtgggcactggccat

SEQ ID NO: 8365419 - DNA, 22 bp, Homo sapiens
tcagagcaaattcctgtgagcc

SEQ ID NO: 8365420 - DNA, 22 bp, Homo sapiens
tcagagatgcagtgccacctac

SEQ ID NO: 8365421 - DNA, 22 bp, Homo sapiens
cagttgtccccaaaatatacgg

SEQ ID NO: 8365422 - DNA, 22 bp, Homo sapiens
cagttggtgatgaggctagtag

SEQ ID NO: 8365423 - DNA, 22 bp, Homo sapiens
cagttggtcttcccttggagca

SEQ ID NO: 8365424 - DNA, 22 bp, Homo sapiens
cagttgcctactacatggcagg

SEQ ID NO: 8365425 - DNA, 22 bp, Homo sapiens
cagttgcagctgtgacattgcg

SEQ ID NO: 8365426 - DNA, 22 bp, Homo sapiens
tcaatgaaagagcatgcatttt

SEQ ID NO: 8365427 - DNA, 22 bp, Homo sapiens
cagttactgtatgtcaaagact

SEQ ID NO: 8365428 - DNA, 22 bp, Homo sapiens
cagttagctgacaagtaggcta

SEQ ID NO: 8365429 - DNA, 22 bp, Homo sapiens
tcaatattcttctttagtagga

SEQ ID NO: 8365430 - DNA, 22 bp, Homo sapiens
tcaatagattaggtattagatt

SEQ ID NO: 8365431 - DNA, 22 bp, Homo sapiens
tcaatgaaagagcatgcatttt

SEQ ID NO: 8365432 - DNA, 18 bp, Homo sapiens
tcaatctctgatggtgtt

SEQ ID NO: 8365433 - DNA, 22 bp, Homo sapiens
tcagataaaggagagcttagca

SEQ ID NO: 8365434 - DNA, 22 bp, Homo sapiens
tcagataccattgaatttgttg

SEQ ID NO: 8365435 - DNA, 22 bp, Homo sapiens
tcagataagtgaagcaaagttt

SEQ ID NO: 8365436 - DNA, 22 bp, Homo sapiens
tcagataattaatcatgaaatt

SEQ ID NO: 8365437 - DNA, 22 bp, Homo sapiens
tcagaggatcatgtccctactc

SEQ ID NO: 8365438 - DNA, 22 bp, Homo sapiens
tcagaggagggactcagaccca

SEQ ID NO: 8365439 - DNA, 22 bp, Homo sapiens
tcagaggagctgcagaacgctg

SEQ ID NO: 8365440 - DNA, 22 bp, Homo sapiens
tcagaggagccaaagttctgag

SEQ ID NO: 8365441 - DNA, 22 bp, Homo sapiens
tcagaggagcaaaagaggggat

SEQ ID NO: 8365442 - DNA, 23 bp, Homo sapiens
tcagagcaagatgatgtatgagc

SEQ ID NO: 8365443 - DNA, 22 bp, Homo sapiens
tcagatattctctaagaacaat

SEQ ID NO: 8365444 - DNA, 22 bp, Homo sapiens
tcagatattctctaagaacaat

SEQ ID NO: 8365445 - DNA, 22 bp, Homo sapiens
cagtttgtcttgattcagaaca

SEQ ID NO: 8365446 - DNA, 22 bp, Homo sapiens
tcagatctaattggattattat

SEQ ID NO: 8365447 - DNA, 22 bp, Homo sapiens
tcagatctggtgaagttatagt

SEQ ID NO: 8365448 - DNA, 22 bp, Homo sapiens
cagttttctatggtagaagcat

SEQ ID NO: 8365449 - DNA, 22 bp, Homo sapiens
cagtttttgccattaagagtaa

SEQ ID NO: 8365450 - DNA, 22 bp, Homo sapiens
cataaaagccacctatttaaag

SEQ ID NO: 8365451 - DNA, 23 bp, Homo sapiens
cataaaatattagtatggtagca

SEQ ID NO: 8365452 - DNA, 22 bp, Homo sapiens
ccaaggcagaagatggctcttg

SEQ ID NO: 8365453 - DNA, 22 bp, Homo sapiens
ccaaggagtagagcaggaagct

SEQ ID NO: 8365454 - DNA, 22 bp, Homo sapiens
ccaaggcaacgttggtgtcagg

SEQ ID NO: 8365455 - DNA, 22 bp, Homo sapiens
ccaaggagaatgacaccatgga

SEQ ID NO: 8365456 - DNA, 22 bp, Homo sapiens
tcctagaaagatgtcttttcac

SEQ ID NO: 8365457 - DNA, 22 bp, Homo sapiens
tcctagaaagatgtcttttcac

SEQ ID NO: 8365458 - DNA, 22 bp, Homo sapiens
tcctggcagaaatggggctgtg

SEQ ID NO: 8365459 - DNA, 22 bp, Homo sapiens
tcctggcagagagcatgaggcc

SEQ ID NO: 8365460 - DNA, 22 bp, Homo sapiens
tcctggcactttgggggctcgc

SEQ ID NO: 8365461 - DNA, 22 bp, Homo sapiens
ccaaggctcctcagctggtctt

SEQ ID NO: 8365462 - DNA, 22 bp, Homo sapiens
ccaaggcccctgtggtctagcc

SEQ ID NO: 8365463 - DNA, 22 bp, Homo sapiens
ccaaggctgtggggctgtgcag

SEQ ID NO: 8365464 - DNA, 22 bp, Homo sapiens
ccaaggctgtcattcagtagct

SEQ ID NO: 8365465 - DNA, 17 bp, Homo sapiens
ccacaccctttccttcc

SEQ ID NO: 8365466 - DNA, 22 bp, Homo sapiens
ccacacagtcagtttccaagaa

SEQ ID NO: 8365467 - DNA, 22 bp, Homo sapiens
ccacactgcctgttatctccca

SEQ ID NO: 8365468 - DNA, 22 bp, Homo sapiens
ccacagaaaataaagcacgatt

SEQ ID NO: 8365469 - DNA, 22 bp, Homo sapiens
ccacagaaaataaagcacgatt

SEQ ID NO: 8365470 - DNA, 22 bp, Homo sapiens
tcctggcaggtcagcaggagca

SEQ ID NO: 8365471 - DNA, 22 bp, Homo sapiens
tcctggcagggtggcagcgggt

SEQ ID NO: 8365472 - DNA, 22 bp, Homo sapiens
tcctggcaggtcagcaggagca

SEQ ID NO: 8365473 - DNA, 22 bp, Homo sapiens
tcctggcaggtgtattggctgt

SEQ ID NO: 8365474 - DNA, 22 bp, Homo sapiens
tcctggcagcccgcaggtgctg

SEQ ID NO: 8365475 - DNA, 22 bp, Homo sapiens
tcctggcagggtggcagcgggt

SEQ ID NO: 8365476 - DNA, 22 bp, Homo sapiens
tcctggcagggtctaggtctag

SEQ ID NO: 8365477 - DNA, 22 bp, Homo sapiens
tcctggctcctgatctgtcact

SEQ ID NO: 8365478 - DNA, 22 bp, Homo sapiens
tcctggctccagcagctcttcc

SEQ ID NO: 8365479 - DNA, 22 bp, Homo sapiens
tcctggctccagcagctcttcc

SEQ ID NO: 8365480 - DNA, 22 bp, Homo sapiens
tcctggctccagcagctcttcc

SEQ ID NO: 8365481 - DNA, 22 bp, Homo sapiens
tcctgggagcccttgctccacc

SEQ ID NO: 8365482 - DNA, 22 bp, Homo sapiens
ccactgtcagaggggctgtgcc

SEQ ID NO: 8365483 - DNA, 22 bp, Homo sapiens
ccactgtcttttccaggctgaa

SEQ ID NO: 8365484 - DNA, 22 bp, Homo sapiens
ccactgtaagtttgaaaataac

SEQ ID NO: 8365485 - DNA, 22 bp, Homo sapiens
ccactgtataagcaaaatgaaa

SEQ ID NO: 8365486 - DNA, 22 bp, Homo sapiens
ccacttaagagaacagctatag

SEQ ID NO: 8365487 - DNA, 22 bp, Homo sapiens
ccacttcatcccagctcagata

SEQ ID NO: 8365488 - DNA, 22 bp, Homo sapiens
tctaagaatactcatatcttct

SEQ ID NO: 8365489 - DNA, 21 bp, Homo sapiens
tctaagaacatgattctccct

SEQ ID NO: 8365490 - DNA, 22 bp, Homo sapiens
tctaagtaaaatttgtcatttc

SEQ ID NO: 8365491 - DNA, 22 bp, Homo sapiens
ccagacaggggctgttcctgct

SEQ ID NO: 8365492 - DNA, 22 bp, Homo sapiens
ccagagaccagaacatggggat

SEQ ID NO: 8365493 - DNA, 22 bp, Homo sapiens
ccagagaaccatctgcttgagg

SEQ ID NO: 8365494 - DNA, 22 bp, Homo sapiens
ccagagaaccttgagctgtgag

SEQ ID NO: 8365495 - DNA, 22 bp, Homo sapiens
ccagagaaccttgagctgtgag

SEQ ID NO: 8365496 - DNA, 22 bp, Homo sapiens
ccagagaaccttgagctgtgag

SEQ ID NO: 8365497 - DNA, 22 bp, Homo sapiens
ccagagaaggtggagcttgtgt

SEQ ID NO: 8365498 - DNA, 22 bp, Homo sapiens
tcctgggcttcacagactctgt

SEQ ID NO: 8365499 - DNA, 22 bp, Homo sapiens
tcctgggcttgctcctccagct

SEQ ID NO: 8365500 - DNA, 22 bp, Homo sapiens
tcctgggcttcacagactctgt

SEQ ID NO: 8365501 - DNA, 22 bp, Homo sapiens
tcctgggctttgtttctctcct

SEQ ID NO: 8365502 - DNA, 22 bp, Homo sapiens
tccttgtaaaggagctctaaca

SEQ ID NO: 8365503 - DNA, 23 bp, Homo sapiens
tccttgggcctgcccagagtggt

SEQ ID NO: 8365504 - DNA, 22 bp, Homo sapiens
tccttggggtaactccagcctg

SEQ ID NO: 8365505 - DNA, 22 bp, Homo sapiens
tcccactcactgtctctgacac

SEQ ID NO: 8365506 - DNA, 22 bp, Homo sapiens
cattgtcacccaaagctcatag

SEQ ID NO: 8365507 - DNA, 22 bp, Homo sapiens
cattgtgtatttctgtagtact

SEQ ID NO: 8365508 - DNA, 22 bp, Homo sapiens
catttaaaggttgtgggtaaaa

SEQ ID NO: 8365509 - DNA, 22 bp, Homo sapiens
cattgttttgagaacaacctga

SEQ ID NO: 8365510 - DNA, 20 bp, Homo sapiens
tccctcctgcagatagagaa

SEQ ID NO: 8365511 - DNA, 22 bp, Homo sapiens
tccctcctggccgtcaccgctg

SEQ ID NO: 8365512 - DNA, 22 bp, Homo sapiens
tccctcctggccgtcaccgctg

SEQ ID NO: 8365513 - DNA, 22 bp, Homo sapiens
catttaatagatgctgtttcag

SEQ ID NO: 8365514 - DNA, 22 bp, Homo sapiens
tccctgggtcattctctggcac

SEQ ID NO: 8365515 - DNA, 22 bp, Homo sapiens
tccctggggttcctccagccac

SEQ ID NO: 8365516 - DNA, 22 bp, Homo sapiens
tccctggggtatcgctgaggca

SEQ ID NO: 8365517 - DNA, 22 bp, Homo sapiens
tccctgctttcttgtgagggga

SEQ ID NO: 8365518 - DNA, 22 bp, Homo sapiens
catttattctcagatccttgtc

SEQ ID NO: 8365519 - DNA, 22 bp, Homo sapiens
catttattgagtggccacagtg

SEQ ID NO: 8365520 - DNA, 22 bp, Homo sapiens
catttattcatgatctgtagct

SEQ ID NO: 8365521 - DNA, 22 bp, Homo sapiens
catttattcatgatctgtagct

SEQ ID NO: 8365522 - DNA, 22 bp, Homo sapiens
catttattcatgatctgtagct

SEQ ID NO: 8365523 - DNA, 22 bp, Homo sapiens
catttattcagctcagtcggtt

SEQ ID NO: 8365524 - DNA, 22 bp, Homo sapiens
tccctctctagcctgttcagta

SEQ ID NO: 8365525 - DNA, 22 bp, Homo sapiens
tcccacatgtgaatcctcaggt

SEQ ID NO: 8365526 - DNA, 22 bp, Homo sapiens
cattctgggtctggctcaggga

SEQ ID NO: 8365527 - DNA, 22 bp, Homo sapiens
cattctctgatcttcacatacc

SEQ ID NO: 8365528 - DNA, 22 bp, Homo sapiens
cattcttatatttactcattca

SEQ ID NO: 8365529 - DNA, 22 bp, Homo sapiens
cattcttatatttactcattca

SEQ ID NO: 8365530 - DNA, 21 bp, Homo sapiens
cattacatggttttagtgaac

SEQ ID NO: 8365531 - DNA, 22 bp, Homo sapiens
cattagaactaagatgtccagg

SEQ ID NO: 8365532 - DNA, 22 bp, Homo sapiens
cattagaagaacagttatatta

SEQ ID NO: 8365533 - DNA, 22 bp, Homo sapiens
cattagaattaggttgtttacc

SEQ ID NO: 8365534 - DNA, 22 bp, Homo sapiens
cattctcaatagtagatgagta

SEQ ID NO: 8365535 - DNA, 18 bp, Homo sapiens
cattagcaccacgtagag

SEQ ID NO: 8365536 - DNA, 22 bp, Homo sapiens
cattagcattacttcaaagagt

SEQ ID NO: 8365537 - DNA, 22 bp, Homo sapiens
cattagctatctgtttacatta

SEQ ID NO: 8365538 - DNA, 22 bp, Homo sapiens
cattaggtatttaagcacacag

SEQ ID NO: 8365539 - DNA, 22 bp, Homo sapiens
catgggcagttggcagggctca

SEQ ID NO: 8365540 - DNA, 22 bp, Homo sapiens
catgggcccgtgagaggcaggg

SEQ ID NO: 8365541 - DNA, 22 bp, Homo sapiens
tccatttaggttccactagtta

SEQ ID NO: 8365542 - DNA, 22 bp, Homo sapiens
tccattttcatctcatgtataa

SEQ ID NO: 8365543 - DNA, 21 bp, Homo sapiens
tccaggagcacgggactagga

SEQ ID NO: 8365544 - DNA, 22 bp, Homo sapiens
catgggaggttggcttggcatg

SEQ ID NO: 8365545 - DNA, 23 bp, Homo sapiens
catgggagtgagaatgccagctc

SEQ ID NO: 8365546 - DNA, 22 bp, Homo sapiens
tccaggagaggtgtggggactg

SEQ ID NO: 8365547 - DNA, 22 bp, Homo sapiens
tccaggagatacactgcaccag

SEQ ID NO: 8365548 - DNA, 19 bp, Homo sapiens
tgccacagataaaaactga

SEQ ID NO: 8365549 - DNA, 22 bp, Homo sapiens
tgccacagaggtgaagcccact

SEQ ID NO: 8365550 - DNA, 22 bp, Homo sapiens
tgccagctcccttttctcctcc

SEQ ID NO: 8365551 - DNA, 22 bp, Homo sapiens
tgccacagcagtgctttgacag

SEQ ID NO: 8365552 - DNA, 22 bp, Homo sapiens
tgccagctcccttttctcctcc

SEQ ID NO: 8365553 - DNA, 22 bp, Homo sapiens
tgccagctcctgcagctcctgt

SEQ ID NO: 8365554 - DNA, 22 bp, Homo sapiens
tgccaggagagtgcatgcaggg

SEQ ID NO: 8365555 - DNA, 22 bp, Homo sapiens
tgccaggaggaggtgggacaga

SEQ ID NO: 8365556 - DNA, 22 bp, Homo sapiens
tgccaggacaaggaccacatgg

SEQ ID NO: 8365557 - DNA, 22 bp, Homo sapiens
tgccaggaagtgtgtgggcctg

SEQ ID NO: 8365558 - DNA, 19 bp, Homo sapiens
tgccaggaatactccagaa

SEQ ID NO: 8365559 - DNA, 22 bp, Homo sapiens
tgccagcttttgactatcttag

SEQ ID NO: 8365560 - DNA, 22 bp, Homo sapiens
tgccagcttgtggtcagaggct

SEQ ID NO: 8365561 - DNA, 22 bp, Homo sapiens
tgccagcttgtggtcagaggct

SEQ ID NO: 8365562 - DNA, 22 bp, Homo sapiens
tgccagcttcttacggctgcct

SEQ ID NO: 8365563 - DNA, 21 bp, Homo sapiens
tgccagctgctgcatctgtct

SEQ ID NO: 8365564 - DNA, 21 bp, Homo sapiens
tgccagctgctgcatctgtct

SEQ ID NO: 8365565 - DNA, 22 bp, Homo sapiens
tgccagctgacagcagagacaa

SEQ ID NO: 8365566 - DNA, 22 bp, Homo sapiens
tgccagctgttcccacccaaaa

SEQ ID NO: 8365567 - DNA, 22 bp, Homo sapiens
tgccagctgcttgtcccccaca

SEQ ID NO: 8365568 - DNA, 22 bp, Homo sapiens
tgccagctgcttgtcccccaca

SEQ ID NO: 8365569 - DNA, 22 bp, Homo sapiens
cccaggagagaggccagttggc

SEQ ID NO: 8365570 - DNA, 22 bp, Homo sapiens
cccaggagagggaaccaaatgt

SEQ ID NO: 8365571 - DNA, 22 bp, Homo sapiens
cccaggagagaggggataaagc

SEQ ID NO: 8365572 - DNA, 22 bp, Homo sapiens
cccaggagacctagatctgttt

SEQ ID NO: 8365573 - DNA, 22 bp, Homo sapiens
tgccaggagtcaggccaggcag

SEQ ID NO: 8365574 - DNA, 22 bp, Homo sapiens
tgccaggagtgtagagtggttt

SEQ ID NO: 8365575 - DNA, 22 bp, Homo sapiens
tgccaggatataagagtgcgat

SEQ ID NO: 8365576 - DNA, 22 bp, Homo sapiens
cccaggagagagacttgaatct

SEQ ID NO: 8365577 - DNA, 22 bp, Homo sapiens
cccaggagagagacttgaatct

SEQ ID NO: 8365578 - DNA, 22 bp, Homo sapiens
tgccctgggctttgctatgact

SEQ ID NO: 8365579 - DNA, 22 bp, Homo sapiens
tgccctggggagcccagccagg

SEQ ID NO: 8365580 - DNA, 22 bp, Homo sapiens
cccaggctcagactggcttgtt

SEQ ID NO: 8365581 - DNA, 22 bp, Homo sapiens
tgcccagccagtttatggtaat

SEQ ID NO: 8365582 - DNA, 22 bp, Homo sapiens
tgcccagccagtttatggtaat

SEQ ID NO: 8365583 - DNA, 22 bp, Homo sapiens
tgcccagccaatttgttatgtt

SEQ ID NO: 8365584 - DNA, 22 bp, Homo sapiens
tgccatagcaatggtaagctga

SEQ ID NO: 8365585 - DNA, 22 bp, Homo sapiens
tgcccagcccctatccctggga

SEQ ID NO: 8365586 - DNA, 22 bp, Homo sapiens
tgcccagcccctatccctggga

SEQ ID NO: 8365587 - DNA, 22 bp, Homo sapiens
tgcccagcctaaacttggcaag

SEQ ID NO: 8365588 - DNA, 22 bp, Homo sapiens
tgcccagcctaaacttggcaag

SEQ ID NO: 8365589 - DNA, 22 bp, Homo sapiens
tgcccagcgcccacattctgtc

SEQ ID NO: 8365590 - DNA, 22 bp, Homo sapiens
tgcccagcgcccacattctgtc

SEQ ID NO: 8365591 - DNA, 22 bp, Homo sapiens
tgcccagctattcctttcttag

SEQ ID NO: 8365592 - DNA, 22 bp, Homo sapiens
tgcccagctattcctttcttag

SEQ ID NO: 8365593 - DNA, 22 bp, Homo sapiens
tgcccagctgtcaaagtagata

SEQ ID NO: 8365594 - DNA, 22 bp, Homo sapiens
tgcccagctgtcaaagtagata

SEQ ID NO: 8365595 - DNA, 22 bp, Homo sapiens
tgccctggttacactggagtcc

SEQ ID NO: 8365596 - DNA, 22 bp, Homo sapiens
tgccctggtagacacagactgt

SEQ ID NO: 8365597 - DNA, 22 bp, Homo sapiens
cccaggctggagggcagtgtca

SEQ ID NO: 8365598 - DNA, 21 bp, Homo sapiens
cccagggaagccgcagtcacc

SEQ ID NO: 8365599 - DNA, 23 bp, Homo sapiens
cccagggacacgatgacacctcc

SEQ ID NO: 8365600 - DNA, 23 bp, Homo sapiens
cccagggacacgatgacacctcc

SEQ ID NO: 8365601 - DNA, 22 bp, Homo sapiens
cccagggaagggctacctgagg

SEQ ID NO: 8365602 - DNA, 20 bp, Homo sapiens
cccaggggttgtggtgagga

SEQ ID NO: 8365603 - DNA, 20 bp, Homo sapiens
cccaggggttgtggtgagga

SEQ ID NO: 8365604 - DNA, 22 bp, Homo sapiens
cccaggggttctgagcagcagc

SEQ ID NO: 8365605 - DNA, 22 bp, Homo sapiens
cccaggggttctagaccagctt

SEQ ID NO: 8365606 - DNA, 22 bp, Homo sapiens
cccaggggttcaaggctgcagt

SEQ ID NO: 8365607 - DNA, 22 bp, Homo sapiens
tgccttcctggagctgaaggct

SEQ ID NO: 8365608 - DNA, 22 bp, Homo sapiens
cccagggattataaaggtgaaa

SEQ ID NO: 8365609 - DNA, 22 bp, Homo sapiens
cccagggattataaaggtgaaa

SEQ ID NO: 8365610 - DNA, 22 bp, Homo sapiens
tgccttcatccatgttatagtg

SEQ ID NO: 8365611 - DNA, 22 bp, Homo sapiens
cccagggacagatgggcagcta

SEQ ID NO: 8365612 - DNA, 22 bp, Homo sapiens
cccagggacagctaggtggggc

SEQ ID NO: 8365613 - DNA, 17 bp, Homo sapiens
cccagggaccactgctt

SEQ ID NO: 8365614 - DNA, 22 bp, Homo sapiens
ccccaccaccaaggctcagttt

SEQ ID NO: 8365615 - DNA, 22 bp, Homo sapiens
ccccaccagcaccctctctatc

SEQ ID NO: 8365616 - DNA, 22 bp, Homo sapiens
ccccacagccgccagcagggag

SEQ ID NO: 8365617 - DNA, 22 bp, Homo sapiens
ccccacagcttgtggagagaat

SEQ ID NO: 8365618 - DNA, 22 bp, Homo sapiens
ccccaccaccaaggctcagttt

SEQ ID NO: 8365619 - DNA, 22 bp, Homo sapiens
ccccacaggtgtctgaggcagg

SEQ ID NO: 8365620 - DNA, 22 bp, Homo sapiens
ccccaaggtgctcactgtctgg

SEQ ID NO: 8365621 - DNA, 22 bp, Homo sapiens
cccattcatcctcgcttccttc

SEQ ID NO: 8365622 - DNA, 22 bp, Homo sapiens
cccaggtctatgccagctctga

SEQ ID NO: 8365623 - DNA, 22 bp, Homo sapiens
cccaggtctatgccagctctga

SEQ ID NO: 8365624 - DNA, 22 bp, Homo sapiens
cccaggtctatgccagctctga

SEQ ID NO: 8365625 - DNA, 22 bp, Homo sapiens
cccaggtctccctgcagccctg

SEQ ID NO: 8365626 - DNA, 22 bp, Homo sapiens
cccaggtccccacctgtctgct

SEQ ID NO: 8365627 - DNA, 22 bp, Homo sapiens
cccaggtcccgccccagctcta

SEQ ID NO: 8365628 - DNA, 22 bp, Homo sapiens
cccaggtcccgccccagctcta

SEQ ID NO: 8365629 - DNA, 22 bp, Homo sapiens
cccaggtcccggggccagctgc

SEQ ID NO: 8365630 - DNA, 21 bp, Homo sapiens
cccaggtcgtggtcttcccag

SEQ ID NO: 8365631 - DNA, 22 bp, Homo sapiens
ccccaaaacttagtgacttaaa

SEQ ID NO: 8365632 - DNA, 22 bp, Homo sapiens
ccccaaaacttggtgacttcca

SEQ ID NO: 8365633 - DNA, 18 bp, Homo sapiens
ccccaaaagtcaccctgg

SEQ ID NO: 8365634 - DNA, 22 bp, Homo sapiens
ccccttccttcctcagacagcc

SEQ ID NO: 8365635 - DNA, 22 bp, Homo sapiens
tgctgggatatagcttctaggg

SEQ ID NO: 8365636 - DNA, 18 bp, Homo sapiens
cccggctaatttttggta

SEQ ID NO: 8365637 - DNA, 22 bp, Homo sapiens
cccgctccttacctgtccaacc

SEQ ID NO: 8365638 - DNA, 22 bp, Homo sapiens
ccccttctctgcaagcctgctc

SEQ ID NO: 8365639 - DNA, 22 bp, Homo sapiens
ccccttctgtgtcctgtcagcc

SEQ ID NO: 8365640 - DNA, 22 bp, Homo sapiens
tgctggctttagtgattggggt

SEQ ID NO: 8365641 - DNA, 23 bp, Homo sapiens
tgctggctaagaatctgcatttt

SEQ ID NO: 8365642 - DNA, 22 bp, Homo sapiens
tgctggctaatggaaaccagat

SEQ ID NO: 8365643 - DNA, 22 bp, Homo sapiens
tgctggctttctgtccctggca

SEQ ID NO: 8365644 - DNA, 22 bp, Homo sapiens
tgctggcttttccttcaggcag

SEQ ID NO: 8365645 - DNA, 23 bp, Homo sapiens
tgctggcttttatctggtcccta

SEQ ID NO: 8365646 - DNA, 22 bp, Homo sapiens
tggaatggggactttgggacat

SEQ ID NO: 8365647 - DNA, 22 bp, Homo sapiens
ccctcctgtgcctgaggccagc

SEQ ID NO: 8365648 - DNA, 22 bp, Homo sapiens
ccctccttaccaccacagctcc

SEQ ID NO: 8365649 - DNA, 22 bp, Homo sapiens
ccctctacagggaagcgctttc

SEQ ID NO: 8365650 - DNA, 22 bp, Homo sapiens
ccctcgctctaggcagccctgt

SEQ ID NO: 8365651 - DNA, 22 bp, Homo sapiens
ccctcctggaggcggatgccca

SEQ ID NO: 8365652 - DNA, 22 bp, Homo sapiens
ccctcctctccctaagagtcac

SEQ ID NO: 8365653 - DNA, 22 bp, Homo sapiens
ccctcctctccctaagagtcac

SEQ ID NO: 8365654 - DNA, 22 bp, Homo sapiens
tgctgtgtctttctgtgaaaag

SEQ ID NO: 8365655 - DNA, 22 bp, Homo sapiens
tgctgtgtggatgtgaagaatc

SEQ ID NO: 8365656 - DNA, 22 bp, Homo sapiens
tgctgtgttcctcagtttcatg

SEQ ID NO: 8365657 - DNA, 22 bp, Homo sapiens
tggaatggaaacaaactgagga

SEQ ID NO: 8365658 - DNA, 22 bp, Homo sapiens
tggaatggaaacaaactgagga

SEQ ID NO: 8365659 - DNA, 22 bp, Homo sapiens
tgctgtgtaaaaggtgattgaa

SEQ ID NO: 8365660 - DNA, 22 bp, Homo sapiens
tgctgtggttcccagagtggat

SEQ ID NO: 8365661 - DNA, 22 bp, Homo sapiens
tgctgtggattcagagatgaaa

SEQ ID NO: 8365662 - DNA, 22 bp, Homo sapiens
ccctgagcacacctggcagaca

SEQ ID NO: 8365663 - DNA, 22 bp, Homo sapiens
ccctgagcaacaaactgaatac

SEQ ID NO: 8365664 - DNA, 22 bp, Homo sapiens
ccctgagatgcctcaccctagt

SEQ ID NO: 8365665 - DNA, 22 bp, Homo sapiens
ccctgagcattcatgtgagctt

SEQ ID NO: 8365666 - DNA, 22 bp, Homo sapiens
ccctgagcattcatgtgagctt

SEQ ID NO: 8365667 - DNA, 22 bp, Homo sapiens
ccctgagccacacagagcaggt

SEQ ID NO: 8365668 - DNA, 22 bp, Homo sapiens
tggagcaggactgctgccctca

SEQ ID NO: 8365669 - DNA, 22 bp, Homo sapiens
tggagcaggactgctgccctca

SEQ ID NO: 8365670 - DNA, 22 bp, Homo sapiens
ccctgaggaaagggtggagggc

SEQ ID NO: 8365671 - DNA, 22 bp, Homo sapiens
ccctgaggaccaggaaggaggg

SEQ ID NO: 8365672 - DNA, 20 bp, Homo sapiens
ccctgagaccagagagcagc

SEQ ID NO: 8365673 - DNA, 22 bp, Homo sapiens
ccctgacccaaaactgtcagaa

SEQ ID NO: 8365674 - DNA, 22 bp, Homo sapiens
ccctgaccatcccgcactgact

SEQ ID NO: 8365675 - DNA, 22 bp, Homo sapiens
ccctgaaatcctgtgctctgtg

SEQ ID NO: 8365676 - DNA, 19 bp, Homo sapiens
ccctcttgcacaaagcaaa

SEQ ID NO: 8365677 - DNA, 19 bp, Homo sapiens
ccctcttgcacaaagcaaa

SEQ ID NO: 8365678 - DNA, 22 bp, Homo sapiens
cctcaggctctgggtgcctacc

SEQ ID NO: 8365679 - DNA, 22 bp, Homo sapiens
cctcaggctctgggtgcctacc

SEQ ID NO: 8365680 - DNA, 22 bp, Homo sapiens
cctcaggctagctactgtccct

SEQ ID NO: 8365681 - DNA, 22 bp, Homo sapiens
cctcaggcctgccagagcccca

SEQ ID NO: 8365682 - DNA, 22 bp, Homo sapiens
cctcaggcttcgtcttccaccc

SEQ ID NO: 8365683 - DNA, 22 bp, Homo sapiens
cctcaggcttacgggcaatgga

SEQ ID NO: 8365684 - DNA, 22 bp, Homo sapiens
cctcaggcttacgggcaatgga

SEQ ID NO: 8365685 - DNA, 22 bp, Homo sapiens
cctcagagttggccacgagagc

SEQ ID NO: 8365686 - DNA, 22 bp, Homo sapiens
tggcccagagcactgctgggca

SEQ ID NO: 8365687 - DNA, 19 bp, Homo sapiens
tggcccagatggtcctggg

SEQ ID NO: 8365688 - DNA, 19 bp, Homo sapiens
tggcccagatggtcctggg

SEQ ID NO: 8365689 - DNA, 22 bp, Homo sapiens
tggcccagatctctgaccttga

SEQ ID NO: 8365690 - DNA, 22 bp, Homo sapiens
tggcccagcagttctgccccag

SEQ ID NO: 8365691 - DNA, 22 bp, Homo sapiens
tggcccagcactccaagtaggg

SEQ ID NO: 8365692 - DNA, 20 bp, Homo sapiens
tggcccagcacgacgaggac

SEQ ID NO: 8365693 - DNA, 22 bp, Homo sapiens
cctcatctgtcatcctagggaa

SEQ ID NO: 8365694 - DNA, 20 bp, Homo sapiens
cctcatctcaagggcagtcc

SEQ ID NO: 8365695 - DNA, 22 bp, Homo sapiens
cctcagtgtgcagcagcatctg

SEQ ID NO: 8365696 - DNA, 22 bp, Homo sapiens
cctcatgttgctcgcatctgca

SEQ ID NO: 8365697 - DNA, 22 bp, Homo sapiens
cctcatgctgcatctctgaggt

SEQ ID NO: 8365698 - DNA, 22 bp, Homo sapiens
cctcatgagttcttctgcccat

SEQ ID NO: 8365699 - DNA, 19 bp, Homo sapiens
cctcatcttggtgtgtgca

SEQ ID NO: 8365700 - DNA, 18 bp, Homo sapiens
cctccaagtccccagcct

SEQ ID NO: 8365701 - DNA, 22 bp, Homo sapiens
tggctctgtcaaactgcacaca

SEQ ID NO: 8365702 - DNA, 22 bp, Homo sapiens
tggctctggtgcgggctcctgc

SEQ ID NO: 8365703 - DNA, 18 bp, Homo sapiens
cctagcctccaagctcat

SEQ ID NO: 8365704 - DNA, 21 bp, Homo sapiens
cctagcctcttacccagcttt

SEQ ID NO: 8365705 - DNA, 22 bp, Homo sapiens
cctagccttcggcctacccatc

SEQ ID NO: 8365706 - DNA, 22 bp, Homo sapiens
cctagccttcggcctacccatc

SEQ ID NO: 8365707 - DNA, 22 bp, Homo sapiens
cctagagctctgctttatctaa

SEQ ID NO: 8365708 - DNA, 22 bp, Homo sapiens
cctagaggctgcaaggagaggc

SEQ ID NO: 8365709 - DNA, 22 bp, Homo sapiens
tggcagaggctctgtgatgttg

SEQ ID NO: 8365710 - DNA, 22 bp, Homo sapiens
tggcagaggaggctcagattga

SEQ ID NO: 8365711 - DNA, 22 bp, Homo sapiens
cctcagaggtgtggcatctctg

SEQ ID NO: 8365712 - DNA, 22 bp, Homo sapiens
cctcagaggttctgtgtgggaa

SEQ ID NO: 8365713 - DNA, 21 bp, Homo sapiens
cctaggaggcttaattaggct

SEQ ID NO: 8365714 - DNA, 20 bp, Homo sapiens
cctaggcatgctgagtctcc

SEQ ID NO: 8365715 - DNA, 22 bp, Homo sapiens
tggcagggtgggcttcagcccc

SEQ ID NO: 8365716 - DNA, 22 bp, Homo sapiens
tggcagggttggccaccttacc

SEQ ID NO: 8365717 - DNA, 18 bp, Homo sapiens
tggagcaggtaggcatga

SEQ ID NO: 8365718 - DNA, 18 bp, Homo sapiens
tggagcaggtaggcatga

SEQ ID NO: 8365719 - DNA, 22 bp, Homo sapiens
tggagcaggcatctttctctct

SEQ ID NO: 8365720 - DNA, 22 bp, Homo sapiens
ccctgcagccttgcatgccttc

SEQ ID NO: 8365721 - DNA, 22 bp, Homo sapiens
cccttctttgtaataaagatta

SEQ ID NO: 8365722 - DNA, 22 bp, Homo sapiens
cccttccttgtgactggtgggg

SEQ ID NO: 8365723 - DNA, 22 bp, Homo sapiens
cccttctctttcactcactatt

SEQ ID NO: 8365724 - DNA, 22 bp, Homo sapiens
cccttcctgggtgtcccggagt

SEQ ID NO: 8365725 - DNA, 22 bp, Homo sapiens
cccttcctcaaggagctgtgtt

SEQ ID NO: 8365726 - DNA, 22 bp, Homo sapiens
cctcttccttctcactgtggaa

SEQ ID NO: 8365727 - DNA, 22 bp, Homo sapiens
cctcttctaggtttcagcctgc

SEQ ID NO: 8365728 - DNA, 19 bp, Homo sapiens
cctcttcctctgacactat

SEQ ID NO: 8365729 - DNA, 19 bp, Homo sapiens
cctcttcctctgacactat

SEQ ID NO: 8365730 - DNA, 17 bp, Homo sapiens
cctcttcctctcagctg

SEQ ID NO: 8365731 - DNA, 22 bp, Homo sapiens
tgggagtggggcatagaaggta

SEQ ID NO: 8365732 - DNA, 19 bp, Homo sapiens
tgggagtggggaaggtcct

SEQ ID NO: 8365733 - DNA, 19 bp, Homo sapiens
tgggagtggggaaggtcct

SEQ ID NO: 8365734 - DNA, 22 bp, Homo sapiens
tgggagtggggcatagaaggta

SEQ ID NO: 8365735 - DNA, 18 bp, Homo sapiens
tgggagtgggagtggata

SEQ ID NO: 8365736 - DNA, 18 bp, Homo sapiens
tgggagtgggagtggata

SEQ ID NO: 8365737 - DNA, 22 bp, Homo sapiens
cctgagcacacatcagaatcac

SEQ ID NO: 8365738 - DNA, 22 bp, Homo sapiens
tgggccagtttctcattgaaat

SEQ ID NO: 8365739 - DNA, 22 bp, Homo sapiens
tgggcccaagagagtctccaac

SEQ ID NO: 8365740 - DNA, 22 bp, Homo sapiens
cctgagcagggctctgcagggc

SEQ ID NO: 8365741 - DNA, 21 bp, Homo sapiens
tgggcccagctctgtctgttt

SEQ ID NO: 8365742 - DNA, 22 bp, Homo sapiens
tgggcccaagtgcaatgcagtg

SEQ ID NO: 8365743 - DNA, 22 bp, Homo sapiens
tgggcccacatgcctttctgcc

SEQ ID NO: 8365744 - DNA, 22 bp, Homo sapiens
tgggcccatcattgctgtgggc

SEQ ID NO: 8365745 - DNA, 22 bp, Homo sapiens
tgggctgcggataggcctcgga

SEQ ID NO: 8365746 - DNA, 22 bp, Homo sapiens
cctgagctagggaaggaagacc

SEQ ID NO: 8365747 - DNA, 22 bp, Homo sapiens
cctgagctcaagaaggtgacca

SEQ ID NO: 8365748 - DNA, 22 bp, Homo sapiens
cctgagctgaactaagcagttt

SEQ ID NO: 8365749 - DNA, 22 bp, Homo sapiens
cctgagctctgcactttttaga

SEQ ID NO: 8365750 - DNA, 22 bp, Homo sapiens
cctgagctccagtagcagccag

SEQ ID NO: 8365751 - DNA, 22 bp, Homo sapiens
cctgagctggaagagcttgtgc

SEQ ID NO: 8365752 - DNA, 22 bp, Homo sapiens
cctgagctggagacattacata

SEQ ID NO: 8365753 - DNA, 22 bp, Homo sapiens
cctgagctgcggggcagtgctc

SEQ ID NO: 8365754 - DNA, 17 bp, Homo sapiens
tggctctgtcctcagct

SEQ ID NO: 8365755 - DNA, 17 bp, Homo sapiens
tggctctgtcctcagct

SEQ ID NO: 8365756 - DNA, 22 bp, Homo sapiens
tggctggctagtgggcaggatt

SEQ ID NO: 8365757 - DNA, 18 bp, Homo sapiens
tggctggctctgtcatct

SEQ ID NO: 8365758 - DNA, 22 bp, Homo sapiens
tggctggctggaccacacctgc

SEQ ID NO: 8365759 - DNA, 22 bp, Homo sapiens
tggctgctagccagagcttcag

SEQ ID NO: 8365760 - DNA, 22 bp, Homo sapiens
tggctggctttcttgtatttac

SEQ ID NO: 8365761 - DNA, 20 bp, Homo sapiens
tggctggcttgtatttcctt

SEQ ID NO: 8365762 - DNA, 22 bp, Homo sapiens
tggctggcttgttcactgactg

SEQ ID NO: 8365763 - DNA, 22 bp, Homo sapiens
tggctggctgtcaaggaaagcc

SEQ ID NO: 8365764 - DNA, 22 bp, Homo sapiens
tggctggctgtcaaggaaagcc

SEQ ID NO: 8365765 - DNA, 22 bp, Homo sapiens
tggctggctgtcagtaggctgt

SEQ ID NO: 8365766 - DNA, 22 bp, Homo sapiens
tggctggctgtccagctgggca

SEQ ID NO: 8365767 - DNA, 22 bp, Homo sapiens
tggcttcattctgtagttaaaa

SEQ ID NO: 8365768 - DNA, 22 bp, Homo sapiens
tggcttcattcagcatgacagt

SEQ ID NO: 8365769 - DNA, 22 bp, Homo sapiens
tggcttcattcagcatgacagt

SEQ ID NO: 8365770 - DNA, 22 bp, Homo sapiens
tggcttcatggcaagtcttagt

SEQ ID NO: 8365771 - DNA, 22 bp, Homo sapiens
cctctggacttgggacagtgag

SEQ ID NO: 8365772 - DNA, 22 bp, Homo sapiens
tgggaaggacagaacataattg

SEQ ID NO: 8365773 - DNA, 22 bp, Homo sapiens
tgggaaggaatggtgattaata

SEQ ID NO: 8365774 - DNA, 22 bp, Homo sapiens
tgggaaggaactgcctttagct

SEQ ID NO: 8365775 - DNA, 22 bp, Homo sapiens
tgggaaggaactgcctttagct

SEQ ID NO: 8365776 - DNA, 22 bp, Homo sapiens
tgggaaggacgtgtcagtggca

SEQ ID NO: 8365777 - DNA, 22 bp, Homo sapiens
tgggaaggatacgttacaagat

SEQ ID NO: 8365778 - DNA, 22 bp, Homo sapiens
tgggaaggataccttggaacat

SEQ ID NO: 8365779 - DNA, 22 bp, Homo sapiens
tgggaaggcagtcactgtccta

SEQ ID NO: 8365780 - DNA, 22 bp, Homo sapiens
cctctgagtacagtgatggatt

SEQ ID NO: 8365781 - DNA, 22 bp, Homo sapiens
cctctgcccttttcctgtatca

SEQ ID NO: 8365782 - DNA, 21 bp, Homo sapiens
cctctgctcgggcatgcgttt

SEQ ID NO: 8365783 - DNA, 22 bp, Homo sapiens
cctctgctctggtccatgtgct

SEQ ID NO: 8365784 - DNA, 20 bp, Homo sapiens
cctctgcctttctagtctga

SEQ ID NO: 8365785 - DNA, 20 bp, Homo sapiens
cctctgcctttctagtctga

SEQ ID NO: 8365786 - DNA, 22 bp, Homo sapiens
tgcacacattctatggggctga

SEQ ID NO: 8365787 - DNA, 22 bp, Homo sapiens
tgcacacatgtatgtatatgtg

SEQ ID NO: 8365788 - DNA, 22 bp, Homo sapiens
tgcacacatgtttacaagcatc

SEQ ID NO: 8365789 - DNA, 22 bp, Homo sapiens
cccagacagtcaagaggcctgc

SEQ ID NO: 8365790 - DNA, 22 bp, Homo sapiens
cccagacataacagcagagagg

SEQ ID NO: 8365791 - DNA, 22 bp, Homo sapiens
cccagacataacagcagagagg

SEQ ID NO: 8365792 - DNA, 22 bp, Homo sapiens
cccagaaggcttgccaggaagc

SEQ ID NO: 8365793 - DNA, 22 bp, Homo sapiens
cccagaaggcttgccaggaagc

SEQ ID NO: 8365794 - DNA, 22 bp, Homo sapiens
cccagaaggctaagcgtggatt

SEQ ID NO: 8365795 - DNA, 22 bp, Homo sapiens
cccagaataggtaagcccaggg

SEQ ID NO: 8365796 - DNA, 22 bp, Homo sapiens
cccactgtggaagaaaggggag

SEQ ID NO: 8365797 - DNA, 22 bp, Homo sapiens
cccactgttgcctcaaatatca

SEQ ID NO: 8365798 - DNA, 22 bp, Homo sapiens
cccactgtgttgctgttaatct

SEQ ID NO: 8365799 - DNA, 22 bp, Homo sapiens
cccactgtgttgcagtctagtg

SEQ ID NO: 8365800 - DNA, 22 bp, Homo sapiens
cccactgttgcctcaaatatca

SEQ ID NO: 8365801 - DNA, 22 bp, Homo sapiens
cccactgtttccctgaggctct

SEQ ID NO: 8365802 - DNA, 22 bp, Homo sapiens
cccactgtttccctgaggctct

SEQ ID NO: 8365803 - DNA, 22 bp, Homo sapiens
tgcaaatagcctgatgaaagaa

SEQ ID NO: 8365804 - DNA, 22 bp, Homo sapiens
ccattgtaaagagtatactttg

SEQ ID NO: 8365805 - DNA, 22 bp, Homo sapiens
ccattgtaaagagtatactttg

SEQ ID NO: 8365806 - DNA, 23 bp, Homo sapiens
tgattttaaaaagtaagttatca

SEQ ID NO: 8365807 - DNA, 22 bp, Homo sapiens
tgattttacttagcatgatgtt

SEQ ID NO: 8365808 - DNA, 23 bp, Homo sapiens
tgattttaaaaagtaagttatca

SEQ ID NO: 8365809 - DNA, 23 bp, Homo sapiens
tgattttaaaaagtaagttatca

SEQ ID NO: 8365810 - DNA, 22 bp, Homo sapiens
ccattatccacgggcttcctga

SEQ ID NO: 8365811 - DNA, 22 bp, Homo sapiens
ccattatccattttgagtctta

SEQ ID NO: 8365812 - DNA, 22 bp, Homo sapiens
ccattaaagcaccactgtaata

SEQ ID NO: 8365813 - DNA, 22 bp, Homo sapiens
ccattaaaattgtgacatagga

SEQ ID NO: 8365814 - DNA, 22 bp, Homo sapiens
ccatgttggaacttcacattct

SEQ ID NO: 8365815 - DNA, 19 bp, Homo sapiens
ccattgtaaagaaaaatgt

SEQ ID NO: 8365816 - DNA, 20 bp, Homo sapiens
ccattctgggtgcagtctgg

SEQ ID NO: 8365817 - DNA, 22 bp, Homo sapiens
ccatggcctgaaggagtgcatc

SEQ ID NO: 8365818 - DNA, 22 bp, Homo sapiens
tgaggtcacctggaggcagcct

SEQ ID NO: 8365819 - DNA, 22 bp, Homo sapiens
ccatggcctgaaggagtgcatc

SEQ ID NO: 8365820 - DNA, 22 bp, Homo sapiens
ccatgtgttcaataagggagtt

SEQ ID NO: 8365821 - DNA, 22 bp, Homo sapiens
tgaggtagtttttcaagtattt

SEQ ID NO: 8365822 - DNA, 22 bp, Homo sapiens
tgaggtagtgcttgtcatgttt

SEQ ID NO: 8365823 - DNA, 22 bp, Homo sapiens
ccatgccttcctttccctggaa

SEQ ID NO: 8365824 - DNA, 22 bp, Homo sapiens
ccatgccttcctttccctggaa

SEQ ID NO: 8365825 - DNA, 22 bp, Homo sapiens
ccatgcccttgtcatctccagg

SEQ ID NO: 8365826 - DNA, 22 bp, Homo sapiens
ccatgctaggaactctcaggga

SEQ ID NO: 8365827 - DNA, 22 bp, Homo sapiens
ccatgctgaccctgtgcaggca

SEQ ID NO: 8365828 - DNA, 19 bp, Homo sapiens
ccatgccatcattttaaag

SEQ ID NO: 8365829 - DNA, 19 bp, Homo sapiens
ccatgccatcattttaaag

SEQ ID NO: 8365830 - DNA, 22 bp, Homo sapiens
ccagtgtttccgtcagtacacg

SEQ ID NO: 8365831 - DNA, 22 bp, Homo sapiens
tgagggctgacaggaggacagc

SEQ ID NO: 8365832 - DNA, 22 bp, Homo sapiens
tgagggctgacaggaggacagc

SEQ ID NO: 8365833 - DNA, 22 bp, Homo sapiens
tgagggctgcttccagagctag

SEQ ID NO: 8365834 - DNA, 22 bp, Homo sapiens
tgagggctgcttccagagctag

SEQ ID NO: 8365835 - DNA, 22 bp, Homo sapiens
tgagggctgtggaaggctaacc

SEQ ID NO: 8365836 - DNA, 22 bp, Homo sapiens
tgagggctgtggaaggctaacc

SEQ ID NO: 8365837 - DNA, 22 bp, Homo sapiens
tgagggccgaggagctgtgggt

SEQ ID NO: 8365838 - DNA, 20 bp, Homo sapiens
tgagggctaaccagactctg

SEQ ID NO: 8365839 - DNA, 22 bp, Homo sapiens
tgagggctaaattgtggcaggt

SEQ ID NO: 8365840 - DNA, 22 bp, Homo sapiens
tgagggctaaattgtggcaggt

SEQ ID NO: 8365841 - DNA, 23 bp, Homo sapiens
tgaggctgattgatttttgctca

SEQ ID NO: 8365842 - DNA, 22 bp, Homo sapiens
ccagtcctttgagccagttctg

SEQ ID NO: 8365843 - DNA, 22 bp, Homo sapiens
ccagtcctgtgtgaccctgcac

SEQ ID NO: 8365844 - DNA, 22 bp, Homo sapiens
ccagtcctgctccctgaccacc

SEQ ID NO: 8365845 - DNA, 22 bp, Homo sapiens
ccagtcctcagatggtctgtgc

SEQ ID NO: 8365846 - DNA, 20 bp, Homo sapiens
ccagtctctggccagcatca

SEQ ID NO: 8365847 - DNA, 22 bp, Homo sapiens
tgaggcagcattcttcaagaca

SEQ ID NO: 8365848 - DNA, 22 bp, Homo sapiens
tgaggcagcctgcattaaagag

SEQ ID NO: 8365849 - DNA, 22 bp, Homo sapiens
tgaggcagcccactttccttag

SEQ ID NO: 8365850 - DNA, 22 bp, Homo sapiens
ccaggctggagtgcaatggtgc

SEQ ID NO: 8365851 - DNA, 22 bp, Homo sapiens
ccaggctggagtgcagtagtgt

SEQ ID NO: 8365852 - DNA, 22 bp, Homo sapiens
tgaatgatgtataatattgaga

SEQ ID NO: 8365853 - DNA, 22 bp, Homo sapiens
ccagggcttcagttagtggtga

SEQ ID NO: 8365854 - DNA, 19 bp, Homo sapiens
ccagggctttaagttgagg

SEQ ID NO: 8365855 - DNA, 22 bp, Homo sapiens
ccaggggaaacagggagcactc

SEQ ID NO: 8365856 - DNA, 22 bp, Homo sapiens
ccagggctttgccaaagtccag

SEQ ID NO: 8365857 - DNA, 22 bp, Homo sapiens
tgacaagctttacagaattgaa

SEQ ID NO: 8365858 - DNA, 22 bp, Homo sapiens
tgagaaggaaacaatggctttt

SEQ ID NO: 8365859 - DNA, 22 bp, Homo sapiens
tgacatcagaatggcatagaaa

SEQ ID NO: 8365860 - DNA, 22 bp, Homo sapiens
tgaggcagaaattcctgttttc

SEQ ID NO: 8365861 - DNA, 22 bp, Homo sapiens
tgaggcagagtaagatacatga

SEQ ID NO: 8365862 - DNA, 22 bp, Homo sapiens
tgaggcagcaattgtattgtat

SEQ ID NO: 8365863 - DNA, 22 bp, Homo sapiens
tgaggcagcaattgattattca

SEQ ID NO: 8365864 - DNA, 22 bp, Homo sapiens
tgaggcagatatttattgggtt

SEQ ID NO: 8365865 - DNA, 17 bp, Homo sapiens
ccaggtgggaggtgggg

SEQ ID NO: 8365866 - DNA, 22 bp, Homo sapiens
tgagacatgtgaatatttgtac

SEQ ID NO: 8365867 - DNA, 22 bp, Homo sapiens
tgagacagttctgcagctgggt

SEQ ID NO: 8365868 - DNA, 22 bp, Homo sapiens
tgagaatagcagactggtaact

SEQ ID NO: 8365869 - DNA, 22 bp, Homo sapiens
tgagaatgccataagagctatt

SEQ ID NO: 8365870 - DNA, 22 bp, Homo sapiens
tgagaatatttgaagatgttag

SEQ ID NO: 8365871 - DNA, 22 bp, Homo sapiens
tgagaatcagctgcacagaggt

SEQ ID NO: 8365872 - DNA, 22 bp, Homo sapiens
ccaggggctctcagggtgtgtg

SEQ ID NO: 8365873 - DNA, 22 bp, Homo sapiens
tgagaagtgacattattgaatg

SEQ ID NO: 8365874 - DNA, 20 bp, Homo sapiens
tgagaaggggtcagctgtac

SEQ ID NO: 8365875 - DNA, 20 bp, Homo sapiens
tgagaaggggtcagctgtac

SEQ ID NO: 8365876 - DNA, 22 bp, Homo sapiens
ccagggtaccccaagggcaggt

SEQ ID NO: 8365877 - DNA, 17 bp, Homo sapiens
ccaggtggaatcgtgga

SEQ ID NO: 8365878 - DNA, 19 bp, Homo sapiens
ccaggtggaactgaggtag

SEQ ID NO: 8365879 - DNA, 22 bp, Homo sapiens
ccaggaggttgaggctgcagtg

SEQ ID NO: 8365880 - DNA, 22 bp, Homo sapiens
ccaggaggttgaggctgcagtg

SEQ ID NO: 8365881 - DNA, 22 bp, Homo sapiens
ccaggaggttgaggctgcagtg

SEQ ID NO: 8365882 - DNA, 22 bp, Homo sapiens
ccaggaggttgaggctgcagtg

SEQ ID NO: 8365883 - DNA, 22 bp, Homo sapiens
ccaggagggaccgcggcatccc

SEQ ID NO: 8365884 - DNA, 17 bp, Homo sapiens
ccaggagagatgcttgt

SEQ ID NO: 8365885 - DNA, 22 bp, Homo sapiens
ccaggagacccagggaaggagc

SEQ ID NO: 8365886 - DNA, 22 bp, Homo sapiens
ccaggagactgtactgatattt

SEQ ID NO: 8365887 - DNA, 22 bp, Homo sapiens
ccaggagactgtactgatattt

SEQ ID NO: 8365888 - DNA, 22 bp, Homo sapiens
tcttcacatggagaagcaactc

SEQ ID NO: 8365889 - DNA, 22 bp, Homo sapiens
tcttcacattcacgtaacatag

SEQ ID NO: 8365890 - DNA, 22 bp, Homo sapiens
tcttcacattttaagaagttct

SEQ ID NO: 8365891 - DNA, 22 bp, Homo sapiens
tcttcacattttaagaagttct

SEQ ID NO: 8365892 - DNA, 22 bp, Homo sapiens
tcttagaatgtcaactgatgtt

SEQ ID NO: 8365893 - DNA, 22 bp, Homo sapiens
tcttagaatgtcaactgatgtt

SEQ ID NO: 8365894 - DNA, 22 bp, Homo sapiens
ccaggatgacccccactttcct

SEQ ID NO: 8365895 - DNA, 22 bp, Homo sapiens
ccaggatggggagcagatagaa

SEQ ID NO: 8365896 - DNA, 22 bp, Homo sapiens
ccaggccagagtgcagtggcac

SEQ ID NO: 8365897 - DNA, 22 bp, Homo sapiens
ccaggccagcaggcacacctgc

SEQ ID NO: 8365898 - DNA, 22 bp, Homo sapiens
ccaggccagcctggagcatggc

SEQ ID NO: 8365899 - DNA, 22 bp, Homo sapiens
ccaggccagcgctggctggagg

SEQ ID NO: 8365900 - DNA, 21 bp, Homo sapiens
tcttccctcaggatgtcctgc

SEQ ID NO: 8365901 - DNA, 21 bp, Homo sapiens
tcttcccattatgttccaatt

SEQ ID NO: 8365902 - DNA, 22 bp, Homo sapiens
tcttcccattagtaatgaagtg

SEQ ID NO: 8365903 - DNA, 22 bp, Homo sapiens
tcttcccattagtaatgaagtg

SEQ ID NO: 8365904 - DNA, 22 bp, Homo sapiens
tcttcagataaagggagagtat

SEQ ID NO: 8365905 - DNA, 22 bp, Homo sapiens
tcttcagataaagggagagtat

SEQ ID NO: 8365906 - DNA, 22 bp, Homo sapiens
tcttcccagctgctgcgatgcc

SEQ ID NO: 8365907 - DNA, 22 bp, Homo sapiens
tcttcccagaggaggtgccagc

SEQ ID NO: 8365908 - DNA, 22 bp, Homo sapiens
tcttcccaatgcaaagtaggac

SEQ ID NO: 8365909 - DNA, 22 bp, Homo sapiens
tcttcagacccttagctgtgat

SEQ ID NO: 8365910 - DNA, 22 bp, Homo sapiens
tcttcagacccttagctgtgat

SEQ ID NO: 8365911 - DNA, 22 bp, Homo sapiens
tcttcagagcatttctgaggta

SEQ ID NO: 8365912 - DNA, 22 bp, Homo sapiens
ccaggcctggacgggtggcctg

SEQ ID NO: 8365913 - DNA, 22 bp, Homo sapiens
ccaggcctggccaggggatgcc

SEQ ID NO: 8365914 - DNA, 22 bp, Homo sapiens
tctttggctgcctgaagcccaa

SEQ ID NO: 8365915 - DNA, 22 bp, Homo sapiens
tctttggcttgtctcctcagtt

SEQ ID NO: 8365916 - DNA, 22 bp, Homo sapiens
tctttggctttgccacacccaa

SEQ ID NO: 8365917 - DNA, 22 bp, Homo sapiens
tctttggctttgccacacccaa

SEQ ID NO: 8365918 - DNA, 22 bp, Homo sapiens
tctttggccttaggagcccttg

SEQ ID NO: 8365919 - DNA, 22 bp, Homo sapiens
tctttggctatgatttactgtt

SEQ ID NO: 8365920 - DNA, 22 bp, Homo sapiens
tctttgggagaaggggtcccag

SEQ ID NO: 8365921 - DNA, 22 bp, Homo sapiens
ccaggctgctgttggtgtccgc

SEQ ID NO: 8365922 - DNA, 22 bp, Homo sapiens
tctttcttcagccctgtaagat

SEQ ID NO: 8365923 - DNA, 22 bp, Homo sapiens
tctttcttattatgctcaatgt

SEQ ID NO: 8365924 - DNA, 22 bp, Homo sapiens
tctttcttctttcatagtgtga

SEQ ID NO: 8365925 - DNA, 22 bp, Homo sapiens
tctttcttgtgggtgccctttt

SEQ ID NO: 8365926 - DNA, 22 bp, Homo sapiens
tctttcttggtattctgagcta

SEQ ID NO: 8365927 - DNA, 22 bp, Homo sapiens
ccaggcctgcattccctctcag

SEQ ID NO: 8365928 - DNA, 19 bp, Homo sapiens
ccaggcctgcgggcgttgg

SEQ ID NO: 8365929 - DNA, 22 bp, Homo sapiens
ccaggcctggaccatgccaggg

SEQ ID NO: 8365930 - DNA, 22 bp, Homo sapiens
ccaggcctgcatctgctgcgca

SEQ ID NO: 8365931 - DNA, 22 bp, Homo sapiens
ccaggccagtgtttggtccagg

SEQ ID NO: 8365932 - DNA, 22 bp, Homo sapiens
tctggcctatttctgtcagatc

SEQ ID NO: 8365933 - DNA, 22 bp, Homo sapiens
tctggcctatttctgtcagatc

SEQ ID NO: 8365934 - DNA, 22 bp, Homo sapiens
tctggcctatttctgtcagatc

SEQ ID NO: 8365935 - DNA, 22 bp, Homo sapiens
tctggccctgctgctgtgagca

SEQ ID NO: 8365936 - DNA, 22 bp, Homo sapiens
tctggcctcttgggatgctccc

SEQ ID NO: 8365937 - DNA, 22 bp, Homo sapiens
tctggcctgtgttggtggcccc

SEQ ID NO: 8365938 - DNA, 22 bp, Homo sapiens
tctggcctgggcctgccggtgc

SEQ ID NO: 8365939 - DNA, 22 bp, Homo sapiens
tctggcctgggcctgccggtgc

SEQ ID NO: 8365940 - DNA, 22 bp, Homo sapiens
tctggctatatgctggcttcca

SEQ ID NO: 8365941 - DNA, 22 bp, Homo sapiens
tctggctcaggtcagacaggga

SEQ ID NO: 8365942 - DNA, 22 bp, Homo sapiens
tctggctcaggtcagacaggga

SEQ ID NO: 8365943 - DNA, 22 bp, Homo sapiens
ccaggacagggagacgggagcc

SEQ ID NO: 8365944 - DNA, 22 bp, Homo sapiens
ccaggacctggagctctatgaa

SEQ ID NO: 8365945 - DNA, 22 bp, Homo sapiens
ccaggagaagcatctgagtgta

SEQ ID NO: 8365946 - DNA, 22 bp, Homo sapiens
ccaggagaagcatctgagtgta

SEQ ID NO: 8365947 - DNA, 20 bp, Homo sapiens
ccaggactgctggggactct

SEQ ID NO: 8365948 - DNA, 19 bp, Homo sapiens
tctggttcatttctgctgt

SEQ ID NO: 8365949 - DNA, 22 bp, Homo sapiens
ccaggacttcgaggctacagtg

SEQ ID NO: 8365950 - DNA, 20 bp, Homo sapiens
tctggtgccccttcctgaga

SEQ ID NO: 8365951 - DNA, 20 bp, Homo sapiens
tctggtgccccttcctgaga

SEQ ID NO: 8365952 - DNA, 22 bp, Homo sapiens
tctggtgtcaggctgtcctcgg

SEQ ID NO: 8365953 - DNA, 22 bp, Homo sapiens
tctggtcatcggaaagatcaaa

SEQ ID NO: 8365954 - DNA, 20 bp, Homo sapiens
tctggggatgaggtctagga

SEQ ID NO: 8365955 - DNA, 22 bp, Homo sapiens
tctggggatgaggtccagtgat

SEQ ID NO: 8365956 - DNA, 22 bp, Homo sapiens
tctgggagcagctcagcagatt

SEQ ID NO: 8365957 - DNA, 22 bp, Homo sapiens
tctgggagccatgccttggagt

SEQ ID NO: 8365958 - DNA, 22 bp, Homo sapiens
tctgggagcctgaaagtgaatg

SEQ ID NO: 8365959 - DNA, 22 bp, Homo sapiens
ccaggactcaattaacctcact

SEQ ID NO: 8365960 - DNA, 22 bp, Homo sapiens
ccaggactcaatgaccacaggg

SEQ ID NO: 8365961 - DNA, 21 bp, Homo sapiens
ccaggactccatggggtctct

SEQ ID NO: 8365962 - DNA, 22 bp, Homo sapiens
tctgggagcagatgatggtata

SEQ ID NO: 8365963 - DNA, 22 bp, Homo sapiens
tctgctattttctatctgtgtg

SEQ ID NO: 8365964 - DNA, 22 bp, Homo sapiens
ccagagactggctgagagatct

SEQ ID NO: 8365965 - DNA, 22 bp, Homo sapiens
tctgctttcaaattcacttagt

SEQ ID NO: 8365966 - DNA, 22 bp, Homo sapiens
ccagctctcagcgggagactca

SEQ ID NO: 8365967 - DNA, 21 bp, Homo sapiens
tctggaagaaaaaagtattat

SEQ ID NO: 8365968 - DNA, 18 bp, Homo sapiens
tctggaacaacttcatgt

SEQ ID NO: 8365969 - DNA, 20 bp, Homo sapiens
ccagctgcagttcttaatga

SEQ ID NO: 8365970 - DNA, 22 bp, Homo sapiens
ccagctgcatcctattcactgc

SEQ ID NO: 8365971 - DNA, 22 bp, Homo sapiens
ccagctgcatgacattaggtga

SEQ ID NO: 8365972 - DNA, 22 bp, Homo sapiens
ccagctgcaggggagcagtgga

SEQ ID NO: 8365973 - DNA, 22 bp, Homo sapiens
ccagctgcaggtgttccagatg

SEQ ID NO: 8365974 - DNA, 22 bp, Homo sapiens
ccagctgcaggggagcagtgga

SEQ ID NO: 8365975 - DNA, 22 bp, Homo sapiens
ccagctgcagaatgttggggaa

SEQ ID NO: 8365976 - DNA, 22 bp, Homo sapiens
ccagctctgcagggcctggggt

SEQ ID NO: 8365977 - DNA, 22 bp, Homo sapiens
ccagctctgattttgacctcca

SEQ ID NO: 8365978 - DNA, 22 bp, Homo sapiens
ccagctgctaacacaaaggagt

SEQ ID NO: 8365979 - DNA, 22 bp, Homo sapiens
ccagctgcggtctcccaaagtt

SEQ ID NO: 8365980 - DNA, 22 bp, Homo sapiens
ccagctgcgggcatcgagagtt

SEQ ID NO: 8365981 - DNA, 22 bp, Homo sapiens
ccagctgctatcatgccatttc

SEQ ID NO: 8365982 - DNA, 17 bp, Homo sapiens
ccagctgctccctcaga

SEQ ID NO: 8365983 - DNA, 21 bp, Homo sapiens
ccagctgctccttgaggttcc

SEQ ID NO: 8365984 - DNA, 22 bp, Homo sapiens
ccagctgcccactatgtgttct

SEQ ID NO: 8365985 - DNA, 22 bp, Homo sapiens
ccagctgcccaagaggcatcct

SEQ ID NO: 8365986 - DNA, 18 bp, Homo sapiens
ccagctgcgctgaaccga

SEQ ID NO: 8365987 - DNA, 22 bp, Homo sapiens
ccagctgcctaagcaatccata

SEQ ID NO: 8365988 - DNA, 21 bp, Homo sapiens
ccagctgcctgcactttggac

SEQ ID NO: 8365989 - DNA, 22 bp, Homo sapiens
ccagctgctgtgcagggaggct

SEQ ID NO: 8365990 - DNA, 22 bp, Homo sapiens
ccagctgctgtgcagggaggct

SEQ ID NO: 8365991 - DNA, 22 bp, Homo sapiens
ccagctgcttgggaaaatgtct

SEQ ID NO: 8365992 - DNA, 22 bp, Homo sapiens
tctggaggccatagggaaggat

SEQ ID NO: 8365993 - DNA, 22 bp, Homo sapiens
ccagctgctctcttctccgcca

SEQ ID NO: 8365994 - DNA, 22 bp, Homo sapiens
ccagctgctgacatgggcaggt

SEQ ID NO: 8365995 - DNA, 22 bp, Homo sapiens
ccagctgctgtgaggaccacag

SEQ ID NO: 8365996 - DNA, 22 bp, Homo sapiens
ccagctgctgcaccgtgcatgg

SEQ ID NO: 8365997 - DNA, 22 bp, Homo sapiens
ttttctaatttagttaccctcc

SEQ ID NO: 8365998 - DNA, 22 bp, Homo sapiens
ttttctatctcctagaactgcc

SEQ ID NO: 8365999 - DNA, 22 bp, Homo sapiens
ttttctatctcctagaactgcc

SEQ ID NO: 8366000 - DNA, 22 bp, Homo sapiens
ttttcttctacctgctgtccaa

SEQ ID NO: 8366001 - DNA, 22 bp, Homo sapiens
ttttcttctacctgctgtccaa

SEQ ID NO: 8366002 - DNA, 22 bp, Homo sapiens
ttttctattaactcattttgca

SEQ ID NO: 8366003 - DNA, 22 bp, Homo sapiens
ttttctattaactcattttgca

SEQ ID NO: 8366004 - DNA, 22 bp, Homo sapiens
ttttcttctacctgctgtccaa

SEQ ID NO: 8366005 - DNA, 22 bp, Homo sapiens
ttttgaaagagtcctgctacag

SEQ ID NO: 8366006 - DNA, 23 bp, Homo sapiens
ttttcctttggacaggctgtatt

SEQ ID NO: 8366007 - DNA, 22 bp, Homo sapiens
ttttatctgcttcattagttga

SEQ ID NO: 8366008 - DNA, 22 bp, Homo sapiens
ttttatctacctatgctcattt

SEQ ID NO: 8366009 - DNA, 22 bp, Homo sapiens
ttttatctacctatgctcattt

SEQ ID NO: 8366010 - DNA, 22 bp, Homo sapiens
ttttatcattacccagctgaaa

SEQ ID NO: 8366011 - DNA, 22 bp, Homo sapiens
ttttatctgtgacatctggcag

SEQ ID NO: 8366012 - DNA, 22 bp, Homo sapiens
ttttatgaagataattttctga

SEQ ID NO: 8366013 - DNA, 19 bp, Homo sapiens
ttttccttctcctcttaat

SEQ ID NO: 8366014 - DNA, 22 bp, Homo sapiens
ttttgaaagccaggtttgtatg

SEQ ID NO: 8366015 - DNA, 22 bp, Homo sapiens
ttttgaaagccaggtttgtatg

SEQ ID NO: 8366016 - DNA, 22 bp, Homo sapiens
ttttgaaagggtgatttggctt

SEQ ID NO: 8366017 - DNA, 22 bp, Homo sapiens
ttttggaatgaggaacatccag

SEQ ID NO: 8366018 - DNA, 22 bp, Homo sapiens
ttttggaatctgggaaaacagt

SEQ ID NO: 8366019 - DNA, 22 bp, Homo sapiens
ttttggaatttatacagtaatg

SEQ ID NO: 8366020 - DNA, 22 bp, Homo sapiens
ttttggaatttatacagtaatg

SEQ ID NO: 8366021 - DNA, 22 bp, Homo sapiens
ttttggaatttatacagtaatg

SEQ ID NO: 8366022 - DNA, 22 bp, Homo sapiens
ttttgccgaaggtatctgagat

SEQ ID NO: 8366023 - DNA, 22 bp, Homo sapiens
ttttgcaaagtacattatcagg

SEQ ID NO: 8366024 - DNA, 22 bp, Homo sapiens
ttttgatatcatgatgaacaga

SEQ ID NO: 8366025 - DNA, 22 bp, Homo sapiens
ttttggcactttgtctgattct

SEQ ID NO: 8366026 - DNA, 22 bp, Homo sapiens
ttttggcagcaggtatggggca

SEQ ID NO: 8366027 - DNA, 22 bp, Homo sapiens
tttttcatgagactagaagtca

SEQ ID NO: 8366028 - DNA, 22 bp, Homo sapiens
tttttcatctgattgataactc

SEQ ID NO: 8366029 - DNA, 22 bp, Homo sapiens
ttttggctctgtctgtatcttt

SEQ ID NO: 8366030 - DNA, 22 bp, Homo sapiens
ttttggctctgcaggtttgcac

SEQ ID NO: 8366031 - DNA, 22 bp, Homo sapiens
ttttggctccagtggtttgtgc

SEQ ID NO: 8366032 - DNA, 22 bp, Homo sapiens
tttttcctagtgctttctggta

SEQ ID NO: 8366033 - DNA, 22 bp, Homo sapiens
tttttccttaggggttactcac

SEQ ID NO: 8366034 - DNA, 22 bp, Homo sapiens
tttttcctagcgatttgtcagc

SEQ ID NO: 8366035 - DNA, 22 bp, Homo sapiens
tttttcctagcgatttgtcagc

SEQ ID NO: 8366036 - DNA, 22 bp, Homo sapiens
tttttccaccgtacttcctgag

SEQ ID NO: 8366037 - DNA, 22 bp, Homo sapiens
tttttcctaagcagtggagctg

SEQ ID NO: 8366038 - DNA, 20 bp, Homo sapiens
tttttccttctctacaggca

SEQ ID NO: 8366039 - DNA, 22 bp, Homo sapiens
tttttccttggatgtgtctctc

SEQ ID NO: 8366040 - DNA, 22 bp, Homo sapiens
tttttctactgcccacattgta

SEQ ID NO: 8366041 - DNA, 22 bp, Homo sapiens
tttttctaatggcttaggatgt

SEQ ID NO: 8366042 - DNA, 22 bp, Homo sapiens
tttttctaatggcttaggatgt

SEQ ID NO: 8366043 - DNA, 22 bp, Homo sapiens
tttttgaaggctgatgtgatta

SEQ ID NO: 8366044 - DNA, 22 bp, Homo sapiens
tttttctactggtgttggtgta

SEQ ID NO: 8366045 - DNA, 22 bp, Homo sapiens
tttttgctaatccccagccact

SEQ ID NO: 8366046 - DNA, 22 bp, Homo sapiens
tttttgcaccaacctaatagaa

SEQ ID NO: 8366047 - DNA, 22 bp, Homo sapiens
ttttatcaatcattaagacatt

SEQ ID NO: 8366048 - DNA, 22 bp, Homo sapiens
ttttatcaatcattaagacatt

SEQ ID NO: 8366049 - DNA, 22 bp, Homo sapiens
ttttatcagcagggataacaag

SEQ ID NO: 8366050 - DNA, 22 bp, Homo sapiens
ttttatatggcacattggttgg

SEQ ID NO: 8366051 - DNA, 22 bp, Homo sapiens
ttttatattgagtgagagttcc

SEQ ID NO: 8366052 - DNA, 22 bp, Homo sapiens
ttttatagctgaatagtattcc

SEQ ID NO: 8366053 - DNA, 22 bp, Homo sapiens
ttttatacttaagacagagttt

SEQ ID NO: 8366054 - DNA, 22 bp, Homo sapiens
ttttataagcaagaaagggaaa

SEQ ID NO: 8366055 - DNA, 22 bp, Homo sapiens
tttgtttgaaagtctctacagc

SEQ ID NO: 8366056 - DNA, 22 bp, Homo sapiens
tttgtttagatggtaaatcagt

SEQ ID NO: 8366057 - DNA, 22 bp, Homo sapiens
tttgtttactcattcattgatg

SEQ ID NO: 8366058 - DNA, 22 bp, Homo sapiens
tttgtttagagaattgaagcag

SEQ ID NO: 8366059 - DNA, 22 bp, Homo sapiens
ttttagaagtgcctatcctatg

SEQ ID NO: 8366060 - DNA, 22 bp, Homo sapiens
tttgttttgaactagctcagaa

SEQ ID NO: 8366061 - DNA, 22 bp, Homo sapiens
tttgttttctgtaggcctttcc

SEQ ID NO: 8366062 - DNA, 22 bp, Homo sapiens
tttgttttcaatgtgtcattca

SEQ ID NO: 8366063 - DNA, 22 bp, Homo sapiens
tttgttttcaatgtgtcattca

SEQ ID NO: 8366064 - DNA, 22 bp, Homo sapiens
tttgttcagctctcattgatta

SEQ ID NO: 8366065 - DNA, 22 bp, Homo sapiens
tttgttctgaagcaagtaggga

SEQ ID NO: 8366066 - DNA, 22 bp, Homo sapiens
tttgttctgcatcacagaaaaa

SEQ ID NO: 8366067 - DNA, 22 bp, Homo sapiens
tttgtttacaaaaataagcagt

SEQ ID NO: 8366068 - DNA, 22 bp, Homo sapiens
tttgtttacaaaaataagcagt

SEQ ID NO: 8366069 - DNA, 22 bp, Homo sapiens
tttgtacttcattggttctact

SEQ ID NO: 8366070 - DNA, 22 bp, Homo sapiens
tttgtagagaatgttaagcact

SEQ ID NO: 8366071 - DNA, 22 bp, Homo sapiens
tttgtactgttgaaattgctgg

SEQ ID NO: 8366072 - DNA, 22 bp, Homo sapiens
tttgtactggaagaacatgcaa

SEQ ID NO: 8366073 - DNA, 22 bp, Homo sapiens
tttgtactgaagattgtaaact

SEQ ID NO: 8366074 - DNA, 22 bp, Homo sapiens
tttgtacatttcactccattgt

SEQ ID NO: 8366075 - DNA, 22 bp, Homo sapiens
tttgtactctcagaattcagaa

SEQ ID NO: 8366076 - DNA, 22 bp, Homo sapiens
tttgtagttgtggatgctgaag

SEQ ID NO: 8366077 - DNA, 22 bp, Homo sapiens
tttgtagcagcatgatttataa

SEQ ID NO: 8366078 - DNA, 22 bp, Homo sapiens
tttgtataagaacattctagca

SEQ ID NO: 8366079 - DNA, 22 bp, Homo sapiens
tttgtataaattggagcaatgt

SEQ ID NO: 8366080 - DNA, 22 bp, Homo sapiens
tttgtataagaacattctagca

SEQ ID NO: 8366081 - DNA, 22 bp, Homo sapiens
tttgtataagaacattctagca

SEQ ID NO: 8366082 - DNA, 22 bp, Homo sapiens
tttgcagaagaaaacatgaaca

SEQ ID NO: 8366083 - DNA, 22 bp, Homo sapiens
tttgcacacacaataacaaatg

SEQ ID NO: 8366084 - DNA, 22 bp, Homo sapiens
tttgcacacattcttagaaatg

SEQ ID NO: 8366085 - DNA, 22 bp, Homo sapiens
tttgcacagcctttctggctgc

SEQ ID NO: 8366086 - DNA, 22 bp, Homo sapiens
tttgcagagtgcagaagcatct

SEQ ID NO: 8366087 - DNA, 22 bp, Homo sapiens
tttgcagcaaggagagagcatt

SEQ ID NO: 8366088 - DNA, 22 bp, Homo sapiens
tttgcaagaagaatggcacaaa

SEQ ID NO: 8366089 - DNA, 22 bp, Homo sapiens
tttctttatcctcctttgcaca

SEQ ID NO: 8366090 - DNA, 22 bp, Homo sapiens
tttctttatcctcctttgcaca

SEQ ID NO: 8366091 - DNA, 22 bp, Homo sapiens
tttctttccatacatattgcta

SEQ ID NO: 8366092 - DNA, 22 bp, Homo sapiens
tttgatttactggatattctca

SEQ ID NO: 8366093 - DNA, 22 bp, Homo sapiens
tttctttctcgtaaacttagtt

SEQ ID NO: 8366094 - DNA, 22 bp, Homo sapiens
tttgcaaatgaagctctgagga

SEQ ID NO: 8366095 - DNA, 22 bp, Homo sapiens
tttgattttcagcaatagtggc

SEQ ID NO: 8366096 - DNA, 22 bp, Homo sapiens
tttgattttcagcaatagtggc

SEQ ID NO: 8366097 - DNA, 20 bp, Homo sapiens
tttgatttcacaaggccagt

SEQ ID NO: 8366098 - DNA, 22 bp, Homo sapiens
tttgatttactggatattctca

SEQ ID NO: 8366099 - DNA, 22 bp, Homo sapiens
tttggcaggtagtcccaaaggg

SEQ ID NO: 8366100 - DNA, 19 bp, Homo sapiens
tttggcaggagataggatg

SEQ ID NO: 8366101 - DNA, 22 bp, Homo sapiens
tttggcagcttccatattcact

SEQ ID NO: 8366102 - DNA, 22 bp, Homo sapiens
tttggcagagtgtgggcatttg

SEQ ID NO: 8366103 - DNA, 22 bp, Homo sapiens
tttggcagatgaccctcaagtt

SEQ ID NO: 8366104 - DNA, 22 bp, Homo sapiens
tttggcagcacccgccatctat

SEQ ID NO: 8366105 - DNA, 19 bp, Homo sapiens
tttggcagcattaatatca

SEQ ID NO: 8366106 - DNA, 22 bp, Homo sapiens
tttggcagctaaggcagctcgc

SEQ ID NO: 8366107 - DNA, 22 bp, Homo sapiens
tttggcagctctacctttttat

SEQ ID NO: 8366108 - DNA, 22 bp, Homo sapiens
tttggcagctcttgactgttct

SEQ ID NO: 8366109 - DNA, 22 bp, Homo sapiens
tttggcagaaataagtggggca

SEQ ID NO: 8366110 - DNA, 22 bp, Homo sapiens
tttggcagagtaaggcctgctt

SEQ ID NO: 8366111 - DNA, 22 bp, Homo sapiens
tttggcagagtcatttcagaaa

SEQ ID NO: 8366112 - DNA, 22 bp, Homo sapiens
tttggcagaggttgtcaggcca

SEQ ID NO: 8366113 - DNA, 22 bp, Homo sapiens
tttggcagaggaagaaggcaca

SEQ ID NO: 8366114 - DNA, 22 bp, Homo sapiens
tttggcagaattgatggtcctt

SEQ ID NO: 8366115 - DNA, 23 bp, Homo sapiens
tttggcagaagcacattattgtg

SEQ ID NO: 8366116 - DNA, 22 bp, Homo sapiens
tttggagtttaacaacttgaag

SEQ ID NO: 8366117 - DNA, 22 bp, Homo sapiens
tttggagatagggcctagcaat

SEQ ID NO: 8366118 - DNA, 22 bp, Homo sapiens
tttggaggggaagaccttggag

SEQ ID NO: 8366119 - DNA, 22 bp, Homo sapiens
tttggagagcagctaggccctt

SEQ ID NO: 8366120 - DNA, 22 bp, Homo sapiens
tttggagaaatggctgatcaaa

SEQ ID NO: 8366121 - DNA, 22 bp, Homo sapiens
tttggagaaatggctgatcaaa

SEQ ID NO: 8366122 - DNA, 22 bp, Homo sapiens
tttggaaggtgaggcatgaagg

SEQ ID NO: 8366123 - DNA, 22 bp, Homo sapiens
tttggaagacagggcaggaaag

SEQ ID NO: 8366124 - DNA, 22 bp, Homo sapiens
tttcttctcgacaccttatccc

SEQ ID NO: 8366125 - DNA, 22 bp, Homo sapiens
tttcttctcacccaggacagag

SEQ ID NO: 8366126 - DNA, 22 bp, Homo sapiens
tttcttcctgctttgtcccatg

SEQ ID NO: 8366127 - DNA, 22 bp, Homo sapiens
tttcttcctggattcctacttc

SEQ ID NO: 8366128 - DNA, 22 bp, Homo sapiens
tttctttatcatagcatctttg

SEQ ID NO: 8366129 - DNA, 22 bp, Homo sapiens
tttctttatcctcctttgcaca

SEQ ID NO: 8366130 - DNA, 22 bp, Homo sapiens
tttctttatcatagcatctttg

SEQ ID NO: 8366131 - DNA, 22 bp, Homo sapiens
tttctttaattctcacagcaat

SEQ ID NO: 8366132 - DNA, 22 bp, Homo sapiens
tttctttaaaggaactctgttt

SEQ ID NO: 8366133 - DNA, 23 bp, Homo sapiens
tttctgttgggtatatatccaag

SEQ ID NO: 8366134 - DNA, 23 bp, Homo sapiens
tttctgttgggtatatatccaag

SEQ ID NO: 8366135 - DNA, 22 bp, Homo sapiens
tttctgttgtacttaaactagg

SEQ ID NO: 8366136 - DNA, 22 bp, Homo sapiens
tttctgttgtacttaaactagg

SEQ ID NO: 8366137 - DNA, 21 bp, Homo sapiens
tttcttatctgtaaagtggga

SEQ ID NO: 8366138 - DNA, 22 bp, Homo sapiens
tttctgtattttgtcataacct

SEQ ID NO: 8366139 - DNA, 22 bp, Homo sapiens
tttcttatgagcaagactctat

SEQ ID NO: 8366140 - DNA, 22 bp, Homo sapiens
tttcttatggggtagtccttta

SEQ ID NO: 8366141 - DNA, 22 bp, Homo sapiens
tttcttcagagagagctttccc

SEQ ID NO: 8366142 - DNA, 22 bp, Homo sapiens
tttcttcagcaggtttgtgaga

SEQ ID NO: 8366143 - DNA, 22 bp, Homo sapiens
tttcttccccactgcaggctct

SEQ ID NO: 8366144 - DNA, 19 bp, Homo sapiens
tttcttccaaagactatgg

SEQ ID NO: 8366145 - DNA, 22 bp, Homo sapiens
tttcttccaaaggcacgttctc

SEQ ID NO: 8366146 - DNA, 22 bp, Homo sapiens
tttcttccaaaggcacgttctc

SEQ ID NO: 8366147 - DNA, 22 bp, Homo sapiens
tttcttcagccactccaaactg

SEQ ID NO: 8366148 - DNA, 22 bp, Homo sapiens
tttcttcatagaccttgtcttg

SEQ ID NO: 8366149 - DNA, 22 bp, Homo sapiens
tttctgaaaactgaagtagtgc

SEQ ID NO: 8366150 - DNA, 22 bp, Homo sapiens
tttctctttggaggggctgaat

SEQ ID NO: 8366151 - DNA, 22 bp, Homo sapiens
tttctctttcaatctgcagtac

SEQ ID NO: 8366152 - DNA, 22 bp, Homo sapiens
tttctctttgacaggaatcaga

SEQ ID NO: 8366153 - DNA, 22 bp, Homo sapiens
tttctctttgacaggaatcaga

SEQ ID NO: 8366154 - DNA, 22 bp, Homo sapiens
tttctcttgcgatatgctacac

SEQ ID NO: 8366155 - DNA, 22 bp, Homo sapiens
tttctcttcactgtgtgcctca

SEQ ID NO: 8366156 - DNA, 22 bp, Homo sapiens
tttctcttcactgtgtgcctca

SEQ ID NO: 8366157 - DNA, 22 bp, Homo sapiens
tttctgaaaactgaagtagtgc

SEQ ID NO: 8366158 - DNA, 22 bp, Homo sapiens
tttctgaaacatggtctttgta

SEQ ID NO: 8366159 - DNA, 22 bp, Homo sapiens
tttctgaaacatggtctttgta

SEQ ID NO: 8366160 - DNA, 22 bp, Homo sapiens
tttctgaaatctcttttgagga

SEQ ID NO: 8366161 - DNA, 22 bp, Homo sapiens
tttctgaaatgctggctttgga

SEQ ID NO: 8366162 - DNA, 22 bp, Homo sapiens
tttctgaacaaagccattatca

SEQ ID NO: 8366163 - DNA, 22 bp, Homo sapiens
tttctgaaatctcttttgagga

SEQ ID NO: 8366164 - DNA, 22 bp, Homo sapiens
tttctgaagatacagctttgct

SEQ ID NO: 8366165 - DNA, 22 bp, Homo sapiens
tttctgaagatacagctttgct

SEQ ID NO: 8366166 - DNA, 22 bp, Homo sapiens
tttctgaacttggtactggagc

SEQ ID NO: 8366167 - DNA, 21 bp, Homo sapiens
tttctgaaggcaacatctatc

SEQ ID NO: 8366168 - DNA, 21 bp, Homo sapiens
tttctgaaggcaacatctatc

SEQ ID NO: 8366169 - DNA, 21 bp, Homo sapiens
tttctgaaggcaacatctatc

SEQ ID NO: 8366170 - DNA, 22 bp, Homo sapiens
tttctcttaatgtctctgtgct

SEQ ID NO: 8366171 - DNA, 22 bp, Homo sapiens
tttctctggcctcagtttaaca

SEQ ID NO: 8366172 - DNA, 22 bp, Homo sapiens
tttctcctctccagagtgcagt

SEQ ID NO: 8366173 - DNA, 22 bp, Homo sapiens
tttctcctgagttccacgctac

SEQ ID NO: 8366174 - DNA, 22 bp, Homo sapiens
tttctcctgctagaacaaggag

SEQ ID NO: 8366175 - DNA, 22 bp, Homo sapiens
tttctgcatgcatttaattaaa

SEQ ID NO: 8366176 - DNA, 17 bp, Homo sapiens
tttctgcatgattggac

SEQ ID NO: 8366177 - DNA, 22 bp, Homo sapiens
tttctgactccagagaggaata

SEQ ID NO: 8366178 - DNA, 22 bp, Homo sapiens
tttctgataattttgtgaaatc

SEQ ID NO: 8366179 - DNA, 22 bp, Homo sapiens
tttctgctcgctctcaatcagg

SEQ ID NO: 8366180 - DNA, 22 bp, Homo sapiens
tttctgcccccgagggcggtgc

SEQ ID NO: 8366181 - DNA, 22 bp, Homo sapiens
tttctgcatttacaaaatgagg

SEQ ID NO: 8366182 - DNA, 22 bp, Homo sapiens
tttctgcatttacaaaatgagg

SEQ ID NO: 8366183 - DNA, 22 bp, Homo sapiens
tttctgaaggttaaggaattag

SEQ ID NO: 8366184 - DNA, 22 bp, Homo sapiens
tttctgaaggttaaggaattag

SEQ ID NO: 8366185 - DNA, 22 bp, Homo sapiens
tttctgaagggcagcagactct

SEQ ID NO: 8366186 - DNA, 23 bp, Homo sapiens
tttctgaagttgagatggacttt

SEQ ID NO: 8366187 - DNA, 23 bp, Homo sapiens
tttctgaagttgagatggacttt

SEQ ID NO: 8366188 - DNA, 22 bp, Homo sapiens
tttctgaagtcttctaacagat

SEQ ID NO: 8366189 - DNA, 18 bp, Homo sapiens
tttctgaatgtctatttc

SEQ ID NO: 8366190 - DNA, 22 bp, Homo sapiens
tttctgaattcctaggatgttg

SEQ ID NO: 8366191 - DNA, 22 bp, Homo sapiens
tttctgaataactctatgatat

SEQ ID NO: 8366192 - DNA, 22 bp, Homo sapiens
tttctgaatttactcaaggtca

SEQ ID NO: 8366193 - DNA, 22 bp, Homo sapiens
tttctgctgtgtaaaatgaggg

SEQ ID NO: 8366194 - DNA, 22 bp, Homo sapiens
tttctgctgtgctttcttgcgt

SEQ ID NO: 8366195 - DNA, 22 bp, Homo sapiens
tttctgctttcagagtgagaca

SEQ ID NO: 8366196 - DNA, 22 bp, Homo sapiens
tttctggaaacgggttcaagct

SEQ ID NO: 8366197 - DNA, 22 bp, Homo sapiens
tttctgcttgagagaattgctg

SEQ ID NO: 8366198 - DNA, 22 bp, Homo sapiens
tttctgcttccttgagaaggag

SEQ ID NO: 8366199 - DNA, 22 bp, Homo sapiens
tttctggaacagtaattgaaga

SEQ ID NO: 8366200 - DNA, 20 bp, Homo sapiens
tttctgtagctcagtattca

SEQ ID NO: 8366201 - DNA, 22 bp, Homo sapiens
tttcctctttgtaccttgacta

SEQ ID NO: 8366202 - DNA, 22 bp, Homo sapiens
tttcctctttgtgacacagctg

SEQ ID NO: 8366203 - DNA, 22 bp, Homo sapiens
tttcctctttgtaccttgacta

SEQ ID NO: 8366204 - DNA, 22 bp, Homo sapiens
tttctaatctgattctcctacc

SEQ ID NO: 8366205 - DNA, 22 bp, Homo sapiens
tttctactgttatgacactggg

SEQ ID NO: 8366206 - DNA, 22 bp, Homo sapiens
tttctacatttgtaaccagatt

SEQ ID NO: 8366207 - DNA, 22 bp, Homo sapiens
tttctacatttgtaaccagatt

SEQ ID NO: 8366208 - DNA, 22 bp, Homo sapiens
tttctacattcaaaaactacca

SEQ ID NO: 8366209 - DNA, 22 bp, Homo sapiens
tttctaagtaagattaacttct

SEQ ID NO: 8366210 - DNA, 22 bp, Homo sapiens
tttctcatggacccttcatgat

SEQ ID NO: 8366211 - DNA, 22 bp, Homo sapiens
tttctcatggacccttcatgat

SEQ ID NO: 8366212 - DNA, 22 bp, Homo sapiens
tttctccacttctcttgccaac

SEQ ID NO: 8366213 - DNA, 22 bp, Homo sapiens
tttctccacttctcttgccaac

SEQ ID NO: 8366214 - DNA, 22 bp, Homo sapiens
tttctccacgccagcttgctta

SEQ ID NO: 8366215 - DNA, 22 bp, Homo sapiens
tttctccaatgtatcagcacac

SEQ ID NO: 8366216 - DNA, 22 bp, Homo sapiens
tttctcatagtcatgcctctta

SEQ ID NO: 8366217 - DNA, 22 bp, Homo sapiens
tttctcatggaacatcgtttag

SEQ ID NO: 8366218 - DNA, 22 bp, Homo sapiens
tttctcatggaacatagctcct

SEQ ID NO: 8366219 - DNA, 22 bp, Homo sapiens
tttctcatggaacatagctcct

SEQ ID NO: 8366220 - DNA, 22 bp, Homo sapiens
tttctccctccactacaggctc

SEQ ID NO: 8366221 - DNA, 22 bp, Homo sapiens
tttctccatcaccccctcggtg

SEQ ID NO: 8366222 - DNA, 20 bp, Homo sapiens
tttctcccaagtgcaagggt

SEQ ID NO: 8366223 - DNA, 22 bp, Homo sapiens
tttctcccaactctggaagcca

SEQ ID NO: 8366224 - DNA, 20 bp, Homo sapiens
tttctcccaagtgcaagggt

SEQ ID NO: 8366225 - DNA, 21 bp, Homo sapiens
tttctcagttgtgtgagcagc

SEQ ID NO: 8366226 - DNA, 22 bp, Homo sapiens
tttctcagttgtgcgagcagca

SEQ ID NO: 8366227 - DNA, 21 bp, Homo sapiens
tttctcagttgtgtgagcagc

SEQ ID NO: 8366228 - DNA, 22 bp, Homo sapiens
tttctcagtgtagcttttcaag

SEQ ID NO: 8366229 - DNA, 22 bp, Homo sapiens
tttctcagtgcagtttctacgt

SEQ ID NO: 8366230 - DNA, 22 bp, Homo sapiens
tttctcagtgcagtttctacgt

SEQ ID NO: 8366231 - DNA, 22 bp, Homo sapiens
tttctcagttctctgcaaggag

SEQ ID NO: 8366232 - DNA, 22 bp, Homo sapiens
tttctcagctcagcatctgggt

SEQ ID NO: 8366233 - DNA, 19 bp, Homo sapiens
tttctcaggaagtttgtgt

SEQ ID NO: 8366234 - DNA, 22 bp, Homo sapiens
tttctcagctgtggagcctatc

SEQ ID NO: 8366235 - DNA, 22 bp, Homo sapiens
tttctcagctcagcatctgggt

SEQ ID NO: 8366236 - DNA, 22 bp, Homo sapiens
tttctcagtcacatgaaccaat

SEQ ID NO: 8366237 - DNA, 22 bp, Homo sapiens
tttctcagtagtaatggcagtc

SEQ ID NO: 8366238 - DNA, 22 bp, Homo sapiens
tttctcagggaggagtcaagcc

SEQ ID NO: 8366239 - DNA, 22 bp, Homo sapiens
tttctattgtaagtctcctata

SEQ ID NO: 8366240 - DNA, 22 bp, Homo sapiens
tttctattggcgtcactgttgt

SEQ ID NO: 8366241 - DNA, 22 bp, Homo sapiens
tttctattgtaagtctcctata

SEQ ID NO: 8366242 - DNA, 22 bp, Homo sapiens
tttctcagagcacggggagtga

SEQ ID NO: 8366243 - DNA, 22 bp, Homo sapiens
tttctcagaggagccagacggt

SEQ ID NO: 8366244 - DNA, 22 bp, Homo sapiens
tttctagaaatagagatagagt

SEQ ID NO: 8366245 - DNA, 22 bp, Homo sapiens
tttctactttggaatgcactga

SEQ ID NO: 8366246 - DNA, 19 bp, Homo sapiens
tttcaggagctatgcaggg

SEQ ID NO: 8366247 - DNA, 22 bp, Homo sapiens
tttcaggatcaaatgaaatcgt

SEQ ID NO: 8366248 - DNA, 22 bp, Homo sapiens
tttcaggagagaccagaaatga

SEQ ID NO: 8366249 - DNA, 22 bp, Homo sapiens
tttcaggattttatgagatagt

SEQ ID NO: 8366250 - DNA, 22 bp, Homo sapiens
tttcaggattttatgagatagt

SEQ ID NO: 8366251 - DNA, 22 bp, Homo sapiens
tttcaggattagtttaagcagg

SEQ ID NO: 8366252 - DNA, 22 bp, Homo sapiens
tttcaggaaacatttaatggca

SEQ ID NO: 8366253 - DNA, 22 bp, Homo sapiens
tttcaggaaggtgaggcacatg

SEQ ID NO: 8366254 - DNA, 22 bp, Homo sapiens
tttcaggacacctttaaaaacg

SEQ ID NO: 8366255 - DNA, 22 bp, Homo sapiens
tttcaggactcaaaacgataat

SEQ ID NO: 8366256 - DNA, 22 bp, Homo sapiens
tttcaggccatagcacagggaa

SEQ ID NO: 8366257 - DNA, 22 bp, Homo sapiens
tttcagcactttaggcagcagg

SEQ ID NO: 8366258 - DNA, 22 bp, Homo sapiens
tttcagagttgtcttcttgacc

SEQ ID NO: 8366259 - DNA, 22 bp, Homo sapiens
tttcagagttggggaaaagcag

SEQ ID NO: 8366260 - DNA, 23 bp, Homo sapiens
tttcaaagactttcccttagagt

SEQ ID NO: 8366261 - DNA, 22 bp, Homo sapiens
tttcaaagaccattaactatca

SEQ ID NO: 8366262 - DNA, 17 bp, Homo sapiens
tttcaaagcagtcagga

SEQ ID NO: 8366263 - DNA, 17 bp, Homo sapiens
tttcaaagcagtcagga

SEQ ID NO: 8366264 - DNA, 22 bp, Homo sapiens
tttcaaagcaactgaaaaggaa

SEQ ID NO: 8366265 - DNA, 22 bp, Homo sapiens
tttcaaaggaggctgagaggat

SEQ ID NO: 8366266 - DNA, 20 bp, Homo sapiens
tttcaaaggcacctatgaag

SEQ ID NO: 8366267 - DNA, 20 bp, Homo sapiens
tttcaaaggcacctatgaag

SEQ ID NO: 8366268 - DNA, 22 bp, Homo sapiens
tttcagagctgagatgccacag

SEQ ID NO: 8366269 - DNA, 22 bp, Homo sapiens
tttcagaggaggaaggcagtta

SEQ ID NO: 8366270 - DNA, 22 bp, Homo sapiens
tttcagaggagagctggaccaa

SEQ ID NO: 8366271 - DNA, 22 bp, Homo sapiens
tttcagaggaaatctcattgag

SEQ ID NO: 8366272 - DNA, 22 bp, Homo sapiens
tttcagagtcagctcctctcta

SEQ ID NO: 8366273 - DNA, 22 bp, Homo sapiens
tttcagaggtgcttggaatgct

SEQ ID NO: 8366274 - DNA, 22 bp, Homo sapiens
tttcagaggtatgctgcttatc

SEQ ID NO: 8366275 - DNA, 22 bp, Homo sapiens
tttcagagttatgtaagaaaat

SEQ ID NO: 8366276 - DNA, 22 bp, Homo sapiens
tttcagagttagtagagcatgt

SEQ ID NO: 8366277 - DNA, 20 bp, Homo sapiens
tttcagagtgtctttccatt

SEQ ID NO: 8366278 - DNA, 20 bp, Homo sapiens
tttcagagtgtctttccatt

SEQ ID NO: 8366279 - DNA, 22 bp, Homo sapiens
tttcattgtcatctatcttaga

SEQ ID NO: 8366280 - DNA, 22 bp, Homo sapiens
tttcatttcatagaattgtgtt

SEQ ID NO: 8366281 - DNA, 22 bp, Homo sapiens
tttcatttcatagaattgtgtt

SEQ ID NO: 8366282 - DNA, 22 bp, Homo sapiens
tttcatttcatagaattgtgtt

SEQ ID NO: 8366283 - DNA, 22 bp, Homo sapiens
tttcattttggttatgccataa

SEQ ID NO: 8366284 - DNA, 22 bp, Homo sapiens
tttccaaacccagcgagctaca

SEQ ID NO: 8366285 - DNA, 22 bp, Homo sapiens
tttccaaaatgaatctaatgca

SEQ ID NO: 8366286 - DNA, 22 bp, Homo sapiens
tttccaaaatgaatctaatgca

SEQ ID NO: 8366287 - DNA, 22 bp, Homo sapiens
tttccaaaagtttgttctgtgc

SEQ ID NO: 8366288 - DNA, 22 bp, Homo sapiens
tttccaaaagtttgttctgtgc

SEQ ID NO: 8366289 - DNA, 22 bp, Homo sapiens
tttcctctgggccctgccaccc

SEQ ID NO: 8366290 - DNA, 22 bp, Homo sapiens
tttcctctgctgccattgcccc

SEQ ID NO: 8366291 - DNA, 22 bp, Homo sapiens
tttcctcttatacagtgtttat

SEQ ID NO: 8366292 - DNA, 22 bp, Homo sapiens
tttcctctgtcatgacagctga

SEQ ID NO: 8366293 - DNA, 22 bp, Homo sapiens
tttcctcttcttcccatgtcat

SEQ ID NO: 8366294 - DNA, 22 bp, Homo sapiens
tttcctcttcttcccatgtcat

SEQ ID NO: 8366295 - DNA, 22 bp, Homo sapiens
tttcctcttcgattaagtttgg

SEQ ID NO: 8366296 - DNA, 22 bp, Homo sapiens
tttccaaaggagtaccacgcat

SEQ ID NO: 8366297 - DNA, 22 bp, Homo sapiens
tttccaaaggctaaactcagtt

SEQ ID NO: 8366298 - DNA, 22 bp, Homo sapiens
tttccaaaggctaaactcagtt

SEQ ID NO: 8366299 - DNA, 22 bp, Homo sapiens
tttccaaaggaggaaccagttt

SEQ ID NO: 8366300 - DNA, 22 bp, Homo sapiens
tttccaaagctgagttgagcaa

SEQ ID NO: 8366301 - DNA, 22 bp, Homo sapiens
tttccaaaggaggaaccagttt

SEQ ID NO: 8366302 - DNA, 22 bp, Homo sapiens
tttccaaagttgccataagctt

SEQ ID NO: 8366303 - DNA, 22 bp, Homo sapiens
tttccaaagttgccataagctt

SEQ ID NO: 8366304 - DNA, 22 bp, Homo sapiens
tttccaaataaggtcacactca

SEQ ID NO: 8366305 - DNA, 22 bp, Homo sapiens
tttccaaaggtggcaggaacaa

SEQ ID NO: 8366306 - DNA, 22 bp, Homo sapiens
tttccaaaggtggcaggaacaa

SEQ ID NO: 8366307 - DNA, 16 bp, Homo sapiens
tttccaaagggcagct

SEQ ID NO: 8366308 - DNA, 22 bp, Homo sapiens
tttacaacctcatattctgatg

SEQ ID NO: 8366309 - DNA, 22 bp, Homo sapiens
tttacaacctcatattctgatg

SEQ ID NO: 8366310 - DNA, 22 bp, Homo sapiens
tttacaactttctgttctgtat

SEQ ID NO: 8366311 - DNA, 22 bp, Homo sapiens
tttacaacgttcctggtgctaa

SEQ ID NO: 8366312 - DNA, 22 bp, Homo sapiens
tttactaagtacttgtatccct

SEQ ID NO: 8366313 - DNA, 22 bp, Homo sapiens
tttactaagcccagttatatgc

SEQ ID NO: 8366314 - DNA, 22 bp, Homo sapiens
tttactacttgtgataactgaa

SEQ ID NO: 8366315 - DNA, 22 bp, Homo sapiens
tttactaacaccatacatgctg

SEQ ID NO: 8366316 - DNA, 22 bp, Homo sapiens
tttaccatataagaaaggcatg

SEQ ID NO: 8366317 - DNA, 22 bp, Homo sapiens
tttaccatctgccacagatatg

SEQ ID NO: 8366318 - DNA, 22 bp, Homo sapiens
tttagaaattgcagagtgggtg

SEQ ID NO: 8366319 - DNA, 22 bp, Homo sapiens
tttagaaattcatctatggcct

SEQ ID NO: 8366320 - DNA, 22 bp, Homo sapiens
tttactttctcaagtatatagg

SEQ ID NO: 8366321 - DNA, 22 bp, Homo sapiens
tttactttgtgtcaagtcaaga

SEQ ID NO: 8366322 - DNA, 22 bp, Homo sapiens
tttacttttggtaaggtcattt

SEQ ID NO: 8366323 - DNA, 22 bp, Homo sapiens
tttactgagtgacctagaataa

SEQ ID NO: 8366324 - DNA, 21 bp, Homo sapiens
tttactgagcacttactatgt

SEQ ID NO: 8366325 - DNA, 22 bp, Homo sapiens
tttactgacctccaatcccact

SEQ ID NO: 8366326 - DNA, 22 bp, Homo sapiens
tttactgaatttggtatattcc

SEQ ID NO: 8366327 - DNA, 22 bp, Homo sapiens
tttactgaactgctagtacagg

SEQ ID NO: 8366328 - DNA, 22 bp, Homo sapiens
tttactgagtgacctagaataa

SEQ ID NO: 8366329 - DNA, 23 bp, Homo sapiens
ttgtttttagaggtggcatgaga

SEQ ID NO: 8366330 - DNA, 22 bp, Homo sapiens
ttgtttttagagaagccctgaa

SEQ ID NO: 8366331 - DNA, 22 bp, Homo sapiens
ttgtttttaaacatgtgactga

SEQ ID NO: 8366332 - DNA, 22 bp, Homo sapiens
tttaaaagttatcatctgtcca

SEQ ID NO: 8366333 - DNA, 22 bp, Homo sapiens
tttaaaagttatcatctgtcca

SEQ ID NO: 8366334 - DNA, 22 bp, Homo sapiens
tttaaaatcagatgggagttgg

SEQ ID NO: 8366335 - DNA, 22 bp, Homo sapiens
tttaaaatttagacctctccac

SEQ ID NO: 8366336 - DNA, 22 bp, Homo sapiens
tttaaaatttagacctctccac

SEQ ID NO: 8366337 - DNA, 22 bp, Homo sapiens
tttaaaatttagacctctccac

SEQ ID NO: 8366338 - DNA, 22 bp, Homo sapiens
tttaaacaaataggattgccta

SEQ ID NO: 8366339 - DNA, 21 bp, Homo sapiens
tttaatttgcatgtatgacgc

SEQ ID NO: 8366340 - DNA, 22 bp, Homo sapiens
tttaatttgtatttctagaggg

SEQ ID NO: 8366341 - DNA, 22 bp, Homo sapiens
tttaatttgtatttctagaggg

SEQ ID NO: 8366342 - DNA, 22 bp, Homo sapiens
tttaattttcctcttcctggag

SEQ ID NO: 8366343 - DNA, 22 bp, Homo sapiens
tttaattttctgggcccagcag

SEQ ID NO: 8366344 - DNA, 22 bp, Homo sapiens
tttaattttcctggtaggcctg

SEQ ID NO: 8366345 - DNA, 22 bp, Homo sapiens
tttaattttcctcttcctggag

SEQ ID NO: 8366346 - DNA, 22 bp, Homo sapiens
tttaatttgaaatgagtaaccc

SEQ ID NO: 8366347 - DNA, 22 bp, Homo sapiens
tttaattgttgtgggtacatag

SEQ ID NO: 8366348 - DNA, 22 bp, Homo sapiens
tttaattgcatttaaagatgga

SEQ ID NO: 8366349 - DNA, 22 bp, Homo sapiens
tttatagggacagttcttggag

SEQ ID NO: 8366350 - DNA, 22 bp, Homo sapiens
tttataggatatgggggaagga

SEQ ID NO: 8366351 - DNA, 22 bp, Homo sapiens
tttatagctgtgagaccttggg

SEQ ID NO: 8366352 - DNA, 22 bp, Homo sapiens
tttatagggtagctaggattga

SEQ ID NO: 8366353 - DNA, 23 bp, Homo sapiens
tttatagcagcatgatttatagt

SEQ ID NO: 8366354 - DNA, 23 bp, Homo sapiens
tttatagcagcatgatttataat

SEQ ID NO: 8366355 - DNA, 22 bp, Homo sapiens
tttattaatgtagcatccatgg

SEQ ID NO: 8366356 - DNA, 22 bp, Homo sapiens
tttattaatgtagcatccatgg

SEQ ID NO: 8366357 - DNA, 22 bp, Homo sapiens
tttattaagatgcgaatgctga

SEQ ID NO: 8366358 - DNA, 22 bp, Homo sapiens
tttattaagatgcgaatgctga

SEQ ID NO: 8366359 - DNA, 21 bp, Homo sapiens
tttattaacaactgtggacgt

SEQ ID NO: 8366360 - DNA, 21 bp, Homo sapiens
tttattaacaactgtggacgt

SEQ ID NO: 8366361 - DNA, 21 bp, Homo sapiens
tttattaacaactgtggacgt

SEQ ID NO: 8366362 - DNA, 22 bp, Homo sapiens
tttattaaaactgttggctctg

SEQ ID NO: 8366363 - DNA, 22 bp, Homo sapiens
tttattaaaactgttggctctg

SEQ ID NO: 8366364 - DNA, 22 bp, Homo sapiens
tttatagatgtctgtattataa

SEQ ID NO: 8366365 - DNA, 22 bp, Homo sapiens
tttatacttcataatgtctatt

SEQ ID NO: 8366366 - DNA, 22 bp, Homo sapiens
tttatacttcataatgtctatt

SEQ ID NO: 8366367 - DNA, 22 bp, Homo sapiens
tttataattatctctactctta

SEQ ID NO: 8366368 - DNA, 22 bp, Homo sapiens
tttagttcacaccagggtagca

SEQ ID NO: 8366369 - DNA, 22 bp, Homo sapiens
tttagttttgatgaaaatgcca

SEQ ID NO: 8366370 - DNA, 19 bp, Homo sapiens
tttatttgagacatgcctt

SEQ ID NO: 8366371 - DNA, 22 bp, Homo sapiens
tttatttgtcttgccatttagt

SEQ ID NO: 8366372 - DNA, 22 bp, Homo sapiens
tttatttgtcttgccatttagt

SEQ ID NO: 8366373 - DNA, 22 bp, Homo sapiens
tttattattctgttctctctac

SEQ ID NO: 8366374 - DNA, 22 bp, Homo sapiens
tttattatccagtgttgtcatg

SEQ ID NO: 8366375 - DNA, 22 bp, Homo sapiens
tttattagtgcttgtatcactg

SEQ ID NO: 8366376 - DNA, 22 bp, Homo sapiens
tttattagattatcaaagaggt

SEQ ID NO: 8366377 - DNA, 22 bp, Homo sapiens
tttattaattagtgacccaatg

SEQ ID NO: 8366378 - DNA, 22 bp, Homo sapiens
tttattaatgtagcatccatgg

SEQ ID NO: 8366379 - DNA, 22 bp, Homo sapiens
tttattaattagtgacccaatg

SEQ ID NO: 8366380 - DNA, 22 bp, Homo sapiens
ttgttagcatgcttaatggata

SEQ ID NO: 8366381 - DNA, 22 bp, Homo sapiens
ttgttacagcagtgatttcaga

SEQ ID NO: 8366382 - DNA, 22 bp, Homo sapiens
ttgttacatcttatgtaagtgg

SEQ ID NO: 8366383 - DNA, 22 bp, Homo sapiens
ttgttacatacagcagaacata

SEQ ID NO: 8366384 - DNA, 22 bp, Homo sapiens
ttgtgttttcttatggcataaa

SEQ ID NO: 8366385 - DNA, 22 bp, Homo sapiens
ttgttaaaaatagatttccagg

SEQ ID NO: 8366386 - DNA, 22 bp, Homo sapiens
ttgttattattactaagtcttc

SEQ ID NO: 8366387 - DNA, 22 bp, Homo sapiens
ttgttattattactaagtcttc

SEQ ID NO: 8366388 - DNA, 22 bp, Homo sapiens
ttgttagtttatataatgtagt

SEQ ID NO: 8366389 - DNA, 22 bp, Homo sapiens
ttgttagctgatcttgagtgca

SEQ ID NO: 8366390 - DNA, 22 bp, Homo sapiens
ttgttagtaagtgacaaaaatc

SEQ ID NO: 8366391 - DNA, 22 bp, Homo sapiens
ttgtgtttcccttgcatattcc

SEQ ID NO: 8366392 - DNA, 22 bp, Homo sapiens
ttgtgtttctggccaagatgga

SEQ ID NO: 8366393 - DNA, 22 bp, Homo sapiens
ttgtgtttctggccaagatgga

SEQ ID NO: 8366394 - DNA, 22 bp, Homo sapiens
ttgtgaatggtgccgcaataaa

SEQ ID NO: 8366395 - DNA, 22 bp, Homo sapiens
ttgtgagaaatcttaatcccaa

SEQ ID NO: 8366396 - DNA, 22 bp, Homo sapiens
ttgttttattctgcaatttccc

SEQ ID NO: 8366397 - DNA, 22 bp, Homo sapiens
ttgttttatctttctacagact

SEQ ID NO: 8366398 - DNA, 22 bp, Homo sapiens
ttgttttaacgactcagcttgt

SEQ ID NO: 8366399 - DNA, 22 bp, Homo sapiens
ttgttttagtaggtacactgag

SEQ ID NO: 8366400 - DNA, 22 bp, Homo sapiens
ttgtttctggaaaaggcgagaa

SEQ ID NO: 8366401 - DNA, 20 bp, Homo sapiens
ttgtttctgctattttctaa

SEQ ID NO: 8366402 - DNA, 22 bp, Homo sapiens
ttgtttctcctggtgcctgata

SEQ ID NO: 8366403 - DNA, 22 bp, Homo sapiens
ttgtttcttcaggcttttagga

SEQ ID NO: 8366404 - DNA, 22 bp, Homo sapiens
ttgtgaatagtgccgctataaa

SEQ ID NO: 8366405 - DNA, 22 bp, Homo sapiens
ttgtgaatagtgccgcaataaa

SEQ ID NO: 8366406 - DNA, 22 bp, Homo sapiens
ttgtgaatagtgctgcaataaa

SEQ ID NO: 8366407 - DNA, 22 bp, Homo sapiens
ttgtctctaagtgtgatcttca

SEQ ID NO: 8366408 - DNA, 22 bp, Homo sapiens
ttgtctctcattcctgcaactc

SEQ ID NO: 8366409 - DNA, 21 bp, Homo sapiens
ttggttttctgagtctgtaca

SEQ ID NO: 8366410 - DNA, 22 bp, Homo sapiens
ttggttttctatcctctgcaat

SEQ ID NO: 8366411 - DNA, 22 bp, Homo sapiens
ttggttttctcagctggaccat

SEQ ID NO: 8366412 - DNA, 22 bp, Homo sapiens
ttggttttgaaatagcttattg

SEQ ID NO: 8366413 - DNA, 22 bp, Homo sapiens
ttggttttgggatgtacaaagg

SEQ ID NO: 8366414 - DNA, 22 bp, Homo sapiens
ttggttttgggatgtacaaagg

SEQ ID NO: 8366415 - DNA, 22 bp, Homo sapiens
ttgtctatacatcaataatgat

SEQ ID NO: 8366416 - DNA, 22 bp, Homo sapiens
ttgtctaatgagctccacttca

SEQ ID NO: 8366417 - DNA, 22 bp, Homo sapiens
ttggtttactaggattcaaatt

SEQ ID NO: 8366418 - DNA, 22 bp, Homo sapiens
ttggtttagagagtgtggttac

SEQ ID NO: 8366419 - DNA, 22 bp, Homo sapiens
ttggttttcaggggcaggataa

SEQ ID NO: 8366420 - DNA, 22 bp, Homo sapiens
ttggttttcatagctccactct

SEQ ID NO: 8366421 - DNA, 22 bp, Homo sapiens
ttggttttatcttaagattctt

SEQ ID NO: 8366422 - DNA, 20 bp, Homo sapiens
ttggttgagccagggcctgg

SEQ ID NO: 8366423 - DNA, 22 bp, Homo sapiens
ttggttacttttaaacttgtct

SEQ ID NO: 8366424 - DNA, 22 bp, Homo sapiens
ttggttactaaaaactgtttgg

SEQ ID NO: 8366425 - DNA, 22 bp, Homo sapiens
ttggttacttcagtggagaaag

SEQ ID NO: 8366426 - DNA, 22 bp, Homo sapiens
ttggttacacttaatttttcca

SEQ ID NO: 8366427 - DNA, 22 bp, Homo sapiens
ttggttaccttcagaaatgagt

SEQ ID NO: 8366428 - DNA, 23 bp, Homo sapiens
ttggttactggatttgaggggcc

SEQ ID NO: 8366429 - DNA, 22 bp, Homo sapiens
ttggttacttaagttggtgcga

SEQ ID NO: 8366430 - DNA, 22 bp, Homo sapiens
ttggttacaagtttgctctgcc

SEQ ID NO: 8366431 - DNA, 22 bp, Homo sapiens
ttggttacagactcttctctaa

SEQ ID NO: 8366432 - DNA, 22 bp, Homo sapiens
ttggttacacagactggtgctt

SEQ ID NO: 8366433 - DNA, 19 bp, Homo sapiens
ttggttacaactgagcttc

SEQ ID NO: 8366434 - DNA, 22 bp, Homo sapiens
ttggtgtacatctccccttcat

SEQ ID NO: 8366435 - DNA, 22 bp, Homo sapiens
ttgcaagatgttaccattgtta

SEQ ID NO: 8366436 - DNA, 20 bp, Homo sapiens
ttgcaataaatgaaagacca

SEQ ID NO: 8366437 - DNA, 22 bp, Homo sapiens
ttgcaacaggtgtgttttggtg

SEQ ID NO: 8366438 - DNA, 23 bp, Homo sapiens
ttgcaaatttcagttagttcatg

SEQ ID NO: 8366439 - DNA, 21 bp, Homo sapiens
ttgcaacaacctatatatttt

SEQ ID NO: 8366440 - DNA, 18 bp, Homo sapiens
ttgcaaattcttccctgt

SEQ ID NO: 8366441 - DNA, 22 bp, Homo sapiens
ttgcaaagagtcatgtaagtca

SEQ ID NO: 8366442 - DNA, 22 bp, Homo sapiens
ttgcaaagttccctacacatgt

SEQ ID NO: 8366443 - DNA, 22 bp, Homo sapiens
ttgattttgcctgatctgagag

SEQ ID NO: 8366444 - DNA, 22 bp, Homo sapiens
ttgattttgcctgatctgagag

SEQ ID NO: 8366445 - DNA, 22 bp, Homo sapiens
ttgcaaatgtgaataattacac

SEQ ID NO: 8366446 - DNA, 22 bp, Homo sapiens
ttgcaaatgaccattgccacat

SEQ ID NO: 8366447 - DNA, 22 bp, Homo sapiens
ttgattaaaatgagacatcatt

SEQ ID NO: 8366448 - DNA, 22 bp, Homo sapiens
ttgattaatcccatgtgagtag

SEQ ID NO: 8366449 - DNA, 22 bp, Homo sapiens
ttgatcatctaagagtaatagt

SEQ ID NO: 8366450 - DNA, 22 bp, Homo sapiens
ttgatcatctaagagtaatagt

SEQ ID NO: 8366451 - DNA, 20 bp, Homo sapiens
ttgaggcatgtctagaagta

SEQ ID NO: 8366452 - DNA, 22 bp, Homo sapiens
ttgagcacattccctttcatgg

SEQ ID NO: 8366453 - DNA, 22 bp, Homo sapiens
ttgagcaagtgtacgagcaggc

SEQ ID NO: 8366454 - DNA, 22 bp, Homo sapiens
ttgaggattcatgtcagaattc

SEQ ID NO: 8366455 - DNA, 22 bp, Homo sapiens
ttgaggattcatgtcagaattc

SEQ ID NO: 8366456 - DNA, 23 bp, Homo sapiens
ttgagcatttgtggatactgaaa

SEQ ID NO: 8366457 - DNA, 22 bp, Homo sapiens
ttgaagcacaatgtcttttatc

SEQ ID NO: 8366458 - DNA, 22 bp, Homo sapiens
ttgaagcccttcttgatagtca

SEQ ID NO: 8366459 - DNA, 22 bp, Homo sapiens
ttgaagctgtctttcagaatca

SEQ ID NO: 8366460 - DNA, 22 bp, Homo sapiens
ttgagataggtggaatctcttt

SEQ ID NO: 8366461 - DNA, 22 bp, Homo sapiens
ttctttcaatagctggcatatg

SEQ ID NO: 8366462 - DNA, 22 bp, Homo sapiens
ttctttattgagacttcattgt

SEQ ID NO: 8366463 - DNA, 22 bp, Homo sapiens
ttctttattgagacttcattgt

SEQ ID NO: 8366464 - DNA, 22 bp, Homo sapiens
ttctttatgttaatgaatctat

SEQ ID NO: 8366465 - DNA, 22 bp, Homo sapiens
ttctttatgttaatgaatctat

SEQ ID NO: 8366466 - DNA, 22 bp, Homo sapiens
ttctttatgttaatgaatctat

SEQ ID NO: 8366467 - DNA, 22 bp, Homo sapiens
ttctttatggaatggtgatagt

SEQ ID NO: 8366468 - DNA, 22 bp, Homo sapiens
ttgaagatctttgcattgcagg

SEQ ID NO: 8366469 - DNA, 22 bp, Homo sapiens
ttgaagagacgatttttccacc

SEQ ID NO: 8366470 - DNA, 22 bp, Homo sapiens
ttgaagagtcgcttaacctgtg

SEQ ID NO: 8366471 - DNA, 22 bp, Homo sapiens
ttgaagaagtaattttaagtct

SEQ ID NO: 8366472 - DNA, 19 bp, Homo sapiens
ttgaagaataaaaacacat

SEQ ID NO: 8366473 - DNA, 22 bp, Homo sapiens
ttcttctttcctataattaatt

SEQ ID NO: 8366474 - DNA, 22 bp, Homo sapiens
ttcttctttcctataattaatt

SEQ ID NO: 8366475 - DNA, 22 bp, Homo sapiens
ttcttctttcctataattaatt

SEQ ID NO: 8366476 - DNA, 22 bp, Homo sapiens
ttcttgaaaatagccatgtaca

SEQ ID NO: 8366477 - DNA, 22 bp, Homo sapiens
ttcttctttcctataattaatt

SEQ ID NO: 8366478 - DNA, 22 bp, Homo sapiens
ttcttgaccatgtatgtggtcc

SEQ ID NO: 8366479 - DNA, 22 bp, Homo sapiens
ttcttgaatcactttagagata

SEQ ID NO: 8366480 - DNA, 22 bp, Homo sapiens
ttcttgaatagggattgataaa

SEQ ID NO: 8366481 - DNA, 22 bp, Homo sapiens
ttcttacattactttacatgtg

SEQ ID NO: 8366482 - DNA, 22 bp, Homo sapiens
ttcttacatcagtttattttgt

SEQ ID NO: 8366483 - DNA, 22 bp, Homo sapiens
ttcttacatctataaagttggg

SEQ ID NO: 8366484 - DNA, 22 bp, Homo sapiens
ttcttacatattttcatatggt

SEQ ID NO: 8366485 - DNA, 22 bp, Homo sapiens
ttcttacagccctattactaaa

SEQ ID NO: 8366486 - DNA, 22 bp, Homo sapiens
ttcttacagatttggtgaatga

SEQ ID NO: 8366487 - DNA, 22 bp, Homo sapiens
ttcttacagagtttacagagcc

SEQ ID NO: 8366488 - DNA, 22 bp, Homo sapiens
ttcttggaaactgattccttgt

SEQ ID NO: 8366489 - DNA, 22 bp, Homo sapiens
ttcttggaaactgattccttgt

SEQ ID NO: 8366490 - DNA, 22 bp, Homo sapiens
ttctttatcagttactcatagg

SEQ ID NO: 8366491 - DNA, 22 bp, Homo sapiens
ttctttatcagttactcatagg

SEQ ID NO: 8366492 - DNA, 22 bp, Homo sapiens
ttctttatcagttactcatagg

SEQ ID NO: 8366493 - DNA, 22 bp, Homo sapiens
ttctttatcagttactcatagg

SEQ ID NO: 8366494 - DNA, 22 bp, Homo sapiens
ttctttaggtagatccagtttt

SEQ ID NO: 8366495 - DNA, 22 bp, Homo sapiens
ttctttatatctgctagtgggt

SEQ ID NO: 8366496 - DNA, 22 bp, Homo sapiens
ttctttaccagtgaaatgttat

SEQ ID NO: 8366497 - DNA, 22 bp, Homo sapiens
ttctttaccactactcttccaa

SEQ ID NO: 8366498 - DNA, 22 bp, Homo sapiens
ttctttaccactactcttccaa

SEQ ID NO: 8366499 - DNA, 20 bp, Homo sapiens
ttctttacgacctttctgca

SEQ ID NO: 8366500 - DNA, 20 bp, Homo sapiens
ttctttacgacctttctgca

SEQ ID NO: 8366501 - DNA, 22 bp, Homo sapiens
ttctttagcaacttggatttag

SEQ ID NO: 8366502 - DNA, 18 bp, Homo sapiens
ttctttaattcagtttga

SEQ ID NO: 8366503 - DNA, 22 bp, Homo sapiens
ttctgttatcattaagcattat

SEQ ID NO: 8366504 - DNA, 22 bp, Homo sapiens
ttctgttacatggggcacagtg

SEQ ID NO: 8366505 - DNA, 22 bp, Homo sapiens
ttcttacaagtattccaggtcc

SEQ ID NO: 8366506 - DNA, 22 bp, Homo sapiens
ttcttacagagtttacagagcc

SEQ ID NO: 8366507 - DNA, 22 bp, Homo sapiens
ttcttaaaacttatggacaggt

SEQ ID NO: 8366508 - DNA, 22 bp, Homo sapiens
ttcttacactcttaaaaatcat

SEQ ID NO: 8366509 - DNA, 22 bp, Homo sapiens
ttctgcttattctgtagccttt

SEQ ID NO: 8366510 - DNA, 20 bp, Homo sapiens
ttctgcttgcaaatatcaag

SEQ ID NO: 8366511 - DNA, 22 bp, Homo sapiens
ttctgcttctgtgtgtcccagg

SEQ ID NO: 8366512 - DNA, 22 bp, Homo sapiens
ttctgcttttagctaaactata

SEQ ID NO: 8366513 - DNA, 22 bp, Homo sapiens
ttctgggcaggactggggaccc

SEQ ID NO: 8366514 - DNA, 21 bp, Homo sapiens
ttctgctgtgccatgcctctg

SEQ ID NO: 8366515 - DNA, 22 bp, Homo sapiens
ttctgagattgttaggcactaa

SEQ ID NO: 8366516 - DNA, 22 bp, Homo sapiens
ttctgagattgttaggcactaa

SEQ ID NO: 8366517 - DNA, 22 bp, Homo sapiens
ttctgagagagcctctcatgtt

SEQ ID NO: 8366518 - DNA, 22 bp, Homo sapiens
ttctgagagtaaacatagcctg

SEQ ID NO: 8366519 - DNA, 22 bp, Homo sapiens
ttctgagacttgagattaattt

SEQ ID NO: 8366520 - DNA, 22 bp, Homo sapiens
ttctgagagttgtagtgtatcc

SEQ ID NO: 8366521 - DNA, 22 bp, Homo sapiens
ttctgagatacaaaatttactt

SEQ ID NO: 8366522 - DNA, 22 bp, Homo sapiens
ttctgagatgtgaatctgtcaa

SEQ ID NO: 8366523 - DNA, 22 bp, Homo sapiens
ttctgagatgcgttagaaattt

SEQ ID NO: 8366524 - DNA, 22 bp, Homo sapiens
ttctgagaaggctgtggacaca

SEQ ID NO: 8366525 - DNA, 22 bp, Homo sapiens
ttctgagaagggtgggtctggc

SEQ ID NO: 8366526 - DNA, 22 bp, Homo sapiens
ttctgagaagtaaaatggcgtt

SEQ ID NO: 8366527 - DNA, 22 bp, Homo sapiens
ttctgaatcctcgaaacatagc

SEQ ID NO: 8366528 - DNA, 22 bp, Homo sapiens
ttctagttccctctggaatgta

SEQ ID NO: 8366529 - DNA, 22 bp, Homo sapiens
ttctagtgtccttggacttgct

SEQ ID NO: 8366530 - DNA, 22 bp, Homo sapiens
ttctagttaatgtagcatcttg

SEQ ID NO: 8366531 - DNA, 22 bp, Homo sapiens
ttctcttttagaggctccatga

SEQ ID NO: 8366532 - DNA, 22 bp, Homo sapiens
ttctcttttagaggctccatga

SEQ ID NO: 8366533 - DNA, 22 bp, Homo sapiens
ttctataatgcaagccactgca

SEQ ID NO: 8366534 - DNA, 22 bp, Homo sapiens
ttctataatgcaagccactgca

SEQ ID NO: 8366535 - DNA, 22 bp, Homo sapiens
ttctataagactcatatttctt

SEQ ID NO: 8366536 - DNA, 22 bp, Homo sapiens
ttctataaatgaatgtgtatat

SEQ ID NO: 8366537 - DNA, 22 bp, Homo sapiens
ttctcttttcaccagttgctaa

SEQ ID NO: 8366538 - DNA, 22 bp, Homo sapiens
ttcatgtaattccataaggtaa

SEQ ID NO: 8366539 - DNA, 22 bp, Homo sapiens
ttcatgtccagaggaagttgag

SEQ ID NO: 8366540 - DNA, 22 bp, Homo sapiens
ttcatgtagtgtaatgtcttca

SEQ ID NO: 8366541 - DNA, 22 bp, Homo sapiens
ttcatgtatttatcatgtaaat

SEQ ID NO: 8366542 - DNA, 22 bp, Homo sapiens
ttcatgtttcctcttgtgctgc

SEQ ID NO: 8366543 - DNA, 22 bp, Homo sapiens
ttcatgttgtagtatgtatcag

SEQ ID NO: 8366544 - DNA, 22 bp, Homo sapiens
ttcatgtttcaattgttaatgt

SEQ ID NO: 8366545 - DNA, 18 bp, Homo sapiens
ttcatgttggcttaggga

SEQ ID NO: 8366546 - DNA, 22 bp, Homo sapiens
ttcatgtgtctgtagcacatat

SEQ ID NO: 8366547 - DNA, 22 bp, Homo sapiens
ttcatgtgtctgtagcacatat

SEQ ID NO: 8366548 - DNA, 23 bp, Homo sapiens
ttcatgtggacctagaggcctgt

SEQ ID NO: 8366549 - DNA, 22 bp, Homo sapiens
ttcatgtgtatggaacattttt

SEQ ID NO: 8366550 - DNA, 22 bp, Homo sapiens
ttcatgtgccagagctgaaaat

SEQ ID NO: 8366551 - DNA, 18 bp, Homo sapiens
ttcatcatgactctgtgg

SEQ ID NO: 8366552 - DNA, 22 bp, Homo sapiens
ttcagtgtcacaagagcaagcc

SEQ ID NO: 8366553 - DNA, 22 bp, Homo sapiens
ttcagtgtcaatttttaaatat

SEQ ID NO: 8366554 - DNA, 22 bp, Homo sapiens
ttcagtgtatcttgtcagggag

SEQ ID NO: 8366555 - DNA, 22 bp, Homo sapiens
ttcagtgtatattttttgagta

SEQ ID NO: 8366556 - DNA, 22 bp, Homo sapiens
ttcagtgtacagtgaagggatt

SEQ ID NO: 8366557 - DNA, 22 bp, Homo sapiens
ttcagtggtttgatgatgtata

SEQ ID NO: 8366558 - DNA, 22 bp, Homo sapiens
ttcagtgacttacctggagcca

SEQ ID NO: 8366559 - DNA, 22 bp, Homo sapiens
ttcatgatagtatctattcaat

SEQ ID NO: 8366560 - DNA, 21 bp, Homo sapiens
ttcatcattggtaaaaagtgg

SEQ ID NO: 8366561 - DNA, 22 bp, Homo sapiens
ttcatggagttgagaaggctaa

SEQ ID NO: 8366562 - DNA, 22 bp, Homo sapiens
ttcatggagttgagaaggctaa

SEQ ID NO: 8366563 - DNA, 22 bp, Homo sapiens
ttcagggtctagagtatctacc

SEQ ID NO: 8366564 - DNA, 20 bp, Homo sapiens
ttcagggtgagagttctagg

SEQ ID NO: 8366565 - DNA, 22 bp, Homo sapiens
ttcagtagggccctcacacagt

SEQ ID NO: 8366566 - DNA, 22 bp, Homo sapiens
ttcagtatgtgtaaactacttt

SEQ ID NO: 8366567 - DNA, 22 bp, Homo sapiens
ttcagtatgattcctccagtag

SEQ ID NO: 8366568 - DNA, 22 bp, Homo sapiens
ttcacattcagaaaaagcccgt

SEQ ID NO: 8366569 - DNA, 22 bp, Homo sapiens
ttcacattagtggttctatata

SEQ ID NO: 8366570 - DNA, 22 bp, Homo sapiens
ttcacattccgcggctattttc

SEQ ID NO: 8366571 - DNA, 22 bp, Homo sapiens
ttcacagtggccctctctgagt

SEQ ID NO: 8366572 - DNA, 21 bp, Homo sapiens
ttcacagtggataactttctg

SEQ ID NO: 8366573 - DNA, 22 bp, Homo sapiens
ttcacagtgctgcacctggctt

SEQ ID NO: 8366574 - DNA, 22 bp, Homo sapiens
ttcacagtggccctctctgagt

SEQ ID NO: 8366575 - DNA, 22 bp, Homo sapiens
ttcacagtggctaagttctgca

SEQ ID NO: 8366576 - DNA, 22 bp, Homo sapiens
ttcacagtggctgtgccatttg

SEQ ID NO: 8366577 - DNA, 22 bp, Homo sapiens
ttcacagtggctaagttctgca

SEQ ID NO: 8366578 - DNA, 22 bp, Homo sapiens
ttcacagtggctgacaggctgg

SEQ ID NO: 8366579 - DNA, 22 bp, Homo sapiens
ttcacattagtggttctatata

SEQ ID NO: 8366580 - DNA, 22 bp, Homo sapiens
ttcacagtaacagggggatatg

SEQ ID NO: 8366581 - DNA, 22 bp, Homo sapiens
ttcacagtaagtaggatagttg

SEQ ID NO: 8366582 - DNA, 22 bp, Homo sapiens
ttcacagtaagtaggatagttg

SEQ ID NO: 8366583 - DNA, 22 bp, Homo sapiens
ttcacagtaatgtgcccaggta

SEQ ID NO: 8366584 - DNA, 22 bp, Homo sapiens
ttcacagtataggtttccagcg

SEQ ID NO: 8366585 - DNA, 22 bp, Homo sapiens
ttcacagtcacccttctccatg

SEQ ID NO: 8366586 - DNA, 22 bp, Homo sapiens
ttcacagtgccagggggcaggc

SEQ ID NO: 8366587 - DNA, 22 bp, Homo sapiens
ttcacagtgctcacagttcagt

SEQ ID NO: 8366588 - DNA, 22 bp, Homo sapiens
ttcacagtgagctatgtcttgt

SEQ ID NO: 8366589 - DNA, 22 bp, Homo sapiens
ttcacagtcacccttctccatg

SEQ ID NO: 8366590 - DNA, 22 bp, Homo sapiens
ttcacagtctatcttggttttt

SEQ ID NO: 8366591 - DNA, 22 bp, Homo sapiens
ttcacaataatgtccatcctct

SEQ ID NO: 8366592 - DNA, 22 bp, Homo sapiens
ttcacaagtcattagctgcata

SEQ ID NO: 8366593 - DNA, 22 bp, Homo sapiens
ttcacaaagctggagcatttcc

SEQ ID NO: 8366594 - DNA, 22 bp, Homo sapiens
ttcaagaagcccaaagactagc

SEQ ID NO: 8366595 - DNA, 22 bp, Homo sapiens
ttcaatgttaagaagaatatgt

SEQ ID NO: 8366596 - DNA, 22 bp, Homo sapiens
ttcaattcaattctaaatatat

SEQ ID NO: 8366597 - DNA, 22 bp, Homo sapiens
ttcaatttagtgatgttgttgg

SEQ ID NO: 8366598 - DNA, 22 bp, Homo sapiens
ttcaatttcataatatctagct

SEQ ID NO: 8366599 - DNA, 22 bp, Homo sapiens
ttcaatttagtgatgttgttgg

SEQ ID NO: 8366600 - DNA, 22 bp, Homo sapiens
ttcaatttcataatatctagct

SEQ ID NO: 8366601 - DNA, 22 bp, Homo sapiens
ttcacaaaaatgctgaacagtt

SEQ ID NO: 8366602 - DNA, 22 bp, Homo sapiens
ttcacaaaacactattttctgg

SEQ ID NO: 8366603 - DNA, 22 bp, Homo sapiens
ttcacaaaatggtttgttgatg

SEQ ID NO: 8366604 - DNA, 20 bp, Homo sapiens
ttagagttagctgttatgca

SEQ ID NO: 8366605 - DNA, 22 bp, Homo sapiens
ttagagttaggatttgtcttta

SEQ ID NO: 8366606 - DNA, 22 bp, Homo sapiens
ttagataaaagtgttcaataaa

SEQ ID NO: 8366607 - DNA, 22 bp, Homo sapiens
ttagataaaagtgttcaataaa

SEQ ID NO: 8366608 - DNA, 22 bp, Homo sapiens
ttagataaattaagactttaca

SEQ ID NO: 8366609 - DNA, 22 bp, Homo sapiens
ttagataaattaagactttaca

SEQ ID NO: 8366610 - DNA, 22 bp, Homo sapiens
ttcaaaggtgactttgggccag

SEQ ID NO: 8366611 - DNA, 22 bp, Homo sapiens
ttcaaagtaaaaatgtgttcac

SEQ ID NO: 8366612 - DNA, 17 bp, Homo sapiens
ttcaaagcttatcaagg

SEQ ID NO: 8366613 - DNA, 22 bp, Homo sapiens
ttcaaaggaaaggcagtgtcaa

SEQ ID NO: 8366614 - DNA, 22 bp, Homo sapiens
ttcaaaggaaaggcagtgtcaa

SEQ ID NO: 8366615 - DNA, 22 bp, Homo sapiens
ttcaactattatgaataaaatt

SEQ ID NO: 8366616 - DNA, 22 bp, Homo sapiens
ttcaactagatttatacaattc

SEQ ID NO: 8366617 - DNA, 22 bp, Homo sapiens
ttcaacatcttggagctggaac

SEQ ID NO: 8366618 - DNA, 22 bp, Homo sapiens
ttcaacatgttctacataaggg

SEQ ID NO: 8366619 - DNA, 22 bp, Homo sapiens
ttcaacatgctttatttctaaa

SEQ ID NO: 8366620 - DNA, 22 bp, Homo sapiens
ttcaacatcattgtaagcctct

SEQ ID NO: 8366621 - DNA, 22 bp, Homo sapiens
ttctaatacacggtatgacttt

SEQ ID NO: 8366622 - DNA, 22 bp, Homo sapiens
ttctaatcccagctctactact

SEQ ID NO: 8366623 - DNA, 22 bp, Homo sapiens
ttctacaaatatttactgttcc

SEQ ID NO: 8366624 - DNA, 20 bp, Homo sapiens
ttctacaaaactgattctga

SEQ ID NO: 8366625 - DNA, 22 bp, Homo sapiens
ttctacaaatatttactgttcc

SEQ ID NO: 8366626 - DNA, 22 bp, Homo sapiens
ttctacaatatgaataatgaag

SEQ ID NO: 8366627 - DNA, 22 bp, Homo sapiens
ttctacacacctctgaggacat

SEQ ID NO: 8366628 - DNA, 22 bp, Homo sapiens
ttctacacagtgcgggttaaca

SEQ ID NO: 8366629 - DNA, 22 bp, Homo sapiens
ttctacttgccaaatgacacat

SEQ ID NO: 8366630 - DNA, 22 bp, Homo sapiens
ttctactttctctgtcattaaa

SEQ ID NO: 8366631 - DNA, 22 bp, Homo sapiens
ttctagcatgccttttagcaca

SEQ ID NO: 8366632 - DNA, 22 bp, Homo sapiens
ttctaggaagggaagcatggca

SEQ ID NO: 8366633 - DNA, 22 bp, Homo sapiens
ttctagagaactcgagtgcctt

SEQ ID NO: 8366634 - DNA, 22 bp, Homo sapiens
ttcctctttctctgtgctatgt

SEQ ID NO: 8366635 - DNA, 22 bp, Homo sapiens
ttcctgtgtgactcaagtggtt

SEQ ID NO: 8366636 - DNA, 17 bp, Homo sapiens
ttcctgtggtttgatct

SEQ ID NO: 8366637 - DNA, 22 bp, Homo sapiens
ttcctgtggccttacatctgtg

SEQ ID NO: 8366638 - DNA, 22 bp, Homo sapiens
ttcctgtgcctcaggtctcagc

SEQ ID NO: 8366639 - DNA, 22 bp, Homo sapiens
ttccttctagagcttgtttagg

SEQ ID NO: 8366640 - DNA, 22 bp, Homo sapiens
ttccttaatgaatcaggccatt

SEQ ID NO: 8366641 - DNA, 22 bp, Homo sapiens
ttccttctccagaacttctagg

SEQ ID NO: 8366642 - DNA, 22 bp, Homo sapiens
ttccttctccagaacttctagg

SEQ ID NO: 8366643 - DNA, 22 bp, Homo sapiens
ttcctcagaaaatactgtccaa

SEQ ID NO: 8366644 - DNA, 22 bp, Homo sapiens
ttcctcagagggcgctggggaa

SEQ ID NO: 8366645 - DNA, 22 bp, Homo sapiens
ttcctcagagagacagaaacta

SEQ ID NO: 8366646 - DNA, 22 bp, Homo sapiens
ttcctcagcacaaagccaagat

SEQ ID NO: 8366647 - DNA, 22 bp, Homo sapiens
ttcctcagcacaaagccaagat

SEQ ID NO: 8366648 - DNA, 22 bp, Homo sapiens
ttcctcagctcagcgagagaga

SEQ ID NO: 8366649 - DNA, 22 bp, Homo sapiens
ttcctcagctggcctgattggg

SEQ ID NO: 8366650 - DNA, 22 bp, Homo sapiens
ttcctatagaaagctgtgtaga

SEQ ID NO: 8366651 - DNA, 22 bp, Homo sapiens
ttcctagacagttcttcccaaa

SEQ ID NO: 8366652 - DNA, 22 bp, Homo sapiens
ttcctaggatggtgaagcagga

SEQ ID NO: 8366653 - DNA, 22 bp, Homo sapiens
ttcctacatttgtacaataaga

SEQ ID NO: 8366654 - DNA, 22 bp, Homo sapiens
ttcctcagttagtgcctgaggc

SEQ ID NO: 8366655 - DNA, 22 bp, Homo sapiens
ttcctcagttagtgcctgaggc

SEQ ID NO: 8366656 - DNA, 18 bp, Homo sapiens
ttcctccacagagcgctg

SEQ ID NO: 8366657 - DNA, 22 bp, Homo sapiens
ttcctccacgtgacaggagcca

SEQ ID NO: 8366658 - DNA, 22 bp, Homo sapiens
ttcctccagaagctgtagggga

SEQ ID NO: 8366659 - DNA, 22 bp, Homo sapiens
ttcctccagccatgattgtaaa

SEQ ID NO: 8366660 - DNA, 22 bp, Homo sapiens
ttcctcagggaggctagcagta

SEQ ID NO: 8366661 - DNA, 22 bp, Homo sapiens
ttcctcagggaggctagcagta

SEQ ID NO: 8366662 - DNA, 22 bp, Homo sapiens
ttcctcagtgcccccatacggt

SEQ ID NO: 8366663 - DNA, 22 bp, Homo sapiens
ttcctcagctttagactatgaa

SEQ ID NO: 8366664 - DNA, 22 bp, Homo sapiens
ttcctcagctgtgtcctggcga

SEQ ID NO: 8366665 - DNA, 22 bp, Homo sapiens
ttcctaagtcctgccagcagtc

SEQ ID NO: 8366666 - DNA, 20 bp, Homo sapiens
ttccctggaaggagaagcag

SEQ ID NO: 8366667 - DNA, 22 bp, Homo sapiens
ttccagaagatggcagcaaagg

SEQ ID NO: 8366668 - DNA, 22 bp, Homo sapiens
ttccacaatgtatgaataagat

SEQ ID NO: 8366669 - DNA, 22 bp, Homo sapiens
ttccacaattcagattgttgcc

SEQ ID NO: 8366670 - DNA, 22 bp, Homo sapiens
ttccacaatgccaggggcatca

SEQ ID NO: 8366671 - DNA, 22 bp, Homo sapiens
ttccacaatggttaagctcgtt

SEQ ID NO: 8366672 - DNA, 23 bp, Homo sapiens
ttccacaatgaaaataaagcagg

SEQ ID NO: 8366673 - DNA, 17 bp, Homo sapiens
ttccacaatagtttgtc

SEQ ID NO: 8366674 - DNA, 22 bp, Homo sapiens
ttccacaaggccttgtcctgct

SEQ ID NO: 8366675 - DNA, 22 bp, Homo sapiens
ttccacaagtgatatctagctg

SEQ ID NO: 8366676 - DNA, 22 bp, Homo sapiens
ttccacaagatgtttcttagaa

SEQ ID NO: 8366677 - DNA, 22 bp, Homo sapiens
ttccacaagacttgggttaaga

SEQ ID NO: 8366678 - DNA, 22 bp, Homo sapiens
ttccacaacaaccaagcatata

SEQ ID NO: 8366679 - DNA, 22 bp, Homo sapiens
ttccacaaatcaattctgctga

SEQ ID NO: 8366680 - DNA, 22 bp, Homo sapiens
ttccacaaacacatcctgagca

SEQ ID NO: 8366681 - DNA, 22 bp, Homo sapiens
ttccacaaatacactccacatt

SEQ ID NO: 8366682 - DNA, 22 bp, Homo sapiens
ttccacaggtttcagactgttc

SEQ ID NO: 8366683 - DNA, 21 bp, Homo sapiens
ttccacagtgagaactgcaag

SEQ ID NO: 8366684 - DNA, 22 bp, Homo sapiens
ttccacagtcatcctgggaatt

SEQ ID NO: 8366685 - DNA, 22 bp, Homo sapiens
tgttttgttagcactctgggaa

SEQ ID NO: 8366686 - DNA, 22 bp, Homo sapiens
tgtttttaaataatgatagaaa

SEQ ID NO: 8366687 - DNA, 22 bp, Homo sapiens
ttaaatattatgttgtctgcaa

SEQ ID NO: 8366688 - DNA, 22 bp, Homo sapiens
ttaaatattatgttgtctgcaa

SEQ ID NO: 8366689 - DNA, 22 bp, Homo sapiens
ttaaagcccagcatatactagg

SEQ ID NO: 8366690 - DNA, 22 bp, Homo sapiens
ttaaattaggactctagttctg

SEQ ID NO: 8366691 - DNA, 22 bp, Homo sapiens
ttaacaaaaatatcaggcatca

SEQ ID NO: 8366692 - DNA, 22 bp, Homo sapiens
ttaacaaaaatatcaggcatca

SEQ ID NO: 8366693 - DNA, 22 bp, Homo sapiens
ttaacaatagagtttcttcagg

SEQ ID NO: 8366694 - DNA, 22 bp, Homo sapiens
ttaacaatagagtttcttcagg

SEQ ID NO: 8366695 - DNA, 22 bp, Homo sapiens
ttaacaaaaatatcaggcatca

SEQ ID NO: 8366696 - DNA, 22 bp, Homo sapiens
ttaacacagggggagacaaagt

SEQ ID NO: 8366697 - DNA, 22 bp, Homo sapiens
ttaaatgagatgttcagatatt

SEQ ID NO: 8366698 - DNA, 22 bp, Homo sapiens
ttaaatgacttttattattctc

SEQ ID NO: 8366699 - DNA, 22 bp, Homo sapiens
ttaaatgaacgagatatgcaac

SEQ ID NO: 8366700 - DNA, 22 bp, Homo sapiens
ttaaatcaggcatcatttcagt

SEQ ID NO: 8366701 - DNA, 22 bp, Homo sapiens
ttaaatcagtaggctactcctt

SEQ ID NO: 8366702 - DNA, 22 bp, Homo sapiens
ttaagtgtttagtaagagatgt

SEQ ID NO: 8366703 - DNA, 22 bp, Homo sapiens
ttaagtgagcttgaataatctt

SEQ ID NO: 8366704 - DNA, 22 bp, Homo sapiens
ttaagtagattcagtgttaagg

SEQ ID NO: 8366705 - DNA, 22 bp, Homo sapiens
ttaaggaattacgaaaatattt

SEQ ID NO: 8366706 - DNA, 22 bp, Homo sapiens
ttaaggagcacagtgtattaat

SEQ ID NO: 8366707 - DNA, 22 bp, Homo sapiens
ttaattctgcctttcatgtaac

SEQ ID NO: 8366708 - DNA, 22 bp, Homo sapiens
ttaatttatacataatcacagg

SEQ ID NO: 8366709 - DNA, 22 bp, Homo sapiens
ttaatttatacataatcacagg

SEQ ID NO: 8366710 - DNA, 22 bp, Homo sapiens
ttaatttatacataatcacagg

SEQ ID NO: 8366711 - DNA, 22 bp, Homo sapiens
ttaatttatacataatcacagg

SEQ ID NO: 8366712 - DNA, 22 bp, Homo sapiens
ttaataaacaggtgcagctgaa

SEQ ID NO: 8366713 - DNA, 22 bp, Homo sapiens
ttaagaagtgagtagaagtaat

SEQ ID NO: 8366714 - DNA, 22 bp, Homo sapiens
ttaagaatgtgccttttggttg

SEQ ID NO: 8366715 - DNA, 20 bp, Homo sapiens
ttaagaaaagcacatcctgc

SEQ ID NO: 8366716 - DNA, 20 bp, Homo sapiens
ttaagaaaagcacatcctgc

SEQ ID NO: 8366717 - DNA, 22 bp, Homo sapiens
ttaagagaaggaatgacctagc

SEQ ID NO: 8366718 - DNA, 22 bp, Homo sapiens
ttaaggaacaattctacacacc

SEQ ID NO: 8366719 - DNA, 22 bp, Homo sapiens
ttaaggaaggtgaatttcttgg

SEQ ID NO: 8366720 - DNA, 22 bp, Homo sapiens
ttaacattaaaagcagcatttt

SEQ ID NO: 8366721 - DNA, 22 bp, Homo sapiens
ttaacatgtcttgacttcatct

SEQ ID NO: 8366722 - DNA, 22 bp, Homo sapiens
ttaacattaaaagcagcatttt

SEQ ID NO: 8366723 - DNA, 22 bp, Homo sapiens
ttaacatgtcttgacttcatct

SEQ ID NO: 8366724 - DNA, 22 bp, Homo sapiens
ttaacatttagtgtacccctgt

SEQ ID NO: 8366725 - DNA, 22 bp, Homo sapiens
ttaacatttagtgtacccctgt

SEQ ID NO: 8366726 - DNA, 22 bp, Homo sapiens
ttaacatttcttttccactcat

SEQ ID NO: 8366727 - DNA, 22 bp, Homo sapiens
ttaacattgtccttagcagatt

SEQ ID NO: 8366728 - DNA, 22 bp, Homo sapiens
ttaacattgtccttagcagatt

SEQ ID NO: 8366729 - DNA, 22 bp, Homo sapiens
ttaacattgtccttagcagatt

SEQ ID NO: 8366730 - DNA, 22 bp, Homo sapiens
ttaacatttcttttccactcat

SEQ ID NO: 8366731 - DNA, 22 bp, Homo sapiens
ttaacatttgtgaagcatttag

SEQ ID NO: 8366732 - DNA, 22 bp, Homo sapiens
ttaacatttgtgaagcatttag

SEQ ID NO: 8366733 - DNA, 22 bp, Homo sapiens
ttaactctccctccttacatcc

SEQ ID NO: 8366734 - DNA, 19 bp, Homo sapiens
ttaacagtcaccaaggaga

SEQ ID NO: 8366735 - DNA, 22 bp, Homo sapiens
ttaacatacatcatgaacaatg

SEQ ID NO: 8366736 - DNA, 22 bp, Homo sapiens
ttaacatcctgtttaaatttgg

SEQ ID NO: 8366737 - DNA, 22 bp, Homo sapiens
ttaacagaggacacatcaaact

SEQ ID NO: 8366738 - DNA, 22 bp, Homo sapiens
ttaacactatctgtcataatta

SEQ ID NO: 8366739 - DNA, 22 bp, Homo sapiens
ttacatattgtctattgttcaa

SEQ ID NO: 8366740 - DNA, 22 bp, Homo sapiens
ttacatcagaaggaaacagcgt

SEQ ID NO: 8366741 - DNA, 22 bp, Homo sapiens
ttacatcattgagacatacata

SEQ ID NO: 8366742 - DNA, 19 bp, Homo sapiens
ttacatctgcaacactggt

SEQ ID NO: 8366743 - DNA, 22 bp, Homo sapiens
ttacatgacaaagctttggctc

SEQ ID NO: 8366744 - DNA, 22 bp, Homo sapiens
ttacagtattgttaaactcttt

SEQ ID NO: 8366745 - DNA, 22 bp, Homo sapiens
ttacatattatccaaaactgct

SEQ ID NO: 8366746 - DNA, 22 bp, Homo sapiens
ttacagtacagaaaataacaga

SEQ ID NO: 8366747 - DNA, 21 bp, Homo sapiens
ttacaggtcatccaagtcacc

SEQ ID NO: 8366748 - DNA, 22 bp, Homo sapiens
ttacaaactgtcatatagtatt

SEQ ID NO: 8366749 - DNA, 22 bp, Homo sapiens
ttacaaactccagtgagtgagc

SEQ ID NO: 8366750 - DNA, 22 bp, Homo sapiens
ttacaaacaagatcttattctt

SEQ ID NO: 8366751 - DNA, 22 bp, Homo sapiens
ttacaaacaagatcttattctt

SEQ ID NO: 8366752 - DNA, 22 bp, Homo sapiens
ttacaaacaacagacatttatt

SEQ ID NO: 8366753 - DNA, 22 bp, Homo sapiens
ttacacaacagtgcatcagcag

SEQ ID NO: 8366754 - DNA, 22 bp, Homo sapiens
ttacacaaagttagctcttgca

SEQ ID NO: 8366755 - DNA, 22 bp, Homo sapiens
ttacacaaagttagctcttgca

SEQ ID NO: 8366756 - DNA, 22 bp, Homo sapiens
ttacacaaacacattccagata

SEQ ID NO: 8366757 - DNA, 22 bp, Homo sapiens
ttacacaatatatggtacttgg

SEQ ID NO: 8366758 - DNA, 22 bp, Homo sapiens
ttacacaagttctttaacctat

SEQ ID NO: 8366759 - DNA, 22 bp, Homo sapiens
ttaattttctcatctgtgaaat

SEQ ID NO: 8366760 - DNA, 22 bp, Homo sapiens
ttaattttctcatctgtgaaat

SEQ ID NO: 8366761 - DNA, 21 bp, Homo sapiens
ttaatttattcatgatagcta

SEQ ID NO: 8366762 - DNA, 21 bp, Homo sapiens
ttaatttattcatgatagcta

SEQ ID NO: 8366763 - DNA, 22 bp, Homo sapiens
ttaattttaacctgtttgtgtc

SEQ ID NO: 8366764 - DNA, 22 bp, Homo sapiens
ttaatttttatgtatagtgtgt

SEQ ID NO: 8366765 - DNA, 22 bp, Homo sapiens
ttaattttgatgaggttcagtt

SEQ ID NO: 8366766 - DNA, 22 bp, Homo sapiens
ttaattttctcatctgtgaaat

SEQ ID NO: 8366767 - DNA, 22 bp, Homo sapiens
ttacaaacaacagacatttatt

SEQ ID NO: 8366768 - DNA, 22 bp, Homo sapiens
ttacacattgcagatcaaaatg

SEQ ID NO: 8366769 - DNA, 22 bp, Homo sapiens
ttacacattgcagatcaaaatg

SEQ ID NO: 8366770 - DNA, 22 bp, Homo sapiens
ttacacattaacaggcagctaa

SEQ ID NO: 8366771 - DNA, 18 bp, Homo sapiens
ttacactagccttggttc

SEQ ID NO: 8366772 - DNA, 22 bp, Homo sapiens
ttacactcatattgcacttacc

SEQ ID NO: 8366773 - DNA, 19 bp, Homo sapiens
ttacactcctgggcagtgg

SEQ ID NO: 8366774 - DNA, 22 bp, Homo sapiens
ttacactctggttgtgggcctt

SEQ ID NO: 8366775 - DNA, 22 bp, Homo sapiens
ttacacatgaaggtccaatgtt

SEQ ID NO: 8366776 - DNA, 22 bp, Homo sapiens
ttacacagtgcacaagcagagt

SEQ ID NO: 8366777 - DNA, 22 bp, Homo sapiens
ttacacagtgcacaagcagagt

SEQ ID NO: 8366778 - DNA, 22 bp, Homo sapiens
ttacacagtgcacaagcagagt

SEQ ID NO: 8366779 - DNA, 22 bp, Homo sapiens
ttacacactctgccctgctgtt

SEQ ID NO: 8366780 - DNA, 22 bp, Homo sapiens
ttacacaattttattgacctaa

SEQ ID NO: 8366781 - DNA, 22 bp, Homo sapiens
ttacacaattactcactcctgg

SEQ ID NO: 8366782 - DNA, 22 bp, Homo sapiens
ttacacacagagctgggcctgg

SEQ ID NO: 8366783 - DNA, 22 bp, Homo sapiens
ttacacacaattagcatagtaa

SEQ ID NO: 8366784 - DNA, 22 bp, Homo sapiens
ttacacagatggttagtagagg

SEQ ID NO: 8366785 - DNA, 21 bp, Homo sapiens
ttagaagctaatgcagctggt

SEQ ID NO: 8366786 - DNA, 22 bp, Homo sapiens
ttagacatagaatattgtctag

SEQ ID NO: 8366787 - DNA, 22 bp, Homo sapiens
ttagagaagctgtaattattca

SEQ ID NO: 8366788 - DNA, 22 bp, Homo sapiens
ttagagaaattctggtaatgta

SEQ ID NO: 8366789 - DNA, 22 bp, Homo sapiens
ttagagaaccaatgaatagtct

SEQ ID NO: 8366790 - DNA, 22 bp, Homo sapiens
ttagagaaatgggtactgcata

SEQ ID NO: 8366791 - DNA, 22 bp, Homo sapiens
ttagagaagctgtaattattca

SEQ ID NO: 8366792 - DNA, 22 bp, Homo sapiens
ttactttgtttgcacttcacct

SEQ ID NO: 8366793 - DNA, 22 bp, Homo sapiens
ttacttttctattcgatatgtg

SEQ ID NO: 8366794 - DNA, 22 bp, Homo sapiens
ttagaaacaaaatagttatttg

SEQ ID NO: 8366795 - DNA, 19 bp, Homo sapiens
ttagaaactgttgacactg

SEQ ID NO: 8366796 - DNA, 22 bp, Homo sapiens
ttagaaagaactttagatatca

SEQ ID NO: 8366797 - DNA, 22 bp, Homo sapiens
ttagaaagagtataccagaaac

SEQ ID NO: 8366798 - DNA, 22 bp, Homo sapiens
ttagaaagagtataccagaaac

SEQ ID NO: 8366799 - DNA, 22 bp, Homo sapiens
ttagaaagaatagcctggctgc

SEQ ID NO: 8366800 - DNA, 20 bp, Homo sapiens
ttagaaagagcgtgataaga

SEQ ID NO: 8366801 - DNA, 22 bp, Homo sapiens
ttactttgttctcaagatatgt

SEQ ID NO: 8366802 - DNA, 22 bp, Homo sapiens
ttactttgggtcctgcttataa

SEQ ID NO: 8366803 - DNA, 22 bp, Homo sapiens
ttactttccagctctagcttca

SEQ ID NO: 8366804 - DNA, 22 bp, Homo sapiens
ttactttatgtgatggattagt

SEQ ID NO: 8366805 - DNA, 22 bp, Homo sapiens
ttactttatctcctagattcca

SEQ ID NO: 8366806 - DNA, 22 bp, Homo sapiens
ttacttaaacagaaatgcagaa

SEQ ID NO: 8366807 - DNA, 22 bp, Homo sapiens
ttacttcttgtctcatgcctat

SEQ ID NO: 8366808 - DNA, 22 bp, Homo sapiens
ttacttattaccaccaatgccg

SEQ ID NO: 8366809 - DNA, 19 bp, Homo sapiens
ttacttcaggagtgaaatt

SEQ ID NO: 8366810 - DNA, 22 bp, Homo sapiens
ttacttgacataaatgagttta

SEQ ID NO: 8366811 - DNA, 22 bp, Homo sapiens
ttacttgaaaggaaattaaggt

SEQ ID NO: 8366812 - DNA, 22 bp, Homo sapiens
ttacttgatgtatgatgagtag

SEQ ID NO: 8366813 - DNA, 22 bp, Homo sapiens
ttacttgaggaaaagtagtgtc

SEQ ID NO: 8366814 - DNA, 22 bp, Homo sapiens
ttacttgattgtggagtctgag

SEQ ID NO: 8366815 - DNA, 22 bp, Homo sapiens
ttacttgatgtatgatgagtag

SEQ ID NO: 8366816 - DNA, 21 bp, Homo sapiens
ttactttagaaattgcctttt

SEQ ID NO: 8366817 - DNA, 22 bp, Homo sapiens
ttactttagatcatactgtgtg

SEQ ID NO: 8366818 - DNA, 22 bp, Homo sapiens
ttactttaagggtgtcttatta

SEQ ID NO: 8366819 - DNA, 22 bp, Homo sapiens
ttactgctgttaggatattttt

SEQ ID NO: 8366820 - DNA, 22 bp, Homo sapiens
ttactgtaaaggtcacatggtg

SEQ ID NO: 8366821 - DNA, 22 bp, Homo sapiens
ttactggctgggcctgagggct

SEQ ID NO: 8366822 - DNA, 22 bp, Homo sapiens
ttactgtagaagagaatgattc

SEQ ID NO: 8366823 - DNA, 22 bp, Homo sapiens
ttactgtatacacaagtggtga

SEQ ID NO: 8366824 - DNA, 22 bp, Homo sapiens
ttactgatcccccaggtgaccc

SEQ ID NO: 8366825 - DNA, 22 bp, Homo sapiens
ttactgatacacataagaattt

SEQ ID NO: 8366826 - DNA, 22 bp, Homo sapiens
ttactgatggaacagagataga

SEQ ID NO: 8366827 - DNA, 22 bp, Homo sapiens
ttactgaaggtggatagtgagt

SEQ ID NO: 8366828 - DNA, 22 bp, Homo sapiens
ttactcgtgacaatgtccttga

SEQ ID NO: 8366829 - DNA, 22 bp, Homo sapiens
ttactacagagagagctccagt

SEQ ID NO: 8366830 - DNA, 22 bp, Homo sapiens
ttacattttggggtaaggataa

SEQ ID NO: 8366831 - DNA, 22 bp, Homo sapiens
tgtgttttacaaattctcttaa

SEQ ID NO: 8366832 - DNA, 22 bp, Homo sapiens
tgtgttttaaatggaaatttga

SEQ ID NO: 8366833 - DNA, 21 bp, Homo sapiens
tgtgttttaatgatattctgt

SEQ ID NO: 8366834 - DNA, 22 bp, Homo sapiens
tgtgttttgaactcatctactg

SEQ ID NO: 8366835 - DNA, 20 bp, Homo sapiens
tgtgttttgcagggcattta

SEQ ID NO: 8366836 - DNA, 22 bp, Homo sapiens
tgtgttttggaaggaacatgca

SEQ ID NO: 8366837 - DNA, 22 bp, Homo sapiens
tgtgttttggaaggaacatgca

SEQ ID NO: 8366838 - DNA, 22 bp, Homo sapiens
tgtgttttgtgtgacccagctc

SEQ ID NO: 8366839 - DNA, 22 bp, Homo sapiens
tgtgttttccagaatggtgttt

SEQ ID NO: 8366840 - DNA, 22 bp, Homo sapiens
tgtgttttccagaatggtgttt

SEQ ID NO: 8366841 - DNA, 22 bp, Homo sapiens
tgtgttttcctccctggcgttt

SEQ ID NO: 8366842 - DNA, 21 bp, Homo sapiens
tgtgttttctctctgggaggt

SEQ ID NO: 8366843 - DNA, 22 bp, Homo sapiens
tgtgttttatctattgtatctt

SEQ ID NO: 8366844 - DNA, 22 bp, Homo sapiens
tgtgtttctgagaatcccacct

SEQ ID NO: 8366845 - DNA, 22 bp, Homo sapiens
tgtgtttgaggcatgttgcaga

SEQ ID NO: 8366846 - DNA, 21 bp, Homo sapiens
tgtgtgcatatgcatgtacat

SEQ ID NO: 8366847 - DNA, 20 bp, Homo sapiens
tgtgtgcacacatgacattc

SEQ ID NO: 8366848 - DNA, 22 bp, Homo sapiens
tgtgttctggaaagctcactga

SEQ ID NO: 8366849 - DNA, 22 bp, Homo sapiens
tgtgttctggctgtgacagctg

SEQ ID NO: 8366850 - DNA, 22 bp, Homo sapiens
tgtgttcttaaaagcagtgata

SEQ ID NO: 8366851 - DNA, 22 bp, Homo sapiens
tgtgttgtgacattcttggatg

SEQ ID NO: 8366852 - DNA, 22 bp, Homo sapiens
tgtgttgtgacattcttggatg

SEQ ID NO: 8366853 - DNA, 22 bp, Homo sapiens
tgtgttctgaaggagaagagtg

SEQ ID NO: 8366854 - DNA, 22 bp, Homo sapiens
tgtgttctggaaagctcactga

SEQ ID NO: 8366855 - DNA, 22 bp, Homo sapiens
tgtgttaattttccctttctct

SEQ ID NO: 8366856 - DNA, 22 bp, Homo sapiens
tgtgttaattttccctttctct

SEQ ID NO: 8366857 - DNA, 21 bp, Homo sapiens
tgttatgtgcttcaagaagtg

SEQ ID NO: 8366858 - DNA, 22 bp, Homo sapiens
tgttatgtgccacacttgaggg

SEQ ID NO: 8366859 - DNA, 22 bp, Homo sapiens
tgttatttgggaaagttgtaca

SEQ ID NO: 8366860 - DNA, 22 bp, Homo sapiens
tgttatttctttgccatatctt

SEQ ID NO: 8366861 - DNA, 22 bp, Homo sapiens
tgttatttatttcacctccaga

SEQ ID NO: 8366862 - DNA, 22 bp, Homo sapiens
tgttatttatctgagcatttat

SEQ ID NO: 8366863 - DNA, 22 bp, Homo sapiens
tgttatttatctgagcatttat

SEQ ID NO: 8366864 - DNA, 22 bp, Homo sapiens
tgttattgatatctaatgctct

SEQ ID NO: 8366865 - DNA, 22 bp, Homo sapiens
tgttattatctgttaggtgttc

SEQ ID NO: 8366866 - DNA, 22 bp, Homo sapiens
tgttattatctgttaggtgttc

SEQ ID NO: 8366867 - DNA, 22 bp, Homo sapiens
tgttattatgtttccagagcct

SEQ ID NO: 8366868 - DNA, 22 bp, Homo sapiens
tgttattatgtttccagagcct

SEQ ID NO: 8366869 - DNA, 22 bp, Homo sapiens
tgttcaatccccaggtcctgaa

SEQ ID NO: 8366870 - DNA, 22 bp, Homo sapiens
tgttcacaacgtgcaggtttgt

SEQ ID NO: 8366871 - DNA, 22 bp, Homo sapiens
tgttcacaagatgtctgtggct

SEQ ID NO: 8366872 - DNA, 22 bp, Homo sapiens
tgttcacacacggaggccacag

SEQ ID NO: 8366873 - DNA, 22 bp, Homo sapiens
tgttcacacacggaggccacag

SEQ ID NO: 8366874 - DNA, 22 bp, Homo sapiens
tgttatttgggaaagttgtaca

SEQ ID NO: 8366875 - DNA, 22 bp, Homo sapiens
tgttatttgggaaagttgtaca

SEQ ID NO: 8366876 - DNA, 22 bp, Homo sapiens
tgttcaaatcttttgcttattt

SEQ ID NO: 8366877 - DNA, 21 bp, Homo sapiens
tgttcaaacgtacacatttct

SEQ ID NO: 8366878 - DNA, 22 bp, Homo sapiens
tgttcaaatgatcttcttaaat

SEQ ID NO: 8366879 - DNA, 22 bp, Homo sapiens
tgttcctggttcctgcatgatg

SEQ ID NO: 8366880 - DNA, 22 bp, Homo sapiens
tgttcctggttcctgcatgatg

SEQ ID NO: 8366881 - DNA, 22 bp, Homo sapiens
tgtttctttgtagatattcttt

SEQ ID NO: 8366882 - DNA, 20 bp, Homo sapiens
tgtttcttttaatgagcggc

SEQ ID NO: 8366883 - DNA, 22 bp, Homo sapiens
tgtttcttgataaagcagaaaa

SEQ ID NO: 8366884 - DNA, 22 bp, Homo sapiens
tgtttcttgagagtattaccct

SEQ ID NO: 8366885 - DNA, 23 bp, Homo sapiens
tgtttctagaatcattgatgtct

SEQ ID NO: 8366886 - DNA, 18 bp, Homo sapiens
tgtttcctcctggaggct

SEQ ID NO: 8366887 - DNA, 22 bp, Homo sapiens
tgtttcctaagtgtctctgaag

SEQ ID NO: 8366888 - DNA, 22 bp, Homo sapiens
tgtttactatgatgtaacctat

SEQ ID NO: 8366889 - DNA, 22 bp, Homo sapiens
tgtttcaagcaatagcatttca

SEQ ID NO: 8366890 - DNA, 22 bp, Homo sapiens
tgtttcaggcttctgggatttt

SEQ ID NO: 8366891 - DNA, 22 bp, Homo sapiens
tgtttcagagcactgggcttat

SEQ ID NO: 8366892 - DNA, 22 bp, Homo sapiens
tgtttacatggaggttttcagc

SEQ ID NO: 8366893 - DNA, 22 bp, Homo sapiens
tgtttacatatttggtctcaga

SEQ ID NO: 8366894 - DNA, 22 bp, Homo sapiens
tgtttacatgcataagcttaag

SEQ ID NO: 8366895 - DNA, 22 bp, Homo sapiens
tgtttacatgcataagcttaag

SEQ ID NO: 8366896 - DNA, 21 bp, Homo sapiens
tgttcctgttctctaggatcc

SEQ ID NO: 8366897 - DNA, 23 bp, Homo sapiens
tgttcctgtcaaattttcttccc

SEQ ID NO: 8366898 - DNA, 22 bp, Homo sapiens
tgttctctctccttttgaagtg

SEQ ID NO: 8366899 - DNA, 19 bp, Homo sapiens
tgttctagcggcaccaggc

SEQ ID NO: 8366900 - DNA, 22 bp, Homo sapiens
tgttctaggcaaaagctgattt

SEQ ID NO: 8366901 - DNA, 22 bp, Homo sapiens
tgttctatcaatttaagggaaa

SEQ ID NO: 8366902 - DNA, 22 bp, Homo sapiens
tgttctcactggatgcttcaca

SEQ ID NO: 8366903 - DNA, 22 bp, Homo sapiens
tgttctcttttcctgctgagcc

SEQ ID NO: 8366904 - DNA, 22 bp, Homo sapiens
tgttctggagataagaggtaga

SEQ ID NO: 8366905 - DNA, 22 bp, Homo sapiens
tgttctgccagcacttctcagc

SEQ ID NO: 8366906 - DNA, 22 bp, Homo sapiens
tgttctggtgaggccatggggt

SEQ ID NO: 8366907 - DNA, 22 bp, Homo sapiens
tgttctgtacctgtcctggggc

SEQ ID NO: 8366908 - DNA, 22 bp, Homo sapiens
tgttctggggttgagagacaat

SEQ ID NO: 8366909 - DNA, 22 bp, Homo sapiens
tgttctgtgcatctagccagta

SEQ ID NO: 8366910 - DNA, 22 bp, Homo sapiens
tgtttacaaggagtttatattg

SEQ ID NO: 8366911 - DNA, 22 bp, Homo sapiens
tgtttacaaaaccgtggtactg

SEQ ID NO: 8366912 - DNA, 22 bp, Homo sapiens
tgtttacagaaggcagacttcc

SEQ ID NO: 8366913 - DNA, 22 bp, Homo sapiens
tgtttacagggtgattttacct

SEQ ID NO: 8366914 - DNA, 22 bp, Homo sapiens
tgtttacagctgatcaggcatc

SEQ ID NO: 8366915 - DNA, 22 bp, Homo sapiens
tgtgtccattcaggcactgacc

SEQ ID NO: 8366916 - DNA, 22 bp, Homo sapiens
tgtgtcctcagggaagcagaga

SEQ ID NO: 8366917 - DNA, 22 bp, Homo sapiens
tgtgtccatctgacaggagagg

SEQ ID NO: 8366918 - DNA, 22 bp, Homo sapiens
tgtgtcctttggaggatcagcg

SEQ ID NO: 8366919 - DNA, 22 bp, Homo sapiens
tgtgtcctgtccccttgctgct

SEQ ID NO: 8366920 - DNA, 22 bp, Homo sapiens
tgtgtcctcatgtggcagagag

SEQ ID NO: 8366921 - DNA, 22 bp, Homo sapiens
tgtgtcctgcagacagactcag

SEQ ID NO: 8366922 - DNA, 22 bp, Homo sapiens
tgtgtgaattctgagcagttta

SEQ ID NO: 8366923 - DNA, 20 bp, Homo sapiens
tgtgtgaatttcagagccgc

SEQ ID NO: 8366924 - DNA, 22 bp, Homo sapiens
tgtgtgaggattcctggttctt

SEQ ID NO: 8366925 - DNA, 22 bp, Homo sapiens
tgtgtgagtaaggctgagagag

SEQ ID NO: 8366926 - DNA, 22 bp, Homo sapiens
tgtgtgaggtggttctgagaag

SEQ ID NO: 8366927 - DNA, 22 bp, Homo sapiens
tgtgtctttggcgatgtctgga

SEQ ID NO: 8366928 - DNA, 22 bp, Homo sapiens
tgtgtctttgttccaggtacga

SEQ ID NO: 8366929 - DNA, 20 bp, Homo sapiens
tgtgtcttcctttctttatg

SEQ ID NO: 8366930 - DNA, 22 bp, Homo sapiens
tgtgtcttacataattacatgt

SEQ ID NO: 8366931 - DNA, 22 bp, Homo sapiens
tgtgtcttacataattacatgt

SEQ ID NO: 8366932 - DNA, 22 bp, Homo sapiens
tgtgtcttaagttccaagacat

SEQ ID NO: 8366933 - DNA, 22 bp, Homo sapiens
tgtgtacaaactaacaacatat

SEQ ID NO: 8366934 - DNA, 21 bp, Homo sapiens
tgtgtaatatgtataagaata

SEQ ID NO: 8366935 - DNA, 21 bp, Homo sapiens
tgtgtaatatgtataagaata

SEQ ID NO: 8366936 - DNA, 22 bp, Homo sapiens
tgtgtaaatttatttacataaa

SEQ ID NO: 8366937 - DNA, 22 bp, Homo sapiens
tgtgtaaattatttttaatgat

SEQ ID NO: 8366938 - DNA, 22 bp, Homo sapiens
tgtgtaaaatctgattaatact

SEQ ID NO: 8366939 - DNA, 20 bp, Homo sapiens
tgtggtttttgccagttgaa

SEQ ID NO: 8366940 - DNA, 22 bp, Homo sapiens
tgtgtaaaagattagtttacta

SEQ ID NO: 8366941 - DNA, 22 bp, Homo sapiens
tgtggttggaatgcagccatgc

SEQ ID NO: 8366942 - DNA, 22 bp, Homo sapiens
tgtggttttggttcagaaacaa

SEQ ID NO: 8366943 - DNA, 22 bp, Homo sapiens
tgtggtgccgagagtctggacg

SEQ ID NO: 8366944 - DNA, 22 bp, Homo sapiens
tgtggtgagaaactggtagatt

SEQ ID NO: 8366945 - DNA, 22 bp, Homo sapiens
tgtggggaggctgcagtgctgc

SEQ ID NO: 8366946 - DNA, 19 bp, Homo sapiens
tgtggggagtcagggggct

SEQ ID NO: 8366947 - DNA, 22 bp, Homo sapiens
tgtggcctgattttgcatctct

SEQ ID NO: 8366948 - DNA, 22 bp, Homo sapiens
tgtggcagatacagaagatcaa

SEQ ID NO: 8366949 - DNA, 21 bp, Homo sapiens
tgtggcagatgttgggaggca

SEQ ID NO: 8366950 - DNA, 22 bp, Homo sapiens
tgtggcagaaggctaaggtgtc

SEQ ID NO: 8366951 - DNA, 22 bp, Homo sapiens
tgtggatgaataaagtgcagac

SEQ ID NO: 8366952 - DNA, 20 bp, Homo sapiens
tgtggatgaggtaaggatag

SEQ ID NO: 8366953 - DNA, 22 bp, Homo sapiens
tgtggatgagggagtgaacaaa

SEQ ID NO: 8366954 - DNA, 22 bp, Homo sapiens
tgtggaggattctgatgccagc

SEQ ID NO: 8366955 - DNA, 22 bp, Homo sapiens
tgtggaggattctgatgccagc

SEQ ID NO: 8366956 - DNA, 22 bp, Homo sapiens
tgtggcagaactgggactcaaa

SEQ ID NO: 8366957 - DNA, 22 bp, Homo sapiens
tgtggcagaaccagaattcaaa

SEQ ID NO: 8366958 - DNA, 22 bp, Homo sapiens
tgtggcagaaagcatgtggaca

SEQ ID NO: 8366959 - DNA, 22 bp, Homo sapiens
tgtggcagaaagcatgtggaca

SEQ ID NO: 8366960 - DNA, 22 bp, Homo sapiens
tgtggcagtaaaattgggcaac

SEQ ID NO: 8366961 - DNA, 22 bp, Homo sapiens
tgtggcagtataagagctagaa

SEQ ID NO: 8366962 - DNA, 22 bp, Homo sapiens
tgtggcagtctcactggagggc

SEQ ID NO: 8366963 - DNA, 22 bp, Homo sapiens
tgtggcattgaataaccttgga

SEQ ID NO: 8366964 - DNA, 21 bp, Homo sapiens
tgtggcatcattgatctgtga

SEQ ID NO: 8366965 - DNA, 22 bp, Homo sapiens
tgtggcagtctcactggagggc

SEQ ID NO: 8366966 - DNA, 19 bp, Homo sapiens
tgtggccatggttcagctg

SEQ ID NO: 8366967 - DNA, 22 bp, Homo sapiens
tccccctcattacctcattcaa

SEQ ID NO: 8366968 - DNA, 22 bp, Homo sapiens
tcccctccaactccaactatgg

SEQ ID NO: 8366969 - DNA, 22 bp, Homo sapiens
tcccctcccttccaacagagct

SEQ ID NO: 8366970 - DNA, 22 bp, Homo sapiens
tcccccaggctggagtgcagtg

SEQ ID NO: 8366971 - DNA, 22 bp, Homo sapiens
tcccccaactcttagcactgta

SEQ ID NO: 8366972 - DNA, 22 bp, Homo sapiens
tcccccaaatgaatgaggaata

SEQ ID NO: 8366973 - DNA, 22 bp, Homo sapiens
tcccccactctaaaggagcctt

SEQ ID NO: 8366974 - DNA, 22 bp, Homo sapiens
tccccagtaagcctgcactgtg

SEQ ID NO: 8366975 - DNA, 22 bp, Homo sapiens
tccccagtaagcctgcactgtg

SEQ ID NO: 8366976 - DNA, 22 bp, Homo sapiens
tccccagtcccggcggtgggtg

SEQ ID NO: 8366977 - DNA, 22 bp, Homo sapiens
tccccaggtcctgtcggctcct

SEQ ID NO: 8366978 - DNA, 22 bp, Homo sapiens
tccccaggtcctgtcggctcct

SEQ ID NO: 8366979 - DNA, 22 bp, Homo sapiens
tcccctgcagatgagggcagtg

SEQ ID NO: 8366980 - DNA, 21 bp, Homo sapiens
gggctggatattggaaagagg

SEQ ID NO: 8366981 - DNA, 22 bp, Homo sapiens
gggctggagttgggaagacaaa

SEQ ID NO: 8366982 - DNA, 22 bp, Homo sapiens
gggctggatctcacgtgagacc

SEQ ID NO: 8366983 - DNA, 20 bp, Homo sapiens
gggctgtgcctcctcgtggt

SEQ ID NO: 8366984 - DNA, 22 bp, Homo sapiens
gggctgtgtaatgtgctctttt

SEQ ID NO: 8366985 - DNA, 22 bp, Homo sapiens
gggctgtgggacccggcacttt

SEQ ID NO: 8366986 - DNA, 22 bp, Homo sapiens
gggctggagtcttctgaaagcc

SEQ ID NO: 8366987 - DNA, 19 bp, Homo sapiens
gggctggagggatagagcc

SEQ ID NO: 8366988 - DNA, 21 bp, Homo sapiens
gggctggaggatgggaagccc

SEQ ID NO: 8366989 - DNA, 22 bp, Homo sapiens
cagagccacttggagatgagaa

SEQ ID NO: 8366990 - DNA, 22 bp, Homo sapiens
cagagccacttggagatgagaa

SEQ ID NO: 8366991 - DNA, 22 bp, Homo sapiens
cagagccagagacctgctgtgc

SEQ ID NO: 8366992 - DNA, 22 bp, Homo sapiens
cagagccagcccactgttcccg

SEQ ID NO: 8366993 - DNA, 22 bp, Homo sapiens
cagagccagcagtggggacagg

SEQ ID NO: 8366994 - DNA, 22 bp, Homo sapiens
ggggcagagtctggactgttgt

SEQ ID NO: 8366995 - DNA, 22 bp, Homo sapiens
ggggcagatggaacagagcaca

SEQ ID NO: 8366996 - DNA, 22 bp, Homo sapiens
ggggcagatggaacagagcaca

SEQ ID NO: 8366997 - DNA, 22 bp, Homo sapiens
ggggcagctaccggaagtaggg

SEQ ID NO: 8366998 - DNA, 22 bp, Homo sapiens
ggggcagagagaaggaagcttg

SEQ ID NO: 8366999 - DNA, 22 bp, Homo sapiens
ggggcagagaataaaaacctaa

SEQ ID NO: 8367000 - DNA, 22 bp, Homo sapiens
ggggaggaagctctcagttcca

SEQ ID NO: 8367001 - DNA, 22 bp, Homo sapiens
ggggcagagtagctggggtgtg

SEQ ID NO: 8367002 - DNA, 22 bp, Homo sapiens
ggggcagagcatagctccaatt

SEQ ID NO: 8367003 - DNA, 21 bp, Homo sapiens
ggggcagagctaggccctgca

SEQ ID NO: 8367004 - DNA, 21 bp, Homo sapiens
ggggcagagctaggccctgca

SEQ ID NO: 8367005 - DNA, 22 bp, Homo sapiens
ggggccttggatctgtgccccg

SEQ ID NO: 8367006 - DNA, 22 bp, Homo sapiens
ggggccttttctgaatgtggaa

SEQ ID NO: 8367007 - DNA, 22 bp, Homo sapiens
gggtaatgaacaggtggcagag

SEQ ID NO: 8367008 - DNA, 22 bp, Homo sapiens
cagatatgataggattagcaca

SEQ ID NO: 8367009 - DNA, 19 bp, Homo sapiens
cagatgagaaaagtgaggt

SEQ ID NO: 8367010 - DNA, 22 bp, Homo sapiens
cagatgcaggtctgctcacctg

SEQ ID NO: 8367011 - DNA, 22 bp, Homo sapiens
cagatgcagcaaaatgacaggc

SEQ ID NO: 8367012 - DNA, 22 bp, Homo sapiens
cagatgcagcaaaatgacaggc

SEQ ID NO: 8367013 - DNA, 22 bp, Homo sapiens
cagatgcacattctcatcagca

SEQ ID NO: 8367014 - DNA, 20 bp, Homo sapiens
gggtgtgggcccggccaggc

SEQ ID NO: 8367015 - DNA, 22 bp, Homo sapiens
gggtgggatctgtggagcctca

SEQ ID NO: 8367016 - DNA, 22 bp, Homo sapiens
ggtataaatgatcagatcgctg

SEQ ID NO: 8367017 - DNA, 22 bp, Homo sapiens
gggttccctgcctggccactct

SEQ ID NO: 8367018 - DNA, 18 bp, Homo sapiens
gggtccccagctgcaggg

SEQ ID NO: 8367019 - DNA, 22 bp, Homo sapiens
gggtcccctcatcatggagact

SEQ ID NO: 8367020 - DNA, 22 bp, Homo sapiens
gggtccctggaattacttgaca

SEQ ID NO: 8367021 - DNA, 22 bp, Homo sapiens
gggtccaggtcttcaggcagag

SEQ ID NO: 8367022 - DNA, 22 bp, Homo sapiens
gggtccaggtcttcaggcagag

SEQ ID NO: 8367023 - DNA, 22 bp, Homo sapiens
gggtccagtttcatctgaggtt

SEQ ID NO: 8367024 - DNA, 22 bp, Homo sapiens
gggcaggggtagcattccaagt

SEQ ID NO: 8367025 - DNA, 22 bp, Homo sapiens
gggcaggggtagcattccaagt

SEQ ID NO: 8367026 - DNA, 22 bp, Homo sapiens
gggcaggggtcagtggccccaa

SEQ ID NO: 8367027 - DNA, 18 bp, Homo sapiens
cagagcagaggtggagcg

SEQ ID NO: 8367028 - DNA, 18 bp, Homo sapiens
cagagcagaggtggagcg

SEQ ID NO: 8367029 - DNA, 22 bp, Homo sapiens
cagagcagacgttgagattaag

SEQ ID NO: 8367030 - DNA, 22 bp, Homo sapiens
cagagcagacgttgagattaag

SEQ ID NO: 8367031 - DNA, 22 bp, Homo sapiens
cagagcagaagcggtcctcaca

SEQ ID NO: 8367032 - DNA, 22 bp, Homo sapiens
cagagcagaaggtccaagcctg

SEQ ID NO: 8367033 - DNA, 22 bp, Homo sapiens
cagagcagaaggtccaagcctg

SEQ ID NO: 8367034 - DNA, 22 bp, Homo sapiens
cagagcaggcccactgccctcc

SEQ ID NO: 8367035 - DNA, 22 bp, Homo sapiens
cagagcagtgaggagttgtgta

SEQ ID NO: 8367036 - DNA, 22 bp, Homo sapiens
gggcaggtactgggtggtgagc

SEQ ID NO: 8367037 - DNA, 22 bp, Homo sapiens
gggcaggggtcagtggccccaa

SEQ ID NO: 8367038 - DNA, 20 bp, Homo sapiens
cagagcagtgcccaggcggc

SEQ ID NO: 8367039 - DNA, 20 bp, Homo sapiens
cagagcagtgcccaggcggc

SEQ ID NO: 8367040 - DNA, 22 bp, Homo sapiens
cagagcagtggagagtaggtct

SEQ ID NO: 8367041 - DNA, 22 bp, Homo sapiens
cagagcagtggagagtaggtct

SEQ ID NO: 8367042 - DNA, 22 bp, Homo sapiens
cagagcagtggagagtaggtct

SEQ ID NO: 8367043 - DNA, 22 bp, Homo sapiens
cagagcagtgaggagttgtgta

SEQ ID NO: 8367044 - DNA, 22 bp, Homo sapiens
cagagcagtgaggagttgtgta

SEQ ID NO: 8367045 - DNA, 20 bp, Homo sapiens
cagagcagtgcccaggcggc

SEQ ID NO: 8367046 - DNA, 19 bp, Homo sapiens
cagagcagtggttcctgaa

SEQ ID NO: 8367047 - DNA, 22 bp, Homo sapiens
cagagcagtggggttggtcaga

SEQ ID NO: 8367048 - DNA, 22 bp, Homo sapiens
cagagcagtggggttggtcaga

SEQ ID NO: 8367049 - DNA, 22 bp, Homo sapiens
cagagccaaacctcagggcccg

SEQ ID NO: 8367050 - DNA, 22 bp, Homo sapiens
cagagccaaatgctgtggttat

SEQ ID NO: 8367051 - DNA, 22 bp, Homo sapiens
cagagccaaacctcagggcccg

SEQ ID NO: 8367052 - DNA, 22 bp, Homo sapiens
cagagccaacgccacctgccca

SEQ ID NO: 8367053 - DNA, 22 bp, Homo sapiens
cagagccacagcctccagattt

SEQ ID NO: 8367054 - DNA, 22 bp, Homo sapiens
cagagccactgtctgccaggca

SEQ ID NO: 8367055 - DNA, 20 bp, Homo sapiens
cagagccaagagcagcatct

SEQ ID NO: 8367056 - DNA, 22 bp, Homo sapiens
gggatgagagctgggacagaag

SEQ ID NO: 8367057 - DNA, 22 bp, Homo sapiens
cagagcagaaacctgggtgatt

SEQ ID NO: 8367058 - DNA, 22 bp, Homo sapiens
cagagcagaaacctgggtgatt

SEQ ID NO: 8367059 - DNA, 22 bp, Homo sapiens
cagagcagaagcggtcctcaca

SEQ ID NO: 8367060 - DNA, 22 bp, Homo sapiens
cagagcagaagcggtcctcaca

SEQ ID NO: 8367061 - DNA, 22 bp, Homo sapiens
gggatgagagtagggtgtgaaa

SEQ ID NO: 8367062 - DNA, 22 bp, Homo sapiens
cagagaggaggctatatgcaaa

SEQ ID NO: 8367063 - DNA, 22 bp, Homo sapiens
cagagcactgcttggaggattt

SEQ ID NO: 8367064 - DNA, 22 bp, Homo sapiens
cagagacaatgtctctgcttgt

SEQ ID NO: 8367065 - DNA, 22 bp, Homo sapiens
cagagacaccccagaaaataag

SEQ ID NO: 8367066 - DNA, 22 bp, Homo sapiens
cagagacaccccagaaaataag

SEQ ID NO: 8367067 - DNA, 22 bp, Homo sapiens
cagagacaacctggtagagaaa

SEQ ID NO: 8367068 - DNA, 22 bp, Homo sapiens
cagagacacttaacaggaatgg

SEQ ID NO: 8367069 - DNA, 22 bp, Homo sapiens
cagagacacttaacaggaatgg

SEQ ID NO: 8367070 - DNA, 22 bp, Homo sapiens
cagagaagagtctggcctctct

SEQ ID NO: 8367071 - DNA, 22 bp, Homo sapiens
cagagaagagtctggcctctct

SEQ ID NO: 8367072 - DNA, 22 bp, Homo sapiens
cagagaagagtctggcctctct

SEQ ID NO: 8367073 - DNA, 22 bp, Homo sapiens
cagagaagagtctggcctctct

SEQ ID NO: 8367074 - DNA, 22 bp, Homo sapiens
cagagaagaaagtgactataat

SEQ ID NO: 8367075 - DNA, 22 bp, Homo sapiens
cagagaagaaagtgactataat

SEQ ID NO: 8367076 - DNA, 22 bp, Homo sapiens
cagagaacttagctagttttcc

SEQ ID NO: 8367077 - DNA, 22 bp, Homo sapiens
gggaggcatgtgttatccactt

SEQ ID NO: 8367078 - DNA, 20 bp, Homo sapiens
gggaggcattggtccctcac

SEQ ID NO: 8367079 - DNA, 22 bp, Homo sapiens
cagacttgacggcagctgcttt

SEQ ID NO: 8367080 - DNA, 22 bp, Homo sapiens
gggagctgatcaggtggattca

SEQ ID NO: 8367081 - DNA, 22 bp, Homo sapiens
cagacacttattgagcaagtac

SEQ ID NO: 8367082 - DNA, 22 bp, Homo sapiens
gggagcataaactcagatttca

SEQ ID NO: 8367083 - DNA, 22 bp, Homo sapiens
gggagcatttattttccgttag

SEQ ID NO: 8367084 - DNA, 22 bp, Homo sapiens
cagacagaaggaaggccaacat

SEQ ID NO: 8367085 - DNA, 22 bp, Homo sapiens
cagacacagatatgcatatggc

SEQ ID NO: 8367086 - DNA, 22 bp, Homo sapiens
cagacacaccaggcccattctg

SEQ ID NO: 8367087 - DNA, 22 bp, Homo sapiens
cagacacagatatgcatatggc

SEQ ID NO: 8367088 - DNA, 22 bp, Homo sapiens
cagacactaggtgacagagtgc

SEQ ID NO: 8367089 - DNA, 18 bp, Homo sapiens
cagacactctgctctgca

SEQ ID NO: 8367090 - DNA, 18 bp, Homo sapiens
cagacactctgctctgca

SEQ ID NO: 8367091 - DNA, 22 bp, Homo sapiens
gggagctgctgaacacaagggt

SEQ ID NO: 8367092 - DNA, 22 bp, Homo sapiens
gggaggcagtgctggaggctgg

SEQ ID NO: 8367093 - DNA, 22 bp, Homo sapiens
gggaggcacgaggcgcgcagtg

SEQ ID NO: 8367094 - DNA, 22 bp, Homo sapiens
gggaggcacgaggcgcgcagtg

SEQ ID NO: 8367095 - DNA, 22 bp, Homo sapiens
cagacaaagcggaaactgttta

SEQ ID NO: 8367096 - DNA, 22 bp, Homo sapiens
cagacaaagcggaaactgttta

SEQ ID NO: 8367097 - DNA, 22 bp, Homo sapiens
cagaatttttcactcaatcttc

SEQ ID NO: 8367098 - DNA, 22 bp, Homo sapiens
cagacacacaagcaatctaagt

SEQ ID NO: 8367099 - DNA, 22 bp, Homo sapiens
cagaaacaggcaacgtgtgcac

SEQ ID NO: 8367100 - DNA, 22 bp, Homo sapiens
cagaaacagagaaatattggct

SEQ ID NO: 8367101 - DNA, 22 bp, Homo sapiens
cagaaacacttgtagagaagtt

SEQ ID NO: 8367102 - DNA, 22 bp, Homo sapiens
ggctggcactgaggagagctct

SEQ ID NO: 8367103 - DNA, 22 bp, Homo sapiens
cagaaaatagagtttctctgag

SEQ ID NO: 8367104 - DNA, 22 bp, Homo sapiens
cagaaaatagagtttctctgag

SEQ ID NO: 8367105 - DNA, 22 bp, Homo sapiens
ggctggcacctgccctccgctg

SEQ ID NO: 8367106 - DNA, 22 bp, Homo sapiens
ggctggcacgaagccctgctgg

SEQ ID NO: 8367107 - DNA, 22 bp, Homo sapiens
ggctggcactctgtccagtgtc

SEQ ID NO: 8367108 - DNA, 22 bp, Homo sapiens
ggctggcaagtgtctgctcatg

SEQ ID NO: 8367109 - DNA, 19 bp, Homo sapiens
ggctggcaagtgacagtgt

SEQ ID NO: 8367110 - DNA, 22 bp, Homo sapiens
cagccctgtctatgactgatga

SEQ ID NO: 8367111 - DNA, 22 bp, Homo sapiens
cagccctgtctatgactgatga

SEQ ID NO: 8367112 - DNA, 22 bp, Homo sapiens
cagccctggccccaggtggtct

SEQ ID NO: 8367113 - DNA, 22 bp, Homo sapiens
cagccctgaaacaacctcctct

SEQ ID NO: 8367114 - DNA, 22 bp, Homo sapiens
cagccctggcccaggtgcctta

SEQ ID NO: 8367115 - DNA, 22 bp, Homo sapiens
cagccctggtgccaaggttccc

SEQ ID NO: 8367116 - DNA, 22 bp, Homo sapiens
cagccctgtccaatgtctgctc

SEQ ID NO: 8367117 - DNA, 22 bp, Homo sapiens
cagccctgtccaatgtctgctc

SEQ ID NO: 8367118 - DNA, 22 bp, Homo sapiens
cagccctgtccagcagagggtg

SEQ ID NO: 8367119 - DNA, 22 bp, Homo sapiens
cagccctgtccaatgtctgctc

SEQ ID NO: 8367120 - DNA, 22 bp, Homo sapiens
cagccctgtccctgagggacct

SEQ ID NO: 8367121 - DNA, 22 bp, Homo sapiens
cagccctgtccctgagggacct

SEQ ID NO: 8367122 - DNA, 22 bp, Homo sapiens
gtcctgtgacctgcatcctgag

SEQ ID NO: 8367123 - DNA, 22 bp, Homo sapiens
gtgaatttctgactaaaagtgc

SEQ ID NO: 8367124 - DNA, 22 bp, Homo sapiens
gtcctgtgccgaggtgggaagc

SEQ ID NO: 8367125 - DNA, 22 bp, Homo sapiens
gtcctgtgctcagacatggggg

SEQ ID NO: 8367126 - DNA, 22 bp, Homo sapiens
gtcctgtgcaccgtgggatgtt

SEQ ID NO: 8367127 - DNA, 22 bp, Homo sapiens
gtcctgtgccctgggtggcgct

SEQ ID NO: 8367128 - DNA, 22 bp, Homo sapiens
cagccctgaaacaacctcctct

SEQ ID NO: 8367129 - DNA, 22 bp, Homo sapiens
gtgagattccttagattcatgg

SEQ ID NO: 8367130 - DNA, 22 bp, Homo sapiens
gtgagagtggtttatgtccatg

SEQ ID NO: 8367131 - DNA, 23 bp, Homo sapiens
gtgagcagcaccatgaggctaga

SEQ ID NO: 8367132 - DNA, 22 bp, Homo sapiens
cagccaggactcccatttagga

SEQ ID NO: 8367133 - DNA, 22 bp, Homo sapiens
cagccaggactcccatttagga

SEQ ID NO: 8367134 - DNA, 22 bp, Homo sapiens
cagccaggagcctctgcaacta

SEQ ID NO: 8367135 - DNA, 22 bp, Homo sapiens
cagccaggatggagaactgttg

SEQ ID NO: 8367136 - DNA, 22 bp, Homo sapiens
cagccaggcccagatcatgctg

SEQ ID NO: 8367137 - DNA, 22 bp, Homo sapiens
cagccagctggtgcggcagagc

SEQ ID NO: 8367138 - DNA, 22 bp, Homo sapiens
cagccagctgtcccaagtgcct

SEQ ID NO: 8367139 - DNA, 22 bp, Homo sapiens
cagccaggacagggaaactagt

SEQ ID NO: 8367140 - DNA, 22 bp, Homo sapiens
gtccagcaggatgcaagtgcca

SEQ ID NO: 8367141 - DNA, 22 bp, Homo sapiens
gtccagcatttaggcttgctga

SEQ ID NO: 8367142 - DNA, 20 bp, Homo sapiens
gtccagagtaatgtgctgac

SEQ ID NO: 8367143 - DNA, 22 bp, Homo sapiens
gtccagagggctgcaggatgct

SEQ ID NO: 8367144 - DNA, 22 bp, Homo sapiens
cagcatctgaccaatatctaca

SEQ ID NO: 8367145 - DNA, 22 bp, Homo sapiens
cagcatctcatttgacttctgc

SEQ ID NO: 8367146 - DNA, 22 bp, Homo sapiens
cagcatctcattcattcatgtt

SEQ ID NO: 8367147 - DNA, 22 bp, Homo sapiens
gtagggagcccagagcccagtg

SEQ ID NO: 8367148 - DNA, 22 bp, Homo sapiens
gtattttacttacgcatgactt

SEQ ID NO: 8367149 - DNA, 22 bp, Homo sapiens
gtagggacatgccattatctca

SEQ ID NO: 8367150 - DNA, 22 bp, Homo sapiens
gtcagatctttggggatgctgt

SEQ ID NO: 8367151 - DNA, 22 bp, Homo sapiens
gtcagatctttggggatgctgt

SEQ ID NO: 8367152 - DNA, 22 bp, Homo sapiens
gtacacagatgcttgagaatct

SEQ ID NO: 8367153 - DNA, 22 bp, Homo sapiens
cagcagcctagaagctctacca

SEQ ID NO: 8367154 - DNA, 22 bp, Homo sapiens
gtacttctcaaactagaaacta

SEQ ID NO: 8367155 - DNA, 22 bp, Homo sapiens
gtagaaaaagcagtaagtctca

SEQ ID NO: 8367156 - DNA, 22 bp, Homo sapiens
gtagaaaaagcagtaagtctca

SEQ ID NO: 8367157 - DNA, 22 bp, Homo sapiens
gtagaaatagtggttgacagga

SEQ ID NO: 8367158 - DNA, 22 bp, Homo sapiens
gtagaaaattaggatgaggctt

SEQ ID NO: 8367159 - DNA, 22 bp, Homo sapiens
gtaggcaggtggaggagtgaag

SEQ ID NO: 8367160 - DNA, 22 bp, Homo sapiens
gtaggcagtctctcaggtgatc

SEQ ID NO: 8367161 - DNA, 22 bp, Homo sapiens
gtaggcagtggttggaagagaa

SEQ ID NO: 8367162 - DNA, 22 bp, Homo sapiens
gtaggctgtgtgaggctagaga

SEQ ID NO: 8367163 - DNA, 22 bp, Homo sapiens
cagcagcctacaatgcacagaa

SEQ ID NO: 8367164 - DNA, 22 bp, Homo sapiens
cagcagccgagagggggctctg

SEQ ID NO: 8367165 - DNA, 22 bp, Homo sapiens
cagcaaagcaggctcctagaac

SEQ ID NO: 8367166 - DNA, 22 bp, Homo sapiens
cagcaaagcaggctcctagaac

SEQ ID NO: 8367167 - DNA, 22 bp, Homo sapiens
cagcaaagcttaatttatatct

SEQ ID NO: 8367168 - DNA, 22 bp, Homo sapiens
cagcaaaggggatgcgtcctaa

SEQ ID NO: 8367169 - DNA, 22 bp, Homo sapiens
cagcaaaggggatgcgtcctaa

SEQ ID NO: 8367170 - DNA, 22 bp, Homo sapiens
cagcagcagattcagcgtctgg

SEQ ID NO: 8367171 - DNA, 22 bp, Homo sapiens
cagcaaaggtagaagcacagga

SEQ ID NO: 8367172 - DNA, 22 bp, Homo sapiens
cagattcttcattcattctaca

SEQ ID NO: 8367173 - DNA, 22 bp, Homo sapiens
cagcaaaagccagcataagctc

SEQ ID NO: 8367174 - DNA, 22 bp, Homo sapiens
caccactgtatccctagcactt

SEQ ID NO: 8367175 - DNA, 22 bp, Homo sapiens
caccactgcttcctgccatctg

SEQ ID NO: 8367176 - DNA, 22 bp, Homo sapiens
caccactggaggtcttggcttt

SEQ ID NO: 8367177 - DNA, 22 bp, Homo sapiens
caccaggagccatcaggagtcc

SEQ ID NO: 8367178 - DNA, 22 bp, Homo sapiens
caccagctccaccagggcaggt

SEQ ID NO: 8367179 - DNA, 22 bp, Homo sapiens
caccagcttgcagtcttaaccc

SEQ ID NO: 8367180 - DNA, 22 bp, Homo sapiens
cacatgtttttggccatcatgg

SEQ ID NO: 8367181 - DNA, 22 bp, Homo sapiens
cacattcacttctctgtccacc

SEQ ID NO: 8367182 - DNA, 22 bp, Homo sapiens
cacattcaggattttccatgtc

SEQ ID NO: 8367183 - DNA, 22 bp, Homo sapiens
cacattatgctactaccaaatg

SEQ ID NO: 8367184 - DNA, 22 bp, Homo sapiens
cacatgtgcagttacatgaatt

SEQ ID NO: 8367185 - DNA, 22 bp, Homo sapiens
cacatgtgtatatgtgaggggg

SEQ ID NO: 8367186 - DNA, 21 bp, Homo sapiens
cacatgtgaattactgaactg

SEQ ID NO: 8367187 - DNA, 22 bp, Homo sapiens
cacatgtgcaaatactgaggct

SEQ ID NO: 8367188 - DNA, 22 bp, Homo sapiens
cacatgtgtgctgaggactgtg

SEQ ID NO: 8367189 - DNA, 22 bp, Homo sapiens
ggcagatgctggcttctgctgt

SEQ ID NO: 8367190 - DNA, 22 bp, Homo sapiens
ggcagatggaagaggctgggtc

SEQ ID NO: 8367191 - DNA, 20 bp, Homo sapiens
ggcagatgcagagctatgca

SEQ ID NO: 8367192 - DNA, 20 bp, Homo sapiens
ggcagatgcagagctatgca

SEQ ID NO: 8367193 - DNA, 18 bp, Homo sapiens
ggcagatgacaggagaga

SEQ ID NO: 8367194 - DNA, 20 bp, Homo sapiens
ggcagatacctgtgtttaag

SEQ ID NO: 8367195 - DNA, 22 bp, Homo sapiens
ggcagatactaagctgcttcct

SEQ ID NO: 8367196 - DNA, 18 bp, Homo sapiens
ggcagatgacaggagaga

SEQ ID NO: 8367197 - DNA, 22 bp, Homo sapiens
ggcagatgacagaccagtatgt

SEQ ID NO: 8367198 - DNA, 22 bp, Homo sapiens
ggcagagtcagaggtggttctg

SEQ ID NO: 8367199 - DNA, 22 bp, Homo sapiens
ggcagagtgctctgggcagggg

SEQ ID NO: 8367200 - DNA, 22 bp, Homo sapiens
cacatgagtcctgccaggtatg

SEQ ID NO: 8367201 - DNA, 22 bp, Homo sapiens
cacatgaaggctggggtcgtga

SEQ ID NO: 8367202 - DNA, 22 bp, Homo sapiens
cacatgaggtgacttccaagct

SEQ ID NO: 8367203 - DNA, 20 bp, Homo sapiens
ggcaatcctaacgtgttcca

SEQ ID NO: 8367204 - DNA, 22 bp, Homo sapiens
ggcaagtgtgagaagggactgg

SEQ ID NO: 8367205 - DNA, 22 bp, Homo sapiens
ggcaataatctactctgccact

SEQ ID NO: 8367206 - DNA, 22 bp, Homo sapiens
ggcaataatgacattttaaaaa

SEQ ID NO: 8367207 - DNA, 22 bp, Homo sapiens
ggcaatagttgtgggttcttta

SEQ ID NO: 8367208 - DNA, 22 bp, Homo sapiens
ggcaatgtttcgatgggagctg

SEQ ID NO: 8367209 - DNA, 22 bp, Homo sapiens
ggagagcctccacggcttctgt

SEQ ID NO: 8367210 - DNA, 20 bp, Homo sapiens
ggagagccacatagtctccc

SEQ ID NO: 8367211 - DNA, 23 bp, Homo sapiens
ggagagctcctcgtgactcactg

SEQ ID NO: 8367212 - DNA, 22 bp, Homo sapiens
cacaggaggttaggaagtggtc

SEQ ID NO: 8367213 - DNA, 22 bp, Homo sapiens
cacaggccaataccctctctct

SEQ ID NO: 8367214 - DNA, 20 bp, Homo sapiens
cacaggccttgtgagcagac

SEQ ID NO: 8367215 - DNA, 22 bp, Homo sapiens
cacagggctttgatggctgagt

SEQ ID NO: 8367216 - DNA, 22 bp, Homo sapiens
cacaggtagatgccatgcagca

SEQ ID NO: 8367217 - DNA, 22 bp, Homo sapiens
cacaggtatatgtgtatatact

SEQ ID NO: 8367218 - DNA, 22 bp, Homo sapiens
cacaggtgccatctcttcatgg

SEQ ID NO: 8367219 - DNA, 22 bp, Homo sapiens
cacaggtgtttgttatactcag

SEQ ID NO: 8367220 - DNA, 23 bp, Homo sapiens
cacaggtgtttcatcttctcagt

SEQ ID NO: 8367221 - DNA, 22 bp, Homo sapiens
cacaggtgtgtgccttatcaaa

SEQ ID NO: 8367222 - DNA, 22 bp, Homo sapiens
cacaggtgtgtcctggtcttgt

SEQ ID NO: 8367223 - DNA, 22 bp, Homo sapiens
cacaggtgtatgaatatgtcca

SEQ ID NO: 8367224 - DNA, 17 bp, Homo sapiens
cacaggtgtggtttgag

SEQ ID NO: 8367225 - DNA, 22 bp, Homo sapiens
cacaggtggcttctttcatctt

SEQ ID NO: 8367226 - DNA, 21 bp, Homo sapiens
cacaggtgggtcagtgaggcc

SEQ ID NO: 8367227 - DNA, 22 bp, Homo sapiens
cacaggttaggtattatactat

SEQ ID NO: 8367228 - DNA, 22 bp, Homo sapiens
cacaggttcacctcaggtaggt

SEQ ID NO: 8367229 - DNA, 22 bp, Homo sapiens
cacaggtttgacaaggataaaa

SEQ ID NO: 8367230 - DNA, 22 bp, Homo sapiens
cacagtctcctctcttagcctg

SEQ ID NO: 8367231 - DNA, 22 bp, Homo sapiens
cacagtgaatttcaagtgttgt

SEQ ID NO: 8367232 - DNA, 22 bp, Homo sapiens
ggcaaggggtcaggctgagaca

SEQ ID NO: 8367233 - DNA, 22 bp, Homo sapiens
cacagtgcatgatgggcagaag

SEQ ID NO: 8367234 - DNA, 19 bp, Homo sapiens
cacagtgcagccatttctc

SEQ ID NO: 8367235 - DNA, 22 bp, Homo sapiens
cacagtgcgaaagaaacccagc

SEQ ID NO: 8367236 - DNA, 22 bp, Homo sapiens
cacagtgcactaagctccgggg

SEQ ID NO: 8367237 - DNA, 22 bp, Homo sapiens
cacagtgattgatttttacttt

SEQ ID NO: 8367238 - DNA, 22 bp, Homo sapiens
cacagtgcaatcggccacaaat

SEQ ID NO: 8367239 - DNA, 22 bp, Homo sapiens
cacagtgcaatcggccacaaat

SEQ ID NO: 8367240 - DNA, 19 bp, Homo sapiens
cacagtgcagccatttctc

SEQ ID NO: 8367241 - DNA, 22 bp, Homo sapiens
cacagtgcactaagctccgggg

SEQ ID NO: 8367242 - DNA, 22 bp, Homo sapiens
cacagtgaatttcaagtgttgt

SEQ ID NO: 8367243 - DNA, 22 bp, Homo sapiens
cacagtgaatttcaagtgttgt

SEQ ID NO: 8367244 - DNA, 22 bp, Homo sapiens
cacagtgactggcacatagtaa

SEQ ID NO: 8367245 - DNA, 22 bp, Homo sapiens
cacagtgacctctttaaaaggg

SEQ ID NO: 8367246 - DNA, 22 bp, Homo sapiens
caccctgggagtggaagtcagt

SEQ ID NO: 8367247 - DNA, 22 bp, Homo sapiens
cacctgcccagcacctgggatc

SEQ ID NO: 8367248 - DNA, 22 bp, Homo sapiens
caccaggctggagtgcagaggt

SEQ ID NO: 8367249 - DNA, 22 bp, Homo sapiens
caccctgggagtggaagtcagt

SEQ ID NO: 8367250 - DNA, 22 bp, Homo sapiens
cacctgccccagtcttggagct

SEQ ID NO: 8367251 - DNA, 22 bp, Homo sapiens
caccaggataaaacctctagat

SEQ ID NO: 8367252 - DNA, 22 bp, Homo sapiens
ggccagggaggagaggcccctg

SEQ ID NO: 8367253 - DNA, 22 bp, Homo sapiens
cacctgctgagctgctgggggt

SEQ ID NO: 8367254 - DNA, 22 bp, Homo sapiens
cacctggcccagctccagtgct

SEQ ID NO: 8367255 - DNA, 22 bp, Homo sapiens
cactccagcctcagtgacagag

SEQ ID NO: 8367256 - DNA, 22 bp, Homo sapiens
cactccctctagttgcattctg

SEQ ID NO: 8367257 - DNA, 22 bp, Homo sapiens
cactcctataattaaagatgca

SEQ ID NO: 8367258 - DNA, 22 bp, Homo sapiens
cactcccttcaggagcctagga

SEQ ID NO: 8367259 - DNA, 22 bp, Homo sapiens
cactctaagaacacaaaggccc

SEQ ID NO: 8367260 - DNA, 22 bp, Homo sapiens
cactgcaacctccacctcctgg

SEQ ID NO: 8367261 - DNA, 22 bp, Homo sapiens
cactctgacacatgaacttgat

SEQ ID NO: 8367262 - DNA, 22 bp, Homo sapiens
cactgcactccagcctgggaga

SEQ ID NO: 8367263 - DNA, 22 bp, Homo sapiens
cactgcactccagcctgggaga

SEQ ID NO: 8367264 - DNA, 21 bp, Homo sapiens
cactcaataaatgtcatatgc

SEQ ID NO: 8367265 - DNA, 22 bp, Homo sapiens
cactcaatacaatggttggcac

SEQ ID NO: 8367266 - DNA, 22 bp, Homo sapiens
cactatttcctggattttgacg

SEQ ID NO: 8367267 - DNA, 22 bp, Homo sapiens
cactattttctcttcagatggc

SEQ ID NO: 8367268 - DNA, 22 bp, Homo sapiens
cactcaggctgtgtcaggagga

SEQ ID NO: 8367269 - DNA, 22 bp, Homo sapiens
cactcagaggtttgattgctca

SEQ ID NO: 8367270 - DNA, 22 bp, Homo sapiens
cactcacttatttctaacagaa

SEQ ID NO: 8367271 - DNA, 22 bp, Homo sapiens
cactccaagacctactttctct

SEQ ID NO: 8367272 - DNA, 21 bp, Homo sapiens
cactatttatatatgccagct

SEQ ID NO: 8367273 - DNA, 22 bp, Homo sapiens
cactatatgcctttgaaataca

SEQ ID NO: 8367274 - DNA, 23 bp, Homo sapiens
cacggcagcctccgagggtgctg

SEQ ID NO: 8367275 - DNA, 22 bp, Homo sapiens
ggccagggccaaggctttccca

SEQ ID NO: 8367276 - DNA, 22 bp, Homo sapiens
cactataatcctgttttagaac

SEQ ID NO: 8367277 - DNA, 22 bp, Homo sapiens
cacttgttggtggtgaaatcac

SEQ ID NO: 8367278 - DNA, 21 bp, Homo sapiens
cactttaaaaatatctttata

SEQ ID NO: 8367279 - DNA, 21 bp, Homo sapiens
cactttaaaaatatctttata

SEQ ID NO: 8367280 - DNA, 22 bp, Homo sapiens
cacttgggattaggggctaggt

SEQ ID NO: 8367281 - DNA, 22 bp, Homo sapiens
cactttaactcacatttcagct

SEQ ID NO: 8367282 - DNA, 22 bp, Homo sapiens
cactttaactcacatttcagct

SEQ ID NO: 8367283 - DNA, 22 bp, Homo sapiens
ggctggcaagtcagtgctgatg

SEQ ID NO: 8367284 - DNA, 22 bp, Homo sapiens
cacttgaaaatcagaggaaatt

SEQ ID NO: 8367285 - DNA, 23 bp, Homo sapiens
cacttcccctgtggcgagcctgc

SEQ ID NO: 8367286 - DNA, 21 bp, Homo sapiens
cacttgaatggtgttttacaa

SEQ ID NO: 8367287 - DNA, 22 bp, Homo sapiens
cacttgagttcttaatagtcag

SEQ ID NO: 8367288 - DNA, 22 bp, Homo sapiens
cacttgcttaccggagaggtgc

SEQ ID NO: 8367289 - DNA, 22 bp, Homo sapiens
cacttaaatgttcctacagcag

SEQ ID NO: 8367290 - DNA, 22 bp, Homo sapiens
cacttacacttctgaaagccta

SEQ ID NO: 8367291 - DNA, 22 bp, Homo sapiens
cacttcattgggaccagggctg

SEQ ID NO: 8367292 - DNA, 20 bp, Homo sapiens
ggctctgcttgtgagcagcc

SEQ ID NO: 8367293 - DNA, 22 bp, Homo sapiens
cacttaaatctgttgagaaaaa

SEQ ID NO: 8367294 - DNA, 22 bp, Homo sapiens
cactgtggcttaccaaagctaa

SEQ ID NO: 8367295 - DNA, 22 bp, Homo sapiens
cacttaaatctgttgagaaaaa

SEQ ID NO: 8367296 - DNA, 22 bp, Homo sapiens
cacttaaagtcttagcttacag

SEQ ID NO: 8367297 - DNA, 22 bp, Homo sapiens
cacttaaatctgttgagaaaaa

SEQ ID NO: 8367298 - DNA, 22 bp, Homo sapiens
cacttaaatgttcctacagcag

SEQ ID NO: 8367299 - DNA, 22 bp, Homo sapiens
cactgtaatagcattataagtg

SEQ ID NO: 8367300 - DNA, 22 bp, Homo sapiens
cactgtaatggaattttcttta

SEQ ID NO: 8367301 - DNA, 22 bp, Homo sapiens
cactgtaagatgagctttttta

SEQ ID NO: 8367302 - DNA, 22 bp, Homo sapiens
cactgtcacgttctgaaactgt

SEQ ID NO: 8367303 - DNA, 22 bp, Homo sapiens
ggctctgctggattgaggccag

SEQ ID NO: 8367304 - DNA, 22 bp, Homo sapiens
ggctctgctggtaagatgcctc

SEQ ID NO: 8367305 - DNA, 22 bp, Homo sapiens
ggctctgcttcctggaattgtg

SEQ ID NO: 8367306 - DNA, 22 bp, Homo sapiens
ggctctgcttcagaaggctcat

SEQ ID NO: 8367307 - DNA, 22 bp, Homo sapiens
ggctctgcttcagaaggctcat

SEQ ID NO: 8367308 - DNA, 22 bp, Homo sapiens
ggctctgcttgaggccagcctg

SEQ ID NO: 8367309 - DNA, 22 bp, Homo sapiens
cactgcactccagctgggtgac

SEQ ID NO: 8367310 - DNA, 22 bp, Homo sapiens
cactgcactccagcctgggtga

SEQ ID NO: 8367311 - DNA, 22 bp, Homo sapiens
cactgcactccagcctgggcaa

SEQ ID NO: 8367312 - DNA, 22 bp, Homo sapiens
cactgcactccagcctgggtca

SEQ ID NO: 8367313 - DNA, 22 bp, Homo sapiens
cacaaatggttgtagacattaa

SEQ ID NO: 8367314 - DNA, 22 bp, Homo sapiens
cacaaatgtagtagcttaaaac

SEQ ID NO: 8367315 - DNA, 22 bp, Homo sapiens
cacaaccatgcacagctaattt

SEQ ID NO: 8367316 - DNA, 22 bp, Homo sapiens
cacaacttagcaatgttttaga

SEQ ID NO: 8367317 - DNA, 22 bp, Homo sapiens
cacaactgccatctgagcagca

SEQ ID NO: 8367318 - DNA, 22 bp, Homo sapiens
ggacatggagctccatggaggc

SEQ ID NO: 8367319 - DNA, 22 bp, Homo sapiens
ggacatggagcatgtagagaaa

SEQ ID NO: 8367320 - DNA, 22 bp, Homo sapiens
ggaagctccccaagcctgccct

SEQ ID NO: 8367321 - DNA, 22 bp, Homo sapiens
ggaagctgaacttagcaaggaa

SEQ ID NO: 8367322 - DNA, 22 bp, Homo sapiens
ggaagctccccaagcctgccct

SEQ ID NO: 8367323 - DNA, 22 bp, Homo sapiens
ggaagctgaacttagcaaggaa

SEQ ID NO: 8367324 - DNA, 22 bp, Homo sapiens
ggaagctgaggcccagtgaagg

SEQ ID NO: 8367325 - DNA, 22 bp, Homo sapiens
ggaagctgaatccagagacagg

SEQ ID NO: 8367326 - DNA, 22 bp, Homo sapiens
ggaagctggacaggctttgagt

SEQ ID NO: 8367327 - DNA, 22 bp, Homo sapiens
ggaagctggcatatgtaatcct

SEQ ID NO: 8367328 - DNA, 22 bp, Homo sapiens
ggaagctggctcttataaatat

SEQ ID NO: 8367329 - DNA, 22 bp, Homo sapiens
ggagagaggagcccactgctgt

SEQ ID NO: 8367330 - DNA, 22 bp, Homo sapiens
ggagagaggagcccactgctgt

SEQ ID NO: 8367331 - DNA, 22 bp, Homo sapiens
ggagaagggacagactcagctt

SEQ ID NO: 8367332 - DNA, 22 bp, Homo sapiens
ggagaagggacagactcagctt

SEQ ID NO: 8367333 - DNA, 22 bp, Homo sapiens
ggagaagggacagactcagctt

SEQ ID NO: 8367334 - DNA, 22 bp, Homo sapiens
cacacaggtatatatatgtaca

SEQ ID NO: 8367335 - DNA, 22 bp, Homo sapiens
ggaccagctatcaatgccaggg

SEQ ID NO: 8367336 - DNA, 22 bp, Homo sapiens
cacacaggagagtgctggaggt

SEQ ID NO: 8367337 - DNA, 20 bp, Homo sapiens
ggaccagctgtctgaggggc

SEQ ID NO: 8367338 - DNA, 22 bp, Homo sapiens
cacacagtggagtattactcag

SEQ ID NO: 8367339 - DNA, 22 bp, Homo sapiens
cacacagtagtatgaggcaaaa

SEQ ID NO: 8367340 - DNA, 22 bp, Homo sapiens
caatttcaagattctgttcttt

SEQ ID NO: 8367341 - DNA, 22 bp, Homo sapiens
caattgtcagtgctgtttaaat

SEQ ID NO: 8367342 - DNA, 22 bp, Homo sapiens
caattgtattactgagcttata

SEQ ID NO: 8367343 - DNA, 22 bp, Homo sapiens
caattcccagctgccgggctgc

SEQ ID NO: 8367344 - DNA, 22 bp, Homo sapiens
caattcattacattgcaaagac

SEQ ID NO: 8367345 - DNA, 22 bp, Homo sapiens
caattctttcagctgcatttgt

SEQ ID NO: 8367346 - DNA, 22 bp, Homo sapiens
caatcaggagaaagagcgtgtg

SEQ ID NO: 8367347 - DNA, 22 bp, Homo sapiens
caatccatcaattacacaggct

SEQ ID NO: 8367348 - DNA, 22 bp, Homo sapiens
caattcatgttaaacagaagca

SEQ ID NO: 8367349 - DNA, 22 bp, Homo sapiens
caattcatgtgagcggactctt

SEQ ID NO: 8367350 - DNA, 22 bp, Homo sapiens
caattcatgggctgaggaaggg

SEQ ID NO: 8367351 - DNA, 22 bp, Homo sapiens
caattcatctgggtaggtagcc

SEQ ID NO: 8367352 - DNA, 22 bp, Homo sapiens
caatttcaatacaaaatacatt

SEQ ID NO: 8367353 - DNA, 22 bp, Homo sapiens
caatttcaatacaaaatacatt

SEQ ID NO: 8367354 - DNA, 22 bp, Homo sapiens
caatttcactaataatatttac

SEQ ID NO: 8367355 - DNA, 22 bp, Homo sapiens
caatttcactaataatatttac

SEQ ID NO: 8367356 - DNA, 22 bp, Homo sapiens
caatttcaatgaggccacaggg

SEQ ID NO: 8367357 - DNA, 22 bp, Homo sapiens
caatttcaggtggataggtttt

SEQ ID NO: 8367358 - DNA, 22 bp, Homo sapiens
caatttcagacctttccttgga

SEQ ID NO: 8367359 - DNA, 22 bp, Homo sapiens
caatttcactaataatatttac

SEQ ID NO: 8367360 - DNA, 22 bp, Homo sapiens
caatttcatcttgtgcttcaat

SEQ ID NO: 8367361 - DNA, 18 bp, Homo sapiens
caatttcatccttaagcc

SEQ ID NO: 8367362 - DNA, 20 bp, Homo sapiens
caatttcatcatttcctgtg

SEQ ID NO: 8367363 - DNA, 20 bp, Homo sapiens
caatttcatcatttcctgtg

SEQ ID NO: 8367364 - DNA, 22 bp, Homo sapiens
caatttcatgccatgtattgct

SEQ ID NO: 8367365 - DNA, 22 bp, Homo sapiens
caatttcatcttgtgcttcaat

SEQ ID NO: 8367366 - DNA, 22 bp, Homo sapiens
caatttcattaatagatataga

SEQ ID NO: 8367367 - DNA, 22 bp, Homo sapiens
caatttccttcatagatgactg

SEQ ID NO: 8367368 - DNA, 22 bp, Homo sapiens
caatttcatggataaaagatgt

SEQ ID NO: 8367369 - DNA, 22 bp, Homo sapiens
caataagatgtattgagcagag

SEQ ID NO: 8367370 - DNA, 22 bp, Homo sapiens
caatactgggcaggagagtaca

SEQ ID NO: 8367371 - DNA, 22 bp, Homo sapiens
caatactgcatctttgcccttt

SEQ ID NO: 8367372 - DNA, 22 bp, Homo sapiens
caaggctgcttcagactagtga

SEQ ID NO: 8367373 - DNA, 22 bp, Homo sapiens
caaggctgcttcagactagtga

SEQ ID NO: 8367374 - DNA, 18 bp, Homo sapiens
caatagaaacagtaggaa

SEQ ID NO: 8367375 - DNA, 22 bp, Homo sapiens
caatagaaaactcaatacttaa

SEQ ID NO: 8367376 - DNA, 18 bp, Homo sapiens
caatagaaacagtaggaa

SEQ ID NO: 8367377 - DNA, 22 bp, Homo sapiens
caatagaaaactcaatacttaa

SEQ ID NO: 8367378 - DNA, 20 bp, Homo sapiens
caatagaatgtggagataag

SEQ ID NO: 8367379 - DNA, 22 bp, Homo sapiens
caatagaaggcacagataggta

SEQ ID NO: 8367380 - DNA, 22 bp, Homo sapiens
caatagaaggcacagataggta

SEQ ID NO: 8367381 - DNA, 22 bp, Homo sapiens
caatatataggaacaacttagg

SEQ ID NO: 8367382 - DNA, 22 bp, Homo sapiens
caatatataatgagtactttcc

SEQ ID NO: 8367383 - DNA, 22 bp, Homo sapiens
caatagttcggtcctgaaggcc

SEQ ID NO: 8367384 - DNA, 22 bp, Homo sapiens
caagaataaccagacaatagca

SEQ ID NO: 8367385 - DNA, 22 bp, Homo sapiens
caagaataaccagacaatagca

SEQ ID NO: 8367386 - DNA, 22 bp, Homo sapiens
gctggacttagaggtggaaaag

SEQ ID NO: 8367387 - DNA, 22 bp, Homo sapiens
gctgctggcgctgggcgtccgg

SEQ ID NO: 8367388 - DNA, 22 bp, Homo sapiens
gctggaaatgaatggagaggtg

SEQ ID NO: 8367389 - DNA, 22 bp, Homo sapiens
gctgcctgccctgggtcatctg

SEQ ID NO: 8367390 - DNA, 22 bp, Homo sapiens
gctgcctgccttgcctggagga

SEQ ID NO: 8367391 - DNA, 21 bp, Homo sapiens
gctgcctgcccctcgggggct

SEQ ID NO: 8367392 - DNA, 22 bp, Homo sapiens
gctgcctgcacagagctgcttt

SEQ ID NO: 8367393 - DNA, 22 bp, Homo sapiens
caagccatactgggtgaaatca

SEQ ID NO: 8367394 - DNA, 22 bp, Homo sapiens
gctggctgaggtctagctcttt

SEQ ID NO: 8367395 - DNA, 22 bp, Homo sapiens
caagcccccggcaagtgtgtat

SEQ ID NO: 8367396 - DNA, 22 bp, Homo sapiens
caagccatattttgaagaatga

SEQ ID NO: 8367397 - DNA, 22 bp, Homo sapiens
caagcccactgctcagagccaa

SEQ ID NO: 8367398 - DNA, 22 bp, Homo sapiens
caagcccagatcctgcgtgtct

SEQ ID NO: 8367399 - DNA, 22 bp, Homo sapiens
caagccttggaaatccattctg

SEQ ID NO: 8367400 - DNA, 22 bp, Homo sapiens
caagcgtggctgctctgatgga

SEQ ID NO: 8367401 - DNA, 22 bp, Homo sapiens
caagcgtggctgctctgatgga

SEQ ID NO: 8367402 - DNA, 22 bp, Homo sapiens
caagctctgcgggctccaagat

SEQ ID NO: 8367403 - DNA, 22 bp, Homo sapiens
gctgggctcaccaggccactag

SEQ ID NO: 8367404 - DNA, 22 bp, Homo sapiens
gctgggctcagacctagtgaac

SEQ ID NO: 8367405 - DNA, 20 bp, Homo sapiens
gctgggctttgactgacaca

SEQ ID NO: 8367406 - DNA, 22 bp, Homo sapiens
caagaaattctgttcagatagc

SEQ ID NO: 8367407 - DNA, 22 bp, Homo sapiens
gctgcctgatgtccagcaggac

SEQ ID NO: 8367408 - DNA, 17 bp, Homo sapiens
gctgcctgcaactgact

SEQ ID NO: 8367409 - DNA, 22 bp, Homo sapiens
caagaaacaccaatgactgctg

SEQ ID NO: 8367410 - DNA, 22 bp, Homo sapiens
caactttctgttaaatgttagt

SEQ ID NO: 8367411 - DNA, 22 bp, Homo sapiens
caactttctgttaaatgttagt

SEQ ID NO: 8367412 - DNA, 22 bp, Homo sapiens
caagaaatggggaggggagttg

SEQ ID NO: 8367413 - DNA, 22 bp, Homo sapiens
caagaaatggggaggggagttg

SEQ ID NO: 8367414 - DNA, 22 bp, Homo sapiens
caagaaatgggatttgactgcc

SEQ ID NO: 8367415 - DNA, 22 bp, Homo sapiens
caagaaactttattctgccata

SEQ ID NO: 8367416 - DNA, 22 bp, Homo sapiens
caagaaactttattctgccata

SEQ ID NO: 8367417 - DNA, 22 bp, Homo sapiens
gctgccctgtctgcagcaggac

SEQ ID NO: 8367418 - DNA, 22 bp, Homo sapiens
caaattttgtgtgttctctagt

SEQ ID NO: 8367419 - DNA, 22 bp, Homo sapiens
caaatttaggtaacagtctgta

SEQ ID NO: 8367420 - DNA, 22 bp, Homo sapiens
gctgccctgtccggctctcctg

SEQ ID NO: 8367421 - DNA, 22 bp, Homo sapiens
caaattttgtgtgttctctagt

SEQ ID NO: 8367422 - DNA, 22 bp, Homo sapiens
caaattttgtgtgttctctagt

SEQ ID NO: 8367423 - DNA, 22 bp, Homo sapiens
caacaatatgccagactcaatt

SEQ ID NO: 8367424 - DNA, 22 bp, Homo sapiens
caacaatatgctgagtttttca

SEQ ID NO: 8367425 - DNA, 22 bp, Homo sapiens
gctctggaccctgccagcctta

SEQ ID NO: 8367426 - DNA, 22 bp, Homo sapiens
gctctggagatggagccttgag

SEQ ID NO: 8367427 - DNA, 23 bp, Homo sapiens
gctctggagctgggcctggcagg

SEQ ID NO: 8367428 - DNA, 22 bp, Homo sapiens
caaagtatgaaccagtttctct

SEQ ID NO: 8367429 - DNA, 22 bp, Homo sapiens
gctgccctccagttcccacagt

SEQ ID NO: 8367430 - DNA, 22 bp, Homo sapiens
gctgccacgatctctgctgtag

SEQ ID NO: 8367431 - DNA, 17 bp, Homo sapiens
gctgccacctttggagc

SEQ ID NO: 8367432 - DNA, 22 bp, Homo sapiens
gctgccacgatctctgctgtag

SEQ ID NO: 8367433 - DNA, 22 bp, Homo sapiens
gctgccctgcatctgtgccttc

SEQ ID NO: 8367434 - DNA, 22 bp, Homo sapiens
gctgccctgactccagcagcct

SEQ ID NO: 8367435 - DNA, 21 bp, Homo sapiens
gctgccctggctcagcattca

SEQ ID NO: 8367436 - DNA, 22 bp, Homo sapiens
gctgccctgtccggctctcctg

SEQ ID NO: 8367437 - DNA, 22 bp, Homo sapiens
gctgccctctgtgtttgtcctt

SEQ ID NO: 8367438 - DNA, 22 bp, Homo sapiens
atggctcatttatcttgcagcc

SEQ ID NO: 8367439 - DNA, 21 bp, Homo sapiens
atggctcaggccatcaatgga

SEQ ID NO: 8367440 - DNA, 22 bp, Homo sapiens
atggcagacgaggcagcagggg

SEQ ID NO: 8367441 - DNA, 22 bp, Homo sapiens
atggctctcttgacctaggcac

SEQ ID NO: 8367442 - DNA, 22 bp, Homo sapiens
atggctctgagaacctgagcta

SEQ ID NO: 8367443 - DNA, 22 bp, Homo sapiens
gagcacaggctgctgtgaactg

SEQ ID NO: 8367444 - DNA, 22 bp, Homo sapiens
gagcacagctggaggtagcatt

SEQ ID NO: 8367445 - DNA, 22 bp, Homo sapiens
gagcacagctggaggtagcatt

SEQ ID NO: 8367446 - DNA, 22 bp, Homo sapiens
gagcacagcagggctctgggtg

SEQ ID NO: 8367447 - DNA, 22 bp, Homo sapiens
gagcacagggaatagacagata

SEQ ID NO: 8367448 - DNA, 22 bp, Homo sapiens
atgggagtgtgcttgaggagtt

SEQ ID NO: 8367449 - DNA, 22 bp, Homo sapiens
atgggagtccaacatcaaggac

SEQ ID NO: 8367450 - DNA, 22 bp, Homo sapiens
atgggagggtggaaaggctctg

SEQ ID NO: 8367451 - DNA, 22 bp, Homo sapiens
gagctgccagtgtatgaattct

SEQ ID NO: 8367452 - DNA, 22 bp, Homo sapiens
atgggcagagtggggacaggaa

SEQ ID NO: 8367453 - DNA, 21 bp, Homo sapiens
atgggcagaggcagagaggct

SEQ ID NO: 8367454 - DNA, 22 bp, Homo sapiens
gagctgccctgagctttgcatg

SEQ ID NO: 8367455 - DNA, 22 bp, Homo sapiens
gagccccaggacagctctagtt

SEQ ID NO: 8367456 - DNA, 22 bp, Homo sapiens
gagcccgagcgcgtacccggcg

SEQ ID NO: 8367457 - DNA, 21 bp, Homo sapiens
atgggcagaggcagagaggct

SEQ ID NO: 8367458 - DNA, 22 bp, Homo sapiens
gagcccagtctgctcctgcgcc

SEQ ID NO: 8367459 - DNA, 22 bp, Homo sapiens
atgggcagacagggagctcacg

SEQ ID NO: 8367460 - DNA, 22 bp, Homo sapiens
atggcagaattaggatttcaag

SEQ ID NO: 8367461 - DNA, 22 bp, Homo sapiens
atggcagacacaggcaggcaga

SEQ ID NO: 8367462 - DNA, 22 bp, Homo sapiens
atggcagacctgggctggagaa

SEQ ID NO: 8367463 - DNA, 22 bp, Homo sapiens
atggcagacctgggctggagaa

SEQ ID NO: 8367464 - DNA, 22 bp, Homo sapiens
atggcagaagtcaagatgagtt

SEQ ID NO: 8367465 - DNA, 21 bp, Homo sapiens
gagacagcccagtgccagggc

SEQ ID NO: 8367466 - DNA, 22 bp, Homo sapiens
gagacagcctactccagtctca

SEQ ID NO: 8367467 - DNA, 22 bp, Homo sapiens
gagacaggatttaaccaaagct

SEQ ID NO: 8367468 - DNA, 17 bp, Homo sapiens
gagacagcaggagcccc

SEQ ID NO: 8367469 - DNA, 22 bp, Homo sapiens
gagaatacaaccagaagctgag

SEQ ID NO: 8367470 - DNA, 22 bp, Homo sapiens
atgcttaacttcctagtctata

SEQ ID NO: 8367471 - DNA, 22 bp, Homo sapiens
atgcttaactctgtacatagtt

SEQ ID NO: 8367472 - DNA, 23 bp, Homo sapiens
gagaacagccacagagagctgtg

SEQ ID NO: 8367473 - DNA, 22 bp, Homo sapiens
atgcttaactctgtacatagtt

SEQ ID NO: 8367474 - DNA, 22 bp, Homo sapiens
atgcttaaccttggtgtacaat

SEQ ID NO: 8367475 - DNA, 22 bp, Homo sapiens
atgcttaaaaggctgcgttaga

SEQ ID NO: 8367476 - DNA, 22 bp, Homo sapiens
gagaataaatctaaagtttctt

SEQ ID NO: 8367477 - DNA, 22 bp, Homo sapiens
gagaataaatctaaagtttctt

SEQ ID NO: 8367478 - DNA, 18 bp, Homo sapiens
gagaagtgcatacattat

SEQ ID NO: 8367479 - DNA, 22 bp, Homo sapiens
atgctgtgaaaaagaaggctga

SEQ ID NO: 8367480 - DNA, 22 bp, Homo sapiens
atgctgtgcctggaaagcggct

SEQ ID NO: 8367481 - DNA, 22 bp, Homo sapiens
atgctggcagccgagtgctcca

SEQ ID NO: 8367482 - DNA, 22 bp, Homo sapiens
atgctggattgagagcaagggg

SEQ ID NO: 8367483 - DNA, 22 bp, Homo sapiens
atgctggcagccgagtgctcca

SEQ ID NO: 8367484 - DNA, 22 bp, Homo sapiens
gaggagggagctggaagctctt

SEQ ID NO: 8367485 - DNA, 22 bp, Homo sapiens
gaggagctgggtcagggagaca

SEQ ID NO: 8367486 - DNA, 22 bp, Homo sapiens
atgggcaggcaaggtggcgagt

SEQ ID NO: 8367487 - DNA, 22 bp, Homo sapiens
atgggcaggcactggctctcag

SEQ ID NO: 8367488 - DNA, 22 bp, Homo sapiens
atgggcagctgcagcagtggtg

SEQ ID NO: 8367489 - DNA, 22 bp, Homo sapiens
atgggcagctgcagcagtggtg

SEQ ID NO: 8367490 - DNA, 22 bp, Homo sapiens
gaggcacagtcccgaggcaagg

SEQ ID NO: 8367491 - DNA, 22 bp, Homo sapiens
gaggcacagtgtttggtcagtg

SEQ ID NO: 8367492 - DNA, 18 bp, Homo sapiens
gaggcacatagttggggc

SEQ ID NO: 8367493 - DNA, 22 bp, Homo sapiens
atgtaggattgagtgatagagg

SEQ ID NO: 8367494 - DNA, 22 bp, Homo sapiens
gaggcacatatatacagagccc

SEQ ID NO: 8367495 - DNA, 22 bp, Homo sapiens
gaggaggggacagtacttgtgc

SEQ ID NO: 8367496 - DNA, 22 bp, Homo sapiens
gaggcacagagccctaggagct

SEQ ID NO: 8367497 - DNA, 22 bp, Homo sapiens
gaggcacagagccctaggagct

SEQ ID NO: 8367498 - DNA, 22 bp, Homo sapiens
gaggcctgggttggaggtgcat

SEQ ID NO: 8367499 - DNA, 23 bp, Homo sapiens
atgtatttaaatttcagtgatga

SEQ ID NO: 8367500 - DNA, 22 bp, Homo sapiens
atgtattcaagccacatacatt

SEQ ID NO: 8367501 - DNA, 23 bp, Homo sapiens
atgtatctcatccaaggaagctc

SEQ ID NO: 8367502 - DNA, 22 bp, Homo sapiens
atgtatcagaaatagcattggc

SEQ ID NO: 8367503 - DNA, 23 bp, Homo sapiens
atgttaccaatggaggaaattgg

SEQ ID NO: 8367504 - DNA, 22 bp, Homo sapiens
atgttacttagaataattctgg

SEQ ID NO: 8367505 - DNA, 22 bp, Homo sapiens
atgttacctctattagaatatt

SEQ ID NO: 8367506 - DNA, 22 bp, Homo sapiens
atgttaccatcttttatctaca

SEQ ID NO: 8367507 - DNA, 22 bp, Homo sapiens
atgttaccttgttctccaaaaa

SEQ ID NO: 8367508 - DNA, 22 bp, Homo sapiens
atgttactgtgatcatgatact

SEQ ID NO: 8367509 - DNA, 22 bp, Homo sapiens
atgtggctagtggacacagtat

SEQ ID NO: 8367510 - DNA, 22 bp, Homo sapiens
atgttaaaagtctgagtgggag

SEQ ID NO: 8367511 - DNA, 22 bp, Homo sapiens
atgtggctggtagttgacaact

SEQ ID NO: 8367512 - DNA, 23 bp, Homo sapiens
atgttaaacataactgaagagcc

SEQ ID NO: 8367513 - DNA, 22 bp, Homo sapiens
atgttaaaagtgaggatggcca

SEQ ID NO: 8367514 - DNA, 21 bp, Homo sapiens
atgtggctcccttcctcagga

SEQ ID NO: 8367515 - DNA, 22 bp, Homo sapiens
atgtggctccttactcatcagc

SEQ ID NO: 8367516 - DNA, 22 bp, Homo sapiens
atgtggctccttactcatcagc

SEQ ID NO: 8367517 - DNA, 22 bp, Homo sapiens
atgtggctgccacctgcctgaa

SEQ ID NO: 8367518 - DNA, 22 bp, Homo sapiens
gaggttggagggctggcctgca

SEQ ID NO: 8367519 - DNA, 22 bp, Homo sapiens
gaggttgggaagtccaagctgg

SEQ ID NO: 8367520 - DNA, 21 bp, Homo sapiens
gagtgcaggtctgatgccatc

SEQ ID NO: 8367521 - DNA, 22 bp, Homo sapiens
atgttatgacaagcatgacaga

SEQ ID NO: 8367522 - DNA, 23 bp, Homo sapiens
gaggtgtgaattctgggtgctgc

SEQ ID NO: 8367523 - DNA, 22 bp, Homo sapiens
gaggtgtgatgcagagtggtgg

SEQ ID NO: 8367524 - DNA, 22 bp, Homo sapiens
gaggtgtgatgcagagtggtgg

SEQ ID NO: 8367525 - DNA, 22 bp, Homo sapiens
gaggtgtgaggaatgaatgggg

SEQ ID NO: 8367526 - DNA, 22 bp, Homo sapiens
gaggtgtgcacagcgtgctgac

SEQ ID NO: 8367527 - DNA, 22 bp, Homo sapiens
gaggtgtgctgcggcccggtgc

SEQ ID NO: 8367528 - DNA, 22 bp, Homo sapiens
gaggtgtgttacagattgtcat

SEQ ID NO: 8367529 - DNA, 22 bp, Homo sapiens
gaggtgtgttacagattgtcat

SEQ ID NO: 8367530 - DNA, 22 bp, Homo sapiens
gaggtgtggtcctcagccccca

SEQ ID NO: 8367531 - DNA, 22 bp, Homo sapiens
atgtggcattcttggtcatttc

SEQ ID NO: 8367532 - DNA, 22 bp, Homo sapiens
atgtggcaatggttagcactgt

SEQ ID NO: 8367533 - DNA, 22 bp, Homo sapiens
atgtggcaccgatctttagcca

SEQ ID NO: 8367534 - DNA, 22 bp, Homo sapiens
atgtggcaccgatctttagcca

SEQ ID NO: 8367535 - DNA, 21 bp, Homo sapiens
atgtgcttagctgctggtagt

SEQ ID NO: 8367536 - DNA, 22 bp, Homo sapiens
atgtgctcttattaccctgtcg

SEQ ID NO: 8367537 - DNA, 22 bp, Homo sapiens
atgtgcttggaaaagcagtggt

SEQ ID NO: 8367538 - DNA, 22 bp, Homo sapiens
atgtcactgtgaggcagctgtc

SEQ ID NO: 8367539 - DNA, 22 bp, Homo sapiens
atgtcacttttctccctgctgg

SEQ ID NO: 8367540 - DNA, 22 bp, Homo sapiens
atgtgccctttctgctttgcag

SEQ ID NO: 8367541 - DNA, 22 bp, Homo sapiens
atgtgccctcttagagtctctg

SEQ ID NO: 8367542 - DNA, 22 bp, Homo sapiens
atgtgaggttaacctactgtta

SEQ ID NO: 8367543 - DNA, 22 bp, Homo sapiens
atgtgaggtatctaggtcttcg

SEQ ID NO: 8367544 - DNA, 22 bp, Homo sapiens
atgtcatattactaatgctggc

SEQ ID NO: 8367545 - DNA, 22 bp, Homo sapiens
atgtcagtctttctgtctcaga

SEQ ID NO: 8367546 - DNA, 23 bp, Homo sapiens
ctttgccacccagagcctgacag

SEQ ID NO: 8367547 - DNA, 20 bp, Homo sapiens
ctttgcctattctctgcctg

SEQ ID NO: 8367548 - DNA, 22 bp, Homo sapiens
ctttctttcgaagacgtgatta

SEQ ID NO: 8367549 - DNA, 22 bp, Homo sapiens
ctttctttcgaagacgtgatta

SEQ ID NO: 8367550 - DNA, 22 bp, Homo sapiens
ctttgctgccagaacccagcag

SEQ ID NO: 8367551 - DNA, 22 bp, Homo sapiens
ctttgcttactggtgtctgcat

SEQ ID NO: 8367552 - DNA, 22 bp, Homo sapiens
ctttgcttactggtgtctgcat

SEQ ID NO: 8367553 - DNA, 22 bp, Homo sapiens
ctttgcttctccaacctgctca

SEQ ID NO: 8367554 - DNA, 22 bp, Homo sapiens
ctttgctagtgtttcagtagac

SEQ ID NO: 8367555 - DNA, 22 bp, Homo sapiens
ctttggctgacaggtttctggt

SEQ ID NO: 8367556 - DNA, 22 bp, Homo sapiens
ctttggctacaagcgctgcaat

SEQ ID NO: 8367557 - DNA, 22 bp, Homo sapiens
ctttggaaagtggttcaggtga

SEQ ID NO: 8367558 - DNA, 22 bp, Homo sapiens
ctttggaaagtaagcagctaga

SEQ ID NO: 8367559 - DNA, 22 bp, Homo sapiens
ctttggaaagtaagcagctaga

SEQ ID NO: 8367560 - DNA, 22 bp, Homo sapiens
ctttggctaacaaatcagcttg

SEQ ID NO: 8367561 - DNA, 19 bp, Homo sapiens
ctttgcttgtttctgtgtc

SEQ ID NO: 8367562 - DNA, 22 bp, Homo sapiens
ctttgctttactcccactgtgt

SEQ ID NO: 8367563 - DNA, 22 bp, Homo sapiens
ctttgcttctccaacctgctca

SEQ ID NO: 8367564 - DNA, 22 bp, Homo sapiens
ctttggaaaaatacctggcata

SEQ ID NO: 8367565 - DNA, 22 bp, Homo sapiens
ctttggaaaaagtgactggctc

SEQ ID NO: 8367566 - DNA, 22 bp, Homo sapiens
ctttggaaaagcataccaagga

SEQ ID NO: 8367567 - DNA, 22 bp, Homo sapiens
ctttgggatttcatgagagcta

SEQ ID NO: 8367568 - DNA, 22 bp, Homo sapiens
ctttggcttttagatatccatt

SEQ ID NO: 8367569 - DNA, 22 bp, Homo sapiens
ctttggcttgccctggcagtac

SEQ ID NO: 8367570 - DNA, 22 bp, Homo sapiens
ctttggcttttagatatccatt

SEQ ID NO: 8367571 - DNA, 22 bp, Homo sapiens
ctttggcttgccctggcagtac

SEQ ID NO: 8367572 - DNA, 22 bp, Homo sapiens
ctttggctgggcaaagggaggt

SEQ ID NO: 8367573 - DNA, 22 bp, Homo sapiens
ctttggctgacgaggaggaggc

SEQ ID NO: 8367574 - DNA, 22 bp, Homo sapiens
ctttggctgcattcgagttgct

SEQ ID NO: 8367575 - DNA, 22 bp, Homo sapiens
ctttggctgtcctcttggctgg

SEQ ID NO: 8367576 - DNA, 19 bp, Homo sapiens
ctttttcaccttctagaag

SEQ ID NO: 8367577 - DNA, 19 bp, Homo sapiens
ctttttcaccttctagaag

SEQ ID NO: 8367578 - DNA, 22 bp, Homo sapiens
ctttttcattggctttaggaca

SEQ ID NO: 8367579 - DNA, 22 bp, Homo sapiens
ctttttcattggctttaggaca

SEQ ID NO: 8367580 - DNA, 19 bp, Homo sapiens
ctttttcaccttctagaag

SEQ ID NO: 8367581 - DNA, 22 bp, Homo sapiens
ctttttcattggctttaggaca

SEQ ID NO: 8367582 - DNA, 22 bp, Homo sapiens
ctttttatctcttaatgatgtt

SEQ ID NO: 8367583 - DNA, 22 bp, Homo sapiens
ctttttcaagtcaaagagggta

SEQ ID NO: 8367584 - DNA, 22 bp, Homo sapiens
ctttttatctcttaatgatgtt

SEQ ID NO: 8367585 - DNA, 22 bp, Homo sapiens
ctttttatagctatgtcctatg

SEQ ID NO: 8367586 - DNA, 22 bp, Homo sapiens
ctttttataccgtgccagttga

SEQ ID NO: 8367587 - DNA, 18 bp, Homo sapiens
cttttgttttccctcctc

SEQ ID NO: 8367588 - DNA, 22 bp, Homo sapiens
ctttttacaaagcctgtcttct

SEQ ID NO: 8367589 - DNA, 22 bp, Homo sapiens
ctttttactctgttgtctcagc

SEQ ID NO: 8367590 - DNA, 22 bp, Homo sapiens
atgagacatgacttcaggcctt

SEQ ID NO: 8367591 - DNA, 22 bp, Homo sapiens
atgagaaagttaatcatcatga

SEQ ID NO: 8367592 - DNA, 22 bp, Homo sapiens
atgagaaagagttgtatctaga

SEQ ID NO: 8367593 - DNA, 22 bp, Homo sapiens
atgagaaatttattacaagcta

SEQ ID NO: 8367594 - DNA, 18 bp, Homo sapiens
atgagaggtgtcagaaga

SEQ ID NO: 8367595 - DNA, 22 bp, Homo sapiens
atgagaggtttcgtcagaggaa

SEQ ID NO: 8367596 - DNA, 22 bp, Homo sapiens
atgagaggtttcgtcagaggaa

SEQ ID NO: 8367597 - DNA, 22 bp, Homo sapiens
atgagattttaaaacttcactt

SEQ ID NO: 8367598 - DNA, 22 bp, Homo sapiens
atgagattttatagtgtcttga

SEQ ID NO: 8367599 - DNA, 22 bp, Homo sapiens
atgagcagatgctcctgcctct

SEQ ID NO: 8367600 - DNA, 22 bp, Homo sapiens
atgagcagatatggattttaga

SEQ ID NO: 8367601 - DNA, 22 bp, Homo sapiens
atgagcaggaagagcacaaaga

SEQ ID NO: 8367602 - DNA, 22 bp, Homo sapiens
atctttggacggtcccaactga

SEQ ID NO: 8367603 - DNA, 22 bp, Homo sapiens
atctttggaaagccaagcacag

SEQ ID NO: 8367604 - DNA, 22 bp, Homo sapiens
atctttggatcgctcccccttc

SEQ ID NO: 8367605 - DNA, 22 bp, Homo sapiens
atctttggccacttgtgctgca

SEQ ID NO: 8367606 - DNA, 20 bp, Homo sapiens
atctttggctcagaagcctt

SEQ ID NO: 8367607 - DNA, 22 bp, Homo sapiens
atctttgggatcctgatttact

SEQ ID NO: 8367608 - DNA, 22 bp, Homo sapiens
atctttgggatatttgtgatta

SEQ ID NO: 8367609 - DNA, 22 bp, Homo sapiens
cttgttttaaactgttgtggct

SEQ ID NO: 8367610 - DNA, 17 bp, Homo sapiens
cttgttttccactggga

SEQ ID NO: 8367611 - DNA, 22 bp, Homo sapiens
ctttacagaataagaatactgg

SEQ ID NO: 8367612 - DNA, 22 bp, Homo sapiens
ctttacagcttagtggtatgga

SEQ ID NO: 8367613 - DNA, 22 bp, Homo sapiens
ctttacagatggataattgttt

SEQ ID NO: 8367614 - DNA, 22 bp, Homo sapiens
ctttattctgcaaattgccttg

SEQ ID NO: 8367615 - DNA, 22 bp, Homo sapiens
ctttattcctacaagattttct

SEQ ID NO: 8367616 - DNA, 22 bp, Homo sapiens
ctttacttcagcaagctttcct

SEQ ID NO: 8367617 - DNA, 22 bp, Homo sapiens
ctttattagatgtagactttct

SEQ ID NO: 8367618 - DNA, 22 bp, Homo sapiens
ctttagaaatctggatgtattt

SEQ ID NO: 8367619 - DNA, 21 bp, Homo sapiens
atctttattacgcagagaaga

SEQ ID NO: 8367620 - DNA, 21 bp, Homo sapiens
atctttattacgcagagaaga

SEQ ID NO: 8367621 - DNA, 18 bp, Homo sapiens
atctttccatagcatgtt

SEQ ID NO: 8367622 - DNA, 22 bp, Homo sapiens
atctttctatttctaaaaacta

SEQ ID NO: 8367623 - DNA, 22 bp, Homo sapiens
atctttcttatttgaagaaaga

SEQ ID NO: 8367624 - DNA, 22 bp, Homo sapiens
cttctccctggcttctgcacac

SEQ ID NO: 8367625 - DNA, 18 bp, Homo sapiens
cttctcccatcttggcca

SEQ ID NO: 8367626 - DNA, 19 bp, Homo sapiens
cttctccagcttctagaag

SEQ ID NO: 8367627 - DNA, 22 bp, Homo sapiens
cttctccctgggggctctttat

SEQ ID NO: 8367628 - DNA, 22 bp, Homo sapiens
cttctccagccacgcccactcc

SEQ ID NO: 8367629 - DNA, 22 bp, Homo sapiens
atctggactagagcagaatggg

SEQ ID NO: 8367630 - DNA, 22 bp, Homo sapiens
atgccactgcactccagcctag

SEQ ID NO: 8367631 - DNA, 22 bp, Homo sapiens
atgccactgcactccagcctag

SEQ ID NO: 8367632 - DNA, 22 bp, Homo sapiens
atgcatttgtaaaatataatcg

SEQ ID NO: 8367633 - DNA, 22 bp, Homo sapiens
atgccactgcactccagcctgg

SEQ ID NO: 8367634 - DNA, 22 bp, Homo sapiens
atgccactgcactccagcctgg

SEQ ID NO: 8367635 - DNA, 22 bp, Homo sapiens
atgccactgcacttcagcctgg

SEQ ID NO: 8367636 - DNA, 22 bp, Homo sapiens
atgccactgcacttcagcctgg

SEQ ID NO: 8367637 - DNA, 22 bp, Homo sapiens
atgccactgcacttcagcctgg

SEQ ID NO: 8367638 - DNA, 22 bp, Homo sapiens
atgctacagccctctttgcata

SEQ ID NO: 8367639 - DNA, 23 bp, Homo sapiens
atgctagctgtgccaacaccata

SEQ ID NO: 8367640 - DNA, 22 bp, Homo sapiens
atgctataaactctaggtcatt

SEQ ID NO: 8367641 - DNA, 22 bp, Homo sapiens
atgctatgtaactggcagatag

SEQ ID NO: 8367642 - DNA, 22 bp, Homo sapiens
atgctatagaaatatttaaatt

SEQ ID NO: 8367643 - DNA, 22 bp, Homo sapiens
atgctatactcaaagaaattca

SEQ ID NO: 8367644 - DNA, 22 bp, Homo sapiens
atgctatacatatgacatcaca

SEQ ID NO: 8367645 - DNA, 20 bp, Homo sapiens
gacagcttggggtgtcacct

SEQ ID NO: 8367646 - DNA, 22 bp, Homo sapiens
gacaggaaacaagaaggcagga

SEQ ID NO: 8367647 - DNA, 22 bp, Homo sapiens
gacaggaaacaagaaggcagga

SEQ ID NO: 8367648 - DNA, 22 bp, Homo sapiens
atgctcttgaggctaaagacat

SEQ ID NO: 8367649 - DNA, 22 bp, Homo sapiens
gacaggaaaggggtctgttttc

SEQ ID NO: 8367650 - DNA, 16 bp, Homo sapiens
atgctgctattagagg

SEQ ID NO: 8367651 - DNA, 16 bp, Homo sapiens
atgctgctattagagg

SEQ ID NO: 8367652 - DNA, 22 bp, Homo sapiens
atgctaaatccagaagcagtca

SEQ ID NO: 8367653 - DNA, 22 bp, Homo sapiens
atgctaaactatgatcattttc

SEQ ID NO: 8367654 - DNA, 22 bp, Homo sapiens
atgctaaactatgatcattttc

SEQ ID NO: 8367655 - DNA, 22 bp, Homo sapiens
atgcctggatttgggactcaaa

SEQ ID NO: 8367656 - DNA, 22 bp, Homo sapiens
atgctaaggcactaccttctca

SEQ ID NO: 8367657 - DNA, 22 bp, Homo sapiens
atgctacagcatctctcatcag

SEQ ID NO: 8367658 - DNA, 22 bp, Homo sapiens
atgctaaggcccaggagaaaat

SEQ ID NO: 8367659 - DNA, 22 bp, Homo sapiens
gaattttagaatatgtgggctt

SEQ ID NO: 8367660 - DNA, 22 bp, Homo sapiens
gaattttaataaaggtttatca

SEQ ID NO: 8367661 - DNA, 22 bp, Homo sapiens
gaattttaagtgttcgcctctt

SEQ ID NO: 8367662 - DNA, 22 bp, Homo sapiens
gaatttggatctttgatagagt

SEQ ID NO: 8367663 - DNA, 22 bp, Homo sapiens
gaatttcctctaaacccctgag

SEQ ID NO: 8367664 - DNA, 22 bp, Homo sapiens
atgagcagtttttaagtagcaa

SEQ ID NO: 8367665 - DNA, 22 bp, Homo sapiens
atgagcagtaggttcatggctg

SEQ ID NO: 8367666 - DNA, 22 bp, Homo sapiens
atgagcaggtttaagagaggcc

SEQ ID NO: 8367667 - DNA, 19 bp, Homo sapiens
atgagcaggcaagacaagc

SEQ ID NO: 8367668 - DNA, 22 bp, Homo sapiens
atgagctgggccatccagtgat

SEQ ID NO: 8367669 - DNA, 22 bp, Homo sapiens
atgagctagaaaaccatgtgga

SEQ ID NO: 8367670 - DNA, 22 bp, Homo sapiens
gaagagagagccctggggtccg

SEQ ID NO: 8367671 - DNA, 22 bp, Homo sapiens
gaagaaatgtgttcaaggtagg

SEQ ID NO: 8367672 - DNA, 22 bp, Homo sapiens
gaagagagagtggggttctgcg

SEQ ID NO: 8367673 - DNA, 22 bp, Homo sapiens
gaagagagccgcgggacatcag

SEQ ID NO: 8367674 - DNA, 21 bp, Homo sapiens
gaagagagtcctcatcctgag

SEQ ID NO: 8367675 - DNA, 22 bp, Homo sapiens
atgatggctaggctggttttga

SEQ ID NO: 8367676 - DNA, 22 bp, Homo sapiens
gaagagatgacaaaggagcatg

SEQ ID NO: 8367677 - DNA, 22 bp, Homo sapiens
atgatgttaccagtacttagag

SEQ ID NO: 8367678 - DNA, 22 bp, Homo sapiens
atgatgtgtgctgatcaagctt

SEQ ID NO: 8367679 - DNA, 22 bp, Homo sapiens
gaagctggagaatgggtctagg

SEQ ID NO: 8367680 - DNA, 22 bp, Homo sapiens
gaagctgggtcgctgggatcct

SEQ ID NO: 8367681 - DNA, 22 bp, Homo sapiens
gaagctgtgctgggggatctgt

SEQ ID NO: 8367682 - DNA, 22 bp, Homo sapiens
gaaggaggctccccaaagtctg

SEQ ID NO: 8367683 - DNA, 22 bp, Homo sapiens
gaaggaggcgttagccctagga

SEQ ID NO: 8367684 - DNA, 22 bp, Homo sapiens
gaagctgatgaggaccagattg

SEQ ID NO: 8367685 - DNA, 22 bp, Homo sapiens
gaagccttgaactgcaaacccc

SEQ ID NO: 8367686 - DNA, 22 bp, Homo sapiens
gaagccttgaactgcaaacccc

SEQ ID NO: 8367687 - DNA, 22 bp, Homo sapiens
gaaggagggtgcggatctgagc

SEQ ID NO: 8367688 - DNA, 22 bp, Homo sapiens
gaaggagggagcggcgcggatt

SEQ ID NO: 8367689 - DNA, 22 bp, Homo sapiens
gaaggaggtgtcagttggactg

SEQ ID NO: 8367690 - DNA, 22 bp, Homo sapiens
gaaggaggtctgcattctacag

SEQ ID NO: 8367691 - DNA, 22 bp, Homo sapiens
gatgtggggttgagggaccagc

SEQ ID NO: 8367692 - DNA, 22 bp, Homo sapiens
gatgtggggataatactggtac

SEQ ID NO: 8367693 - DNA, 18 bp, Homo sapiens
gatgtgggccctggatat

SEQ ID NO: 8367694 - DNA, 22 bp, Homo sapiens
gattcatgttatagagagtcag

SEQ ID NO: 8367695 - DNA, 22 bp, Homo sapiens
gattcagtgagggtgagaagaa

SEQ ID NO: 8367696 - DNA, 22 bp, Homo sapiens
gatgtctttctgtgtgcctaga

SEQ ID NO: 8367697 - DNA, 22 bp, Homo sapiens
gatgtctttgaggctcactgct

SEQ ID NO: 8367698 - DNA, 22 bp, Homo sapiens
gatgtctttctaatactggctt

SEQ ID NO: 8367699 - DNA, 22 bp, Homo sapiens
gatgtctttgctgttatccact

SEQ ID NO: 8367700 - DNA, 20 bp, Homo sapiens
gatgtcttggtcacagtggc

SEQ ID NO: 8367701 - DNA, 22 bp, Homo sapiens
attaacatgagttggagatagg

SEQ ID NO: 8367702 - DNA, 22 bp, Homo sapiens
attaacatgcagccagacacac

SEQ ID NO: 8367703 - DNA, 19 bp, Homo sapiens
attaacatcagtgttggcc

SEQ ID NO: 8367704 - DNA, 22 bp, Homo sapiens
attaaattttcactaggctccc

SEQ ID NO: 8367705 - DNA, 22 bp, Homo sapiens
attaaattggatctgcatagtt

SEQ ID NO: 8367706 - DNA, 22 bp, Homo sapiens
attaaattggacgctgggggaa

SEQ ID NO: 8367707 - DNA, 22 bp, Homo sapiens
gattcttaagacattatgtatt

SEQ ID NO: 8367708 - DNA, 22 bp, Homo sapiens
gattccagaaaccagtgaagat

SEQ ID NO: 8367709 - DNA, 22 bp, Homo sapiens
gattccagaaaccagtgaagat

SEQ ID NO: 8367710 - DNA, 22 bp, Homo sapiens
gatggcaggcaggtgagtagag

SEQ ID NO: 8367711 - DNA, 22 bp, Homo sapiens
gatggcagcagcagccagggat

SEQ ID NO: 8367712 - DNA, 22 bp, Homo sapiens
gatggcagtcaaccaggtgagg

SEQ ID NO: 8367713 - DNA, 22 bp, Homo sapiens
gatggcagtcaaccaggtgagg

SEQ ID NO: 8367714 - DNA, 22 bp, Homo sapiens
gatggcacacagacatccccgc

SEQ ID NO: 8367715 - DNA, 22 bp, Homo sapiens
atgttatttattatcctcggtt

SEQ ID NO: 8367716 - DNA, 22 bp, Homo sapiens
atgttattgatgcctgaggctt

SEQ ID NO: 8367717 - DNA, 22 bp, Homo sapiens
atgttatttattgaaacacttt

SEQ ID NO: 8367718 - DNA, 22 bp, Homo sapiens
atgttatttattgaaacacttt

SEQ ID NO: 8367719 - DNA, 22 bp, Homo sapiens
atgttatttcaaaattcccttg

SEQ ID NO: 8367720 - DNA, 22 bp, Homo sapiens
atgttatttcaaaattcccttg

SEQ ID NO: 8367721 - DNA, 22 bp, Homo sapiens
gagtggggaaagccaggacaga

SEQ ID NO: 8367722 - DNA, 22 bp, Homo sapiens
gagtggggaaagccaggacaga

SEQ ID NO: 8367723 - DNA, 21 bp, Homo sapiens
gagtgggctgagatggggctg

SEQ ID NO: 8367724 - DNA, 20 bp, Homo sapiens
gagtgggccatggagtgaga

SEQ ID NO: 8367725 - DNA, 22 bp, Homo sapiens
gagtgggcaccgtgggcacact

SEQ ID NO: 8367726 - DNA, 21 bp, Homo sapiens
atgttattctgttcctccagc

SEQ ID NO: 8367727 - DNA, 22 bp, Homo sapiens
atgttattcaatttgaatccaa

SEQ ID NO: 8367728 - DNA, 22 bp, Homo sapiens
atgttattcaatttgaatccaa

SEQ ID NO: 8367729 - DNA, 23 bp, Homo sapiens
atgttattattagcagtcttgcc

SEQ ID NO: 8367730 - DNA, 23 bp, Homo sapiens
atgttattattagcagtcttgcc

SEQ ID NO: 8367731 - DNA, 22 bp, Homo sapiens
atgttattaaagtacagattct

SEQ ID NO: 8367732 - DNA, 22 bp, Homo sapiens
atgttattaaagtacagattct

SEQ ID NO: 8367733 - DNA, 22 bp, Homo sapiens
atgttatgtgcaagatacataa

SEQ ID NO: 8367734 - DNA, 22 bp, Homo sapiens
gagtggggcgtggatccagcgt

SEQ ID NO: 8367735 - DNA, 22 bp, Homo sapiens
gcagagagttgggctgcgccag

SEQ ID NO: 8367736 - DNA, 22 bp, Homo sapiens
gcagagaggaatgaagccatcc

SEQ ID NO: 8367737 - DNA, 22 bp, Homo sapiens
gcagagactccactgtcttgtg

SEQ ID NO: 8367738 - DNA, 22 bp, Homo sapiens
attcaagtggctgctatgttaa

SEQ ID NO: 8367739 - DNA, 22 bp, Homo sapiens
attcaataaatatgctacatgg

SEQ ID NO: 8367740 - DNA, 22 bp, Homo sapiens
gcagagatccttgctggatgac

SEQ ID NO: 8367741 - DNA, 22 bp, Homo sapiens
attatggtaaagttaatatgta

SEQ ID NO: 8367742 - DNA, 22 bp, Homo sapiens
attatggacatcaaataactct

SEQ ID NO: 8367743 - DNA, 22 bp, Homo sapiens
attatggatggaggcattagtc

SEQ ID NO: 8367744 - DNA, 22 bp, Homo sapiens
gcagaatttgggggtaaccttt

SEQ ID NO: 8367745 - DNA, 22 bp, Homo sapiens
gcagaatttaggaattaggaaa

SEQ ID NO: 8367746 - DNA, 22 bp, Homo sapiens
attattaaaatgtgtttctctt

SEQ ID NO: 8367747 - DNA, 22 bp, Homo sapiens
gcacccagaataaggacaggac

SEQ ID NO: 8367748 - DNA, 22 bp, Homo sapiens
gcacccagaataaggacaggac

SEQ ID NO: 8367749 - DNA, 22 bp, Homo sapiens
gcaccatgacagtgaggagaac

SEQ ID NO: 8367750 - DNA, 22 bp, Homo sapiens
gcacacagctagattaccattc

SEQ ID NO: 8367751 - DNA, 22 bp, Homo sapiens
gcacacaggcagtttccagcca

SEQ ID NO: 8367752 - DNA, 22 bp, Homo sapiens
gcacacagctagattaccattc

SEQ ID NO: 8367753 - DNA, 22 bp, Homo sapiens
gcacacagattaggaaacagaa

SEQ ID NO: 8367754 - DNA, 22 bp, Homo sapiens
gcacacagactaaccatatttc

SEQ ID NO: 8367755 - DNA, 22 bp, Homo sapiens
gcacacagagaggtggtatgtc

SEQ ID NO: 8367756 - DNA, 22 bp, Homo sapiens
gcaccagggagggtgtgcttca

SEQ ID NO: 8367757 - DNA, 22 bp, Homo sapiens
attatataggacttgcccttcc

SEQ ID NO: 8367758 - DNA, 22 bp, Homo sapiens
attatcacatggactttgcttt

SEQ ID NO: 8367759 - DNA, 22 bp, Homo sapiens
attatccagcaccaatgtcaga

SEQ ID NO: 8367760 - DNA, 22 bp, Homo sapiens
attatccagcaccaatgtcaga

SEQ ID NO: 8367761 - DNA, 22 bp, Homo sapiens
gcatcagcaccaaccttccagg

SEQ ID NO: 8367762 - DNA, 19 bp, Homo sapiens
gcatcagagcagaaggggt

SEQ ID NO: 8367763 - DNA, 22 bp, Homo sapiens
attgcactccagcctgggggac

SEQ ID NO: 8367764 - DNA, 22 bp, Homo sapiens
attgcaatctggtgaaaacagt

SEQ ID NO: 8367765 - DNA, 22 bp, Homo sapiens
attgcacaaagagggaaactga

SEQ ID NO: 8367766 - DNA, 22 bp, Homo sapiens
gcatggcagaacacctcgcccg

SEQ ID NO: 8367767 - DNA, 22 bp, Homo sapiens
gcaggtgttttaagacattgaa

SEQ ID NO: 8367768 - DNA, 22 bp, Homo sapiens
gcaggttatccaactacaatgt

SEQ ID NO: 8367769 - DNA, 22 bp, Homo sapiens
attcttttttaaggaatagaac

SEQ ID NO: 8367770 - DNA, 22 bp, Homo sapiens
gcagtaagatgtaagtgctata

SEQ ID NO: 8367771 - DNA, 22 bp, Homo sapiens
gcagtaagatgtttcccagagc

SEQ ID NO: 8367772 - DNA, 22 bp, Homo sapiens
attgcaaataatgcgagccagt

SEQ ID NO: 8367773 - DNA, 22 bp, Homo sapiens
attgcaaatgagtcttaatata

SEQ ID NO: 8367774 - DNA, 22 bp, Homo sapiens
gcaggcaggtggcatcttgtga

SEQ ID NO: 8367775 - DNA, 22 bp, Homo sapiens
attctgctagtaacagatgaag

SEQ ID NO: 8367776 - DNA, 22 bp, Homo sapiens
attctgcacatccaagaacagg

SEQ ID NO: 8367777 - DNA, 22 bp, Homo sapiens
gcagggcaaacccaggtgttca

SEQ ID NO: 8367778 - DNA, 22 bp, Homo sapiens
gcagggcagtaagagctagagt

SEQ ID NO: 8367779 - DNA, 22 bp, Homo sapiens
gcagggcagtgtgtctgtgggg

SEQ ID NO: 8367780 - DNA, 22 bp, Homo sapiens
attctgctgcacaccttccccc

SEQ ID NO: 8367781 - DNA, 20 bp, Homo sapiens
gcagggcatcttggccccca

SEQ ID NO: 8367782 - DNA, 22 bp, Homo sapiens
gcagggcatccctgagcgggtg

SEQ ID NO: 8367783 - DNA, 22 bp, Homo sapiens
gcagggcatagaggcacggagg

SEQ ID NO: 8367784 - DNA, 22 bp, Homo sapiens
attcttttcccaactgctttaa

SEQ ID NO: 8367785 - DNA, 22 bp, Homo sapiens
attcttttttaaggaatagaac

SEQ ID NO: 8367786 - DNA, 22 bp, Homo sapiens
attcttttcccaactgctttaa

SEQ ID NO: 8367787 - DNA, 22 bp, Homo sapiens
gcagctgtgggttccaagtcta

SEQ ID NO: 8367788 - DNA, 22 bp, Homo sapiens
gcagctgttcagctggccagat

SEQ ID NO: 8367789 - DNA, 22 bp, Homo sapiens
attctctttgtataacatcttg

SEQ ID NO: 8367790 - DNA, 22 bp, Homo sapiens
gcaggcaggagcccaactgcct

SEQ ID NO: 8367791 - DNA, 22 bp, Homo sapiens
gcaggcaggcttccttgaactg

SEQ ID NO: 8367792 - DNA, 22 bp, Homo sapiens
gcaggcaggagcccaactgcct

SEQ ID NO: 8367793 - DNA, 22 bp, Homo sapiens
gcaggcaggcttccttgaactg

SEQ ID NO: 8367794 - DNA, 20 bp, Homo sapiens
gcaggcagggaatgggggtg

SEQ ID NO: 8367795 - DNA, 20 bp, Homo sapiens
gcaggcagggaatgggggtg

SEQ ID NO: 8367796 - DNA, 22 bp, Homo sapiens
gcagcttggggacatgaaaaga

SEQ ID NO: 8367797 - DNA, 22 bp, Homo sapiens
gcagcttgaagctcggaggagc

SEQ ID NO: 8367798 - DNA, 22 bp, Homo sapiens
gcagcttggatttctgtagttt

SEQ ID NO: 8367799 - DNA, 23 bp, Homo sapiens
gcagcttgtggtttagtagaggg

SEQ ID NO: 8367800 - DNA, 22 bp, Homo sapiens
gcagcttggtgaaaggtgatgg

SEQ ID NO: 8367801 - DNA, 22 bp, Homo sapiens
gcagcttgtcagacctttactg

SEQ ID NO: 8367802 - DNA, 22 bp, Homo sapiens
gcagcttcctgagtgtggacag

SEQ ID NO: 8367803 - DNA, 22 bp, Homo sapiens
gcagcttcagtaggtgaagaca

SEQ ID NO: 8367804 - DNA, 22 bp, Homo sapiens
gcagcttagaaaaatgaaattg

SEQ ID NO: 8367805 - DNA, 22 bp, Homo sapiens
gcagcttcagccagagggccag

SEQ ID NO: 8367806 - DNA, 22 bp, Homo sapiens
attccacagctacatcaatcta

SEQ ID NO: 8367807 - DNA, 22 bp, Homo sapiens
attccacagctacgttttgagc

SEQ ID NO: 8367808 - DNA, 22 bp, Homo sapiens
attccaaagcctgaataatgga

SEQ ID NO: 8367809 - DNA, 22 bp, Homo sapiens
attccaaaggctggcctggagg

SEQ ID NO: 8367810 - DNA, 22 bp, Homo sapiens
attccaaagcacatcagaacta

SEQ ID NO: 8367811 - DNA, 22 bp, Homo sapiens
attccaaagacagaagcagctg

SEQ ID NO: 8367812 - DNA, 22 bp, Homo sapiens
attccaaaggttaatgcccatt

SEQ ID NO: 8367813 - DNA, 22 bp, Homo sapiens
attccaaggtctttctagattg

SEQ ID NO: 8367814 - DNA, 22 bp, Homo sapiens
attccacaagaccataaattag

SEQ ID NO: 8367815 - DNA, 22 bp, Homo sapiens
attcaataagtcactgtggaat

SEQ ID NO: 8367816 - DNA, 22 bp, Homo sapiens
attcacaaatgctgccccattc

SEQ ID NO: 8367817 - DNA, 19 bp, Homo sapiens
attcatttttgccttctaa

SEQ ID NO: 8367818 - DNA, 22 bp, Homo sapiens
attcatgcaggattgtctccaa

SEQ ID NO: 8367819 - DNA, 19 bp, Homo sapiens
attcatgaaggcttgaagg

SEQ ID NO: 8367820 - DNA, 22 bp, Homo sapiens
attccaaactctttccctgtcg

SEQ ID NO: 8367821 - DNA, 22 bp, Homo sapiens
attccaaacttaccccagagga

SEQ ID NO: 8367822 - DNA, 22 bp, Homo sapiens
attccaaacttaccccagagga

SEQ ID NO: 8367823 - DNA, 22 bp, Homo sapiens
attccaaaaggatgttagaatg

SEQ ID NO: 8367824 - DNA, 22 bp, Homo sapiens
attccaaacgcctcgcggactt

SEQ ID NO: 8367825 - DNA, 22 bp, Homo sapiens
attccaaacagtgctgcagact

SEQ ID NO: 8367826 - DNA, 18 bp, Homo sapiens
gccagctgcacggccctc

SEQ ID NO: 8367827 - DNA, 22 bp, Homo sapiens
gccagctgccaagttgtgagat

SEQ ID NO: 8367828 - DNA, 22 bp, Homo sapiens
gccagctgctggaacagcgcga

SEQ ID NO: 8367829 - DNA, 22 bp, Homo sapiens
gccagccagagaggcatggtta

SEQ ID NO: 8367830 - DNA, 22 bp, Homo sapiens
attgtacatgcagtgagtcatc

SEQ ID NO: 8367831 - DNA, 20 bp, Homo sapiens
gcatggcatgtagtgaagtg

SEQ ID NO: 8367832 - DNA, 22 bp, Homo sapiens
attgtactacaccatagtactg

SEQ ID NO: 8367833 - DNA, 22 bp, Homo sapiens
atttatgtatctgtgtagatca

SEQ ID NO: 8367834 - DNA, 22 bp, Homo sapiens
atttattaagcatctgctatgt

SEQ ID NO: 8367835 - DNA, 22 bp, Homo sapiens
atttattaagcatctgctatgt

SEQ ID NO: 8367836 - DNA, 22 bp, Homo sapiens
atttatgagctgaaccatgaaa

SEQ ID NO: 8367837 - DNA, 22 bp, Homo sapiens
atttatgagctgaaccatgaaa

SEQ ID NO: 8367838 - DNA, 22 bp, Homo sapiens
atttatgattagcctattgttg

SEQ ID NO: 8367839 - DNA, 22 bp, Homo sapiens
atttatgattagcctattgttg

SEQ ID NO: 8367840 - DNA, 22 bp, Homo sapiens
atttatgcatcccagcatgtga

SEQ ID NO: 8367841 - DNA, 22 bp, Homo sapiens
atttattatgggatttggcaca

SEQ ID NO: 8367842 - DNA, 22 bp, Homo sapiens
atttattacctcggagtttctg

SEQ ID NO: 8367843 - DNA, 22 bp, Homo sapiens
atttattaagcatctgctatgt

SEQ ID NO: 8367844 - DNA, 22 bp, Homo sapiens
atttattacctcggagtttctg

SEQ ID NO: 8367845 - DNA, 22 bp, Homo sapiens
atttattaagcatctgctatgt

SEQ ID NO: 8367846 - DNA, 22 bp, Homo sapiens
gccagctggagtgagagtgggc

SEQ ID NO: 8367847 - DNA, 22 bp, Homo sapiens
gccagctggagtgagagtgggc

SEQ ID NO: 8367848 - DNA, 22 bp, Homo sapiens
gccagctgcttctccagaattt

SEQ ID NO: 8367849 - DNA, 22 bp, Homo sapiens
gccagctggagactggcagggg

SEQ ID NO: 8367850 - DNA, 22 bp, Homo sapiens
gccagctggagactggcagggg

SEQ ID NO: 8367851 - DNA, 22 bp, Homo sapiens
atttatcaacatgtaccattgg

SEQ ID NO: 8367852 - DNA, 22 bp, Homo sapiens
atttatcatcagaccttttaaa

SEQ ID NO: 8367853 - DNA, 22 bp, Homo sapiens
atttatcaccagttagctgact

SEQ ID NO: 8367854 - DNA, 22 bp, Homo sapiens
atttatgacagaagatatgctg

SEQ ID NO: 8367855 - DNA, 22 bp, Homo sapiens
atttatgacaaccaaagagtga

SEQ ID NO: 8367856 - DNA, 22 bp, Homo sapiens
atttatgactggtgaatagaac

SEQ ID NO: 8367857 - DNA, 22 bp, Homo sapiens
atttatgacagaagatatgctg

SEQ ID NO: 8367858 - DNA, 22 bp, Homo sapiens
atttatgacaaccaaagagtga

SEQ ID NO: 8367859 - DNA, 22 bp, Homo sapiens
atttatctctggaaactaagca

SEQ ID NO: 8367860 - DNA, 23 bp, Homo sapiens
atttcctactataaaagaggtaa

SEQ ID NO: 8367861 - DNA, 22 bp, Homo sapiens
atttcctaacagaggcaacagt

SEQ ID NO: 8367862 - DNA, 22 bp, Homo sapiens
atttcctaatttagggatagac

SEQ ID NO: 8367863 - DNA, 22 bp, Homo sapiens
atttcctaatttatgcaggagt

SEQ ID NO: 8367864 - DNA, 23 bp, Homo sapiens
atttcctaaaagataatcattac

SEQ ID NO: 8367865 - DNA, 22 bp, Homo sapiens
gccctggggaaggtgtctccaa

SEQ ID NO: 8367866 - DNA, 17 bp, Homo sapiens
gccctgcctgctgccct

SEQ ID NO: 8367867 - DNA, 22 bp, Homo sapiens
gccctgggctccctgctccaca

SEQ ID NO: 8367868 - DNA, 22 bp, Homo sapiens
atttcccatgtgaatcaattgg

SEQ ID NO: 8367869 - DNA, 22 bp, Homo sapiens
atttcccagggccctcatagtt

SEQ ID NO: 8367870 - DNA, 22 bp, Homo sapiens
atttcccagctttgatcagttt

SEQ ID NO: 8367871 - DNA, 22 bp, Homo sapiens
atttcccaggactagaaatata

SEQ ID NO: 8367872 - DNA, 22 bp, Homo sapiens
atttcccactctactacatgct

SEQ ID NO: 8367873 - DNA, 22 bp, Homo sapiens
atttcccaatacgctaagtgga

SEQ ID NO: 8367874 - DNA, 22 bp, Homo sapiens
gccctgtcccttggcttctagg

SEQ ID NO: 8367875 - DNA, 22 bp, Homo sapiens
atttcttaaaacttcagggaga

SEQ ID NO: 8367876 - DNA, 22 bp, Homo sapiens
atttcttacataacaaattgtt

SEQ ID NO: 8367877 - DNA, 22 bp, Homo sapiens
atttcttcaggttcttctagga

SEQ ID NO: 8367878 - DNA, 22 bp, Homo sapiens
atttcttcaggtcagaaataga

SEQ ID NO: 8367879 - DNA, 22 bp, Homo sapiens
atttcttatgaatattgactgt

SEQ ID NO: 8367880 - DNA, 22 bp, Homo sapiens
atttcttatgaatattgactgt

SEQ ID NO: 8367881 - DNA, 22 bp, Homo sapiens
gcccagtctcttctggccctgt

SEQ ID NO: 8367882 - DNA, 22 bp, Homo sapiens
gcccagtagttcaaggttgcag

SEQ ID NO: 8367883 - DNA, 22 bp, Homo sapiens
gcccaggttggagagcagtggc

SEQ ID NO: 8367884 - DNA, 22 bp, Homo sapiens
gccatcctgatgacaggccact

SEQ ID NO: 8367885 - DNA, 22 bp, Homo sapiens
gccatcctggattcagaccaaa

SEQ ID NO: 8367886 - DNA, 22 bp, Homo sapiens
gccatctcggagctatcaaagg

SEQ ID NO: 8367887 - DNA, 22 bp, Homo sapiens
atttgtaaagtgcttaaaagta

SEQ ID NO: 8367888 - DNA, 22 bp, Homo sapiens
atttggaattcgagtaattcca

SEQ ID NO: 8367889 - DNA, 22 bp, Homo sapiens
atttggaattctatttcagtag

SEQ ID NO: 8367890 - DNA, 22 bp, Homo sapiens
atttggaattcgagtaattcca

SEQ ID NO: 8367891 - DNA, 22 bp, Homo sapiens
atttcttcctctgtcagtaact

SEQ ID NO: 8367892 - DNA, 22 bp, Homo sapiens
atttggaatgtgtttgatcacc

SEQ ID NO: 8367893 - DNA, 22 bp, Homo sapiens
atttcttcctctgtcagtaact

SEQ ID NO: 8367894 - DNA, 22 bp, Homo sapiens
atttcttccattgcctcttcaa

SEQ ID NO: 8367895 - DNA, 22 bp, Homo sapiens
atttcttcctctgtcagtaact

SEQ ID NO: 8367896 - DNA, 22 bp, Homo sapiens
atttgtcaataagatgaacata

SEQ ID NO: 8367897 - DNA, 22 bp, Homo sapiens
atttgtcaacaggcatttaggt

SEQ ID NO: 8367898 - DNA, 22 bp, Homo sapiens
atttgtatcttctaatattatc

SEQ ID NO: 8367899 - DNA, 22 bp, Homo sapiens
atttgtagtgaagtgaaaataa

SEQ ID NO: 8367900 - DNA, 22 bp, Homo sapiens
atttgtagtgaagtgaaaataa

SEQ ID NO: 8367901 - DNA, 22 bp, Homo sapiens
atttgtatcaatctcaatatat

SEQ ID NO: 8367902 - DNA, 22 bp, Homo sapiens
atttgtatcaatctcaatatat

SEQ ID NO: 8367903 - DNA, 22 bp, Homo sapiens
atttgtatcaatctcaatatat

SEQ ID NO: 8367904 - DNA, 22 bp, Homo sapiens
atttgtctctgcactttactca

SEQ ID NO: 8367905 - DNA, 22 bp, Homo sapiens
atttgtctagtggtattcacgt

SEQ ID NO: 8367906 - DNA, 22 bp, Homo sapiens
atttgtctagtggtattcacgt

SEQ ID NO: 8367907 - DNA, 22 bp, Homo sapiens
atttgtctagtggtattcacgt

SEQ ID NO: 8367908 - DNA, 22 bp, Homo sapiens
atttgtcagtggaagtgattca

SEQ ID NO: 8367909 - DNA, 22 bp, Homo sapiens
atttgtcatatataatactctt

SEQ ID NO: 8367910 - DNA, 22 bp, Homo sapiens
attttcctagtcatgtgcttct

SEQ ID NO: 8367911 - DNA, 22 bp, Homo sapiens
attttcctcaagcctctggaag

SEQ ID NO: 8367912 - DNA, 22 bp, Homo sapiens
attttcctctggtttccccaga

SEQ ID NO: 8367913 - DNA, 22 bp, Homo sapiens
attttcctccatgtgagcagtt

SEQ ID NO: 8367914 - DNA, 22 bp, Homo sapiens
attttcctctggtttccccaga

SEQ ID NO: 8367915 - DNA, 22 bp, Homo sapiens
attttctaagcctgtcagactt

SEQ ID NO: 8367916 - DNA, 22 bp, Homo sapiens
attttccttgtgggttagcgaa

SEQ ID NO: 8367917 - DNA, 22 bp, Homo sapiens
attttccttctaagaggaaggt

SEQ ID NO: 8367918 - DNA, 22 bp, Homo sapiens
attttccttctaagaggaaggt

SEQ ID NO: 8367919 - DNA, 17 bp, Homo sapiens
gccttccagcatgtggg

SEQ ID NO: 8367920 - DNA, 22 bp, Homo sapiens
gccttccagaatacacatagca

SEQ ID NO: 8367921 - DNA, 17 bp, Homo sapiens
gccttccagcatgtggg

SEQ ID NO: 8367922 - DNA, 19 bp, Homo sapiens
gccttcccaccacccgtcc

SEQ ID NO: 8367923 - DNA, 22 bp, Homo sapiens
gccttccaggcagggggagcag

SEQ ID NO: 8367924 - DNA, 20 bp, Homo sapiens
gccttccagttcagtggcac

SEQ ID NO: 8367925 - DNA, 22 bp, Homo sapiens
gccttcccaagacgcctgagtt

SEQ ID NO: 8367926 - DNA, 22 bp, Homo sapiens
attttccatctccacaccaggg

SEQ ID NO: 8367927 - DNA, 22 bp, Homo sapiens
attttccatctccacaccaggg

SEQ ID NO: 8367928 - DNA, 22 bp, Homo sapiens
attttccaaaataattgttact

SEQ ID NO: 8367929 - DNA, 22 bp, Homo sapiens
attttcattttgcagggtgaga

SEQ ID NO: 8367930 - DNA, 21 bp, Homo sapiens
attttcattaattcagtgtgg

SEQ ID NO: 8367931 - DNA, 21 bp, Homo sapiens
attttcattaattcagtgtgg

SEQ ID NO: 8367932 - DNA, 21 bp, Homo sapiens
attttcatttccaggggagga

SEQ ID NO: 8367933 - DNA, 21 bp, Homo sapiens
attttcattaattcagtgtgg

SEQ ID NO: 8367934 - DNA, 22 bp, Homo sapiens
attttcatcatgggtttaacat

SEQ ID NO: 8367935 - DNA, 22 bp, Homo sapiens
attttcatcgctaggttggcct

SEQ ID NO: 8367936 - DNA, 22 bp, Homo sapiens
attttcatgactaccttaaata

SEQ ID NO: 8367937 - DNA, 22 bp, Homo sapiens
attttcatggcttctgctcagt

SEQ ID NO: 8367938 - DNA, 22 bp, Homo sapiens
attttcatggcttctgctcagt

SEQ ID NO: 8367939 - DNA, 22 bp, Homo sapiens
gctcagagaagttgtgcctggc

SEQ ID NO: 8367940 - DNA, 22 bp, Homo sapiens
attttgctggtctgaattactt

SEQ ID NO: 8367941 - DNA, 22 bp, Homo sapiens
gctcagagagaggctcaccatt

SEQ ID NO: 8367942 - DNA, 22 bp, Homo sapiens
gctcagagagaggctcaccatt

SEQ ID NO: 8367943 - DNA, 22 bp, Homo sapiens
caaaagatacttgcatctaact

SEQ ID NO: 8367944 - DNA, 22 bp, Homo sapiens
caaaagcaaagtccctgaatgt

SEQ ID NO: 8367945 - DNA, 20 bp, Homo sapiens
caaaagcaatgaagttatga

SEQ ID NO: 8367946 - DNA, 22 bp, Homo sapiens
caaaagcaaagtccctgaatgt

SEQ ID NO: 8367947 - DNA, 22 bp, Homo sapiens
caaaagcagcaagtttatatgt

SEQ ID NO: 8367948 - DNA, 20 bp, Homo sapiens
caaaagcaatgaagttatga

SEQ ID NO: 8367949 - DNA, 22 bp, Homo sapiens
gctcagagaaaactggggcttg

SEQ ID NO: 8367950 - DNA, 22 bp, Homo sapiens
attttgcacactatgcagcttt

SEQ ID NO: 8367951 - DNA, 22 bp, Homo sapiens
attttgaatcaccttggaagaa

SEQ ID NO: 8367952 - DNA, 22 bp, Homo sapiens
attttgaagggaattgaagttc

SEQ ID NO: 8367953 - DNA, 22 bp, Homo sapiens
attttgaatcaccttggaagaa

SEQ ID NO: 8367954 - DNA, 22 bp, Homo sapiens
gctccccagcttagccctggct

SEQ ID NO: 8367955 - DNA, 22 bp, Homo sapiens
gctcccagtctgatggaggaga

SEQ ID NO: 8367956 - DNA, 22 bp, Homo sapiens
caaaagcagcaagtttatatgt

SEQ ID NO: 8367957 - DNA, 22 bp, Homo sapiens
gctcccagggaccgcagggcag

SEQ ID NO: 8367958 - DNA, 22 bp, Homo sapiens
caaagaatgagtgagtacataa

SEQ ID NO: 8367959 - DNA, 22 bp, Homo sapiens
caaagaatgagtgagtacataa

SEQ ID NO: 8367960 - DNA, 22 bp, Homo sapiens
caaagaatcactcatctttagc

SEQ ID NO: 8367961 - DNA, 22 bp, Homo sapiens
caaagaagagatttacagagct

SEQ ID NO: 8367962 - DNA, 22 bp, Homo sapiens
caaagaagagatttacagagct

SEQ ID NO: 8367963 - DNA, 22 bp, Homo sapiens
caaagaatcactcatctttagc

SEQ ID NO: 8367964 - DNA, 22 bp, Homo sapiens
caaagaatcactcatctttagc

SEQ ID NO: 8367965 - DNA, 22 bp, Homo sapiens
cccaggagttggaggctgcagt

SEQ ID NO: 8367966 - DNA, 23 bp, Homo sapiens
cccaggagtttcactgcaaaggt

SEQ ID NO: 8367967 - DNA, 23 bp, Homo sapiens
cccaggagtttcactgcaaaggt

SEQ ID NO: 8367968 - DNA, 22 bp, Homo sapiens
cccaggagtttgagttcagcat

SEQ ID NO: 8367969 - DNA, 22 bp, Homo sapiens
cccaggatggggctgcagttat

SEQ ID NO: 8367970 - DNA, 20 bp, Homo sapiens
cccaggagtttgctcttact

SEQ ID NO: 8367971 - DNA, 23 bp, Homo sapiens
agggaacaagcaagctgctagtc

SEQ ID NO: 8367972 - DNA, 22 bp, Homo sapiens
agggaaattaatgtgagcaatg

SEQ ID NO: 8367973 - DNA, 22 bp, Homo sapiens
agggaaattaatgtgagcaatg

SEQ ID NO: 8367974 - DNA, 22 bp, Homo sapiens
agggaaatggagagtgtagttt

SEQ ID NO: 8367975 - DNA, 22 bp, Homo sapiens
cccagggcttttctcactagac

SEQ ID NO: 8367976 - DNA, 23 bp, Homo sapiens
agggaagaaacatgaagggctgt

SEQ ID NO: 8367977 - DNA, 23 bp, Homo sapiens
agggaagaaacatgaagggctgt

SEQ ID NO: 8367978 - DNA, 22 bp, Homo sapiens
agggaagaagctggtagtaggt

SEQ ID NO: 8367979 - DNA, 21 bp, Homo sapiens
cccagggaagccgcagtcacc

SEQ ID NO: 8367980 - DNA, 21 bp, Homo sapiens
cccagggaagccgcagtcacc

SEQ ID NO: 8367981 - DNA, 22 bp, Homo sapiens
cccagggccctggacagctaca

SEQ ID NO: 8367982 - DNA, 22 bp, Homo sapiens
cccagggctgcagatggaggct

SEQ ID NO: 8367983 - DNA, 22 bp, Homo sapiens
cccagggctgcagatggaggct

SEQ ID NO: 8367984 - DNA, 21 bp, Homo sapiens
aggcttggatctagacaggcc

SEQ ID NO: 8367985 - DNA, 21 bp, Homo sapiens
aggcttggatctagacaggcc

SEQ ID NO: 8367986 - DNA, 22 bp, Homo sapiens
aggcttggaggttctgtagcca

SEQ ID NO: 8367987 - DNA, 22 bp, Homo sapiens
cccaggagttggaggctacggt

SEQ ID NO: 8367988 - DNA, 22 bp, Homo sapiens
cccaggagttggaggctacggt

SEQ ID NO: 8367989 - DNA, 22 bp, Homo sapiens
cccaggaggtggagcttgcagt

SEQ ID NO: 8367990 - DNA, 19 bp, Homo sapiens
aggcttggattgtggccaa

SEQ ID NO: 8367991 - DNA, 22 bp, Homo sapiens
aggcttctgtgagctcatacaa

SEQ ID NO: 8367992 - DNA, 22 bp, Homo sapiens
aggcttctgtttcttaaaggtg

SEQ ID NO: 8367993 - DNA, 22 bp, Homo sapiens
aggcttcttcttcctatttagt

SEQ ID NO: 8367994 - DNA, 22 bp, Homo sapiens
aggcttcttctctatgtacaag

SEQ ID NO: 8367995 - DNA, 22 bp, Homo sapiens
aggcttcttgagccccacaggc

SEQ ID NO: 8367996 - DNA, 22 bp, Homo sapiens
aggcttcttgataaaatgcaga

SEQ ID NO: 8367997 - DNA, 22 bp, Homo sapiens
aggcttcttgcttccaaatgca

SEQ ID NO: 8367998 - DNA, 22 bp, Homo sapiens
aggcttcttttagaggggatgg

SEQ ID NO: 8367999 - DNA, 19 bp, Homo sapiens
aggcttggaacagccttat

SEQ ID NO: 8368000 - DNA, 22 bp, Homo sapiens
aggcttggaaaatttacagtgt

SEQ ID NO: 8368001 - DNA, 22 bp, Homo sapiens
aggcttcacctgcacctgagct

SEQ ID NO: 8368002 - DNA, 22 bp, Homo sapiens
aggcttctaaatcacaaggaaa

SEQ ID NO: 8368003 - DNA, 22 bp, Homo sapiens
aggcttcgcaaggttagagctg

SEQ ID NO: 8368004 - DNA, 22 bp, Homo sapiens
aggctggctgagctgcagcctg

SEQ ID NO: 8368005 - DNA, 22 bp, Homo sapiens
aggctggctggcaggggacaca

SEQ ID NO: 8368006 - DNA, 22 bp, Homo sapiens
aggctggctgacttctgaagca

SEQ ID NO: 8368007 - DNA, 22 bp, Homo sapiens
aggctggctgagctgcagcctg

SEQ ID NO: 8368008 - DNA, 22 bp, Homo sapiens
aggcttctgctgtattaacact

SEQ ID NO: 8368009 - DNA, 22 bp, Homo sapiens
aggcttctggaatccagtttct

SEQ ID NO: 8368010 - DNA, 22 bp, Homo sapiens
aggcttctctccttggcttgca

SEQ ID NO: 8368011 - DNA, 22 bp, Homo sapiens
aggcttctgataccatgagaga

SEQ ID NO: 8368012 - DNA, 22 bp, Homo sapiens
aggcttctctgcaagatgttaa

SEQ ID NO: 8368013 - DNA, 22 bp, Homo sapiens
aggcttctacgtggtcccaggg

SEQ ID NO: 8368014 - DNA, 22 bp, Homo sapiens
aggcttctacgtggtcccaggg

SEQ ID NO: 8368015 - DNA, 22 bp, Homo sapiens
aggcttctaggaaactttctgg

SEQ ID NO: 8368016 - DNA, 21 bp, Homo sapiens
aggcttctccgtgcaggaaga

SEQ ID NO: 8368017 - DNA, 22 bp, Homo sapiens
aggcttctccttcctaccttcc

SEQ ID NO: 8368018 - DNA, 22 bp, Homo sapiens
agggcagagattaattaagaca

SEQ ID NO: 8368019 - DNA, 22 bp, Homo sapiens
agggcagagatctgagtgggca

SEQ ID NO: 8368020 - DNA, 22 bp, Homo sapiens
agggcagagctgtctaaatggc

SEQ ID NO: 8368021 - DNA, 22 bp, Homo sapiens
agggcagagcactgaattggga

SEQ ID NO: 8368022 - DNA, 22 bp, Homo sapiens
agggcagagatctgagtgggca

SEQ ID NO: 8368023 - DNA, 22 bp, Homo sapiens
agggcagagagatgaatgggat

SEQ ID NO: 8368024 - DNA, 22 bp, Homo sapiens
agggcagagagatgaatgggat

SEQ ID NO: 8368025 - DNA, 22 bp, Homo sapiens
agggcagagacatgcttcctga

SEQ ID NO: 8368026 - DNA, 20 bp, Homo sapiens
agggcagagggattacaggc

SEQ ID NO: 8368027 - DNA, 22 bp, Homo sapiens
agggcagaggcggacacggaag

SEQ ID NO: 8368028 - DNA, 22 bp, Homo sapiens
ccctggacacacacttttattc

SEQ ID NO: 8368029 - DNA, 20 bp, Homo sapiens
ccctggactcctgagcaaac

SEQ ID NO: 8368030 - DNA, 22 bp, Homo sapiens
agggatgggaactcctccagca

SEQ ID NO: 8368031 - DNA, 22 bp, Homo sapiens
agggatgggaactcctccagca

SEQ ID NO: 8368032 - DNA, 18 bp, Homo sapiens
ccctcttgcacaaagcaa

SEQ ID NO: 8368033 - DNA, 22 bp, Homo sapiens
agggatgctgctaagtggtcta

SEQ ID NO: 8368034 - DNA, 22 bp, Homo sapiens
agggatggaagctcgtctgcaa

SEQ ID NO: 8368035 - DNA, 22 bp, Homo sapiens
agggagaagagaacaaagccct

SEQ ID NO: 8368036 - DNA, 22 bp, Homo sapiens
agggagaagagaacaaagccct

SEQ ID NO: 8368037 - DNA, 22 bp, Homo sapiens
cccaggggtatccatggagaag

SEQ ID NO: 8368038 - DNA, 22 bp, Homo sapiens
agggactcctctgctcggctgc

SEQ ID NO: 8368039 - DNA, 22 bp, Homo sapiens
agggctccaaggaagtgtagct

SEQ ID NO: 8368040 - DNA, 22 bp, Homo sapiens
agggctcattgacatggaaaag

SEQ ID NO: 8368041 - DNA, 22 bp, Homo sapiens
agggctcatctgagactgacat

SEQ ID NO: 8368042 - DNA, 22 bp, Homo sapiens
agggctcataattcctgacttc

SEQ ID NO: 8368043 - DNA, 21 bp, Homo sapiens
agggctcaaatgtgcttgctg

SEQ ID NO: 8368044 - DNA, 22 bp, Homo sapiens
cctccccacgggcagccggcgc

SEQ ID NO: 8368045 - DNA, 22 bp, Homo sapiens
agggctctgttggggtcagcac

SEQ ID NO: 8368046 - DNA, 21 bp, Homo sapiens
ccctttctccatacttcatcc

SEQ ID NO: 8368047 - DNA, 22 bp, Homo sapiens
ccctttgcccagtatattctag

SEQ ID NO: 8368048 - DNA, 22 bp, Homo sapiens
ccctttcttccgtgacttctgc

SEQ ID NO: 8368049 - DNA, 22 bp, Homo sapiens
cccttcagtgctaggctgcctg

SEQ ID NO: 8368050 - DNA, 22 bp, Homo sapiens
cccttcagtgctaggctgcctg

SEQ ID NO: 8368051 - DNA, 22 bp, Homo sapiens
cccttcagtgcgtgagaatgag

SEQ ID NO: 8368052 - DNA, 22 bp, Homo sapiens
cccttcagtgcgtgagaatgag

SEQ ID NO: 8368053 - DNA, 22 bp, Homo sapiens
ccctttcccttctggctcaggg

SEQ ID NO: 8368054 - DNA, 22 bp, Homo sapiens
ccctttcctgaagaatattttt

SEQ ID NO: 8368055 - DNA, 22 bp, Homo sapiens
ccgaggctggagtgcagtggcg

SEQ ID NO: 8368056 - DNA, 22 bp, Homo sapiens
ccgaggaagggacagggctctg

SEQ ID NO: 8368057 - DNA, 21 bp, Homo sapiens
ccgccgctgatagctctgggc

SEQ ID NO: 8368058 - DNA, 22 bp, Homo sapiens
agggccagagtctgtgtagata

SEQ ID NO: 8368059 - DNA, 22 bp, Homo sapiens
agggccagaatccctcagtcta

SEQ ID NO: 8368060 - DNA, 22 bp, Homo sapiens
agggccagaatccctcagtcta

SEQ ID NO: 8368061 - DNA, 22 bp, Homo sapiens
ccctggaggcaaaggttgcagt

SEQ ID NO: 8368062 - DNA, 22 bp, Homo sapiens
cctctgggccagcctggaccct

SEQ ID NO: 8368063 - DNA, 22 bp, Homo sapiens
cctctgggagactgctactgag

SEQ ID NO: 8368064 - DNA, 21 bp, Homo sapiens
cctctggcttgtgctgtgccc

SEQ ID NO: 8368065 - DNA, 22 bp, Homo sapiens
cctctgggaagccagtcctgct

SEQ ID NO: 8368066 - DNA, 22 bp, Homo sapiens
cctcctggaggctctagggaaa

SEQ ID NO: 8368067 - DNA, 22 bp, Homo sapiens
cctcctggatggatttggtgga

SEQ ID NO: 8368068 - DNA, 22 bp, Homo sapiens
cctcctggaaaaattccctggc

SEQ ID NO: 8368069 - DNA, 22 bp, Homo sapiens
cctcctggaaaaattccctggc

SEQ ID NO: 8368070 - DNA, 22 bp, Homo sapiens
cctcctggaggctctaagggag

SEQ ID NO: 8368071 - DNA, 22 bp, Homo sapiens
cctcctggagcattggtgagga

SEQ ID NO: 8368072 - DNA, 22 bp, Homo sapiens
cctcctgcacttgctttccttc

SEQ ID NO: 8368073 - DNA, 22 bp, Homo sapiens
cctcctgcactgcaagcttgag

SEQ ID NO: 8368074 - DNA, 22 bp, Homo sapiens
cctcctgcacctccaggaactc

SEQ ID NO: 8368075 - DNA, 22 bp, Homo sapiens
cctcctgcacctccaggaactc

SEQ ID NO: 8368076 - DNA, 19 bp, Homo sapiens
cctcctgctagatatgcaa

SEQ ID NO: 8368077 - DNA, 22 bp, Homo sapiens
cctcctgcggcgtccgcgctct

SEQ ID NO: 8368078 - DNA, 22 bp, Homo sapiens
cctgaggagattgtggctgggg

SEQ ID NO: 8368079 - DNA, 22 bp, Homo sapiens
cctgaggaggtgaagtctccat

SEQ ID NO: 8368080 - DNA, 22 bp, Homo sapiens
cctgaggatattcaccagcatg

SEQ ID NO: 8368081 - DNA, 22 bp, Homo sapiens
cctgaggatgccagcatgggtg

SEQ ID NO: 8368082 - DNA, 22 bp, Homo sapiens
cctgaggatgccagcatgggtg

SEQ ID NO: 8368083 - DNA, 22 bp, Homo sapiens
aggggagagaacataaggaagt

SEQ ID NO: 8368084 - DNA, 22 bp, Homo sapiens
cctgaggacacacgctgcagga

SEQ ID NO: 8368085 - DNA, 19 bp, Homo sapiens
cctgaggaaaagatgattg

SEQ ID NO: 8368086 - DNA, 22 bp, Homo sapiens
cctgaggacacacgctgcagga

SEQ ID NO: 8368087 - DNA, 22 bp, Homo sapiens
aggctccaccagtcaggtgcat

SEQ ID NO: 8368088 - DNA, 22 bp, Homo sapiens
aggctccaccctacagagctcc

SEQ ID NO: 8368089 - DNA, 22 bp, Homo sapiens
ccagggaaggctctgcctgctt

SEQ ID NO: 8368090 - DNA, 22 bp, Homo sapiens
ccagggaaggctgctggctgtg

SEQ ID NO: 8368091 - DNA, 22 bp, Homo sapiens
ccagggaaggctgctggctgtg

SEQ ID NO: 8368092 - DNA, 23 bp, Homo sapiens
ccagggaaggccatcttcaactg

SEQ ID NO: 8368093 - DNA, 22 bp, Homo sapiens
aggctcagtatagctggcaagt

SEQ ID NO: 8368094 - DNA, 17 bp, Homo sapiens
ccaggagcgtgggtctc

SEQ ID NO: 8368095 - DNA, 22 bp, Homo sapiens
ccagggaggagcatttcatggt

SEQ ID NO: 8368096 - DNA, 22 bp, Homo sapiens
ccagggaggagcatttcatggt

SEQ ID NO: 8368097 - DNA, 22 bp, Homo sapiens
ccagggagcggggctgggtctc

SEQ ID NO: 8368098 - DNA, 22 bp, Homo sapiens
aggctcctgagaggcagaggct

SEQ ID NO: 8368099 - DNA, 22 bp, Homo sapiens
ccagggagcccacaggacaatg

SEQ ID NO: 8368100 - DNA, 22 bp, Homo sapiens
ccagggagcctggtgtgtcagc

SEQ ID NO: 8368101 - DNA, 22 bp, Homo sapiens
ccagggaatctctgagtgtgtt

SEQ ID NO: 8368102 - DNA, 22 bp, Homo sapiens
ccagggaatcaggcagaagtca

SEQ ID NO: 8368103 - DNA, 22 bp, Homo sapiens
ccagggaatgtgggatgactct

SEQ ID NO: 8368104 - DNA, 22 bp, Homo sapiens
ccagggaatgtgggatgactct

SEQ ID NO: 8368105 - DNA, 22 bp, Homo sapiens
ccagggaatgatatttttgcct

SEQ ID NO: 8368106 - DNA, 22 bp, Homo sapiens
ccagggaagtcacattgtctag

SEQ ID NO: 8368107 - DNA, 22 bp, Homo sapiens
ccagggaagtcacattgtctag

SEQ ID NO: 8368108 - DNA, 22 bp, Homo sapiens
ccagggaatcaggcagaagtca

SEQ ID NO: 8368109 - DNA, 22 bp, Homo sapiens
ccagggaagtagttgtgagagc

SEQ ID NO: 8368110 - DNA, 22 bp, Homo sapiens
ccagggaagtagttgtgagagc

SEQ ID NO: 8368111 - DNA, 22 bp, Homo sapiens
ccagggtcttcgaggcagcaat

SEQ ID NO: 8368112 - DNA, 22 bp, Homo sapiens
ccagggtcttggagaggagtgc

SEQ ID NO: 8368113 - DNA, 22 bp, Homo sapiens
aggctccttgctcacaggctca

SEQ ID NO: 8368114 - DNA, 22 bp, Homo sapiens
aggctcctgggtgtggccgcca

SEQ ID NO: 8368115 - DNA, 22 bp, Homo sapiens
aggctcctgcaggtgaggtgct

SEQ ID NO: 8368116 - DNA, 22 bp, Homo sapiens
ccagggtgaggaggctcccacg

SEQ ID NO: 8368117 - DNA, 22 bp, Homo sapiens
aggctggctgacttctgaagca

SEQ ID NO: 8368118 - DNA, 22 bp, Homo sapiens
aggctggctgaaaaacaccctt

SEQ ID NO: 8368119 - DNA, 22 bp, Homo sapiens
aggctggctcggcttttctgtc

SEQ ID NO: 8368120 - DNA, 17 bp, Homo sapiens
aggctggctcacaggga

SEQ ID NO: 8368121 - DNA, 21 bp, Homo sapiens
cccagagcctagggagggcac

SEQ ID NO: 8368122 - DNA, 22 bp, Homo sapiens
cccagagccggtggtgctcaca

SEQ ID NO: 8368123 - DNA, 22 bp, Homo sapiens
cccagagccgctcccctacttc

SEQ ID NO: 8368124 - DNA, 20 bp, Homo sapiens
cccagagccatagccagaca

SEQ ID NO: 8368125 - DNA, 22 bp, Homo sapiens
cccagagcatgtgctgcctttg

SEQ ID NO: 8368126 - DNA, 19 bp, Homo sapiens
cccagagcatcctgaactt

SEQ ID NO: 8368127 - DNA, 22 bp, Homo sapiens
aggctgcctggctgtgagtgaa

SEQ ID NO: 8368128 - DNA, 22 bp, Homo sapiens
aggctgcctcttttgagagggt

SEQ ID NO: 8368129 - DNA, 18 bp, Homo sapiens
cccactgtccccacaggc

SEQ ID NO: 8368130 - DNA, 22 bp, Homo sapiens
cccactgtctgttcccagggcc

SEQ ID NO: 8368131 - DNA, 16 bp, Homo sapiens
cccactgtctggtctt

SEQ ID NO: 8368132 - DNA, 20 bp, Homo sapiens
aggctgcctaaggctctgca

SEQ ID NO: 8368133 - DNA, 22 bp, Homo sapiens
ccatgtgcttgctctggcacct

SEQ ID NO: 8368134 - DNA, 21 bp, Homo sapiens
ccatgtcagatgtgggctgtg

SEQ ID NO: 8368135 - DNA, 20 bp, Homo sapiens
aggctgcctaaggctctgca

SEQ ID NO: 8368136 - DNA, 22 bp, Homo sapiens
ccatgtacatgaacacggcggc

SEQ ID NO: 8368137 - DNA, 21 bp, Homo sapiens
ccatgggaagcatcctcgcgg

SEQ ID NO: 8368138 - DNA, 22 bp, Homo sapiens
ccatgggaattgggaggtccca

SEQ ID NO: 8368139 - DNA, 22 bp, Homo sapiens
ccatgggacctacctcctgtgc

SEQ ID NO: 8368140 - DNA, 22 bp, Homo sapiens
ccatgggagatgatggggagtg

SEQ ID NO: 8368141 - DNA, 21 bp, Homo sapiens
ccatgggagctgttaatcctg

SEQ ID NO: 8368142 - DNA, 22 bp, Homo sapiens
ccatgggagatgatggggagtg

SEQ ID NO: 8368143 - DNA, 22 bp, Homo sapiens
aggctctgtcaggcggagcagc

SEQ ID NO: 8368144 - DNA, 22 bp, Homo sapiens
aggctctgtgatgtgccaggca

SEQ ID NO: 8368145 - DNA, 22 bp, Homo sapiens
aggctctgtgcagcctgcatct

SEQ ID NO: 8368146 - DNA, 22 bp, Homo sapiens
aggctgaggcgggtagatcacc

SEQ ID NO: 8368147 - DNA, 22 bp, Homo sapiens
aggctgaggggcgagggaccct

SEQ ID NO: 8368148 - DNA, 20 bp, Homo sapiens
aggctgagggtgattgtgtc

SEQ ID NO: 8368149 - DNA, 22 bp, Homo sapiens
aggctgaggtaggaggatcgct

SEQ ID NO: 8368150 - DNA, 22 bp, Homo sapiens
aggctgaggtgtgctgtgatcg

SEQ ID NO: 8368151 - DNA, 22 bp, Homo sapiens
aggctgaggtgtgctgtgatcg

SEQ ID NO: 8368152 - DNA, 22 bp, Homo sapiens
aggctgagtcgggaggatcact

SEQ ID NO: 8368153 - DNA, 19 bp, Homo sapiens
ccatgcagcctgggggcag

SEQ ID NO: 8368154 - DNA, 22 bp, Homo sapiens
ccatggctccttgccctgtagc

SEQ ID NO: 8368155 - DNA, 22 bp, Homo sapiens
ccatggcttacagatggagcat

SEQ ID NO: 8368156 - DNA, 22 bp, Homo sapiens
aggccctgggagcagagatgca

SEQ ID NO: 8368157 - DNA, 22 bp, Homo sapiens
ccaggacaagtgtggccatggc

SEQ ID NO: 8368158 - DNA, 22 bp, Homo sapiens
aggccctggcactgcctgggag

SEQ ID NO: 8368159 - DNA, 22 bp, Homo sapiens
ccaggaaaaacacattgaagag

SEQ ID NO: 8368160 - DNA, 22 bp, Homo sapiens
aggccctggcccccagagattc

SEQ ID NO: 8368161 - DNA, 22 bp, Homo sapiens
ccaggagagcaggcgtgcagct

SEQ ID NO: 8368162 - DNA, 22 bp, Homo sapiens
ccaggagagcaggcgtgcagct

SEQ ID NO: 8368163 - DNA, 22 bp, Homo sapiens
ccaggagagctctcgttcagtg

SEQ ID NO: 8368164 - DNA, 22 bp, Homo sapiens
ccaggagatttttccatagcac

SEQ ID NO: 8368165 - DNA, 22 bp, Homo sapiens
ccaggagatttttccatagcac

SEQ ID NO: 8368166 - DNA, 22 bp, Homo sapiens
ccaggagatgggaaagtagcag

SEQ ID NO: 8368167 - DNA, 19 bp, Homo sapiens
ccaggagagcttggagaag

SEQ ID NO: 8368168 - DNA, 22 bp, Homo sapiens
ccaggagataagctgagtttat

SEQ ID NO: 8368169 - DNA, 22 bp, Homo sapiens
ccagcctccatgtagatagctg

SEQ ID NO: 8368170 - DNA, 22 bp, Homo sapiens
ccagcctcatcgcctgcctgtc

SEQ ID NO: 8368171 - DNA, 22 bp, Homo sapiens
ccagcctgaaatgcctcatcct

SEQ ID NO: 8368172 - DNA, 22 bp, Homo sapiens
ccagcctgaaatgcctcatcct

SEQ ID NO: 8368173 - DNA, 22 bp, Homo sapiens
ccagcctgaaatgcctcatcct

SEQ ID NO: 8368174 - DNA, 22 bp, Homo sapiens
aggccagagttaaggagaacag

SEQ ID NO: 8368175 - DNA, 22 bp, Homo sapiens
ccagcctcatcgcctgcctgtc

SEQ ID NO: 8368176 - DNA, 22 bp, Homo sapiens
ccagcctggactgggtcttgtg

SEQ ID NO: 8368177 - DNA, 22 bp, Homo sapiens
aggcccagagagccagttagtg

SEQ ID NO: 8368178 - DNA, 21 bp, Homo sapiens
aggcccagagtcttgggggga

SEQ ID NO: 8368179 - DNA, 22 bp, Homo sapiens
aggcccagagcaggaaagggtt

SEQ ID NO: 8368180 - DNA, 22 bp, Homo sapiens
aggcccagcccgtcctcgtgct

SEQ ID NO: 8368181 - DNA, 19 bp, Homo sapiens
aggcccagcgctgggggct

SEQ ID NO: 8368182 - DNA, 22 bp, Homo sapiens
aggcccagctggacaaactgct

SEQ ID NO: 8368183 - DNA, 22 bp, Homo sapiens
ccagcttgtttgaagctcgtca

SEQ ID NO: 8368184 - DNA, 22 bp, Homo sapiens
ccagcttgttccttagactctg

SEQ ID NO: 8368185 - DNA, 22 bp, Homo sapiens
aggcatggatgtagcagtgacc

SEQ ID NO: 8368186 - DNA, 22 bp, Homo sapiens
aggcatggatgtagcagtgacc

SEQ ID NO: 8368187 - DNA, 22 bp, Homo sapiens
aggcatggatggatccagggct

SEQ ID NO: 8368188 - DNA, 22 bp, Homo sapiens
aggcatggcactgagcagcttc

SEQ ID NO: 8368189 - DNA, 22 bp, Homo sapiens
aggcatggcactgagcagcttc

SEQ ID NO: 8368190 - DNA, 22 bp, Homo sapiens
aggcatggcactgagcagcttc

SEQ ID NO: 8368191 - DNA, 22 bp, Homo sapiens
aggcatggcactgagcagcttc

SEQ ID NO: 8368192 - DNA, 22 bp, Homo sapiens
aggcatggcactgagcagcttc

SEQ ID NO: 8368193 - DNA, 22 bp, Homo sapiens
ccagagcaattctcacagaact

SEQ ID NO: 8368194 - DNA, 22 bp, Homo sapiens
ccagagcagaaccggaacacca

SEQ ID NO: 8368195 - DNA, 22 bp, Homo sapiens
aggcatgcaaacagtctagagt

SEQ ID NO: 8368196 - DNA, 21 bp, Homo sapiens
aggcatggaaatggcacactg

SEQ ID NO: 8368197 - DNA, 21 bp, Homo sapiens
aggcatggaaatggcacactg

SEQ ID NO: 8368198 - DNA, 22 bp, Homo sapiens
aggcatggacatttcggcagct

SEQ ID NO: 8368199 - DNA, 22 bp, Homo sapiens
ccagcagaggcatcatccttcc

SEQ ID NO: 8368200 - DNA, 22 bp, Homo sapiens
ccagcagagctggaagtgtgct

SEQ ID NO: 8368201 - DNA, 22 bp, Homo sapiens
ccagcagaggggcggagtgcag

SEQ ID NO: 8368202 - DNA, 22 bp, Homo sapiens
ccagcagaggggcggagtgcag

SEQ ID NO: 8368203 - DNA, 22 bp, Homo sapiens
aggccagacagctagaaacagg

SEQ ID NO: 8368204 - DNA, 19 bp, Homo sapiens
ccagcagacacagctgccc

SEQ ID NO: 8368205 - DNA, 19 bp, Homo sapiens
ccagcagacacagctgccc

SEQ ID NO: 8368206 - DNA, 19 bp, Homo sapiens
ccagcagacacagctgccc

SEQ ID NO: 8368207 - DNA, 22 bp, Homo sapiens
ccagcagagcatggggaggaag

SEQ ID NO: 8368208 - DNA, 22 bp, Homo sapiens
ccagcagagcatggggaggaag

SEQ ID NO: 8368209 - DNA, 22 bp, Homo sapiens
ccagcagagcatggggaggaag

SEQ ID NO: 8368210 - DNA, 22 bp, Homo sapiens
ccagcagaagctcccgctgggt

SEQ ID NO: 8368211 - DNA, 22 bp, Homo sapiens
ccagcagacacacaggcgtggg

SEQ ID NO: 8368212 - DNA, 19 bp, Homo sapiens
ccagcagaagccactcctg

SEQ ID NO: 8368213 - DNA, 22 bp, Homo sapiens
ccagcactgttctaaggaaaca

SEQ ID NO: 8368214 - DNA, 22 bp, Homo sapiens
aggcagggtcttgctatgttgc

SEQ ID NO: 8368215 - DNA, 22 bp, Homo sapiens
aggcaggggagctggaagggta

SEQ ID NO: 8368216 - DNA, 22 bp, Homo sapiens
aggcagggtgatgataatgatt

SEQ ID NO: 8368217 - DNA, 22 bp, Homo sapiens
ccacaggaagttatgagtacta

SEQ ID NO: 8368218 - DNA, 22 bp, Homo sapiens
ccacagcttcttatatcactgg

SEQ ID NO: 8368219 - DNA, 22 bp, Homo sapiens
ccacagcttcgcagtctgctgc

SEQ ID NO: 8368220 - DNA, 22 bp, Homo sapiens
ccagagaggggaagggcttgcc

SEQ ID NO: 8368221 - DNA, 22 bp, Homo sapiens
ccagagaggggaagggcttgcc

SEQ ID NO: 8368222 - DNA, 22 bp, Homo sapiens
ccagagagtaggaggcattatt

SEQ ID NO: 8368223 - DNA, 22 bp, Homo sapiens
ccagagagtcgatgggggacac

SEQ ID NO: 8368224 - DNA, 22 bp, Homo sapiens
ccagagaaagtgaagcaaatgt

SEQ ID NO: 8368225 - DNA, 22 bp, Homo sapiens
ccagagagggcgccacctggag

SEQ ID NO: 8368226 - DNA, 22 bp, Homo sapiens
ccagagaaaggtttgattcatt

SEQ ID NO: 8368227 - DNA, 22 bp, Homo sapiens
catttgttaattactattatct

SEQ ID NO: 8368228 - DNA, 22 bp, Homo sapiens
catttgttctgatttcaaaagg

SEQ ID NO: 8368229 - DNA, 22 bp, Homo sapiens
catttgttctgatttcaaaagg

SEQ ID NO: 8368230 - DNA, 20 bp, Homo sapiens
catttgttagctttctactg

SEQ ID NO: 8368231 - DNA, 22 bp, Homo sapiens
cattaacaatgactgcttgact

SEQ ID NO: 8368232 - DNA, 22 bp, Homo sapiens
cattaacaattgtttatgctgt

SEQ ID NO: 8368233 - DNA, 19 bp, Homo sapiens
aggcagcaggccagggatg

SEQ ID NO: 8368234 - DNA, 21 bp, Homo sapiens
aggcagcaggatccagggaca

SEQ ID NO: 8368235 - DNA, 22 bp, Homo sapiens
catttgtttagaagtctttata

SEQ ID NO: 8368236 - DNA, 22 bp, Homo sapiens
catttgttgggacaatgaaaag

SEQ ID NO: 8368237 - DNA, 22 bp, Homo sapiens
catttgttggtcagattgtagt

SEQ ID NO: 8368238 - DNA, 22 bp, Homo sapiens
aggcactggtctaccccttagt

SEQ ID NO: 8368239 - DNA, 22 bp, Homo sapiens
aggcactgtactaggtacaggg

SEQ ID NO: 8368240 - DNA, 22 bp, Homo sapiens
aggcactgtactaggtacaggg

SEQ ID NO: 8368241 - DNA, 22 bp, Homo sapiens
aggcactgtgcagtcccaagca

SEQ ID NO: 8368242 - DNA, 22 bp, Homo sapiens
aggcactgtgcagtcccaagca

SEQ ID NO: 8368243 - DNA, 15 bp, Homo sapiens
aggcactgtgggacc

SEQ ID NO: 8368244 - DNA, 22 bp, Homo sapiens
aggcactgtggaagacatggtt

SEQ ID NO: 8368245 - DNA, 22 bp, Homo sapiens
aggcactgtggaagacatggtt

SEQ ID NO: 8368246 - DNA, 22 bp, Homo sapiens
aggcactgtggaagacatggtt

SEQ ID NO: 8368247 - DNA, 22 bp, Homo sapiens
aggcactgtgcttcttatatgt

SEQ ID NO: 8368248 - DNA, 22 bp, Homo sapiens
aggcactgtgctgatgtcttat

SEQ ID NO: 8368249 - DNA, 22 bp, Homo sapiens
cattaaaatatctcatggtgtt

SEQ ID NO: 8368250 - DNA, 22 bp, Homo sapiens
catgttttgtgtacagaatatt

SEQ ID NO: 8368251 - DNA, 22 bp, Homo sapiens
cattaaattccttgttctcaaa

SEQ ID NO: 8368252 - DNA, 22 bp, Homo sapiens
cattaacaaatggaagcatgaa

SEQ ID NO: 8368253 - DNA, 22 bp, Homo sapiens
cattaaattccttgttctcaaa

SEQ ID NO: 8368254 - DNA, 22 bp, Homo sapiens
cattaaatatcaacctagacta

SEQ ID NO: 8368255 - DNA, 22 bp, Homo sapiens
cattaaatcttccagacctcac

SEQ ID NO: 8368256 - DNA, 22 bp, Homo sapiens
cattaaatatcaacctagacta

SEQ ID NO: 8368257 - DNA, 22 bp, Homo sapiens
ccaagcctagtcgtgcacacag

SEQ ID NO: 8368258 - DNA, 22 bp, Homo sapiens
ccaagcgggaatgcaatggcgt

SEQ ID NO: 8368259 - DNA, 22 bp, Homo sapiens
ccaagcaaggctaattcacttg

SEQ ID NO: 8368260 - DNA, 22 bp, Homo sapiens
ccaagcaggatattctgtgtca

SEQ ID NO: 8368261 - DNA, 22 bp, Homo sapiens
ccaaaggcggaactgagtctct

SEQ ID NO: 8368262 - DNA, 22 bp, Homo sapiens
ccaaaggcggaactgagtctct

SEQ ID NO: 8368263 - DNA, 23 bp, Homo sapiens
aggcagcaggttgtccagggtga

SEQ ID NO: 8368264 - DNA, 23 bp, Homo sapiens
aggcagcaggttgtccagggtga

SEQ ID NO: 8368265 - DNA, 22 bp, Homo sapiens
aggcagcagggccactggctga

SEQ ID NO: 8368266 - DNA, 22 bp, Homo sapiens
ccaaggactggacacacaggtt

SEQ ID NO: 8368267 - DNA, 22 bp, Homo sapiens
ccaaggtgggcagatcacgagg

SEQ ID NO: 8368268 - DNA, 22 bp, Homo sapiens
ccaaggtgggaggattgcttga

SEQ ID NO: 8368269 - DNA, 22 bp, Homo sapiens
ccaaggtggctacagccctgca

SEQ ID NO: 8368270 - DNA, 22 bp, Homo sapiens
ccaagtcctgctgccactctac

SEQ ID NO: 8368271 - DNA, 18 bp, Homo sapiens
aggcaggctggagtgact

SEQ ID NO: 8368272 - DNA, 22 bp, Homo sapiens
ccaatcctcatgttcaacaacc

SEQ ID NO: 8368273 - DNA, 20 bp, Homo sapiens
ccaataaagctctataggga

SEQ ID NO: 8368274 - DNA, 22 bp, Homo sapiens
aggagggatagaaaaatacttg

SEQ ID NO: 8368275 - DNA, 21 bp, Homo sapiens
aggagggcacaaggccaggaa

SEQ ID NO: 8368276 - DNA, 22 bp, Homo sapiens
aggagggatagaaaaatacttg

SEQ ID NO: 8368277 - DNA, 20 bp, Homo sapiens
aggaggggatagaatcaaag

SEQ ID NO: 8368278 - DNA, 22 bp, Homo sapiens
aggaggggcaatgatagtctgg

SEQ ID NO: 8368279 - DNA, 22 bp, Homo sapiens
catggcactgagcaggtatgca

SEQ ID NO: 8368280 - DNA, 22 bp, Homo sapiens
catggcagaaacctgagctgct

SEQ ID NO: 8368281 - DNA, 22 bp, Homo sapiens
catggcagagaaggggaactgg

SEQ ID NO: 8368282 - DNA, 22 bp, Homo sapiens
catggacagtgggacagtgtgt

SEQ ID NO: 8368283 - DNA, 22 bp, Homo sapiens
catggaaggcaaaagacacaga

SEQ ID NO: 8368284 - DNA, 22 bp, Homo sapiens
catggcaataggaatgatgtga

SEQ ID NO: 8368285 - DNA, 22 bp, Homo sapiens
aggcactgcagattacaggcgc

SEQ ID NO: 8368286 - DNA, 22 bp, Homo sapiens
aggcactgcagattacaggcgc

SEQ ID NO: 8368287 - DNA, 22 bp, Homo sapiens
aggcactgcagattacaggcgc

SEQ ID NO: 8368288 - DNA, 22 bp, Homo sapiens
catgtcacaattcttaatggga

SEQ ID NO: 8368289 - DNA, 22 bp, Homo sapiens
catgtatcttaattgctttgga

SEQ ID NO: 8368290 - DNA, 22 bp, Homo sapiens
catgtacattctgtagatggag

SEQ ID NO: 8368291 - DNA, 19 bp, Homo sapiens
catggtgaaaccccgtctc

SEQ ID NO: 8368292 - DNA, 22 bp, Homo sapiens
catggtactgccacagaagagt

SEQ ID NO: 8368293 - DNA, 23 bp, Homo sapiens
catggggagcagtgctcctgacc

SEQ ID NO: 8368294 - DNA, 22 bp, Homo sapiens
catggggcccatgtgctccaag

SEQ ID NO: 8368295 - DNA, 22 bp, Homo sapiens
cagtttctctcaataagcatcg

SEQ ID NO: 8368296 - DNA, 22 bp, Homo sapiens
cagttttaaattgttagataat

SEQ ID NO: 8368297 - DNA, 22 bp, Homo sapiens
cagttttagctagagcaaacca

SEQ ID NO: 8368298 - DNA, 22 bp, Homo sapiens
cagttttagctagagcaaacca

SEQ ID NO: 8368299 - DNA, 22 bp, Homo sapiens
cagttttagggcaatgtgaaga

SEQ ID NO: 8368300 - DNA, 22 bp, Homo sapiens
cagttttagggcaatgtgaaga

SEQ ID NO: 8368301 - DNA, 22 bp, Homo sapiens
cagtttcctgaagagaaagaat

SEQ ID NO: 8368302 - DNA, 22 bp, Homo sapiens
cagtttccctgcttgaaaacgt

SEQ ID NO: 8368303 - DNA, 22 bp, Homo sapiens
cagtttctacgaaggtcaaccc

SEQ ID NO: 8368304 - DNA, 22 bp, Homo sapiens
cagtttctccaaacgcaggctg

SEQ ID NO: 8368305 - DNA, 22 bp, Homo sapiens
cagtttctcaggcctctcccag

SEQ ID NO: 8368306 - DNA, 22 bp, Homo sapiens
cagtttctacgacttaagcaca

SEQ ID NO: 8368307 - DNA, 22 bp, Homo sapiens
cagtttctatggctgggctctg

SEQ ID NO: 8368308 - DNA, 22 bp, Homo sapiens
cagtttctcagacttcccttgt

SEQ ID NO: 8368309 - DNA, 18 bp, Homo sapiens
cagtggtgctgggatgtg

SEQ ID NO: 8368310 - DNA, 22 bp, Homo sapiens
cagtggttatacttactgtttc

SEQ ID NO: 8368311 - DNA, 22 bp, Homo sapiens
cagtggtgaagagcaggggctc

SEQ ID NO: 8368312 - DNA, 21 bp, Homo sapiens
cagtggtctgtctccattttt

SEQ ID NO: 8368313 - DNA, 22 bp, Homo sapiens
cagttctggaggatagaagtct

SEQ ID NO: 8368314 - DNA, 23 bp, Homo sapiens
cagtggtcagaacgtgggagggt

SEQ ID NO: 8368315 - DNA, 22 bp, Homo sapiens
cagtggcgtgatctctgctcac

SEQ ID NO: 8368316 - DNA, 22 bp, Homo sapiens
cagtggcgtgatctctgctcac

SEQ ID NO: 8368317 - DNA, 22 bp, Homo sapiens
catagcaacagcatcaagtcaa

SEQ ID NO: 8368318 - DNA, 22 bp, Homo sapiens
cagttttatcatctgtgaaatg

SEQ ID NO: 8368319 - DNA, 22 bp, Homo sapiens
catacatatgtggatgtcatat

SEQ ID NO: 8368320 - DNA, 22 bp, Homo sapiens
catagttcctacctaagcataa

SEQ ID NO: 8368321 - DNA, 22 bp, Homo sapiens
catagtgtctggtaacatagta

SEQ ID NO: 8368322 - DNA, 22 bp, Homo sapiens
catagttataaggcaacactgt

SEQ ID NO: 8368323 - DNA, 22 bp, Homo sapiens
catataaatacaacatgtgtta

SEQ ID NO: 8368324 - DNA, 22 bp, Homo sapiens
catataaatacaacatgtgtta

SEQ ID NO: 8368325 - DNA, 22 bp, Homo sapiens
cataggctgggctctctccaca

SEQ ID NO: 8368326 - DNA, 22 bp, Homo sapiens
cataggctgggctctctccaca

SEQ ID NO: 8368327 - DNA, 22 bp, Homo sapiens
cataggctcttcagagaactga

SEQ ID NO: 8368328 - DNA, 22 bp, Homo sapiens
catatttagtgtttggagatcg

SEQ ID NO: 8368329 - DNA, 22 bp, Homo sapiens
catatttagtgtttggagatcg

SEQ ID NO: 8368330 - DNA, 22 bp, Homo sapiens
catatttatagatctggcattt

SEQ ID NO: 8368331 - DNA, 22 bp, Homo sapiens
catatttagtgtttggagatcg

SEQ ID NO: 8368332 - DNA, 22 bp, Homo sapiens
catatttagtgtttggagatcg

SEQ ID NO: 8368333 - DNA, 22 bp, Homo sapiens
catatttcagtctaagatgtgt

SEQ ID NO: 8368334 - DNA, 21 bp, Homo sapiens
aggaggctgtctctttcagct

SEQ ID NO: 8368335 - DNA, 22 bp, Homo sapiens
aggagggagcttaagccaggca

SEQ ID NO: 8368336 - DNA, 22 bp, Homo sapiens
aggagggagcttaagccaggca

SEQ ID NO: 8368337 - DNA, 22 bp, Homo sapiens
aggagggagcttaagccaggca

SEQ ID NO: 8368338 - DNA, 22 bp, Homo sapiens
aggaccctgagcgggcatgccg

SEQ ID NO: 8368339 - DNA, 22 bp, Homo sapiens
aggacctactgatatcttagca

SEQ ID NO: 8368340 - DNA, 19 bp, Homo sapiens
aggacccttatcctggctt

SEQ ID NO: 8368341 - DNA, 22 bp, Homo sapiens
aggacgctctcgctgaacttct

SEQ ID NO: 8368342 - DNA, 22 bp, Homo sapiens
caggtggcttattagggtcagt

SEQ ID NO: 8368343 - DNA, 22 bp, Homo sapiens
caggtgccatagacgggcctgg

SEQ ID NO: 8368344 - DNA, 22 bp, Homo sapiens
caggtggcttctctgcagcctt

SEQ ID NO: 8368345 - DNA, 22 bp, Homo sapiens
caggtggcttctctgcagcctt

SEQ ID NO: 8368346 - DNA, 22 bp, Homo sapiens
caggtggcttctccctaggcca

SEQ ID NO: 8368347 - DNA, 22 bp, Homo sapiens
caggtgggagcgaggagctact

SEQ ID NO: 8368348 - DNA, 22 bp, Homo sapiens
aggacatgtgcctccagggcag

SEQ ID NO: 8368349 - DNA, 22 bp, Homo sapiens
aggacaggattgagctgaactg

SEQ ID NO: 8368350 - DNA, 22 bp, Homo sapiens
aggacatgtaaatggagaggga

SEQ ID NO: 8368351 - DNA, 22 bp, Homo sapiens
cagtgccgagctgggggctcct

SEQ ID NO: 8368352 - DNA, 22 bp, Homo sapiens
aggactccatgtgtcctggaga

SEQ ID NO: 8368353 - DNA, 22 bp, Homo sapiens
aggactgaaaatgagttcttct

SEQ ID NO: 8368354 - DNA, 21 bp, Homo sapiens
cagtgcaggggttagcgtgta

SEQ ID NO: 8368355 - DNA, 22 bp, Homo sapiens
cagtggcatggttgactgcagt

SEQ ID NO: 8368356 - DNA, 22 bp, Homo sapiens
cagtggcctttcctgctgctca

SEQ ID NO: 8368357 - DNA, 22 bp, Homo sapiens
aggagaaggaggcccctcacac

SEQ ID NO: 8368358 - DNA, 22 bp, Homo sapiens
caggctgcggtcggctctggtc

SEQ ID NO: 8368359 - DNA, 22 bp, Homo sapiens
caggctgcgtttgtgaaaggta

SEQ ID NO: 8368360 - DNA, 22 bp, Homo sapiens
caggctgctccagggtaggaaa

SEQ ID NO: 8368361 - DNA, 22 bp, Homo sapiens
caggctgcggccgtgtgagcat

SEQ ID NO: 8368362 - DNA, 22 bp, Homo sapiens
agctgtggcaaccttgtcagac

SEQ ID NO: 8368363 - DNA, 22 bp, Homo sapiens
agctgtggaagactgtcagggt

SEQ ID NO: 8368364 - DNA, 22 bp, Homo sapiens
caggctccactgtaggcagctc

SEQ ID NO: 8368365 - DNA, 22 bp, Homo sapiens
caggctccactgtaggcagctc

SEQ ID NO: 8368366 - DNA, 22 bp, Homo sapiens
caggctcagcaggagcctgacc

SEQ ID NO: 8368367 - DNA, 22 bp, Homo sapiens
caggctcagctctggccagtgc

SEQ ID NO: 8368368 - DNA, 22 bp, Homo sapiens
caggctggagtgcagttgtgca

SEQ ID NO: 8368369 - DNA, 22 bp, Homo sapiens
caggctggagttacctttaggg

SEQ ID NO: 8368370 - DNA, 22 bp, Homo sapiens
cagggagaaatctccaggaggt

SEQ ID NO: 8368371 - DNA, 22 bp, Homo sapiens
cagggagaaatctccaggaggt

SEQ ID NO: 8368372 - DNA, 22 bp, Homo sapiens
caggctggacattagatacata

SEQ ID NO: 8368373 - DNA, 22 bp, Homo sapiens
caggctgctgtccacaaagcat

SEQ ID NO: 8368374 - DNA, 22 bp, Homo sapiens
caggctgctgcctagaatgaca

SEQ ID NO: 8368375 - DNA, 22 bp, Homo sapiens
caggctggagtacaattgtgtg

SEQ ID NO: 8368376 - DNA, 22 bp, Homo sapiens
caggctggagtgcagtgtcgcc

SEQ ID NO: 8368377 - DNA, 22 bp, Homo sapiens
cagggagctctgggccggactc

SEQ ID NO: 8368378 - DNA, 22 bp, Homo sapiens
cagggagctggtgccagccgac

SEQ ID NO: 8368379 - DNA, 22 bp, Homo sapiens
cagggatgggatggagtcagtt

SEQ ID NO: 8368380 - DNA, 19 bp, Homo sapiens
cagggatgggtagggactc

SEQ ID NO: 8368381 - DNA, 23 bp, Homo sapiens
cagggccaggcagcagctgtcac

SEQ ID NO: 8368382 - DNA, 22 bp, Homo sapiens
cagggcctcgaagcctctgggc

SEQ ID NO: 8368383 - DNA, 22 bp, Homo sapiens
cagggcctgcaagagacctggg

SEQ ID NO: 8368384 - DNA, 22 bp, Homo sapiens
cagggcctgcaagagacctggg

SEQ ID NO: 8368385 - DNA, 22 bp, Homo sapiens
cagggctcgctcttgcccttcg

SEQ ID NO: 8368386 - DNA, 22 bp, Homo sapiens
cagggctcgctgccagcttcag

SEQ ID NO: 8368387 - DNA, 22 bp, Homo sapiens
cagggctctgccttgagggatg

SEQ ID NO: 8368388 - DNA, 22 bp, Homo sapiens
cagggctccctgcagcctctgt

SEQ ID NO: 8368389 - DNA, 22 bp, Homo sapiens
cagggctccctgcagcctctgt

SEQ ID NO: 8368390 - DNA, 22 bp, Homo sapiens
cagggctcccttgcaaggaggg

SEQ ID NO: 8368391 - DNA, 22 bp, Homo sapiens
cagggctccccagagagcctct

SEQ ID NO: 8368392 - DNA, 22 bp, Homo sapiens
caggggctgaaatgttggggtt

SEQ ID NO: 8368393 - DNA, 22 bp, Homo sapiens
caggggctgaaatgttggggtt

SEQ ID NO: 8368394 - DNA, 22 bp, Homo sapiens
caggtgagtaacaatgggtgat

SEQ ID NO: 8368395 - DNA, 22 bp, Homo sapiens
caggtgaggctgaacagatgaa

SEQ ID NO: 8368396 - DNA, 22 bp, Homo sapiens
caggtgaggctgaacagatgaa

SEQ ID NO: 8368397 - DNA, 22 bp, Homo sapiens
caggtgagttttcctccttggt

SEQ ID NO: 8368398 - DNA, 22 bp, Homo sapiens
caggtgagaggcggtcctgcat

SEQ ID NO: 8368399 - DNA, 22 bp, Homo sapiens
cagctctgggtaggaggaatct

SEQ ID NO: 8368400 - DNA, 22 bp, Homo sapiens
cagctctggggcagagtgacta

SEQ ID NO: 8368401 - DNA, 22 bp, Homo sapiens
cagctctgggtgacaggagggc

SEQ ID NO: 8368402 - DNA, 22 bp, Homo sapiens
cagctctgtaaattccttcatc

SEQ ID NO: 8368403 - DNA, 22 bp, Homo sapiens
cagctctgtctgtagaaacttc

SEQ ID NO: 8368404 - DNA, 22 bp, Homo sapiens
cagctgacctggctaagggagc

SEQ ID NO: 8368405 - DNA, 22 bp, Homo sapiens
cagctgacactttgacctagag

SEQ ID NO: 8368406 - DNA, 22 bp, Homo sapiens
cagctgacaagagtccttggag

SEQ ID NO: 8368407 - DNA, 22 bp, Homo sapiens
cagctgagaaaggcaggctcac

SEQ ID NO: 8368408 - DNA, 22 bp, Homo sapiens
cagctgagagacaatgagtcat

SEQ ID NO: 8368409 - DNA, 22 bp, Homo sapiens
agctgagggcaggatggggtga

SEQ ID NO: 8368410 - DNA, 22 bp, Homo sapiens
agctgcaagtgttgcctcctac

SEQ ID NO: 8368411 - DNA, 22 bp, Homo sapiens
agctgcactgacctgtatgaag

SEQ ID NO: 8368412 - DNA, 22 bp, Homo sapiens
agctgcaattaaagactgtgaa

SEQ ID NO: 8368413 - DNA, 22 bp, Homo sapiens
agctgccaagttggagtagcaa

SEQ ID NO: 8368414 - DNA, 22 bp, Homo sapiens
caggaaggcccacctgtcctgt

SEQ ID NO: 8368415 - DNA, 22 bp, Homo sapiens
caggaaggcccacctgtcctgt

SEQ ID NO: 8368416 - DNA, 22 bp, Homo sapiens
caggaaggcccacctgtcctgt

SEQ ID NO: 8368417 - DNA, 22 bp, Homo sapiens
caggaaggcgcggctgtgcctg

SEQ ID NO: 8368418 - DNA, 19 bp, Homo sapiens
agctgggctgtcacagtga

SEQ ID NO: 8368419 - DNA, 22 bp, Homo sapiens
caggccagggagaatatgaagc

SEQ ID NO: 8368420 - DNA, 22 bp, Homo sapiens
agctgggctggagctccaagcg

SEQ ID NO: 8368421 - DNA, 22 bp, Homo sapiens
agctgggctgggctgagctgag

SEQ ID NO: 8368422 - DNA, 22 bp, Homo sapiens
caggccagcgtccagaacaagc

SEQ ID NO: 8368423 - DNA, 22 bp, Homo sapiens
caggccagcgtccagaacaagc

SEQ ID NO: 8368424 - DNA, 22 bp, Homo sapiens
caggccagcttcctgacatcct

SEQ ID NO: 8368425 - DNA, 22 bp, Homo sapiens
agctggcctccgggtgcctggg

SEQ ID NO: 8368426 - DNA, 20 bp, Homo sapiens
caggccagaggtttgatggc

SEQ ID NO: 8368427 - DNA, 22 bp, Homo sapiens
agctggccggcctccaggtgga

SEQ ID NO: 8368428 - DNA, 20 bp, Homo sapiens
agctggcccacaggtgtggg

SEQ ID NO: 8368429 - DNA, 20 bp, Homo sapiens
agctggcccccggtggcctg

SEQ ID NO: 8368430 - DNA, 22 bp, Homo sapiens
agctggccattgtgagtggcct

SEQ ID NO: 8368431 - DNA, 22 bp, Homo sapiens
caggcactgtgcaagggtctcg

SEQ ID NO: 8368432 - DNA, 22 bp, Homo sapiens
caggcactggggatgctgggat

SEQ ID NO: 8368433 - DNA, 22 bp, Homo sapiens
caggcactgtgctgagctctgc

SEQ ID NO: 8368434 - DNA, 22 bp, Homo sapiens
caggcactcattcagagaggtg

SEQ ID NO: 8368435 - DNA, 22 bp, Homo sapiens
caggcacactgtctacactgag

SEQ ID NO: 8368436 - DNA, 22 bp, Homo sapiens
caggcactggccagtcagcaca

SEQ ID NO: 8368437 - DNA, 22 bp, Homo sapiens
caggcactggccagtcagcaca

SEQ ID NO: 8368438 - DNA, 22 bp, Homo sapiens
agctgctgcctcactggtctgt

SEQ ID NO: 8368439 - DNA, 22 bp, Homo sapiens
agctgctgccggtggccaccct

SEQ ID NO: 8368440 - DNA, 22 bp, Homo sapiens
agctgctgcgcctcaccctggc

SEQ ID NO: 8368441 - DNA, 22 bp, Homo sapiens
agctgctgcaagtggtgctaac

SEQ ID NO: 8368442 - DNA, 19 bp, Homo sapiens
agctgctgattggtggagg

SEQ ID NO: 8368443 - DNA, 19 bp, Homo sapiens
agctgctggcccagggacc

SEQ ID NO: 8368444 - DNA, 22 bp, Homo sapiens
caggcacactgtctacactgag

SEQ ID NO: 8368445 - DNA, 22 bp, Homo sapiens
caggaggacatactggctcaca

SEQ ID NO: 8368446 - DNA, 22 bp, Homo sapiens
caggagccccaggctgacaata

SEQ ID NO: 8368447 - DNA, 22 bp, Homo sapiens
agctgccacctctgcctttggg

SEQ ID NO: 8368448 - DNA, 22 bp, Homo sapiens
caggaggattgcttgaggccag

SEQ ID NO: 8368449 - DNA, 22 bp, Homo sapiens
caggaggattgcttgaggccag

SEQ ID NO: 8368450 - DNA, 22 bp, Homo sapiens
caggaggattgcttgaggccag

SEQ ID NO: 8368451 - DNA, 22 bp, Homo sapiens
caggaggaggtgaggtagaact

SEQ ID NO: 8368452 - DNA, 22 bp, Homo sapiens
caggaggagggtacaccatcag

SEQ ID NO: 8368453 - DNA, 22 bp, Homo sapiens
caggaggagggtacaccatcag

SEQ ID NO: 8368454 - DNA, 22 bp, Homo sapiens
aggtgtggcttgaagtctctat

SEQ ID NO: 8368455 - DNA, 22 bp, Homo sapiens
aggtgtggctggggcagaggcc

SEQ ID NO: 8368456 - DNA, 22 bp, Homo sapiens
aggtgtggctggggcagaggcc

SEQ ID NO: 8368457 - DNA, 19 bp, Homo sapiens
aggtgtgggggctgcagac

SEQ ID NO: 8368458 - DNA, 17 bp, Homo sapiens
aggtgtggtcaagggag

SEQ ID NO: 8368459 - DNA, 19 bp, Homo sapiens
aggtgtgggggctgcagac

SEQ ID NO: 8368460 - DNA, 22 bp, Homo sapiens
cctggtccccatcggcccagcg

SEQ ID NO: 8368461 - DNA, 22 bp, Homo sapiens
cctggtcctaggggtggaacca

SEQ ID NO: 8368462 - DNA, 22 bp, Homo sapiens
cctggtgcaccaagtaagggtg

SEQ ID NO: 8368463 - DNA, 22 bp, Homo sapiens
cctggtgccactagagaatgtc

SEQ ID NO: 8368464 - DNA, 22 bp, Homo sapiens
aggttaaaaaggattcagttaa

SEQ ID NO: 8368465 - DNA, 22 bp, Homo sapiens
aggtgtgtataaacatacatat

SEQ ID NO: 8368466 - DNA, 22 bp, Homo sapiens
aggtgtgttccaggaatggtga

SEQ ID NO: 8368467 - DNA, 18 bp, Homo sapiens
aggtgtgtttctaggagc

SEQ ID NO: 8368468 - DNA, 22 bp, Homo sapiens
aggttggcctcagggaggctct

SEQ ID NO: 8368469 - DNA, 22 bp, Homo sapiens
aggtttataggaaatttgttcc

SEQ ID NO: 8368470 - DNA, 22 bp, Homo sapiens
agtaatgaatacggtatttgaa

SEQ ID NO: 8368471 - DNA, 22 bp, Homo sapiens
cgcctgctctcactggacagct

SEQ ID NO: 8368472 - DNA, 22 bp, Homo sapiens
cgcctgctctgtttccatgtgg

SEQ ID NO: 8368473 - DNA, 22 bp, Homo sapiens
cgcctgcttaacgaattgtgtt

SEQ ID NO: 8368474 - DNA, 22 bp, Homo sapiens
agtacaaaggcccttgattact

SEQ ID NO: 8368475 - DNA, 22 bp, Homo sapiens
agtacaaactgtttcaaagtag

SEQ ID NO: 8368476 - DNA, 20 bp, Homo sapiens
cctttattatttgtatgatg

SEQ ID NO: 8368477 - DNA, 20 bp, Homo sapiens
cctttattatttgtatgatg

SEQ ID NO: 8368478 - DNA, 22 bp, Homo sapiens
cctttattcaattagtcctaat

SEQ ID NO: 8368479 - DNA, 22 bp, Homo sapiens
cctttatgagatcctggggtga

SEQ ID NO: 8368480 - DNA, 22 bp, Homo sapiens
cgcgctgtttacgtgacttaat

SEQ ID NO: 8368481 - DNA, 22 bp, Homo sapiens
cgcggtggcggcctccagcgcc

SEQ ID NO: 8368482 - DNA, 22 bp, Homo sapiens
cgcggtggcggcctccagcgcc

SEQ ID NO: 8368483 - DNA, 22 bp, Homo sapiens
cgcgctctccttctggcaccca

SEQ ID NO: 8368484 - DNA, 22 bp, Homo sapiens
cgcgaggtggaggttgcagtga

SEQ ID NO: 8368485 - DNA, 22 bp, Homo sapiens
cgtgagggcatggcagtgagga

SEQ ID NO: 8368486 - DNA, 22 bp, Homo sapiens
cgtgccactgcactctagcctg

SEQ ID NO: 8368487 - DNA, 22 bp, Homo sapiens
cgtgcgcctcagcctcgtgcgc

SEQ ID NO: 8368488 - DNA, 22 bp, Homo sapiens
cgtgcgcctcagcctcgtgcgc

SEQ ID NO: 8368489 - DNA, 22 bp, Homo sapiens
cgtggctcttttctgcatcagg

SEQ ID NO: 8368490 - DNA, 22 bp, Homo sapiens
ctaaaattatcaagataattcc

SEQ ID NO: 8368491 - DNA, 22 bp, Homo sapiens
ctaaaattatcaagataattcc

SEQ ID NO: 8368492 - DNA, 22 bp, Homo sapiens
ctaaaattatcaagataattcc

SEQ ID NO: 8368493 - DNA, 22 bp, Homo sapiens
cgtggcagtggaaggctgggtg

SEQ ID NO: 8368494 - DNA, 22 bp, Homo sapiens
cgtggccacccagtggtgcgtg

SEQ ID NO: 8368495 - DNA, 22 bp, Homo sapiens
cgtggccagcacaaggcagtga

SEQ ID NO: 8368496 - DNA, 22 bp, Homo sapiens
ctaaacaatgaacaaagcactg

SEQ ID NO: 8368497 - DNA, 22 bp, Homo sapiens
ctaaacaagggattataattga

SEQ ID NO: 8368498 - DNA, 22 bp, Homo sapiens
ctaaacaagggattataattga

SEQ ID NO: 8368499 - DNA, 22 bp, Homo sapiens
agtcacatttgggggtgtcaaa

SEQ ID NO: 8368500 - DNA, 17 bp, Homo sapiens
agtcagaggagtatctg

SEQ ID NO: 8368501 - DNA, 17 bp, Homo sapiens
agtcagaggagtatctg

SEQ ID NO: 8368502 - DNA, 22 bp, Homo sapiens
agtcagagtctattgctgtggt

SEQ ID NO: 8368503 - DNA, 22 bp, Homo sapiens
agtcagagttttgaggtgtgac

SEQ ID NO: 8368504 - DNA, 22 bp, Homo sapiens
agtcagagttttgaggtgtgac

SEQ ID NO: 8368505 - DNA, 22 bp, Homo sapiens
ctacaagatttttaaaactgta

SEQ ID NO: 8368506 - DNA, 23 bp, Homo sapiens
agtcagagcagaagggctgcttg

SEQ ID NO: 8368507 - DNA, 22 bp, Homo sapiens
agtcagagaatgttttcatgga

SEQ ID NO: 8368508 - DNA, 22 bp, Homo sapiens
agtcaggattttggattattcg

SEQ ID NO: 8368509 - DNA, 22 bp, Homo sapiens
agtcaggggatctagacttgaa

SEQ ID NO: 8368510 - DNA, 22 bp, Homo sapiens
ctacactagagttgcaatggaa

SEQ ID NO: 8368511 - DNA, 22 bp, Homo sapiens
cctggagcaggagctgcagagg

SEQ ID NO: 8368512 - DNA, 22 bp, Homo sapiens
cctggagcccaaggcagtgaga

SEQ ID NO: 8368513 - DNA, 22 bp, Homo sapiens
cctgcctgctttctgctttgca

SEQ ID NO: 8368514 - DNA, 22 bp, Homo sapiens
cctgcctggctgtcagcagagc

SEQ ID NO: 8368515 - DNA, 22 bp, Homo sapiens
cctgcctgcgtcctctgagggc

SEQ ID NO: 8368516 - DNA, 22 bp, Homo sapiens
cctgcctgcgtcctctgagggc

SEQ ID NO: 8368517 - DNA, 20 bp, Homo sapiens
agggtggcaagttagtgaca

SEQ ID NO: 8368518 - DNA, 22 bp, Homo sapiens
cctggagcgcgggtcaagctgg

SEQ ID NO: 8368519 - DNA, 22 bp, Homo sapiens
cctggagcgcgggtcaagctgg

SEQ ID NO: 8368520 - DNA, 22 bp, Homo sapiens
cctggccttaagggcagggagc

SEQ ID NO: 8368521 - DNA, 22 bp, Homo sapiens
cctggccagccagggctggggt

SEQ ID NO: 8368522 - DNA, 22 bp, Homo sapiens
cctggctcagaccccagttctg

SEQ ID NO: 8368523 - DNA, 22 bp, Homo sapiens
cctggctcagaccccagttctg

SEQ ID NO: 8368524 - DNA, 22 bp, Homo sapiens
cctggctcaggcacgcatggct

SEQ ID NO: 8368525 - DNA, 22 bp, Homo sapiens
cctggctcaggcacgcatggct

SEQ ID NO: 8368526 - DNA, 22 bp, Homo sapiens
cctggctcaaggcgaggactcc

SEQ ID NO: 8368527 - DNA, 22 bp, Homo sapiens
cctggctaggagagctgggctc

SEQ ID NO: 8368528 - DNA, 22 bp, Homo sapiens
cctggcctttgaacgctagact

SEQ ID NO: 8368529 - DNA, 22 bp, Homo sapiens
cctggctcattatgtgccccca

SEQ ID NO: 8368530 - DNA, 22 bp, Homo sapiens
cctggctccaaagctgtgactc

SEQ ID NO: 8368531 - DNA, 22 bp, Homo sapiens
cctggctcagtgttgaaggggt

SEQ ID NO: 8368532 - DNA, 22 bp, Homo sapiens
aggtatattgaatgcttactta

SEQ ID NO: 8368533 - DNA, 22 bp, Homo sapiens
aggtatatgctattacttctgc

SEQ ID NO: 8368534 - DNA, 22 bp, Homo sapiens
aggtctggtgagagcaggtgct

SEQ ID NO: 8368535 - DNA, 22 bp, Homo sapiens
aggtctgggattgaagacatca

SEQ ID NO: 8368536 - DNA, 22 bp, Homo sapiens
aggtctggagtgggatctgaga

SEQ ID NO: 8368537 - DNA, 22 bp, Homo sapiens
aggtctgtgaattcctgagaaa

SEQ ID NO: 8368538 - DNA, 22 bp, Homo sapiens
aggtctggtgttgggcctgaaa

SEQ ID NO: 8368539 - DNA, 19 bp, Homo sapiens
aggtgaggggcaccatgtc

SEQ ID NO: 8368540 - DNA, 19 bp, Homo sapiens
aggtgaggggcaccatgtc

SEQ ID NO: 8368541 - DNA, 22 bp, Homo sapiens
aggtgagggtgccagtgcatgg

SEQ ID NO: 8368542 - DNA, 22 bp, Homo sapiens
aggtgagggtgccagtgcatgg

SEQ ID NO: 8368543 - DNA, 22 bp, Homo sapiens
aggtgagggtgccagtgcatgg

SEQ ID NO: 8368544 - DNA, 22 bp, Homo sapiens
aggtgaggtttgggaggtgtca

SEQ ID NO: 8368545 - DNA, 22 bp, Homo sapiens
aggtctgcctcactcacttctg

SEQ ID NO: 8368546 - DNA, 22 bp, Homo sapiens
aggtctgcctcactcacttctg

SEQ ID NO: 8368547 - DNA, 22 bp, Homo sapiens
aggtatgagcctctgcacccag

SEQ ID NO: 8368548 - DNA, 22 bp, Homo sapiens
aggtatgccaattaggtcaagt

SEQ ID NO: 8368549 - DNA, 21 bp, Homo sapiens
aggtggagtgcttagcatcca

SEQ ID NO: 8368550 - DNA, 22 bp, Homo sapiens
cctggtcaggtaactgggctga

SEQ ID NO: 8368551 - DNA, 22 bp, Homo sapiens
cctggtccccatcggcccagcg

SEQ ID NO: 8368552 - DNA, 22 bp, Homo sapiens
cctgggcaggtgtggcttcccc

SEQ ID NO: 8368553 - DNA, 22 bp, Homo sapiens
cctgggcaggatgggcccggtg

SEQ ID NO: 8368554 - DNA, 23 bp, Homo sapiens
aggtgcactgtggtggcagtggc

SEQ ID NO: 8368555 - DNA, 22 bp, Homo sapiens
aggtgagtcctgggcacaggta

SEQ ID NO: 8368556 - DNA, 17 bp, Homo sapiens
agtggcaggcagatggg

SEQ ID NO: 8368557 - DNA, 22 bp, Homo sapiens
agtggcaggcggagatgtagga

SEQ ID NO: 8368558 - DNA, 22 bp, Homo sapiens
agtggcaggcggagatgtagga

SEQ ID NO: 8368559 - DNA, 22 bp, Homo sapiens
agtggcagccgagcaggagatg

SEQ ID NO: 8368560 - DNA, 22 bp, Homo sapiens
agtggcagctgtcatgccctag

SEQ ID NO: 8368561 - DNA, 22 bp, Homo sapiens
agtggcaggcagaagcttctca

SEQ ID NO: 8368562 - DNA, 17 bp, Homo sapiens
agtggcaggcagatggg

SEQ ID NO: 8368563 - DNA, 22 bp, Homo sapiens
ctctctccttagctgcagacca

SEQ ID NO: 8368564 - DNA, 22 bp, Homo sapiens
ctctctggcttggcacggagat

SEQ ID NO: 8368565 - DNA, 22 bp, Homo sapiens
ctctctggcttggcacggagat

SEQ ID NO: 8368566 - DNA, 18 bp, Homo sapiens
ctctctgggtgaggacaa

SEQ ID NO: 8368567 - DNA, 18 bp, Homo sapiens
ctctctgggtgaggacaa

SEQ ID NO: 8368568 - DNA, 18 bp, Homo sapiens
ctctctgggtgaggacaa

SEQ ID NO: 8368569 - DNA, 22 bp, Homo sapiens
ctctctggggttccagacgtgg

SEQ ID NO: 8368570 - DNA, 22 bp, Homo sapiens
ctctctggcttggcacggagat

SEQ ID NO: 8368571 - DNA, 22 bp, Homo sapiens
agtgggctgagcttgctgggtg

SEQ ID NO: 8368572 - DNA, 22 bp, Homo sapiens
agtgggctgtaatttaggaatg

SEQ ID NO: 8368573 - DNA, 22 bp, Homo sapiens
agtgggcttttttccgttccat

SEQ ID NO: 8368574 - DNA, 22 bp, Homo sapiens
agtggggaagagcatgggccct

SEQ ID NO: 8368575 - DNA, 22 bp, Homo sapiens
ctctgagaggctgccctgccat

SEQ ID NO: 8368576 - DNA, 22 bp, Homo sapiens
ctctgagacttttcacctccca

SEQ ID NO: 8368577 - DNA, 22 bp, Homo sapiens
ctctgagactcaagtgagtggg

SEQ ID NO: 8368578 - DNA, 22 bp, Homo sapiens
ctctgagacttagcatctacat

SEQ ID NO: 8368579 - DNA, 22 bp, Homo sapiens
ctctgagaatatgagctctttg

SEQ ID NO: 8368580 - DNA, 22 bp, Homo sapiens
ctctgagaagagttcaagtaaa

SEQ ID NO: 8368581 - DNA, 22 bp, Homo sapiens
ctctgagaaagctgtgagctaa

SEQ ID NO: 8368582 - DNA, 22 bp, Homo sapiens
ctctgagaagccttgatgggga

SEQ ID NO: 8368583 - DNA, 22 bp, Homo sapiens
ctctgagaagagttcaagtaaa

SEQ ID NO: 8368584 - DNA, 22 bp, Homo sapiens
ctgaagcatatcatgccaagtt

SEQ ID NO: 8368585 - DNA, 22 bp, Homo sapiens
ctgaagccatgtgctcactggt

SEQ ID NO: 8368586 - DNA, 22 bp, Homo sapiens
ctgaagccatgtgctcactggt

SEQ ID NO: 8368587 - DNA, 22 bp, Homo sapiens
ctgagaaaggacctcaaacagg

SEQ ID NO: 8368588 - DNA, 22 bp, Homo sapiens
ctgaagcttagtttacgctcca

SEQ ID NO: 8368589 - DNA, 22 bp, Homo sapiens
ctgaagcttagtttacgctcca

SEQ ID NO: 8368590 - DNA, 22 bp, Homo sapiens
ctgaagcttgataaactataaa

SEQ ID NO: 8368591 - DNA, 22 bp, Homo sapiens
ctgaagctaggtcaaaaaaggg

SEQ ID NO: 8368592 - DNA, 22 bp, Homo sapiens
ctgaagctgaaaacttccagca

SEQ ID NO: 8368593 - DNA, 22 bp, Homo sapiens
ctgaagctctccagtttgtttc

SEQ ID NO: 8368594 - DNA, 22 bp, Homo sapiens
ctgaagctgggcacttcctttt

SEQ ID NO: 8368595 - DNA, 22 bp, Homo sapiens
ctgagaggatgctgcagtggag

SEQ ID NO: 8368596 - DNA, 22 bp, Homo sapiens
ctgagaggatgctgcagtggag

SEQ ID NO: 8368597 - DNA, 22 bp, Homo sapiens
ctgagaggaacatcttatgctt

SEQ ID NO: 8368598 - DNA, 22 bp, Homo sapiens
ctgagagcatcgctggagatag

SEQ ID NO: 8368599 - DNA, 22 bp, Homo sapiens
ctgagagcatcgctggagatag

SEQ ID NO: 8368600 - DNA, 22 bp, Homo sapiens
ctgagaggcggagcttgcagtg

SEQ ID NO: 8368601 - DNA, 22 bp, Homo sapiens
ctgagaggcagccagagaaaat

SEQ ID NO: 8368602 - DNA, 19 bp, Homo sapiens
agtgttaacccagtgttgg

SEQ ID NO: 8368603 - DNA, 22 bp, Homo sapiens
agtgttaacatgaatggtttcc

SEQ ID NO: 8368604 - DNA, 23 bp, Homo sapiens
agtgttaaatttcgcacctaaat

SEQ ID NO: 8368605 - DNA, 22 bp, Homo sapiens
agtgtgtgcctttggatacctg

SEQ ID NO: 8368606 - DNA, 21 bp, Homo sapiens
agtgtgtgtggaatgagaata

SEQ ID NO: 8368607 - DNA, 22 bp, Homo sapiens
agtgtgggggctttggtgtcac

SEQ ID NO: 8368608 - DNA, 22 bp, Homo sapiens
agtgtgggggctttggtgtcac

SEQ ID NO: 8368609 - DNA, 22 bp, Homo sapiens
agtgtctgcctatttttcaagc

SEQ ID NO: 8368610 - DNA, 22 bp, Homo sapiens
agtgtctgcctatttttcaagc

SEQ ID NO: 8368611 - DNA, 22 bp, Homo sapiens
agtgtctgccagctgccaggtg

SEQ ID NO: 8368612 - DNA, 22 bp, Homo sapiens
agtgtctgcaaaatgaaagagc

SEQ ID NO: 8368613 - DNA, 22 bp, Homo sapiens
ctcttaaagcttccagtttcaa

SEQ ID NO: 8368614 - DNA, 22 bp, Homo sapiens
ctcttaaataacatcattgctt

SEQ ID NO: 8368615 - DNA, 19 bp, Homo sapiens
ctcttaaattgtctcttgc

SEQ ID NO: 8368616 - DNA, 20 bp, Homo sapiens
ctcttaaatgtaaagtaggc

SEQ ID NO: 8368617 - DNA, 18 bp, Homo sapiens
ctcttaagcctttgtcaa

SEQ ID NO: 8368618 - DNA, 22 bp, Homo sapiens
ctcttagaaactatagagatta

SEQ ID NO: 8368619 - DNA, 22 bp, Homo sapiens
ctcttagaaactatagagatta

SEQ ID NO: 8368620 - DNA, 22 bp, Homo sapiens
ctcttacattcttttactagca

SEQ ID NO: 8368621 - DNA, 22 bp, Homo sapiens
agtggggacaatgagagcaggt

SEQ ID NO: 8368622 - DNA, 22 bp, Homo sapiens
agtggggacttatgccagcatt

SEQ ID NO: 8368623 - DNA, 22 bp, Homo sapiens
agtggggacaatgagagcaggt

SEQ ID NO: 8368624 - DNA, 20 bp, Homo sapiens
agtggggagtcaggagtgcc

SEQ ID NO: 8368625 - DNA, 20 bp, Homo sapiens
agtggggagtcaggagtgcc

SEQ ID NO: 8368626 - DNA, 22 bp, Homo sapiens
agtggggaggtccaggccaccc

SEQ ID NO: 8368627 - DNA, 23 bp, Homo sapiens
agtgtctgagtgcaggctgtgca

SEQ ID NO: 8368628 - DNA, 22 bp, Homo sapiens
agtgtctgaactgggtgctgac

SEQ ID NO: 8368629 - DNA, 22 bp, Homo sapiens
agtgtctgaacctgcagtggga

SEQ ID NO: 8368630 - DNA, 22 bp, Homo sapiens
agtgtctgagccagaattagaa

SEQ ID NO: 8368631 - DNA, 22 bp, Homo sapiens
ctcaggatgcaattccatcaag

SEQ ID NO: 8368632 - DNA, 22 bp, Homo sapiens
agtcttaatagagaaaaactgt

SEQ ID NO: 8368633 - DNA, 22 bp, Homo sapiens
ctcaggcagtgccctctggccg

SEQ ID NO: 8368634 - DNA, 22 bp, Homo sapiens
ctcaggcagttctgtagcctcc

SEQ ID NO: 8368635 - DNA, 22 bp, Homo sapiens
ctcaggcacttttgtcacagac

SEQ ID NO: 8368636 - DNA, 22 bp, Homo sapiens
ctcaggcacttttgtcacagac

SEQ ID NO: 8368637 - DNA, 22 bp, Homo sapiens
agtctgcttcctggagaactca

SEQ ID NO: 8368638 - DNA, 23 bp, Homo sapiens
agtctgtgcttggtgggagggcc

SEQ ID NO: 8368639 - DNA, 22 bp, Homo sapiens
agtcatgctacttcatcttctg

SEQ ID NO: 8368640 - DNA, 22 bp, Homo sapiens
agtcatcatgtacagagagcaa

SEQ ID NO: 8368641 - DNA, 22 bp, Homo sapiens
agtcatatttatataatttccc

SEQ ID NO: 8368642 - DNA, 22 bp, Homo sapiens
agtcatatgacccttcacaaac

SEQ ID NO: 8368643 - DNA, 22 bp, Homo sapiens
agtccaagattagggtgacagc

SEQ ID NO: 8368644 - DNA, 22 bp, Homo sapiens
agtctcttttgcgaagagtgtt

SEQ ID NO: 8368645 - DNA, 22 bp, Homo sapiens
agtctctttctaaataaggtca

SEQ ID NO: 8368646 - DNA, 20 bp, Homo sapiens
agtctctcccagaatgagca

SEQ ID NO: 8368647 - DNA, 22 bp, Homo sapiens
agtctctccacattgttataaa

SEQ ID NO: 8368648 - DNA, 22 bp, Homo sapiens
agtctctttaatcacagtgtct

SEQ ID NO: 8368649 - DNA, 22 bp, Homo sapiens
agtccaaggccatacagttgtg

SEQ ID NO: 8368650 - DNA, 22 bp, Homo sapiens
agtgcagaggctgggaaatgct

SEQ ID NO: 8368651 - DNA, 22 bp, Homo sapiens
agtgcagatttttagtcagctt

SEQ ID NO: 8368652 - DNA, 22 bp, Homo sapiens
agtgcagagacctggtcaggca

SEQ ID NO: 8368653 - DNA, 23 bp, Homo sapiens
agtgacccatttcagggtgtctt

SEQ ID NO: 8368654 - DNA, 22 bp, Homo sapiens
agtgacagtctcagagatcagg

SEQ ID NO: 8368655 - DNA, 22 bp, Homo sapiens
ctccatatgttcagttatgcag

SEQ ID NO: 8368656 - DNA, 22 bp, Homo sapiens
ctcaggcagttgtttgcatagt

SEQ ID NO: 8368657 - DNA, 22 bp, Homo sapiens
agtgcagctttttctttacatg

SEQ ID NO: 8368658 - DNA, 22 bp, Homo sapiens
agtgcagctccctcacctgctt

SEQ ID NO: 8368659 - DNA, 22 bp, Homo sapiens
agtgcagcttataaagcatcaa

SEQ ID NO: 8368660 - DNA, 22 bp, Homo sapiens
agtgcagctgggactgtagggt

SEQ ID NO: 8368661 - DNA, 22 bp, Homo sapiens
agtgcagccttctgggccgctt

SEQ ID NO: 8368662 - DNA, 22 bp, Homo sapiens
agtgcagctaagtggctctgtg

SEQ ID NO: 8368663 - DNA, 22 bp, Homo sapiens
agtgcagctattacaacagtgt

SEQ ID NO: 8368664 - DNA, 21 bp, Homo sapiens
ctcccagggtgactgttcaac

SEQ ID NO: 8368665 - DNA, 22 bp, Homo sapiens
ctcctcagctgggaggagtccc

SEQ ID NO: 8368666 - DNA, 22 bp, Homo sapiens
ctcctcagctgggaggagtccc

SEQ ID NO: 8368667 - DNA, 22 bp, Homo sapiens
agtgcagccgagatcaggtgct

SEQ ID NO: 8368668 - DNA, 22 bp, Homo sapiens
agtgcagcatgctggggaggct

SEQ ID NO: 8368669 - DNA, 22 bp, Homo sapiens
ctcccaggggaactatcaagta

SEQ ID NO: 8368670 - DNA, 22 bp, Homo sapiens
ctcccaggggaactatcaagta

SEQ ID NO: 8368671 - DNA, 22 bp, Homo sapiens
agtgcagcaacaaactgccctc

SEQ ID NO: 8368672 - DNA, 22 bp, Homo sapiens
agtgcagcagctgctccttaac

SEQ ID NO: 8368673 - DNA, 22 bp, Homo sapiens
agtgcagcaccatgttacagag

SEQ ID NO: 8368674 - DNA, 22 bp, Homo sapiens
agtgcagcatgaagcacatgtg

SEQ ID NO: 8368675 - DNA, 22 bp, Homo sapiens
cttcagagaacttgatcgctgc

SEQ ID NO: 8368676 - DNA, 22 bp, Homo sapiens
cttcagaattcctcagcctcag

SEQ ID NO: 8368677 - DNA, 22 bp, Homo sapiens
cttcagaatccagaatcagaat

SEQ ID NO: 8368678 - DNA, 22 bp, Homo sapiens
cttcagatattaatatcaatta

SEQ ID NO: 8368679 - DNA, 22 bp, Homo sapiens
cttcagatccctctgccactgt

SEQ ID NO: 8368680 - DNA, 22 bp, Homo sapiens
cttcagagtgactcagcatctt

SEQ ID NO: 8368681 - DNA, 22 bp, Homo sapiens
cttcagagtgactcagcatctt

SEQ ID NO: 8368682 - DNA, 22 bp, Homo sapiens
cttcagagtgcagaagattggg

SEQ ID NO: 8368683 - DNA, 22 bp, Homo sapiens
cttcagagagtccagggactgc

SEQ ID NO: 8368684 - DNA, 22 bp, Homo sapiens
cttcagagcatcacttcagctg

SEQ ID NO: 8368685 - DNA, 22 bp, Homo sapiens
cttcagagcatcacttcagctg

SEQ ID NO: 8368686 - DNA, 22 bp, Homo sapiens
cttcagagcttgttaaaactgt

SEQ ID NO: 8368687 - DNA, 22 bp, Homo sapiens
cttcagagcttgttaaaactgt

SEQ ID NO: 8368688 - DNA, 22 bp, Homo sapiens
cttcagaggggactcaaagtca

SEQ ID NO: 8368689 - DNA, 22 bp, Homo sapiens
cttcagaggggactcaaagtca

SEQ ID NO: 8368690 - DNA, 22 bp, Homo sapiens
ctgtttcaaagggtactgtgag

SEQ ID NO: 8368691 - DNA, 22 bp, Homo sapiens
ctgtttcagctactgttccatg

SEQ ID NO: 8368692 - DNA, 22 bp, Homo sapiens
atcctttaagttaataaaattc

SEQ ID NO: 8368693 - DNA, 22 bp, Homo sapiens
atccttccttcatttgacaggt

SEQ ID NO: 8368694 - DNA, 22 bp, Homo sapiens
atccttccagagttattctcaa

SEQ ID NO: 8368695 - DNA, 22 bp, Homo sapiens
atccttaatttacttgcatctt

SEQ ID NO: 8368696 - DNA, 22 bp, Homo sapiens
cttcagcagatgtgctagagat

SEQ ID NO: 8368697 - DNA, 22 bp, Homo sapiens
cttcagttagtttcatgtgagc

SEQ ID NO: 8368698 - DNA, 22 bp, Homo sapiens
atctcaggtgaaacttctaggt

SEQ ID NO: 8368699 - DNA, 22 bp, Homo sapiens
atctccagctcgcagagctcct

SEQ ID NO: 8368700 - DNA, 22 bp, Homo sapiens
cttcatgagggtaatctacaaa

SEQ ID NO: 8368701 - DNA, 22 bp, Homo sapiens
atctggaagccagatactcagt

SEQ ID NO: 8368702 - DNA, 22 bp, Homo sapiens
cttcatgttcttggtgaaaggc

SEQ ID NO: 8368703 - DNA, 22 bp, Homo sapiens
atctgcatgtccccatggatcc

SEQ ID NO: 8368704 - DNA, 22 bp, Homo sapiens
atctgcatgtccccatggatcc

SEQ ID NO: 8368705 - DNA, 22 bp, Homo sapiens
atctgcatgtatctctctgcat

SEQ ID NO: 8368706 - DNA, 21 bp, Homo sapiens
atctggaaattctgccagaga

SEQ ID NO: 8368707 - DNA, 17 bp, Homo sapiens
atctgcatttctaatga

SEQ ID NO: 8368708 - DNA, 22 bp, Homo sapiens
atctgcatttacattgcttgta

SEQ ID NO: 8368709 - DNA, 22 bp, Homo sapiens
ctgttatttagaacatggaatc

SEQ ID NO: 8368710 - DNA, 22 bp, Homo sapiens
ctgttatttatgctgctccatt

SEQ ID NO: 8368711 - DNA, 22 bp, Homo sapiens
ctgttatttctgccaggtgagt

SEQ ID NO: 8368712 - DNA, 22 bp, Homo sapiens
ctgttatttctgaatgccatcc

SEQ ID NO: 8368713 - DNA, 19 bp, Homo sapiens
ctgttattgtcagagctcc

SEQ ID NO: 8368714 - DNA, 22 bp, Homo sapiens
ctgttattccccttgctgtggt

SEQ ID NO: 8368715 - DNA, 22 bp, Homo sapiens
ctgttattcaagacaaaggcag

SEQ ID NO: 8368716 - DNA, 22 bp, Homo sapiens
ctgttattcaagacaaaggcag

SEQ ID NO: 8368717 - DNA, 23 bp, Homo sapiens
ctgttattccaggctgatgggtg

SEQ ID NO: 8368718 - DNA, 22 bp, Homo sapiens
ctgttattccccttgctgtggt

SEQ ID NO: 8368719 - DNA, 22 bp, Homo sapiens
ctgttattaaaaagctcaggct

SEQ ID NO: 8368720 - DNA, 22 bp, Homo sapiens
ctgttatgcatggtcattgcct

SEQ ID NO: 8368721 - DNA, 22 bp, Homo sapiens
ctgttactggacgcacgcagct

SEQ ID NO: 8368722 - DNA, 22 bp, Homo sapiens
ctgttagtaatgaagagaatgg

SEQ ID NO: 8368723 - DNA, 22 bp, Homo sapiens
ctgttatttgagagtgttgaat

SEQ ID NO: 8368724 - DNA, 22 bp, Homo sapiens
ctgttatttgagagtgttgaat

SEQ ID NO: 8368725 - DNA, 22 bp, Homo sapiens
ctgttatttgctggaagagttt

SEQ ID NO: 8368726 - DNA, 22 bp, Homo sapiens
ctgttatttggaggatgcttgg

SEQ ID NO: 8368727 - DNA, 22 bp, Homo sapiens
ctgttattttataattcaagaa

SEQ ID NO: 8368728 - DNA, 22 bp, Homo sapiens
ctgtttattacgtaattaatat

SEQ ID NO: 8368729 - DNA, 22 bp, Homo sapiens
atcattcagtgaccacttccca

SEQ ID NO: 8368730 - DNA, 22 bp, Homo sapiens
ctgtgtgtgaacacagcccagc

SEQ ID NO: 8368731 - DNA, 22 bp, Homo sapiens
ctgttactcctttggcagatta

SEQ ID NO: 8368732 - DNA, 22 bp, Homo sapiens
atcattcagcctaagcaagtac

SEQ ID NO: 8368733 - DNA, 22 bp, Homo sapiens
atcattaaatataagcttcaca

SEQ ID NO: 8368734 - DNA, 22 bp, Homo sapiens
atcattagaccaaactagagct

SEQ ID NO: 8368735 - DNA, 22 bp, Homo sapiens
atcaggaagccagtctaatgga

SEQ ID NO: 8368736 - DNA, 22 bp, Homo sapiens
atcaggaagtctgccacaaggc

SEQ ID NO: 8368737 - DNA, 22 bp, Homo sapiens
atcaggatcagggctagcagag

SEQ ID NO: 8368738 - DNA, 22 bp, Homo sapiens
atcaggaaatacttatttataa

SEQ ID NO: 8368739 - DNA, 22 bp, Homo sapiens
atcaggaaatacttatttataa

SEQ ID NO: 8368740 - DNA, 22 bp, Homo sapiens
atcaggaacgttcatggactgt

SEQ ID NO: 8368741 - DNA, 20 bp, Homo sapiens
atcaggaagagagactgacc

SEQ ID NO: 8368742 - DNA, 22 bp, Homo sapiens
atcaggcagaagcagaaagatg

SEQ ID NO: 8368743 - DNA, 22 bp, Homo sapiens
atcaggccagcaatccctgggc

SEQ ID NO: 8368744 - DNA, 22 bp, Homo sapiens
atcaggatctgggagcctgaaa

SEQ ID NO: 8368745 - DNA, 22 bp, Homo sapiens
ctgtgggagcacatgacagata

SEQ ID NO: 8368746 - DNA, 22 bp, Homo sapiens
ctgtgggagcacatgacagata

SEQ ID NO: 8368747 - DNA, 22 bp, Homo sapiens
ctgtgcctgccttgttcactga

SEQ ID NO: 8368748 - DNA, 22 bp, Homo sapiens
ctgtgcctggggggcagagctg

SEQ ID NO: 8368749 - DNA, 22 bp, Homo sapiens
ctgtgccttggcgctgtgccac

SEQ ID NO: 8368750 - DNA, 22 bp, Homo sapiens
ctgtgcagtaggtcagggctgg

SEQ ID NO: 8368751 - DNA, 22 bp, Homo sapiens
ctgtgcctaagatgcatgtctc

SEQ ID NO: 8368752 - DNA, 22 bp, Homo sapiens
ctgtccagggtgtgcaggggct

SEQ ID NO: 8368753 - DNA, 22 bp, Homo sapiens
ctgtccagggtgtgcaggggct

SEQ ID NO: 8368754 - DNA, 23 bp, Homo sapiens
ctgtccaggattcttgagagaac

SEQ ID NO: 8368755 - DNA, 23 bp, Homo sapiens
ctgtccaggattcttgagagaac

SEQ ID NO: 8368756 - DNA, 21 bp, Homo sapiens
ctgtccagtaattcctggcac

SEQ ID NO: 8368757 - DNA, 22 bp, Homo sapiens
ctgggcctgagctctgaagagt

SEQ ID NO: 8368758 - DNA, 22 bp, Homo sapiens
ctgggccagttatgtctcatct

SEQ ID NO: 8368759 - DNA, 22 bp, Homo sapiens
ctgggccagggaggtgtctgta

SEQ ID NO: 8368760 - DNA, 22 bp, Homo sapiens
ctgggccatgggccagcgaggc

SEQ ID NO: 8368761 - DNA, 22 bp, Homo sapiens
ctgggcccacaagtggaatcgt

SEQ ID NO: 8368762 - DNA, 22 bp, Homo sapiens
ctgggccatgggccagcgaggc

SEQ ID NO: 8368763 - DNA, 22 bp, Homo sapiens
ctgggccatctctctgcaagtg

SEQ ID NO: 8368764 - DNA, 22 bp, Homo sapiens
ctgggccatggaagtctctgcc

SEQ ID NO: 8368765 - DNA, 22 bp, Homo sapiens
atatcaaacgaagttattttaa

SEQ ID NO: 8368766 - DNA, 22 bp, Homo sapiens
atatcaaagctagtggaaattt

SEQ ID NO: 8368767 - DNA, 22 bp, Homo sapiens
atatattttttgagacagagtc

SEQ ID NO: 8368768 - DNA, 22 bp, Homo sapiens
atatcacagatgcagaaagaga

SEQ ID NO: 8368769 - DNA, 22 bp, Homo sapiens
atatcacaggaaaggaagatac

SEQ ID NO: 8368770 - DNA, 22 bp, Homo sapiens
atatcattatgttatgagcaca

SEQ ID NO: 8368771 - DNA, 22 bp, Homo sapiens
atatattttgcggtcacgtggc

SEQ ID NO: 8368772 - DNA, 22 bp, Homo sapiens
atatattttgcggtcacgtggc

SEQ ID NO: 8368773 - DNA, 22 bp, Homo sapiens
atatattttgaatagcctctgt

SEQ ID NO: 8368774 - DNA, 22 bp, Homo sapiens
atatattttgaatagcctctgt

SEQ ID NO: 8368775 - DNA, 22 bp, Homo sapiens
atagtctttactgctgaattga

SEQ ID NO: 8368776 - DNA, 22 bp, Homo sapiens
atagtcttcagcactttgatca

SEQ ID NO: 8368777 - DNA, 22 bp, Homo sapiens
atagtgaaaatgctgtcagcat

SEQ ID NO: 8368778 - DNA, 22 bp, Homo sapiens
atagtatttccagaaatagtct

SEQ ID NO: 8368779 - DNA, 22 bp, Homo sapiens
atagtcttagaatcttgagtgt

SEQ ID NO: 8368780 - DNA, 22 bp, Homo sapiens
atagtatttccagaaatagtct

SEQ ID NO: 8368781 - DNA, 22 bp, Homo sapiens
atagtcttagatcagataaagt

SEQ ID NO: 8368782 - DNA, 22 bp, Homo sapiens
atagtcttcagcactttgatca

SEQ ID NO: 8368783 - DNA, 22 bp, Homo sapiens
ctggtgctggagcctagtccct

SEQ ID NO: 8368784 - DNA, 22 bp, Homo sapiens
ctggggcagagcctttagcaaa

SEQ ID NO: 8368785 - DNA, 22 bp, Homo sapiens
ctggggaggatgctacgacctg

SEQ ID NO: 8368786 - DNA, 22 bp, Homo sapiens
ctggggaggatgctacgacctg

SEQ ID NO: 8368787 - DNA, 22 bp, Homo sapiens
ctgggctgtcaatggccctctg

SEQ ID NO: 8368788 - DNA, 22 bp, Homo sapiens
ctggtggggagtcctggtctcc

SEQ ID NO: 8368789 - DNA, 22 bp, Homo sapiens
atattttcacagaacttgcaaa

SEQ ID NO: 8368790 - DNA, 22 bp, Homo sapiens
atattttcactgaaccaaagta

SEQ ID NO: 8368791 - DNA, 22 bp, Homo sapiens
atattttctggaactatgcctg

SEQ ID NO: 8368792 - DNA, 22 bp, Homo sapiens
atattttcactgaaccaaagta

SEQ ID NO: 8368793 - DNA, 22 bp, Homo sapiens
ctgtatatggcttactttatat

SEQ ID NO: 8368794 - DNA, 22 bp, Homo sapiens
atattttgaagttaataatgtg

SEQ ID NO: 8368795 - DNA, 22 bp, Homo sapiens
atattttgaagttaataatgtg

SEQ ID NO: 8368796 - DNA, 22 bp, Homo sapiens
atattttgaagttaataatgtg

SEQ ID NO: 8368797 - DNA, 22 bp, Homo sapiens
ctgtatctgtcagctggtctcg

SEQ ID NO: 8368798 - DNA, 22 bp, Homo sapiens
ctgtccagaaagggggcaacaa

SEQ ID NO: 8368799 - DNA, 22 bp, Homo sapiens
ctgtcatttaagacattctgga

SEQ ID NO: 8368800 - DNA, 22 bp, Homo sapiens
ctgtccagctgaccagagcagc

SEQ ID NO: 8368801 - DNA, 22 bp, Homo sapiens
ctgtccagctgaccagagcagc

SEQ ID NO: 8368802 - DNA, 22 bp, Homo sapiens
ctgtccagaaagggggcaacaa

SEQ ID NO: 8368803 - DNA, 16 bp, Homo sapiens
ctgtccagcatctgcc

SEQ ID NO: 8368804 - DNA, 22 bp, Homo sapiens
ctgtccagctgaccagagcagc

SEQ ID NO: 8368805 - DNA, 22 bp, Homo sapiens
ctgtccagcttggctcctgggg

SEQ ID NO: 8368806 - DNA, 22 bp, Homo sapiens
ctgtattaaaggcagtgatctt

SEQ ID NO: 8368807 - DNA, 22 bp, Homo sapiens
ctgtatgtcttgtgaattgtag

SEQ ID NO: 8368808 - DNA, 22 bp, Homo sapiens
ctgtatgtttctatgaatgtga

SEQ ID NO: 8368809 - DNA, 22 bp, Homo sapiens
ctgtatttagttaaaatgctaa

SEQ ID NO: 8368810 - DNA, 22 bp, Homo sapiens
ctgtatttcccacattctctat

SEQ ID NO: 8368811 - DNA, 22 bp, Homo sapiens
atacatctcatgtaagagataa

SEQ ID NO: 8368812 - DNA, 22 bp, Homo sapiens
atacatgacagcatagcatcct

SEQ ID NO: 8368813 - DNA, 22 bp, Homo sapiens
atacatgaggaggctggaaaca

SEQ ID NO: 8368814 - DNA, 22 bp, Homo sapiens
atacatgaggaggctggaaaca

SEQ ID NO: 8368815 - DNA, 22 bp, Homo sapiens
ctggagctggtatagggacaaa

SEQ ID NO: 8368816 - DNA, 22 bp, Homo sapiens
ctggagctggcttccttccact

SEQ ID NO: 8368817 - DNA, 22 bp, Homo sapiens
ctggaagacgtttgaagccatg

SEQ ID NO: 8368818 - DNA, 22 bp, Homo sapiens
ctggaacacctgagttaccact

SEQ ID NO: 8368819 - DNA, 22 bp, Homo sapiens
ctggaagaactccagttctgtg

SEQ ID NO: 8368820 - DNA, 21 bp, Homo sapiens
atacagaaggtggcaaagtac

SEQ ID NO: 8368821 - DNA, 19 bp, Homo sapiens
ctggaaagttggcagtgag

SEQ ID NO: 8368822 - DNA, 22 bp, Homo sapiens
ctggaaatcactactagtcaat

SEQ ID NO: 8368823 - DNA, 21 bp, Homo sapiens
ctggaacaaatactagcaaac

SEQ ID NO: 8368824 - DNA, 22 bp, Homo sapiens
ctggaacaagtggccttgcaag

SEQ ID NO: 8368825 - DNA, 22 bp, Homo sapiens
ctggaacacctgagttaccact

SEQ ID NO: 8368826 - DNA, 21 bp, Homo sapiens
ctggaacaaatactagcaaac

SEQ ID NO: 8368827 - DNA, 22 bp, Homo sapiens
ataatgtttttgtataagcatg

SEQ ID NO: 8368828 - DNA, 22 bp, Homo sapiens
ataatgtttcagtactgtctgt

SEQ ID NO: 8368829 - DNA, 22 bp, Homo sapiens
ataatgtctgcagagccacaca

SEQ ID NO: 8368830 - DNA, 22 bp, Homo sapiens
ataatgtaggtatgtgtattta

SEQ ID NO: 8368831 - DNA, 22 bp, Homo sapiens
ataattaatttcagtaatctcc

SEQ ID NO: 8368832 - DNA, 22 bp, Homo sapiens
ataattaatttcagtaatctcc

SEQ ID NO: 8368833 - DNA, 22 bp, Homo sapiens
ataattaggtcttataacgtct

SEQ ID NO: 8368834 - DNA, 22 bp, Homo sapiens
ataattcatgggcctttcacct

SEQ ID NO: 8368835 - DNA, 20 bp, Homo sapiens
ataattatttacttttgtgc

SEQ ID NO: 8368836 - DNA, 22 bp, Homo sapiens
ataatttacaactgcttttaat

SEQ ID NO: 8368837 - DNA, 22 bp, Homo sapiens
ataatttaaattagtatgtgat

SEQ ID NO: 8368838 - DNA, 22 bp, Homo sapiens
ataatttaattttcacagtggt

SEQ ID NO: 8368839 - DNA, 22 bp, Homo sapiens
ataatttacaactgcttttaat

SEQ ID NO: 8368840 - DNA, 22 bp, Homo sapiens
ataatttacaactgcttttaat

SEQ ID NO: 8368841 - DNA, 22 bp, Homo sapiens
ataatttacaactgcttttaat

SEQ ID NO: 8368842 - DNA, 22 bp, Homo sapiens
atacagaactctcagttgtata

SEQ ID NO: 8368843 - DNA, 22 bp, Homo sapiens
atacagaagaactatagccact

SEQ ID NO: 8368844 - DNA, 22 bp, Homo sapiens
atagaatttgcactaaatctgc

SEQ ID NO: 8368845 - DNA, 22 bp, Homo sapiens
atagaatttgtacttgtagaac

SEQ ID NO: 8368846 - DNA, 22 bp, Homo sapiens
atagacaaacacgaagatgaca

SEQ ID NO: 8368847 - DNA, 22 bp, Homo sapiens
atagaattatggaaagcatctt

SEQ ID NO: 8368848 - DNA, 22 bp, Homo sapiens
atagaattcgtgtttgtaattc

SEQ ID NO: 8368849 - DNA, 22 bp, Homo sapiens
atagaattcgtgtttgtaattc

SEQ ID NO: 8368850 - DNA, 22 bp, Homo sapiens
atagtacaatcagttaattagt

SEQ ID NO: 8368851 - DNA, 22 bp, Homo sapiens
atagtacaatcagttaattagt

SEQ ID NO: 8368852 - DNA, 22 bp, Homo sapiens
ataggtgtgtggttcatggccc

SEQ ID NO: 8368853 - DNA, 22 bp, Homo sapiens
ataggtcagagccacagtgaag

SEQ ID NO: 8368854 - DNA, 22 bp, Homo sapiens
atagcagtgacattttaatgtg

SEQ ID NO: 8368855 - DNA, 22 bp, Homo sapiens
ataggctgagcttctcctttgt

SEQ ID NO: 8368856 - DNA, 22 bp, Homo sapiens
ataggcgtgtttaggaggacgt

SEQ ID NO: 8368857 - DNA, 22 bp, Homo sapiens
atagggcagtggcatctcttaa

SEQ ID NO: 8368858 - DNA, 22 bp, Homo sapiens
ctggccagtgcctgtgggcccc

SEQ ID NO: 8368859 - DNA, 22 bp, Homo sapiens
ctggccagaggttcctctgccc

SEQ ID NO: 8368860 - DNA, 22 bp, Homo sapiens
atacttttaattccttctgagt

SEQ ID NO: 8368861 - DNA, 22 bp, Homo sapiens
atactttgctagtatcagtgtg

SEQ ID NO: 8368862 - DNA, 22 bp, Homo sapiens
atactttgctacattgtacatt

SEQ ID NO: 8368863 - DNA, 22 bp, Homo sapiens
atactttctgaccaattaattg

SEQ ID NO: 8368864 - DNA, 22 bp, Homo sapiens
atagaaacagggaagcaaagca

SEQ ID NO: 8368865 - DNA, 19 bp, Homo sapiens
atagaaagggttaaagaca

SEQ ID NO: 8368866 - DNA, 22 bp, Homo sapiens
atagaaatggcagctggtgcta

SEQ ID NO: 8368867 - DNA, 22 bp, Homo sapiens
atagaaatggcagctggtgcta

SEQ ID NO: 8368868 - DNA, 22 bp, Homo sapiens
atagaaatgtattttggactag

SEQ ID NO: 8368869 - DNA, 22 bp, Homo sapiens
ctgagaggcggaggttgcagtg

SEQ ID NO: 8368870 - DNA, 22 bp, Homo sapiens
agtgttaagagaaaattctgct

SEQ ID NO: 8368871 - DNA, 22 bp, Homo sapiens
agtgttaaggctggttgctata

SEQ ID NO: 8368872 - DNA, 22 bp, Homo sapiens
agtgttaagagaaaattctgct

SEQ ID NO: 8368873 - DNA, 22 bp, Homo sapiens
agtgttaatatctggccctagg

SEQ ID NO: 8368874 - DNA, 18 bp, Homo sapiens
agtgttaagtaagtagca

SEQ ID NO: 8368875 - DNA, 22 bp, Homo sapiens
agtgttaatggtgtatattagg

SEQ ID NO: 8368876 - DNA, 22 bp, Homo sapiens
agtgttaatggtgtatattagg

SEQ ID NO: 8368877 - DNA, 21 bp, Homo sapiens
agtgttaatggaaattatatt

SEQ ID NO: 8368878 - DNA, 21 bp, Homo sapiens
agtgttaatggaaattatatt

SEQ ID NO: 8368879 - DNA, 22 bp, Homo sapiens
agtgttactggttcatgaatct

SEQ ID NO: 8368880 - DNA, 23 bp, Homo sapiens
agtgttcagcatgtagtaaatac

SEQ ID NO: 8368881 - DNA, 22 bp, Homo sapiens
agtttcacagagggttagacgc

SEQ ID NO: 8368882 - DNA, 22 bp, Homo sapiens
agtttatttttgataagtcttg

SEQ ID NO: 8368883 - DNA, 17 bp, Homo sapiens
agtttatttagccttct

SEQ ID NO: 8368884 - DNA, 22 bp, Homo sapiens
agtttattctctggtcttagta

SEQ ID NO: 8368885 - DNA, 20 bp, Homo sapiens
agtttattccaggagaactg

SEQ ID NO: 8368886 - DNA, 22 bp, Homo sapiens
agtttcactaaggtctgtgtgt

SEQ ID NO: 8368887 - DNA, 22 bp, Homo sapiens
agtttcagaatttatgcagaca

SEQ ID NO: 8368888 - DNA, 22 bp, Homo sapiens
agtttcacagtctgtcattgtt

SEQ ID NO: 8368889 - DNA, 23 bp, Homo sapiens
agtttcacattttacatgtggct

SEQ ID NO: 8368890 - DNA, 22 bp, Homo sapiens
agtttctattttcatgtctgtt

SEQ ID NO: 8368891 - DNA, 22 bp, Homo sapiens
agtttctctagagtctttgaaa

SEQ ID NO: 8368892 - DNA, 22 bp, Homo sapiens
agtttctagcaaggattgttga

SEQ ID NO: 8368893 - DNA, 22 bp, Homo sapiens
agtttctatgtaagctacgtga

SEQ ID NO: 8368894 - DNA, 22 bp, Homo sapiens
agtttctatgtgaaatgcacat

SEQ ID NO: 8368895 - DNA, 22 bp, Homo sapiens
agttttattccaatgtgcagca

SEQ ID NO: 8368896 - DNA, 22 bp, Homo sapiens
ataagcatttcacaggtgtgtt

SEQ ID NO: 8368897 - DNA, 22 bp, Homo sapiens
ataagtgttaggtaaacatctt

SEQ ID NO: 8368898 - DNA, 22 bp, Homo sapiens
ataagtgtgtaaggcattctgt

SEQ ID NO: 8368899 - DNA, 22 bp, Homo sapiens
ctgcctgctgcctgtggagggt

SEQ ID NO: 8368900 - DNA, 22 bp, Homo sapiens
ctgcctgcttctgagccagagg

SEQ ID NO: 8368901 - DNA, 22 bp, Homo sapiens
ataataaaccaggatgggtctg

SEQ ID NO: 8368902 - DNA, 22 bp, Homo sapiens
ataataatgaaagccactgtgt

SEQ ID NO: 8368903 - DNA, 23 bp, Homo sapiens
ataataattatggcagcaaagtg

SEQ ID NO: 8368904 - DNA, 18 bp, Homo sapiens
ctgcctgctctccagctt

SEQ ID NO: 8368905 - DNA, 22 bp, Homo sapiens
agttttgaaatgaaatgtagtt

SEQ ID NO: 8368906 - DNA, 22 bp, Homo sapiens
agttttctgctaaaccagctaa

SEQ ID NO: 8368907 - DNA, 22 bp, Homo sapiens
agttttctgttctacaatttga

SEQ ID NO: 8368908 - DNA, 22 bp, Homo sapiens
agttttcagtaaatattagtga

SEQ ID NO: 8368909 - DNA, 22 bp, Homo sapiens
agttttcaatatatgatagtga

SEQ ID NO: 8368910 - DNA, 22 bp, Homo sapiens
agttttcacactcaccaaaagg

SEQ ID NO: 8368911 - DNA, 22 bp, Homo sapiens
ctgccctcccagttggtccgtg

SEQ ID NO: 8368912 - DNA, 22 bp, Homo sapiens
ctgccctcgggccctcccatag

SEQ ID NO: 8368913 - DNA, 22 bp, Homo sapiens
ctgccctcgggccctcccatag

SEQ ID NO: 8368914 - DNA, 22 bp, Homo sapiens
ctgccctcgggccctcccatag

SEQ ID NO: 8368915 - DNA, 18 bp, Homo sapiens
ctgcccagagcatttcat

SEQ ID NO: 8368916 - DNA, 22 bp, Homo sapiens
agttttgatactttctcttcat

SEQ ID NO: 8368917 - DNA, 22 bp, Homo sapiens
ctgccctctagaggaggactga

SEQ ID NO: 8368918 - DNA, 22 bp, Homo sapiens
ctgccctctagggatgcactgg

SEQ ID NO: 8368919 - DNA, 22 bp, Homo sapiens
ctgccctctagggatgcactgg

SEQ ID NO: 8368920 - DNA, 22 bp, Homo sapiens
ctgccctggtcccatggctgat

SEQ ID NO: 8368921 - DNA, 21 bp, Homo sapiens
acatacattatctttttaaaa

SEQ ID NO: 8368922 - DNA, 18 bp, Homo sapiens
acatacattctgtctgca

SEQ ID NO: 8368923 - DNA, 22 bp, Homo sapiens
aggcagctaagatggataatga

SEQ ID NO: 8368924 - DNA, 17 bp, Homo sapiens
aggcagctcagaacatc

SEQ ID NO: 8368925 - DNA, 17 bp, Homo sapiens
aggcagctcagaacatc

SEQ ID NO: 8368926 - DNA, 22 bp, Homo sapiens
acatagcttaaatgagaagata

SEQ ID NO: 8368927 - DNA, 22 bp, Homo sapiens
aggcagctggaggcagagacta

SEQ ID NO: 8368928 - DNA, 22 bp, Homo sapiens
acatattggcaaactggaggca

SEQ ID NO: 8368929 - DNA, 22 bp, Homo sapiens
acatattgagctctaaaagtac

SEQ ID NO: 8368930 - DNA, 22 bp, Homo sapiens
acatatttccatgcagcatgtc

SEQ ID NO: 8368931 - DNA, 22 bp, Homo sapiens
aggcagctctgtggcctcccag

SEQ ID NO: 8368932 - DNA, 21 bp, Homo sapiens
aggcagctcaggcccagagag

SEQ ID NO: 8368933 - DNA, 21 bp, Homo sapiens
aggcagctcaggcccagagag

SEQ ID NO: 8368934 - DNA, 22 bp, Homo sapiens
aggcagctgaccacagtatgat

SEQ ID NO: 8368935 - DNA, 22 bp, Homo sapiens
aggcagctctgtggcctcccag

SEQ ID NO: 8368936 - DNA, 22 bp, Homo sapiens
aggcagctgaccacagtatgat

SEQ ID NO: 8368937 - DNA, 22 bp, Homo sapiens
aggcagctgccctctccttcct

SEQ ID NO: 8368938 - DNA, 22 bp, Homo sapiens
aggcagctgccctctccttcct

SEQ ID NO: 8368939 - DNA, 22 bp, Homo sapiens
aggcagctggaaaactccaggc

SEQ ID NO: 8368940 - DNA, 21 bp, Homo sapiens
aggcagctggaaggcctggct

SEQ ID NO: 8368941 - DNA, 21 bp, Homo sapiens
aggatggaaaggactaggggt

SEQ ID NO: 8368942 - DNA, 22 bp, Homo sapiens
aggatggaattaggtagcaagt

SEQ ID NO: 8368943 - DNA, 21 bp, Homo sapiens
aggatggaaaggactaggggt

SEQ ID NO: 8368944 - DNA, 22 bp, Homo sapiens
aggatgaggctggcaggtcttg

SEQ ID NO: 8368945 - DNA, 22 bp, Homo sapiens
acagtttaggatgagagaacac

SEQ ID NO: 8368946 - DNA, 20 bp, Homo sapiens
acagtttatccagttagcag

SEQ ID NO: 8368947 - DNA, 22 bp, Homo sapiens
acagtttataaaaataatgagg

SEQ ID NO: 8368948 - DNA, 22 bp, Homo sapiens
acagtttagaatgccacatagt

SEQ ID NO: 8368949 - DNA, 22 bp, Homo sapiens
acagtttagagcatgatgacca

SEQ ID NO: 8368950 - DNA, 22 bp, Homo sapiens
aggatggattctgtatgtggga

SEQ ID NO: 8368951 - DNA, 19 bp, Homo sapiens
aggatggagcaggcggtga

SEQ ID NO: 8368952 - DNA, 22 bp, Homo sapiens
aggcactgcttctaagtaggaa

SEQ ID NO: 8368953 - DNA, 18 bp, Homo sapiens
aggcactggaattaaggg

SEQ ID NO: 8368954 - DNA, 22 bp, Homo sapiens
aggcactgggaatatgctgagg

SEQ ID NO: 8368955 - DNA, 20 bp, Homo sapiens
aggcactggatttcttatat

SEQ ID NO: 8368956 - DNA, 22 bp, Homo sapiens
aggcactgggggatgagcaagg

SEQ ID NO: 8368957 - DNA, 20 bp, Homo sapiens
aggcactggggataggtaag

SEQ ID NO: 8368958 - DNA, 22 bp, Homo sapiens
aggcactgggaatatgctgagg

SEQ ID NO: 8368959 - DNA, 22 bp, Homo sapiens
aggcactgggaatatgctgagg

SEQ ID NO: 8368960 - DNA, 22 bp, Homo sapiens
aggcactgggtaattagtagct

SEQ ID NO: 8368961 - DNA, 22 bp, Homo sapiens
aggcactgggtaattagtagct

SEQ ID NO: 8368962 - DNA, 21 bp, Homo sapiens
acatacattatctttttaaaa

SEQ ID NO: 8368963 - DNA, 22 bp, Homo sapiens
aggcactgggggatgagcaagg

SEQ ID NO: 8368964 - DNA, 20 bp, Homo sapiens
acagtttattttacttggtt

SEQ ID NO: 8368965 - DNA, 22 bp, Homo sapiens
acagtttattgcacaggtaacc

SEQ ID NO: 8368966 - DNA, 22 bp, Homo sapiens
acagtttctccatttacacctt

SEQ ID NO: 8368967 - DNA, 21 bp, Homo sapiens
acagtttattagagtaagtgc

SEQ ID NO: 8368968 - DNA, 21 bp, Homo sapiens
acagtttattagagtaagtgc

SEQ ID NO: 8368969 - DNA, 22 bp, Homo sapiens
acagtttatgtaaagctgccaa

SEQ ID NO: 8368970 - DNA, 22 bp, Homo sapiens
acagtttatgcctctgagcctg

SEQ ID NO: 8368971 - DNA, 22 bp, Homo sapiens
acagtttatcgattcacctacc

SEQ ID NO: 8368972 - DNA, 22 bp, Homo sapiens
acagtttatggtgttttatata

SEQ ID NO: 8368973 - DNA, 22 bp, Homo sapiens
aggagcagaactgattctgact

SEQ ID NO: 8368974 - DNA, 22 bp, Homo sapiens
aggagcagaccgtagtcctgca

SEQ ID NO: 8368975 - DNA, 22 bp, Homo sapiens
acagtacaccactgtgtacagt

SEQ ID NO: 8368976 - DNA, 22 bp, Homo sapiens
aggagcagaatttaatgtgcag

SEQ ID NO: 8368977 - DNA, 22 bp, Homo sapiens
acagtatatatagtctaaaagc

SEQ ID NO: 8368978 - DNA, 22 bp, Homo sapiens
acaggtgtacaatgcatgacag

SEQ ID NO: 8368979 - DNA, 22 bp, Homo sapiens
acaggtgttgactcacaggccc

SEQ ID NO: 8368980 - DNA, 22 bp, Homo sapiens
aggacacagactgattgcagca

SEQ ID NO: 8368981 - DNA, 22 bp, Homo sapiens
aggacacagacttagatttaaa

SEQ ID NO: 8368982 - DNA, 22 bp, Homo sapiens
aggacacagctcttcagtaaga

SEQ ID NO: 8368983 - DNA, 22 bp, Homo sapiens
aggacacagctgctctgcagag

SEQ ID NO: 8368984 - DNA, 22 bp, Homo sapiens
acagtaaacaatgcagcaaatt

SEQ ID NO: 8368985 - DNA, 22 bp, Homo sapiens
acagtaaaacatttttattagg

SEQ ID NO: 8368986 - DNA, 22 bp, Homo sapiens
acagtaaataatgcatgttgat

SEQ ID NO: 8368987 - DNA, 19 bp, Homo sapiens
acagtgtctgtatataaat

SEQ ID NO: 8368988 - DNA, 22 bp, Homo sapiens
acagtgtggttgtttctggtta

SEQ ID NO: 8368989 - DNA, 22 bp, Homo sapiens
acagtgtctcctggtacccagt

SEQ ID NO: 8368990 - DNA, 22 bp, Homo sapiens
acagtgtctcactgctgaaatc

SEQ ID NO: 8368991 - DNA, 23 bp, Homo sapiens
acagtgtctgctgcaagatatct

SEQ ID NO: 8368992 - DNA, 23 bp, Homo sapiens
acagtgtctgctgcaagatatct

SEQ ID NO: 8368993 - DNA, 22 bp, Homo sapiens
acagtgtctgacacattgtagc

SEQ ID NO: 8368994 - DNA, 22 bp, Homo sapiens
acagtgtctgacacgtaggaag

SEQ ID NO: 8368995 - DNA, 22 bp, Homo sapiens
acagtgtctgacacgtaggaag

SEQ ID NO: 8368996 - DNA, 22 bp, Homo sapiens
acagtctgcctctcagagcagc

SEQ ID NO: 8368997 - DNA, 22 bp, Homo sapiens
acagtctgcctctcagagcagc

SEQ ID NO: 8368998 - DNA, 22 bp, Homo sapiens
acagtctgcctctcagagcagc

SEQ ID NO: 8368999 - DNA, 22 bp, Homo sapiens
acagtctgcagggtgaacatgt

SEQ ID NO: 8369000 - DNA, 22 bp, Homo sapiens
acagtctctgttgctgctgttt

SEQ ID NO: 8369001 - DNA, 22 bp, Homo sapiens
acagtccttgtttcggtcagat

SEQ ID NO: 8369002 - DNA, 22 bp, Homo sapiens
acagtcagtatcccaggcaaat

SEQ ID NO: 8369003 - DNA, 22 bp, Homo sapiens
acagtcagggcttactcaggga

SEQ ID NO: 8369004 - DNA, 22 bp, Homo sapiens
acagtatgaatgcagaatgtag

SEQ ID NO: 8369005 - DNA, 19 bp, Homo sapiens
acaggatatatcaggaaat

SEQ ID NO: 8369006 - DNA, 22 bp, Homo sapiens
acaggcacaggtgtgccccacc

SEQ ID NO: 8369007 - DNA, 22 bp, Homo sapiens
acaggaggggcatgaaagacgg

SEQ ID NO: 8369008 - DNA, 22 bp, Homo sapiens
acaggagtagggctggtggaga

SEQ ID NO: 8369009 - DNA, 23 bp, Homo sapiens
acaggaggggacaggtggccgtg

SEQ ID NO: 8369010 - DNA, 22 bp, Homo sapiens
acaggagggacaccttcctgct

SEQ ID NO: 8369011 - DNA, 23 bp, Homo sapiens
acaggaggggacaggtggccgtg

SEQ ID NO: 8369012 - DNA, 22 bp, Homo sapiens
acaggagggacaccttcctgct

SEQ ID NO: 8369013 - DNA, 22 bp, Homo sapiens
agctggattccagtgcagtcac

SEQ ID NO: 8369014 - DNA, 22 bp, Homo sapiens
agctctggtatttctttaatcc

SEQ ID NO: 8369015 - DNA, 22 bp, Homo sapiens
agctctgggtcacggctgccga

SEQ ID NO: 8369016 - DNA, 22 bp, Homo sapiens
agctctgggtcacggctgccga

SEQ ID NO: 8369017 - DNA, 22 bp, Homo sapiens
agctgaagcaacaacaggatgg

SEQ ID NO: 8369018 - DNA, 22 bp, Homo sapiens
agctgagagctgtgtcaagata

SEQ ID NO: 8369019 - DNA, 21 bp, Homo sapiens
acagctgcctgccatgggggt

SEQ ID NO: 8369020 - DNA, 22 bp, Homo sapiens
agctggatgaatttggaacact

SEQ ID NO: 8369021 - DNA, 22 bp, Homo sapiens
agctggattaaatatagctttc

SEQ ID NO: 8369022 - DNA, 22 bp, Homo sapiens
acagctgggtgtcccacttctg

SEQ ID NO: 8369023 - DNA, 19 bp, Homo sapiens
acagggaatttccacagaa

SEQ ID NO: 8369024 - DNA, 19 bp, Homo sapiens
acagggaatttccacagaa

SEQ ID NO: 8369025 - DNA, 22 bp, Homo sapiens
acagggagatatcttcaatatc

SEQ ID NO: 8369026 - DNA, 22 bp, Homo sapiens
acagggagatgggtgaaagcgg

SEQ ID NO: 8369027 - DNA, 22 bp, Homo sapiens
acagggaatggagggatcagta

SEQ ID NO: 8369028 - DNA, 22 bp, Homo sapiens
acagggaatggagggatcagta

SEQ ID NO: 8369029 - DNA, 22 bp, Homo sapiens
acagggaagttctgcaacagga

SEQ ID NO: 8369030 - DNA, 22 bp, Homo sapiens
acagggaagttctgcaacagga

SEQ ID NO: 8369031 - DNA, 22 bp, Homo sapiens
acagggaaggagcatagaaaaa

SEQ ID NO: 8369032 - DNA, 22 bp, Homo sapiens
acagggaaggatttagtgggaa

SEQ ID NO: 8369033 - DNA, 22 bp, Homo sapiens
acagggaagttctgcaacagga

SEQ ID NO: 8369034 - DNA, 22 bp, Homo sapiens
acagggaaggcatccgcgaatg

SEQ ID NO: 8369035 - DNA, 22 bp, Homo sapiens
acaggcagggacctcttgagtt

SEQ ID NO: 8369036 - DNA, 22 bp, Homo sapiens
acaggcagggaccttggctaag

SEQ ID NO: 8369037 - DNA, 22 bp, Homo sapiens
acaggcaggcttcggccagagc

SEQ ID NO: 8369038 - DNA, 22 bp, Homo sapiens
acagggaagctcaggggctctg

SEQ ID NO: 8369039 - DNA, 22 bp, Homo sapiens
acagggaaggacatgacttggc

SEQ ID NO: 8369040 - DNA, 22 bp, Homo sapiens
acagggaaggagcatagaaaaa

SEQ ID NO: 8369041 - DNA, 22 bp, Homo sapiens
acagggaaggacatgacttggc

SEQ ID NO: 8369042 - DNA, 22 bp, Homo sapiens
acagggaagctcaggggctctg

SEQ ID NO: 8369043 - DNA, 22 bp, Homo sapiens
acaggcagggaccttggctaag

SEQ ID NO: 8369044 - DNA, 22 bp, Homo sapiens
acaggcagattaagggtaggca

SEQ ID NO: 8369045 - DNA, 22 bp, Homo sapiens
acaggcagcactaatctctggt

SEQ ID NO: 8369046 - DNA, 22 bp, Homo sapiens
acaggcagcaaaatcagcctca

SEQ ID NO: 8369047 - DNA, 22 bp, Homo sapiens
acaggcaggcgggacagcccga

SEQ ID NO: 8369048 - DNA, 22 bp, Homo sapiens
acaggcaggcgggacagcccga

SEQ ID NO: 8369049 - DNA, 22 bp, Homo sapiens
acaggcaggcgggacagcccga

SEQ ID NO: 8369050 - DNA, 22 bp, Homo sapiens
acaggcaggcttcggccagagc

SEQ ID NO: 8369051 - DNA, 22 bp, Homo sapiens
acaggcaggagctccccattcc

SEQ ID NO: 8369052 - DNA, 22 bp, Homo sapiens
aggacacaccaggtccagctgt

SEQ ID NO: 8369053 - DNA, 22 bp, Homo sapiens
aggacacacaaagagtgagaac

SEQ ID NO: 8369054 - DNA, 22 bp, Homo sapiens
aggacaattttggcatagttct

SEQ ID NO: 8369055 - DNA, 22 bp, Homo sapiens
aggacaatctctcctttatcag

SEQ ID NO: 8369056 - DNA, 22 bp, Homo sapiens
aggaagaatgtttacatatcaa

SEQ ID NO: 8369057 - DNA, 23 bp, Homo sapiens
aggaagagagagtgcctctttct

SEQ ID NO: 8369058 - DNA, 21 bp, Homo sapiens
aggaagaaaggttggaggttg

SEQ ID NO: 8369059 - DNA, 21 bp, Homo sapiens
aggaagaaaggttggaggttg

SEQ ID NO: 8369060 - DNA, 22 bp, Homo sapiens
aggaagaaactgagctctgaca

SEQ ID NO: 8369061 - DNA, 22 bp, Homo sapiens
acagggagccccagcatttcca

SEQ ID NO: 8369062 - DNA, 22 bp, Homo sapiens
aggaagaacagataatggacgc

SEQ ID NO: 8369063 - DNA, 22 bp, Homo sapiens
aggaagaacctaagaaagtctc

SEQ ID NO: 8369064 - DNA, 22 bp, Homo sapiens
aggaagaacctaagaaagtctc

SEQ ID NO: 8369065 - DNA, 22 bp, Homo sapiens
aggaagaaatgtgacttcaaac

SEQ ID NO: 8369066 - DNA, 22 bp, Homo sapiens
acattgtataatgattatcaca

SEQ ID NO: 8369067 - DNA, 22 bp, Homo sapiens
acatttcactgttcacagcagg

SEQ ID NO: 8369068 - DNA, 22 bp, Homo sapiens
acattgtataatgattatcaca

SEQ ID NO: 8369069 - DNA, 22 bp, Homo sapiens
acatttcctaacgtatacactg

SEQ ID NO: 8369070 - DNA, 22 bp, Homo sapiens
acatttcagaatcacacagctt

SEQ ID NO: 8369071 - DNA, 22 bp, Homo sapiens
acattgtaaatacctttatcac

SEQ ID NO: 8369072 - DNA, 22 bp, Homo sapiens
acattgtagttgttctgcagca

SEQ ID NO: 8369073 - DNA, 22 bp, Homo sapiens
acattgtagacttttcatatgt

SEQ ID NO: 8369074 - DNA, 22 bp, Homo sapiens
acattgtagacttttcatatgt

SEQ ID NO: 8369075 - DNA, 22 bp, Homo sapiens
acatttctaatttaatgtaaca

SEQ ID NO: 8369076 - DNA, 22 bp, Homo sapiens
acatttctatagtgcatctgtt

SEQ ID NO: 8369077 - DNA, 18 bp, Homo sapiens
acatttctatgcttctgg

SEQ ID NO: 8369078 - DNA, 22 bp, Homo sapiens
acatttctagttgttcatctcc

SEQ ID NO: 8369079 - DNA, 22 bp, Homo sapiens
acatttctatagtgcatctgtt

SEQ ID NO: 8369080 - DNA, 22 bp, Homo sapiens
acatttctagttgttcatctcc

SEQ ID NO: 8369081 - DNA, 22 bp, Homo sapiens
aggctctggctactacagagct

SEQ ID NO: 8369082 - DNA, 22 bp, Homo sapiens
aggctctgttattctagagggc

SEQ ID NO: 8369083 - DNA, 22 bp, Homo sapiens
aggctctttgagactacctgga

SEQ ID NO: 8369084 - DNA, 22 bp, Homo sapiens
aggctgacaagttcgtctaaag

SEQ ID NO: 8369085 - DNA, 22 bp, Homo sapiens
acattgcaataataattctctt

SEQ ID NO: 8369086 - DNA, 22 bp, Homo sapiens
acatttgaaatgccatgtgagg

SEQ ID NO: 8369087 - DNA, 22 bp, Homo sapiens
acatttgaaatgccatgtgagg

SEQ ID NO: 8369088 - DNA, 22 bp, Homo sapiens
acatttgactctgttcatatta

SEQ ID NO: 8369089 - DNA, 22 bp, Homo sapiens
acatttgattgatgaatcaaat

SEQ ID NO: 8369090 - DNA, 22 bp, Homo sapiens
acatttggcatcttgtaacact

SEQ ID NO: 8369091 - DNA, 18 bp, Homo sapiens
acatttctatgcttctgg

SEQ ID NO: 8369092 - DNA, 22 bp, Homo sapiens
acatttctcagggagttttgct

SEQ ID NO: 8369093 - DNA, 22 bp, Homo sapiens
aggctgaggagggatgttgctt

SEQ ID NO: 8369094 - DNA, 22 bp, Homo sapiens
aggctgagctggtagtgagtac

SEQ ID NO: 8369095 - DNA, 22 bp, Homo sapiens
acatttcttgatgcctctgtga

SEQ ID NO: 8369096 - DNA, 22 bp, Homo sapiens
acatttctttctattcagtagc

SEQ ID NO: 8369097 - DNA, 22 bp, Homo sapiens
acatttcttttcatctctatat

SEQ ID NO: 8369098 - DNA, 22 bp, Homo sapiens
acatttctcttgatgtctctat

SEQ ID NO: 8369099 - DNA, 22 bp, Homo sapiens
acatttcttgatgcctctgtga

SEQ ID NO: 8369100 - DNA, 22 bp, Homo sapiens
acatttcttgatgcctctgtga

SEQ ID NO: 8369101 - DNA, 22 bp, Homo sapiens
acatttcttgatgcctctgtga

SEQ ID NO: 8369102 - DNA, 22 bp, Homo sapiens
acatttctttctattcagtagc

SEQ ID NO: 8369103 - DNA, 22 bp, Homo sapiens
acatcacacgccttccaggagg

SEQ ID NO: 8369104 - DNA, 22 bp, Homo sapiens
acatcagagggctcacatgatc

SEQ ID NO: 8369105 - DNA, 21 bp, Homo sapiens
acatcagagttgtgaaggtag

SEQ ID NO: 8369106 - DNA, 22 bp, Homo sapiens
acatcacagtagttaagccaga

SEQ ID NO: 8369107 - DNA, 22 bp, Homo sapiens
acatcacggtccagcacggctg

SEQ ID NO: 8369108 - DNA, 22 bp, Homo sapiens
acatcatcgtgcacatacataa

SEQ ID NO: 8369109 - DNA, 21 bp, Homo sapiens
acatccagggtcctcactgcc

SEQ ID NO: 8369110 - DNA, 22 bp, Homo sapiens
acatccatcttatgagataggt

SEQ ID NO: 8369111 - DNA, 22 bp, Homo sapiens
acatccactatccttgcttgtt

SEQ ID NO: 8369112 - DNA, 22 bp, Homo sapiens
acatccactatccttgcttgtt

SEQ ID NO: 8369113 - DNA, 22 bp, Homo sapiens
acatccaccacatgccaggctc

SEQ ID NO: 8369114 - DNA, 22 bp, Homo sapiens
acatccacatttattcagtcat

SEQ ID NO: 8369115 - DNA, 22 bp, Homo sapiens
acatgccatcactttcattcct

SEQ ID NO: 8369116 - DNA, 22 bp, Homo sapiens
acatgccatgaaggtatttttg

SEQ ID NO: 8369117 - DNA, 22 bp, Homo sapiens
acatgctaggtacagatctaaa

SEQ ID NO: 8369118 - DNA, 22 bp, Homo sapiens
acatgctagactttctttatga

SEQ ID NO: 8369119 - DNA, 22 bp, Homo sapiens
acatgccagcccatttaaatgg

SEQ ID NO: 8369120 - DNA, 22 bp, Homo sapiens
acatgccagcccatttaaatgg

SEQ ID NO: 8369121 - DNA, 22 bp, Homo sapiens
acatgctttgcacttacatcat

SEQ ID NO: 8369122 - DNA, 22 bp, Homo sapiens
acatgctttaacttattttgat

SEQ ID NO: 8369123 - DNA, 22 bp, Homo sapiens
acatgctttgatgtattttgca

SEQ ID NO: 8369124 - DNA, 22 bp, Homo sapiens
acatgctttctaggtccttctg

SEQ ID NO: 8369125 - DNA, 22 bp, Homo sapiens
acatgcttctgtttcaagaact

SEQ ID NO: 8369126 - DNA, 22 bp, Homo sapiens
acatgcttccaaattatgttgg

SEQ ID NO: 8369127 - DNA, 22 bp, Homo sapiens
acatgcttgtttttcacaacct

SEQ ID NO: 8369128 - DNA, 22 bp, Homo sapiens
acatgcttgtttttcacaacct

SEQ ID NO: 8369129 - DNA, 20 bp, Homo sapiens
aggcctcttcatgacagctg

SEQ ID NO: 8369130 - DNA, 22 bp, Homo sapiens
aggcctcttcagggagcatgga

SEQ ID NO: 8369131 - DNA, 22 bp, Homo sapiens
aggcctctgtagggccctgaag

SEQ ID NO: 8369132 - DNA, 22 bp, Homo sapiens
aggcctgaagtgtggagtgggg

SEQ ID NO: 8369133 - DNA, 22 bp, Homo sapiens
aggcctgagcagaggagtggac

SEQ ID NO: 8369134 - DNA, 22 bp, Homo sapiens
acatgtttggctctatgctata

SEQ ID NO: 8369135 - DNA, 22 bp, Homo sapiens
acatgtttgcctgcaggcttag

SEQ ID NO: 8369136 - DNA, 22 bp, Homo sapiens
acatgtttgcctgcaggcttag

SEQ ID NO: 8369137 - DNA, 22 bp, Homo sapiens
acatgtttggctctatgctata

SEQ ID NO: 8369138 - DNA, 22 bp, Homo sapiens
acatgtttaagtttaatgaaaa

SEQ ID NO: 8369139 - DNA, 22 bp, Homo sapiens
acatgtttaagtttaatgaaaa

SEQ ID NO: 8369140 - DNA, 22 bp, Homo sapiens
acatgtttaagtttgttatatg

SEQ ID NO: 8369141 - DNA, 22 bp, Homo sapiens
acatgttaaacatcatggaatg

SEQ ID NO: 8369142 - DNA, 22 bp, Homo sapiens
acatgttagaaatgcagaatct

SEQ ID NO: 8369143 - DNA, 22 bp, Homo sapiens
acatgttcatgcatgcacaggt

SEQ ID NO: 8369144 - DNA, 22 bp, Homo sapiens
aggccagggtcccacactcgca

SEQ ID NO: 8369145 - DNA, 22 bp, Homo sapiens
aggccagggccagattagccac

SEQ ID NO: 8369146 - DNA, 22 bp, Homo sapiens
aggccagggccagattagccac

SEQ ID NO: 8369147 - DNA, 22 bp, Homo sapiens
aggccaggggtgagcacttctg

SEQ ID NO: 8369148 - DNA, 22 bp, Homo sapiens
aggccagggtagggcccattgt

SEQ ID NO: 8369149 - DNA, 22 bp, Homo sapiens
aggccaggcctttctccattcc

SEQ ID NO: 8369150 - DNA, 22 bp, Homo sapiens
aggccaggcctttctccattcc

SEQ ID NO: 8369151 - DNA, 22 bp, Homo sapiens
aggccagggcactgctctttag

SEQ ID NO: 8369152 - DNA, 22 bp, Homo sapiens
accagcagggctgggccaatgg

SEQ ID NO: 8369153 - DNA, 22 bp, Homo sapiens
accagcagggctgggccaatgg

SEQ ID NO: 8369154 - DNA, 22 bp, Homo sapiens
accagcaggccaggggcactgc

SEQ ID NO: 8369155 - DNA, 22 bp, Homo sapiens
accagcagttatgaggccagga

SEQ ID NO: 8369156 - DNA, 22 bp, Homo sapiens
accagcagttatgaggccagga

SEQ ID NO: 8369157 - DNA, 22 bp, Homo sapiens
acatttgtctggctagaaagtt

SEQ ID NO: 8369158 - DNA, 22 bp, Homo sapiens
accagcagctgccagagtggag

SEQ ID NO: 8369159 - DNA, 22 bp, Homo sapiens
accagcagctgcgggccactgc

SEQ ID NO: 8369160 - DNA, 22 bp, Homo sapiens
accagcagcctagagcgttctt

SEQ ID NO: 8369161 - DNA, 22 bp, Homo sapiens
accagcagctgccagagtggag

SEQ ID NO: 8369162 - DNA, 22 bp, Homo sapiens
aggcttggtgccaaggagcctg

SEQ ID NO: 8369163 - DNA, 19 bp, Homo sapiens
aggcttggttgcagcaagc

SEQ ID NO: 8369164 - DNA, 22 bp, Homo sapiens
aggcttgtctcagaagatgctg

SEQ ID NO: 8369165 - DNA, 20 bp, Homo sapiens
aggcttggcttggcaggaac

SEQ ID NO: 8369166 - DNA, 22 bp, Homo sapiens
accagccccaccgggactgcag

SEQ ID NO: 8369167 - DNA, 20 bp, Homo sapiens
aggcttggcttggcaggaac

SEQ ID NO: 8369168 - DNA, 18 bp, Homo sapiens
aggcttgggcccagcagc

SEQ ID NO: 8369169 - DNA, 22 bp, Homo sapiens
aggcttgggactgcttaggagc

SEQ ID NO: 8369170 - DNA, 22 bp, Homo sapiens
aggcttgttttactaaaagcaa

SEQ ID NO: 8369171 - DNA, 22 bp, Homo sapiens
agggagagaagttatacaagat

SEQ ID NO: 8369172 - DNA, 22 bp, Homo sapiens
agggacagtctactgttcactg

SEQ ID NO: 8369173 - DNA, 19 bp, Homo sapiens
agggagaattccaagagga

SEQ ID NO: 8369174 - DNA, 22 bp, Homo sapiens
agggagacaaaagcagctgcca

SEQ ID NO: 8369175 - DNA, 22 bp, Homo sapiens
accagctcagaagccagaaaga

SEQ ID NO: 8369176 - DNA, 17 bp, Homo sapiens
accagcctctcctgggg

SEQ ID NO: 8369177 - DNA, 22 bp, Homo sapiens
agggagaggagcgtttcacatc

SEQ ID NO: 8369178 - DNA, 22 bp, Homo sapiens
agggagagaagttatacaagat

SEQ ID NO: 8369179 - DNA, 22 bp, Homo sapiens
agggcagcagctcctcctagct

SEQ ID NO: 8369180 - DNA, 22 bp, Homo sapiens
agggcagcacagctgtgctcct

SEQ ID NO: 8369181 - DNA, 22 bp, Homo sapiens
agggcagcaatttggttcctgg

SEQ ID NO: 8369182 - DNA, 22 bp, Homo sapiens
agggcagcaatttggttcctgg

SEQ ID NO: 8369183 - DNA, 22 bp, Homo sapiens
agggcagcacagctgtgctcct

SEQ ID NO: 8369184 - DNA, 21 bp, Homo sapiens
agggcagattagctgtaagag

SEQ ID NO: 8369185 - DNA, 22 bp, Homo sapiens
agggcagcaatgcagctgctgc

SEQ ID NO: 8369186 - DNA, 22 bp, Homo sapiens
agggcagcaatgcagctgctgc

SEQ ID NO: 8369187 - DNA, 22 bp, Homo sapiens
agggcagcaatgcagctgctgc

SEQ ID NO: 8369188 - DNA, 22 bp, Homo sapiens
acccagagccagggtcaggagc

SEQ ID NO: 8369189 - DNA, 22 bp, Homo sapiens
acccagagccagggtcaggagc

SEQ ID NO: 8369190 - DNA, 22 bp, Homo sapiens
acccagccacagcattgaggga

SEQ ID NO: 8369191 - DNA, 22 bp, Homo sapiens
acccagccatgttcagttctct

SEQ ID NO: 8369192 - DNA, 22 bp, Homo sapiens
acccagcatgacacctgcacat

SEQ ID NO: 8369193 - DNA, 22 bp, Homo sapiens
acccagagcccttagcacagac

SEQ ID NO: 8369194 - DNA, 22 bp, Homo sapiens
acccagcccagaatctggggcc

SEQ ID NO: 8369195 - DNA, 22 bp, Homo sapiens
acccagcccagaatctggggcc

SEQ ID NO: 8369196 - DNA, 19 bp, Homo sapiens
acccagcccaggagtggca

SEQ ID NO: 8369197 - DNA, 22 bp, Homo sapiens
acccagcctacaaagctcacct

SEQ ID NO: 8369198 - DNA, 22 bp, Homo sapiens
acccagcctacaaagctcacct

SEQ ID NO: 8369199 - DNA, 22 bp, Homo sapiens
acccaggacacagagatgaccc

SEQ ID NO: 8369200 - DNA, 22 bp, Homo sapiens
acccagctggatgcatggaggc

SEQ ID NO: 8369201 - DNA, 22 bp, Homo sapiens
acccaggctggagtgcagtgac

SEQ ID NO: 8369202 - DNA, 22 bp, Homo sapiens
acccaggctggagtgcagtggt

SEQ ID NO: 8369203 - DNA, 22 bp, Homo sapiens
acccaggctggagtgcagtgtc

SEQ ID NO: 8369204 - DNA, 22 bp, Homo sapiens
acccaggctggagtgcagtggg

SEQ ID NO: 8369205 - DNA, 22 bp, Homo sapiens
acccaggctggagtgcagtggc

SEQ ID NO: 8369206 - DNA, 22 bp, Homo sapiens
acccaggctggagtgcagtgat

SEQ ID NO: 8369207 - DNA, 22 bp, Homo sapiens
agggggcattatgaggcttttc

SEQ ID NO: 8369208 - DNA, 22 bp, Homo sapiens
agggggcattatgaggcttttc

SEQ ID NO: 8369209 - DNA, 20 bp, Homo sapiens
accctccactgttcactgtg

SEQ ID NO: 8369210 - DNA, 22 bp, Homo sapiens
accctccactttatctgtcttt

SEQ ID NO: 8369211 - DNA, 22 bp, Homo sapiens
agggggcatcaggtcctggctc

SEQ ID NO: 8369212 - DNA, 22 bp, Homo sapiens
agggggcatcaggtcctggctc

SEQ ID NO: 8369213 - DNA, 22 bp, Homo sapiens
agggggcaggagagacctgctg

SEQ ID NO: 8369214 - DNA, 22 bp, Homo sapiens
acccaggctggcgtgcagtggc

SEQ ID NO: 8369215 - DNA, 22 bp, Homo sapiens
acttacaagttccctttctcag

SEQ ID NO: 8369216 - DNA, 22 bp, Homo sapiens
acttacaagttccctttctcag

SEQ ID NO: 8369217 - DNA, 22 bp, Homo sapiens
acttacaagctagggaagcttg

SEQ ID NO: 8369218 - DNA, 22 bp, Homo sapiens
acttaacagacattatttacct

SEQ ID NO: 8369219 - DNA, 22 bp, Homo sapiens
acttacaatcaaccaccttgga

SEQ ID NO: 8369220 - DNA, 22 bp, Homo sapiens
acttacaatcaaccaccttgga

SEQ ID NO: 8369221 - DNA, 22 bp, Homo sapiens
acttagaaagggattctagatt

SEQ ID NO: 8369222 - DNA, 22 bp, Homo sapiens
acttacctaatagtccatagca

SEQ ID NO: 8369223 - DNA, 22 bp, Homo sapiens
acttagaagatgcagtaaagca

SEQ ID NO: 8369224 - DNA, 22 bp, Homo sapiens
acttagaatatgttcaagattt

SEQ ID NO: 8369225 - DNA, 22 bp, Homo sapiens
acttagaagatgcagtaaagca

SEQ ID NO: 8369226 - DNA, 22 bp, Homo sapiens
atacagatgttgaatgttatat

SEQ ID NO: 8369227 - DNA, 22 bp, Homo sapiens
atacacttgtacattttttaat

SEQ ID NO: 8369228 - DNA, 22 bp, Homo sapiens
acttaaatagaactcctcaata

SEQ ID NO: 8369229 - DNA, 22 bp, Homo sapiens
acttaaagttataatttgctaa

SEQ ID NO: 8369230 - DNA, 22 bp, Homo sapiens
acttaaagtagttttactgtgg

SEQ ID NO: 8369231 - DNA, 22 bp, Homo sapiens
ataatgcatttagaataattca

SEQ ID NO: 8369232 - DNA, 21 bp, Homo sapiens
acttaaattccttgatattta

SEQ ID NO: 8369233 - DNA, 23 bp, Homo sapiens
acttaaatggttctttatctcag

SEQ ID NO: 8369234 - DNA, 22 bp, Homo sapiens
atacagtaaccacattctatag

SEQ ID NO: 8369235 - DNA, 22 bp, Homo sapiens
acttctcttcataggtggcaat

SEQ ID NO: 8369236 - DNA, 22 bp, Homo sapiens
acttctgataaagagcatgtgc

SEQ ID NO: 8369237 - DNA, 22 bp, Homo sapiens
atacagattgctatacttacaa

SEQ ID NO: 8369238 - DNA, 22 bp, Homo sapiens
atacagattgctatacttacaa

SEQ ID NO: 8369239 - DNA, 22 bp, Homo sapiens
atacagcagtgaataagataaa

SEQ ID NO: 8369240 - DNA, 22 bp, Homo sapiens
atacagcttacagttctaatgc

SEQ ID NO: 8369241 - DNA, 22 bp, Homo sapiens
atacagggacatccagtttttc

SEQ ID NO: 8369242 - DNA, 22 bp, Homo sapiens
atacaggatgctgaacatctct

SEQ ID NO: 8369243 - DNA, 22 bp, Homo sapiens
atacaggatgctgaacatctct

SEQ ID NO: 8369244 - DNA, 22 bp, Homo sapiens
acttctggatagagtcagcttt

SEQ ID NO: 8369245 - DNA, 22 bp, Homo sapiens
acttctggaggcctagggaaga

SEQ ID NO: 8369246 - DNA, 22 bp, Homo sapiens
atacatgttcgtgtacatgttc

SEQ ID NO: 8369247 - DNA, 22 bp, Homo sapiens
atacatgttcgtgtacatgttc

SEQ ID NO: 8369248 - DNA, 22 bp, Homo sapiens
atacatgttgagaaaatatctg

SEQ ID NO: 8369249 - DNA, 22 bp, Homo sapiens
atacattagctcatatgattaa

SEQ ID NO: 8369250 - DNA, 22 bp, Homo sapiens
atacatgtttgctggataaaca

SEQ ID NO: 8369251 - DNA, 22 bp, Homo sapiens
atacatgttgagaaaatatctg

SEQ ID NO: 8369252 - DNA, 22 bp, Homo sapiens
atacatgttgtaccatatgttt

SEQ ID NO: 8369253 - DNA, 22 bp, Homo sapiens
atactgtacgctcctggcattt

SEQ ID NO: 8369254 - DNA, 22 bp, Homo sapiens
atactgctgctgctgaaatcac

SEQ ID NO: 8369255 - DNA, 22 bp, Homo sapiens
atactgaaaaatgatttgctgt

SEQ ID NO: 8369256 - DNA, 22 bp, Homo sapiens
atactgtgtgcagagtcctaat

SEQ ID NO: 8369257 - DNA, 22 bp, Homo sapiens
actttatgacaccctttagtga

SEQ ID NO: 8369258 - DNA, 22 bp, Homo sapiens
actttcaaatatcatgattcta

SEQ ID NO: 8369259 - DNA, 22 bp, Homo sapiens
actgtataaggcataggtaagc

SEQ ID NO: 8369260 - DNA, 22 bp, Homo sapiens
actgtatttccaacagacaaat

SEQ ID NO: 8369261 - DNA, 21 bp, Homo sapiens
actgtattgttttcaaggatc

SEQ ID NO: 8369262 - DNA, 22 bp, Homo sapiens
actgtcaaaagagattatatta

SEQ ID NO: 8369263 - DNA, 22 bp, Homo sapiens
actgtcacttgcaactgtgagg

SEQ ID NO: 8369264 - DNA, 22 bp, Homo sapiens
actgtcactaactaagtctagt

SEQ ID NO: 8369265 - DNA, 22 bp, Homo sapiens
actgtcaagagattcaaattca

SEQ ID NO: 8369266 - DNA, 22 bp, Homo sapiens
actgtacttacgcatatacagg

SEQ ID NO: 8369267 - DNA, 22 bp, Homo sapiens
actgggaagtcagagagaggct

SEQ ID NO: 8369268 - DNA, 22 bp, Homo sapiens
actgggactgtatgtgctggac

SEQ ID NO: 8369269 - DNA, 20 bp, Homo sapiens
actgggagctaacggagatt

SEQ ID NO: 8369270 - DNA, 22 bp, Homo sapiens
actgggaagatggaggcaagca

SEQ ID NO: 8369271 - DNA, 22 bp, Homo sapiens
actgggaaaagctatggcaaat

SEQ ID NO: 8369272 - DNA, 22 bp, Homo sapiens
actgggaacaaggtgctcagcg

SEQ ID NO: 8369273 - DNA, 22 bp, Homo sapiens
ataatgagaatacagtaactat

SEQ ID NO: 8369274 - DNA, 22 bp, Homo sapiens
ataatgagcttttgaatactga

SEQ ID NO: 8369275 - DNA, 22 bp, Homo sapiens
ataatgaggatttgcatattag

SEQ ID NO: 8369276 - DNA, 22 bp, Homo sapiens
ataatgaatgcagagttatttt

SEQ ID NO: 8369277 - DNA, 22 bp, Homo sapiens
ataatgaatgcagagttatttt

SEQ ID NO: 8369278 - DNA, 22 bp, Homo sapiens
ataatgaatgcagagttatttt

SEQ ID NO: 8369279 - DNA, 22 bp, Homo sapiens
ataatcctgctttttcactatt

SEQ ID NO: 8369280 - DNA, 22 bp, Homo sapiens
actgtgccacaattcaccaggg

SEQ ID NO: 8369281 - DNA, 22 bp, Homo sapiens
ataaggttaacatcatcagtga

SEQ ID NO: 8369282 - DNA, 22 bp, Homo sapiens
actgtgcatctattgccattta

SEQ ID NO: 8369283 - DNA, 22 bp, Homo sapiens
actgtgatgatgaagcatggtt

SEQ ID NO: 8369284 - DNA, 22 bp, Homo sapiens
ataaaaactgacccatcctttg

SEQ ID NO: 8369285 - DNA, 22 bp, Homo sapiens
ataaaatttgctactgttaaat

SEQ ID NO: 8369286 - DNA, 22 bp, Homo sapiens
ataaaatttgctactgttaaat

SEQ ID NO: 8369287 - DNA, 22 bp, Homo sapiens
ataaaatttgctactgttaaat

SEQ ID NO: 8369288 - DNA, 22 bp, Homo sapiens
ataaacaagactggccaacttt

SEQ ID NO: 8369289 - DNA, 22 bp, Homo sapiens
ataaaatttgctactgttaaat

SEQ ID NO: 8369290 - DNA, 22 bp, Homo sapiens
agaacacttttaaatggcttgt

SEQ ID NO: 8369291 - DNA, 18 bp, Homo sapiens
agaacacttggttagatc

SEQ ID NO: 8369292 - DNA, 22 bp, Homo sapiens
agaacagcagcacgtcaagctg

SEQ ID NO: 8369293 - DNA, 22 bp, Homo sapiens
agaacagcagcacgtcaagctg

SEQ ID NO: 8369294 - DNA, 22 bp, Homo sapiens
agaacagcagtagtatacagta

SEQ ID NO: 8369295 - DNA, 22 bp, Homo sapiens
agaaattaggaaagtaacactt

SEQ ID NO: 8369296 - DNA, 22 bp, Homo sapiens
agaaattatgcagtagttttat

SEQ ID NO: 8369297 - DNA, 22 bp, Homo sapiens
agaaagtgtgtcatactaagtg

SEQ ID NO: 8369298 - DNA, 22 bp, Homo sapiens
agaaagggctattttgaggtag

SEQ ID NO: 8369299 - DNA, 22 bp, Homo sapiens
agaaagggctattttgaggtag

SEQ ID NO: 8369300 - DNA, 22 bp, Homo sapiens
agaaaggtcacttagcctcagc

SEQ ID NO: 8369301 - DNA, 22 bp, Homo sapiens
agaaaggtggatgctctggaat

SEQ ID NO: 8369302 - DNA, 22 bp, Homo sapiens
agaaagggttctctgaggtgct

SEQ ID NO: 8369303 - DNA, 22 bp, Homo sapiens
agaaagggttctctgaggtgct

SEQ ID NO: 8369304 - DNA, 22 bp, Homo sapiens
atcatcctagaaggaagctagg

SEQ ID NO: 8369305 - DNA, 19 bp, Homo sapiens
agaacagctttttgtgaca

SEQ ID NO: 8369306 - DNA, 22 bp, Homo sapiens
atcatccaagcgtagttcttct

SEQ ID NO: 8369307 - DNA, 22 bp, Homo sapiens
atcgcaagtttaaaaatctttg

SEQ ID NO: 8369308 - DNA, 22 bp, Homo sapiens
atctaataccctctttatttct

SEQ ID NO: 8369309 - DNA, 22 bp, Homo sapiens
atctcaaagcatggagcagaat

SEQ ID NO: 8369310 - DNA, 22 bp, Homo sapiens
atctcaaacatctttgaccata

SEQ ID NO: 8369311 - DNA, 22 bp, Homo sapiens
atctcaaacatctttgaccata

SEQ ID NO: 8369312 - DNA, 22 bp, Homo sapiens
atctcaaaaatgacctagagaa

SEQ ID NO: 8369313 - DNA, 22 bp, Homo sapiens
atctcaaatgattacaccaagc

SEQ ID NO: 8369314 - DNA, 22 bp, Homo sapiens
atctcacaggactgaaacgtaa

SEQ ID NO: 8369315 - DNA, 22 bp, Homo sapiens
atctaaaaggagctctttatct

SEQ ID NO: 8369316 - DNA, 22 bp, Homo sapiens
atcgtaaagccctatggcttca

SEQ ID NO: 8369317 - DNA, 22 bp, Homo sapiens
atatttataagcaagcaggact

SEQ ID NO: 8369318 - DNA, 22 bp, Homo sapiens
atattcttccaaaacatcattt

SEQ ID NO: 8369319 - DNA, 22 bp, Homo sapiens
atattcttccaaaacatcattt

SEQ ID NO: 8369320 - DNA, 22 bp, Homo sapiens
atatttataaggcaggcaagta

SEQ ID NO: 8369321 - DNA, 22 bp, Homo sapiens
atatttcaggttttgcaggccg

SEQ ID NO: 8369322 - DNA, 22 bp, Homo sapiens
atattccattggtttcccttct

SEQ ID NO: 8369323 - DNA, 22 bp, Homo sapiens
atattccagttatatcaaatca

SEQ ID NO: 8369324 - DNA, 21 bp, Homo sapiens
agaaaagtagagttttcagag

SEQ ID NO: 8369325 - DNA, 21 bp, Homo sapiens
agaaaagtatttgaatcaaga

SEQ ID NO: 8369326 - DNA, 21 bp, Homo sapiens
agaaaagtatttgaatcaaga

SEQ ID NO: 8369327 - DNA, 22 bp, Homo sapiens
agaaaagttttctgagactgac

SEQ ID NO: 8369328 - DNA, 23 bp, Homo sapiens
agaaaagttcatacctttttaac

SEQ ID NO: 8369329 - DNA, 22 bp, Homo sapiens
actttcccacttaatgtattta

SEQ ID NO: 8369330 - DNA, 23 bp, Homo sapiens
actttcccatagcatggcttcct

SEQ ID NO: 8369331 - DNA, 23 bp, Homo sapiens
actttcccatagcatggcttcct

SEQ ID NO: 8369332 - DNA, 22 bp, Homo sapiens
actttccctctcagaactctta

SEQ ID NO: 8369333 - DNA, 22 bp, Homo sapiens
actttctattcccacagagata

SEQ ID NO: 8369334 - DNA, 22 bp, Homo sapiens
actttctcaaatcagactttaa

SEQ ID NO: 8369335 - DNA, 22 bp, Homo sapiens
actttctcaaatcagactttaa

SEQ ID NO: 8369336 - DNA, 22 bp, Homo sapiens
actttcagaattgtacagagtc

SEQ ID NO: 8369337 - DNA, 22 bp, Homo sapiens
actttcagaattgtacagagtc

SEQ ID NO: 8369338 - DNA, 22 bp, Homo sapiens
actttcaagcaagaacactttg

SEQ ID NO: 8369339 - DNA, 22 bp, Homo sapiens
actttcatgttcatttggaacc

SEQ ID NO: 8369340 - DNA, 22 bp, Homo sapiens
atatgaaagtaagcatgtgtgt

SEQ ID NO: 8369341 - DNA, 22 bp, Homo sapiens
atatgaaagtaagcatgtgtgt

SEQ ID NO: 8369342 - DNA, 22 bp, Homo sapiens
actttctcaggaattcacagac

SEQ ID NO: 8369343 - DNA, 22 bp, Homo sapiens
actttctcaggaattcacagac

SEQ ID NO: 8369344 - DNA, 22 bp, Homo sapiens
atatgcttgactctttcacatc

SEQ ID NO: 8369345 - DNA, 22 bp, Homo sapiens
atatgcttatgatgtctcaagt

SEQ ID NO: 8369346 - DNA, 22 bp, Homo sapiens
atatgcttacactacaagatga

SEQ ID NO: 8369347 - DNA, 22 bp, Homo sapiens
atatgcttacagcttaaaatcc

SEQ ID NO: 8369348 - DNA, 22 bp, Homo sapiens
atatgcttacagcttaaaatcc

SEQ ID NO: 8369349 - DNA, 22 bp, Homo sapiens
agaaaaggttgaaagtaggatt

SEQ ID NO: 8369350 - DNA, 22 bp, Homo sapiens
atatgcttgggactgatacagt

SEQ ID NO: 8369351 - DNA, 22 bp, Homo sapiens
agtgtacagttctatgaatttc

SEQ ID NO: 8369352 - DNA, 22 bp, Homo sapiens
actgcacttcagcctgggtgtc

SEQ ID NO: 8369353 - DNA, 22 bp, Homo sapiens
actgcactttaggccaactagg

SEQ ID NO: 8369354 - DNA, 22 bp, Homo sapiens
actgcagcaaagcccgtgtctt

SEQ ID NO: 8369355 - DNA, 22 bp, Homo sapiens
agtggcagtggctgggcagagc

SEQ ID NO: 8369356 - DNA, 22 bp, Homo sapiens
agtggcagtagatgagctggtt

SEQ ID NO: 8369357 - DNA, 22 bp, Homo sapiens
agtggcagtggaaagcacacgg

SEQ ID NO: 8369358 - DNA, 22 bp, Homo sapiens
actgcacttcagcctgggtgac

SEQ ID NO: 8369359 - DNA, 22 bp, Homo sapiens
agtggcagtagatgagctggtt

SEQ ID NO: 8369360 - DNA, 22 bp, Homo sapiens
agtggcagtagatgagctggtt

SEQ ID NO: 8369361 - DNA, 22 bp, Homo sapiens
agtggcaggtgtttcgtggtgc

SEQ ID NO: 8369362 - DNA, 22 bp, Homo sapiens
agtggcagtaacattccacaat

SEQ ID NO: 8369363 - DNA, 21 bp, Homo sapiens
actgagggccagagaggacct

SEQ ID NO: 8369364 - DNA, 21 bp, Homo sapiens
actgagggccagagaggacct

SEQ ID NO: 8369365 - DNA, 22 bp, Homo sapiens
agtggcagagctgggatttggg

SEQ ID NO: 8369366 - DNA, 22 bp, Homo sapiens
agtggcagggctggctgctgca

SEQ ID NO: 8369367 - DNA, 22 bp, Homo sapiens
agtgttctttgcatgaggatag

SEQ ID NO: 8369368 - DNA, 22 bp, Homo sapiens
actggctttgggttgccgcaga

SEQ ID NO: 8369369 - DNA, 22 bp, Homo sapiens
actggctttgagggaatagcta

SEQ ID NO: 8369370 - DNA, 23 bp, Homo sapiens
actgctttattcatgaggctctc

SEQ ID NO: 8369371 - DNA, 22 bp, Homo sapiens
actgctttatctgagaagtcct

SEQ ID NO: 8369372 - DNA, 22 bp, Homo sapiens
agtgtatgcaggttttcaatgt

SEQ ID NO: 8369373 - DNA, 21 bp, Homo sapiens
actggaagtgggtcaggaagt

SEQ ID NO: 8369374 - DNA, 22 bp, Homo sapiens
actgcttttctaagattctgtg

SEQ ID NO: 8369375 - DNA, 22 bp, Homo sapiens
actgaggacagtgaggagggct

SEQ ID NO: 8369376 - DNA, 22 bp, Homo sapiens
actgagctgtgacaatgcttaa

SEQ ID NO: 8369377 - DNA, 22 bp, Homo sapiens
actgagctgcttgaagtgaact

SEQ ID NO: 8369378 - DNA, 22 bp, Homo sapiens
actgagggccaaaggcactgag

SEQ ID NO: 8369379 - DNA, 22 bp, Homo sapiens
actgaggctagattgctgttct

SEQ ID NO: 8369380 - DNA, 22 bp, Homo sapiens
actgagctgcaagtcagggagg

SEQ ID NO: 8369381 - DNA, 20 bp, Homo sapiens
actgagctgcatggagagga

SEQ ID NO: 8369382 - DNA, 22 bp, Homo sapiens
actgagctctgatgagatttgg

SEQ ID NO: 8369383 - DNA, 22 bp, Homo sapiens
actgagctcttgactgggagtt

SEQ ID NO: 8369384 - DNA, 22 bp, Homo sapiens
actcttactccctcaggcactg

SEQ ID NO: 8369385 - DNA, 23 bp, Homo sapiens
actctgtaggctgtccatgtgca

SEQ ID NO: 8369386 - DNA, 22 bp, Homo sapiens
actcttcagtacaataatatct

SEQ ID NO: 8369387 - DNA, 22 bp, Homo sapiens
actcttcaccgctactgaaata

SEQ ID NO: 8369388 - DNA, 22 bp, Homo sapiens
agtgcaattttgctttcccaat

SEQ ID NO: 8369389 - DNA, 18 bp, Homo sapiens
agtctttaaagatgttac

SEQ ID NO: 8369390 - DNA, 22 bp, Homo sapiens
agtctttacatgtgttatatat

SEQ ID NO: 8369391 - DNA, 22 bp, Homo sapiens
agtctttaagtaatgataggca

SEQ ID NO: 8369392 - DNA, 22 bp, Homo sapiens
actcgtgtcaagatcctaagtc

SEQ ID NO: 8369393 - DNA, 22 bp, Homo sapiens
agtcttctgggtgtttccagag

SEQ ID NO: 8369394 - DNA, 22 bp, Homo sapiens
agtcttctttgtgttctctcat

SEQ ID NO: 8369395 - DNA, 22 bp, Homo sapiens
agtcttctttcatttactcagt

SEQ ID NO: 8369396 - DNA, 22 bp, Homo sapiens
agtcttcttgatcttttcagtg

SEQ ID NO: 8369397 - DNA, 22 bp, Homo sapiens
agtcttctttcatttactcagt

SEQ ID NO: 8369398 - DNA, 22 bp, Homo sapiens
agtcttcttgatcttttcagtg

SEQ ID NO: 8369399 - DNA, 22 bp, Homo sapiens
agtcccagtgacttggccagaa

SEQ ID NO: 8369400 - DNA, 22 bp, Homo sapiens
agtcccagtgagatgaaccagg

SEQ ID NO: 8369401 - DNA, 22 bp, Homo sapiens
agtcccagtgagatgagccacg

SEQ ID NO: 8369402 - DNA, 22 bp, Homo sapiens
agtcccagttcggttcttcctc

SEQ ID NO: 8369403 - DNA, 22 bp, Homo sapiens
actcctgggttccggagattct

SEQ ID NO: 8369404 - DNA, 22 bp, Homo sapiens
actcctgggttctaaatttgaa

SEQ ID NO: 8369405 - DNA, 20 bp, Homo sapiens
actcctggtaacttttgtga

SEQ ID NO: 8369406 - DNA, 22 bp, Homo sapiens
actcctgggttgcagtcctcaa

SEQ ID NO: 8369407 - DNA, 17 bp, Homo sapiens
actcctggtctgaaggg

SEQ ID NO: 8369408 - DNA, 22 bp, Homo sapiens
actcctggtgctgatgaagaga

SEQ ID NO: 8369409 - DNA, 22 bp, Homo sapiens
actcctggttcccagttgagat

SEQ ID NO: 8369410 - DNA, 22 bp, Homo sapiens
actcctggtttgtgtcctggct

SEQ ID NO: 8369411 - DNA, 21 bp, Homo sapiens
actagctttctggagaagtgt

SEQ ID NO: 8369412 - DNA, 22 bp, Homo sapiens
actaggaattcaagtagacaga

SEQ ID NO: 8369413 - DNA, 22 bp, Homo sapiens
agtattttcaaccatagcctgg

SEQ ID NO: 8369414 - DNA, 22 bp, Homo sapiens
agtattttcgccatcacaagaa

SEQ ID NO: 8369415 - DNA, 22 bp, Homo sapiens
agtcaaagatgaccgagttcct

SEQ ID NO: 8369416 - DNA, 22 bp, Homo sapiens
actcaggaaatgagaggctctc

SEQ ID NO: 8369417 - DNA, 22 bp, Homo sapiens
actcaggaagaaagcagctggt

SEQ ID NO: 8369418 - DNA, 22 bp, Homo sapiens
agtcaacagtttttgatgtaaa

SEQ ID NO: 8369419 - DNA, 22 bp, Homo sapiens
agtcccagctcagaaccactag

SEQ ID NO: 8369420 - DNA, 22 bp, Homo sapiens
agtcccagctctgccacttact

SEQ ID NO: 8369421 - DNA, 22 bp, Homo sapiens
agtcccagcttcccccatgcag

SEQ ID NO: 8369422 - DNA, 19 bp, Homo sapiens
actcaggcttcctctgagg

SEQ ID NO: 8369423 - DNA, 22 bp, Homo sapiens
agtccaggcgggtatagaggct

SEQ ID NO: 8369424 - DNA, 22 bp, Homo sapiens
actcaggctacaacgcgtggct

SEQ ID NO: 8369425 - DNA, 21 bp, Homo sapiens
actcaggcaccaggggatggc

SEQ ID NO: 8369426 - DNA, 22 bp, Homo sapiens
actcaggagggatcagctatca

SEQ ID NO: 8369427 - DNA, 22 bp, Homo sapiens
acgcccggtctccatagttttt

SEQ ID NO: 8369428 - DNA, 22 bp, Homo sapiens
acgcagtttgtggacatttttt

SEQ ID NO: 8369429 - DNA, 20 bp, Homo sapiens
aggtggctcctgctgggggt

SEQ ID NO: 8369430 - DNA, 22 bp, Homo sapiens
aggtggctcctcccatggctgg

SEQ ID NO: 8369431 - DNA, 22 bp, Homo sapiens
aggtggctcctcccatggctgg

SEQ ID NO: 8369432 - DNA, 22 bp, Homo sapiens
aggttctttgtagtgtcattgg

SEQ ID NO: 8369433 - DNA, 22 bp, Homo sapiens
agtaaaatcaccatctctttgt

SEQ ID NO: 8369434 - DNA, 22 bp, Homo sapiens
agtaaaattaatggatcagaag

SEQ ID NO: 8369435 - DNA, 22 bp, Homo sapiens
agtaaaatcaccatctctttgt

SEQ ID NO: 8369436 - DNA, 22 bp, Homo sapiens
actagccaagttttacgactaa

SEQ ID NO: 8369437 - DNA, 22 bp, Homo sapiens
actagattttggccattataca

SEQ ID NO: 8369438 - DNA, 22 bp, Homo sapiens
aggtggagacccagagaaggcg

SEQ ID NO: 8369439 - DNA, 20 bp, Homo sapiens
acctggctctcaggagcaac

SEQ ID NO: 8369440 - DNA, 22 bp, Homo sapiens
acctggcactacaggcacctgt

SEQ ID NO: 8369441 - DNA, 22 bp, Homo sapiens
aggtggctatgaggatgcagtc

SEQ ID NO: 8369442 - DNA, 22 bp, Homo sapiens
aggtggctcccagtgttgttgt

SEQ ID NO: 8369443 - DNA, 22 bp, Homo sapiens
aggtggcatttacaccatggga

SEQ ID NO: 8369444 - DNA, 20 bp, Homo sapiens
aggtctcagagcaagagccc

SEQ ID NO: 8369445 - DNA, 22 bp, Homo sapiens
aggtctcaaactggcaccctgt

SEQ ID NO: 8369446 - DNA, 19 bp, Homo sapiens
aggtccttggctggaagtt

SEQ ID NO: 8369447 - DNA, 22 bp, Homo sapiens
acctctgggcagcacctttgta

SEQ ID NO: 8369448 - DNA, 22 bp, Homo sapiens
acctctggccttcaggcatcat

SEQ ID NO: 8369449 - DNA, 22 bp, Homo sapiens
acctctgggaaaagtatggaaa

SEQ ID NO: 8369450 - DNA, 22 bp, Homo sapiens
acctctggccaagactcgtgtt

SEQ ID NO: 8369451 - DNA, 22 bp, Homo sapiens
acctcctgatgagagtaaagga

SEQ ID NO: 8369452 - DNA, 22 bp, Homo sapiens
acctgaattgtcatatcttatt

SEQ ID NO: 8369453 - DNA, 22 bp, Homo sapiens
acctgaatttgaaatgtttatt

SEQ ID NO: 8369454 - DNA, 22 bp, Homo sapiens
acctgaaaattattatttccgc

SEQ ID NO: 8369455 - DNA, 22 bp, Homo sapiens
acctgaaactcaactttatctc

SEQ ID NO: 8369456 - DNA, 22 bp, Homo sapiens
acctgaaaccaacttgtgtact

SEQ ID NO: 8369457 - DNA, 22 bp, Homo sapiens
acctcctgatgagagtaaagga

SEQ ID NO: 8369458 - DNA, 22 bp, Homo sapiens
acctcccttgctaaagactgtg

SEQ ID NO: 8369459 - DNA, 22 bp, Homo sapiens
accctccccaagaggtcgtgcc

SEQ ID NO: 8369460 - DNA, 22 bp, Homo sapiens
accctccaggctgcagctcctg

SEQ ID NO: 8369461 - DNA, 22 bp, Homo sapiens
acctgatatgtttgatcaccct

SEQ ID NO: 8369462 - DNA, 22 bp, Homo sapiens
acctgaggcctccccagcagac

SEQ ID NO: 8369463 - DNA, 22 bp, Homo sapiens
acctgagagctataaggtttta

SEQ ID NO: 8369464 - DNA, 22 bp, Homo sapiens
cagagaaactcagatagctgat

SEQ ID NO: 8369465 - DNA, 22 bp, Homo sapiens
cagagaaagaagcccattcatt

SEQ ID NO: 8369466 - DNA, 22 bp, Homo sapiens
cagagaaagaagcccattcatt

SEQ ID NO: 8369467 - DNA, 22 bp, Homo sapiens
cagacatgatgtaagcagaggc

SEQ ID NO: 8369468 - DNA, 22 bp, Homo sapiens
cagacatggaaatttagtgtta

SEQ ID NO: 8369469 - DNA, 22 bp, Homo sapiens
cagagaaaaaatcctgctctca

SEQ ID NO: 8369470 - DNA, 22 bp, Homo sapiens
cagagaaaaaatcctgctctca

SEQ ID NO: 8369471 - DNA, 22 bp, Homo sapiens
cagagaaaaaatcctgctctca

SEQ ID NO: 8369472 - DNA, 22 bp, Homo sapiens
cagacttttgggaggtctgtgg

SEQ ID NO: 8369473 - DNA, 22 bp, Homo sapiens
cagagaaagggtgaattccttc

SEQ ID NO: 8369474 - DNA, 22 bp, Homo sapiens
cagagaaagggtgaattccttc

SEQ ID NO: 8369475 - DNA, 22 bp, Homo sapiens
cagagaaagacttgcccttagt

SEQ ID NO: 8369476 - DNA, 22 bp, Homo sapiens
agcccaaggcttccctgctggc

SEQ ID NO: 8369477 - DNA, 22 bp, Homo sapiens
agcccagagggtagcagaagaa

SEQ ID NO: 8369478 - DNA, 22 bp, Homo sapiens
agcccagataaagtacaaccat

SEQ ID NO: 8369479 - DNA, 22 bp, Homo sapiens
agcccagcactgggggcccagc

SEQ ID NO: 8369480 - DNA, 22 bp, Homo sapiens
agcccagcagaaagtccagcct

SEQ ID NO: 8369481 - DNA, 22 bp, Homo sapiens
agcccagcaaaggggtttgaga

SEQ ID NO: 8369482 - DNA, 22 bp, Homo sapiens
agcccagcaaagggaggttcag

SEQ ID NO: 8369483 - DNA, 22 bp, Homo sapiens
agcccagcccgggctgcgcttt

SEQ ID NO: 8369484 - DNA, 22 bp, Homo sapiens
agcccagccactattaaatgtt

SEQ ID NO: 8369485 - DNA, 23 bp, Homo sapiens
agcccagcagagaacctaggtcc

SEQ ID NO: 8369486 - DNA, 22 bp, Homo sapiens
agcccagcagtaagattagaga

SEQ ID NO: 8369487 - DNA, 18 bp, Homo sapiens
agcccaggcatcgtctgc

SEQ ID NO: 8369488 - DNA, 22 bp, Homo sapiens
agcccagggaaccaggaagtgg

SEQ ID NO: 8369489 - DNA, 22 bp, Homo sapiens
agcccagggaaccaggaagtgg

SEQ ID NO: 8369490 - DNA, 22 bp, Homo sapiens
cagaggctcttcctcactgccc

SEQ ID NO: 8369491 - DNA, 22 bp, Homo sapiens
cagagggagccctccaggagca

SEQ ID NO: 8369492 - DNA, 22 bp, Homo sapiens
cagagggagccctccaggagca

SEQ ID NO: 8369493 - DNA, 23 bp, Homo sapiens
cagaggcatcggattcaacatca

SEQ ID NO: 8369494 - DNA, 22 bp, Homo sapiens
cagaggcatactcccagtcttg

SEQ ID NO: 8369495 - DNA, 22 bp, Homo sapiens
cagaggcatactcccagtcttg

SEQ ID NO: 8369496 - DNA, 22 bp, Homo sapiens
cagaggcatactcccagtcttg

SEQ ID NO: 8369497 - DNA, 20 bp, Homo sapiens
cagaggcattttcagactct

SEQ ID NO: 8369498 - DNA, 22 bp, Homo sapiens
agcccaggcagagggatgcttg

SEQ ID NO: 8369499 - DNA, 22 bp, Homo sapiens
agcccaggcagagggatgcttg

SEQ ID NO: 8369500 - DNA, 21 bp, Homo sapiens
cagaggcaggtcctgggacgg

SEQ ID NO: 8369501 - DNA, 22 bp, Homo sapiens
agcccagccggattcccagttc

SEQ ID NO: 8369502 - DNA, 22 bp, Homo sapiens
cagaggagttcagtacacagcc

SEQ ID NO: 8369503 - DNA, 21 bp, Homo sapiens
cagaggcaggtcctgggacgg

SEQ ID NO: 8369504 - DNA, 21 bp, Homo sapiens
cagaggcaggctctgtgtgtg

SEQ ID NO: 8369505 - DNA, 22 bp, Homo sapiens
agccagagactgtgtctgtaat

SEQ ID NO: 8369506 - DNA, 22 bp, Homo sapiens
agccagacatggctcctgctcc

SEQ ID NO: 8369507 - DNA, 22 bp, Homo sapiens
cagacaggtagggacagaacat

SEQ ID NO: 8369508 - DNA, 22 bp, Homo sapiens
cagacatgatgtaagcagaggc

SEQ ID NO: 8369509 - DNA, 21 bp, Homo sapiens
cagacatgagtctcagctttg

SEQ ID NO: 8369510 - DNA, 21 bp, Homo sapiens
cagacatgagtctcagctttg

SEQ ID NO: 8369511 - DNA, 22 bp, Homo sapiens
cagacatgagatacagctgcta

SEQ ID NO: 8369512 - DNA, 22 bp, Homo sapiens
cagaatgtagatcatcatcaag

SEQ ID NO: 8369513 - DNA, 22 bp, Homo sapiens
cagaatggcttttatggctcag

SEQ ID NO: 8369514 - DNA, 22 bp, Homo sapiens
cagaatgtatatgatctaaggt

SEQ ID NO: 8369515 - DNA, 22 bp, Homo sapiens
cagaatgtatatgatctaaggt

SEQ ID NO: 8369516 - DNA, 23 bp, Homo sapiens
agccacttctatcttgctcctgg

SEQ ID NO: 8369517 - DNA, 22 bp, Homo sapiens
agccactttagataccatctta

SEQ ID NO: 8369518 - DNA, 22 bp, Homo sapiens
cagaataccctatagacagaat

SEQ ID NO: 8369519 - DNA, 22 bp, Homo sapiens
cagaatctcgacttctggcccc

SEQ ID NO: 8369520 - DNA, 22 bp, Homo sapiens
agccacatggacctgatgctag

SEQ ID NO: 8369521 - DNA, 22 bp, Homo sapiens
agccacatgagtgagccatctt

SEQ ID NO: 8369522 - DNA, 22 bp, Homo sapiens
agccacagtgcaagagagaaaa

SEQ ID NO: 8369523 - DNA, 22 bp, Homo sapiens
agccactcagtgctgtattgac

SEQ ID NO: 8369524 - DNA, 22 bp, Homo sapiens
agccaccttcacatggtctatc

SEQ ID NO: 8369525 - DNA, 22 bp, Homo sapiens
agccacctctgtgcaggcctcg

SEQ ID NO: 8369526 - DNA, 22 bp, Homo sapiens
agccaccctaccagccctgaaa

SEQ ID NO: 8369527 - DNA, 22 bp, Homo sapiens
agccacaggaaacagagacagc

SEQ ID NO: 8369528 - DNA, 22 bp, Homo sapiens
agcatagttaatacttttggta

SEQ ID NO: 8369529 - DNA, 22 bp, Homo sapiens
agcatataaatggacatatttg

SEQ ID NO: 8369530 - DNA, 22 bp, Homo sapiens
agcataggttttccggtgtgcc

SEQ ID NO: 8369531 - DNA, 22 bp, Homo sapiens
agcatatacaaactcatataca

SEQ ID NO: 8369532 - DNA, 22 bp, Homo sapiens
cagaaatatgtgccatgcctta

SEQ ID NO: 8369533 - DNA, 22 bp, Homo sapiens
cagaataccctatagacagaat

SEQ ID NO: 8369534 - DNA, 22 bp, Homo sapiens
cagaataagctgtgttgtcaag

SEQ ID NO: 8369535 - DNA, 22 bp, Homo sapiens
cagaaatatcagttgaaagtgc

SEQ ID NO: 8369536 - DNA, 22 bp, Homo sapiens
cagaaatatcacctggactcta

SEQ ID NO: 8369537 - DNA, 22 bp, Homo sapiens
cagaaatatcagttgaaagtgc

SEQ ID NO: 8369538 - DNA, 22 bp, Homo sapiens
agccactgtctgaacttctgtg

SEQ ID NO: 8369539 - DNA, 22 bp, Homo sapiens
agctcagagataatcaagagac

SEQ ID NO: 8369540 - DNA, 22 bp, Homo sapiens
agctcagagataatcaagagac

SEQ ID NO: 8369541 - DNA, 22 bp, Homo sapiens
cagctcagtctggagagatgca

SEQ ID NO: 8369542 - DNA, 22 bp, Homo sapiens
cagctcagtctggagagatgca

SEQ ID NO: 8369543 - DNA, 22 bp, Homo sapiens
cagctcaggctctccatgctcc

SEQ ID NO: 8369544 - DNA, 22 bp, Homo sapiens
cagcgtctcgttgtgggcctcg

SEQ ID NO: 8369545 - DNA, 22 bp, Homo sapiens
agctcaggcaactctgggcccc

SEQ ID NO: 8369546 - DNA, 23 bp, Homo sapiens
agctcctgaggccagcctctcct

SEQ ID NO: 8369547 - DNA, 23 bp, Homo sapiens
agctcctgaggccagcctctcct

SEQ ID NO: 8369548 - DNA, 22 bp, Homo sapiens
agctcctgatacatgcaggaat

SEQ ID NO: 8369549 - DNA, 22 bp, Homo sapiens
agctcctgattctcagagatag

SEQ ID NO: 8369550 - DNA, 22 bp, Homo sapiens
agctcctgatacatgcaggaat

SEQ ID NO: 8369551 - DNA, 22 bp, Homo sapiens
agctcctgattctcagagatag

SEQ ID NO: 8369552 - DNA, 22 bp, Homo sapiens
cagctcattcctcaatctagga

SEQ ID NO: 8369553 - DNA, 22 bp, Homo sapiens
cagctcagtttcaataccaggt

SEQ ID NO: 8369554 - DNA, 22 bp, Homo sapiens
cagctcagtcttgaagcactgg

SEQ ID NO: 8369555 - DNA, 22 bp, Homo sapiens
agctcctgaaaatccagactgg

SEQ ID NO: 8369556 - DNA, 22 bp, Homo sapiens
cagccctgcacgctgcctccgc

SEQ ID NO: 8369557 - DNA, 22 bp, Homo sapiens
cagccctgcagagggcgctcct

SEQ ID NO: 8369558 - DNA, 22 bp, Homo sapiens
cagccctgcagagggcgctcct

SEQ ID NO: 8369559 - DNA, 16 bp, Homo sapiens
cagccctgaggaagaa

SEQ ID NO: 8369560 - DNA, 22 bp, Homo sapiens
cagccctgagttagcccacgga

SEQ ID NO: 8369561 - DNA, 22 bp, Homo sapiens
cagccctgagttagcccacgga

SEQ ID NO: 8369562 - DNA, 22 bp, Homo sapiens
cagccctgcacgctgcctccgc

SEQ ID NO: 8369563 - DNA, 22 bp, Homo sapiens
cagccctgagaaggaggatctc

SEQ ID NO: 8369564 - DNA, 22 bp, Homo sapiens
cagccctgagagaaccatctat

SEQ ID NO: 8369565 - DNA, 22 bp, Homo sapiens
cagccctgagagaaccatctat

SEQ ID NO: 8369566 - DNA, 22 bp, Homo sapiens
cagccctgagcaaggcttttaa

SEQ ID NO: 8369567 - DNA, 22 bp, Homo sapiens
cagccccatggtgtgctccagc

SEQ ID NO: 8369568 - DNA, 23 bp, Homo sapiens
cagccctgaaatcgaggtgacac

SEQ ID NO: 8369569 - DNA, 21 bp, Homo sapiens
cagcagtgtgtctgagctaga

SEQ ID NO: 8369570 - DNA, 22 bp, Homo sapiens
cagcagttcacacttaacaagt

SEQ ID NO: 8369571 - DNA, 22 bp, Homo sapiens
cagcagttatgagtagaatagt

SEQ ID NO: 8369572 - DNA, 22 bp, Homo sapiens
cagcagtgtggaagctgagggg

SEQ ID NO: 8369573 - DNA, 22 bp, Homo sapiens
cagcagtgtggaagctgagggg

SEQ ID NO: 8369574 - DNA, 22 bp, Homo sapiens
cagcagtgtggaagctgagggg

SEQ ID NO: 8369575 - DNA, 22 bp, Homo sapiens
cagcagttcaggctccttcccg

SEQ ID NO: 8369576 - DNA, 22 bp, Homo sapiens
cagcataggatgtggagccagg

SEQ ID NO: 8369577 - DNA, 22 bp, Homo sapiens
cagcataggatgtggagccagg

SEQ ID NO: 8369578 - DNA, 22 bp, Homo sapiens
cagcaggggaactgtgggccag

SEQ ID NO: 8369579 - DNA, 22 bp, Homo sapiens
cagcagggggcagcgcagatca

SEQ ID NO: 8369580 - DNA, 22 bp, Homo sapiens
cagcagggtatacagggaattt

SEQ ID NO: 8369581 - DNA, 22 bp, Homo sapiens
cagcagtgtctccagcatcaca

SEQ ID NO: 8369582 - DNA, 22 bp, Homo sapiens
cagcagtgtgcaggtgtgctgg

SEQ ID NO: 8369583 - DNA, 22 bp, Homo sapiens
cagaggtgcatacaggtcatta

SEQ ID NO: 8369584 - DNA, 22 bp, Homo sapiens
agcctccctatgcaccttcagg

SEQ ID NO: 8369585 - DNA, 22 bp, Homo sapiens
agcctccctatgcaccttcagg

SEQ ID NO: 8369586 - DNA, 22 bp, Homo sapiens
cagaggtctgacactgaatggt

SEQ ID NO: 8369587 - DNA, 22 bp, Homo sapiens
cagagggccccctggccacagt

SEQ ID NO: 8369588 - DNA, 22 bp, Homo sapiens
cagaggtagggttggcccagga

SEQ ID NO: 8369589 - DNA, 22 bp, Homo sapiens
cagaggtattttgataaacgcc

SEQ ID NO: 8369590 - DNA, 22 bp, Homo sapiens
cagagggcacatggtttcctca

SEQ ID NO: 8369591 - DNA, 22 bp, Homo sapiens
cagagggagtttctgaggttgc

SEQ ID NO: 8369592 - DNA, 22 bp, Homo sapiens
cagagggagtttctgaggttgc

SEQ ID NO: 8369593 - DNA, 22 bp, Homo sapiens
agcctctgcacttcttacaggt

SEQ ID NO: 8369594 - DNA, 22 bp, Homo sapiens
agcctctgcacttcttacaggt

SEQ ID NO: 8369595 - DNA, 22 bp, Homo sapiens
agcctctgctggccctggcact

SEQ ID NO: 8369596 - DNA, 22 bp, Homo sapiens
agcctctgctggccctggcact

SEQ ID NO: 8369597 - DNA, 22 bp, Homo sapiens
agcctctggtcctccctcagct

SEQ ID NO: 8369598 - DNA, 22 bp, Homo sapiens
agcctctggccctagactgctt

SEQ ID NO: 8369599 - DNA, 22 bp, Homo sapiens
agcctctgtgactcacaggtca

SEQ ID NO: 8369600 - DNA, 22 bp, Homo sapiens
agcctctgtcaagcttttcaaa

SEQ ID NO: 8369601 - DNA, 22 bp, Homo sapiens
agcctctgtagaaagcagtgtg

SEQ ID NO: 8369602 - DNA, 22 bp, Homo sapiens
agcctctgtagaaagcagtgtg

SEQ ID NO: 8369603 - DNA, 22 bp, Homo sapiens
agcctggatccatgtggctacc

SEQ ID NO: 8369604 - DNA, 22 bp, Homo sapiens
cagcagctgatggggaagtgat

SEQ ID NO: 8369605 - DNA, 22 bp, Homo sapiens
cagcagggcccccgggtgcgcc

SEQ ID NO: 8369606 - DNA, 22 bp, Homo sapiens
cagcagggcccccgggtgcgcc

SEQ ID NO: 8369607 - DNA, 22 bp, Homo sapiens
cagcaggatatggtggagagag

SEQ ID NO: 8369608 - DNA, 22 bp, Homo sapiens
agcctggcactgaggcagggcg

SEQ ID NO: 8369609 - DNA, 22 bp, Homo sapiens
cagcagcattgctctggattcc

SEQ ID NO: 8369610 - DNA, 22 bp, Homo sapiens
cagcagctcaggctgcttccca

SEQ ID NO: 8369611 - DNA, 22 bp, Homo sapiens
cagcagctcagtctctcagtag

SEQ ID NO: 8369612 - DNA, 22 bp, Homo sapiens
cagcagctcctctgcggctatg

SEQ ID NO: 8369613 - DNA, 22 bp, Homo sapiens
agcagcaggagccgtggggtga

SEQ ID NO: 8369614 - DNA, 22 bp, Homo sapiens
caagcagagaagtctctaggct

SEQ ID NO: 8369615 - DNA, 22 bp, Homo sapiens
caagcagagactagatagctgt

SEQ ID NO: 8369616 - DNA, 22 bp, Homo sapiens
caagcagagaggtcaactaata

SEQ ID NO: 8369617 - DNA, 20 bp, Homo sapiens
agcagcagatgttggaggtg

SEQ ID NO: 8369618 - DNA, 22 bp, Homo sapiens
agcagcagattatggtctacat

SEQ ID NO: 8369619 - DNA, 22 bp, Homo sapiens
agcagcaggctgtgtggactga

SEQ ID NO: 8369620 - DNA, 22 bp, Homo sapiens
agcagcaggctagggaactgct

SEQ ID NO: 8369621 - DNA, 22 bp, Homo sapiens
agcagcaggattttcgttggga

SEQ ID NO: 8369622 - DNA, 22 bp, Homo sapiens
agcagcaggctagggaactgct

SEQ ID NO: 8369623 - DNA, 22 bp, Homo sapiens
agcagcaggattttcgttggga

SEQ ID NO: 8369624 - DNA, 17 bp, Homo sapiens
caagagagatgactgga

SEQ ID NO: 8369625 - DNA, 22 bp, Homo sapiens
caagagcctttgggcagaagga

SEQ ID NO: 8369626 - DNA, 22 bp, Homo sapiens
caagcaacgactttcaagctgt

SEQ ID NO: 8369627 - DNA, 22 bp, Homo sapiens
caagcagaagcctcaggggcat

SEQ ID NO: 8369628 - DNA, 22 bp, Homo sapiens
caagcagaaatctagaactcca

SEQ ID NO: 8369629 - DNA, 22 bp, Homo sapiens
agcagccagaaatccagaggtg

SEQ ID NO: 8369630 - DNA, 22 bp, Homo sapiens
agcagccacccagctgctcatt

SEQ ID NO: 8369631 - DNA, 22 bp, Homo sapiens
agcagccaaggtaacctgtgct

SEQ ID NO: 8369632 - DNA, 22 bp, Homo sapiens
cacaaggcacattccttgtcca

SEQ ID NO: 8369633 - DNA, 22 bp, Homo sapiens
cacaaggccctgggtcaccaca

SEQ ID NO: 8369634 - DNA, 22 bp, Homo sapiens
cacaaggctttcatctggcata

SEQ ID NO: 8369635 - DNA, 22 bp, Homo sapiens
cacaaggctttcatctggcata

SEQ ID NO: 8369636 - DNA, 22 bp, Homo sapiens
cacaaggacctcagatggatga

SEQ ID NO: 8369637 - DNA, 22 bp, Homo sapiens
cacaaggactggatggagtggg

SEQ ID NO: 8369638 - DNA, 22 bp, Homo sapiens
cacaaggacctcagatggatga

SEQ ID NO: 8369639 - DNA, 22 bp, Homo sapiens
cacaaggactggatggagtggg

SEQ ID NO: 8369640 - DNA, 22 bp, Homo sapiens
cacaaggaggtcctgaggaagc

SEQ ID NO: 8369641 - DNA, 20 bp, Homo sapiens
cacaagaggagttccctgag

SEQ ID NO: 8369642 - DNA, 22 bp, Homo sapiens
agcagcagggcatgtcttactc

SEQ ID NO: 8369643 - DNA, 22 bp, Homo sapiens
agcagcagggcatgtcttactc

SEQ ID NO: 8369644 - DNA, 22 bp, Homo sapiens
agcagcaggcttaaggaaaagt

SEQ ID NO: 8369645 - DNA, 22 bp, Homo sapiens
cacaagaaataagctgcctttc

SEQ ID NO: 8369646 - DNA, 22 bp, Homo sapiens
cacaagagagtgcgcgttgcaa

SEQ ID NO: 8369647 - DNA, 20 bp, Homo sapiens
cacaagagaatacacactgg

SEQ ID NO: 8369648 - DNA, 22 bp, Homo sapiens
caattttttccatgctcttaca

SEQ ID NO: 8369649 - DNA, 22 bp, Homo sapiens
caattttttccatgctcttaca

SEQ ID NO: 8369650 - DNA, 22 bp, Homo sapiens
caattttttccatgctcttaca

SEQ ID NO: 8369651 - DNA, 22 bp, Homo sapiens
agcagcagggtcattgctcttt

SEQ ID NO: 8369652 - DNA, 22 bp, Homo sapiens
agcagcagggtcattgctcttt

SEQ ID NO: 8369653 - DNA, 22 bp, Homo sapiens
agcacattaagtgagttcatgt

SEQ ID NO: 8369654 - DNA, 22 bp, Homo sapiens
caaattaatgtgtctcaaaata

SEQ ID NO: 8369655 - DNA, 22 bp, Homo sapiens
agcaccagcaactatgggctgc

SEQ ID NO: 8369656 - DNA, 22 bp, Homo sapiens
agcacatttaagtatgaaatat

SEQ ID NO: 8369657 - DNA, 22 bp, Homo sapiens
agcacattcttgccttaacctc

SEQ ID NO: 8369658 - DNA, 22 bp, Homo sapiens
agcacattttctcaaagctcat

SEQ ID NO: 8369659 - DNA, 22 bp, Homo sapiens
agcacattttctcaaagctcat

SEQ ID NO: 8369660 - DNA, 22 bp, Homo sapiens
caagacaatgggtaagtgtaac

SEQ ID NO: 8369661 - DNA, 22 bp, Homo sapiens
agcacaggtgaaacagtcaggt

SEQ ID NO: 8369662 - DNA, 22 bp, Homo sapiens
agcaaagatgtccggggcaagc

SEQ ID NO: 8369663 - DNA, 22 bp, Homo sapiens
agcaaagcaccatatggcagtt

SEQ ID NO: 8369664 - DNA, 22 bp, Homo sapiens
agcaaagcagtggctaagctga

SEQ ID NO: 8369665 - DNA, 22 bp, Homo sapiens
agcaaagaaatggaggctcaga

SEQ ID NO: 8369666 - DNA, 22 bp, Homo sapiens
agcaaagacagggacgaccaag

SEQ ID NO: 8369667 - DNA, 22 bp, Homo sapiens
agcaaagaagggttcttcatta

SEQ ID NO: 8369668 - DNA, 22 bp, Homo sapiens
agcaaagaagggttcttcatta

SEQ ID NO: 8369669 - DNA, 19 bp, Homo sapiens
agcacagtttccacatgca

SEQ ID NO: 8369670 - DNA, 22 bp, Homo sapiens
agcacagttttcattgcagggt

SEQ ID NO: 8369671 - DNA, 22 bp, Homo sapiens
agcacaggtgaaacagtcaggt

SEQ ID NO: 8369672 - DNA, 22 bp, Homo sapiens
agcacagtaaagcagtgtcaca

SEQ ID NO: 8369673 - DNA, 22 bp, Homo sapiens
agcagctgcagggagggtctgc

SEQ ID NO: 8369674 - DNA, 22 bp, Homo sapiens
agcagctgcagggagggtctgc

SEQ ID NO: 8369675 - DNA, 22 bp, Homo sapiens
agcagctgcagagggctccccc

SEQ ID NO: 8369676 - DNA, 22 bp, Homo sapiens
cacacaaatattctggaggcaa

SEQ ID NO: 8369677 - DNA, 22 bp, Homo sapiens
agcaggagtttgatgcttttat

SEQ ID NO: 8369678 - DNA, 22 bp, Homo sapiens
agcaggcacaagaaagggaggt

SEQ ID NO: 8369679 - DNA, 22 bp, Homo sapiens
cacacactggagcaaggagatg

SEQ ID NO: 8369680 - DNA, 22 bp, Homo sapiens
cacacactgttaatgtaggagt

SEQ ID NO: 8369681 - DNA, 22 bp, Homo sapiens
cacagtgttccagagcagtggt

SEQ ID NO: 8369682 - DNA, 22 bp, Homo sapiens
cacagtcctacagagatcagag

SEQ ID NO: 8369683 - DNA, 22 bp, Homo sapiens
agcaggcaggaatggtggaaca

SEQ ID NO: 8369684 - DNA, 22 bp, Homo sapiens
agcaggcagcctaggaagtgaa

SEQ ID NO: 8369685 - DNA, 22 bp, Homo sapiens
agcaggcaggaaggcagcactg

SEQ ID NO: 8369686 - DNA, 22 bp, Homo sapiens
agcaggcagctgggggagttga

SEQ ID NO: 8369687 - DNA, 22 bp, Homo sapiens
agcaggcactatgccaggatct

SEQ ID NO: 8369688 - DNA, 22 bp, Homo sapiens
agcaggcactatgccaggatct

SEQ ID NO: 8369689 - DNA, 22 bp, Homo sapiens
agcaggcagccatttggaaggc

SEQ ID NO: 8369690 - DNA, 22 bp, Homo sapiens
cacagtttctgaacactttgca

SEQ ID NO: 8369691 - DNA, 22 bp, Homo sapiens
cacagtttctgaacactttgca

SEQ ID NO: 8369692 - DNA, 22 bp, Homo sapiens
cacagtttgcataggaaaaaca

SEQ ID NO: 8369693 - DNA, 22 bp, Homo sapiens
cacagtttctgaacactttgca

SEQ ID NO: 8369694 - DNA, 22 bp, Homo sapiens
cacagtttgggtctccggggca

SEQ ID NO: 8369695 - DNA, 22 bp, Homo sapiens
cacagtttggtatagaagtgat

SEQ ID NO: 8369696 - DNA, 22 bp, Homo sapiens
cacagtttggtatagaagtgat

SEQ ID NO: 8369697 - DNA, 22 bp, Homo sapiens
cacagtttggtatagaagtgat

SEQ ID NO: 8369698 - DNA, 22 bp, Homo sapiens
cacagtttctataggtcagaat

SEQ ID NO: 8369699 - DNA, 22 bp, Homo sapiens
cacagtttcaataattattctt

SEQ ID NO: 8369700 - DNA, 22 bp, Homo sapiens
cacagtttatgatctcagtgaa

SEQ ID NO: 8369701 - DNA, 22 bp, Homo sapiens
agcaggctgatgggcatgcttg

SEQ ID NO: 8369702 - DNA, 22 bp, Homo sapiens
agcaggctgatgggcatgcttg

SEQ ID NO: 8369703 - DNA, 17 bp, Homo sapiens
agcaggctgcagaggcc

SEQ ID NO: 8369704 - DNA, 20 bp, Homo sapiens
agcaggctgcagggtgaaat

SEQ ID NO: 8369705 - DNA, 22 bp, Homo sapiens
agcaggctccaggctggccatc

SEQ ID NO: 8369706 - DNA, 22 bp, Homo sapiens
agcaggctccttccttctctgg

SEQ ID NO: 8369707 - DNA, 22 bp, Homo sapiens
agcaggctgagcacccaggggg

SEQ ID NO: 8369708 - DNA, 22 bp, Homo sapiens
agcaggctccttccttctctgg

SEQ ID NO: 8369709 - DNA, 22 bp, Homo sapiens
cactgctacctctgcctcccgg

SEQ ID NO: 8369710 - DNA, 23 bp, Homo sapiens
cactgccttcagttgcttcacct

SEQ ID NO: 8369711 - DNA, 22 bp, Homo sapiens
cactgctcgctgcagcatggcc

SEQ ID NO: 8369712 - DNA, 22 bp, Homo sapiens
agcatacaggtctgaaacagct

SEQ ID NO: 8369713 - DNA, 22 bp, Homo sapiens
cactgctttaaggctgagtaac

SEQ ID NO: 8369714 - DNA, 22 bp, Homo sapiens
agcatacaccctaaactgctta

SEQ ID NO: 8369715 - DNA, 22 bp, Homo sapiens
cactgcttctggaggaatttgg

SEQ ID NO: 8369716 - DNA, 22 bp, Homo sapiens
cacctgaatggaactttgaacc

SEQ ID NO: 8369717 - DNA, 22 bp, Homo sapiens
cacctgagcactggggccgccc

SEQ ID NO: 8369718 - DNA, 22 bp, Homo sapiens
cacctgaagatttagagattga

SEQ ID NO: 8369719 - DNA, 22 bp, Homo sapiens
cacctctttgatttgaggcaag

SEQ ID NO: 8369720 - DNA, 22 bp, Homo sapiens
cacctcatggataagataaact

SEQ ID NO: 8369721 - DNA, 22 bp, Homo sapiens
cacctctgcctcaagcttccca

SEQ ID NO: 8369722 - DNA, 22 bp, Homo sapiens
cacctacttccaagagtttcca

SEQ ID NO: 8369723 - DNA, 22 bp, Homo sapiens
caccgcggagtgatggagaaac

SEQ ID NO: 8369724 - DNA, 22 bp, Homo sapiens
caccctttgctgctcttcctcc

SEQ ID NO: 8369725 - DNA, 22 bp, Homo sapiens
cacctagggtttcgcctttctt

SEQ ID NO: 8369726 - DNA, 22 bp, Homo sapiens
cacccaggctggagtgcagtgg

SEQ ID NO: 8369727 - DNA, 22 bp, Homo sapiens
cacccaggctggagtgcattgg

SEQ ID NO: 8369728 - DNA, 22 bp, Homo sapiens
cacccaggctggattgcagtgg

SEQ ID NO: 8369729 - DNA, 22 bp, Homo sapiens
caccctgtcagttgcaggatag

SEQ ID NO: 8369730 - DNA, 22 bp, Homo sapiens
agcaggggtaacagaaggaaag

SEQ ID NO: 8369731 - DNA, 22 bp, Homo sapiens
agcagggggagttagactagat

SEQ ID NO: 8369732 - DNA, 22 bp, Homo sapiens
agcagggggcatccttgccctt

SEQ ID NO: 8369733 - DNA, 22 bp, Homo sapiens
agcaggggctcctccacagcca

SEQ ID NO: 8369734 - DNA, 23 bp, Homo sapiens
agcaggctgcttctccacagctg

SEQ ID NO: 8369735 - DNA, 23 bp, Homo sapiens
agcaggctgcttctccacagctg

SEQ ID NO: 8369736 - DNA, 22 bp, Homo sapiens
agcagggctggggcacgagcca

SEQ ID NO: 8369737 - DNA, 22 bp, Homo sapiens
agcaggggtctctgctaatgaa

SEQ ID NO: 8369738 - DNA, 22 bp, Homo sapiens
agcagggtatgttagagctgta

SEQ ID NO: 8369739 - DNA, 22 bp, Homo sapiens
agcaggggtggaaggtagcttt

SEQ ID NO: 8369740 - DNA, 22 bp, Homo sapiens
agcaggggtggaaggtagcttt

SEQ ID NO: 8369741 - DNA, 22 bp, Homo sapiens
agcagggtatgttagagctgta

SEQ ID NO: 8369742 - DNA, 22 bp, Homo sapiens
agcagggtcctgaggtgagtca

SEQ ID NO: 8369743 - DNA, 22 bp, Homo sapiens
agcagggtcctgaggtgagtca

SEQ ID NO: 8369744 - DNA, 22 bp, Homo sapiens
cacccaggctggagtgcagtga

SEQ ID NO: 8369745 - DNA, 22 bp, Homo sapiens
cacccaggctggagtgcagtgg

SEQ ID NO: 8369746 - DNA, 22 bp, Homo sapiens
cacccaggctggagtgcagggg

SEQ ID NO: 8369747 - DNA, 22 bp, Homo sapiens
cacccaggctggagtgcagtga

SEQ ID NO: 8369748 - DNA, 22 bp, Homo sapiens
caccaggtggaaatgtcacagc

SEQ ID NO: 8369749 - DNA, 22 bp, Homo sapiens
cacccaggctggagagcagtgg

SEQ ID NO: 8369750 - DNA, 21 bp, Homo sapiens
agaggtctaagattctagctt

SEQ ID NO: 8369751 - DNA, 22 bp, Homo sapiens
attgctgactcaataattgaag

SEQ ID NO: 8369752 - DNA, 22 bp, Homo sapiens
attgcctgccactctgtgagga

SEQ ID NO: 8369753 - DNA, 22 bp, Homo sapiens
attgccatgctcatagggtcga

SEQ ID NO: 8369754 - DNA, 22 bp, Homo sapiens
attgccctagggctaagcagga

SEQ ID NO: 8369755 - DNA, 22 bp, Homo sapiens
attgccctctggctgacaggct

SEQ ID NO: 8369756 - DNA, 21 bp, Homo sapiens
attgctctgttgtgtctagaa

SEQ ID NO: 8369757 - DNA, 22 bp, Homo sapiens
agagttgctatagaaggatgga

SEQ ID NO: 8369758 - DNA, 22 bp, Homo sapiens
agagtttcttgtgagcactgac

SEQ ID NO: 8369759 - DNA, 22 bp, Homo sapiens
agagttctgtctgccacacgaa

SEQ ID NO: 8369760 - DNA, 21 bp, Homo sapiens
agagttcttgctgagcaagcc

SEQ ID NO: 8369761 - DNA, 21 bp, Homo sapiens
agagttcttgctgagcaagcc

SEQ ID NO: 8369762 - DNA, 22 bp, Homo sapiens
agagttctgaaattatctttac

SEQ ID NO: 8369763 - DNA, 22 bp, Homo sapiens
agagttctctctcatttgagct

SEQ ID NO: 8369764 - DNA, 22 bp, Homo sapiens
agaggtcttttggtctgcagaa

SEQ ID NO: 8369765 - DNA, 22 bp, Homo sapiens
agaggtgaaagaatttggctct

SEQ ID NO: 8369766 - DNA, 22 bp, Homo sapiens
agagtgggtgatctctgttgtc

SEQ ID NO: 8369767 - DNA, 22 bp, Homo sapiens
agataaacccaacttaatgaag

SEQ ID NO: 8369768 - DNA, 22 bp, Homo sapiens
agataaaatggttcaaaggcta

SEQ ID NO: 8369769 - DNA, 22 bp, Homo sapiens
agataaattcctaagatttcag

SEQ ID NO: 8369770 - DNA, 22 bp, Homo sapiens
agataaattcctaagatttcag

SEQ ID NO: 8369771 - DNA, 20 bp, Homo sapiens
agatacagtttaattactct

SEQ ID NO: 8369772 - DNA, 22 bp, Homo sapiens
atttcactctccctgccactta

SEQ ID NO: 8369773 - DNA, 22 bp, Homo sapiens
atttcactcttaattgcttcct

SEQ ID NO: 8369774 - DNA, 22 bp, Homo sapiens
atttcacattaatttgatgctc

SEQ ID NO: 8369775 - DNA, 22 bp, Homo sapiens
atttggcagtataaattctggc

SEQ ID NO: 8369776 - DNA, 22 bp, Homo sapiens
atttggcatagagtatcattct

SEQ ID NO: 8369777 - DNA, 22 bp, Homo sapiens
atttggcagtgaagggatcaca

SEQ ID NO: 8369778 - DNA, 18 bp, Homo sapiens
atttggcagatgatgaac

SEQ ID NO: 8369779 - DNA, 22 bp, Homo sapiens
atttggcagccacagcaatctt

SEQ ID NO: 8369780 - DNA, 20 bp, Homo sapiens
atttggcatgaagtattgat

SEQ ID NO: 8369781 - DNA, 20 bp, Homo sapiens
atttggcatgaagtattgat

SEQ ID NO: 8369782 - DNA, 22 bp, Homo sapiens
atttggcatagagtatcattct

SEQ ID NO: 8369783 - DNA, 20 bp, Homo sapiens
atttggcatagtttaagcaa

SEQ ID NO: 8369784 - DNA, 22 bp, Homo sapiens
atttggcataggcagaggccca

SEQ ID NO: 8369785 - DNA, 22 bp, Homo sapiens
atttggcacagcttttcctacc

SEQ ID NO: 8369786 - DNA, 22 bp, Homo sapiens
atttggcacactgggttctcgt

SEQ ID NO: 8369787 - DNA, 22 bp, Homo sapiens
atttggcaacattaattgaatc

SEQ ID NO: 8369788 - DNA, 22 bp, Homo sapiens
atttggcaatgctagagaagtt

SEQ ID NO: 8369789 - DNA, 22 bp, Homo sapiens
atttggcaaataatttgagggt

SEQ ID NO: 8369790 - DNA, 21 bp, Homo sapiens
atttggcaaaggcgatgcaca

SEQ ID NO: 8369791 - DNA, 22 bp, Homo sapiens
atttggcaaaaattagcagtag

SEQ ID NO: 8369792 - DNA, 22 bp, Homo sapiens
atttggcaaaagttagaagaaa

SEQ ID NO: 8369793 - DNA, 15 bp, Homo sapiens
atttggcatggcctc

SEQ ID NO: 8369794 - DNA, 22 bp, Homo sapiens
atttgtgataatttgttacagc

SEQ ID NO: 8369795 - DNA, 21 bp, Homo sapiens
caaaaggataggaaattaggg

SEQ ID NO: 8369796 - DNA, 22 bp, Homo sapiens
caaaagcagttctatctgagtt

SEQ ID NO: 8369797 - DNA, 22 bp, Homo sapiens
atttctcttagcaagacattac

SEQ ID NO: 8369798 - DNA, 22 bp, Homo sapiens
atttctcttagcaagacattac

SEQ ID NO: 8369799 - DNA, 18 bp, Homo sapiens
atttctctggggtgattc

SEQ ID NO: 8369800 - DNA, 22 bp, Homo sapiens
atttctctgcagtgttcggaat

SEQ ID NO: 8369801 - DNA, 22 bp, Homo sapiens
atttctctgcctcagcttctgc

SEQ ID NO: 8369802 - DNA, 22 bp, Homo sapiens
atttctctgcctcagcttctgc

SEQ ID NO: 8369803 - DNA, 22 bp, Homo sapiens
atttgcttttactatgttaaaa

SEQ ID NO: 8369804 - DNA, 22 bp, Homo sapiens
atttggaattctatttcagtag

SEQ ID NO: 8369805 - DNA, 17 bp, Homo sapiens
atttggaatttctcttc

SEQ ID NO: 8369806 - DNA, 17 bp, Homo sapiens
atttggaatttctcttc

SEQ ID NO: 8369807 - DNA, 22 bp, Homo sapiens
atttggagacaggatttttcag

SEQ ID NO: 8369808 - DNA, 22 bp, Homo sapiens
atttggatatcactgaatacat

SEQ ID NO: 8369809 - DNA, 22 bp, Homo sapiens
atttctcattaagatcttccaa

SEQ ID NO: 8369810 - DNA, 22 bp, Homo sapiens
atttctcatctttgtgaatggt

SEQ ID NO: 8369811 - DNA, 22 bp, Homo sapiens
atttccttcagtgtttaatact

SEQ ID NO: 8369812 - DNA, 22 bp, Homo sapiens
atttctccttgttgcaatgcag

SEQ ID NO: 8369813 - DNA, 22 bp, Homo sapiens
atttctctcattgttagctagg

SEQ ID NO: 8369814 - DNA, 22 bp, Homo sapiens
atttctctcattgttagctagg

SEQ ID NO: 8369815 - DNA, 22 bp, Homo sapiens
atttcctggtgtggaagtattt

SEQ ID NO: 8369816 - DNA, 22 bp, Homo sapiens
atttcctgttgcttttgccact

SEQ ID NO: 8369817 - DNA, 22 bp, Homo sapiens
atttcctgtacctatcaaggca

SEQ ID NO: 8369818 - DNA, 22 bp, Homo sapiens
atttcctgatctgtaaaatagc

SEQ ID NO: 8369819 - DNA, 22 bp, Homo sapiens
atttcctggaatgactagtggg

SEQ ID NO: 8369820 - DNA, 22 bp, Homo sapiens
atttcctatttcttgtccccta

SEQ ID NO: 8369821 - DNA, 22 bp, Homo sapiens
atttcctaggtgctcgagtgct

SEQ ID NO: 8369822 - DNA, 22 bp, Homo sapiens
atttcctatagatatggtgagt

SEQ ID NO: 8369823 - DNA, 22 bp, Homo sapiens
atttcctatcctggtcttaaaa

SEQ ID NO: 8369824 - DNA, 22 bp, Homo sapiens
atttcctatggatacaggcaga

SEQ ID NO: 8369825 - DNA, 22 bp, Homo sapiens
atttcctatacagttgtccata

SEQ ID NO: 8369826 - DNA, 22 bp, Homo sapiens
attccagatggcttcaagtaag

SEQ ID NO: 8369827 - DNA, 22 bp, Homo sapiens
agagggaaaaactcatgtcatt

SEQ ID NO: 8369828 - DNA, 17 bp, Homo sapiens
agagggaaaatgcggtt

SEQ ID NO: 8369829 - DNA, 18 bp, Homo sapiens
agagggaaagcaggctga

SEQ ID NO: 8369830 - DNA, 18 bp, Homo sapiens
agagggaaagcaggctga

SEQ ID NO: 8369831 - DNA, 22 bp, Homo sapiens
agagggaaatccaggagtgctt

SEQ ID NO: 8369832 - DNA, 22 bp, Homo sapiens
agagggaaatccaggagtgctt

SEQ ID NO: 8369833 - DNA, 18 bp, Homo sapiens
agagggaaagcaggctga

SEQ ID NO: 8369834 - DNA, 21 bp, Homo sapiens
agagggagagtggcccttcca

SEQ ID NO: 8369835 - DNA, 22 bp, Homo sapiens
attccagagaaaggcctggctg

SEQ ID NO: 8369836 - DNA, 22 bp, Homo sapiens
attccagacaggtaaattaggt

SEQ ID NO: 8369837 - DNA, 22 bp, Homo sapiens
attccagagaggttctggaggt

SEQ ID NO: 8369838 - DNA, 22 bp, Homo sapiens
attcatgtcatagcaggatttc

SEQ ID NO: 8369839 - DNA, 19 bp, Homo sapiens
attcattggccagggtggt

SEQ ID NO: 8369840 - DNA, 22 bp, Homo sapiens
attcatgttagcccacatgtag

SEQ ID NO: 8369841 - DNA, 20 bp, Homo sapiens
attcatgtctttataaaagc

SEQ ID NO: 8369842 - DNA, 17 bp, Homo sapiens
agaggcagatacttgga

SEQ ID NO: 8369843 - DNA, 22 bp, Homo sapiens
agaggcagcagtcatactacag

SEQ ID NO: 8369844 - DNA, 22 bp, Homo sapiens
agaggcaggaggttgacttgag

SEQ ID NO: 8369845 - DNA, 22 bp, Homo sapiens
agaggcagccgtatttcaaagg

SEQ ID NO: 8369846 - DNA, 22 bp, Homo sapiens
agaggcaggaagagctgatttt

SEQ ID NO: 8369847 - DNA, 22 bp, Homo sapiens
attcatttagagggattaagca

SEQ ID NO: 8369848 - DNA, 22 bp, Homo sapiens
attcatttagagggattaagca

SEQ ID NO: 8369849 - DNA, 22 bp, Homo sapiens
attcatttaggtattcacttac

SEQ ID NO: 8369850 - DNA, 22 bp, Homo sapiens
attcatttgctattgtgtatgg

SEQ ID NO: 8369851 - DNA, 22 bp, Homo sapiens
attcatttgctattgtgtatgg

SEQ ID NO: 8369852 - DNA, 22 bp, Homo sapiens
attcatttgctattgtgtatgg

SEQ ID NO: 8369853 - DNA, 22 bp, Homo sapiens
agaggaggaagagctttaaaat

SEQ ID NO: 8369854 - DNA, 22 bp, Homo sapiens
agaggagctgggaggccctcgt

SEQ ID NO: 8369855 - DNA, 22 bp, Homo sapiens
agaggaggctgggtccagataa

SEQ ID NO: 8369856 - DNA, 22 bp, Homo sapiens
attataggcttgagccaccgtg

SEQ ID NO: 8369857 - DNA, 22 bp, Homo sapiens
attattcaacacttgagaaatt

SEQ ID NO: 8369858 - DNA, 22 bp, Homo sapiens
agaggcactgttcttagcgact

SEQ ID NO: 8369859 - DNA, 22 bp, Homo sapiens
agaggcactcgggagtctgtgg

SEQ ID NO: 8369860 - DNA, 22 bp, Homo sapiens
agaggcagaagtgttcaaaccc

SEQ ID NO: 8369861 - DNA, 22 bp, Homo sapiens
attattattgttgatgttaggg

SEQ ID NO: 8369862 - DNA, 22 bp, Homo sapiens
attattattgttgatgttaggg

SEQ ID NO: 8369863 - DNA, 22 bp, Homo sapiens
attattatggttgctcttttcc

SEQ ID NO: 8369864 - DNA, 22 bp, Homo sapiens
attattaaagcttaggtcttat

SEQ ID NO: 8369865 - DNA, 22 bp, Homo sapiens
attattaaagcttaggtcttat

SEQ ID NO: 8369866 - DNA, 23 bp, Homo sapiens
attattaaggacatggactttgt

SEQ ID NO: 8369867 - DNA, 22 bp, Homo sapiens
attattaaagcttaggtcttat

SEQ ID NO: 8369868 - DNA, 23 bp, Homo sapiens
attattaaggacatggactttgt

SEQ ID NO: 8369869 - DNA, 22 bp, Homo sapiens
attattataaagtgcatgacct

SEQ ID NO: 8369870 - DNA, 22 bp, Homo sapiens
attattagtgatgttgttactg

SEQ ID NO: 8369871 - DNA, 22 bp, Homo sapiens
agagctggtttactcaggaatt

SEQ ID NO: 8369872 - DNA, 21 bp, Homo sapiens
agagctggtaggtaggtaggt

SEQ ID NO: 8369873 - DNA, 22 bp, Homo sapiens
atgtgtaggtgaatcgaggctg

SEQ ID NO: 8369874 - DNA, 22 bp, Homo sapiens
agagctgtggatagtcctggat

SEQ ID NO: 8369875 - DNA, 22 bp, Homo sapiens
atgtttactggtttatagaata

SEQ ID NO: 8369876 - DNA, 22 bp, Homo sapiens
atgtttatgacctccataagga

SEQ ID NO: 8369877 - DNA, 22 bp, Homo sapiens
atgtttatgcaaacatgtgagt

SEQ ID NO: 8369878 - DNA, 22 bp, Homo sapiens
atgtttatgcaaacatgtgagt

SEQ ID NO: 8369879 - DNA, 22 bp, Homo sapiens
atgtttatgcaaacatgtgagt

SEQ ID NO: 8369880 - DNA, 22 bp, Homo sapiens
atgtttatgcaaacatgtgagt

SEQ ID NO: 8369881 - DNA, 22 bp, Homo sapiens
atgtttacaattcagtattaca

SEQ ID NO: 8369882 - DNA, 22 bp, Homo sapiens
agagctgtttggacatctgagt

SEQ ID NO: 8369883 - DNA, 22 bp, Homo sapiens
agaggaagctgagatgcctctt

SEQ ID NO: 8369884 - DNA, 22 bp, Homo sapiens
atgtttatgttgggctatattt

SEQ ID NO: 8369885 - DNA, 22 bp, Homo sapiens
agaggacaaaatgagaagtgct

SEQ ID NO: 8369886 - DNA, 22 bp, Homo sapiens
agaggacacatctttcctcaaa

SEQ ID NO: 8369887 - DNA, 22 bp, Homo sapiens
atgggggaaagtacgagcatgg

SEQ ID NO: 8369888 - DNA, 22 bp, Homo sapiens
agagatggccttaggtgggaat

SEQ ID NO: 8369889 - DNA, 22 bp, Homo sapiens
agagatgaatcttgagactctg

SEQ ID NO: 8369890 - DNA, 22 bp, Homo sapiens
agagatgacatgagggacttaa

SEQ ID NO: 8369891 - DNA, 22 bp, Homo sapiens
agagatgactgatggctgatta

SEQ ID NO: 8369892 - DNA, 22 bp, Homo sapiens
agagatgagaacatgcttggat

SEQ ID NO: 8369893 - DNA, 22 bp, Homo sapiens
agagatgcagggtacatggaat

SEQ ID NO: 8369894 - DNA, 22 bp, Homo sapiens
agagatggatgttattatgggt

SEQ ID NO: 8369895 - DNA, 22 bp, Homo sapiens
agagatgcattcagcatggatg

SEQ ID NO: 8369896 - DNA, 22 bp, Homo sapiens
agagatgcattcagcatggatg

SEQ ID NO: 8369897 - DNA, 22 bp, Homo sapiens
atgggtggagggtgacacggat

SEQ ID NO: 8369898 - DNA, 22 bp, Homo sapiens
agagcagcctcagctccctgtg

SEQ ID NO: 8369899 - DNA, 22 bp, Homo sapiens
atgggtccctggccgccctcgg

SEQ ID NO: 8369900 - DNA, 22 bp, Homo sapiens
agagccagaccattgccgtgca

SEQ ID NO: 8369901 - DNA, 22 bp, Homo sapiens
agagccagaccattgccgtgca

SEQ ID NO: 8369902 - DNA, 22 bp, Homo sapiens
agagccagagacctgggttcac

SEQ ID NO: 8369903 - DNA, 22 bp, Homo sapiens
agagccacagtggataggagcc

SEQ ID NO: 8369904 - DNA, 22 bp, Homo sapiens
agagccagatggagccgtgtgt

SEQ ID NO: 8369905 - DNA, 22 bp, Homo sapiens
atgtatttgcgtatggacatac

SEQ ID NO: 8369906 - DNA, 22 bp, Homo sapiens
atgtatttgcttgttatggatt

SEQ ID NO: 8369907 - DNA, 22 bp, Homo sapiens
agagcctggctcccagctaccg

SEQ ID NO: 8369908 - DNA, 22 bp, Homo sapiens
atgtattttaagatttgcctca

SEQ ID NO: 8369909 - DNA, 22 bp, Homo sapiens
atgtcaaagcagactgagagcg

SEQ ID NO: 8369910 - DNA, 22 bp, Homo sapiens
agagcctgtcaattgtaaagag

SEQ ID NO: 8369911 - DNA, 22 bp, Homo sapiens
atgtgtacaaccaagcactaaa

SEQ ID NO: 8369912 - DNA, 22 bp, Homo sapiens
atgtggggactctgagagaatt

SEQ ID NO: 8369913 - DNA, 22 bp, Homo sapiens
atgtgggagatttcaggaggtg

SEQ ID NO: 8369914 - DNA, 22 bp, Homo sapiens
atgtgggagatttcaggaggtg

SEQ ID NO: 8369915 - DNA, 22 bp, Homo sapiens
atgtgggaaatacaagctaaaa

SEQ ID NO: 8369916 - DNA, 21 bp, Homo sapiens
agagaagaggactttctcaca

SEQ ID NO: 8369917 - DNA, 18 bp, Homo sapiens
agagaagaggtgttagtc

SEQ ID NO: 8369918 - DNA, 22 bp, Homo sapiens
atggccagcccttcccgcagct

SEQ ID NO: 8369919 - DNA, 22 bp, Homo sapiens
atggcagcctgtggacagtcaa

SEQ ID NO: 8369920 - DNA, 22 bp, Homo sapiens
atggcagcctgagcagaggaat

SEQ ID NO: 8369921 - DNA, 22 bp, Homo sapiens
atggcagcctgagcagaggaat

SEQ ID NO: 8369922 - DNA, 22 bp, Homo sapiens
agaccactaaaactttctctat

SEQ ID NO: 8369923 - DNA, 22 bp, Homo sapiens
agaccactaaaactttctctat

SEQ ID NO: 8369924 - DNA, 22 bp, Homo sapiens
agaccaagactataatgagagg

SEQ ID NO: 8369925 - DNA, 22 bp, Homo sapiens
agaccaagaaaggatgaggatc

SEQ ID NO: 8369926 - DNA, 22 bp, Homo sapiens
agaccaggtctttatggctcca

SEQ ID NO: 8369927 - DNA, 22 bp, Homo sapiens
agaccacttggataagaaacag

SEQ ID NO: 8369928 - DNA, 22 bp, Homo sapiens
agaccacttggataagaaacag

SEQ ID NO: 8369929 - DNA, 22 bp, Homo sapiens
agaccactggcctcctgcagac

SEQ ID NO: 8369930 - DNA, 22 bp, Homo sapiens
agaccactcaaaattagtgtct

SEQ ID NO: 8369931 - DNA, 22 bp, Homo sapiens
agaccatggccatcctaggaaa

SEQ ID NO: 8369932 - DNA, 22 bp, Homo sapiens
agaccatgacctgccactaagc

SEQ ID NO: 8369933 - DNA, 22 bp, Homo sapiens
agaccatgggctctgaagagca

SEQ ID NO: 8369934 - DNA, 22 bp, Homo sapiens
agacccacactttgagtagcaa

SEQ ID NO: 8369935 - DNA, 22 bp, Homo sapiens
agagacccgcagcctcggagct

SEQ ID NO: 8369936 - DNA, 22 bp, Homo sapiens
agagaccctggagttcttcact

SEQ ID NO: 8369937 - DNA, 20 bp, Homo sapiens
agagaccctgtagcttgcag

SEQ ID NO: 8369938 - DNA, 22 bp, Homo sapiens
agagacccattgccggaatcac

SEQ ID NO: 8369939 - DNA, 22 bp, Homo sapiens
agagacccagactgatcattgc

SEQ ID NO: 8369940 - DNA, 19 bp, Homo sapiens
agagaccacagagctgcct

SEQ ID NO: 8369941 - DNA, 22 bp, Homo sapiens
agagacagggttttgtcgtgtt

SEQ ID NO: 8369942 - DNA, 22 bp, Homo sapiens
agagacatggagaggcaaagtt

SEQ ID NO: 8369943 - DNA, 23 bp, Homo sapiens
agagacatttggatacagaaaca

SEQ ID NO: 8369944 - DNA, 22 bp, Homo sapiens
agagacagggttttgtcgtgtt

SEQ ID NO: 8369945 - DNA, 22 bp, Homo sapiens
agagaagcagggagtcatctgt

SEQ ID NO: 8369946 - DNA, 22 bp, Homo sapiens
agagaagcattcttctcagggc

SEQ ID NO: 8369947 - DNA, 22 bp, Homo sapiens
agagaagagtcttgtcaaatta

SEQ ID NO: 8369948 - DNA, 22 bp, Homo sapiens
agagaagagtcttgtcaaatta

SEQ ID NO: 8369949 - DNA, 22 bp, Homo sapiens
agagaaggaaagctgacatggg

SEQ ID NO: 8369950 - DNA, 22 bp, Homo sapiens
agagaaggaaagctgacatggg

SEQ ID NO: 8369951 - DNA, 22 bp, Homo sapiens
agagaaggaaagctgacatggg

SEQ ID NO: 8369952 - DNA, 22 bp, Homo sapiens
atggcctggccagagctctgct

SEQ ID NO: 8369953 - DNA, 22 bp, Homo sapiens
atggccttagtgatgattaata

SEQ ID NO: 8369954 - DNA, 22 bp, Homo sapiens
atggcctgggcccgcttcagat

SEQ ID NO: 8369955 - DNA, 22 bp, Homo sapiens
atggccgcctgtccttcccgcc

SEQ ID NO: 8369956 - DNA, 22 bp, Homo sapiens
agagactgatggagctcactct

SEQ ID NO: 8369957 - DNA, 22 bp, Homo sapiens
atggccttggctgcagagacat

SEQ ID NO: 8369958 - DNA, 17 bp, Homo sapiens
atggctcacctgtgggc

SEQ ID NO: 8369959 - DNA, 22 bp, Homo sapiens
atggctagcaccgcgttgctgg

SEQ ID NO: 8369960 - DNA, 22 bp, Homo sapiens
agagatgaagggcattccccag

SEQ ID NO: 8369961 - DNA, 22 bp, Homo sapiens
agagatgaacataaaacaagga

SEQ ID NO: 8369962 - DNA, 22 bp, Homo sapiens
atggctcagcccatggaagaaa

SEQ ID NO: 8369963 - DNA, 21 bp, Homo sapiens
agaagtcaattgaactgaaat

SEQ ID NO: 8369964 - DNA, 22 bp, Homo sapiens
agaagtgagttgtgactatggg

SEQ ID NO: 8369965 - DNA, 22 bp, Homo sapiens
agaagtgaggaaatcctcttta

SEQ ID NO: 8369966 - DNA, 22 bp, Homo sapiens
agaagtgagactcagttgatga

SEQ ID NO: 8369967 - DNA, 22 bp, Homo sapiens
agaagtgagactcagttgatga

SEQ ID NO: 8369968 - DNA, 22 bp, Homo sapiens
agaagtgagttgtgactatggg

SEQ ID NO: 8369969 - DNA, 22 bp, Homo sapiens
agaagtttgaaattaggagaaa

SEQ ID NO: 8369970 - DNA, 22 bp, Homo sapiens
atgaaacatgctttgtggatga

SEQ ID NO: 8369971 - DNA, 22 bp, Homo sapiens
atgaaactaaactacataagtt

SEQ ID NO: 8369972 - DNA, 23 bp, Homo sapiens
atgaaactcaagccagatccaag

SEQ ID NO: 8369973 - DNA, 22 bp, Homo sapiens
atgaaactctaacttaacaagt

SEQ ID NO: 8369974 - DNA, 22 bp, Homo sapiens
agaagttaattcctgaaattct

SEQ ID NO: 8369975 - DNA, 22 bp, Homo sapiens
atgaaagtggcttgattaaatg

SEQ ID NO: 8369976 - DNA, 22 bp, Homo sapiens
atgaaagctcagtgcactgaca

SEQ ID NO: 8369977 - DNA, 22 bp, Homo sapiens
atgaaagtagggtaaaatcaca

SEQ ID NO: 8369978 - DNA, 22 bp, Homo sapiens
atgaaagatgatttaaagtact

SEQ ID NO: 8369979 - DNA, 22 bp, Homo sapiens
atgaaattgatcttgaactttt

SEQ ID NO: 8369980 - DNA, 22 bp, Homo sapiens
agacaaattgggacattgtgtt

SEQ ID NO: 8369981 - DNA, 22 bp, Homo sapiens
agacaaatggtaattatgtcta

SEQ ID NO: 8369982 - DNA, 18 bp, Homo sapiens
agacaaacttcttctgcc

SEQ ID NO: 8369983 - DNA, 22 bp, Homo sapiens
agacaaagacagcatctcaggt

SEQ ID NO: 8369984 - DNA, 22 bp, Homo sapiens
atgaacaatgactacatattga

SEQ ID NO: 8369985 - DNA, 22 bp, Homo sapiens
agacagcatgatacatgatgct

SEQ ID NO: 8369986 - DNA, 22 bp, Homo sapiens
agacagccaatgctggaagatg

SEQ ID NO: 8369987 - DNA, 22 bp, Homo sapiens
agacagccaatgctggaagatg

SEQ ID NO: 8369988 - DNA, 22 bp, Homo sapiens
agacagcatttctagcaccagg

SEQ ID NO: 8369989 - DNA, 22 bp, Homo sapiens
agacagcatgagcctgctgatg

SEQ ID NO: 8369990 - DNA, 22 bp, Homo sapiens
agacagcatgatacatgatgct

SEQ ID NO: 8369991 - DNA, 22 bp, Homo sapiens
agacagcatgagcctgctgatg

SEQ ID NO: 8369992 - DNA, 22 bp, Homo sapiens
agacagcatgagcctgctgatg

SEQ ID NO: 8369993 - DNA, 22 bp, Homo sapiens
agacagcaggggagtctggttt

SEQ ID NO: 8369994 - DNA, 22 bp, Homo sapiens
agacagcaggggagtctggttt

SEQ ID NO: 8369995 - DNA, 22 bp, Homo sapiens
agacagcaggggagtctggttt

SEQ ID NO: 8369996 - DNA, 21 bp, Homo sapiens
agacagcagatagtcgaaagg

SEQ ID NO: 8369997 - DNA, 22 bp, Homo sapiens
agacatttggaagatacacata

SEQ ID NO: 8369998 - DNA, 22 bp, Homo sapiens
agacatatattgcaattcactg

SEQ ID NO: 8369999 - DNA, 20 bp, Homo sapiens
atgcacatacgcatgcacat

SEQ ID NO: 8370000 - DNA, 22 bp, Homo sapiens
atgcaactgagatggcctctgg

SEQ ID NO: 8370001 - DNA, 22 bp, Homo sapiens
atgacaaaatgaatgcagctag

SEQ ID NO: 8370002 - DNA, 22 bp, Homo sapiens
atgcacctgaactccatcagct

SEQ ID NO: 8370003 - DNA, 22 bp, Homo sapiens
atgcactgtaagactagccatg

SEQ ID NO: 8370004 - DNA, 22 bp, Homo sapiens
atgcactgggtgaggaaggaga

SEQ ID NO: 8370005 - DNA, 22 bp, Homo sapiens
atgcactgcccctctgcacctc

SEQ ID NO: 8370006 - DNA, 22 bp, Homo sapiens
atgcacccagtgtctggactat

SEQ ID NO: 8370007 - DNA, 22 bp, Homo sapiens
atgcacatgtatgtcaatattt

SEQ ID NO: 8370008 - DNA, 22 bp, Homo sapiens
atgcacatgtatctatatacaa

SEQ ID NO: 8370009 - DNA, 22 bp, Homo sapiens
atgcacatgtatctatatacaa

SEQ ID NO: 8370010 - DNA, 17 bp, Homo sapiens
agacagacctctgcatc

SEQ ID NO: 8370011 - DNA, 17 bp, Homo sapiens
agacagacctctgcatc

SEQ ID NO: 8370012 - DNA, 17 bp, Homo sapiens
agacagacctctgcatc

SEQ ID NO: 8370013 - DNA, 22 bp, Homo sapiens
agacagacattctagagccacc

SEQ ID NO: 8370014 - DNA, 22 bp, Homo sapiens
agacagacattctagagccacc

SEQ ID NO: 8370015 - DNA, 22 bp, Homo sapiens
agacagaccatggctattcaga

SEQ ID NO: 8370016 - DNA, 22 bp, Homo sapiens
atgcacttaaataacataactt

SEQ ID NO: 8370017 - DNA, 22 bp, Homo sapiens
aataagaattgccagatttgaa

SEQ ID NO: 8370018 - DNA, 22 bp, Homo sapiens
aataacttaagaaatttcccca

SEQ ID NO: 8370019 - DNA, 22 bp, Homo sapiens
aagtttctattattacattcgt

SEQ ID NO: 8370020 - DNA, 22 bp, Homo sapiens
aataacttcagttcttacatta

SEQ ID NO: 8370021 - DNA, 22 bp, Homo sapiens
aataagatcctgaagatatgtt

SEQ ID NO: 8370022 - DNA, 22 bp, Homo sapiens
aataagaatttacttgtcaaga

SEQ ID NO: 8370023 - DNA, 22 bp, Homo sapiens
aagtttcaaatataaaattaca

SEQ ID NO: 8370024 - DNA, 22 bp, Homo sapiens
aagtttatgttggtaagatatc

SEQ ID NO: 8370025 - DNA, 22 bp, Homo sapiens
aagtttatgttggtaagatatc

SEQ ID NO: 8370026 - DNA, 22 bp, Homo sapiens
aagtttcatgatgtaattattg

SEQ ID NO: 8370027 - DNA, 22 bp, Homo sapiens
aagtttcatgacttggttatta

SEQ ID NO: 8370028 - DNA, 22 bp, Homo sapiens
aagtttcaaatgttgattatgc

SEQ ID NO: 8370029 - DNA, 22 bp, Homo sapiens
aagtttctacatctccatcata

SEQ ID NO: 8370030 - DNA, 22 bp, Homo sapiens
aagtttaaggtggaagtggtgg

SEQ ID NO: 8370031 - DNA, 22 bp, Homo sapiens
aagtttaacttgaattctttct

SEQ ID NO: 8370032 - DNA, 22 bp, Homo sapiens
aataatattcctctgtgtgcgt

SEQ ID NO: 8370033 - DNA, 22 bp, Homo sapiens
actgcgctccagcctgggtgac

SEQ ID NO: 8370034 - DNA, 22 bp, Homo sapiens
aataagatcctgaagatatgtt

SEQ ID NO: 8370035 - DNA, 22 bp, Homo sapiens
aataagatcttaaaggttatat

SEQ ID NO: 8370036 - DNA, 22 bp, Homo sapiens
actgcctgtgtcccttcagtgc

SEQ ID NO: 8370037 - DNA, 22 bp, Homo sapiens
actgcctgtttggcatggcccc

SEQ ID NO: 8370038 - DNA, 23 bp, Homo sapiens
actgcctgtgccgatctctctca

SEQ ID NO: 8370039 - DNA, 22 bp, Homo sapiens
aataatgttgacgatagtctta

SEQ ID NO: 8370040 - DNA, 22 bp, Homo sapiens
aataatgttgacgatagtctta

SEQ ID NO: 8370041 - DNA, 22 bp, Homo sapiens
aataatgtgtgctgcagtctta

SEQ ID NO: 8370042 - DNA, 22 bp, Homo sapiens
aataattagtgggacagagaac

SEQ ID NO: 8370043 - DNA, 22 bp, Homo sapiens
aataattacccatctttttgta

SEQ ID NO: 8370044 - DNA, 22 bp, Homo sapiens
aataattttagctcagagttgt

SEQ ID NO: 8370045 - DNA, 22 bp, Homo sapiens
aataattttgagagcctggaaa

SEQ ID NO: 8370046 - DNA, 22 bp, Homo sapiens
aataatttccagccaactggaa

SEQ ID NO: 8370047 - DNA, 20 bp, Homo sapiens
actccaggtggcatgaggac

SEQ ID NO: 8370048 - DNA, 22 bp, Homo sapiens
aagttatttttcaagatccttt

SEQ ID NO: 8370049 - DNA, 22 bp, Homo sapiens
aagttattggtggagagcactg

SEQ ID NO: 8370050 - DNA, 22 bp, Homo sapiens
aagttattgcagcaatccaagt

SEQ ID NO: 8370051 - DNA, 22 bp, Homo sapiens
actaattgtatagttgatgtaa

SEQ ID NO: 8370052 - DNA, 22 bp, Homo sapiens
actaattggaacactttttgcc

SEQ ID NO: 8370053 - DNA, 22 bp, Homo sapiens
actaattgagtgcatgatcttt

SEQ ID NO: 8370054 - DNA, 22 bp, Homo sapiens
actaattgaaatgtcctggcca

SEQ ID NO: 8370055 - DNA, 22 bp, Homo sapiens
actaattgctttcttgtgctga

SEQ ID NO: 8370056 - DNA, 22 bp, Homo sapiens
actaattgaaatgagactggtg

SEQ ID NO: 8370057 - DNA, 22 bp, Homo sapiens
actaatgattattgtcattgtg

SEQ ID NO: 8370058 - DNA, 22 bp, Homo sapiens
aagttatatcatctcattgacg

SEQ ID NO: 8370059 - DNA, 22 bp, Homo sapiens
actaaatgagatactgtcttca

SEQ ID NO: 8370060 - DNA, 22 bp, Homo sapiens
aagtggagagccctggaggtct

SEQ ID NO: 8370061 - DNA, 22 bp, Homo sapiens
aagtgcatatttttgttgtaga

SEQ ID NO: 8370062 - DNA, 22 bp, Homo sapiens
aagtgcttggctaatggttatg

SEQ ID NO: 8370063 - DNA, 22 bp, Homo sapiens
aagtgcttggattgcaggtatg

SEQ ID NO: 8370064 - DNA, 22 bp, Homo sapiens
aagtgctttaaaatttcctgag

SEQ ID NO: 8370065 - DNA, 22 bp, Homo sapiens
aagtcacagagttggaagtcag

SEQ ID NO: 8370066 - DNA, 22 bp, Homo sapiens
aagtcactgttttagttttctc

SEQ ID NO: 8370067 - DNA, 22 bp, Homo sapiens
aagtcagataggtgagtccaaa

SEQ ID NO: 8370068 - DNA, 22 bp, Homo sapiens
aagtcagagcaactgagacatt

SEQ ID NO: 8370069 - DNA, 22 bp, Homo sapiens
aagtcactttcccattccttgc

SEQ ID NO: 8370070 - DNA, 22 bp, Homo sapiens
aagtcacttgattgttgacaga

SEQ ID NO: 8370071 - DNA, 22 bp, Homo sapiens
aatccagcacatggacacagtc

SEQ ID NO: 8370072 - DNA, 22 bp, Homo sapiens
aatcataattgtatacattcat

SEQ ID NO: 8370073 - DNA, 22 bp, Homo sapiens
aatccagctgtgtcacaggtga

SEQ ID NO: 8370074 - DNA, 22 bp, Homo sapiens
aatccattgctgtgctgccagg

SEQ ID NO: 8370075 - DNA, 22 bp, Homo sapiens
aatccatgcatgcaaggaaagg

SEQ ID NO: 8370076 - DNA, 22 bp, Homo sapiens
aatcctggaatacaagagtgaa

SEQ ID NO: 8370077 - DNA, 22 bp, Homo sapiens
aatccctttttcatttaataga

SEQ ID NO: 8370078 - DNA, 20 bp, Homo sapiens
aatcccttctctggactctt

SEQ ID NO: 8370079 - DNA, 22 bp, Homo sapiens
aatcaagaataagttgtaaagc

SEQ ID NO: 8370080 - DNA, 22 bp, Homo sapiens
acttgtgttaccaaggtttggt

SEQ ID NO: 8370081 - DNA, 22 bp, Homo sapiens
acttgtctttgtaaaatagaaa

SEQ ID NO: 8370082 - DNA, 22 bp, Homo sapiens
aatcaaaacctacagaggtaat

SEQ ID NO: 8370083 - DNA, 22 bp, Homo sapiens
aatcaactgtttccacagggag

SEQ ID NO: 8370084 - DNA, 21 bp, Homo sapiens
aatcaaatgtcatatccccag

SEQ ID NO: 8370085 - DNA, 22 bp, Homo sapiens
acttcttttcaaatcatgcaaa

SEQ ID NO: 8370086 - DNA, 21 bp, Homo sapiens
aatacagaaatgagtagttgc

SEQ ID NO: 8370087 - DNA, 22 bp, Homo sapiens
aatacaatcaaattcactagca

SEQ ID NO: 8370088 - DNA, 22 bp, Homo sapiens
aatacaatcaaattcactagca

SEQ ID NO: 8370089 - DNA, 22 bp, Homo sapiens
aatacaatcaaattcactagca

SEQ ID NO: 8370090 - DNA, 22 bp, Homo sapiens
acttgaaacatctttaaatgta

SEQ ID NO: 8370091 - DNA, 22 bp, Homo sapiens
acttgaaaccctgagatgataa

SEQ ID NO: 8370092 - DNA, 22 bp, Homo sapiens
acttgaaacatctttaaatgta

SEQ ID NO: 8370093 - DNA, 22 bp, Homo sapiens
acttgaaacatctttaaatgta

SEQ ID NO: 8370094 - DNA, 22 bp, Homo sapiens
acttgaaaggaagctctaaaac

SEQ ID NO: 8370095 - DNA, 22 bp, Homo sapiens
acttgaaagaagtttccttaaa

SEQ ID NO: 8370096 - DNA, 22 bp, Homo sapiens
aatatagttctggtattgttaa

SEQ ID NO: 8370097 - DNA, 22 bp, Homo sapiens
acttgaggaagcagcaagggat

SEQ ID NO: 8370098 - DNA, 22 bp, Homo sapiens
acttgacacctaattagtcatc

SEQ ID NO: 8370099 - DNA, 22 bp, Homo sapiens
acttgacagaagtcagtacttt

SEQ ID NO: 8370100 - DNA, 22 bp, Homo sapiens
acttgacacttatattactcac

SEQ ID NO: 8370101 - DNA, 21 bp, Homo sapiens
aatatatgcaatgctttctgc

SEQ ID NO: 8370102 - DNA, 22 bp, Homo sapiens
aatatatgagggagctatttga

SEQ ID NO: 8370103 - DNA, 22 bp, Homo sapiens
aatatatgactccactgcatga

SEQ ID NO: 8370104 - DNA, 22 bp, Homo sapiens
aatatatgtggtattgaccagc

SEQ ID NO: 8370105 - DNA, 23 bp, Homo sapiens
aatatatgtgtttttctgcttca

SEQ ID NO: 8370106 - DNA, 19 bp, Homo sapiens
aatattttagcctcttcct

SEQ ID NO: 8370107 - DNA, 22 bp, Homo sapiens
aatatcagaatgtaatggtcct

SEQ ID NO: 8370108 - DNA, 22 bp, Homo sapiens
aatattcatttgcagaagaagt

SEQ ID NO: 8370109 - DNA, 22 bp, Homo sapiens
aatattcatttgcagaagaagt

SEQ ID NO: 8370110 - DNA, 22 bp, Homo sapiens
aatgagcttctataatcttgtc

SEQ ID NO: 8370111 - DNA, 22 bp, Homo sapiens
aatgagatggaattcccgccta

SEQ ID NO: 8370112 - DNA, 22 bp, Homo sapiens
agaagggaactcagagatgatt

SEQ ID NO: 8370113 - DNA, 22 bp, Homo sapiens
agaagggagagaaagttggtta

SEQ ID NO: 8370114 - DNA, 22 bp, Homo sapiens
agaagggagagaaagttggtta

SEQ ID NO: 8370115 - DNA, 20 bp, Homo sapiens
aatgagttattttgtatatg

SEQ ID NO: 8370116 - DNA, 22 bp, Homo sapiens
aatgagttagatgagaaaataa

SEQ ID NO: 8370117 - DNA, 22 bp, Homo sapiens
aatgactttgaaatatttgagt

SEQ ID NO: 8370118 - DNA, 22 bp, Homo sapiens
aatgactttgaaatatttgagt

SEQ ID NO: 8370119 - DNA, 22 bp, Homo sapiens
aatgagaatgtaagtgaagaga

SEQ ID NO: 8370120 - DNA, 22 bp, Homo sapiens
agaaatactgtgagagcagcct

SEQ ID NO: 8370121 - DNA, 22 bp, Homo sapiens
agaaatactgcctaagactgta

SEQ ID NO: 8370122 - DNA, 22 bp, Homo sapiens
agaaatactgcctaagactgta

SEQ ID NO: 8370123 - DNA, 20 bp, Homo sapiens
agaaatactttggtataatg

SEQ ID NO: 8370124 - DNA, 22 bp, Homo sapiens
aatgaatgggtttaatatttta

SEQ ID NO: 8370125 - DNA, 19 bp, Homo sapiens
aatgactgagtacattgtc

SEQ ID NO: 8370126 - DNA, 22 bp, Homo sapiens
aatgactctgctgcagagacac

SEQ ID NO: 8370127 - DNA, 22 bp, Homo sapiens
aatgaaactcgaaataatcaca

SEQ ID NO: 8370128 - DNA, 22 bp, Homo sapiens
agaaaacattacataggtgtgt

SEQ ID NO: 8370129 - DNA, 22 bp, Homo sapiens
agaaaactctacatctgtatgt

SEQ ID NO: 8370130 - DNA, 22 bp, Homo sapiens
agaaaacataggagacaggaaa

SEQ ID NO: 8370131 - DNA, 22 bp, Homo sapiens
agaaaacagaaagtcattggtg

SEQ ID NO: 8370132 - DNA, 22 bp, Homo sapiens
agaaaacataggagacaggaaa

SEQ ID NO: 8370133 - DNA, 22 bp, Homo sapiens
agaaaaatcttggcgcttgtct

SEQ ID NO: 8370134 - DNA, 22 bp, Homo sapiens
aatcctggcatgtgccttggga

SEQ ID NO: 8370135 - DNA, 22 bp, Homo sapiens
agaaaacagaaagtcattggtg

SEQ ID NO: 8370136 - DNA, 18 bp, Homo sapiens
agaaataccagtattgga

SEQ ID NO: 8370137 - DNA, 22 bp, Homo sapiens
agaaatacattctctggtgtgt

SEQ ID NO: 8370138 - DNA, 22 bp, Homo sapiens
agaaataagagctttccttggg

SEQ ID NO: 8370139 - DNA, 21 bp, Homo sapiens
agaaatacagcagggatgatc

SEQ ID NO: 8370140 - DNA, 22 bp, Homo sapiens
agaaataatcagcttaggggca

SEQ ID NO: 8370141 - DNA, 22 bp, Homo sapiens
agaaatacaaagtactaagata

SEQ ID NO: 8370142 - DNA, 22 bp, Homo sapiens
aatgaacatggacaagttaata

SEQ ID NO: 8370143 - DNA, 22 bp, Homo sapiens
aatgaacatgggagtactaata

SEQ ID NO: 8370144 - DNA, 22 bp, Homo sapiens
aaggcagagatattcttgatct

SEQ ID NO: 8370145 - DNA, 19 bp, Homo sapiens
acagttctaatttctgtgg

SEQ ID NO: 8370146 - DNA, 22 bp, Homo sapiens
acagttctagcttttacatttt

SEQ ID NO: 8370147 - DNA, 22 bp, Homo sapiens
acagttctgagctataattgct

SEQ ID NO: 8370148 - DNA, 21 bp, Homo sapiens
acagttctgccggcatctttc

SEQ ID NO: 8370149 - DNA, 22 bp, Homo sapiens
acagttctttggatggaagaat

SEQ ID NO: 8370150 - DNA, 22 bp, Homo sapiens
acagttcttaaaacttgaatta

SEQ ID NO: 8370151 - DNA, 22 bp, Homo sapiens
aaggcagatataaagactagag

SEQ ID NO: 8370152 - DNA, 22 bp, Homo sapiens
acagttgagatgcaactttggg

SEQ ID NO: 8370153 - DNA, 22 bp, Homo sapiens
aaggcagccttttgagttgatt

SEQ ID NO: 8370154 - DNA, 22 bp, Homo sapiens
aaggcagctcagctcatggcag

SEQ ID NO: 8370155 - DNA, 22 bp, Homo sapiens
aaggcagcttcaccacagcatt

SEQ ID NO: 8370156 - DNA, 22 bp, Homo sapiens
aaggcagggaaagtggattagg

SEQ ID NO: 8370157 - DNA, 22 bp, Homo sapiens
aaggcagtaaaatctaccttgc

SEQ ID NO: 8370158 - DNA, 22 bp, Homo sapiens
aaggcaggtattgatgccacag

SEQ ID NO: 8370159 - DNA, 22 bp, Homo sapiens
aaggcagtaggatcttccacag

SEQ ID NO: 8370160 - DNA, 22 bp, Homo sapiens
aaggcagtactttatgtccata

SEQ ID NO: 8370161 - DNA, 22 bp, Homo sapiens
aaggcagtaggtgtttcaaact

SEQ ID NO: 8370162 - DNA, 22 bp, Homo sapiens
aaggcagtatctgtagagtgct

SEQ ID NO: 8370163 - DNA, 22 bp, Homo sapiens
aaggcagtcaaagcagacttct

SEQ ID NO: 8370164 - DNA, 18 bp, Homo sapiens
aaggcagtatgattgcac

SEQ ID NO: 8370165 - DNA, 22 bp, Homo sapiens
aaggcagtggctggaaaacctg

SEQ ID NO: 8370166 - DNA, 22 bp, Homo sapiens
aaggcagtctggtttcaaagca

SEQ ID NO: 8370167 - DNA, 22 bp, Homo sapiens
aaggcagtcagttgttttgaaa

SEQ ID NO: 8370168 - DNA, 22 bp, Homo sapiens
aaggcagtcagttgttttgaaa

SEQ ID NO: 8370169 - DNA, 22 bp, Homo sapiens
aaggcagtggttgggtggagga

SEQ ID NO: 8370170 - DNA, 22 bp, Homo sapiens
aaggcagttaatttggctagaa

SEQ ID NO: 8370171 - DNA, 22 bp, Homo sapiens
aaggcagtggttgtgatactgt

SEQ ID NO: 8370172 - DNA, 22 bp, Homo sapiens
aaggcagttaccgcaatggagg

SEQ ID NO: 8370173 - DNA, 22 bp, Homo sapiens
aaggcagttcactcacgcagcc

SEQ ID NO: 8370174 - DNA, 22 bp, Homo sapiens
aaggcagtttgggccaccatct

SEQ ID NO: 8370175 - DNA, 22 bp, Homo sapiens
aaggaactaactatgtagagat

SEQ ID NO: 8370176 - DNA, 22 bp, Homo sapiens
aaggaactctagagccttgaac

SEQ ID NO: 8370177 - DNA, 22 bp, Homo sapiens
aaggaactgatgctcaaagaat

SEQ ID NO: 8370178 - DNA, 22 bp, Homo sapiens
aaggaactgatgctcaaagaat

SEQ ID NO: 8370179 - DNA, 22 bp, Homo sapiens
aaggaactttgcagaggtgatt

SEQ ID NO: 8370180 - DNA, 22 bp, Homo sapiens
aaggaacttgccacagaaaaga

SEQ ID NO: 8370181 - DNA, 22 bp, Homo sapiens
aaggaagaaatgaataggtgga

SEQ ID NO: 8370182 - DNA, 21 bp, Homo sapiens
aaggcagaagcatggaatgag

SEQ ID NO: 8370183 - DNA, 22 bp, Homo sapiens
aaggcagaaattcaactactgg

SEQ ID NO: 8370184 - DNA, 19 bp, Homo sapiens
aaggcagaagttggatatg

SEQ ID NO: 8370185 - DNA, 22 bp, Homo sapiens
aaggcacttttctaaagacctt

SEQ ID NO: 8370186 - DNA, 22 bp, Homo sapiens
aaggcagaaagggatgtgagtg

SEQ ID NO: 8370187 - DNA, 22 bp, Homo sapiens
aaggcagaaagggatgtgagtg

SEQ ID NO: 8370188 - DNA, 22 bp, Homo sapiens
aaggaaattaggttattttgct

SEQ ID NO: 8370189 - DNA, 22 bp, Homo sapiens
aaggaaatgaggttgatggatg

SEQ ID NO: 8370190 - DNA, 22 bp, Homo sapiens
aaggaaatgaggttgatggatg

SEQ ID NO: 8370191 - DNA, 22 bp, Homo sapiens
aaggaaatgaggttgatggatg

SEQ ID NO: 8370192 - DNA, 22 bp, Homo sapiens
aaggaaatgtgcctgacactgc

SEQ ID NO: 8370193 - DNA, 22 bp, Homo sapiens
aaggaaatgtgcctgacactgc

SEQ ID NO: 8370194 - DNA, 22 bp, Homo sapiens
aaggaaattaggttattttgct

SEQ ID NO: 8370195 - DNA, 22 bp, Homo sapiens
acagtatacattgattaggacc

SEQ ID NO: 8370196 - DNA, 22 bp, Homo sapiens
aaggaaatctttgtaacatctt

SEQ ID NO: 8370197 - DNA, 22 bp, Homo sapiens
aaggaaatctttgtaacatctt

SEQ ID NO: 8370198 - DNA, 22 bp, Homo sapiens
aaggaaatgaagctgatgttgg

SEQ ID NO: 8370199 - DNA, 22 bp, Homo sapiens
aaggaaatgaagctgatgttgg

SEQ ID NO: 8370200 - DNA, 22 bp, Homo sapiens
aaggaaatctttgtaacatctt

SEQ ID NO: 8370201 - DNA, 22 bp, Homo sapiens
aaggaaatgaagctgatgttgg

SEQ ID NO: 8370202 - DNA, 22 bp, Homo sapiens
acaggcaggtcctgtcccagct

SEQ ID NO: 8370203 - DNA, 18 bp, Homo sapiens
aagctgccctcaggcagg

SEQ ID NO: 8370204 - DNA, 22 bp, Homo sapiens
acaggcaggtcctgtcccagct

SEQ ID NO: 8370205 - DNA, 22 bp, Homo sapiens
aagctgcccaagactgaagcat

SEQ ID NO: 8370206 - DNA, 22 bp, Homo sapiens
acaggcagtgatttcctctggt

SEQ ID NO: 8370207 - DNA, 22 bp, Homo sapiens
acaggcagtgggccagatttgt

SEQ ID NO: 8370208 - DNA, 22 bp, Homo sapiens
acaggcaggttgagaaacattt

SEQ ID NO: 8370209 - DNA, 22 bp, Homo sapiens
aagctgccagctgagctgaggc

SEQ ID NO: 8370210 - DNA, 22 bp, Homo sapiens
aagctgccaatggtaagctgct

SEQ ID NO: 8370211 - DNA, 22 bp, Homo sapiens
aagctgccacacggtgagtact

SEQ ID NO: 8370212 - DNA, 22 bp, Homo sapiens
aagccagggtttgtggatctat

SEQ ID NO: 8370213 - DNA, 18 bp, Homo sapiens
aagccaggtcaagataag

SEQ ID NO: 8370214 - DNA, 22 bp, Homo sapiens
aagccaggtgtgcccaggatcc

SEQ ID NO: 8370215 - DNA, 22 bp, Homo sapiens
aagccaggtgttgtggtaagag

SEQ ID NO: 8370216 - DNA, 22 bp, Homo sapiens
aagccaggtgtttaggccagcg

SEQ ID NO: 8370217 - DNA, 22 bp, Homo sapiens
aagccaggctgcacttgctggg

SEQ ID NO: 8370218 - DNA, 22 bp, Homo sapiens
aagccaggccattctctggttc

SEQ ID NO: 8370219 - DNA, 22 bp, Homo sapiens
aagccaggccattctctggttc

SEQ ID NO: 8370220 - DNA, 22 bp, Homo sapiens
aagccaggctgcacttgctggg

SEQ ID NO: 8370221 - DNA, 22 bp, Homo sapiens
aagccagggattcctgagggag

SEQ ID NO: 8370222 - DNA, 22 bp, Homo sapiens
aagccagggattcctgagggag

SEQ ID NO: 8370223 - DNA, 22 bp, Homo sapiens
aagccagggtcaggggcctcct

SEQ ID NO: 8370224 - DNA, 22 bp, Homo sapiens
aagccaggggttggtatgctat

SEQ ID NO: 8370225 - DNA, 22 bp, Homo sapiens
aagccaggggctgcttaggaga

SEQ ID NO: 8370226 - DNA, 22 bp, Homo sapiens
aaggaaagattctctctctaga

SEQ ID NO: 8370227 - DNA, 22 bp, Homo sapiens
aaggaaagattctctctctaga

SEQ ID NO: 8370228 - DNA, 22 bp, Homo sapiens
aaggaaagattctctctctaga

SEQ ID NO: 8370229 - DNA, 22 bp, Homo sapiens
aaggaaagattctctctctaga

SEQ ID NO: 8370230 - DNA, 22 bp, Homo sapiens
aaggaaagctgtggttctgaga

SEQ ID NO: 8370231 - DNA, 22 bp, Homo sapiens
aaggaaagctgtggttctgaga

SEQ ID NO: 8370232 - DNA, 22 bp, Homo sapiens
aaggaaagattctctctctaga

SEQ ID NO: 8370233 - DNA, 22 bp, Homo sapiens
aaggaaaggatgagcatgcatt

SEQ ID NO: 8370234 - DNA, 22 bp, Homo sapiens
aaggaaagctgtggttctgaga

SEQ ID NO: 8370235 - DNA, 22 bp, Homo sapiens
aaggaaatacttctgcagagca

SEQ ID NO: 8370236 - DNA, 22 bp, Homo sapiens
aaggaaatagatgcagatggta

SEQ ID NO: 8370237 - DNA, 22 bp, Homo sapiens
aaggaaatacttctgcagagca

SEQ ID NO: 8370238 - DNA, 22 bp, Homo sapiens
aaggaaatagatgcagatggta

SEQ ID NO: 8370239 - DNA, 22 bp, Homo sapiens
aaggaaatacttctgcagagca

SEQ ID NO: 8370240 - DNA, 22 bp, Homo sapiens
aaggaaatacttctgcagagca

SEQ ID NO: 8370241 - DNA, 22 bp, Homo sapiens
aaggaaatacaacatgtattca

SEQ ID NO: 8370242 - DNA, 22 bp, Homo sapiens
aaggaaatacaacatgtattca

SEQ ID NO: 8370243 - DNA, 22 bp, Homo sapiens
aaggaaatacaacatgtattca

SEQ ID NO: 8370244 - DNA, 22 bp, Homo sapiens
aaggaaaggatgagcatgcatt

SEQ ID NO: 8370245 - DNA, 22 bp, Homo sapiens
aaggaaagacatataaatgact

SEQ ID NO: 8370246 - DNA, 22 bp, Homo sapiens
aaggaaagacatataaatgact

SEQ ID NO: 8370247 - DNA, 22 bp, Homo sapiens
aaggaaagacatataaatgact

SEQ ID NO: 8370248 - DNA, 22 bp, Homo sapiens
aaggaaagagtatgcaccttgt

SEQ ID NO: 8370249 - DNA, 22 bp, Homo sapiens
aaggaaagagtatgcaccttgt

SEQ ID NO: 8370250 - DNA, 22 bp, Homo sapiens
aaggaaagacatataaatgact

SEQ ID NO: 8370251 - DNA, 22 bp, Homo sapiens
aaggaaagacaggacggaattc

SEQ ID NO: 8370252 - DNA, 22 bp, Homo sapiens
acaggcatatttctagattaca

SEQ ID NO: 8370253 - DNA, 22 bp, Homo sapiens
acaggcagtgggccagatttgt

SEQ ID NO: 8370254 - DNA, 22 bp, Homo sapiens
acaggcagttgaggtttgtgtg

SEQ ID NO: 8370255 - DNA, 22 bp, Homo sapiens
aaggaaatctttgtaacatctt

SEQ ID NO: 8370256 - DNA, 22 bp, Homo sapiens
acagtacagtgcagaggaagat

SEQ ID NO: 8370257 - DNA, 22 bp, Homo sapiens
aagggccatcttggactcccca

SEQ ID NO: 8370258 - DNA, 22 bp, Homo sapiens
aagggccattgctgagagcagt

SEQ ID NO: 8370259 - DNA, 22 bp, Homo sapiens
aagggccacatttgggtccctg

SEQ ID NO: 8370260 - DNA, 22 bp, Homo sapiens
aagggcaggaaaagatggatgt

SEQ ID NO: 8370261 - DNA, 22 bp, Homo sapiens
aagggaagtttgcatcctcact

SEQ ID NO: 8370262 - DNA, 22 bp, Homo sapiens
aagggaagtttgcatcctcact

SEQ ID NO: 8370263 - DNA, 22 bp, Homo sapiens
aagggacatagactgtacatct

SEQ ID NO: 8370264 - DNA, 22 bp, Homo sapiens
aagggaaatcatatggtgcagt

SEQ ID NO: 8370265 - DNA, 22 bp, Homo sapiens
aagggaaactttcacaatgtcc

SEQ ID NO: 8370266 - DNA, 22 bp, Homo sapiens
aagggaaggttccattatactt

SEQ ID NO: 8370267 - DNA, 22 bp, Homo sapiens
aagggaaatggccaggcagaga

SEQ ID NO: 8370268 - DNA, 22 bp, Homo sapiens
aagggaaatcctcagcccagga

SEQ ID NO: 8370269 - DNA, 22 bp, Homo sapiens
aagggaaatcctcagcccagga

SEQ ID NO: 8370270 - DNA, 22 bp, Homo sapiens
aaggcttttaaactgtcaagga

SEQ ID NO: 8370271 - DNA, 22 bp, Homo sapiens
aaggcttttgggaattttcaac

SEQ ID NO: 8370272 - DNA, 22 bp, Homo sapiens
aagggaaaatagttgatgacca

SEQ ID NO: 8370273 - DNA, 22 bp, Homo sapiens
aaggctttccagaaagtcttga

SEQ ID NO: 8370274 - DNA, 22 bp, Homo sapiens
aaggctttgattccattgccct

SEQ ID NO: 8370275 - DNA, 22 bp, Homo sapiens
aaggctggtttccttgatgttt

SEQ ID NO: 8370276 - DNA, 22 bp, Homo sapiens
acatgtgtacttttaaggatgt

SEQ ID NO: 8370277 - DNA, 22 bp, Homo sapiens
acatgtgtgacaacagaggtga

SEQ ID NO: 8370278 - DNA, 22 bp, Homo sapiens
aaggctgtggttctatacagaa

SEQ ID NO: 8370279 - DNA, 22 bp, Homo sapiens
aaggcttctttagtgtcctaat

SEQ ID NO: 8370280 - DNA, 22 bp, Homo sapiens
aaggctttatgactccagtgga

SEQ ID NO: 8370281 - DNA, 22 bp, Homo sapiens
aaggcatcatggctggctattt

SEQ ID NO: 8370282 - DNA, 22 bp, Homo sapiens
aaggcatggcagggtttacaca

SEQ ID NO: 8370283 - DNA, 22 bp, Homo sapiens
aaggctgaggagggcctgcagg

SEQ ID NO: 8370284 - DNA, 22 bp, Homo sapiens
aaggctgaggctggagaattac

SEQ ID NO: 8370285 - DNA, 22 bp, Homo sapiens
aaggctgagggctgtacctggc

SEQ ID NO: 8370286 - DNA, 22 bp, Homo sapiens
acatgtgtacatatatatgtgc

SEQ ID NO: 8370287 - DNA, 22 bp, Homo sapiens
accatcttaaggggacttctta

SEQ ID NO: 8370288 - DNA, 22 bp, Homo sapiens
accatgcatcaaagctaatata

SEQ ID NO: 8370289 - DNA, 23 bp, Homo sapiens
accatgatgggagtgcaaataag

SEQ ID NO: 8370290 - DNA, 22 bp, Homo sapiens
aaggtgaactggtaatgacaga

SEQ ID NO: 8370291 - DNA, 22 bp, Homo sapiens
aaggtgactcacaaagccagtt

SEQ ID NO: 8370292 - DNA, 22 bp, Homo sapiens
aaggtgaactggtaatgacaga

SEQ ID NO: 8370293 - DNA, 22 bp, Homo sapiens
aaggtgaggattttgttctgct

SEQ ID NO: 8370294 - DNA, 17 bp, Homo sapiens
aaggtgagagctgttct

SEQ ID NO: 8370295 - DNA, 22 bp, Homo sapiens
aaggtgagagggaaattttcca

SEQ ID NO: 8370296 - DNA, 22 bp, Homo sapiens
aaggtggaggttgcagtgagct

SEQ ID NO: 8370297 - DNA, 22 bp, Homo sapiens
aaggtggaggttgcagtgagct

SEQ ID NO: 8370298 - DNA, 22 bp, Homo sapiens
aagtacatttttaacttacagc

SEQ ID NO: 8370299 - DNA, 22 bp, Homo sapiens
aagtacttctagatggataatc

SEQ ID NO: 8370300 - DNA, 22 bp, Homo sapiens
aagtactttaggatatgtaact

SEQ ID NO: 8370301 - DNA, 22 bp, Homo sapiens
accccaggagctgtgcctagtc

SEQ ID NO: 8370302 - DNA, 22 bp, Homo sapiens
aagtcaatttatgttctcagac

SEQ ID NO: 8370303 - DNA, 22 bp, Homo sapiens
aagtcaattagtaaacttggaa

SEQ ID NO: 8370304 - DNA, 22 bp, Homo sapiens
aagtcacacagttaacatgagg

SEQ ID NO: 8370305 - DNA, 22 bp, Homo sapiens
aagtcaatcaagggtgtaggca

SEQ ID NO: 8370306 - DNA, 22 bp, Homo sapiens
accccagggctgccagcctcct

SEQ ID NO: 8370307 - DNA, 22 bp, Homo sapiens
accccaggtctccaggctctgg

SEQ ID NO: 8370308 - DNA, 22 bp, Homo sapiens
acccccaaacatcaagggctga

SEQ ID NO: 8370309 - DNA, 22 bp, Homo sapiens
accccaggtcatctgagagtcc

SEQ ID NO: 8370310 - DNA, 22 bp, Homo sapiens
aatgttgtgtttcagttcaaga

SEQ ID NO: 8370311 - DNA, 22 bp, Homo sapiens
aatgtttcgtaaattgtctatg

SEQ ID NO: 8370312 - DNA, 22 bp, Homo sapiens
aatgttcagtgcctttaaacat

SEQ ID NO: 8370313 - DNA, 22 bp, Homo sapiens
aatgttcagtgcctttaaacat

SEQ ID NO: 8370314 - DNA, 22 bp, Homo sapiens
aatgttctcaacaaaaggaagc

SEQ ID NO: 8370315 - DNA, 22 bp, Homo sapiens
aatgttcattgttttccatatg

SEQ ID NO: 8370316 - DNA, 22 bp, Homo sapiens
aatgttctgatgtagggtttag

SEQ ID NO: 8370317 - DNA, 22 bp, Homo sapiens
aatgttctgcaactgttttcat

SEQ ID NO: 8370318 - DNA, 22 bp, Homo sapiens
aatgttctgtgctggttctggg

SEQ ID NO: 8370319 - DNA, 20 bp, Homo sapiens
aatgttcagtaattgtttta

SEQ ID NO: 8370320 - DNA, 22 bp, Homo sapiens
aatgttcagctttcttacttaa

SEQ ID NO: 8370321 - DNA, 22 bp, Homo sapiens
aatgttcagaggacaatataaa

SEQ ID NO: 8370322 - DNA, 22 bp, Homo sapiens
aatgttatttctgcatagtagt

SEQ ID NO: 8370323 - DNA, 22 bp, Homo sapiens
aatgttatttctgcatagtagt

SEQ ID NO: 8370324 - DNA, 22 bp, Homo sapiens
aatgttatttctgcatagtagt

SEQ ID NO: 8370325 - DNA, 22 bp, Homo sapiens
aatgttattgtcctttccaaaa

SEQ ID NO: 8370326 - DNA, 22 bp, Homo sapiens
aatgttattgtcctttccaaaa

SEQ ID NO: 8370327 - DNA, 22 bp, Homo sapiens
aattatatgttaatcttcaatt

SEQ ID NO: 8370328 - DNA, 22 bp, Homo sapiens
aattatatgttaatcttcaatt

SEQ ID NO: 8370329 - DNA, 22 bp, Homo sapiens
aattatattgtggtgtgaatgt

SEQ ID NO: 8370330 - DNA, 23 bp, Homo sapiens
aattatctatttcaaatttagca

SEQ ID NO: 8370331 - DNA, 22 bp, Homo sapiens
aattggaaaaagacttaattgc

SEQ ID NO: 8370332 - DNA, 22 bp, Homo sapiens
aattatgcaaccaatgaccacg

SEQ ID NO: 8370333 - DNA, 22 bp, Homo sapiens
aattatgcaaccaatgaccacg

SEQ ID NO: 8370334 - DNA, 22 bp, Homo sapiens
agagctgggacttggactcaat

SEQ ID NO: 8370335 - DNA, 22 bp, Homo sapiens
aatttacacttcatttggaggg

SEQ ID NO: 8370336 - DNA, 22 bp, Homo sapiens
aatttagattgataaacatgga

SEQ ID NO: 8370337 - DNA, 20 bp, Homo sapiens
aatttactcacagaatgaat

SEQ ID NO: 8370338 - DNA, 22 bp, Homo sapiens
aatgtcatagcatttcttcaat

SEQ ID NO: 8370339 - DNA, 22 bp, Homo sapiens
aatgtcatgggaatttattcat

SEQ ID NO: 8370340 - DNA, 22 bp, Homo sapiens
aatgtcattgagctccaatcct

SEQ ID NO: 8370341 - DNA, 22 bp, Homo sapiens
aatgtcactctgtttcctctgc

SEQ ID NO: 8370342 - DNA, 22 bp, Homo sapiens
aatgtcagcctgaaagctattc

SEQ ID NO: 8370343 - DNA, 22 bp, Homo sapiens
aatgtcatagcaaagagagtga

SEQ ID NO: 8370344 - DNA, 22 bp, Homo sapiens
agacagggccactcatcctcac

SEQ ID NO: 8370345 - DNA, 22 bp, Homo sapiens
agacagggtcttgatcagagct

SEQ ID NO: 8370346 - DNA, 22 bp, Homo sapiens
agacagggtcttgatcagagct

SEQ ID NO: 8370347 - DNA, 22 bp, Homo sapiens
agacagggtgatcgcttgagcc

SEQ ID NO: 8370348 - DNA, 22 bp, Homo sapiens
agacagggtgatcgcttgagcc

SEQ ID NO: 8370349 - DNA, 22 bp, Homo sapiens
agacagggtcttgatcagagct

SEQ ID NO: 8370350 - DNA, 22 bp, Homo sapiens
aatgtcattgtgagttaggctt

SEQ ID NO: 8370351 - DNA, 22 bp, Homo sapiens
aatgtctgtgccttaaaacttc

SEQ ID NO: 8370352 - DNA, 22 bp, Homo sapiens
aatgtcttaaagtcgtgttaca

SEQ ID NO: 8370353 - DNA, 22 bp, Homo sapiens
aatgtgtttagttaatgagttg

SEQ ID NO: 8370354 - DNA, 22 bp, Homo sapiens
aatgtctgaggctcatctgagg

SEQ ID NO: 8370355 - DNA, 21 bp, Homo sapiens
agacagagtgcagtctacata

SEQ ID NO: 8370356 - DNA, 22 bp, Homo sapiens
agacagcaatatgggagacgga

SEQ ID NO: 8370357 - DNA, 23 bp, Homo sapiens
agacagaggctgaggctggccgc

SEQ ID NO: 8370358 - DNA, 22 bp, Homo sapiens
agacagcagaaactagagcact

SEQ ID NO: 8370359 - DNA, 19 bp, Homo sapiens
agacagagactgaaataga

SEQ ID NO: 8370360 - DNA, 19 bp, Homo sapiens
agacagagctcagtgggtt

SEQ ID NO: 8370361 - DNA, 22 bp, Homo sapiens
aatgcaatgcagcacctccttg

SEQ ID NO: 8370362 - DNA, 18 bp, Homo sapiens
aatgcaatgtatttgcag

SEQ ID NO: 8370363 - DNA, 22 bp, Homo sapiens
aatgcaagtcaatgctataccc

SEQ ID NO: 8370364 - DNA, 22 bp, Homo sapiens
aatgcaaggcctgtatctgatt

SEQ ID NO: 8370365 - DNA, 22 bp, Homo sapiens
aatgcaaggcctgtatctgatt

SEQ ID NO: 8370366 - DNA, 22 bp, Homo sapiens
aatgcaagatcaaatctaacac

SEQ ID NO: 8370367 - DNA, 22 bp, Homo sapiens
agaggccatctgctctgtgggg

SEQ ID NO: 8370368 - DNA, 22 bp, Homo sapiens
aattttctgcctagcaaaaact

SEQ ID NO: 8370369 - DNA, 22 bp, Homo sapiens
aattttctgcctagcaaaaact

SEQ ID NO: 8370370 - DNA, 22 bp, Homo sapiens
aattttctgcctagcaaaaact

SEQ ID NO: 8370371 - DNA, 22 bp, Homo sapiens
aattttctgatgatgaagcacg

SEQ ID NO: 8370372 - DNA, 22 bp, Homo sapiens
aattttctaaggtgatgatctg

SEQ ID NO: 8370373 - DNA, 22 bp, Homo sapiens
aattttctaaggtgatgatctg

SEQ ID NO: 8370374 - DNA, 20 bp, Homo sapiens
acaaaataggtactgggtag

SEQ ID NO: 8370375 - DNA, 20 bp, Homo sapiens
acaaaataggtactgggtag

SEQ ID NO: 8370376 - DNA, 22 bp, Homo sapiens
acaaaatagagttctcccctgg

SEQ ID NO: 8370377 - DNA, 22 bp, Homo sapiens
acaaaaagggagatgaggtaga

SEQ ID NO: 8370378 - DNA, 22 bp, Homo sapiens
acaaaaagggagatgaggtaga

SEQ ID NO: 8370379 - DNA, 22 bp, Homo sapiens
agagctggggccagagtcaagg

SEQ ID NO: 8370380 - DNA, 22 bp, Homo sapiens
agagctggggccagagtcaagg

SEQ ID NO: 8370381 - DNA, 22 bp, Homo sapiens
agagctgggtgaagtgccatca

SEQ ID NO: 8370382 - DNA, 22 bp, Homo sapiens
aattttcacagtgctgtgagat

SEQ ID NO: 8370383 - DNA, 22 bp, Homo sapiens
aattttattaactggatgtagc

SEQ ID NO: 8370384 - DNA, 22 bp, Homo sapiens
aattttatgccttgcacgttgg

SEQ ID NO: 8370385 - DNA, 22 bp, Homo sapiens
aattttatctctaagcaggctt

SEQ ID NO: 8370386 - DNA, 22 bp, Homo sapiens
aattttatgccttgcacgttgg

SEQ ID NO: 8370387 - DNA, 22 bp, Homo sapiens
aattttatgccttgcacgttgg

SEQ ID NO: 8370388 - DNA, 22 bp, Homo sapiens
aatttgttacacagcaatataa

SEQ ID NO: 8370389 - DNA, 21 bp, Homo sapiens
acaaactgaaatgagtttcct

SEQ ID NO: 8370390 - DNA, 22 bp, Homo sapiens
acaaactgggataggatcctgt

SEQ ID NO: 8370391 - DNA, 22 bp, Homo sapiens
acaaacagagttgaaaaatagg

SEQ ID NO: 8370392 - DNA, 22 bp, Homo sapiens
acaaacagctaacatatgttaa

SEQ ID NO: 8370393 - DNA, 22 bp, Homo sapiens
acaaaccagcttaagcaagatg

SEQ ID NO: 8370394 - DNA, 22 bp, Homo sapiens
acaaaattacctagttattttc

SEQ ID NO: 8370395 - DNA, 20 bp, Homo sapiens
acaaaataggtactgggtag

SEQ ID NO: 8370396 - DNA, 22 bp, Homo sapiens
acaaaattgtgttaaactttat

SEQ ID NO: 8370397 - DNA, 22 bp, Homo sapiens
acaaaattgtgttaaactttat

SEQ ID NO: 8370398 - DNA, 22 bp, Homo sapiens
acaaacacgagacgccactgtg

SEQ ID NO: 8370399 - DNA, 22 bp, Homo sapiens
acaagtttatttgattagaaca

SEQ ID NO: 8370400 - DNA, 22 bp, Homo sapiens
acaagtttatttgattagaaca

SEQ ID NO: 8370401 - DNA, 22 bp, Homo sapiens
acaaattctttctgcctattgg

SEQ ID NO: 8370402 - DNA, 22 bp, Homo sapiens
acaaggaacaagcatgtagttt

SEQ ID NO: 8370403 - DNA, 22 bp, Homo sapiens
acaagggattgttgagtagtct

SEQ ID NO: 8370404 - DNA, 22 bp, Homo sapiens
acaaattatagaaaattgagct

SEQ ID NO: 8370405 - DNA, 22 bp, Homo sapiens
acaaatgttggatttgtcttcc

SEQ ID NO: 8370406 - DNA, 22 bp, Homo sapiens
acaaatgttacataagtttgga

SEQ ID NO: 8370407 - DNA, 22 bp, Homo sapiens
acaaatgtctacattgagaata

SEQ ID NO: 8370408 - DNA, 22 bp, Homo sapiens
acaaatgtctacattgagaata

SEQ ID NO: 8370409 - DNA, 22 bp, Homo sapiens
acaaatggagaaactgaggccc

SEQ ID NO: 8370410 - DNA, 22 bp, Homo sapiens
acaaatgtggacatggataatg

SEQ ID NO: 8370411 - DNA, 22 bp, Homo sapiens
acaaatgtggacatggataatg

SEQ ID NO: 8370412 - DNA, 22 bp, Homo sapiens
acaaatgtctcctcttttgtta

SEQ ID NO: 8370413 - DNA, 22 bp, Homo sapiens
agcaaggaaactatggagagat

SEQ ID NO: 8370414 - DNA, 18 bp, Homo sapiens
agcaagcagttttcatgt

SEQ ID NO: 8370415 - DNA, 18 bp, Homo sapiens
agcaagcagttttcatgt

SEQ ID NO: 8370416 - DNA, 22 bp, Homo sapiens
agcaagattgaggcttcctcag

SEQ ID NO: 8370417 - DNA, 22 bp, Homo sapiens
agcaagattgaggcttcctcag

SEQ ID NO: 8370418 - DNA, 22 bp, Homo sapiens
agcaagcagaattctgtcctct

SEQ ID NO: 8370419 - DNA, 22 bp, Homo sapiens
agcaaggcagctttcactgctt

SEQ ID NO: 8370420 - DNA, 22 bp, Homo sapiens
agcacaggtacggagatgctac

SEQ ID NO: 8370421 - DNA, 22 bp, Homo sapiens
agcaaggaaagtaggcacggaa

SEQ ID NO: 8370422 - DNA, 22 bp, Homo sapiens
agcaaggaaagtaggcacggaa

SEQ ID NO: 8370423 - DNA, 22 bp, Homo sapiens
acaattagctgtgtgtctatct

SEQ ID NO: 8370424 - DNA, 22 bp, Homo sapiens
acaattagtgatcagtgatgcc

SEQ ID NO: 8370425 - DNA, 22 bp, Homo sapiens
acaattcaagaagagagatgaa

SEQ ID NO: 8370426 - DNA, 22 bp, Homo sapiens
acaattcaagatgagattcagg

SEQ ID NO: 8370427 - DNA, 22 bp, Homo sapiens
acaattcaagcaagagagacaa

SEQ ID NO: 8370428 - DNA, 22 bp, Homo sapiens
acaattcactccagtgacccca

SEQ ID NO: 8370429 - DNA, 22 bp, Homo sapiens
acaattcattaatgtgaggtag

SEQ ID NO: 8370430 - DNA, 22 bp, Homo sapiens
acaatgttttgaaacatctagg

SEQ ID NO: 8370431 - DNA, 22 bp, Homo sapiens
acagcaaaggacgaacactctg

SEQ ID NO: 8370432 - DNA, 22 bp, Homo sapiens
acagcaaaagacaagaacttaa

SEQ ID NO: 8370433 - DNA, 22 bp, Homo sapiens
acagcaactcctgcttctgagt

SEQ ID NO: 8370434 - DNA, 17 bp, Homo sapiens
agcctgccccatgctgc

SEQ ID NO: 8370435 - DNA, 17 bp, Homo sapiens
agcctgccccatgctgc

SEQ ID NO: 8370436 - DNA, 17 bp, Homo sapiens
agcctgccccatgctgc

SEQ ID NO: 8370437 - DNA, 22 bp, Homo sapiens
agcctgcctgtgaggctttgag

SEQ ID NO: 8370438 - DNA, 22 bp, Homo sapiens
agcctgcctcagactcaggata

SEQ ID NO: 8370439 - DNA, 22 bp, Homo sapiens
agcctgcctcagactcaggata

SEQ ID NO: 8370440 - DNA, 20 bp, Homo sapiens
agcctgccagctggcccaga

SEQ ID NO: 8370441 - DNA, 22 bp, Homo sapiens
agcctgccaggcgctgcctgga

SEQ ID NO: 8370442 - DNA, 22 bp, Homo sapiens
agcctgcacctgaccaacctgc

SEQ ID NO: 8370443 - DNA, 22 bp, Homo sapiens
agctaggataagcagagactgg

SEQ ID NO: 8370444 - DNA, 22 bp, Homo sapiens
acagcaagacccctagcatggt

SEQ ID NO: 8370445 - DNA, 22 bp, Homo sapiens
agctaggggaccaaggtggccc

SEQ ID NO: 8370446 - DNA, 22 bp, Homo sapiens
agctaggggaccaaggtggccc

SEQ ID NO: 8370447 - DNA, 17 bp, Homo sapiens
agctagggcctagaatc

SEQ ID NO: 8370448 - DNA, 22 bp, Homo sapiens
agctaggggaccaaggtggccc

SEQ ID NO: 8370449 - DNA, 22 bp, Homo sapiens
agctagggacagataccagcca

SEQ ID NO: 8370450 - DNA, 22 bp, Homo sapiens
agctagttcagagagatatgta

SEQ ID NO: 8370451 - DNA, 22 bp, Homo sapiens
agctcctgtgtgcccacctgct

SEQ ID NO: 8370452 - DNA, 22 bp, Homo sapiens
acagcaggcatgaatgacactg

SEQ ID NO: 8370453 - DNA, 22 bp, Homo sapiens
acagcaggcatgaagaaatgtt

SEQ ID NO: 8370454 - DNA, 22 bp, Homo sapiens
acagcaggcatgaagaaatgtt

SEQ ID NO: 8370455 - DNA, 22 bp, Homo sapiens
acagcaggcatgaagaaatgtt

SEQ ID NO: 8370456 - DNA, 22 bp, Homo sapiens
acagcaggatttggcgatgttg

SEQ ID NO: 8370457 - DNA, 22 bp, Homo sapiens
acagcaggcacacaaggataga

SEQ ID NO: 8370458 - DNA, 22 bp, Homo sapiens
acagcaggcacacaaggataga

SEQ ID NO: 8370459 - DNA, 22 bp, Homo sapiens
acagcaggcacacaaggataga

SEQ ID NO: 8370460 - DNA, 22 bp, Homo sapiens
acagcaggcatgaagaaatgtt

SEQ ID NO: 8370461 - DNA, 22 bp, Homo sapiens
agctcaagcgtgggctgggcgc

SEQ ID NO: 8370462 - DNA, 21 bp, Homo sapiens
agctatttcagatttgagagc

SEQ ID NO: 8370463 - DNA, 22 bp, Homo sapiens
agctatttcaaagtttgagaca

SEQ ID NO: 8370464 - DNA, 22 bp, Homo sapiens
acagcaggaattaacatataag

SEQ ID NO: 8370465 - DNA, 22 bp, Homo sapiens
acagcaggaattaacatataag

SEQ ID NO: 8370466 - DNA, 22 bp, Homo sapiens
acagcaggatttggcgatgttg

SEQ ID NO: 8370467 - DNA, 22 bp, Homo sapiens
acagcaggagccttcatatgct

SEQ ID NO: 8370468 - DNA, 22 bp, Homo sapiens
acagcaggagccttcatatgct

SEQ ID NO: 8370469 - DNA, 22 bp, Homo sapiens
agctctgggctgacatgctccc

SEQ ID NO: 8370470 - DNA, 22 bp, Homo sapiens
agctctgggctgacatgctccc

SEQ ID NO: 8370471 - DNA, 22 bp, Homo sapiens
agctctgggggaaagtctgctc

SEQ ID NO: 8370472 - DNA, 22 bp, Homo sapiens
agctctgggggaaagtctgctc

SEQ ID NO: 8370473 - DNA, 22 bp, Homo sapiens
agctcctgttctgagagcagga

SEQ ID NO: 8370474 - DNA, 22 bp, Homo sapiens
agctcctgttctgagagcagga

SEQ ID NO: 8370475 - DNA, 19 bp, Homo sapiens
agctcctgttcagcagctc

SEQ ID NO: 8370476 - DNA, 22 bp, Homo sapiens
agctctcaagataagaaagaac

SEQ ID NO: 8370477 - DNA, 22 bp, Homo sapiens
agctctatcacctgtcagttgc

SEQ ID NO: 8370478 - DNA, 22 bp, Homo sapiens
agccacagtcaacctgtccata

SEQ ID NO: 8370479 - DNA, 22 bp, Homo sapiens
agccacaggtgttggccagtgt

SEQ ID NO: 8370480 - DNA, 22 bp, Homo sapiens
agccacagtcaacctgtccata

SEQ ID NO: 8370481 - DNA, 22 bp, Homo sapiens
agccacagtcaacctgtccata

SEQ ID NO: 8370482 - DNA, 22 bp, Homo sapiens
agccacagtcaacctgtccata

SEQ ID NO: 8370483 - DNA, 22 bp, Homo sapiens
agccacagtctgatgcctgaga

SEQ ID NO: 8370484 - DNA, 22 bp, Homo sapiens
agccagggtgggtgaatgctat

SEQ ID NO: 8370485 - DNA, 22 bp, Homo sapiens
agccatcctccacagccttgat

SEQ ID NO: 8370486 - DNA, 22 bp, Homo sapiens
agccatttcatacacctgcagc

SEQ ID NO: 8370487 - DNA, 22 bp, Homo sapiens
agccatgtcacatatggtcatc

SEQ ID NO: 8370488 - DNA, 22 bp, Homo sapiens
agccatgtcacatatggtcatc

SEQ ID NO: 8370489 - DNA, 22 bp, Homo sapiens
agcccagctttcacccctctgg

SEQ ID NO: 8370490 - DNA, 22 bp, Homo sapiens
acagagagggagtgataaatcc

SEQ ID NO: 8370491 - DNA, 22 bp, Homo sapiens
agcccagcttccttctgtctct

SEQ ID NO: 8370492 - DNA, 19 bp, Homo sapiens
agcccagcttatttgtcag

SEQ ID NO: 8370493 - DNA, 22 bp, Homo sapiens
agcccagcttccttctgtctct

SEQ ID NO: 8370494 - DNA, 22 bp, Homo sapiens
acagagcaggtccagaagtgcc

SEQ ID NO: 8370495 - DNA, 22 bp, Homo sapiens
acagagcagtaagaacacagct

SEQ ID NO: 8370496 - DNA, 22 bp, Homo sapiens
acagagcactgccctgtgccgc

SEQ ID NO: 8370497 - DNA, 22 bp, Homo sapiens
acagagcactgccctgtgccgc

SEQ ID NO: 8370498 - DNA, 22 bp, Homo sapiens
agccattttcctgaaatataac

SEQ ID NO: 8370499 - DNA, 22 bp, Homo sapiens
agccatttggacttctggtagg

SEQ ID NO: 8370500 - DNA, 22 bp, Homo sapiens
agccatttcctgaactctggac

SEQ ID NO: 8370501 - DNA, 22 bp, Homo sapiens
agcccagcggagcgggcccggg

SEQ ID NO: 8370502 - DNA, 22 bp, Homo sapiens
agcccaaacctgcgagcagagc

SEQ ID NO: 8370503 - DNA, 22 bp, Homo sapiens
agcccagctcctccacagaata

SEQ ID NO: 8370504 - DNA, 18 bp, Homo sapiens
agcccagcggagtgaatc

SEQ ID NO: 8370505 - DNA, 22 bp, Homo sapiens
agcccagctgcctgcctgctgt

SEQ ID NO: 8370506 - DNA, 22 bp, Homo sapiens
agcccagctgctatgtacctgg

SEQ ID NO: 8370507 - DNA, 22 bp, Homo sapiens
acagagcatttgggacagagag

SEQ ID NO: 8370508 - DNA, 22 bp, Homo sapiens
acagagcatgatggaagatcga

SEQ ID NO: 8370509 - DNA, 22 bp, Homo sapiens
acagagcagttctggagctggc

SEQ ID NO: 8370510 - DNA, 22 bp, Homo sapiens
acagagcagtaagaacacagct

SEQ ID NO: 8370511 - DNA, 21 bp, Homo sapiens
acagagcataatggtgtggca

SEQ ID NO: 8370512 - DNA, 22 bp, Homo sapiens
acagagcataatgtctagcaca

SEQ ID NO: 8370513 - DNA, 22 bp, Homo sapiens
agccccctccctagtgactgga

SEQ ID NO: 8370514 - DNA, 22 bp, Homo sapiens
agcccccagtctaaactgttgg

SEQ ID NO: 8370515 - DNA, 22 bp, Homo sapiens
agcccccaggatgcaaaatgac

SEQ ID NO: 8370516 - DNA, 22 bp, Homo sapiens
agcccccaggagtctccacgcc

SEQ ID NO: 8370517 - DNA, 22 bp, Homo sapiens
agcccccaggagtctccacgcc

SEQ ID NO: 8370518 - DNA, 22 bp, Homo sapiens
acagagtctgacaggtaggcgc

SEQ ID NO: 8370519 - DNA, 22 bp, Homo sapiens
acagagtctgacaggtaggcgc

SEQ ID NO: 8370520 - DNA, 22 bp, Homo sapiens
acagagtctcagggatgaaagc

SEQ ID NO: 8370521 - DNA, 22 bp, Homo sapiens
acagagtctcagggatgaaagc

SEQ ID NO: 8370522 - DNA, 22 bp, Homo sapiens
acagagtcttacgtggtgataa

SEQ ID NO: 8370523 - DNA, 22 bp, Homo sapiens
acagagtctcaaacctacaaag

SEQ ID NO: 8370524 - DNA, 22 bp, Homo sapiens
agcagggcatgaataagggttt

SEQ ID NO: 8370525 - DNA, 22 bp, Homo sapiens
agcagggcagttaaagggtcct

SEQ ID NO: 8370526 - DNA, 22 bp, Homo sapiens
agcagggccaacagtaaacacc

SEQ ID NO: 8370527 - DNA, 18 bp, Homo sapiens
agcagggcattttgccat

SEQ ID NO: 8370528 - DNA, 22 bp, Homo sapiens
agcagggcccactaggggagat

SEQ ID NO: 8370529 - DNA, 22 bp, Homo sapiens
agcagggcccactaggggagat

SEQ ID NO: 8370530 - DNA, 23 bp, Homo sapiens
acactgtctcatggatagactgc

SEQ ID NO: 8370531 - DNA, 22 bp, Homo sapiens
acactgtctgggactcaggagt

SEQ ID NO: 8370532 - DNA, 22 bp, Homo sapiens
acactgcagatgtaatttgagt

SEQ ID NO: 8370533 - DNA, 18 bp, Homo sapiens
acactgcagcagtctgct

SEQ ID NO: 8370534 - DNA, 22 bp, Homo sapiens
acactgtaggagaaaggagttt

SEQ ID NO: 8370535 - DNA, 22 bp, Homo sapiens
acactgtagatatagagttagt

SEQ ID NO: 8370536 - DNA, 22 bp, Homo sapiens
acacattatctcattaaatact

SEQ ID NO: 8370537 - DNA, 22 bp, Homo sapiens
acacattatctcattaaatact

SEQ ID NO: 8370538 - DNA, 22 bp, Homo sapiens
acacatttctctttttgtaagt

SEQ ID NO: 8370539 - DNA, 22 bp, Homo sapiens
agcaggaaagaaaaatctgtgt

SEQ ID NO: 8370540 - DNA, 22 bp, Homo sapiens
acacattataggcaatcaaaag

SEQ ID NO: 8370541 - DNA, 22 bp, Homo sapiens
acacattataggcaatcaaaag

SEQ ID NO: 8370542 - DNA, 19 bp, Homo sapiens
acacatttgcacaatccac

SEQ ID NO: 8370543 - DNA, 22 bp, Homo sapiens
acacatttgcataatacctcat

SEQ ID NO: 8370544 - DNA, 22 bp, Homo sapiens
acacatttgggctcctacataa

SEQ ID NO: 8370545 - DNA, 22 bp, Homo sapiens
acacatttgggctcctacataa

SEQ ID NO: 8370546 - DNA, 22 bp, Homo sapiens
acacatttgctaaaatgagctc

SEQ ID NO: 8370547 - DNA, 22 bp, Homo sapiens
agcagggcagtgcttcagctct

SEQ ID NO: 8370548 - DNA, 23 bp, Homo sapiens
acacatttttcccgttctgaggt

SEQ ID NO: 8370549 - DNA, 23 bp, Homo sapiens
acacatttttcccgttctgaggt

SEQ ID NO: 8370550 - DNA, 22 bp, Homo sapiens
acacattttcaacactgtcaag

SEQ ID NO: 8370551 - DNA, 22 bp, Homo sapiens
acacattttcaacactgtcaag

SEQ ID NO: 8370552 - DNA, 22 bp, Homo sapiens
acacattttctaacagggatca

SEQ ID NO: 8370553 - DNA, 22 bp, Homo sapiens
acacattttggctaggtggaga

SEQ ID NO: 8370554 - DNA, 22 bp, Homo sapiens
acacattttgttaaaccctgtg

SEQ ID NO: 8370555 - DNA, 22 bp, Homo sapiens
acacattttggctaggtggaga

SEQ ID NO: 8370556 - DNA, 22 bp, Homo sapiens
acagaaagatgatttgaaatgg

SEQ ID NO: 8370557 - DNA, 22 bp, Homo sapiens
agcagtgttcaatgatacactg

SEQ ID NO: 8370558 - DNA, 22 bp, Homo sapiens
acagaacaagacctgcttattg

SEQ ID NO: 8370559 - DNA, 22 bp, Homo sapiens
agccacaggaaacagagacagc

SEQ ID NO: 8370560 - DNA, 22 bp, Homo sapiens
acagaaattctgggacagaaaa

SEQ ID NO: 8370561 - DNA, 22 bp, Homo sapiens
agcagcagtcctttgtgtaatt

SEQ ID NO: 8370562 - DNA, 22 bp, Homo sapiens
agcagcagtacatataagacta

SEQ ID NO: 8370563 - DNA, 22 bp, Homo sapiens
acacataagaaactacaaagag

SEQ ID NO: 8370564 - DNA, 23 bp, Homo sapiens
agcagcagtgagaggtgtcttac

SEQ ID NO: 8370565 - DNA, 22 bp, Homo sapiens
agcagcagtgtggtttggggaa

SEQ ID NO: 8370566 - DNA, 22 bp, Homo sapiens
agcagcagtgtgtggtcatgtt

SEQ ID NO: 8370567 - DNA, 22 bp, Homo sapiens
agcagcagtgtgtggtcatgtt

SEQ ID NO: 8370568 - DNA, 22 bp, Homo sapiens
agcagcagtcctttgtgtaatt

SEQ ID NO: 8370569 - DNA, 22 bp, Homo sapiens
agcagcagtgacagccgaaagc

SEQ ID NO: 8370570 - DNA, 22 bp, Homo sapiens
acacatatctaagatagatgac

SEQ ID NO: 8370571 - DNA, 22 bp, Homo sapiens
acacatatgtatgcatcatgtg

SEQ ID NO: 8370572 - DNA, 21 bp, Homo sapiens
agcagcttgagtctggagctc

SEQ ID NO: 8370573 - DNA, 22 bp, Homo sapiens
agcagcttgggtctctcctgct

SEQ ID NO: 8370574 - DNA, 18 bp, Homo sapiens
agcagctttgtgcttgat

SEQ ID NO: 8370575 - DNA, 22 bp, Homo sapiens
agcagctttcacctccccgcct

SEQ ID NO: 8370576 - DNA, 22 bp, Homo sapiens
agcagctttaagtcactggtta

SEQ ID NO: 8370577 - DNA, 22 bp, Homo sapiens
agcagctttcctctggggtcag

SEQ ID NO: 8370578 - DNA, 22 bp, Homo sapiens
agcagcttgttaaaaagttcca

SEQ ID NO: 8370579 - DNA, 22 bp, Homo sapiens
agcaccattgcaaatatggcag

SEQ ID NO: 8370580 - DNA, 22 bp, Homo sapiens
agcaccatttatcatctaggta

SEQ ID NO: 8370581 - DNA, 22 bp, Homo sapiens
agcacccttcagcccagcctgg

SEQ ID NO: 8370582 - DNA, 22 bp, Homo sapiens
agcaccctccaacttccctgta

SEQ ID NO: 8370583 - DNA, 22 bp, Homo sapiens
agcaccctcccaccctctcaga

SEQ ID NO: 8370584 - DNA, 20 bp, Homo sapiens
agcacctcccatatgctaga

SEQ ID NO: 8370585 - DNA, 22 bp, Homo sapiens
agcaccgtcatagccaggtaag

SEQ ID NO: 8370586 - DNA, 22 bp, Homo sapiens
agcaccgttcaaacccaggtta

SEQ ID NO: 8370587 - DNA, 22 bp, Homo sapiens
agcacctccttagctatgacca

SEQ ID NO: 8370588 - DNA, 22 bp, Homo sapiens
agcacctgcacagtggaggaaa

SEQ ID NO: 8370589 - DNA, 22 bp, Homo sapiens
acaattgtggcaatttgtatgt

SEQ ID NO: 8370590 - DNA, 22 bp, Homo sapiens
acaattgtggcaatttgtatgt

SEQ ID NO: 8370591 - DNA, 20 bp, Homo sapiens
acaattgtccctgtctgtca

SEQ ID NO: 8370592 - DNA, 22 bp, Homo sapiens
acaatttatccattgtatagtt

SEQ ID NO: 8370593 - DNA, 22 bp, Homo sapiens
agcacctgctatgtgtcaggga

SEQ ID NO: 8370594 - DNA, 22 bp, Homo sapiens
acacaggagatatgtaatggct

SEQ ID NO: 8370595 - DNA, 22 bp, Homo sapiens
acacaggaggaggatggtggtc

SEQ ID NO: 8370596 - DNA, 22 bp, Homo sapiens
acacaggagatatgtaatggct

SEQ ID NO: 8370597 - DNA, 22 bp, Homo sapiens
acaattttccccataggttatc

SEQ ID NO: 8370598 - DNA, 22 bp, Homo sapiens
acaattttccccataggttatc

SEQ ID NO: 8370599 - DNA, 22 bp, Homo sapiens
acaattttaagccagagtgggt

SEQ ID NO: 8370600 - DNA, 22 bp, Homo sapiens
acacaggaagagagataataat

SEQ ID NO: 8370601 - DNA, 22 bp, Homo sapiens
acacaggaactctgagaggtgg

SEQ ID NO: 8370602 - DNA, 22 bp, Homo sapiens
acacagatgggtagaaaacaga

SEQ ID NO: 8370603 - DNA, 20 bp, Homo sapiens
aaagtgtaagcatataatta

SEQ ID NO: 8370604 - DNA, 22 bp, Homo sapiens
aaagtcaatgatttctcctgga

SEQ ID NO: 8370605 - DNA, 22 bp, Homo sapiens
aaagtgctgtgggctgtaagtg

SEQ ID NO: 8370606 - DNA, 22 bp, Homo sapiens
aaagtggccatcctctgcatcg

SEQ ID NO: 8370607 - DNA, 22 bp, Homo sapiens
aaagtattcaaaaatatttggt

SEQ ID NO: 8370608 - DNA, 22 bp, Homo sapiens
aaagtattcaaaaatatttggt

SEQ ID NO: 8370609 - DNA, 22 bp, Homo sapiens
aaagtcaaaatgctctcctgtc

SEQ ID NO: 8370610 - DNA, 22 bp, Homo sapiens
aaagtcaaggtttagactagag

SEQ ID NO: 8370611 - DNA, 22 bp, Homo sapiens
aaagtatatttacttactgtga

SEQ ID NO: 8370612 - DNA, 22 bp, Homo sapiens
aaagtatcaagggaagcatttt

SEQ ID NO: 8370613 - DNA, 22 bp, Homo sapiens
aaagtatcaagggaagcatttt

SEQ ID NO: 8370614 - DNA, 22 bp, Homo sapiens
aaaggaagatgccaggactctg

SEQ ID NO: 8370615 - DNA, 22 bp, Homo sapiens
aaaggaagattgagcttttcca

SEQ ID NO: 8370616 - DNA, 22 bp, Homo sapiens
aaaggaaaataagtagttccat

SEQ ID NO: 8370617 - DNA, 22 bp, Homo sapiens
aaagcttttgttttcgtaactg

SEQ ID NO: 8370618 - DNA, 22 bp, Homo sapiens
aaagcttttcagtatgttcatg

SEQ ID NO: 8370619 - DNA, 22 bp, Homo sapiens
aaagctttgtaaataaacaggt

SEQ ID NO: 8370620 - DNA, 22 bp, Homo sapiens
aaaggtttccgagctttaattt

SEQ ID NO: 8370621 - DNA, 22 bp, Homo sapiens
aaaggtttatttaatcagggag

SEQ ID NO: 8370622 - DNA, 22 bp, Homo sapiens
aaaggtttattgattctgctct

SEQ ID NO: 8370623 - DNA, 22 bp, Homo sapiens
aaagtagaacattttcttatct

SEQ ID NO: 8370624 - DNA, 22 bp, Homo sapiens
aaagctggcctctcaggcttta

SEQ ID NO: 8370625 - DNA, 22 bp, Homo sapiens
aaagcttagcattttcaaaatg

SEQ ID NO: 8370626 - DNA, 22 bp, Homo sapiens
aaagcttaccttttcagtcttt

SEQ ID NO: 8370627 - DNA, 22 bp, Homo sapiens
aaagctttgctggaaggaagag

SEQ ID NO: 8370628 - DNA, 22 bp, Homo sapiens
aaagctttgctggaaggaagag

SEQ ID NO: 8370629 - DNA, 22 bp, Homo sapiens
aaagctttgggtaggaatggga

SEQ ID NO: 8370630 - DNA, 22 bp, Homo sapiens
aaagcttctattcacttacttg

SEQ ID NO: 8370631 - DNA, 22 bp, Homo sapiens
aaagctgttgtatggcccttgg

SEQ ID NO: 8370632 - DNA, 18 bp, Homo sapiens
aaagctgttattccagaa

SEQ ID NO: 8370633 - DNA, 23 bp, Homo sapiens
aaagcttaactgggtaataaagc

SEQ ID NO: 8370634 - DNA, 22 bp, Homo sapiens
aaagctgttaaatgcataatgc

SEQ ID NO: 8370635 - DNA, 22 bp, Homo sapiens
aaagctgtagaatcatcttaat

SEQ ID NO: 8370636 - DNA, 22 bp, Homo sapiens
aaagctgtcaaggcaggaggct

SEQ ID NO: 8370637 - DNA, 18 bp, Homo sapiens
aaagctgttattccagaa

SEQ ID NO: 8370638 - DNA, 22 bp, Homo sapiens
aaagctgggggccctggtctag

SEQ ID NO: 8370639 - DNA, 22 bp, Homo sapiens
aaagctggttattctgaggcag

SEQ ID NO: 8370640 - DNA, 22 bp, Homo sapiens
aaagctgtaatgcatgctttct

SEQ ID NO: 8370641 - DNA, 22 bp, Homo sapiens
aacagcagaaactgcaagctac

SEQ ID NO: 8370642 - DNA, 22 bp, Homo sapiens
aacagataagtatatctatgta

SEQ ID NO: 8370643 - DNA, 22 bp, Homo sapiens
aacagatttgtgaagctactca

SEQ ID NO: 8370644 - DNA, 23 bp, Homo sapiens
aaagatcaaagtggcaggcctgt

SEQ ID NO: 8370645 - DNA, 22 bp, Homo sapiens
aaagatcagaggatagctgagt

SEQ ID NO: 8370646 - DNA, 22 bp, Homo sapiens
aaagatcacgtcccaggactcg

SEQ ID NO: 8370647 - DNA, 22 bp, Homo sapiens
aaagccacgtggcctggggagc

SEQ ID NO: 8370648 - DNA, 22 bp, Homo sapiens
aaagatcagaggatagctgagt

SEQ ID NO: 8370649 - DNA, 22 bp, Homo sapiens
aaagccacagttctatgtctgc

SEQ ID NO: 8370650 - DNA, 22 bp, Homo sapiens
aaagccagtttctggaagtacc

SEQ ID NO: 8370651 - DNA, 22 bp, Homo sapiens
aaagccagttcttagagaaagc

SEQ ID NO: 8370652 - DNA, 22 bp, Homo sapiens
aaagccagtggtatgagagaaa

SEQ ID NO: 8370653 - DNA, 22 bp, Homo sapiens
aaagccagtggtatgagagaaa

SEQ ID NO: 8370654 - DNA, 22 bp, Homo sapiens
aaagccaggttgtgtgcaggaa

SEQ ID NO: 8370655 - DNA, 22 bp, Homo sapiens
aaagccagggtccaggcctgcc

SEQ ID NO: 8370656 - DNA, 22 bp, Homo sapiens
aaattgtggcgtctgtaagagt

SEQ ID NO: 8370657 - DNA, 22 bp, Homo sapiens
aaattttagactcctgggtcta

SEQ ID NO: 8370658 - DNA, 22 bp, Homo sapiens
aaattttagtaaggaagttgag

SEQ ID NO: 8370659 - DNA, 22 bp, Homo sapiens
aaagataatgtttccttattct

SEQ ID NO: 8370660 - DNA, 22 bp, Homo sapiens
aaagagtttggagacaagatca

SEQ ID NO: 8370661 - DNA, 22 bp, Homo sapiens
aaagagtttggagacaagatca

SEQ ID NO: 8370662 - DNA, 22 bp, Homo sapiens
aaagagtttccattgacatttc

SEQ ID NO: 8370663 - DNA, 22 bp, Homo sapiens
aagcatcaacctgtatgctgca

SEQ ID NO: 8370664 - DNA, 22 bp, Homo sapiens
aaatgtacaacatccatatata

SEQ ID NO: 8370665 - DNA, 22 bp, Homo sapiens
aaatgtacactttgcatcttga

SEQ ID NO: 8370666 - DNA, 22 bp, Homo sapiens
aaatgtacactttgcatcttga

SEQ ID NO: 8370667 - DNA, 18 bp, Homo sapiens
aaatggcagaatggatag

SEQ ID NO: 8370668 - DNA, 22 bp, Homo sapiens
aagcatggctgagtgcaatggt

SEQ ID NO: 8370669 - DNA, 22 bp, Homo sapiens
aaatgtatcctacttcctgagt

SEQ ID NO: 8370670 - DNA, 22 bp, Homo sapiens
aaatgtattgcataggatattt

SEQ ID NO: 8370671 - DNA, 22 bp, Homo sapiens
aagctcttgagtaaactagttt

SEQ ID NO: 8370672 - DNA, 22 bp, Homo sapiens
aagctcttgttgaatcttgtca

SEQ ID NO: 8370673 - DNA, 22 bp, Homo sapiens
aagctgaagacacagctccagt

SEQ ID NO: 8370674 - DNA, 22 bp, Homo sapiens
aagctgaatctgaaatagaatt

SEQ ID NO: 8370675 - DNA, 22 bp, Homo sapiens
aagctgaattttctaaaagaat

SEQ ID NO: 8370676 - DNA, 22 bp, Homo sapiens
aagctgaattttctaaaagaat

SEQ ID NO: 8370677 - DNA, 22 bp, Homo sapiens
aagctgaagccggatcaaaaag

SEQ ID NO: 8370678 - DNA, 22 bp, Homo sapiens
aagctgaagccggatcaaaaag

SEQ ID NO: 8370679 - DNA, 22 bp, Homo sapiens
aagctgaatctgaaatagaatt

SEQ ID NO: 8370680 - DNA, 22 bp, Homo sapiens
aagcacagactccctctgagtg

SEQ ID NO: 8370681 - DNA, 22 bp, Homo sapiens
aagcacagacacaaaaggcttt

SEQ ID NO: 8370682 - DNA, 22 bp, Homo sapiens
aagcacagagatgggcacgcct

SEQ ID NO: 8370683 - DNA, 22 bp, Homo sapiens
aaatccttttctatacagcata

SEQ ID NO: 8370684 - DNA, 22 bp, Homo sapiens
aaatccttgatagtttgcccta

SEQ ID NO: 8370685 - DNA, 22 bp, Homo sapiens
aaatcctaatgacaagtttagt

SEQ ID NO: 8370686 - DNA, 22 bp, Homo sapiens
aaatgcaggattaacagctttg

SEQ ID NO: 8370687 - DNA, 22 bp, Homo sapiens
aaatgcaggaaattatgctttt

SEQ ID NO: 8370688 - DNA, 22 bp, Homo sapiens
aagcacagatgcaagggggacc

SEQ ID NO: 8370689 - DNA, 22 bp, Homo sapiens
aagcacagctggaacagcagga

SEQ ID NO: 8370690 - DNA, 22 bp, Homo sapiens
aagcatcaacactatattgatg

SEQ ID NO: 8370691 - DNA, 22 bp, Homo sapiens
aaatgcatatcaaagacttgaa

SEQ ID NO: 8370692 - DNA, 22 bp, Homo sapiens
aaataattgagttggtcaatat

SEQ ID NO: 8370693 - DNA, 22 bp, Homo sapiens
aaataattgagttggtcaatat

SEQ ID NO: 8370694 - DNA, 22 bp, Homo sapiens
aaataattgagttggtcaatat

SEQ ID NO: 8370695 - DNA, 22 bp, Homo sapiens
aaataattatagcgagtctatc

SEQ ID NO: 8370696 - DNA, 22 bp, Homo sapiens
aaatactgtagataatagagtt

SEQ ID NO: 8370697 - DNA, 22 bp, Homo sapiens
aaatactgtagataatagagtt

SEQ ID NO: 8370698 - DNA, 22 bp, Homo sapiens
aaatactggttttggagatgct

SEQ ID NO: 8370699 - DNA, 22 bp, Homo sapiens
aaatagcacagcagctgaggct

SEQ ID NO: 8370700 - DNA, 22 bp, Homo sapiens
aaatagcagaagcagagggggt

SEQ ID NO: 8370701 - DNA, 22 bp, Homo sapiens
aaatccattctgttttaaaagt

SEQ ID NO: 8370702 - DNA, 23 bp, Homo sapiens
aaataggagtatctggatcatga

SEQ ID NO: 8370703 - DNA, 22 bp, Homo sapiens
aaatagctacatgatctctagg

SEQ ID NO: 8370704 - DNA, 22 bp, Homo sapiens
aaatagcataaaataggaagct

SEQ ID NO: 8370705 - DNA, 22 bp, Homo sapiens
aaatagcagcctttagttaaca

SEQ ID NO: 8370706 - DNA, 22 bp, Homo sapiens
aaagtgtggcacaagtcacatc

SEQ ID NO: 8370707 - DNA, 22 bp, Homo sapiens
aaataacttatgatcgtctggc

SEQ ID NO: 8370708 - DNA, 22 bp, Homo sapiens
aaataagaaattcttctttgca

SEQ ID NO: 8370709 - DNA, 22 bp, Homo sapiens
aaataagaaattcttctttgca

SEQ ID NO: 8370710 - DNA, 22 bp, Homo sapiens
aaataagcacttaactgtatca

SEQ ID NO: 8370711 - DNA, 22 bp, Homo sapiens
aaataagaggacagatgtttgg

SEQ ID NO: 8370712 - DNA, 22 bp, Homo sapiens
aaataactttctgtgtatagtc

SEQ ID NO: 8370713 - DNA, 22 bp, Homo sapiens
aaataactttctgtgtatagtc

SEQ ID NO: 8370714 - DNA, 22 bp, Homo sapiens
aaataacttggtttcatcagag

SEQ ID NO: 8370715 - DNA, 22 bp, Homo sapiens
aaataattatagcgagtctatc

SEQ ID NO: 8370716 - DNA, 22 bp, Homo sapiens
aaataattatagcgagtctatc

SEQ ID NO: 8370717 - DNA, 22 bp, Homo sapiens
aaacagtttcattttcatgacc

SEQ ID NO: 8370718 - DNA, 22 bp, Homo sapiens
aaaggtaaagtatctgcccaag

SEQ ID NO: 8370719 - DNA, 22 bp, Homo sapiens
aaaggtaacagttataaccagg

SEQ ID NO: 8370720 - DNA, 22 bp, Homo sapiens
aaaggtaactggggttttgcca

SEQ ID NO: 8370721 - DNA, 22 bp, Homo sapiens
aaaggtatgatactgtgacatg

SEQ ID NO: 8370722 - DNA, 22 bp, Homo sapiens
aaacagttgttatttttatatg

SEQ ID NO: 8370723 - DNA, 22 bp, Homo sapiens
aaacagtggccaattctggaga

SEQ ID NO: 8370724 - DNA, 22 bp, Homo sapiens
aaacaatgagcttttacacact

SEQ ID NO: 8370725 - DNA, 22 bp, Homo sapiens
aaacaatgacaacacagctgcg

SEQ ID NO: 8370726 - DNA, 22 bp, Homo sapiens
aaacaatgtacacatgaatgtt

SEQ ID NO: 8370727 - DNA, 17 bp, Homo sapiens
aaacaatgcagacaagc

SEQ ID NO: 8370728 - DNA, 22 bp, Homo sapiens
aaacaatgtacatttataatgc

SEQ ID NO: 8370729 - DNA, 22 bp, Homo sapiens
aaacaatgtacatttataatgc

SEQ ID NO: 8370730 - DNA, 22 bp, Homo sapiens
aaacaatgttgtctccaagagg

SEQ ID NO: 8370731 - DNA, 22 bp, Homo sapiens
aaacagtgccaggcagatgcca

SEQ ID NO: 8370732 - DNA, 22 bp, Homo sapiens
aaacagctgtcattgttttaaa

SEQ ID NO: 8370733 - DNA, 22 bp, Homo sapiens
aaaggtgttgccttggagacct

SEQ ID NO: 8370734 - DNA, 22 bp, Homo sapiens
aaacctgtagcagtttgttaca

SEQ ID NO: 8370735 - DNA, 22 bp, Homo sapiens
aaacctttgtgtgtctgtgcct

SEQ ID NO: 8370736 - DNA, 22 bp, Homo sapiens
aaaccttcacatctactctaca

SEQ ID NO: 8370737 - DNA, 22 bp, Homo sapiens
aaaccttaaaccaagctcttga

SEQ ID NO: 8370738 - DNA, 22 bp, Homo sapiens
aaactctagggctccacattcc

SEQ ID NO: 8370739 - DNA, 22 bp, Homo sapiens
aaactctagttatgaagtttgt

SEQ ID NO: 8370740 - DNA, 22 bp, Homo sapiens
aaactctagtaaaatgtattca

SEQ ID NO: 8370741 - DNA, 18 bp, Homo sapiens
aaagttcagggagagttg

SEQ ID NO: 8370742 - DNA, 22 bp, Homo sapiens
aaagttcagtgccttctataca

SEQ ID NO: 8370743 - DNA, 22 bp, Homo sapiens
aaagttcactgaccagcactgg

SEQ ID NO: 8370744 - DNA, 22 bp, Homo sapiens
aaagttagaatgatatcaacga

SEQ ID NO: 8370745 - DNA, 22 bp, Homo sapiens
aaagttagacagcatcatttct

SEQ ID NO: 8370746 - DNA, 22 bp, Homo sapiens
aaaccttttcagctgaatggag

SEQ ID NO: 8370747 - DNA, 22 bp, Homo sapiens
aaagagttggactttctcaggc

SEQ ID NO: 8370748 - DNA, 22 bp, Homo sapiens
aaagagttctgtttgagctgaa

SEQ ID NO: 8370749 - DNA, 22 bp, Homo sapiens
aaagagttgaggcagttatcca

SEQ ID NO: 8370750 - DNA, 22 bp, Homo sapiens
aaagagttccaagtcattttat

SEQ ID NO: 8370751 - DNA, 22 bp, Homo sapiens
aaagagttctatgatctttcca

SEQ ID NO: 8370752 - DNA, 22 bp, Homo sapiens
aaagaggggactgttaattcca

SEQ ID NO: 8370753 - DNA, 22 bp, Homo sapiens
aaattacagatcaccaatgcat

SEQ ID NO: 8370754 - DNA, 20 bp, Homo sapiens
aaattactgccacacatttc

SEQ ID NO: 8370755 - DNA, 22 bp, Homo sapiens
aaattagaaatactttcaaagc

SEQ ID NO: 8370756 - DNA, 22 bp, Homo sapiens
aaagagcatggaaagttcagga

SEQ ID NO: 8370757 - DNA, 21 bp, Homo sapiens
aaagagcttttgtgctagtta

SEQ ID NO: 8370758 - DNA, 22 bp, Homo sapiens
aaagaggcaatcaatgtagcaa

SEQ ID NO: 8370759 - DNA, 22 bp, Homo sapiens
aaactcttttgcatattagagg

SEQ ID NO: 8370760 - DNA, 22 bp, Homo sapiens
aaactgataaaataagtacatt

SEQ ID NO: 8370761 - DNA, 22 bp, Homo sapiens
aaactgattttaacattgatat

SEQ ID NO: 8370762 - DNA, 22 bp, Homo sapiens
aaagaagtgttgaatttgcaag

SEQ ID NO: 8370763 - DNA, 22 bp, Homo sapiens
aaagaagtgttgaatttgcaag

SEQ ID NO: 8370764 - DNA, 22 bp, Homo sapiens
aaagaatctatatatcaccacc

SEQ ID NO: 8370765 - DNA, 22 bp, Homo sapiens
aaagaatcagaagtctcaaaca

SEQ ID NO: 8370766 - DNA, 22 bp, Homo sapiens
aaagaatttgtacaccctacta

SEQ ID NO: 8370767 - DNA, 22 bp, Homo sapiens
aaaaatcacttttataggcagc

SEQ ID NO: 8370768 - DNA, 22 bp, Homo sapiens
aaaaatcacttttataggcagc

SEQ ID NO: 8370769 - DNA, 22 bp, Homo sapiens
aaaaatcacttttataggcagc

SEQ ID NO: 8370770 - DNA, 22 bp, Homo sapiens
aaaaatcacttttataggcagc

SEQ ID NO: 8370771 - DNA, 22 bp, Homo sapiens
aaaaatcacttttataggcagc

SEQ ID NO: 8370772 - DNA, 22 bp, Homo sapiens
aaaaatctatgactgcttctcc

SEQ ID NO: 8370773 - DNA, 22 bp, Homo sapiens
aaacacaggtactgcagaagtg

SEQ ID NO: 8370774 - DNA, 22 bp, Homo sapiens
aaaaatagaaggattgactgag

SEQ ID NO: 8370775 - DNA, 22 bp, Homo sapiens
aaaaatagcttctcttgtccct

SEQ ID NO: 8370776 - DNA, 22 bp, Homo sapiens
aaaaatagcttctcttgtccct

SEQ ID NO: 8370777 - DNA, 22 bp, Homo sapiens
aaaaatagaaggattgactgag

SEQ ID NO: 8370778 - DNA, 22 bp, Homo sapiens
aaaatgacattccagtgatatt

SEQ ID NO: 8370779 - DNA, 22 bp, Homo sapiens
aaacagagagatgtatgtggag

SEQ ID NO: 8370780 - DNA, 22 bp, Homo sapiens
aaaagacaggtgtctgcggccc

SEQ ID NO: 8370781 - DNA, 22 bp, Homo sapiens
aaaagagaaagtggcaggcttt

SEQ ID NO: 8370782 - DNA, 22 bp, Homo sapiens
aaaagacatctatttcaggcag

SEQ ID NO: 8370783 - DNA, 22 bp, Homo sapiens
aaacacttcaaggacttctgtc

SEQ ID NO: 8370784 - DNA, 22 bp, Homo sapiens
aaacacttcaaggacttctgtc

SEQ ID NO: 8370785 - DNA, 22 bp, Homo sapiens
aaacacttcctgtaacatgaca

SEQ ID NO: 8370786 - DNA, 22 bp, Homo sapiens
aaacagaaatttcctcatgctc

SEQ ID NO: 8370787 - DNA, 22 bp, Homo sapiens
aaacagaaatttcctcatgctc

SEQ ID NO: 8370788 - DNA, 22 bp, Homo sapiens
aaacacttcttaggtcttaagt

SEQ ID NO: 8370789 - DNA, 22 bp, Homo sapiens
aaaaaattatcatagttcctga

SEQ ID NO: 8370790 - DNA, 22 bp, Homo sapiens
aaaaaattatcatagttcctga

SEQ ID NO: 8370791 - DNA, 22 bp, Homo sapiens
aaaaaatcagatctttggttaa

SEQ ID NO: 8370792 - DNA, 22 bp, Homo sapiens
aaaaacagaatgtgtctaactc

SEQ ID NO: 8370793 - DNA, 22 bp, Homo sapiens
aaaaacactgggctgggagtca

SEQ ID NO: 8370794 - DNA, 22 bp, Homo sapiens
aaaaaattccattctgtgcctt

SEQ ID NO: 8370795 - DNA, 22 bp, Homo sapiens
aaaaacacaactgtctttctct

SEQ ID NO: 8370796 - DNA, 22 bp, Homo sapiens
aaaaacacaactgtctttctct

SEQ ID NO: 8370797 - DNA, 23 bp, Homo sapiens
aaaatcttctgcctatgaagaaa

SEQ ID NO: 8370798 - DNA, 22 bp, Homo sapiens
aaaatcttgactgtttttagaa

SEQ ID NO: 8370799 - DNA, 22 bp, Homo sapiens
aaaatcttgactgtttttagaa

SEQ ID NO: 8370800 - DNA, 22 bp, Homo sapiens
aaaatcttgtgacttaggaagg

SEQ ID NO: 8370801 - DNA, 22 bp, Homo sapiens
aaaatcttgtgacttaggaagg

SEQ ID NO: 8370802 - DNA, 22 bp, Homo sapiens
aaaatgaacagaacaatgggga

SEQ ID NO: 8370803 - DNA, 22 bp, Homo sapiens
aaaatgaagcaaaggcattcag

SEQ ID NO: 8370804 - DNA, 22 bp, Homo sapiens
aaagactaagaagagtattatt

SEQ ID NO: 8370805 - DNA, 22 bp, Homo sapiens
aaaatcctctaattctagaata

SEQ ID NO: 8370806 - DNA, 22 bp, Homo sapiens
aaagacattagcttagatgtca

SEQ ID NO: 8370807 - DNA, 22 bp, Homo sapiens
aaagacattagcttagatgtca

SEQ ID NO: 8370808 - DNA, 22 bp, Homo sapiens
aaagacatggcaagagatgggg

SEQ ID NO: 8370809 - DNA, 22 bp, Homo sapiens
aaaattttgccctatccttcat

SEQ ID NO: 8370810 - DNA, 22 bp, Homo sapiens
aaaattttgccctatccttcat

SEQ ID NO: 8370811 - DNA, 20 bp, Homo sapiens
aaaatctcccagaaacttat

SEQ ID NO: 8370812 - DNA, 22 bp, Homo sapiens
aaaatctcattatcaggaaggg

SEQ ID NO: 8370813 - DNA, 23 bp, Homo sapiens
aaacaagccctaatgaagagtcc

SEQ ID NO: 8370814 - DNA, 22 bp, Homo sapiens
aaacaagagtcttgctccacct

SEQ ID NO: 8370815 - DNA, 22 bp, Homo sapiens
aaacaagtttagaataatgaat

SEQ ID NO: 8370816 - DNA, 22 bp, Homo sapiens
aaactcaagtttcttaatgtca

SEQ ID NO: 8370817 - DNA, 19 bp, Homo sapiens
aaactcatagactcatatt

SEQ ID NO: 8370818 - DNA, 22 bp, Homo sapiens
aaactcatgccattaatccttt

SEQ ID NO: 8370819 - DNA, 22 bp, Homo sapiens
aaactaggaagttcatcttatt

SEQ ID NO: 8370820 - DNA, 22 bp, Homo sapiens
aaactcaaattaaactagctta

SEQ ID NO: 8370821 - DNA, 22 bp, Homo sapiens
aaactcaagtctatgaacaagg

SEQ ID NO: 8370822 - DNA, 22 bp, Homo sapiens
aaaagagcaaacatgtaatagt

SEQ ID NO: 8370823 - DNA, 22 bp, Homo sapiens
aaaagagagctgaggagctcca

SEQ ID NO: 8370824 - DNA, 22 bp, Homo sapiens
aaaagagaatcctgtacagaga

SEQ ID NO: 8370825 - DNA, 22 bp, Homo sapiens
aaactctaatcaaatatagcat

SEQ ID NO: 8370826 - DNA, 22 bp, Homo sapiens
aaactccagtgaatactagaat

SEQ ID NO: 8370827 - DNA, 22 bp, Homo sapiens
aaaagtactattttaacaaagt

SEQ ID NO: 8370828 - DNA, 22 bp, Homo sapiens
aaaagtattggccaccatttct

SEQ ID NO: 8370829 - DNA, 22 bp, Homo sapiens
aaaagtattggccaccatttct

SEQ ID NO: 8370830 - DNA, 22 bp, Homo sapiens
aaaagtatggtggtccttttta

SEQ ID NO: 8370831 - DNA, 22 bp, Homo sapiens
aaaagtatggtggtccttttta

SEQ ID NO: 8370832 - DNA, 22 bp, Homo sapiens
aaaagtatggtggtccttttta

SEQ ID NO: 8370833 - DNA, 22 bp, Homo sapiens
aaaagtattggccaccatttct

SEQ ID NO: 8370834 - DNA, 22 bp, Homo sapiens
aaagaaggggtctacatccaat

SEQ ID NO: 8370835 - DNA, 22 bp, Homo sapiens
aaagacatggaactagagatgg

SEQ ID NO: 8370836 - DNA, 22 bp, Homo sapiens
aaagacatggaactagagatgg

SEQ ID NO: 8370837 - DNA, 22 bp, Homo sapiens
aacactctctgttggtaaggct

SEQ ID NO: 8370838 - DNA, 22 bp, Homo sapiens
aacaaatgtaaaatgcagatgc

SEQ ID NO: 8370839 - DNA, 22 bp, Homo sapiens
aacacatagacgtttgatatca

SEQ ID NO: 8370840 - DNA, 22 bp, Homo sapiens
aacaaatggggccttgtatgaa

SEQ ID NO: 8370841 - DNA, 22 bp, Homo sapiens
aacaaatggaacacaaatcttt

SEQ ID NO: 8370842 - DNA, 22 bp, Homo sapiens
aacaaatgattgttggttggag

SEQ ID NO: 8370843 - DNA, 22 bp, Homo sapiens
aacaaatgacctgatttcttcc

SEQ ID NO: 8370844 - DNA, 22 bp, Homo sapiens
aaggtattattgtctatgtact

SEQ ID NO: 8370845 - DNA, 22 bp, Homo sapiens
aaggtattatttgcaatcattt

SEQ ID NO: 8370846 - DNA, 22 bp, Homo sapiens
aaggtattttctaatgtatact

SEQ ID NO: 8370847 - DNA, 22 bp, Homo sapiens
aaggtcagagcaggaaggagtc

SEQ ID NO: 8370848 - DNA, 22 bp, Homo sapiens
aacagcatgctgggtaacattg

SEQ ID NO: 8370849 - DNA, 22 bp, Homo sapiens
aacagcagggggacctgctggt

SEQ ID NO: 8370850 - DNA, 22 bp, Homo sapiens
aacagcagggatgacatggcca

SEQ ID NO: 8370851 - DNA, 22 bp, Homo sapiens
aacagcagggatgacatggcca

SEQ ID NO: 8370852 - DNA, 22 bp, Homo sapiens
aacagcagctgcctgaatttgc

SEQ ID NO: 8370853 - DNA, 22 bp, Homo sapiens
aacaggaattgatgggagtcct

SEQ ID NO: 8370854 - DNA, 22 bp, Homo sapiens
aacaggaatgaggagaaaaggt

SEQ ID NO: 8370855 - DNA, 22 bp, Homo sapiens
aagtccaggctggcgtagagtc

SEQ ID NO: 8370856 - DNA, 22 bp, Homo sapiens
aagtccaggtcccgggctctgg

SEQ ID NO: 8370857 - DNA, 22 bp, Homo sapiens
aagtccagaactcctgtgatag

SEQ ID NO: 8370858 - DNA, 22 bp, Homo sapiens
aagtccagctgtagctcaacag

SEQ ID NO: 8370859 - DNA, 17 bp, Homo sapiens
aagtccagcctgcagct

SEQ ID NO: 8370860 - DNA, 22 bp, Homo sapiens
aagtcattctatttctctatgt

SEQ ID NO: 8370861 - DNA, 22 bp, Homo sapiens
aagtcattggtagcttgatagg

SEQ ID NO: 8370862 - DNA, 22 bp, Homo sapiens
aagtccaaggtcaccattcaca

SEQ ID NO: 8370863 - DNA, 22 bp, Homo sapiens
aagtcattatctcttctaatct

SEQ ID NO: 8370864 - DNA, 22 bp, Homo sapiens
aagtcatcttgagtctaagatt

SEQ ID NO: 8370865 - DNA, 23 bp, Homo sapiens
aacagccacactgctgagattca

SEQ ID NO: 8370866 - DNA, 23 bp, Homo sapiens
aacagccacactgctgagattca

SEQ ID NO: 8370867 - DNA, 22 bp, Homo sapiens
aaatgtttctacttgtgagcat

SEQ ID NO: 8370868 - DNA, 22 bp, Homo sapiens
aaattcactctgttcctcatgg

SEQ ID NO: 8370869 - DNA, 22 bp, Homo sapiens
aaattcacttgcctgcttagct

SEQ ID NO: 8370870 - DNA, 22 bp, Homo sapiens
aaattccattttgtgactattc

SEQ ID NO: 8370871 - DNA, 22 bp, Homo sapiens
aaattctaaggtcacaatgttg

SEQ ID NO: 8370872 - DNA, 22 bp, Homo sapiens
aaatgttaggttgtactgagtc

SEQ ID NO: 8370873 - DNA, 22 bp, Homo sapiens
aaatgtgtttgataggaatatt

SEQ ID NO: 8370874 - DNA, 22 bp, Homo sapiens
aaatgtgttcctttgctacaga

SEQ ID NO: 8370875 - DNA, 22 bp, Homo sapiens
aaatgtgtttagatggtttatt

SEQ ID NO: 8370876 - DNA, 22 bp, Homo sapiens
aaatgtgtttcgaaaactggtg

SEQ ID NO: 8370877 - DNA, 22 bp, Homo sapiens
aaatgtgcttgtgatcagctgt

SEQ ID NO: 8370878 - DNA, 22 bp, Homo sapiens
aaatgtgtatatgaaacatgat

SEQ ID NO: 8370879 - DNA, 22 bp, Homo sapiens
aaatgtgtatatgaaacatgat

SEQ ID NO: 8370880 - DNA, 22 bp, Homo sapiens
aaatgtgtcagtttcattctct

SEQ ID NO: 8370881 - DNA, 21 bp, Homo sapiens
aaatgtgttccataatgcttt

SEQ ID NO: 8370882 - DNA, 22 bp, Homo sapiens
aaatgtgtgtatgtacatatat

SEQ ID NO: 8370883 - DNA, 22 bp, Homo sapiens
aaatgtgtcatattcaaagtca

SEQ ID NO: 8370884 - DNA, 22 bp, Homo sapiens
aaatgtgtcatattcaaagtca

SEQ ID NO: 8370885 - DNA, 19 bp, Homo sapiens
aagctgagggctgtccacc

SEQ ID NO: 8370886 - DNA, 22 bp, Homo sapiens
aagctgaggatacatgaagcct

SEQ ID NO: 8370887 - DNA, 22 bp, Homo sapiens
aaatgtctatctggcatattcc

SEQ ID NO: 8370888 - DNA, 22 bp, Homo sapiens
aaatgtctatctggcatattcc

SEQ ID NO: 8370889 - DNA, 22 bp, Homo sapiens
aacaaacaaacattttgtcatc

SEQ ID NO: 8370890 - DNA, 22 bp, Homo sapiens
aaattttagaccaggcaaaact

SEQ ID NO: 8370891 - DNA, 22 bp, Homo sapiens
aacaaagatgggtgggaaagag

SEQ ID NO: 8370892 - DNA, 21 bp, Homo sapiens
aacaaagggatgctcatcttt

SEQ ID NO: 8370893 - DNA, 19 bp, Homo sapiens
aaattctgacagtctttta

SEQ ID NO: 8370894 - DNA, 19 bp, Homo sapiens
aaattctgacagtctttta

SEQ ID NO: 8370895 - DNA, 22 bp, Homo sapiens
aaattctgatttaataagtgta

SEQ ID NO: 8370896 - DNA, 22 bp, Homo sapiens
aaattctgcaatttgacaagat

SEQ ID NO: 8370897 - DNA, 22 bp, Homo sapiens
aaattctgtcctgaatgccatt

SEQ ID NO: 8370898 - DNA, 22 bp, Homo sapiens
aaattctctaaagaaaacatga

SEQ ID NO: 8370899 - DNA, 22 bp, Homo sapiens
aaattgcaaaagtacttttagg

SEQ ID NO: 8370900 - DNA, 22 bp, Homo sapiens
aaattctttggcctactttgaa

SEQ ID NO: 8370901 - DNA, 22 bp, Homo sapiens
aaattgaatttgggaaacattg

SEQ ID NO: 8370902 - DNA, 22 bp, Homo sapiens
aacatgctctgtttcttggatg

SEQ ID NO: 8370903 - DNA, 22 bp, Homo sapiens
aacatgctcttcctggctagtc

SEQ ID NO: 8370904 - DNA, 18 bp, Homo sapiens
aacatgcattagaactgc

SEQ ID NO: 8370905 - DNA, 22 bp, Homo sapiens
aacatgcatgaagaagttatat

SEQ ID NO: 8370906 - DNA, 20 bp, Homo sapiens
aacagggggctgcagagggc

SEQ ID NO: 8370907 - DNA, 20 bp, Homo sapiens
aacagggggctgcagagggc

SEQ ID NO: 8370908 - DNA, 22 bp, Homo sapiens
aacatgaaaagcccagagaggt

SEQ ID NO: 8370909 - DNA, 22 bp, Homo sapiens
aacaggaattgcaggcagatct

SEQ ID NO: 8370910 - DNA, 22 bp, Homo sapiens
aacaggcaacagttgactctga

SEQ ID NO: 8370911 - DNA, 22 bp, Homo sapiens
aacaggcctatggtttattcat

SEQ ID NO: 8370912 - DNA, 22 bp, Homo sapiens
aacaggcaggagaattctgcct

SEQ ID NO: 8370913 - DNA, 22 bp, Homo sapiens
aacaggccctgccatttatcca

SEQ ID NO: 8370914 - DNA, 20 bp, Homo sapiens
aacagggcagaagcggagac

SEQ ID NO: 8370915 - DNA, 22 bp, Homo sapiens
aacaggcttttggaaagttaca

SEQ ID NO: 8370916 - DNA, 22 bp, Homo sapiens
aacagggacaaggatagagaaa

SEQ ID NO: 8370917 - DNA, 22 bp, Homo sapiens
aacagggacaaggatagagaaa

SEQ ID NO: 8370918 - DNA, 22 bp, Homo sapiens
aacaggctggccttgaagcagt

SEQ ID NO: 8370919 - DNA, 22 bp, Homo sapiens
aaccaccattctctcctcttcc

SEQ ID NO: 8370920 - DNA, 22 bp, Homo sapiens
aaccacagacccagactagaga

SEQ ID NO: 8370921 - DNA, 22 bp, Homo sapiens
aaccaacataggaatgcagaga

SEQ ID NO: 8370922 - DNA, 21 bp, Homo sapiens
aaccagagccaggctctcagc

SEQ ID NO: 8370923 - DNA, 22 bp, Homo sapiens
aatagttagcttagttctgtat

SEQ ID NO: 8370924 - DNA, 22 bp, Homo sapiens
aatagttttataggtgggatta

SEQ ID NO: 8370925 - DNA, 22 bp, Homo sapiens
aatagtttgaatttatcagatg

SEQ ID NO: 8370926 - DNA, 22 bp, Homo sapiens
aataagaactccatttactcgt

SEQ ID NO: 8370927 - DNA, 21 bp, Homo sapiens
aacatttcaggatccaaattg

SEQ ID NO: 8370928 - DNA, 22 bp, Homo sapiens
aacatttttaagaccaagtgct

SEQ ID NO: 8370929 - DNA, 22 bp, Homo sapiens
aataacttttaaaagaccctgg

SEQ ID NO: 8370930 - DNA, 22 bp, Homo sapiens
aataagaacaactaaggtttat

SEQ ID NO: 8370931 - DNA, 22 bp, Homo sapiens
aataagaaagagtcagcttcag

SEQ ID NO: 8370932 - DNA, 22 bp, Homo sapiens
aataagaaagagtcagcttcag

SEQ ID NO: 8370933 - DNA, 22 bp, Homo sapiens
aataagaactccatttactcgt

SEQ ID NO: 8370934 - DNA, 22 bp, Homo sapiens
aataagaactccatttactcgt

SEQ ID NO: 8370935 - DNA, 22 bp, Homo sapiens
aataagaacaactaaggtttat

SEQ ID NO: 8370936 - DNA, 22 bp, Homo sapiens
aacatgcttgcttagaatcagc

SEQ ID NO: 8370937 - DNA, 22 bp, Homo sapiens
aataacttcagttcttacatta

SEQ ID NO: 8370938 - DNA, 22 bp, Homo sapiens
aataacttcagttcttacatta

SEQ ID NO: 8370939 - DNA, 22 bp, Homo sapiens
aataacttgtatggttattcca

SEQ ID NO: 8370940 - DNA, 22 bp, Homo sapiens
aataacttgaagatctcttcca

SEQ ID NO: 8370941 - DNA, 22 bp, Homo sapiens
aataacttcatcttcaggatag

SEQ ID NO: 8370942 - DNA, 22 bp, Homo sapiens
aataacttcatgtaacatttaa

SEQ ID NO: 8370943 - DNA, 22 bp, Homo sapiens
aatgatatgcaaattatcatca

SEQ ID NO: 8370944 - DNA, 22 bp, Homo sapiens
aactggttatgttacctatgtc

SEQ ID NO: 8370945 - DNA, 21 bp, Homo sapiens
aactggttcaattcaactaga

SEQ ID NO: 8370946 - DNA, 22 bp, Homo sapiens
aatgatcccatttagaaacaga

SEQ ID NO: 8370947 - DNA, 22 bp, Homo sapiens
aactgcctggccaggctgcaac

SEQ ID NO: 8370948 - DNA, 22 bp, Homo sapiens
aactgcttagtgatggatgacc

SEQ ID NO: 8370949 - DNA, 22 bp, Homo sapiens
aacttacaatgttagagtctca

SEQ ID NO: 8370950 - DNA, 22 bp, Homo sapiens
aacttaaacccactcatgtaga

SEQ ID NO: 8370951 - DNA, 22 bp, Homo sapiens
aacttaaacccactcatgtaga

SEQ ID NO: 8370952 - DNA, 22 bp, Homo sapiens
aacttaaacccactcatgtaga

SEQ ID NO: 8370953 - DNA, 22 bp, Homo sapiens
aacttaaacaagctcccaagtt

SEQ ID NO: 8370954 - DNA, 22 bp, Homo sapiens
aacttaaacaagctcccaagtt

SEQ ID NO: 8370955 - DNA, 22 bp, Homo sapiens
aactgttttttactagaggact

SEQ ID NO: 8370956 - DNA, 22 bp, Homo sapiens
aacttaaacccactcatgtaga

SEQ ID NO: 8370957 - DNA, 22 bp, Homo sapiens
aactgtttatgtaagtatgcag

SEQ ID NO: 8370958 - DNA, 22 bp, Homo sapiens
aactgtttttcacgtgtctcat

SEQ ID NO: 8370959 - DNA, 22 bp, Homo sapiens
aactgtttggaactcttccaca

SEQ ID NO: 8370960 - DNA, 22 bp, Homo sapiens
aactgttacatagttatagatc

SEQ ID NO: 8370961 - DNA, 22 bp, Homo sapiens
aactgttacatagttatagatc

SEQ ID NO: 8370962 - DNA, 22 bp, Homo sapiens
aactggttctcttttgcttgtg

SEQ ID NO: 8370963 - DNA, 22 bp, Homo sapiens
aactggttctggaggctgcagg

SEQ ID NO: 8370964 - DNA, 23 bp, Homo sapiens
aactggttgaaggctgttaattg

SEQ ID NO: 8370965 - DNA, 21 bp, Homo sapiens
aactacagttgttccttcatt

SEQ ID NO: 8370966 - DNA, 22 bp, Homo sapiens
aactacagaatcatagaaaata

SEQ ID NO: 8370967 - DNA, 22 bp, Homo sapiens
aatataatgctgttttatgcca

SEQ ID NO: 8370968 - DNA, 22 bp, Homo sapiens
aatataatgctgttttatgcca

SEQ ID NO: 8370969 - DNA, 22 bp, Homo sapiens
aatccacacatctggcatgtga

SEQ ID NO: 8370970 - DNA, 22 bp, Homo sapiens
aatccaatcctactcagaaagt

SEQ ID NO: 8370971 - DNA, 22 bp, Homo sapiens
aatcatcttcatcttacacaga

SEQ ID NO: 8370972 - DNA, 22 bp, Homo sapiens
aatcatcttcatcttacacaga

SEQ ID NO: 8370973 - DNA, 22 bp, Homo sapiens
aatcatctccgaaaaaagagta

SEQ ID NO: 8370974 - DNA, 22 bp, Homo sapiens
aatcatcacgaacacaacagcg

SEQ ID NO: 8370975 - DNA, 21 bp, Homo sapiens
aagagctggatcaaggataag

SEQ ID NO: 8370976 - DNA, 22 bp, Homo sapiens
aagagcttccctgttgtagagg

SEQ ID NO: 8370977 - DNA, 22 bp, Homo sapiens
aagagcttggactttcaagtca

SEQ ID NO: 8370978 - DNA, 22 bp, Homo sapiens
aagaggaactgggggctgagtc

SEQ ID NO: 8370979 - DNA, 22 bp, Homo sapiens
aagaggaactgggggctgagtc

SEQ ID NO: 8370980 - DNA, 22 bp, Homo sapiens
aagaggaactgggggctgagtc

SEQ ID NO: 8370981 - DNA, 22 bp, Homo sapiens
aagaggaaatgattgactatat

SEQ ID NO: 8370982 - DNA, 22 bp, Homo sapiens
aagaggaaatgattgactatat

SEQ ID NO: 8370983 - DNA, 22 bp, Homo sapiens
aagagcagtgttttactcagct

SEQ ID NO: 8370984 - DNA, 22 bp, Homo sapiens
acaaggcagttaaaatggttaa

SEQ ID NO: 8370985 - DNA, 22 bp, Homo sapiens
acaaggcaattcctggtgaatt

SEQ ID NO: 8370986 - DNA, 22 bp, Homo sapiens
aagagatgttgaagtttattag

SEQ ID NO: 8370987 - DNA, 22 bp, Homo sapiens
aagagatgtgggctgctgtgca

SEQ ID NO: 8370988 - DNA, 22 bp, Homo sapiens
aagagatgctttacatcggatg

SEQ ID NO: 8370989 - DNA, 22 bp, Homo sapiens
aagagatgtggaatcatttaca

SEQ ID NO: 8370990 - DNA, 22 bp, Homo sapiens
aagagatgtggaatcatttaca

SEQ ID NO: 8370991 - DNA, 22 bp, Homo sapiens
aagagatgaaggtcctgactgt

SEQ ID NO: 8370992 - DNA, 22 bp, Homo sapiens
aagagatgatggcagccagagg

SEQ ID NO: 8370993 - DNA, 22 bp, Homo sapiens
aagagatgatggcagccagagg

SEQ ID NO: 8370994 - DNA, 22 bp, Homo sapiens
acaaggaggatatgtttaaggg

SEQ ID NO: 8370995 - DNA, 22 bp, Homo sapiens
acaaggaccatgaggcagaccc

SEQ ID NO: 8370996 - DNA, 20 bp, Homo sapiens
acaaggaaccaggaggtggc

SEQ ID NO: 8370997 - DNA, 22 bp, Homo sapiens
aagagaggggttgcatggaaat

SEQ ID NO: 8370998 - DNA, 22 bp, Homo sapiens
aagagaggggttgcatggaaat

SEQ ID NO: 8370999 - DNA, 22 bp, Homo sapiens
aagagagggatttggtttattg

SEQ ID NO: 8371000 - DNA, 22 bp, Homo sapiens
aagagagggacttattaaagtc

SEQ ID NO: 8371001 - DNA, 17 bp, Homo sapiens
aagagaggctgagctgg

SEQ ID NO: 8371002 - DNA, 17 bp, Homo sapiens
aagagaggctgagctgg

SEQ ID NO: 8371003 - DNA, 22 bp, Homo sapiens
aagacatgttttaagaatattt

SEQ ID NO: 8371004 - DNA, 22 bp, Homo sapiens
aagacatgactgcacagccaaa

SEQ ID NO: 8371005 - DNA, 22 bp, Homo sapiens
aagacatacagacagtgagcca

SEQ ID NO: 8371006 - DNA, 22 bp, Homo sapiens
aagacatcagtgatgacatttg

SEQ ID NO: 8371007 - DNA, 22 bp, Homo sapiens
aagacattactggaatctgact

SEQ ID NO: 8371008 - DNA, 22 bp, Homo sapiens
aagacattactggaatctgact

SEQ ID NO: 8371009 - DNA, 22 bp, Homo sapiens
acaaagagaccatgagccaaac

SEQ ID NO: 8371010 - DNA, 22 bp, Homo sapiens
acaaagataagtcagaaagtca

SEQ ID NO: 8371011 - DNA, 22 bp, Homo sapiens
acaaagcacgagtgccatggac

SEQ ID NO: 8371012 - DNA, 22 bp, Homo sapiens
acaaagcacgagtgccatggac

SEQ ID NO: 8371013 - DNA, 22 bp, Homo sapiens
acaaagccagattctggagcac

SEQ ID NO: 8371014 - DNA, 22 bp, Homo sapiens
aattgtaagtgctgagttaagg

SEQ ID NO: 8371015 - DNA, 22 bp, Homo sapiens
aattgtaactacattgagaaca

SEQ ID NO: 8371016 - DNA, 22 bp, Homo sapiens
aattgtaactacattgagaaca

SEQ ID NO: 8371017 - DNA, 22 bp, Homo sapiens
aattgtcttctccttcctggca

SEQ ID NO: 8371018 - DNA, 22 bp, Homo sapiens
aagacaggaacatagcaaatcc

SEQ ID NO: 8371019 - DNA, 22 bp, Homo sapiens
aagacaggaacatagcaaatcc

SEQ ID NO: 8371020 - DNA, 22 bp, Homo sapiens
aagaatacttcgtaagtaggat

SEQ ID NO: 8371021 - DNA, 22 bp, Homo sapiens
aagaatacgtatcaacaatggt

SEQ ID NO: 8371022 - DNA, 22 bp, Homo sapiens
aattggaaaatgctacatatca

SEQ ID NO: 8371023 - DNA, 22 bp, Homo sapiens
aatgttttctctgtgaacacat

SEQ ID NO: 8371024 - DNA, 22 bp, Homo sapiens
aatgttttctgactgctaactt

SEQ ID NO: 8371025 - DNA, 22 bp, Homo sapiens
aagaagcactttcctacatgtt

SEQ ID NO: 8371026 - DNA, 22 bp, Homo sapiens
aatgttttcattatcctaactg

SEQ ID NO: 8371027 - DNA, 22 bp, Homo sapiens
aatgttttagattactgctggg

SEQ ID NO: 8371028 - DNA, 22 bp, Homo sapiens
aatgttttatagctcaagcaat

SEQ ID NO: 8371029 - DNA, 22 bp, Homo sapiens
aatgttttaaaagagattgaga

SEQ ID NO: 8371030 - DNA, 22 bp, Homo sapiens
aatgttttacagatcccattag

SEQ ID NO: 8371031 - DNA, 22 bp, Homo sapiens
aagaaatgcagaaatgtgctgg

SEQ ID NO: 8371032 - DNA, 22 bp, Homo sapiens
aagaaatgcagaaatgtgctgg

SEQ ID NO: 8371033 - DNA, 22 bp, Homo sapiens
aacttcatgtaatttaaaacag

SEQ ID NO: 8371034 - DNA, 21 bp, Homo sapiens
aagaaagataattaaggaccc

SEQ ID NO: 8371035 - DNA, 22 bp, Homo sapiens
aacttagtttagggtattgatt

SEQ ID NO: 8371036 - DNA, 22 bp, Homo sapiens
aagaaatacatggtttttgagt

SEQ ID NO: 8371037 - DNA, 22 bp, Homo sapiens
aagaaatcatatcatttcttgg

SEQ ID NO: 8371038 - DNA, 22 bp, Homo sapiens
aagaaatctgatatttgtttca

SEQ ID NO: 8371039 - DNA, 22 bp, Homo sapiens
aagaaatcagaaaagcattcgt

SEQ ID NO: 8371040 - DNA, 22 bp, Homo sapiens
aagaaatattgggccttataaa

SEQ ID NO: 8371041 - DNA, 22 bp, Homo sapiens
aagaaatattgggccttataaa

SEQ ID NO: 8371042 - DNA, 22 bp, Homo sapiens
aagccaggagcgaggcctcggc

SEQ ID NO: 8371043 - DNA, 22 bp, Homo sapiens
aagccaggcatgcttggacagt

SEQ ID NO: 8371044 - DNA, 22 bp, Homo sapiens
aagccaggataaagttgtttta

SEQ ID NO: 8371045 - DNA, 22 bp, Homo sapiens
aagccaggaccaaactcatcct

SEQ ID NO: 8371046 - DNA, 22 bp, Homo sapiens
aagccaggaccaaactcatcct

SEQ ID NO: 8371047 - DNA, 22 bp, Homo sapiens
aagccaggaagggagctgtccc

SEQ ID NO: 8371048 - DNA, 22 bp, Homo sapiens
aagccaggaatggagtcttcgc

SEQ ID NO: 8371049 - DNA, 22 bp, Homo sapiens
aagccaggaagagagccttcac

SEQ ID NO: 8371050 - DNA, 22 bp, Homo sapiens
aagccagcctgtttccttcttc

SEQ ID NO: 8371051 - DNA, 22 bp, Homo sapiens
acagcagcttgtctgttcttta

SEQ ID NO: 8371052 - DNA, 22 bp, Homo sapiens
acagcagcttcctgactgtact

SEQ ID NO: 8371053 - DNA, 22 bp, Homo sapiens
acagcagctaacccctgggcca

SEQ ID NO: 8371054 - DNA, 22 bp, Homo sapiens
acagcagctgccttcaggctct

SEQ ID NO: 8371055 - DNA, 22 bp, Homo sapiens
acagcagctgggttcccaccat

SEQ ID NO: 8371056 - DNA, 22 bp, Homo sapiens
acagcagctaaaggtgtctcct

SEQ ID NO: 8371057 - DNA, 22 bp, Homo sapiens
acagcagctaacccctgggcca

SEQ ID NO: 8371058 - DNA, 22 bp, Homo sapiens
acagcagctaacccctgggcca

SEQ ID NO: 8371059 - DNA, 22 bp, Homo sapiens
aagcatttggttctgaagactc

SEQ ID NO: 8371060 - DNA, 22 bp, Homo sapiens
aagcatttcaatataatattca

SEQ ID NO: 8371061 - DNA, 22 bp, Homo sapiens
aagcatttatagataagaattt

SEQ ID NO: 8371062 - DNA, 22 bp, Homo sapiens
aagcatggtttctgacgtcatg

SEQ ID NO: 8371063 - DNA, 22 bp, Homo sapiens
aagcagctgatttcacagctca

SEQ ID NO: 8371064 - DNA, 20 bp, Homo sapiens
acagagtagaacatatgcca

SEQ ID NO: 8371065 - DNA, 22 bp, Homo sapiens
aagcagcattcagtgaaatgtg

SEQ ID NO: 8371066 - DNA, 22 bp, Homo sapiens
aagcagaggtagggtgtgcagt

SEQ ID NO: 8371067 - DNA, 22 bp, Homo sapiens
acagaattgatggaaatctcag

SEQ ID NO: 8371068 - DNA, 22 bp, Homo sapiens
aagaggcttcagatccttcaga

SEQ ID NO: 8371069 - DNA, 22 bp, Homo sapiens
aagatgttctattttcactttt

SEQ ID NO: 8371070 - DNA, 22 bp, Homo sapiens
aagaggcgctcctcacttccta

SEQ ID NO: 8371071 - DNA, 22 bp, Homo sapiens
aagatgttgactcctttgatgt

SEQ ID NO: 8371072 - DNA, 22 bp, Homo sapiens
aagatgttctattttcactttt

SEQ ID NO: 8371073 - DNA, 22 bp, Homo sapiens
acacaggtacacatatgtacct

SEQ ID NO: 8371074 - DNA, 22 bp, Homo sapiens
acacagggtctagagttaggcc

SEQ ID NO: 8371075 - DNA, 22 bp, Homo sapiens
acacagggggcattctaggagt

SEQ ID NO: 8371076 - DNA, 22 bp, Homo sapiens
acacaggggaaagtggagctga

SEQ ID NO: 8371077 - DNA, 22 bp, Homo sapiens
aagcacagggtgtctgcattca

SEQ ID NO: 8371078 - DNA, 18 bp, Homo sapiens
aagcacaggtgtttcagg

SEQ ID NO: 8371079 - DNA, 22 bp, Homo sapiens
aagatttactttctttgtaata

SEQ ID NO: 8371080 - DNA, 21 bp, Homo sapiens
acactgcaggtgaagtgcact

SEQ ID NO: 8371081 - DNA, 22 bp, Homo sapiens
acactgcatttcaacaaggccc

SEQ ID NO: 8371082 - DNA, 22 bp, Homo sapiens
acactgctcacttcttcccttg

SEQ ID NO: 8371083 - DNA, 21 bp, Homo sapiens
gtccagagagccggctcctga

SEQ ID NO: 8371084 - DNA, 22 bp, Homo sapiens
gtcagagctgtgcaaggctgag

SEQ ID NO: 8371085 - DNA, 22 bp, Homo sapiens
gtcagaggaggctgagtaggaa

SEQ ID NO: 8371086 - DNA, 22 bp, Homo sapiens
gtcagagcccccagcggcgcgg

SEQ ID NO: 8371087 - DNA, 22 bp, Homo sapiens
gtcagagcccttccctgatttt

SEQ ID NO: 8371088 - DNA, 22 bp, Homo sapiens
gtcagagctggaggcaagttct

SEQ ID NO: 8371089 - DNA, 22 bp, Homo sapiens
gtcagagcactgagttgtgggc

SEQ ID NO: 8371090 - DNA, 22 bp, Homo sapiens
gtccagcccctgactcccaggc

SEQ ID NO: 8371091 - DNA, 22 bp, Homo sapiens
gtccagccaggctgcagcaccc

SEQ ID NO: 8371092 - DNA, 22 bp, Homo sapiens
gtccagccctctgcctccaggt

SEQ ID NO: 8371093 - DNA, 22 bp, Homo sapiens
gtccagcccgggctccgccagc

SEQ ID NO: 8371094 - DNA, 22 bp, Homo sapiens
gtcactggaattacaggcatgc

SEQ ID NO: 8371095 - DNA, 22 bp, Homo sapiens
gtcactggggccacatgcagaa

SEQ ID NO: 8371096 - DNA, 22 bp, Homo sapiens
gtcagaaaaagcaaggctgggc

SEQ ID NO: 8371097 - DNA, 22 bp, Homo sapiens
gtccaggccatggtggacacag

SEQ ID NO: 8371098 - DNA, 20 bp, Homo sapiens
gtccaggacccagcaggagg

SEQ ID NO: 8371099 - DNA, 22 bp, Homo sapiens
gtccagggaaatagcgacaggg

SEQ ID NO: 8371100 - DNA, 23 bp, Homo sapiens
gtcctctggagagaaaggcagta

SEQ ID NO: 8371101 - DNA, 22 bp, Homo sapiens
gtcctctggcctttcccaggac

SEQ ID NO: 8371102 - DNA, 22 bp, Homo sapiens
gtcctctgggctttgagcagtc

SEQ ID NO: 8371103 - DNA, 22 bp, Homo sapiens
gtcctctggtgaaagcattccc

SEQ ID NO: 8371104 - DNA, 22 bp, Homo sapiens
gtcctctgtccctggggcacgg

SEQ ID NO: 8371105 - DNA, 22 bp, Homo sapiens
gtcctgctaccatgctgtgtga

SEQ ID NO: 8371106 - DNA, 22 bp, Homo sapiens
gtcctgcacatggagggcaatg

SEQ ID NO: 8371107 - DNA, 19 bp, Homo sapiens
gtcctgcaactggctctcc

SEQ ID NO: 8371108 - DNA, 22 bp, Homo sapiens
gtcctgcttgttaggcctagtc

SEQ ID NO: 8371109 - DNA, 22 bp, Homo sapiens
gtcctgcttcccacagaaaccg

SEQ ID NO: 8371110 - DNA, 20 bp, Homo sapiens
gtcggctctacccagactgt

SEQ ID NO: 8371111 - DNA, 22 bp, Homo sapiens
gtacaaaagttattgcggtttt

SEQ ID NO: 8371112 - DNA, 22 bp, Homo sapiens
gtacaaaagttattgcggtttt

SEQ ID NO: 8371113 - DNA, 22 bp, Homo sapiens
gtacaacatgattttactctct

SEQ ID NO: 8371114 - DNA, 22 bp, Homo sapiens
gtacaacaggattgatgtacca

SEQ ID NO: 8371115 - DNA, 22 bp, Homo sapiens
gtagtctgaacagtaattttgt

SEQ ID NO: 8371116 - DNA, 22 bp, Homo sapiens
gtagtcccagctaccccggagg

SEQ ID NO: 8371117 - DNA, 22 bp, Homo sapiens
gtaggggatggttccctagaaa

SEQ ID NO: 8371118 - DNA, 22 bp, Homo sapiens
gtcaaaaagtagtcatttctgt

SEQ ID NO: 8371119 - DNA, 22 bp, Homo sapiens
gtatttttcattccaagtgaga

SEQ ID NO: 8371120 - DNA, 22 bp, Homo sapiens
gtatttttaggtaaggaaagta

SEQ ID NO: 8371121 - DNA, 22 bp, Homo sapiens
gtcaacaaagaaaattgttaat

SEQ ID NO: 8371122 - DNA, 22 bp, Homo sapiens
gtatacatagatgatgaacaag

SEQ ID NO: 8371123 - DNA, 22 bp, Homo sapiens
gtattttatggcatgcagtggc

SEQ ID NO: 8371124 - DNA, 22 bp, Homo sapiens
gtatttttaggtaaggaaagta

SEQ ID NO: 8371125 - DNA, 22 bp, Homo sapiens
gtatacagatacttagacgtgc

SEQ ID NO: 8371126 - DNA, 22 bp, Homo sapiens
gtatacagatacttagacgtgc

SEQ ID NO: 8371127 - DNA, 22 bp, Homo sapiens
gtgagcatatatgtaatcgttt

SEQ ID NO: 8371128 - DNA, 22 bp, Homo sapiens
gtgaggagggctggtcccaggc

SEQ ID NO: 8371129 - DNA, 22 bp, Homo sapiens
gtgaggagtctgaagcacataa

SEQ ID NO: 8371130 - DNA, 22 bp, Homo sapiens
gtgaggagctgacactggggtg

SEQ ID NO: 8371131 - DNA, 21 bp, Homo sapiens
gtcttttaagtgaagagaggc

SEQ ID NO: 8371132 - DNA, 21 bp, Homo sapiens
gtctttctacctctatgtggc

SEQ ID NO: 8371133 - DNA, 22 bp, Homo sapiens
gtctttcatggatattcagttt

SEQ ID NO: 8371134 - DNA, 22 bp, Homo sapiens
gtctttatttgagattgtcatt

SEQ ID NO: 8371135 - DNA, 22 bp, Homo sapiens
gtcttttttacaccttacatca

SEQ ID NO: 8371136 - DNA, 22 bp, Homo sapiens
gtctatgtgtaatagcatgtgt

SEQ ID NO: 8371137 - DNA, 22 bp, Homo sapiens
gtctagggctcctcagtgacaa

SEQ ID NO: 8371138 - DNA, 22 bp, Homo sapiens
gtctataagcaggggaaaactt

SEQ ID NO: 8371139 - DNA, 22 bp, Homo sapiens
gtctataagtacaattgcactc

SEQ ID NO: 8371140 - DNA, 22 bp, Homo sapiens
gtctacttttgtcatcattgca

SEQ ID NO: 8371141 - DNA, 22 bp, Homo sapiens
gtctacactgaatttccacaga

SEQ ID NO: 8371142 - DNA, 20 bp, Homo sapiens
gtctacacgggcagtgtaga

SEQ ID NO: 8371143 - DNA, 22 bp, Homo sapiens
gtcttgatctcctgaccttgtg

SEQ ID NO: 8371144 - DNA, 22 bp, Homo sapiens
gtcttgatctcctgaccttgtg

SEQ ID NO: 8371145 - DNA, 22 bp, Homo sapiens
gtctcccaatccgggacagcct

SEQ ID NO: 8371146 - DNA, 22 bp, Homo sapiens
gtctttagttgaaacatgtggt

SEQ ID NO: 8371147 - DNA, 22 bp, Homo sapiens
gtctttagttgaaacatgtggt

SEQ ID NO: 8371148 - DNA, 22 bp, Homo sapiens
gtctttagagctcctggcatct

SEQ ID NO: 8371149 - DNA, 22 bp, Homo sapiens
gtctttagagctcctggcatct

SEQ ID NO: 8371150 - DNA, 22 bp, Homo sapiens
gtcttgggacccgcactgtggg

SEQ ID NO: 8371151 - DNA, 22 bp, Homo sapiens
gtcttgttggagttcttgcagc

SEQ ID NO: 8371152 - DNA, 22 bp, Homo sapiens
gtcttgttaagattttggaata

SEQ ID NO: 8371153 - DNA, 22 bp, Homo sapiens
gtctttatatttactaaagaat

SEQ ID NO: 8371154 - DNA, 22 bp, Homo sapiens
gtgaggcaagggcatactaggc

SEQ ID NO: 8371155 - DNA, 22 bp, Homo sapiens
gtgaggcagaagttccctttta

SEQ ID NO: 8371156 - DNA, 22 bp, Homo sapiens
gtgaggcaagggcatactaggc

SEQ ID NO: 8371157 - DNA, 22 bp, Homo sapiens
gtgaggcagcaggagcctctgt

SEQ ID NO: 8371158 - DNA, 22 bp, Homo sapiens
gtgaggcagagatgccaaaact

SEQ ID NO: 8371159 - DNA, 22 bp, Homo sapiens
gtgaggcagcaggagcctctgt

SEQ ID NO: 8371160 - DNA, 22 bp, Homo sapiens
gtgaggcaggcattctcctttc

SEQ ID NO: 8371161 - DNA, 22 bp, Homo sapiens
gtgccagaggcagtgaggagtt

SEQ ID NO: 8371162 - DNA, 22 bp, Homo sapiens
gtgccagagtttgaggacaatt

SEQ ID NO: 8371163 - DNA, 22 bp, Homo sapiens
gtgccagaaggttcccgctgca

SEQ ID NO: 8371164 - DNA, 22 bp, Homo sapiens
gtgcagggcagccgaatgggct

SEQ ID NO: 8371165 - DNA, 17 bp, Homo sapiens
gtgcagggatgaaggat

SEQ ID NO: 8371166 - DNA, 22 bp, Homo sapiens
gtgctgctcacatctggaggta

SEQ ID NO: 8371167 - DNA, 20 bp, Homo sapiens
gtgctggagttaggaaaggt

SEQ ID NO: 8371168 - DNA, 22 bp, Homo sapiens
gtgctggaactgtgctaagaga

SEQ ID NO: 8371169 - DNA, 22 bp, Homo sapiens
gtgctggaccctggaaggtggt

SEQ ID NO: 8371170 - DNA, 22 bp, Homo sapiens
gtgctggccctgtcctcgagct

SEQ ID NO: 8371171 - DNA, 22 bp, Homo sapiens
gtgctggcacccctctccagtt

SEQ ID NO: 8371172 - DNA, 22 bp, Homo sapiens
gtgctgcagagtctcgtgccgc

SEQ ID NO: 8371173 - DNA, 22 bp, Homo sapiens
gtgctgcagggcctcctgcacc

SEQ ID NO: 8371174 - DNA, 22 bp, Homo sapiens
gtgcccagcagcagcgtccccg

SEQ ID NO: 8371175 - DNA, 22 bp, Homo sapiens
gtgcccagcagcagcgtccccg

SEQ ID NO: 8371176 - DNA, 22 bp, Homo sapiens
gtgcccagctccacctcacaga

SEQ ID NO: 8371177 - DNA, 22 bp, Homo sapiens
gtgcccagctccacctcacaga

SEQ ID NO: 8371178 - DNA, 22 bp, Homo sapiens
gtgcccagctccacctcacaga

SEQ ID NO: 8371179 - DNA, 22 bp, Homo sapiens
gtgcccagctccacctcacaga

SEQ ID NO: 8371180 - DNA, 22 bp, Homo sapiens
gtgccaggtgctaagctgtgct

SEQ ID NO: 8371181 - DNA, 22 bp, Homo sapiens
gtgccaggtgctaagctgtgct

SEQ ID NO: 8371182 - DNA, 22 bp, Homo sapiens
gtgccagggggcactgaacaga

SEQ ID NO: 8371183 - DNA, 22 bp, Homo sapiens
gtgccagcctggtgcgcctggg

SEQ ID NO: 8371184 - DNA, 22 bp, Homo sapiens
gtgccagccgcaccccaggaga

SEQ ID NO: 8371185 - DNA, 22 bp, Homo sapiens
gtgccagctgtccatgttcctc

SEQ ID NO: 8371186 - DNA, 22 bp, Homo sapiens
gtgccagctctccccacatctg

SEQ ID NO: 8371187 - DNA, 22 bp, Homo sapiens
ggtcccagctggtcactgtcag

SEQ ID NO: 8371188 - DNA, 22 bp, Homo sapiens
ggtcccagctggtcactgtcag

SEQ ID NO: 8371189 - DNA, 22 bp, Homo sapiens
gggttgaggcggatgtcggcgg

SEQ ID NO: 8371190 - DNA, 22 bp, Homo sapiens
gggttggattacttagggagaa

SEQ ID NO: 8371191 - DNA, 22 bp, Homo sapiens
ggtccccccatggtgagcactg

SEQ ID NO: 8371192 - DNA, 23 bp, Homo sapiens
ggtcccagtggagaggcctcacc

SEQ ID NO: 8371193 - DNA, 22 bp, Homo sapiens
ggtcccagttgcccaggtcagg

SEQ ID NO: 8371194 - DNA, 22 bp, Homo sapiens
ggtcccagtcctctccctgcta

SEQ ID NO: 8371195 - DNA, 22 bp, Homo sapiens
ggtcccagtcctctccctgcta

SEQ ID NO: 8371196 - DNA, 23 bp, Homo sapiens
ggtcccagtggagaggcctcacc

SEQ ID NO: 8371197 - DNA, 22 bp, Homo sapiens
ggtccctgcccacctgggagct

SEQ ID NO: 8371198 - DNA, 22 bp, Homo sapiens
ggtccctgaagaggcctggggt

SEQ ID NO: 8371199 - DNA, 22 bp, Homo sapiens
ggtccctgaagatgcctgagga

SEQ ID NO: 8371200 - DNA, 22 bp, Homo sapiens
ggtgagggagtggaacgaggtg

SEQ ID NO: 8371201 - DNA, 22 bp, Homo sapiens
ggtgaggctggcttgccttctt

SEQ ID NO: 8371202 - DNA, 22 bp, Homo sapiens
ggtgaggctaagtgacacaggg

SEQ ID NO: 8371203 - DNA, 22 bp, Homo sapiens
ggtgaggcgtccccaccatggg

SEQ ID NO: 8371204 - DNA, 22 bp, Homo sapiens
ggtgaggcaggtggctgctgag

SEQ ID NO: 8371205 - DNA, 22 bp, Homo sapiens
ggtgaggcaggtggctgctgag

SEQ ID NO: 8371206 - DNA, 22 bp, Homo sapiens
ggtgaggcccagtgatctgtgt

SEQ ID NO: 8371207 - DNA, 18 bp, Homo sapiens
ggtgaggcggcggccagc

SEQ ID NO: 8371208 - DNA, 18 bp, Homo sapiens
ggtgaggcggcggccagc

SEQ ID NO: 8371209 - DNA, 22 bp, Homo sapiens
ggtgaggcctgtacaaagctgc

SEQ ID NO: 8371210 - DNA, 22 bp, Homo sapiens
ggtgagcaaagcttcatctgta

SEQ ID NO: 8371211 - DNA, 22 bp, Homo sapiens
ggtgagaggcagtgctgtggaa

SEQ ID NO: 8371212 - DNA, 22 bp, Homo sapiens
ggtgagcactgccctgggtctc

SEQ ID NO: 8371213 - DNA, 22 bp, Homo sapiens
ggtgaggcagagggagtaacct

SEQ ID NO: 8371214 - DNA, 22 bp, Homo sapiens
ggtgaggcagagggagtaacct

SEQ ID NO: 8371215 - DNA, 22 bp, Homo sapiens
ggtgaggcaggtggctgctgag

SEQ ID NO: 8371216 - DNA, 22 bp, Homo sapiens
ggtggagagctggatgagaggt

SEQ ID NO: 8371217 - DNA, 22 bp, Homo sapiens
ggtggatgctgactgttctgct

SEQ ID NO: 8371218 - DNA, 22 bp, Homo sapiens
ggtggatggactctcgggggcc

SEQ ID NO: 8371219 - DNA, 22 bp, Homo sapiens
ggtggcaccttaccctgcgcag

SEQ ID NO: 8371220 - DNA, 22 bp, Homo sapiens
ggtggcagagacataggacata

SEQ ID NO: 8371221 - DNA, 22 bp, Homo sapiens
ggtggcagagacataggacata

SEQ ID NO: 8371222 - DNA, 19 bp, Homo sapiens
ggtggcagaacgtgggtcc

SEQ ID NO: 8371223 - DNA, 22 bp, Homo sapiens
ggtggcagagaggaggtagttt

SEQ ID NO: 8371224 - DNA, 22 bp, Homo sapiens
ggtggcagagacataggacata

SEQ ID NO: 8371225 - DNA, 22 bp, Homo sapiens
ggtgggtggaaacagcatgtac

SEQ ID NO: 8371226 - DNA, 22 bp, Homo sapiens
ggtggggcctgctccagcggcc

SEQ ID NO: 8371227 - DNA, 22 bp, Homo sapiens
ggtgtttgcatggggccagttt

SEQ ID NO: 8371228 - DNA, 19 bp, Homo sapiens
ggttaatgttaggatactt

SEQ ID NO: 8371229 - DNA, 22 bp, Homo sapiens
ggttcacactaagcttaagtgg

SEQ ID NO: 8371230 - DNA, 22 bp, Homo sapiens
ggttcacactaagcttaagtgg

SEQ ID NO: 8371231 - DNA, 22 bp, Homo sapiens
ggttcacatattgagagtattc

SEQ ID NO: 8371232 - DNA, 22 bp, Homo sapiens
ggttcacagtaaggtttgtgct

SEQ ID NO: 8371233 - DNA, 22 bp, Homo sapiens
ggttcacatattgagagtattc

SEQ ID NO: 8371234 - DNA, 22 bp, Homo sapiens
ggttcacactttcatgatttca

SEQ ID NO: 8371235 - DNA, 22 bp, Homo sapiens
ggttcacagctgtggggttccc

SEQ ID NO: 8371236 - DNA, 22 bp, Homo sapiens
ggttcacaggtcctgggagcag

SEQ ID NO: 8371237 - DNA, 22 bp, Homo sapiens
ggttcacaggtccgactgctgg

SEQ ID NO: 8371238 - DNA, 22 bp, Homo sapiens
ggttagagggcatgcgatcttt

SEQ ID NO: 8371239 - DNA, 22 bp, Homo sapiens
ggttacatctcaagtggagtct

SEQ ID NO: 8371240 - DNA, 22 bp, Homo sapiens
ggttacatagtaaggtcctatt

SEQ ID NO: 8371241 - DNA, 22 bp, Homo sapiens
ggttacatgtatgtttggtata

SEQ ID NO: 8371242 - DNA, 22 bp, Homo sapiens
ggttacatggaagaaatataat

SEQ ID NO: 8371243 - DNA, 20 bp, Homo sapiens
ggttacattgtctacatgtg

SEQ ID NO: 8371244 - DNA, 22 bp, Homo sapiens
gtaatttttagttcattctatc

SEQ ID NO: 8371245 - DNA, 22 bp, Homo sapiens
gtaattttggagtataacctgg

SEQ ID NO: 8371246 - DNA, 22 bp, Homo sapiens
gtaatttttagttcattctatc

SEQ ID NO: 8371247 - DNA, 22 bp, Homo sapiens
gtaattacatgagtactgtaag

SEQ ID NO: 8371248 - DNA, 22 bp, Homo sapiens
ggggcagggaggttatcgccga

SEQ ID NO: 8371249 - DNA, 22 bp, Homo sapiens
ggggccagatatcactaaggtt

SEQ ID NO: 8371250 - DNA, 22 bp, Homo sapiens
ggggccagagaggacccaggtg

SEQ ID NO: 8371251 - DNA, 21 bp, Homo sapiens
ggggcatcaagacagagttag

SEQ ID NO: 8371252 - DNA, 22 bp, Homo sapiens
ggggcagtttctcgtttgccat

SEQ ID NO: 8371253 - DNA, 22 bp, Homo sapiens
ggggaggccagtggaccgtccc

SEQ ID NO: 8371254 - DNA, 22 bp, Homo sapiens
ggggaggacctttccaaggctt

SEQ ID NO: 8371255 - DNA, 22 bp, Homo sapiens
ggggaggcaagatgaagtgagg

SEQ ID NO: 8371256 - DNA, 22 bp, Homo sapiens
ggggaggaagctggaacacggg

SEQ ID NO: 8371257 - DNA, 22 bp, Homo sapiens
ggggaggaagctggaacacggg

SEQ ID NO: 8371258 - DNA, 19 bp, Homo sapiens
gggctctggcctcagtggg

SEQ ID NO: 8371259 - DNA, 18 bp, Homo sapiens
gggctctggcatctgggt

SEQ ID NO: 8371260 - DNA, 16 bp, Homo sapiens
gggctgggggattctg

SEQ ID NO: 8371261 - DNA, 23 bp, Homo sapiens
gggcttcattttaattcagctgc

SEQ ID NO: 8371262 - DNA, 22 bp, Homo sapiens
gggcttctacttgcaaaggata

SEQ ID NO: 8371263 - DNA, 22 bp, Homo sapiens
gggcttctaagtgaaagtgtaa

SEQ ID NO: 8371264 - DNA, 22 bp, Homo sapiens
gggcttctagaccagcagtgag

SEQ ID NO: 8371265 - DNA, 22 bp, Homo sapiens
gggcttctattcaagtctgttt

SEQ ID NO: 8371266 - DNA, 20 bp, Homo sapiens
gggctgttgctcttggtttg

SEQ ID NO: 8371267 - DNA, 22 bp, Homo sapiens
gggcttcaaaattggcactctt

SEQ ID NO: 8371268 - DNA, 22 bp, Homo sapiens
gggcttcagggtacttcctcct

SEQ ID NO: 8371269 - DNA, 22 bp, Homo sapiens
gggcttcaggagggtcagccca

SEQ ID NO: 8371270 - DNA, 19 bp, Homo sapiens
gggcttctgggatcaagag

SEQ ID NO: 8371271 - DNA, 22 bp, Homo sapiens
gggcttctctttagtgagctga

SEQ ID NO: 8371272 - DNA, 22 bp, Homo sapiens
gggcttctattctggcacaaga

SEQ ID NO: 8371273 - DNA, 22 bp, Homo sapiens
gggcttctctcaggggcatgag

SEQ ID NO: 8371274 - DNA, 22 bp, Homo sapiens
gggtgcagcagagctcctctgt

SEQ ID NO: 8371275 - DNA, 22 bp, Homo sapiens
gggtgcagcagagctcctctgt

SEQ ID NO: 8371276 - DNA, 21 bp, Homo sapiens
gggtgggtggaattaggagtg

SEQ ID NO: 8371277 - DNA, 21 bp, Homo sapiens
gggtggggttccagccttttc

SEQ ID NO: 8371278 - DNA, 22 bp, Homo sapiens
gggtggagagaaagaaacgtga

SEQ ID NO: 8371279 - DNA, 22 bp, Homo sapiens
gggtggtgtattagagctgcag

SEQ ID NO: 8371280 - DNA, 22 bp, Homo sapiens
ggggtggagatggtggcccttt

SEQ ID NO: 8371281 - DNA, 19 bp, Homo sapiens
ggggtgctagggagggatc

SEQ ID NO: 8371282 - DNA, 19 bp, Homo sapiens
ggggtgctagggagggatc

SEQ ID NO: 8371283 - DNA, 22 bp, Homo sapiens
ggggtgggagtgccatccttga

SEQ ID NO: 8371284 - DNA, 22 bp, Homo sapiens
ggggtgggagtgccatccttga

SEQ ID NO: 8371285 - DNA, 22 bp, Homo sapiens
ggggcccagggcagcagtgcag

SEQ ID NO: 8371286 - DNA, 22 bp, Homo sapiens
ggggcccttgtggctgcaggcc

SEQ ID NO: 8371287 - DNA, 22 bp, Homo sapiens
ggggccagcactgtgcctttgt

SEQ ID NO: 8371288 - DNA, 22 bp, Homo sapiens
ggggccagcaatgttgaggaat

SEQ ID NO: 8371289 - DNA, 22 bp, Homo sapiens
ggggccagcaatgttgaggaat

SEQ ID NO: 8371290 - DNA, 22 bp, Homo sapiens
ggggccaggtccagcttccaaa

SEQ ID NO: 8371291 - DNA, 17 bp, Homo sapiens
ggcagcctcaggcgttt

SEQ ID NO: 8371292 - DNA, 21 bp, Homo sapiens
ggcagcctctgtggaagggga

SEQ ID NO: 8371293 - DNA, 22 bp, Homo sapiens
ggcagccttctctcataggtga

SEQ ID NO: 8371294 - DNA, 18 bp, Homo sapiens
ggcagcctggacatgctc

SEQ ID NO: 8371295 - DNA, 21 bp, Homo sapiens
ggcagcgtgtggacaggaagg

SEQ ID NO: 8371296 - DNA, 22 bp, Homo sapiens
ggcagctcacctctggtccagg

SEQ ID NO: 8371297 - DNA, 22 bp, Homo sapiens
ggcagccttgagggaggcctgg

SEQ ID NO: 8371298 - DNA, 22 bp, Homo sapiens
ggcagccttgagggaggcctgg

SEQ ID NO: 8371299 - DNA, 22 bp, Homo sapiens
ggcagctcacgggcatggggtg

SEQ ID NO: 8371300 - DNA, 22 bp, Homo sapiens
ggcagctcacgggcatggggtg

SEQ ID NO: 8371301 - DNA, 22 bp, Homo sapiens
ggcaggcttgatatggggggac

SEQ ID NO: 8371302 - DNA, 22 bp, Homo sapiens
ggcaggctgttcacctgctttt

SEQ ID NO: 8371303 - DNA, 22 bp, Homo sapiens
ggcaggctgttcacctgctttt

SEQ ID NO: 8371304 - DNA, 22 bp, Homo sapiens
ggcaggctttcagcatcaagtc

SEQ ID NO: 8371305 - DNA, 22 bp, Homo sapiens
ggcaggctttcagcatcaagtc

SEQ ID NO: 8371306 - DNA, 20 bp, Homo sapiens
ggcaggctttatatggaggg

SEQ ID NO: 8371307 - DNA, 22 bp, Homo sapiens
ggcagtgcccggtgcctcctct

SEQ ID NO: 8371308 - DNA, 22 bp, Homo sapiens
ggcagtgccactaagctctgct

SEQ ID NO: 8371309 - DNA, 22 bp, Homo sapiens
ggcagtgccactaagctctgct

SEQ ID NO: 8371310 - DNA, 18 bp, Homo sapiens
ggcagtgcagtctcaggg

SEQ ID NO: 8371311 - DNA, 22 bp, Homo sapiens
ggcagtgcaaggctggcacagt

SEQ ID NO: 8371312 - DNA, 22 bp, Homo sapiens
ggcagtgcaggcccttcagcct

SEQ ID NO: 8371313 - DNA, 18 bp, Homo sapiens
ggcagtgcagtctcaggg

SEQ ID NO: 8371314 - DNA, 22 bp, Homo sapiens
ggcagtggaggaccctgtgtct

SEQ ID NO: 8371315 - DNA, 22 bp, Homo sapiens
ggcagtgactgttcagacgtcc

SEQ ID NO: 8371316 - DNA, 19 bp, Homo sapiens
ggcagtgagaagactcctg

SEQ ID NO: 8371317 - DNA, 22 bp, Homo sapiens
ggcagtgcaaggcagcctggat

SEQ ID NO: 8371318 - DNA, 22 bp, Homo sapiens
ggcagtgagtcccggagaggcc

SEQ ID NO: 8371319 - DNA, 22 bp, Homo sapiens
ggcagtgagtcccggagaggcc

SEQ ID NO: 8371320 - DNA, 22 bp, Homo sapiens
ggcagggcttgtctctgtgatg

SEQ ID NO: 8371321 - DNA, 22 bp, Homo sapiens
ggcaggggtcctggtgttgact

SEQ ID NO: 8371322 - DNA, 20 bp, Homo sapiens
ggcagggcatcaacagctct

SEQ ID NO: 8371323 - DNA, 22 bp, Homo sapiens
ggcagggaagctggcatcacgg

SEQ ID NO: 8371324 - DNA, 22 bp, Homo sapiens
ggcagggaagctggcatcacgg

SEQ ID NO: 8371325 - DNA, 22 bp, Homo sapiens
ggcagggaaacagctgatccca

SEQ ID NO: 8371326 - DNA, 22 bp, Homo sapiens
ggcagggaaacagctgatccca

SEQ ID NO: 8371327 - DNA, 16 bp, Homo sapiens
ggcaccagtgaacaca

SEQ ID NO: 8371328 - DNA, 22 bp, Homo sapiens
ggcaccaggggatgtaatgtcc

SEQ ID NO: 8371329 - DNA, 22 bp, Homo sapiens
ggcaccagggacaatcctcttc

SEQ ID NO: 8371330 - DNA, 22 bp, Homo sapiens
ggcaccagggaaggaaggctgg

SEQ ID NO: 8371331 - DNA, 22 bp, Homo sapiens
ggcaccagggcaagggtctttc

SEQ ID NO: 8371332 - DNA, 22 bp, Homo sapiens
ggcaccagggcaagggtctttc

SEQ ID NO: 8371333 - DNA, 22 bp, Homo sapiens
ggcaccaggctgggcataggcc

SEQ ID NO: 8371334 - DNA, 22 bp, Homo sapiens
ggcaccaggctgggcataggcc

SEQ ID NO: 8371335 - DNA, 22 bp, Homo sapiens
ggaggcagaacttcccgtcagt

SEQ ID NO: 8371336 - DNA, 22 bp, Homo sapiens
ggaggcacttcccgtctcagcc

SEQ ID NO: 8371337 - DNA, 22 bp, Homo sapiens
ggaggcacttcatgctgacccg

SEQ ID NO: 8371338 - DNA, 22 bp, Homo sapiens
ggcacctgtgtaagatctggaa

SEQ ID NO: 8371339 - DNA, 22 bp, Homo sapiens
ggcacctgtgtaagatctggaa

SEQ ID NO: 8371340 - DNA, 22 bp, Homo sapiens
ggcaccttgagggcagaacctt

SEQ ID NO: 8371341 - DNA, 19 bp, Homo sapiens
ggcaccttggctatgcctg

SEQ ID NO: 8371342 - DNA, 22 bp, Homo sapiens
ggcacctgctcatctggactca

SEQ ID NO: 8371343 - DNA, 22 bp, Homo sapiens
ggcacctgatgactgcttccct

SEQ ID NO: 8371344 - DNA, 22 bp, Homo sapiens
ggcacctggatgtagcagtgaa

SEQ ID NO: 8371345 - DNA, 23 bp, Homo sapiens
ggaggcacttaggcagagcagag

SEQ ID NO: 8371346 - DNA, 23 bp, Homo sapiens
ggaggcacttaggcagagcagag

SEQ ID NO: 8371347 - DNA, 22 bp, Homo sapiens
ggaggcaccctatttgaggcct

SEQ ID NO: 8371348 - DNA, 22 bp, Homo sapiens
ggaggcaccctatttgaggcct

SEQ ID NO: 8371349 - DNA, 23 bp, Homo sapiens
ggaggcacttaggcagagcagag

SEQ ID NO: 8371350 - DNA, 22 bp, Homo sapiens
ggaggcacacctcagactggga

SEQ ID NO: 8371351 - DNA, 22 bp, Homo sapiens
ggaggcacacctcagactggga

SEQ ID NO: 8371352 - DNA, 22 bp, Homo sapiens
ggaggagtcagttgggctgctt

SEQ ID NO: 8371353 - DNA, 22 bp, Homo sapiens
ggaggaggtgggttaagttgta

SEQ ID NO: 8371354 - DNA, 22 bp, Homo sapiens
ggaggatgagctacgaggagct

SEQ ID NO: 8371355 - DNA, 22 bp, Homo sapiens
ggaggaggggtttacattggaa

SEQ ID NO: 8371356 - DNA, 22 bp, Homo sapiens
ggcagatggaatgagctgtcta

SEQ ID NO: 8371357 - DNA, 22 bp, Homo sapiens
ggcagaggtgacagtgtctttt

SEQ ID NO: 8371358 - DNA, 22 bp, Homo sapiens
ggcagatgttgcagtgagcaga

SEQ ID NO: 8371359 - DNA, 22 bp, Homo sapiens
ggcagatgttatatgatctgag

SEQ ID NO: 8371360 - DNA, 22 bp, Homo sapiens
ggcagatggggtgacaagagag

SEQ ID NO: 8371361 - DNA, 22 bp, Homo sapiens
ggcagatggagaagcagcaggt

SEQ ID NO: 8371362 - DNA, 22 bp, Homo sapiens
ggcagatggagaagcagcaggt

SEQ ID NO: 8371363 - DNA, 22 bp, Homo sapiens
ggcagatgttgcagtgagcaga

SEQ ID NO: 8371364 - DNA, 22 bp, Homo sapiens
ggcagcaaaaagcctggttgaa

SEQ ID NO: 8371365 - DNA, 22 bp, Homo sapiens
ggcagcagaactggccctgtat

SEQ ID NO: 8371366 - DNA, 22 bp, Homo sapiens
ggcagcagaactggccctgtat

SEQ ID NO: 8371367 - DNA, 22 bp, Homo sapiens
ggcagcactgcagcttgttggg

SEQ ID NO: 8371368 - DNA, 22 bp, Homo sapiens
ggcagcactgcagcttgttggg

SEQ ID NO: 8371369 - DNA, 22 bp, Homo sapiens
ggcccatgaccctagccaactg

SEQ ID NO: 8371370 - DNA, 22 bp, Homo sapiens
ggcccagtgtaccccaggcagt

SEQ ID NO: 8371371 - DNA, 22 bp, Homo sapiens
ggcccagtgctgttcacccagt

SEQ ID NO: 8371372 - DNA, 20 bp, Homo sapiens
ggcccagtgaaccaggacgg

SEQ ID NO: 8371373 - DNA, 22 bp, Homo sapiens
ggcccaggatgcaagaactgaa

SEQ ID NO: 8371374 - DNA, 22 bp, Homo sapiens
ggcccagctttcattccttgct

SEQ ID NO: 8371375 - DNA, 22 bp, Homo sapiens
ggcccagctgtgcttccagccc

SEQ ID NO: 8371376 - DNA, 22 bp, Homo sapiens
ggcccagctgggcggggacacg

SEQ ID NO: 8371377 - DNA, 22 bp, Homo sapiens
ggcccagctgtatattacagtt

SEQ ID NO: 8371378 - DNA, 21 bp, Homo sapiens
ggccagctgcatatgtcactg

SEQ ID NO: 8371379 - DNA, 22 bp, Homo sapiens
ggccagctggatgtgggtgacg

SEQ ID NO: 8371380 - DNA, 22 bp, Homo sapiens
ggccagctgggccaccaggtgc

SEQ ID NO: 8371381 - DNA, 22 bp, Homo sapiens
ggccagctggatgtgggtgacg

SEQ ID NO: 8371382 - DNA, 22 bp, Homo sapiens
ggcccagctctattgaattaca

SEQ ID NO: 8371383 - DNA, 22 bp, Homo sapiens
ggccagctgagctgctgcacag

SEQ ID NO: 8371384 - DNA, 22 bp, Homo sapiens
ggccagctcttgtccacggagg

SEQ ID NO: 8371385 - DNA, 22 bp, Homo sapiens
ggccagcatatagagtgaagta

SEQ ID NO: 8371386 - DNA, 22 bp, Homo sapiens
ggccagcagtcacagggtcaga

SEQ ID NO: 8371387 - DNA, 22 bp, Homo sapiens
ggccacagagggcgggatgctg

SEQ ID NO: 8371388 - DNA, 22 bp, Homo sapiens
ggccacagagggcgggatgctg

SEQ ID NO: 8371389 - DNA, 22 bp, Homo sapiens
ggcagtgggtggatctcaggga

SEQ ID NO: 8371390 - DNA, 22 bp, Homo sapiens
ggcagtgggaaataagtgagaa

SEQ ID NO: 8371391 - DNA, 22 bp, Homo sapiens
ggcagtggcatgtgggtagtgg

SEQ ID NO: 8371392 - DNA, 22 bp, Homo sapiens
ggcagtggcatgtgggtagtgg

SEQ ID NO: 8371393 - DNA, 22 bp, Homo sapiens
ggccacagcaatgctgtgatgt

SEQ ID NO: 8371394 - DNA, 22 bp, Homo sapiens
ggccacagcagatgcttcagat

SEQ ID NO: 8371395 - DNA, 22 bp, Homo sapiens
ggccagcagacctcagggactc

SEQ ID NO: 8371396 - DNA, 19 bp, Homo sapiens
ggccagcacagggctctgt

SEQ ID NO: 8371397 - DNA, 21 bp, Homo sapiens
ggccacagttagggctcagga

SEQ ID NO: 8371398 - DNA, 22 bp, Homo sapiens
ggccacagtgggaaatcctggg

SEQ ID NO: 8371399 - DNA, 22 bp, Homo sapiens
ggccacagtgggaaatcctggg

SEQ ID NO: 8371400 - DNA, 22 bp, Homo sapiens
ggccaccaaagtcctgtggctt

SEQ ID NO: 8371401 - DNA, 22 bp, Homo sapiens
ggccacatgaattcttggacag

SEQ ID NO: 8371402 - DNA, 22 bp, Homo sapiens
ggctctgcactcagagtcattc

SEQ ID NO: 8371403 - DNA, 22 bp, Homo sapiens
ggctctgcagagggcccagctt

SEQ ID NO: 8371404 - DNA, 22 bp, Homo sapiens
ggctctgcagcttgctaactgt

SEQ ID NO: 8371405 - DNA, 22 bp, Homo sapiens
ggctctgcatgtgagtgggtgg

SEQ ID NO: 8371406 - DNA, 22 bp, Homo sapiens
ggctctgcagtgacttgagggg

SEQ ID NO: 8371407 - DNA, 22 bp, Homo sapiens
ggctctgcctctgaccctctgg

SEQ ID NO: 8371408 - DNA, 22 bp, Homo sapiens
ggctctgccgtgtgctcacatg

SEQ ID NO: 8371409 - DNA, 22 bp, Homo sapiens
ggctctgcgcctgcggggactt

SEQ ID NO: 8371410 - DNA, 22 bp, Homo sapiens
ggctctgcctgcctgagtgtcc

SEQ ID NO: 8371411 - DNA, 22 bp, Homo sapiens
ggctctgcccgcggctgcccac

SEQ ID NO: 8371412 - DNA, 22 bp, Homo sapiens
ggctctgcccaggtggacagca

SEQ ID NO: 8371413 - DNA, 22 bp, Homo sapiens
ggctctgcccagatgaagagga

SEQ ID NO: 8371414 - DNA, 22 bp, Homo sapiens
ggctctgccatttcctagctgc

SEQ ID NO: 8371415 - DNA, 22 bp, Homo sapiens
ggctctgccacttcttggctgt

SEQ ID NO: 8371416 - DNA, 22 bp, Homo sapiens
ggctcactgcaagctccgcctc

SEQ ID NO: 8371417 - DNA, 22 bp, Homo sapiens
ggctcagaggagctggaacggt

SEQ ID NO: 8371418 - DNA, 22 bp, Homo sapiens
ggctcagcaatgatgagcccct

SEQ ID NO: 8371419 - DNA, 22 bp, Homo sapiens
ggcctctctgagagcagacgtt

SEQ ID NO: 8371420 - DNA, 22 bp, Homo sapiens
ggcctctctccttggcttgcag

SEQ ID NO: 8371421 - DNA, 22 bp, Homo sapiens
ggcctctcttgggacagctgtc

SEQ ID NO: 8371422 - DNA, 22 bp, Homo sapiens
ggcctctcttgggacagctgtc

SEQ ID NO: 8371423 - DNA, 22 bp, Homo sapiens
ggcctctggggtcctgagccca

SEQ ID NO: 8371424 - DNA, 22 bp, Homo sapiens
ggcctctggcaggcaggccctc

SEQ ID NO: 8371425 - DNA, 22 bp, Homo sapiens
ggctagggacacagctctgctc

SEQ ID NO: 8371426 - DNA, 22 bp, Homo sapiens
ggctcactacaacctccgcctt

SEQ ID NO: 8371427 - DNA, 22 bp, Homo sapiens
ggctgcagttgtgtgaaggccg

SEQ ID NO: 8371428 - DNA, 22 bp, Homo sapiens
ggctgcctcagatttgctgact

SEQ ID NO: 8371429 - DNA, 22 bp, Homo sapiens
ggctgcctcctcgagacaggat

SEQ ID NO: 8371430 - DNA, 22 bp, Homo sapiens
ggctgcctcccaggagaatctg

SEQ ID NO: 8371431 - DNA, 22 bp, Homo sapiens
ggctgcctcctcgagacaggat

SEQ ID NO: 8371432 - DNA, 22 bp, Homo sapiens
ggctgcctccactgcttgtccc

SEQ ID NO: 8371433 - DNA, 22 bp, Homo sapiens
ggctgcctcccaggagaatctg

SEQ ID NO: 8371434 - DNA, 22 bp, Homo sapiens
ggctgcctcctgctgggctgga

SEQ ID NO: 8371435 - DNA, 19 bp, Homo sapiens
ggctgcctcctgggagatt

SEQ ID NO: 8371436 - DNA, 22 bp, Homo sapiens
ggctgcctcctgctgggctgga

SEQ ID NO: 8371437 - DNA, 22 bp, Homo sapiens
ggctgcctctatttaggatcaa

SEQ ID NO: 8371438 - DNA, 20 bp, Homo sapiens
ggctgcctccttcctttcct

SEQ ID NO: 8371439 - DNA, 19 bp, Homo sapiens
ggctgcctcctgggagatt

SEQ ID NO: 8371440 - DNA, 19 bp, Homo sapiens
ggctgcctcctgggagatt

SEQ ID NO: 8371441 - DNA, 19 bp, Homo sapiens
ggctgcctcctgggagatt

SEQ ID NO: 8371442 - DNA, 22 bp, Homo sapiens
ggctctgcggcgtgtgcgcagg

SEQ ID NO: 8371443 - DNA, 22 bp, Homo sapiens
ggctctgcgcggtaaagtgact

SEQ ID NO: 8371444 - DNA, 22 bp, Homo sapiens
ggctgcaggcagggtatccact

SEQ ID NO: 8371445 - DNA, 17 bp, Homo sapiens
ggctgcagtccaggagg

SEQ ID NO: 8371446 - DNA, 22 bp, Homo sapiens
ggctgcaggttggttggcagct

SEQ ID NO: 8371447 - DNA, 22 bp, Homo sapiens
ggctggagtgggctccagagtt

SEQ ID NO: 8371448 - DNA, 22 bp, Homo sapiens
ggctggataccaggagacaggg

SEQ ID NO: 8371449 - DNA, 17 bp, Homo sapiens
ggctggaggggacccgg

SEQ ID NO: 8371450 - DNA, 22 bp, Homo sapiens
ggctggcagtgtgagagaggga

SEQ ID NO: 8371451 - DNA, 22 bp, Homo sapiens
ggctggcaggggatgtcagatg

SEQ ID NO: 8371452 - DNA, 22 bp, Homo sapiens
ggctggcaggcacagtatgcaa

SEQ ID NO: 8371453 - DNA, 22 bp, Homo sapiens
ggctgcctgctcctcctgcacg

SEQ ID NO: 8371454 - DNA, 22 bp, Homo sapiens
ggctgcctggacctcctctttc

SEQ ID NO: 8371455 - DNA, 17 bp, Homo sapiens
ggctggagcagctcccc

SEQ ID NO: 8371456 - DNA, 17 bp, Homo sapiens
ggctggagcagctcccc

SEQ ID NO: 8371457 - DNA, 22 bp, Homo sapiens
ggctgcctgaggctgaggcccg

SEQ ID NO: 8371458 - DNA, 22 bp, Homo sapiens
ggctgcctgaggctgaggcccg

SEQ ID NO: 8371459 - DNA, 22 bp, Homo sapiens
ggctgcctgctcctcctgcacg

SEQ ID NO: 8371460 - DNA, 22 bp, Homo sapiens
ggctgcctgaactttggggaaa

SEQ ID NO: 8371461 - DNA, 22 bp, Homo sapiens
ggctgcctgaactttggggaaa

SEQ ID NO: 8371462 - DNA, 22 bp, Homo sapiens
ggctgcctgaggcagtgagaga

SEQ ID NO: 8371463 - DNA, 22 bp, Homo sapiens
ggctggccagggccctcgctgg

SEQ ID NO: 8371464 - DNA, 22 bp, Homo sapiens
ggctgtgctgagggggaagccc

SEQ ID NO: 8371465 - DNA, 22 bp, Homo sapiens
ggctgtggacactgagctcaga

SEQ ID NO: 8371466 - DNA, 22 bp, Homo sapiens
ggctgtggacactgagctcaga

SEQ ID NO: 8371467 - DNA, 22 bp, Homo sapiens
ggctgtggagctgcagagttgg

SEQ ID NO: 8371468 - DNA, 22 bp, Homo sapiens
ggctgtggagctgcagagttgg

SEQ ID NO: 8371469 - DNA, 21 bp, Homo sapiens
ggctgtggagccatgactcac

SEQ ID NO: 8371470 - DNA, 22 bp, Homo sapiens
ggctgtggcagctggaagtggt

SEQ ID NO: 8371471 - DNA, 22 bp, Homo sapiens
ggctgtggcattaggtgaggcc

SEQ ID NO: 8371472 - DNA, 22 bp, Homo sapiens
gggaagagggagctggaatgat

SEQ ID NO: 8371473 - DNA, 22 bp, Homo sapiens
gggaagagggagctggaatgat

SEQ ID NO: 8371474 - DNA, 22 bp, Homo sapiens
gggaagagggagctggaatgat

SEQ ID NO: 8371475 - DNA, 22 bp, Homo sapiens
ggctgtggtctgggtgctcccc

SEQ ID NO: 8371476 - DNA, 22 bp, Homo sapiens
ggctgtggtctgggtgctcccc

SEQ ID NO: 8371477 - DNA, 22 bp, Homo sapiens
ggctgtggtctcatctagcctt

SEQ ID NO: 8371478 - DNA, 22 bp, Homo sapiens
ggctgtggggccgggtacagtg

SEQ ID NO: 8371479 - DNA, 22 bp, Homo sapiens
ggctgtggggccgggtacagtg

SEQ ID NO: 8371480 - DNA, 22 bp, Homo sapiens
ggctgtggggaccaacaggact

SEQ ID NO: 8371481 - DNA, 22 bp, Homo sapiens
ggctgtggggggagcctgcccg

SEQ ID NO: 8371482 - DNA, 22 bp, Homo sapiens
ggctgtggccagcggggctgag

SEQ ID NO: 8371483 - DNA, 23 bp, Homo sapiens
gggagccaggacctcgcgcccca

SEQ ID NO: 8371484 - DNA, 22 bp, Homo sapiens
gggagccagcctttgcctataa

SEQ ID NO: 8371485 - DNA, 22 bp, Homo sapiens
gggagccatgctggtcttcttt

SEQ ID NO: 8371486 - DNA, 23 bp, Homo sapiens
gggagccatgggtggtcatggag

SEQ ID NO: 8371487 - DNA, 22 bp, Homo sapiens
gggagccagcagggcatggagc

SEQ ID NO: 8371488 - DNA, 19 bp, Homo sapiens
gggagccagaccctttgct

SEQ ID NO: 8371489 - DNA, 22 bp, Homo sapiens
gggagccagagtcacctagaga

SEQ ID NO: 8371490 - DNA, 22 bp, Homo sapiens
gggagccactcagctgagagtt

SEQ ID NO: 8371491 - DNA, 22 bp, Homo sapiens
gggagccactcagctgagagtt

SEQ ID NO: 8371492 - DNA, 22 bp, Homo sapiens
gggaaggccggtccagtcaggt

SEQ ID NO: 8371493 - DNA, 23 bp, Homo sapiens
gggagatgggaaatgaaggctct

SEQ ID NO: 8371494 - DNA, 23 bp, Homo sapiens
gggagatgggaaatgaaggctct

SEQ ID NO: 8371495 - DNA, 22 bp, Homo sapiens
gggagccacagtagcagctact

SEQ ID NO: 8371496 - DNA, 22 bp, Homo sapiens
gggagccacagtgaggtgcatg

SEQ ID NO: 8371497 - DNA, 22 bp, Homo sapiens
gggagccacagtgaggtgcatg

SEQ ID NO: 8371498 - DNA, 22 bp, Homo sapiens
gggaagagtgtcggttgaagtg

SEQ ID NO: 8371499 - DNA, 22 bp, Homo sapiens
gggaagagtgtcggttgaagtg

SEQ ID NO: 8371500 - DNA, 22 bp, Homo sapiens
gggaagagtgtcggttgaagtg

SEQ ID NO: 8371501 - DNA, 22 bp, Homo sapiens
gggaagagtaactagcccatgt

SEQ ID NO: 8371502 - DNA, 22 bp, Homo sapiens
gggaagagtaactagcccatgt

SEQ ID NO: 8371503 - DNA, 22 bp, Homo sapiens
gggaaggcatacctgagggaga

SEQ ID NO: 8371504 - DNA, 22 bp, Homo sapiens
gggaaggcatacctgagggaga

SEQ ID NO: 8371505 - DNA, 22 bp, Homo sapiens
gggaaggcagtgggaggaactg

SEQ ID NO: 8371506 - DNA, 22 bp, Homo sapiens
gggaaggcaggattctctggtg

SEQ ID NO: 8371507 - DNA, 22 bp, Homo sapiens
gggaagcatctgagggtccact

SEQ ID NO: 8371508 - DNA, 22 bp, Homo sapiens
gggagtgggtttggcctaggcc

SEQ ID NO: 8371509 - DNA, 22 bp, Homo sapiens
gggagtgggtttggcctaggcc

SEQ ID NO: 8371510 - DNA, 22 bp, Homo sapiens
gggagtggttgatggtgaaaat

SEQ ID NO: 8371511 - DNA, 19 bp, Homo sapiens
gggagtcaagagattagtt

SEQ ID NO: 8371512 - DNA, 22 bp, Homo sapiens
gggagtggagagcaatggatga

SEQ ID NO: 8371513 - DNA, 22 bp, Homo sapiens
gggagtcagtgaaggagtcaga

SEQ ID NO: 8371514 - DNA, 22 bp, Homo sapiens
gggagtcagagaggtaatggga

SEQ ID NO: 8371515 - DNA, 22 bp, Homo sapiens
gggagctctccctgaggcctgg

SEQ ID NO: 8371516 - DNA, 22 bp, Homo sapiens
gggagccttgggagtgccagcc

SEQ ID NO: 8371517 - DNA, 17 bp, Homo sapiens
gggcagggactcctggg

SEQ ID NO: 8371518 - DNA, 17 bp, Homo sapiens
gggcagggactcctggg

SEQ ID NO: 8371519 - DNA, 22 bp, Homo sapiens
gggcagaggctctggcccatcc

SEQ ID NO: 8371520 - DNA, 21 bp, Homo sapiens
gggcagaggggcctcctgggt

SEQ ID NO: 8371521 - DNA, 21 bp, Homo sapiens
gggcagaggggcctcctgggt

SEQ ID NO: 8371522 - DNA, 20 bp, Homo sapiens
gggcagagccagccagtccc

SEQ ID NO: 8371523 - DNA, 20 bp, Homo sapiens
gggcagagccagccagtccc

SEQ ID NO: 8371524 - DNA, 22 bp, Homo sapiens
gggcagaggctctggcccatcc

SEQ ID NO: 8371525 - DNA, 20 bp, Homo sapiens
gggcagagccagccagtccc

SEQ ID NO: 8371526 - DNA, 22 bp, Homo sapiens
gggcagagagctggaactcctt

SEQ ID NO: 8371527 - DNA, 22 bp, Homo sapiens
gggcagagactcagaaacagaa

SEQ ID NO: 8371528 - DNA, 23 bp, Homo sapiens
gggctcagatttcattctgtgcc

SEQ ID NO: 8371529 - DNA, 22 bp, Homo sapiens
gggctcagaggagtggcctggg

SEQ ID NO: 8371530 - DNA, 22 bp, Homo sapiens
gggctcagctccttccttccta

SEQ ID NO: 8371531 - DNA, 22 bp, Homo sapiens
gggctcagctccttccttccta

SEQ ID NO: 8371532 - DNA, 22 bp, Homo sapiens
gggctcatcaagcctctccgcc

SEQ ID NO: 8371533 - DNA, 22 bp, Homo sapiens
gggctcatggacagctctccag

SEQ ID NO: 8371534 - DNA, 22 bp, Homo sapiens
gggctctggatggagcctgcag

SEQ ID NO: 8371535 - DNA, 22 bp, Homo sapiens
gggctccaactacatcagcctt

SEQ ID NO: 8371536 - DNA, 22 bp, Homo sapiens
gggctccaacggtgagcatgga

SEQ ID NO: 8371537 - DNA, 22 bp, Homo sapiens
gggctccaacggtgagcatgga

SEQ ID NO: 8371538 - DNA, 22 bp, Homo sapiens
gggctcattgggcgctttctaa

SEQ ID NO: 8371539 - DNA, 22 bp, Homo sapiens
gggctccaaaatctatgtcttc

SEQ ID NO: 8371540 - DNA, 22 bp, Homo sapiens
gggctccaaaatcctgtagcct

SEQ ID NO: 8371541 - DNA, 22 bp, Homo sapiens
gggcaggtgtgcagagctgttg

SEQ ID NO: 8371542 - DNA, 22 bp, Homo sapiens
gggcccaggcctccttccttcc

SEQ ID NO: 8371543 - DNA, 22 bp, Homo sapiens
gggcccaggcctccttccttcc

SEQ ID NO: 8371544 - DNA, 22 bp, Homo sapiens
gggcccagtaccctctgccaag

SEQ ID NO: 8371545 - DNA, 22 bp, Homo sapiens
gggccccagtcctcccacgtgg

SEQ ID NO: 8371546 - DNA, 22 bp, Homo sapiens
gctgcagggagctggaaggctc

SEQ ID NO: 8371547 - DNA, 22 bp, Homo sapiens
gctgcagggagctggaaggctc

SEQ ID NO: 8371548 - DNA, 21 bp, Homo sapiens
gctgcagggcccagggcaccc

SEQ ID NO: 8371549 - DNA, 22 bp, Homo sapiens
gctgcaggggggtctggacttg

SEQ ID NO: 8371550 - DNA, 22 bp, Homo sapiens
gctgcaggggggtctggacttg

SEQ ID NO: 8371551 - DNA, 22 bp, Homo sapiens
gctgcagggctctcacaggggg

SEQ ID NO: 8371552 - DNA, 22 bp, Homo sapiens
gctgcaggctgtggcaggggag

SEQ ID NO: 8371553 - DNA, 22 bp, Homo sapiens
gctgcagggagctggaaggctc

SEQ ID NO: 8371554 - DNA, 22 bp, Homo sapiens
gctgcctccactggctcccagt

SEQ ID NO: 8371555 - DNA, 22 bp, Homo sapiens
gctgcctccactggctcccagt

SEQ ID NO: 8371556 - DNA, 22 bp, Homo sapiens
gctgcctccactggctcccagt

SEQ ID NO: 8371557 - DNA, 22 bp, Homo sapiens
gctgcctccactggctcccagt

SEQ ID NO: 8371558 - DNA, 22 bp, Homo sapiens
gctgcctccgccggctccacag

SEQ ID NO: 8371559 - DNA, 22 bp, Homo sapiens
gctgcctccgccggctccacag

SEQ ID NO: 8371560 - DNA, 23 bp, Homo sapiens
gctgcctcctacaaaagcccagc

SEQ ID NO: 8371561 - DNA, 22 bp, Homo sapiens
gctgcctcccccatggctggaa

SEQ ID NO: 8371562 - DNA, 22 bp, Homo sapiens
gctgcctcctgagatttgggca

SEQ ID NO: 8371563 - DNA, 22 bp, Homo sapiens
gctgcctcctgaaagcgctctg

SEQ ID NO: 8371564 - DNA, 22 bp, Homo sapiens
gctgcctctcctgagttgacag

SEQ ID NO: 8371565 - DNA, 22 bp, Homo sapiens
gctgcctctgcacagctcactc

SEQ ID NO: 8371566 - DNA, 22 bp, Homo sapiens
gctgcctctgcacagctcactc

SEQ ID NO: 8371567 - DNA, 22 bp, Homo sapiens
gctgaggtttcaggagtggcag

SEQ ID NO: 8371568 - DNA, 17 bp, Homo sapiens
gctgagtgcagggagtc

SEQ ID NO: 8371569 - DNA, 22 bp, Homo sapiens
gctgagtgtaatgatggcagag

SEQ ID NO: 8371570 - DNA, 22 bp, Homo sapiens
gctgcaggcattttcctgggca

SEQ ID NO: 8371571 - DNA, 22 bp, Homo sapiens
gctgcaggcgcctgcggtctct

SEQ ID NO: 8371572 - DNA, 22 bp, Homo sapiens
gctgcaggcagaatctcccaat

SEQ ID NO: 8371573 - DNA, 22 bp, Homo sapiens
gctgcaggcattttcctgggca

SEQ ID NO: 8371574 - DNA, 22 bp, Homo sapiens
gctgctggtcctcagagctcat

SEQ ID NO: 8371575 - DNA, 22 bp, Homo sapiens
gctgctgtcacccacatctgtc

SEQ ID NO: 8371576 - DNA, 18 bp, Homo sapiens
gctgctggtggagggagc

SEQ ID NO: 8371577 - DNA, 22 bp, Homo sapiens
gctgctgtccttcaagtctgcg

SEQ ID NO: 8371578 - DNA, 22 bp, Homo sapiens
gctggaggggtaataggatggg

SEQ ID NO: 8371579 - DNA, 22 bp, Homo sapiens
gctggagcttgagaggacaggg

SEQ ID NO: 8371580 - DNA, 22 bp, Homo sapiens
gctgctggaacaaatcacccca

SEQ ID NO: 8371581 - DNA, 22 bp, Homo sapiens
gctgctggaagcatgcgatgaa

SEQ ID NO: 8371582 - DNA, 22 bp, Homo sapiens
gctgctggcgctgggcgtccgg

SEQ ID NO: 8371583 - DNA, 22 bp, Homo sapiens
gctgcctctgtagctttggacc

SEQ ID NO: 8371584 - DNA, 23 bp, Homo sapiens
gctgcctctgttggtcttcagtt

SEQ ID NO: 8371585 - DNA, 22 bp, Homo sapiens
gctgctggggtcacatggtaag

SEQ ID NO: 8371586 - DNA, 22 bp, Homo sapiens
gctgctggggccttccctcggg

SEQ ID NO: 8371587 - DNA, 19 bp, Homo sapiens
gctgctggctctggctgga

SEQ ID NO: 8371588 - DNA, 22 bp, Homo sapiens
gctgctgggatcctgggtctca

SEQ ID NO: 8371589 - DNA, 22 bp, Homo sapiens
gctggaggtggtgagaaaaggt

SEQ ID NO: 8371590 - DNA, 22 bp, Homo sapiens
gctggagtatctggggaaggag

SEQ ID NO: 8371591 - DNA, 22 bp, Homo sapiens
gctggagtccagtggcatgatc

SEQ ID NO: 8371592 - DNA, 22 bp, Homo sapiens
gctggagtccagtggcatgatc

SEQ ID NO: 8371593 - DNA, 22 bp, Homo sapiens
gctggagtgctgaggtgcagtg

SEQ ID NO: 8371594 - DNA, 22 bp, Homo sapiens
gctggagtgcagttgcacagtc

SEQ ID NO: 8371595 - DNA, 22 bp, Homo sapiens
gctggagtgctggagtgcagtg

SEQ ID NO: 8371596 - DNA, 22 bp, Homo sapiens
gctggagtgctggagtgcagtg

SEQ ID NO: 8371597 - DNA, 22 bp, Homo sapiens
gctggcaggtccaagatagagc

SEQ ID NO: 8371598 - DNA, 22 bp, Homo sapiens
gctggcaggtccaagatagagc

SEQ ID NO: 8371599 - DNA, 22 bp, Homo sapiens
gctggagttggcaaggcatgta

SEQ ID NO: 8371600 - DNA, 22 bp, Homo sapiens
gctggagttaggtgggcttgaa

SEQ ID NO: 8371601 - DNA, 22 bp, Homo sapiens
gctggagttggcaaggcatgta

SEQ ID NO: 8371602 - DNA, 22 bp, Homo sapiens
gctggatccctgtgggagtggt

SEQ ID NO: 8371603 - DNA, 22 bp, Homo sapiens
gctggcagggtggttgagagag

SEQ ID NO: 8371604 - DNA, 22 bp, Homo sapiens
gctggcagggtggttgagagag

SEQ ID NO: 8371605 - DNA, 22 bp, Homo sapiens
gctggcatggagactctgggtc

SEQ ID NO: 8371606 - DNA, 22 bp, Homo sapiens
gctggcattacaggagagaacc

SEQ ID NO: 8371607 - DNA, 22 bp, Homo sapiens
gctggcagtttcctcaccgagg

SEQ ID NO: 8371608 - DNA, 22 bp, Homo sapiens
gctggcagtcccatcagctggg

SEQ ID NO: 8371609 - DNA, 22 bp, Homo sapiens
gctggcagtcccatcagctggg

SEQ ID NO: 8371610 - DNA, 22 bp, Homo sapiens
gctagaaactgtttaatctctt

SEQ ID NO: 8371611 - DNA, 22 bp, Homo sapiens
gctaggcttcaaaatctccctg

SEQ ID NO: 8371612 - DNA, 22 bp, Homo sapiens
gctaggagtggtgggtcaagga

SEQ ID NO: 8371613 - DNA, 22 bp, Homo sapiens
gctaggctcggaagcagcaggg

SEQ ID NO: 8371614 - DNA, 17 bp, Homo sapiens
gctaggagagggaggag

SEQ ID NO: 8371615 - DNA, 22 bp, Homo sapiens
gctaggagccgctgcactaggt

SEQ ID NO: 8371616 - DNA, 22 bp, Homo sapiens
gctaggaggccctgcacgctta

SEQ ID NO: 8371617 - DNA, 22 bp, Homo sapiens
gctagctgggtttcactgtgga

SEQ ID NO: 8371618 - DNA, 22 bp, Homo sapiens
gctagcctgcagtggctatggt

SEQ ID NO: 8371619 - DNA, 22 bp, Homo sapiens
gctagcctgcagtggctatggt

SEQ ID NO: 8371620 - DNA, 22 bp, Homo sapiens
gctagaaatcgacttcagaatt

SEQ ID NO: 8371621 - DNA, 19 bp, Homo sapiens
gctagaagatagaatgaaa

SEQ ID NO: 8371622 - DNA, 22 bp, Homo sapiens
gctagaaatcgacttcagaatt

SEQ ID NO: 8371623 - DNA, 22 bp, Homo sapiens
gctaggtgcagcagacagctta

SEQ ID NO: 8371624 - DNA, 23 bp, Homo sapiens
gctaggtgcttccacacgtgctg

SEQ ID NO: 8371625 - DNA, 19 bp, Homo sapiens
gctaggtgaccagctggat

SEQ ID NO: 8371626 - DNA, 22 bp, Homo sapiens
gctcagggagagagggcagccg

SEQ ID NO: 8371627 - DNA, 22 bp, Homo sapiens
gctcagggccatggaccagcag

SEQ ID NO: 8371628 - DNA, 22 bp, Homo sapiens
gctcagggagtttcacagtgta

SEQ ID NO: 8371629 - DNA, 22 bp, Homo sapiens
gctcagggcctggctgcggact

SEQ ID NO: 8371630 - DNA, 22 bp, Homo sapiens
gctcagggcgcgagggacgtgg

SEQ ID NO: 8371631 - DNA, 22 bp, Homo sapiens
gctcagtgtgttcaagggctca

SEQ ID NO: 8371632 - DNA, 22 bp, Homo sapiens
gctcagtgcatcattccaggct

SEQ ID NO: 8371633 - DNA, 19 bp, Homo sapiens
gctcagtgatgccagacca

SEQ ID NO: 8371634 - DNA, 20 bp, Homo sapiens
gctcagtggagaaatgcacc

SEQ ID NO: 8371635 - DNA, 22 bp, Homo sapiens
gctcagtgaagggtgccaagta

SEQ ID NO: 8371636 - DNA, 22 bp, Homo sapiens
gctcccagactgaccagaggtg

SEQ ID NO: 8371637 - DNA, 22 bp, Homo sapiens
gctctctgcctttctcaatgac

SEQ ID NO: 8371638 - DNA, 22 bp, Homo sapiens
gctctctggaggccatggacag

SEQ ID NO: 8371639 - DNA, 22 bp, Homo sapiens
gctctgggtagccactgcctgg

SEQ ID NO: 8371640 - DNA, 22 bp, Homo sapiens
gctctgggtagccactgcctgg

SEQ ID NO: 8371641 - DNA, 22 bp, Homo sapiens
gctctgggtagccactgcctgg

SEQ ID NO: 8371642 - DNA, 22 bp, Homo sapiens
gctctgtccagcgtgcacagaa

SEQ ID NO: 8371643 - DNA, 22 bp, Homo sapiens
gctctgtcaacagctagctgtg

SEQ ID NO: 8371644 - DNA, 22 bp, Homo sapiens
gctctgtgaagggtgttgctca

SEQ ID NO: 8371645 - DNA, 19 bp, Homo sapiens
gctctgtgatgctgagggg

SEQ ID NO: 8371646 - DNA, 22 bp, Homo sapiens
gctctgtgccagggctgggcca

SEQ ID NO: 8371647 - DNA, 20 bp, Homo sapiens
gctccccttctctgggcctc

SEQ ID NO: 8371648 - DNA, 22 bp, Homo sapiens
gctccctcccaccagcctgcag

SEQ ID NO: 8371649 - DNA, 22 bp, Homo sapiens
gctccctccatgaggcagaccg

SEQ ID NO: 8371650 - DNA, 22 bp, Homo sapiens
gctccctccatgaggcagaccg

SEQ ID NO: 8371651 - DNA, 22 bp, Homo sapiens
gctccccttggtcctcctggga

SEQ ID NO: 8371652 - DNA, 22 bp, Homo sapiens
gctcccaggatgaggagccagg

SEQ ID NO: 8371653 - DNA, 20 bp, Homo sapiens
gctcccagcctgcagtcccc

SEQ ID NO: 8371654 - DNA, 21 bp, Homo sapiens
gctctctgcatggtggctcag

SEQ ID NO: 8371655 - DNA, 22 bp, Homo sapiens
gctctctcgtgaacaggtggtt

SEQ ID NO: 8371656 - DNA, 22 bp, Homo sapiens
gctctctccctaggcaagtgag

SEQ ID NO: 8371657 - DNA, 22 bp, Homo sapiens
gctccctctgctcaggcacttg

SEQ ID NO: 8371658 - DNA, 19 bp, Homo sapiens
gctctccctctcagttgag

SEQ ID NO: 8371659 - DNA, 19 bp, Homo sapiens
gctctccctctcagttgag

SEQ ID NO: 8371660 - DNA, 22 bp, Homo sapiens
gctgtcccgctgacttccagct

SEQ ID NO: 8371661 - DNA, 22 bp, Homo sapiens
gctgtcccgctgacttccagct

SEQ ID NO: 8371662 - DNA, 22 bp, Homo sapiens
gctgtcccttgtcccaccttgc

SEQ ID NO: 8371663 - DNA, 22 bp, Homo sapiens
gctgtccctttcacaaggtttt

SEQ ID NO: 8371664 - DNA, 22 bp, Homo sapiens
gctgtccttcctggctggggtg

SEQ ID NO: 8371665 - DNA, 22 bp, Homo sapiens
gctgtcctggggagggagaatg

SEQ ID NO: 8371666 - DNA, 22 bp, Homo sapiens
gctgtctgctgtgcactgagca

SEQ ID NO: 8371667 - DNA, 22 bp, Homo sapiens
gctgtcccatggttgcaagatg

SEQ ID NO: 8371668 - DNA, 23 bp, Homo sapiens
gctgtccccatgctccatccctg

SEQ ID NO: 8371669 - DNA, 22 bp, Homo sapiens
gctgtcccgaacccctggtaat

SEQ ID NO: 8371670 - DNA, 23 bp, Homo sapiens
gctgtctgtcatctctgcgggag

SEQ ID NO: 8371671 - DNA, 22 bp, Homo sapiens
gctgtctgtctctgtcccacca

SEQ ID NO: 8371672 - DNA, 22 bp, Homo sapiens
gctgtctgtcttcacatctcgc

SEQ ID NO: 8371673 - DNA, 22 bp, Homo sapiens
gctgtctgctgtgcactgagca

SEQ ID NO: 8371674 - DNA, 22 bp, Homo sapiens
gctgtctggaggctctgaggga

SEQ ID NO: 8371675 - DNA, 22 bp, Homo sapiens
gctgtgtgctcacgtagtggaa

SEQ ID NO: 8371676 - DNA, 22 bp, Homo sapiens
gctggtcccaatgtgtttcctt

SEQ ID NO: 8371677 - DNA, 22 bp, Homo sapiens
gctggtccagggcctctgtggg

SEQ ID NO: 8371678 - DNA, 22 bp, Homo sapiens
gctggtccacatcctggtacgt

SEQ ID NO: 8371679 - DNA, 22 bp, Homo sapiens
gctggccacactgctgatggag

SEQ ID NO: 8371680 - DNA, 22 bp, Homo sapiens
gctgtcacatttggagcactgg

SEQ ID NO: 8371681 - DNA, 22 bp, Homo sapiens
gcttggggtcatgaggctgctg

SEQ ID NO: 8371682 - DNA, 23 bp, Homo sapiens
gcttgtctagtgaattcatatct

SEQ ID NO: 8371683 - DNA, 22 bp, Homo sapiens
gcttgtctctcagccccagtca

SEQ ID NO: 8371684 - DNA, 22 bp, Homo sapiens
gcttggagaagatgttctcaat

SEQ ID NO: 8371685 - DNA, 22 bp, Homo sapiens
gcttggaagtaggattgggaga

SEQ ID NO: 8371686 - DNA, 22 bp, Homo sapiens
gcttaaattgtttgtggatagt

SEQ ID NO: 8371687 - DNA, 22 bp, Homo sapiens
gcttaaagttgtaaattagaga

SEQ ID NO: 8371688 - DNA, 22 bp, Homo sapiens
gcttaaatcccaatgctagacc

SEQ ID NO: 8371689 - DNA, 22 bp, Homo sapiens
gctttacaagtggtgcagatta

SEQ ID NO: 8371690 - DNA, 22 bp, Homo sapiens
gctttacataaacatttattat

SEQ ID NO: 8371691 - DNA, 23 bp, Homo sapiens
gcttgtgtatacaggaggccacc

SEQ ID NO: 8371692 - DNA, 22 bp, Homo sapiens
gctttaaatggcttgcccaagt

SEQ ID NO: 8371693 - DNA, 22 bp, Homo sapiens
gctttaaacctctactctgtcc

SEQ ID NO: 8371694 - DNA, 22 bp, Homo sapiens
gctgttggggccagcaggtcat

SEQ ID NO: 8371695 - DNA, 22 bp, Homo sapiens
gctgtgtgttcaataatgtgat

SEQ ID NO: 8371696 - DNA, 22 bp, Homo sapiens
gctgtgtgctgggcatggcact

SEQ ID NO: 8371697 - DNA, 22 bp, Homo sapiens
gctgtgtgctgggcatggcact

SEQ ID NO: 8371698 - DNA, 22 bp, Homo sapiens
gcttaaaatccatgatttttac

SEQ ID NO: 8371699 - DNA, 22 bp, Homo sapiens
gcttaaaatccatgatttttac

SEQ ID NO: 8371700 - DNA, 22 bp, Homo sapiens
gcttaaaagccacttagtctat

SEQ ID NO: 8371701 - DNA, 22 bp, Homo sapiens
gctttggatgtgtgcctgaggt

SEQ ID NO: 8371702 - DNA, 22 bp, Homo sapiens
gctttatggattgtaaactgca

SEQ ID NO: 8371703 - DNA, 22 bp, Homo sapiens
gctttggatgtgtgcctgaggt

SEQ ID NO: 8371704 - DNA, 22 bp, Homo sapiens
gctttggtcttctagctgtgag

SEQ ID NO: 8371705 - DNA, 22 bp, Homo sapiens
gctttgtgaattattactcaca

SEQ ID NO: 8371706 - DNA, 22 bp, Homo sapiens
gctttagaaatatcactgtgga

SEQ ID NO: 8371707 - DNA, 22 bp, Homo sapiens
gctttacattttggaaaggtga

SEQ ID NO: 8371708 - DNA, 22 bp, Homo sapiens
gctttagacataaagttcttca

SEQ ID NO: 8371709 - DNA, 22 bp, Homo sapiens
gctttgtgtgaagtccatggcg

SEQ ID NO: 8371710 - DNA, 22 bp, Homo sapiens
gcttttatgcacataagggtca

SEQ ID NO: 8371711 - DNA, 22 bp, Homo sapiens
gcttttcctgactttccattag

SEQ ID NO: 8371712 - DNA, 22 bp, Homo sapiens
gcttttcatagataaaattcta

SEQ ID NO: 8371713 - DNA, 22 bp, Homo sapiens
gcttttctataagaactttcaa

SEQ ID NO: 8371714 - DNA, 19 bp, Homo sapiens
gcttttctccttcaagcca

SEQ ID NO: 8371715 - DNA, 22 bp, Homo sapiens
gcttttggacctctgatgtttc

SEQ ID NO: 8371716 - DNA, 22 bp, Homo sapiens
gcttttgtcattcaaatgctct

SEQ ID NO: 8371717 - DNA, 21 bp, Homo sapiens
gctttttgtatggcccaggaa

SEQ ID NO: 8371718 - DNA, 18 bp, Homo sapiens
gctttttagtgcatcttc

SEQ ID NO: 8371719 - DNA, 22 bp, Homo sapiens
ggacagggtaagtactagtgtg

SEQ ID NO: 8371720 - DNA, 22 bp, Homo sapiens
ggacttcattattgggagaggc

SEQ ID NO: 8371721 - DNA, 22 bp, Homo sapiens
ggactgggtcactaagatagta

SEQ ID NO: 8371722 - DNA, 22 bp, Homo sapiens
ggactgtctactaacaagaagc

SEQ ID NO: 8371723 - DNA, 22 bp, Homo sapiens
ggagaaagaagacgaacattgt

SEQ ID NO: 8371724 - DNA, 22 bp, Homo sapiens
ggagaaagctatgtgggggagt

SEQ ID NO: 8371725 - DNA, 22 bp, Homo sapiens
ggagaaagaaatttttgattgg

SEQ ID NO: 8371726 - DNA, 22 bp, Homo sapiens
ggagaaagctatgtgggggagt

SEQ ID NO: 8371727 - DNA, 22 bp, Homo sapiens
ggagaaagctgtagtggaatgt

SEQ ID NO: 8371728 - DNA, 22 bp, Homo sapiens
ggagaaaggcatagcagaacct

SEQ ID NO: 8371729 - DNA, 22 bp, Homo sapiens
ggagaaaggcatagcagaacct

SEQ ID NO: 8371730 - DNA, 23 bp, Homo sapiens
ggacagggccctgccctatggcc

SEQ ID NO: 8371731 - DNA, 22 bp, Homo sapiens
ggacagggctcttggcactcct

SEQ ID NO: 8371732 - DNA, 22 bp, Homo sapiens
ggacagggctcttggcactcct

SEQ ID NO: 8371733 - DNA, 23 bp, Homo sapiens
ggacagggccctgccctatggcc

SEQ ID NO: 8371734 - DNA, 22 bp, Homo sapiens
ggacaggcctggcacagtactg

SEQ ID NO: 8371735 - DNA, 22 bp, Homo sapiens
ggacaggctgcatctgagcatg

SEQ ID NO: 8371736 - DNA, 22 bp, Homo sapiens
ggacaggctgcatctgagcatg

SEQ ID NO: 8371737 - DNA, 22 bp, Homo sapiens
ggacaggctgcatctgagcatg

SEQ ID NO: 8371738 - DNA, 22 bp, Homo sapiens
ggacaggccctctggtcagctt

SEQ ID NO: 8371739 - DNA, 22 bp, Homo sapiens
ggacaggcccggggagcctgga

SEQ ID NO: 8371740 - DNA, 22 bp, Homo sapiens
ggacaggcccggggagcctgga

SEQ ID NO: 8371741 - DNA, 22 bp, Homo sapiens
ggacaggccatatggaatacat

SEQ ID NO: 8371742 - DNA, 19 bp, Homo sapiens
ggaaggagagaaatgcatg

SEQ ID NO: 8371743 - DNA, 22 bp, Homo sapiens
ggaaggaattccaagactaaag

SEQ ID NO: 8371744 - DNA, 19 bp, Homo sapiens
ggaaggagagaaatgcatg

SEQ ID NO: 8371745 - DNA, 22 bp, Homo sapiens
ggaaggaattccaagactaaag

SEQ ID NO: 8371746 - DNA, 22 bp, Homo sapiens
ggaaggaattccaagactaaag

SEQ ID NO: 8371747 - DNA, 22 bp, Homo sapiens
ggaaaaacagtctttattattt

SEQ ID NO: 8371748 - DNA, 22 bp, Homo sapiens
ggaaaaatgacacatatctcaa

SEQ ID NO: 8371749 - DNA, 22 bp, Homo sapiens
ggaaggaggatgctctggcctt

SEQ ID NO: 8371750 - DNA, 22 bp, Homo sapiens
ggaaggaggatgctctggcctt

SEQ ID NO: 8371751 - DNA, 22 bp, Homo sapiens
ggaaggaggggcaaagcagttc

SEQ ID NO: 8371752 - DNA, 22 bp, Homo sapiens
ggaaggagtctttaacacccat

SEQ ID NO: 8371753 - DNA, 22 bp, Homo sapiens
ggacaggatgctgaagatgaag

SEQ ID NO: 8371754 - DNA, 22 bp, Homo sapiens
ggacagagggttgacagagtat

SEQ ID NO: 8371755 - DNA, 22 bp, Homo sapiens
ggacagagggttgacagagtat

SEQ ID NO: 8371756 - DNA, 22 bp, Homo sapiens
ggacagagggttgacagagtat

SEQ ID NO: 8371757 - DNA, 22 bp, Homo sapiens
ggagctggctacagagaactcc

SEQ ID NO: 8371758 - DNA, 22 bp, Homo sapiens
ggagctggctacagagaactcc

SEQ ID NO: 8371759 - DNA, 22 bp, Homo sapiens
ggagctgggaactatgtagtat

SEQ ID NO: 8371760 - DNA, 22 bp, Homo sapiens
ggagctgggaactatgtagtat

SEQ ID NO: 8371761 - DNA, 22 bp, Homo sapiens
ggagctgggaactatgtagtat

SEQ ID NO: 8371762 - DNA, 22 bp, Homo sapiens
ggaggaggggtgactgaatgct

SEQ ID NO: 8371763 - DNA, 22 bp, Homo sapiens
ggaggaggggtgactgaatgct

SEQ ID NO: 8371764 - DNA, 22 bp, Homo sapiens
ggaggaggcggcagaagttcct

SEQ ID NO: 8371765 - DNA, 21 bp, Homo sapiens
ggaggaaaaaggaatgacttg

SEQ ID NO: 8371766 - DNA, 22 bp, Homo sapiens
ggagctgtgggacgctgtccca

SEQ ID NO: 8371767 - DNA, 22 bp, Homo sapiens
ggagccccaattgagcagtacg

SEQ ID NO: 8371768 - DNA, 22 bp, Homo sapiens
ggagccagtttagacctcagtt

SEQ ID NO: 8371769 - DNA, 22 bp, Homo sapiens
ggagccagtgccctctggtgga

SEQ ID NO: 8371770 - DNA, 22 bp, Homo sapiens
ggagccagtatttagtggtctt

SEQ ID NO: 8371771 - DNA, 18 bp, Homo sapiens
ggagcccacggcgtccca

SEQ ID NO: 8371772 - DNA, 22 bp, Homo sapiens
ggagcccaagtctgcactcggc

SEQ ID NO: 8371773 - DNA, 22 bp, Homo sapiens
ggagaagaggagctggaagcct

SEQ ID NO: 8371774 - DNA, 22 bp, Homo sapiens
ggagaagaggagctggaagcct

SEQ ID NO: 8371775 - DNA, 22 bp, Homo sapiens
ggagaagaggagctggaagcct

SEQ ID NO: 8371776 - DNA, 22 bp, Homo sapiens
ggagaaagtacagcaggcaaca

SEQ ID NO: 8371777 - DNA, 22 bp, Homo sapiens
ggagaaagggactgatctgctc

SEQ ID NO: 8371778 - DNA, 22 bp, Homo sapiens
ggagaaagggactgatctgctc

SEQ ID NO: 8371779 - DNA, 22 bp, Homo sapiens
ggagaaagggactgatctgctc

SEQ ID NO: 8371780 - DNA, 22 bp, Homo sapiens
ggagccaggcaatctgtacttt

SEQ ID NO: 8371781 - DNA, 22 bp, Homo sapiens
ggagccagggaagctgcttcct

SEQ ID NO: 8371782 - DNA, 22 bp, Homo sapiens
gcacccagaggtcagcagtgct

SEQ ID NO: 8371783 - DNA, 22 bp, Homo sapiens
gcacccagaggtcagcagtgct

SEQ ID NO: 8371784 - DNA, 22 bp, Homo sapiens
gcacccagccagcatctcagag

SEQ ID NO: 8371785 - DNA, 22 bp, Homo sapiens
gcacccagatattgccttgacc

SEQ ID NO: 8371786 - DNA, 22 bp, Homo sapiens
gcacccagatattgccttgacc

SEQ ID NO: 8371787 - DNA, 22 bp, Homo sapiens
gcagaaggatccgcaggtgcaa

SEQ ID NO: 8371788 - DNA, 22 bp, Homo sapiens
gcacccagcccagggcgtgatg

SEQ ID NO: 8371789 - DNA, 22 bp, Homo sapiens
gcacatttgccactgagctcct

SEQ ID NO: 8371790 - DNA, 22 bp, Homo sapiens
gcacatttctcaaagaattgtc

SEQ ID NO: 8371791 - DNA, 22 bp, Homo sapiens
gcacatttgccactgagctcct

SEQ ID NO: 8371792 - DNA, 22 bp, Homo sapiens
gcacatttgagacatccaggca

SEQ ID NO: 8371793 - DNA, 22 bp, Homo sapiens
gcacatttctcaaagaattgtc

SEQ ID NO: 8371794 - DNA, 22 bp, Homo sapiens
gcacatttaactgagctcagga

SEQ ID NO: 8371795 - DNA, 22 bp, Homo sapiens
gcaccagagggggctctgcagg

SEQ ID NO: 8371796 - DNA, 22 bp, Homo sapiens
gcaccactagagtagagatggt

SEQ ID NO: 8371797 - DNA, 19 bp, Homo sapiens
gcaccagattgagtgacac

SEQ ID NO: 8371798 - DNA, 22 bp, Homo sapiens
gcagacaggattgggttaatag

SEQ ID NO: 8371799 - DNA, 22 bp, Homo sapiens
gcagacagccagactgcactgg

SEQ ID NO: 8371800 - DNA, 23 bp, Homo sapiens
gcagacagagcagactaagacaa

SEQ ID NO: 8371801 - DNA, 22 bp, Homo sapiens
gcagacacttttattctgcata

SEQ ID NO: 8371802 - DNA, 17 bp, Homo sapiens
gcagacacttctattga

SEQ ID NO: 8371803 - DNA, 22 bp, Homo sapiens
gcagacacttttattctgcata

SEQ ID NO: 8371804 - DNA, 22 bp, Homo sapiens
gcagacacttcccactgcagcg

SEQ ID NO: 8371805 - DNA, 22 bp, Homo sapiens
gcagacacagggaaggcaagga

SEQ ID NO: 8371806 - DNA, 22 bp, Homo sapiens
gcagacacatccactcctacag

SEQ ID NO: 8371807 - DNA, 22 bp, Homo sapiens
gcagaagggaataaggagcttt

SEQ ID NO: 8371808 - DNA, 22 bp, Homo sapiens
gcagaggtgctcagtggcagaa

SEQ ID NO: 8371809 - DNA, 22 bp, Homo sapiens
gcagacagggctacagaggtac

SEQ ID NO: 8371810 - DNA, 18 bp, Homo sapiens
gcagagtgcgtctctgtg

SEQ ID NO: 8371811 - DNA, 22 bp, Homo sapiens
gcagagtgaggaagagcttcca

SEQ ID NO: 8371812 - DNA, 22 bp, Homo sapiens
gcagagtgaagggagaggtgtg

SEQ ID NO: 8371813 - DNA, 22 bp, Homo sapiens
gcagagtgagccgaggctgctc

SEQ ID NO: 8371814 - DNA, 22 bp, Homo sapiens
gcagatgttgttgctgggagtt

SEQ ID NO: 8371815 - DNA, 22 bp, Homo sapiens
gcagatgttgtgaggctggtaa

SEQ ID NO: 8371816 - DNA, 22 bp, Homo sapiens
gcagatgttgttgctgggagtt

SEQ ID NO: 8371817 - DNA, 19 bp, Homo sapiens
gcagcaaacaaaacaggta

SEQ ID NO: 8371818 - DNA, 22 bp, Homo sapiens
gcagcaaaaaagtaatatttat

SEQ ID NO: 8371819 - DNA, 22 bp, Homo sapiens
gcagcaaacttccacaagtaga

SEQ ID NO: 8371820 - DNA, 22 bp, Homo sapiens
gcagcaaacttccacaagtaga

SEQ ID NO: 8371821 - DNA, 22 bp, Homo sapiens
gcagcaaagctcttcatgtgat

SEQ ID NO: 8371822 - DNA, 21 bp, Homo sapiens
gcagcaaatgacaacagtgag

SEQ ID NO: 8371823 - DNA, 18 bp, Homo sapiens
gcacatgtaagagtaaag

SEQ ID NO: 8371824 - DNA, 22 bp, Homo sapiens
gcacatggcggccagcaggtga

SEQ ID NO: 8371825 - DNA, 22 bp, Homo sapiens
gcacatgttgctagttacttgc

SEQ ID NO: 8371826 - DNA, 17 bp, Homo sapiens
gcacatgtgttctttta

SEQ ID NO: 8371827 - DNA, 22 bp, Homo sapiens
gcacatgtcttattcactgtta

SEQ ID NO: 8371828 - DNA, 22 bp, Homo sapiens
gcacatgtgagagtagaggcct

SEQ ID NO: 8371829 - DNA, 22 bp, Homo sapiens
gcacagcagctgggggccctgg

SEQ ID NO: 8371830 - DNA, 22 bp, Homo sapiens
gcacagcacagcaacatgtttt

SEQ ID NO: 8371831 - DNA, 22 bp, Homo sapiens
gcacagcacagcaacatgtttt

SEQ ID NO: 8371832 - DNA, 22 bp, Homo sapiens
gcacagagtgggtgagatgtgg

SEQ ID NO: 8371833 - DNA, 22 bp, Homo sapiens
gcacagaggtggaggacaaata

SEQ ID NO: 8371834 - DNA, 22 bp, Homo sapiens
gcacagagtcactagctaagca

SEQ ID NO: 8371835 - DNA, 22 bp, Homo sapiens
gcacagaataacactctgggct

SEQ ID NO: 8371836 - DNA, 22 bp, Homo sapiens
gcacagaagtaaaatacaagtc

SEQ ID NO: 8371837 - DNA, 22 bp, Homo sapiens
gcacagagagggaaggtaactt

SEQ ID NO: 8371838 - DNA, 22 bp, Homo sapiens
gcacagagaggctgtgagcgcc

SEQ ID NO: 8371839 - DNA, 22 bp, Homo sapiens
gcaataaataacatggaagaca

SEQ ID NO: 8371840 - DNA, 22 bp, Homo sapiens
gcaataaaatgtaatgattggg

SEQ ID NO: 8371841 - DNA, 22 bp, Homo sapiens
gcaataaaatgtaatgattggg

SEQ ID NO: 8371842 - DNA, 22 bp, Homo sapiens
gcaataaactctctcaagccac

SEQ ID NO: 8371843 - DNA, 22 bp, Homo sapiens
gcaataaagattttactgtcag

SEQ ID NO: 8371844 - DNA, 20 bp, Homo sapiens
gcaaggcacagtgaggaggg

SEQ ID NO: 8371845 - DNA, 20 bp, Homo sapiens
gcaaggcacagtgaggaggg

SEQ ID NO: 8371846 - DNA, 22 bp, Homo sapiens
gcaaggcagcgcggagtagcta

SEQ ID NO: 8371847 - DNA, 22 bp, Homo sapiens
gcaaggcagcgcggagtagcta

SEQ ID NO: 8371848 - DNA, 22 bp, Homo sapiens
gcaaggctcacattgaactgaa

SEQ ID NO: 8371849 - DNA, 21 bp, Homo sapiens
gcaaggctcattcttgttgta

SEQ ID NO: 8371850 - DNA, 18 bp, Homo sapiens
gcaaggctcaggccaggc

SEQ ID NO: 8371851 - DNA, 21 bp, Homo sapiens
gcaaggcctatcatggcagct

SEQ ID NO: 8371852 - DNA, 22 bp, Homo sapiens
gagtagggtttccaggttagag

SEQ ID NO: 8371853 - DNA, 22 bp, Homo sapiens
gcaaggaagcagagttgctatc

SEQ ID NO: 8371854 - DNA, 22 bp, Homo sapiens
gcagctgtactggcagcattgt

SEQ ID NO: 8371855 - DNA, 22 bp, Homo sapiens
gcagctgtcactttcacaatgc

SEQ ID NO: 8371856 - DNA, 22 bp, Homo sapiens
gcaggcattagcccccatggct

SEQ ID NO: 8371857 - DNA, 22 bp, Homo sapiens
gcaggcatggtcgctgccaggt

SEQ ID NO: 8371858 - DNA, 22 bp, Homo sapiens
gcaggcccagagtcgctggcct

SEQ ID NO: 8371859 - DNA, 22 bp, Homo sapiens
gcaggccacagtggagtctctg

SEQ ID NO: 8371860 - DNA, 22 bp, Homo sapiens
gcaggccctcctctagcaaggc

SEQ ID NO: 8371861 - DNA, 20 bp, Homo sapiens
gcaggccctctctctagtct

SEQ ID NO: 8371862 - DNA, 22 bp, Homo sapiens
gcaggcctcccctgctggagct

SEQ ID NO: 8371863 - DNA, 22 bp, Homo sapiens
gcaggcccttagccttggtggg

SEQ ID NO: 8371864 - DNA, 22 bp, Homo sapiens
gcaggcctaagagaaggcattg

SEQ ID NO: 8371865 - DNA, 18 bp, Homo sapiens
gcaggcctagaacttggt

SEQ ID NO: 8371866 - DNA, 22 bp, Homo sapiens
gcagggcagcttagtccctgtc

SEQ ID NO: 8371867 - DNA, 22 bp, Homo sapiens
gcagggcagctgaagctaggtg

SEQ ID NO: 8371868 - DNA, 22 bp, Homo sapiens
gcagggcagctcactgtggttc

SEQ ID NO: 8371869 - DNA, 19 bp, Homo sapiens
gcagggtggcagagctctt

SEQ ID NO: 8371870 - DNA, 22 bp, Homo sapiens
gcagggtgtgtctcatacagtt

SEQ ID NO: 8371871 - DNA, 22 bp, Homo sapiens
gcagggtgtgtctcatacagtt

SEQ ID NO: 8371872 - DNA, 22 bp, Homo sapiens
gcagggccaggtacaagaagca

SEQ ID NO: 8371873 - DNA, 22 bp, Homo sapiens
gcagggccagtgcagagaggaa

SEQ ID NO: 8371874 - DNA, 22 bp, Homo sapiens
gcagggcagggcaagaactggg

SEQ ID NO: 8371875 - DNA, 22 bp, Homo sapiens
gcagggcatgggccctgtctgc

SEQ ID NO: 8371876 - DNA, 22 bp, Homo sapiens
gcaggtaagagaggctggcttc

SEQ ID NO: 8371877 - DNA, 19 bp, Homo sapiens
gcaggtcattaggctaggt

SEQ ID NO: 8371878 - DNA, 22 bp, Homo sapiens
gcaggtcccagaaagttaattc

SEQ ID NO: 8371879 - DNA, 22 bp, Homo sapiens
gcaggtgaatgatggactagga

SEQ ID NO: 8371880 - DNA, 22 bp, Homo sapiens
gcaggtctggagggcactgggg

SEQ ID NO: 8371881 - DNA, 22 bp, Homo sapiens
gcagccacagaggagggatgca

SEQ ID NO: 8371882 - DNA, 22 bp, Homo sapiens
gcagcagcccagggctctcaga

SEQ ID NO: 8371883 - DNA, 19 bp, Homo sapiens
gcagccaccgcggcggccg

SEQ ID NO: 8371884 - DNA, 22 bp, Homo sapiens
gcagccaccctcaaggctgaat

SEQ ID NO: 8371885 - DNA, 22 bp, Homo sapiens
gcagccacctcccatggcgggg

SEQ ID NO: 8371886 - DNA, 22 bp, Homo sapiens
gcagccactctcattccacgtg

SEQ ID NO: 8371887 - DNA, 22 bp, Homo sapiens
gcagccaggaaagctggaccct

SEQ ID NO: 8371888 - DNA, 22 bp, Homo sapiens
gcagccagccctagtcccactt

SEQ ID NO: 8371889 - DNA, 22 bp, Homo sapiens
gcagcaaggatgaagcacttgg

SEQ ID NO: 8371890 - DNA, 22 bp, Homo sapiens
gcagcacaaagtccccagggac

SEQ ID NO: 8371891 - DNA, 22 bp, Homo sapiens
gcagcagaagtagaagtacagg

SEQ ID NO: 8371892 - DNA, 22 bp, Homo sapiens
gcagcagcagcaattttctgtc

SEQ ID NO: 8371893 - DNA, 22 bp, Homo sapiens
gcagcagcagggagtctgactt

SEQ ID NO: 8371894 - DNA, 22 bp, Homo sapiens
gcagctggtgcaaatgtcactc

SEQ ID NO: 8371895 - DNA, 22 bp, Homo sapiens
gcagctggttaatgggagaatt

SEQ ID NO: 8371896 - DNA, 23 bp, Homo sapiens
gcagctggttagaagggaaggag

SEQ ID NO: 8371897 - DNA, 22 bp, Homo sapiens
gcagctggggaggtcgtgggga

SEQ ID NO: 8371898 - DNA, 22 bp, Homo sapiens
gcagctggggaggtcgtgggga

SEQ ID NO: 8371899 - DNA, 22 bp, Homo sapiens
gcagctggggaggtcgtgggga

SEQ ID NO: 8371900 - DNA, 22 bp, Homo sapiens
gcagctgggtctgtgtgggctg

SEQ ID NO: 8371901 - DNA, 22 bp, Homo sapiens
gcagctgggtctgtgtgggctg

SEQ ID NO: 8371902 - DNA, 22 bp, Homo sapiens
gcagctgggtctgtgtgggctg

SEQ ID NO: 8371903 - DNA, 22 bp, Homo sapiens
gcagctggctcagagaggtggg

SEQ ID NO: 8371904 - DNA, 22 bp, Homo sapiens
gcagctgggacactgaggccag

SEQ ID NO: 8371905 - DNA, 22 bp, Homo sapiens
gcagctgggacactgaggccag

SEQ ID NO: 8371906 - DNA, 22 bp, Homo sapiens
gcagctgggacactgaggccag

SEQ ID NO: 8371907 - DNA, 22 bp, Homo sapiens
gcagcccaatggactgagacag

SEQ ID NO: 8371908 - DNA, 17 bp, Homo sapiens
gcagccagtgcagcagg

SEQ ID NO: 8371909 - DNA, 17 bp, Homo sapiens
gcagccagtgcagcagg

SEQ ID NO: 8371910 - DNA, 22 bp, Homo sapiens
gcctggagtgcagtggcgtgat

SEQ ID NO: 8371911 - DNA, 22 bp, Homo sapiens
gcctggagacagcagaggcggc

SEQ ID NO: 8371912 - DNA, 22 bp, Homo sapiens
gcctggagaaaggaaggtggga

SEQ ID NO: 8371913 - DNA, 20 bp, Homo sapiens
gcctgcaggttggatgggat

SEQ ID NO: 8371914 - DNA, 22 bp, Homo sapiens
gcctgcagggtgatgggctgcc

SEQ ID NO: 8371915 - DNA, 22 bp, Homo sapiens
gcctgcagaactgtgaggcaat

SEQ ID NO: 8371916 - DNA, 22 bp, Homo sapiens
gcctgcagaggtgctgctagct

SEQ ID NO: 8371917 - DNA, 22 bp, Homo sapiens
gcctgagggctcctagcaggct

SEQ ID NO: 8371918 - DNA, 22 bp, Homo sapiens
gcctgaggaattgagggggtaa

SEQ ID NO: 8371919 - DNA, 18 bp, Homo sapiens
gcctccctggctacactt

SEQ ID NO: 8371920 - DNA, 22 bp, Homo sapiens
gcctccacccctggggagtgga

SEQ ID NO: 8371921 - DNA, 22 bp, Homo sapiens
gcccctccgggcgcgtcatagc

SEQ ID NO: 8371922 - DNA, 22 bp, Homo sapiens
gcccctcccagtcaggagcact

SEQ ID NO: 8371923 - DNA, 22 bp, Homo sapiens
gccccttctctgaggaacctgc

SEQ ID NO: 8371924 - DNA, 22 bp, Homo sapiens
gcccctgggagcagagccacca

SEQ ID NO: 8371925 - DNA, 22 bp, Homo sapiens
gccctagcgccagctcagcacc

SEQ ID NO: 8371926 - DNA, 22 bp, Homo sapiens
gccctagcgccagctcagcacc

SEQ ID NO: 8371927 - DNA, 22 bp, Homo sapiens
gcccggccaggaacagagtata

SEQ ID NO: 8371928 - DNA, 22 bp, Homo sapiens
gccctcagagttccccacagtg

SEQ ID NO: 8371929 - DNA, 19 bp, Homo sapiens
gcctcatttccacctcccc

SEQ ID NO: 8371930 - DNA, 22 bp, Homo sapiens
gcctcattacagccaggaagca

SEQ ID NO: 8371931 - DNA, 18 bp, Homo sapiens
gcctccaccatggagggt

SEQ ID NO: 8371932 - DNA, 22 bp, Homo sapiens
gccctgcttctggcatgcagaa

SEQ ID NO: 8371933 - DNA, 22 bp, Homo sapiens
gccctgcttggtcatggccttc

SEQ ID NO: 8371934 - DNA, 22 bp, Homo sapiens
gccctgctggggcacagcaaga

SEQ ID NO: 8371935 - DNA, 23 bp, Homo sapiens
gccctgctgggacctcctgctac

SEQ ID NO: 8371936 - DNA, 22 bp, Homo sapiens
gccctgctgtcttcagagtata

SEQ ID NO: 8371937 - DNA, 22 bp, Homo sapiens
gccctgctgtttagagagctac

SEQ ID NO: 8371938 - DNA, 22 bp, Homo sapiens
gccctgctgctggcagaggcgc

SEQ ID NO: 8371939 - DNA, 22 bp, Homo sapiens
gccctgctcttttgcccaccca

SEQ ID NO: 8371940 - DNA, 22 bp, Homo sapiens
gccctgctgcgcagcacgcatg

SEQ ID NO: 8371941 - DNA, 22 bp, Homo sapiens
gccctgctgagtccggctcaga

SEQ ID NO: 8371942 - DNA, 22 bp, Homo sapiens
gccctgctctgttggtcacctg

SEQ ID NO: 8371943 - DNA, 22 bp, Homo sapiens
gccctgctctggtctctgcccg

SEQ ID NO: 8371944 - DNA, 23 bp, Homo sapiens
gccctgctcctggctgggaggga

SEQ ID NO: 8371945 - DNA, 22 bp, Homo sapiens
gccctgctccaggagaataccc

SEQ ID NO: 8371946 - DNA, 22 bp, Homo sapiens
gccctgctcctccgtcccacga

SEQ ID NO: 8371947 - DNA, 22 bp, Homo sapiens
gccctgctaatttcgtactttt

SEQ ID NO: 8371948 - DNA, 23 bp, Homo sapiens
gccctgctactcacaagctgtgt

SEQ ID NO: 8371949 - DNA, 22 bp, Homo sapiens
gccctgctcatttcacgtgttt

SEQ ID NO: 8371950 - DNA, 22 bp, Homo sapiens
gccaggaaagggaattccctga

SEQ ID NO: 8371951 - DNA, 22 bp, Homo sapiens
gccaggaaattcatgccagatc

SEQ ID NO: 8371952 - DNA, 22 bp, Homo sapiens
gccaggaacacaatgccaagct

SEQ ID NO: 8371953 - DNA, 22 bp, Homo sapiens
gccaggaagagagagccctcca

SEQ ID NO: 8371954 - DNA, 22 bp, Homo sapiens
gccaggaatcactgctgagtaa

SEQ ID NO: 8371955 - DNA, 22 bp, Homo sapiens
gccaggaagttgggccagtcta

SEQ ID NO: 8371956 - DNA, 22 bp, Homo sapiens
gccaggaaggctccctggtcac

SEQ ID NO: 8371957 - DNA, 22 bp, Homo sapiens
gccaggaagtcagccaagccca

SEQ ID NO: 8371958 - DNA, 22 bp, Homo sapiens
gccaggaagtgcagccctgcca

SEQ ID NO: 8371959 - DNA, 22 bp, Homo sapiens
gccaggaaaaaccggccctgct

SEQ ID NO: 8371960 - DNA, 22 bp, Homo sapiens
gccaggaaaaacgtggtgggag

SEQ ID NO: 8371961 - DNA, 19 bp, Homo sapiens
gccaggaaagaatcaggcg

SEQ ID NO: 8371962 - DNA, 22 bp, Homo sapiens
gccaggaaaagaagctggtgct

SEQ ID NO: 8371963 - DNA, 22 bp, Homo sapiens
gccaggaaagccactggcatac

SEQ ID NO: 8371964 - DNA, 22 bp, Homo sapiens
gccagctgtgcttttcctaaaa

SEQ ID NO: 8371965 - DNA, 22 bp, Homo sapiens
gccagcttccatggccacgtca

SEQ ID NO: 8371966 - DNA, 22 bp, Homo sapiens
gccagcttggcatgtgaggagt

SEQ ID NO: 8371967 - DNA, 22 bp, Homo sapiens
gccagctttggcacagggtggt

SEQ ID NO: 8371968 - DNA, 22 bp, Homo sapiens
gccagctttggcacagggtggt

SEQ ID NO: 8371969 - DNA, 22 bp, Homo sapiens
gccactttgatgatataaaaac

SEQ ID NO: 8371970 - DNA, 22 bp, Homo sapiens
gccagaagactggagtcagctg

SEQ ID NO: 8371971 - DNA, 22 bp, Homo sapiens
gccagacactcccctgggcagg

SEQ ID NO: 8371972 - DNA, 22 bp, Homo sapiens
gccagagaatgaaaatcagatt

SEQ ID NO: 8371973 - DNA, 22 bp, Homo sapiens
gccagctgagaaatcattgata

SEQ ID NO: 8371974 - DNA, 22 bp, Homo sapiens
gccagctgaggccgtgcaggct

SEQ ID NO: 8371975 - DNA, 22 bp, Homo sapiens
gccagctgagcaaattccagct

SEQ ID NO: 8371976 - DNA, 22 bp, Homo sapiens
gccagctgagcaaattccagct

SEQ ID NO: 8371977 - DNA, 22 bp, Homo sapiens
gccagctgtatctttggccagc

SEQ ID NO: 8371978 - DNA, 22 bp, Homo sapiens
gccagctgtaagctggggtgat

SEQ ID NO: 8371979 - DNA, 22 bp, Homo sapiens
gccagctgtaagctggggtgat

SEQ ID NO: 8371980 - DNA, 22 bp, Homo sapiens
gccaggcgggtctcaaactcct

SEQ ID NO: 8371981 - DNA, 22 bp, Homo sapiens
gccaggcgggtctcaaactcct

SEQ ID NO: 8371982 - DNA, 22 bp, Homo sapiens
gccaggctaagaaaggtgtgat

SEQ ID NO: 8371983 - DNA, 22 bp, Homo sapiens
gccaggcattattccgatccct

SEQ ID NO: 8371984 - DNA, 22 bp, Homo sapiens
gcccaaagccagtgtgctctcc

SEQ ID NO: 8371985 - DNA, 22 bp, Homo sapiens
gcccaagcagcttcccgagctt

SEQ ID NO: 8371986 - DNA, 22 bp, Homo sapiens
gcccaagccgccttccagagac

SEQ ID NO: 8371987 - DNA, 20 bp, Homo sapiens
gcccaagcgccggccgcaga

SEQ ID NO: 8371988 - DNA, 22 bp, Homo sapiens
gcccaagggcatcaagttctac

SEQ ID NO: 8371989 - DNA, 21 bp, Homo sapiens
gcagtttatgtaatatgcact

SEQ ID NO: 8371990 - DNA, 19 bp, Homo sapiens
gcataaaatgtcaatgtgt

SEQ ID NO: 8371991 - DNA, 22 bp, Homo sapiens
gcattcttggtggagtgctaaa

SEQ ID NO: 8371992 - DNA, 22 bp, Homo sapiens
gcattcttgtttttcctaccct

SEQ ID NO: 8371993 - DNA, 22 bp, Homo sapiens
gcattcttcacagtattcctcc

SEQ ID NO: 8371994 - DNA, 22 bp, Homo sapiens
gcattcttcacagtattcctcc

SEQ ID NO: 8371995 - DNA, 21 bp, Homo sapiens
gcattcttcatgtgattcaga

SEQ ID NO: 8371996 - DNA, 22 bp, Homo sapiens
gcagttacttctgagaagtgaa

SEQ ID NO: 8371997 - DNA, 22 bp, Homo sapiens
gcagttactagcaatttgtgaa

SEQ ID NO: 8371998 - DNA, 22 bp, Homo sapiens
gcagttacctattttgtagaaa

SEQ ID NO: 8371999 - DNA, 18 bp, Homo sapiens
gcaggtgccactgctgtt

SEQ ID NO: 8372000 - DNA, 22 bp, Homo sapiens
gccaccctggacgcactgttcg

SEQ ID NO: 8372001 - DNA, 23 bp, Homo sapiens
gccacctcctggtcagaaagagg

SEQ ID NO: 8372002 - DNA, 22 bp, Homo sapiens
gccacctcccaggacgaggctg

SEQ ID NO: 8372003 - DNA, 21 bp, Homo sapiens
gccacctcgtctcggagcagc

SEQ ID NO: 8372004 - DNA, 22 bp, Homo sapiens
gccacctctagcaaagctcagc

SEQ ID NO: 8372005 - DNA, 22 bp, Homo sapiens
gccacctctctcttgactcgag

SEQ ID NO: 8372006 - DNA, 20 bp, Homo sapiens
gccacctctctagcagtaga

SEQ ID NO: 8372007 - DNA, 22 bp, Homo sapiens
gccacctctctcttgactcgag

SEQ ID NO: 8372008 - DNA, 22 bp, Homo sapiens
gccactgttgctcctcaggaaa

SEQ ID NO: 8372009 - DNA, 22 bp, Homo sapiens
gccactgttcttctttgttcca

SEQ ID NO: 8372010 - DNA, 22 bp, Homo sapiens
gccactgttccaccatcttgat

SEQ ID NO: 8372011 - DNA, 22 bp, Homo sapiens
gccactgtggtcctcccatgat

SEQ ID NO: 8372012 - DNA, 22 bp, Homo sapiens
gccactgtgttgatctagcctg

SEQ ID NO: 8372013 - DNA, 22 bp, Homo sapiens
gccactgtgttgatctagcctg

SEQ ID NO: 8372014 - DNA, 21 bp, Homo sapiens
gccactgtgcacactaaccca

SEQ ID NO: 8372015 - DNA, 20 bp, Homo sapiens
gccactgtgcttacactgct

SEQ ID NO: 8372016 - DNA, 22 bp, Homo sapiens
gccacctggactcagagccagg

SEQ ID NO: 8372017 - DNA, 22 bp, Homo sapiens
gcatttagctttaaaatatttc

SEQ ID NO: 8372018 - DNA, 22 bp, Homo sapiens
gcatttaaatttgaacttcaga

SEQ ID NO: 8372019 - DNA, 22 bp, Homo sapiens
gcatttaaatttgaacttcaga

SEQ ID NO: 8372020 - DNA, 23 bp, Homo sapiens
gcattgtagaatgtttagcagca

SEQ ID NO: 8372021 - DNA, 22 bp, Homo sapiens
gcattggttaagagctttgggg

SEQ ID NO: 8372022 - DNA, 22 bp, Homo sapiens
gcattggtttacacagggtgaa

SEQ ID NO: 8372023 - DNA, 22 bp, Homo sapiens
gcattggttcaaggttgtgcag

SEQ ID NO: 8372024 - DNA, 22 bp, Homo sapiens
gcatttatttctttactgcatc

SEQ ID NO: 8372025 - DNA, 22 bp, Homo sapiens
gcatttatattctgttcggata

SEQ ID NO: 8372026 - DNA, 18 bp, Homo sapiens
gcatttatgcggggctac

SEQ ID NO: 8372027 - DNA, 22 bp, Homo sapiens
gcatttattatctgccaggcac

SEQ ID NO: 8372028 - DNA, 22 bp, Homo sapiens
gttattgtttatcctgcacccc

SEQ ID NO: 8372029 - DNA, 22 bp, Homo sapiens
gttctgcttccttgcttgcgca

SEQ ID NO: 8372030 - DNA, 22 bp, Homo sapiens
gttcttcagtcacatcacagaa

SEQ ID NO: 8372031 - DNA, 22 bp, Homo sapiens
gttaacattcaattaaacagtc

SEQ ID NO: 8372032 - DNA, 22 bp, Homo sapiens
gttatatatagtatttctctga

SEQ ID NO: 8372033 - DNA, 22 bp, Homo sapiens
gttatataattcctgtggtagt

SEQ ID NO: 8372034 - DNA, 22 bp, Homo sapiens
gttatgtactttttaaatcttg

SEQ ID NO: 8372035 - DNA, 22 bp, Homo sapiens
gttatgtatgagggaatgatta

SEQ ID NO: 8372036 - DNA, 22 bp, Homo sapiens
gtgtttcctctagaagccatgg

SEQ ID NO: 8372037 - DNA, 22 bp, Homo sapiens
gtgtttcccctcctggagaagg

SEQ ID NO: 8372038 - DNA, 22 bp, Homo sapiens
gttaaataacctcatgtccgtt

SEQ ID NO: 8372039 - DNA, 22 bp, Homo sapiens
gttaacacatgcaattgcactt

SEQ ID NO: 8372040 - DNA, 23 bp, Homo sapiens
gttaacatggtccatggaagagc

SEQ ID NO: 8372041 - DNA, 22 bp, Homo sapiens
gttaacataggagtttgttgta

SEQ ID NO: 8372042 - DNA, 22 bp, Homo sapiens
gttaacataggcttaggggttt

SEQ ID NO: 8372043 - DNA, 22 bp, Homo sapiens
gttaaattcgatgatggataaa

SEQ ID NO: 8372044 - DNA, 22 bp, Homo sapiens
gtgttctgcagaccagcatcat

SEQ ID NO: 8372045 - DNA, 22 bp, Homo sapiens
gtgttctgcagaccagcatcat

SEQ ID NO: 8372046 - DNA, 22 bp, Homo sapiens
gtgttatttgagtgggagcgtg

SEQ ID NO: 8372047 - DNA, 22 bp, Homo sapiens
gtgttctttatttagtgatgct

SEQ ID NO: 8372048 - DNA, 22 bp, Homo sapiens
gtgttctgggatgattgtagtg

SEQ ID NO: 8372049 - DNA, 22 bp, Homo sapiens
gtgttgatgacattttagaaac

SEQ ID NO: 8372050 - DNA, 23 bp, Homo sapiens
gtgttggcagcagtgctctgggg

SEQ ID NO: 8372051 - DNA, 22 bp, Homo sapiens
gtgttattagagcattaatttt

SEQ ID NO: 8372052 - DNA, 21 bp, Homo sapiens
gtgctgggacacagccaggct

SEQ ID NO: 8372053 - DNA, 22 bp, Homo sapiens
gtgctggctggacatggagcac

SEQ ID NO: 8372054 - DNA, 22 bp, Homo sapiens
gtgctggctgccaggaggctgc

SEQ ID NO: 8372055 - DNA, 17 bp, Homo sapiens
gtgctggcctggggctc

SEQ ID NO: 8372056 - DNA, 21 bp, Homo sapiens
gttcttcctgactagagtagt

SEQ ID NO: 8372057 - DNA, 19 bp, Homo sapiens
gttcttttcacctctgtgc

SEQ ID NO: 8372058 - DNA, 22 bp, Homo sapiens
gttcttttggtagagtgtgcat

SEQ ID NO: 8372059 - DNA, 22 bp, Homo sapiens
gttctttaggggcccaatttcc

SEQ ID NO: 8372060 - DNA, 22 bp, Homo sapiens
gttctttgactccaagaaagta

SEQ ID NO: 8372061 - DNA, 22 bp, Homo sapiens
gttgaaatgagggattaatcag

SEQ ID NO: 8372062 - DNA, 22 bp, Homo sapiens
gttgacagaaaaataacatagc

SEQ ID NO: 8372063 - DNA, 22 bp, Homo sapiens
gttgacagaattgtgtggctgg

SEQ ID NO: 8372064 - DNA, 22 bp, Homo sapiens
gttgacagagcgcctttgaatt

SEQ ID NO: 8372065 - DNA, 22 bp, Homo sapiens
gttgacaggaaggcgttcccag

SEQ ID NO: 8372066 - DNA, 22 bp, Homo sapiens
gtttcaaagcacagctcacatt

SEQ ID NO: 8372067 - DNA, 22 bp, Homo sapiens
gtttcaaagggaagacgctgga

SEQ ID NO: 8372068 - DNA, 22 bp, Homo sapiens
gtttattatacaacaaaagcta

SEQ ID NO: 8372069 - DNA, 22 bp, Homo sapiens
gtttattatacaacaaaagcta

SEQ ID NO: 8372070 - DNA, 22 bp, Homo sapiens
gtttattatacaacaaaagcta

SEQ ID NO: 8372071 - DNA, 22 bp, Homo sapiens
gtttattatacaacaaaagcta

SEQ ID NO: 8372072 - DNA, 22 bp, Homo sapiens
gtttattatacaacaaaagcta

SEQ ID NO: 8372073 - DNA, 22 bp, Homo sapiens
gtttattagagttttctgtctg

SEQ ID NO: 8372074 - DNA, 22 bp, Homo sapiens
gtttattagagttttctgtctg

SEQ ID NO: 8372075 - DNA, 22 bp, Homo sapiens
gtttattaactgtcaagtgatt

SEQ ID NO: 8372076 - DNA, 22 bp, Homo sapiens
gtttattaactgtcaagtgatt

SEQ ID NO: 8372077 - DNA, 22 bp, Homo sapiens
gtttattaactgtcaagtgatt

SEQ ID NO: 8372078 - DNA, 22 bp, Homo sapiens
gtttattagagttttctgtctg

SEQ ID NO: 8372079 - DNA, 22 bp, Homo sapiens
gtttattagagttttctgtctg

SEQ ID NO: 8372080 - DNA, 22 bp, Homo sapiens
gtttattagagttttctgtctg

SEQ ID NO: 8372081 - DNA, 21 bp, Homo sapiens
gtttatgaatcttgtcctgct

SEQ ID NO: 8372082 - DNA, 22 bp, Homo sapiens
gtttatgaattgcattcccttt

SEQ ID NO: 8372083 - DNA, 22 bp, Homo sapiens
gtttattaactgtcaagtgatt

SEQ ID NO: 8372084 - DNA, 22 bp, Homo sapiens
gttgagagttaagcgggctaat

SEQ ID NO: 8372085 - DNA, 22 bp, Homo sapiens
gtttgaaagtggcaagtccttg

SEQ ID NO: 8372086 - DNA, 22 bp, Homo sapiens
gtttgaaagaccaattagattt

SEQ ID NO: 8372087 - DNA, 22 bp, Homo sapiens
gtttcttttaaaatatgtagac

SEQ ID NO: 8372088 - DNA, 22 bp, Homo sapiens
gtttctttctattgactgaaca

SEQ ID NO: 8372089 - DNA, 22 bp, Homo sapiens
gtttcttttaaaatatgtagac

SEQ ID NO: 8372090 - DNA, 22 bp, Homo sapiens
taaatgatttatgtatgtgaaa

SEQ ID NO: 8372091 - DNA, 22 bp, Homo sapiens
taaatgatttatgtatgtgaaa

SEQ ID NO: 8372092 - DNA, 20 bp, Homo sapiens
taaagcagccgtggagggta

SEQ ID NO: 8372093 - DNA, 23 bp, Homo sapiens
taaagcaaagtcaagtgcactcc

SEQ ID NO: 8372094 - DNA, 22 bp, Homo sapiens
taaagatgttctcatttcatag

SEQ ID NO: 8372095 - DNA, 19 bp, Homo sapiens
taaagagaataccggtggc

SEQ ID NO: 8372096 - DNA, 22 bp, Homo sapiens
taaagcacagtatgagcattgg

SEQ ID NO: 8372097 - DNA, 22 bp, Homo sapiens
taaagcaatttgagcaagttct

SEQ ID NO: 8372098 - DNA, 22 bp, Homo sapiens
taaagcaatgaaagttttgcag

SEQ ID NO: 8372099 - DNA, 22 bp, Homo sapiens
taaagcaaggcaaattgttggt

SEQ ID NO: 8372100 - DNA, 22 bp, Homo sapiens
taaagcaaggcaaattgttggt

SEQ ID NO: 8372101 - DNA, 22 bp, Homo sapiens
taaaagagaatggataacagag

SEQ ID NO: 8372102 - DNA, 22 bp, Homo sapiens
taaaacttctcatttttatggt

SEQ ID NO: 8372103 - DNA, 22 bp, Homo sapiens
taaaacttctcatttttatggt

SEQ ID NO: 8372104 - DNA, 22 bp, Homo sapiens
taaaacttaactatccagatta

SEQ ID NO: 8372105 - DNA, 22 bp, Homo sapiens
taaaagctgagatatcctgtac

SEQ ID NO: 8372106 - DNA, 22 bp, Homo sapiens
taaatgttatgcccatcatcca

SEQ ID NO: 8372107 - DNA, 22 bp, Homo sapiens
taaatgttatgcccatcatcca

SEQ ID NO: 8372108 - DNA, 22 bp, Homo sapiens
taaatgttgtaagtacatctaa

SEQ ID NO: 8372109 - DNA, 22 bp, Homo sapiens
taaatgttgtaagtacatctaa

SEQ ID NO: 8372110 - DNA, 22 bp, Homo sapiens
taaatgttgtaagtacatctaa

SEQ ID NO: 8372111 - DNA, 22 bp, Homo sapiens
taaatgtttagtcttatttggg

SEQ ID NO: 8372112 - DNA, 22 bp, Homo sapiens
taaatgtttagtcttatttggg

SEQ ID NO: 8372113 - DNA, 22 bp, Homo sapiens
taacagccctccctccatcctg

SEQ ID NO: 8372114 - DNA, 22 bp, Homo sapiens
taacatgagagctaagacatta

SEQ ID NO: 8372115 - DNA, 22 bp, Homo sapiens
taacatgatttgctatttagat

SEQ ID NO: 8372116 - DNA, 22 bp, Homo sapiens
taacatcctacactgttgtctt

SEQ ID NO: 8372117 - DNA, 22 bp, Homo sapiens
taacatccacattagatgattc

SEQ ID NO: 8372118 - DNA, 22 bp, Homo sapiens
taacatcaaactgcattttcta

SEQ ID NO: 8372119 - DNA, 22 bp, Homo sapiens
taacatcaaacatgttttaaag

SEQ ID NO: 8372120 - DNA, 22 bp, Homo sapiens
taacagtgtgtccagtcagttt

SEQ ID NO: 8372121 - DNA, 22 bp, Homo sapiens
taacagtgacctgaatgtcaat

SEQ ID NO: 8372122 - DNA, 22 bp, Homo sapiens
taagagctccaatatttgtggc

SEQ ID NO: 8372123 - DNA, 22 bp, Homo sapiens
taagagctcccttctccttgca

SEQ ID NO: 8372124 - DNA, 22 bp, Homo sapiens
taagagcagaggttgaataaat

SEQ ID NO: 8372125 - DNA, 22 bp, Homo sapiens
taagagcattgtaaaataatct

SEQ ID NO: 8372126 - DNA, 22 bp, Homo sapiens
taagagctaggattttaaatca

SEQ ID NO: 8372127 - DNA, 22 bp, Homo sapiens
taagagaaggatctgttccagg

SEQ ID NO: 8372128 - DNA, 22 bp, Homo sapiens
taagagaaggatctgttccagg

SEQ ID NO: 8372129 - DNA, 22 bp, Homo sapiens
taagagaaggatctgttccagg

SEQ ID NO: 8372130 - DNA, 22 bp, Homo sapiens
taagagaaggatctgttccagg

SEQ ID NO: 8372131 - DNA, 22 bp, Homo sapiens
taagagaatgtcaggagtggat

SEQ ID NO: 8372132 - DNA, 22 bp, Homo sapiens
taagacatttgacaaaccattt

SEQ ID NO: 8372133 - DNA, 22 bp, Homo sapiens
taagacatggttgatctagtgt

SEQ ID NO: 8372134 - DNA, 22 bp, Homo sapiens
taagacatagccaagagcatcc

SEQ ID NO: 8372135 - DNA, 22 bp, Homo sapiens
taagacataaataggcttttta

SEQ ID NO: 8372136 - DNA, 22 bp, Homo sapiens
taagacatccgttgcttataat

SEQ ID NO: 8372137 - DNA, 22 bp, Homo sapiens
taacatgtttgtacactgaaac

SEQ ID NO: 8372138 - DNA, 22 bp, Homo sapiens
taacatgttcagactacctgtg

SEQ ID NO: 8372139 - DNA, 22 bp, Homo sapiens
taagacaaatactatttcaaga

SEQ ID NO: 8372140 - DNA, 18 bp, Homo sapiens
taacatgttttcattaag

SEQ ID NO: 8372141 - DNA, 22 bp, Homo sapiens
taagacaaatactatttcaaga

SEQ ID NO: 8372142 - DNA, 19 bp, Homo sapiens
taagacagattcctagagt

SEQ ID NO: 8372143 - DNA, 22 bp, Homo sapiens
taagacaattcttcagtcacaa

SEQ ID NO: 8372144 - DNA, 22 bp, Homo sapiens
taagcattatggtaaagaagta

SEQ ID NO: 8372145 - DNA, 22 bp, Homo sapiens
taagcctgcatgaaccatgaga

SEQ ID NO: 8372146 - DNA, 22 bp, Homo sapiens
taagccatacatttcagactct

SEQ ID NO: 8372147 - DNA, 21 bp, Homo sapiens
taagctaaacattcagttaac

SEQ ID NO: 8372148 - DNA, 22 bp, Homo sapiens
taagctaacgtccatggaaatg

SEQ ID NO: 8372149 - DNA, 22 bp, Homo sapiens
taaggaaaatggacatcaaaca

SEQ ID NO: 8372150 - DNA, 22 bp, Homo sapiens
taaggaaagtacatgttttgac

SEQ ID NO: 8372151 - DNA, 22 bp, Homo sapiens
taaggaaagtacatgttttgac

SEQ ID NO: 8372152 - DNA, 22 bp, Homo sapiens
taaggaaagtgccatgatttct

SEQ ID NO: 8372153 - DNA, 22 bp, Homo sapiens
taaggaaacaacttgtattttt

SEQ ID NO: 8372154 - DNA, 22 bp, Homo sapiens
taaggaaacaacttgtattttt

SEQ ID NO: 8372155 - DNA, 22 bp, Homo sapiens
taaggaaaatggacatcaaaca

SEQ ID NO: 8372156 - DNA, 22 bp, Homo sapiens
taatagtttcataatgtgcttc

SEQ ID NO: 8372157 - DNA, 22 bp, Homo sapiens
taatagttgtgactttgtaaag

SEQ ID NO: 8372158 - DNA, 22 bp, Homo sapiens
taaggaatgcttgaatgttcct

SEQ ID NO: 8372159 - DNA, 22 bp, Homo sapiens
taaggaatagtgctatgaaaaa

SEQ ID NO: 8372160 - DNA, 22 bp, Homo sapiens
taaggaatatcataagaagtag

SEQ ID NO: 8372161 - DNA, 22 bp, Homo sapiens
taaggacattggttttgagtaa

SEQ ID NO: 8372162 - DNA, 22 bp, Homo sapiens
taaggaggcgaggtggtgagca

SEQ ID NO: 8372163 - DNA, 22 bp, Homo sapiens
taaggaggcagtcattatcagg

SEQ ID NO: 8372164 - DNA, 22 bp, Homo sapiens
taaggaggttggtgggttggat

SEQ ID NO: 8372165 - DNA, 22 bp, Homo sapiens
taaggaggtgcccactctcagg

SEQ ID NO: 8372166 - DNA, 22 bp, Homo sapiens
taaggagggggaatgattggca

SEQ ID NO: 8372167 - DNA, 22 bp, Homo sapiens
taaggaggctgctgtgaagaaa

SEQ ID NO: 8372168 - DNA, 22 bp, Homo sapiens
taattattctagtcacatagca

SEQ ID NO: 8372169 - DNA, 22 bp, Homo sapiens
taattattctagtcacatagca

SEQ ID NO: 8372170 - DNA, 22 bp, Homo sapiens
taattattatgacaacaattgc

SEQ ID NO: 8372171 - DNA, 22 bp, Homo sapiens
taatctctttatgagaagaagg

SEQ ID NO: 8372172 - DNA, 22 bp, Homo sapiens
taatcttagcaacctccagtgt

SEQ ID NO: 8372173 - DNA, 22 bp, Homo sapiens
taatatatttctgctaagctca

SEQ ID NO: 8372174 - DNA, 23 bp, Homo sapiens
taatatcctgcaatgcacagaac

SEQ ID NO: 8372175 - DNA, 22 bp, Homo sapiens
taatcctgatcaattttagctt

SEQ ID NO: 8372176 - DNA, 22 bp, Homo sapiens
taattatttgaagacattagag

SEQ ID NO: 8372177 - DNA, 22 bp, Homo sapiens
taattatttgaagacattagag

SEQ ID NO: 8372178 - DNA, 22 bp, Homo sapiens
taattattgtctgaagagttat

SEQ ID NO: 8372179 - DNA, 22 bp, Homo sapiens
taattattgtctgaagagttat

SEQ ID NO: 8372180 - DNA, 22 bp, Homo sapiens
taattatttgaagacattagag

SEQ ID NO: 8372181 - DNA, 22 bp, Homo sapiens
taattatttgaagacattagag

SEQ ID NO: 8372182 - DNA, 22 bp, Homo sapiens
taattatttgaagacattagag

SEQ ID NO: 8372183 - DNA, 23 bp, Homo sapiens
taattcacatatacattgcttca

SEQ ID NO: 8372184 - DNA, 22 bp, Homo sapiens
taattgaaatcatttcaattca

SEQ ID NO: 8372185 - DNA, 22 bp, Homo sapiens
taatttacttgcaaataacaat

SEQ ID NO: 8372186 - DNA, 22 bp, Homo sapiens
taatttatatggaattgttgct

SEQ ID NO: 8372187 - DNA, 22 bp, Homo sapiens
taatttatgatgcaaagaaaag

SEQ ID NO: 8372188 - DNA, 22 bp, Homo sapiens
tacacagtgagtcctctctgcc

SEQ ID NO: 8372189 - DNA, 22 bp, Homo sapiens
tacacatacattgcttacaagg

SEQ ID NO: 8372190 - DNA, 22 bp, Homo sapiens
tacacagaacctggtgtacagt

SEQ ID NO: 8372191 - DNA, 22 bp, Homo sapiens
tacacagaaattgtgtagggat

SEQ ID NO: 8372192 - DNA, 22 bp, Homo sapiens
tacacagtaaatggtaaataca

SEQ ID NO: 8372193 - DNA, 22 bp, Homo sapiens
tacacagtatatgggatcacag

SEQ ID NO: 8372194 - DNA, 22 bp, Homo sapiens
tacacagtagagtataatgcgt

SEQ ID NO: 8372195 - DNA, 22 bp, Homo sapiens
tacacaattagttgcaaagtga

SEQ ID NO: 8372196 - DNA, 22 bp, Homo sapiens
tacacacagaggccatgggatt

SEQ ID NO: 8372197 - DNA, 22 bp, Homo sapiens
tacagaatctatgcttcacagt

SEQ ID NO: 8372198 - DNA, 22 bp, Homo sapiens
tacacataggagggtaataaaa

SEQ ID NO: 8372199 - DNA, 22 bp, Homo sapiens
tacacataggtctgaataaaaa

SEQ ID NO: 8372200 - DNA, 22 bp, Homo sapiens
tacagaatgttatgaagcatag

SEQ ID NO: 8372201 - DNA, 22 bp, Homo sapiens
tacaagaggatgtggacatgga

SEQ ID NO: 8372202 - DNA, 22 bp, Homo sapiens
tacaagaggtatatagaaacag

SEQ ID NO: 8372203 - DNA, 22 bp, Homo sapiens
tacaagaatgtcttaaaagctc

SEQ ID NO: 8372204 - DNA, 22 bp, Homo sapiens
tacaagaaggaaaactagcaat

SEQ ID NO: 8372205 - DNA, 22 bp, Homo sapiens
tacaagaaggaaaactagcaat

SEQ ID NO: 8372206 - DNA, 22 bp, Homo sapiens
tacaagaatttctttctggttg

SEQ ID NO: 8372207 - DNA, 22 bp, Homo sapiens
tacaagagaactaatgtaagtc

SEQ ID NO: 8372208 - DNA, 22 bp, Homo sapiens
tacaagagcagtaagcttgtcc

SEQ ID NO: 8372209 - DNA, 22 bp, Homo sapiens
tacaacatttacgttaggctgt

SEQ ID NO: 8372210 - DNA, 22 bp, Homo sapiens
tacaaccatagacatatactag

SEQ ID NO: 8372211 - DNA, 22 bp, Homo sapiens
tacaaccagatcctctaagtca

SEQ ID NO: 8372212 - DNA, 22 bp, Homo sapiens
tacaacttacttgaatggcttt

SEQ ID NO: 8372213 - DNA, 22 bp, Homo sapiens
tacaagaaactacatgaatgca

SEQ ID NO: 8372214 - DNA, 22 bp, Homo sapiens
tacaagaaatttctgcatatat

SEQ ID NO: 8372215 - DNA, 22 bp, Homo sapiens
tacaagaaatttctgcatatat

SEQ ID NO: 8372216 - DNA, 21 bp, Homo sapiens
taatttattcagcacagtgtt

SEQ ID NO: 8372217 - DNA, 21 bp, Homo sapiens
taatttattcagcacagtgtt

SEQ ID NO: 8372218 - DNA, 22 bp, Homo sapiens
taatttatgatgcaaagaaaag

SEQ ID NO: 8372219 - DNA, 22 bp, Homo sapiens
taatttatggtatgtgtgtaat

SEQ ID NO: 8372220 - DNA, 22 bp, Homo sapiens
taatttcaaatttcttagcgtg

SEQ ID NO: 8372221 - DNA, 22 bp, Homo sapiens
tacagtgcttggtatctagtaa

SEQ ID NO: 8372222 - DNA, 22 bp, Homo sapiens
tacagtctctgataactgtcag

SEQ ID NO: 8372223 - DNA, 22 bp, Homo sapiens
tacagagatttattgctaaggc

SEQ ID NO: 8372224 - DNA, 22 bp, Homo sapiens
tacagagatttattgctaaggc

SEQ ID NO: 8372225 - DNA, 22 bp, Homo sapiens
tacagagatactctagatcaaa

SEQ ID NO: 8372226 - DNA, 22 bp, Homo sapiens
tacagagatgccgaagagtgaa

SEQ ID NO: 8372227 - DNA, 22 bp, Homo sapiens
tacagagagtacagcatccaca

SEQ ID NO: 8372228 - DNA, 22 bp, Homo sapiens
tacagtaggattttcagggtct

SEQ ID NO: 8372229 - DNA, 22 bp, Homo sapiens
tacatgtatgtgttaatatctg

SEQ ID NO: 8372230 - DNA, 22 bp, Homo sapiens
taccaaagattaaatagcaaca

SEQ ID NO: 8372231 - DNA, 20 bp, Homo sapiens
taccaacagcaggaagcata

SEQ ID NO: 8372232 - DNA, 22 bp, Homo sapiens
tacatgcttctatatgtgaagt

SEQ ID NO: 8372233 - DNA, 22 bp, Homo sapiens
tacatgcatgtgtgtaaatata

SEQ ID NO: 8372234 - DNA, 22 bp, Homo sapiens
tacatgaatgtttcaatattgt

SEQ ID NO: 8372235 - DNA, 22 bp, Homo sapiens
tacatgcatgatacaaagttgc

SEQ ID NO: 8372236 - DNA, 18 bp, Homo sapiens
tacatgcataaatgaagc

SEQ ID NO: 8372237 - DNA, 22 bp, Homo sapiens
taccatttcagtaaaaacttag

SEQ ID NO: 8372238 - DNA, 22 bp, Homo sapiens
taccatttacttgaaaataaaa

SEQ ID NO: 8372239 - DNA, 19 bp, Homo sapiens
taccatccaagctggtttg

SEQ ID NO: 8372240 - DNA, 22 bp, Homo sapiens
taccataacgtaatgaacttga

SEQ ID NO: 8372241 - DNA, 22 bp, Homo sapiens
taccaattctattttggattga

SEQ ID NO: 8372242 - DNA, 21 bp, Homo sapiens
taccaattgccttctagttgt

SEQ ID NO: 8372243 - DNA, 20 bp, Homo sapiens
taccacttatttgaataatt

SEQ ID NO: 8372244 - DNA, 22 bp, Homo sapiens
taccactgctccctgcctgtga

SEQ ID NO: 8372245 - DNA, 22 bp, Homo sapiens
taccatttctacatatcttgtc

SEQ ID NO: 8372246 - DNA, 22 bp, Homo sapiens
taccatttgagagagaacataa

SEQ ID NO: 8372247 - DNA, 22 bp, Homo sapiens
tactacatacagaatttagaga

SEQ ID NO: 8372248 - DNA, 22 bp, Homo sapiens
tactacaagggccctaaaaggt

SEQ ID NO: 8372249 - DNA, 22 bp, Homo sapiens
tactagaacctcacaacaatcc

SEQ ID NO: 8372250 - DNA, 17 bp, Homo sapiens
tactatgagaaagtagg

SEQ ID NO: 8372251 - DNA, 23 bp, Homo sapiens
tactatggttattatccctctcc

SEQ ID NO: 8372252 - DNA, 22 bp, Homo sapiens
tacttacagaaggaagcaattg

SEQ ID NO: 8372253 - DNA, 22 bp, Homo sapiens
tacttacactgaagcaaagata

SEQ ID NO: 8372254 - DNA, 22 bp, Homo sapiens
tacttacacagctgtagaaggt

SEQ ID NO: 8372255 - DNA, 22 bp, Homo sapiens
tacttacataaaaactgaatgt

SEQ ID NO: 8372256 - DNA, 22 bp, Homo sapiens
tacttaaaactgatagaatctc

SEQ ID NO: 8372257 - DNA, 22 bp, Homo sapiens
tacttaaaactgatagaatctc

SEQ ID NO: 8372258 - DNA, 22 bp, Homo sapiens
tacttaaataattgctgctatt

SEQ ID NO: 8372259 - DNA, 22 bp, Homo sapiens
tacttaaaaattatcaaagtgg

SEQ ID NO: 8372260 - DNA, 22 bp, Homo sapiens
tacttaaaactgatagaatctc

SEQ ID NO: 8372261 - DNA, 22 bp, Homo sapiens
tacttaaaaattatcaaagtgg

SEQ ID NO: 8372262 - DNA, 22 bp, Homo sapiens
tacttaaaaattatcaaagtgg

SEQ ID NO: 8372263 - DNA, 22 bp, Homo sapiens
tactgttatatatagcagcagt

SEQ ID NO: 8372264 - DNA, 22 bp, Homo sapiens
tactctaaaattagctcttggc

SEQ ID NO: 8372265 - DNA, 22 bp, Homo sapiens
tactgaaactcttgtaaatatc

SEQ ID NO: 8372266 - DNA, 22 bp, Homo sapiens
tactgttaatgttaaattcagg

SEQ ID NO: 8372267 - DNA, 22 bp, Homo sapiens
tcaaagaacatcatctgaaatg

SEQ ID NO: 8372268 - DNA, 22 bp, Homo sapiens
tcaaacttggtaagagaaatac

SEQ ID NO: 8372269 - DNA, 18 bp, Homo sapiens
tcaaactgtcattggtga

SEQ ID NO: 8372270 - DNA, 22 bp, Homo sapiens
tcaaactggcagacttctactt

SEQ ID NO: 8372271 - DNA, 22 bp, Homo sapiens
tcaaactgaattaaacacttgt

SEQ ID NO: 8372272 - DNA, 22 bp, Homo sapiens
tcaaaaatggtctttgagctgc

SEQ ID NO: 8372273 - DNA, 20 bp, Homo sapiens
tcaaagacaagctctcatcc

SEQ ID NO: 8372274 - DNA, 22 bp, Homo sapiens
tcaaagaatgttatgagggtag

SEQ ID NO: 8372275 - DNA, 22 bp, Homo sapiens
tcaaagatgatgctgaagttat

SEQ ID NO: 8372276 - DNA, 22 bp, Homo sapiens
tcaaagacatggggaagctgag

SEQ ID NO: 8372277 - DNA, 22 bp, Homo sapiens
tcaaagactatatattttattt

SEQ ID NO: 8372278 - DNA, 21 bp, Homo sapiens
tcaaagactggggctgtgtgc

SEQ ID NO: 8372279 - DNA, 22 bp, Homo sapiens
tcaaagactatatattttattt

SEQ ID NO: 8372280 - DNA, 22 bp, Homo sapiens
tcaaagatagatgttgagaaat

SEQ ID NO: 8372281 - DNA, 22 bp, Homo sapiens
tcaaagagctctatcttcaaaa

SEQ ID NO: 8372282 - DNA, 22 bp, Homo sapiens
tcaaagagctattcagttgtgg

SEQ ID NO: 8372283 - DNA, 22 bp, Homo sapiens
tattttgacgattttatgcaaa

SEQ ID NO: 8372284 - DNA, 22 bp, Homo sapiens
tattttgacgattttatgcaaa

SEQ ID NO: 8372285 - DNA, 22 bp, Homo sapiens
tattttgactattaaaccaaca

SEQ ID NO: 8372286 - DNA, 22 bp, Homo sapiens
tattttgactattaaaccaaca

SEQ ID NO: 8372287 - DNA, 22 bp, Homo sapiens
tattttgagcccctgacatcta

SEQ ID NO: 8372288 - DNA, 22 bp, Homo sapiens
tattttgaggtatttttgagct

SEQ ID NO: 8372289 - DNA, 22 bp, Homo sapiens
tattttgtaattggtcatagct

SEQ ID NO: 8372290 - DNA, 22 bp, Homo sapiens
tatttttgcctctcagataaaa

SEQ ID NO: 8372291 - DNA, 22 bp, Homo sapiens
tcaaaaataagatattctggac

SEQ ID NO: 8372292 - DNA, 22 bp, Homo sapiens
tcaaaaataagatattctggac

SEQ ID NO: 8372293 - DNA, 22 bp, Homo sapiens
tcaaaggcttgtggttctggga

SEQ ID NO: 8372294 - DNA, 22 bp, Homo sapiens
tcaaaggttaactctgttgttc

SEQ ID NO: 8372295 - DNA, 22 bp, Homo sapiens
tcaaataatgccattcatcatc

SEQ ID NO: 8372296 - DNA, 22 bp, Homo sapiens
tcaaatatgtgatagaagctaa

SEQ ID NO: 8372297 - DNA, 22 bp, Homo sapiens
tcaaatctttgaccacttatgt

SEQ ID NO: 8372298 - DNA, 21 bp, Homo sapiens
tcaaatcaggtatcactattg

SEQ ID NO: 8372299 - DNA, 22 bp, Homo sapiens
tatttgaaggcatacattttga

SEQ ID NO: 8372300 - DNA, 22 bp, Homo sapiens
tatttgatagagataaatgata

SEQ ID NO: 8372301 - DNA, 23 bp, Homo sapiens
tatttgctactggtaattctgga

SEQ ID NO: 8372302 - DNA, 22 bp, Homo sapiens
tatttgcaggcttttgtcatgg

SEQ ID NO: 8372303 - DNA, 22 bp, Homo sapiens
tatttgctcaaccctgcctcca

SEQ ID NO: 8372304 - DNA, 23 bp, Homo sapiens
tatttgctactggtaattctgga

SEQ ID NO: 8372305 - DNA, 22 bp, Homo sapiens
tatttgctccttaggcatattt

SEQ ID NO: 8372306 - DNA, 22 bp, Homo sapiens
tatttgctcaataatagtttta

SEQ ID NO: 8372307 - DNA, 22 bp, Homo sapiens
tatttgatgaaggtaaagtctt

SEQ ID NO: 8372308 - DNA, 22 bp, Homo sapiens
tatttgatagagataaatgata

SEQ ID NO: 8372309 - DNA, 22 bp, Homo sapiens
tatttgcaacataaaactctga

SEQ ID NO: 8372310 - DNA, 22 bp, Homo sapiens
tatttgcaacataaaactctga

SEQ ID NO: 8372311 - DNA, 22 bp, Homo sapiens
tattttgacgattttatgcaaa

SEQ ID NO: 8372312 - DNA, 22 bp, Homo sapiens
tattttgacgattttatgcaaa

SEQ ID NO: 8372313 - DNA, 22 bp, Homo sapiens
tattttgaaagtctgttttgaa

SEQ ID NO: 8372314 - DNA, 22 bp, Homo sapiens
tatttggagataagatttttag

SEQ ID NO: 8372315 - DNA, 22 bp, Homo sapiens
tattttcattctgtgtgactgt

SEQ ID NO: 8372316 - DNA, 22 bp, Homo sapiens
tattttcattctgtgtgactgt

SEQ ID NO: 8372317 - DNA, 22 bp, Homo sapiens
tatttggagcctatccatagat

SEQ ID NO: 8372318 - DNA, 23 bp, Homo sapiens
tattttccaaatgatgactacat

SEQ ID NO: 8372319 - DNA, 22 bp, Homo sapiens
tattttctggacagtcttgctt

SEQ ID NO: 8372320 - DNA, 23 bp, Homo sapiens
tattttccaaatgatgactacat

SEQ ID NO: 8372321 - DNA, 21 bp, Homo sapiens
tatttgctgccatctttgagg

SEQ ID NO: 8372322 - DNA, 22 bp, Homo sapiens
tatttgctgtgcttattccatt

SEQ ID NO: 8372323 - DNA, 22 bp, Homo sapiens
tatttgctgaatctgattcaga

SEQ ID NO: 8372324 - DNA, 22 bp, Homo sapiens
tatttgctctcggcccggcccc

SEQ ID NO: 8372325 - DNA, 22 bp, Homo sapiens
tatttgctgacagtgctggagc

SEQ ID NO: 8372326 - DNA, 22 bp, Homo sapiens
tatttgcttttgtgccacagat

SEQ ID NO: 8372327 - DNA, 22 bp, Homo sapiens
tatttggaaacaattcacatgc

SEQ ID NO: 8372328 - DNA, 22 bp, Homo sapiens
tatttgctttgctttatagaga

SEQ ID NO: 8372329 - DNA, 22 bp, Homo sapiens
tatttgctttgctttatagaga

SEQ ID NO: 8372330 - DNA, 22 bp, Homo sapiens
tatttgctttggtcctccaagc

SEQ ID NO: 8372331 - DNA, 22 bp, Homo sapiens
tatttgcttgaagcctggttct

SEQ ID NO: 8372332 - DNA, 22 bp, Homo sapiens
tatttgcttggaaacctaatcc

SEQ ID NO: 8372333 - DNA, 22 bp, Homo sapiens
tatttggaaagtttatctatct

SEQ ID NO: 8372334 - DNA, 22 bp, Homo sapiens
tatttggaaaggacatgtaagt

SEQ ID NO: 8372335 - DNA, 23 bp, Homo sapiens
tatttggaaagagggaagaagac

SEQ ID NO: 8372336 - DNA, 22 bp, Homo sapiens
tatttggaaatgataaagtact

SEQ ID NO: 8372337 - DNA, 22 bp, Homo sapiens
tatttggaaggtataaacacaa

SEQ ID NO: 8372338 - DNA, 22 bp, Homo sapiens
tattgttcttcactggtcttat

SEQ ID NO: 8372339 - DNA, 22 bp, Homo sapiens
tattgtgctcaccattacatcc

SEQ ID NO: 8372340 - DNA, 22 bp, Homo sapiens
tattgtgaatttggaagcaatg

SEQ ID NO: 8372341 - DNA, 22 bp, Homo sapiens
tattgtcttcaactctactttt

SEQ ID NO: 8372342 - DNA, 22 bp, Homo sapiens
tatttaaaatagtgctccagca

SEQ ID NO: 8372343 - DNA, 22 bp, Homo sapiens
tatttaaaaagaggccagctgg

SEQ ID NO: 8372344 - DNA, 22 bp, Homo sapiens
tatttaaaaagaggccagctgg

SEQ ID NO: 8372345 - DNA, 22 bp, Homo sapiens
tatttaataaaactatggcatg

SEQ ID NO: 8372346 - DNA, 22 bp, Homo sapiens
tattaattcttgccaattctcc

SEQ ID NO: 8372347 - DNA, 23 bp, Homo sapiens
tattacaattggtcttattaaga

SEQ ID NO: 8372348 - DNA, 22 bp, Homo sapiens
tattgtatcttaccacatgtat

SEQ ID NO: 8372349 - DNA, 22 bp, Homo sapiens
tattgtatcttctgtttagaag

SEQ ID NO: 8372350 - DNA, 22 bp, Homo sapiens
tattgtccaataggatgttcct

SEQ ID NO: 8372351 - DNA, 22 bp, Homo sapiens
tattgtctgtttgaatgactat

SEQ ID NO: 8372352 - DNA, 22 bp, Homo sapiens
tatggaatggctattttctagg

SEQ ID NO: 8372353 - DNA, 22 bp, Homo sapiens
tatggaaagtgttttcttctgt

SEQ ID NO: 8372354 - DNA, 22 bp, Homo sapiens
tatggaaaaatgtatcttgtca

SEQ ID NO: 8372355 - DNA, 22 bp, Homo sapiens
tatggaaactaattcatttttc

SEQ ID NO: 8372356 - DNA, 22 bp, Homo sapiens
tatgctttaaccctcttatatt

SEQ ID NO: 8372357 - DNA, 22 bp, Homo sapiens
tatgctttgatttcctcagctg

SEQ ID NO: 8372358 - DNA, 22 bp, Homo sapiens
tatgcttttaacctgtaactga

SEQ ID NO: 8372359 - DNA, 17 bp, Homo sapiens
tatgcttttcttctcca

SEQ ID NO: 8372360 - DNA, 22 bp, Homo sapiens
tatgtacatacatgtgcatacg

SEQ ID NO: 8372361 - DNA, 22 bp, Homo sapiens
tatgtacatacatgtgcatacg

SEQ ID NO: 8372362 - DNA, 22 bp, Homo sapiens
tatgtacatatacacgtgtgtg

SEQ ID NO: 8372363 - DNA, 22 bp, Homo sapiens
tatgtacatacatgtgcatacg

SEQ ID NO: 8372364 - DNA, 22 bp, Homo sapiens
tatgtactctaatttgtctcat

SEQ ID NO: 8372365 - DNA, 22 bp, Homo sapiens
tatgtactcatcaactattgaa

SEQ ID NO: 8372366 - DNA, 22 bp, Homo sapiens
tatggcttttaaggagatctga

SEQ ID NO: 8372367 - DNA, 22 bp, Homo sapiens
tatggctttcaaaggaactcgg

SEQ ID NO: 8372368 - DNA, 22 bp, Homo sapiens
tatggctttaaacaacttaggt

SEQ ID NO: 8372369 - DNA, 22 bp, Homo sapiens
tatggctttaaattgaaggagt

SEQ ID NO: 8372370 - DNA, 22 bp, Homo sapiens
tatgggtgttaatggtgagaga

SEQ ID NO: 8372371 - DNA, 22 bp, Homo sapiens
tatgtatagagtcttttaaatt

SEQ ID NO: 8372372 - DNA, 22 bp, Homo sapiens
tatgtatagagtcttttaaatt

SEQ ID NO: 8372373 - DNA, 22 bp, Homo sapiens
tatgtatagagtcttttaaatt

SEQ ID NO: 8372374 - DNA, 22 bp, Homo sapiens
tatgtagcaatagcatcatact

SEQ ID NO: 8372375 - DNA, 22 bp, Homo sapiens
tatgtaggtaaacacagacata

SEQ ID NO: 8372376 - DNA, 22 bp, Homo sapiens
tatgtattctcagatttactaa

SEQ ID NO: 8372377 - DNA, 22 bp, Homo sapiens
tatgtatatgtgtgttgacaac

SEQ ID NO: 8372378 - DNA, 22 bp, Homo sapiens
tatgtatccgtgtgtgtacaga

SEQ ID NO: 8372379 - DNA, 22 bp, Homo sapiens
tattaacattttatgaaaataa

SEQ ID NO: 8372380 - DNA, 22 bp, Homo sapiens
tattaatatgtgtgtgcatgta

SEQ ID NO: 8372381 - DNA, 22 bp, Homo sapiens
tattaatatgtgtgtgcatgta

SEQ ID NO: 8372382 - DNA, 22 bp, Homo sapiens
tattaaattatggatttaggag

SEQ ID NO: 8372383 - DNA, 22 bp, Homo sapiens
tattaaattatggatttaggag

SEQ ID NO: 8372384 - DNA, 22 bp, Homo sapiens
tattaaattatggatttaggag

SEQ ID NO: 8372385 - DNA, 22 bp, Homo sapiens
tattaaattatggatttaggag

SEQ ID NO: 8372386 - DNA, 23 bp, Homo sapiens
tatgtcatgagcatattgaatgt

SEQ ID NO: 8372387 - DNA, 22 bp, Homo sapiens
tatgtcatgggtcaaaatgaag

SEQ ID NO: 8372388 - DNA, 19 bp, Homo sapiens
tatgtccctttcccccatt

SEQ ID NO: 8372389 - DNA, 22 bp, Homo sapiens
tatcagaaatcaacacacagtg

SEQ ID NO: 8372390 - DNA, 22 bp, Homo sapiens
tatcagaaactctggggcaggg

SEQ ID NO: 8372391 - DNA, 22 bp, Homo sapiens
tatcacatacttctcatccagg

SEQ ID NO: 8372392 - DNA, 21 bp, Homo sapiens
tatcacagtagaataggatct

SEQ ID NO: 8372393 - DNA, 21 bp, Homo sapiens
tatcacagtagaataggatct

SEQ ID NO: 8372394 - DNA, 22 bp, Homo sapiens
tatcacaggtgtgatttacatt

SEQ ID NO: 8372395 - DNA, 22 bp, Homo sapiens
tatcagaagacttacagtatcg

SEQ ID NO: 8372396 - DNA, 22 bp, Homo sapiens
tatcagaagacttacagtatcg

SEQ ID NO: 8372397 - DNA, 22 bp, Homo sapiens
tatcagaatgcagccatgtgca

SEQ ID NO: 8372398 - DNA, 22 bp, Homo sapiens
tatcagaaggcacatggagtct

SEQ ID NO: 8372399 - DNA, 22 bp, Homo sapiens
tatcagatatagcattcactgg

SEQ ID NO: 8372400 - DNA, 22 bp, Homo sapiens
tatcaggaagaacacgtgaaat

SEQ ID NO: 8372401 - DNA, 22 bp, Homo sapiens
tatcatttaacagaatcattgc

SEQ ID NO: 8372402 - DNA, 22 bp, Homo sapiens
tatcagcaactcagagcagtct

SEQ ID NO: 8372403 - DNA, 22 bp, Homo sapiens
tatcagatggtgatacatatca

SEQ ID NO: 8372404 - DNA, 22 bp, Homo sapiens
tatcagatgacatcttctatgg

SEQ ID NO: 8372405 - DNA, 22 bp, Homo sapiens
tatcagatgacatcttctatgg

SEQ ID NO: 8372406 - DNA, 22 bp, Homo sapiens
tataaaattctcagtttggggt

SEQ ID NO: 8372407 - DNA, 22 bp, Homo sapiens
tataaaatggcatcagctccaa

SEQ ID NO: 8372408 - DNA, 22 bp, Homo sapiens
tataaagaaatgatttccagaa

SEQ ID NO: 8372409 - DNA, 22 bp, Homo sapiens
tataaagaaggcacagcaagac

SEQ ID NO: 8372410 - DNA, 22 bp, Homo sapiens
tataaagagtctcaaagaagtt

SEQ ID NO: 8372411 - DNA, 22 bp, Homo sapiens
tataaagaaggcacagcaagac

SEQ ID NO: 8372412 - DNA, 22 bp, Homo sapiens
tataaagttggggctgaagtaa

SEQ ID NO: 8372413 - DNA, 22 bp, Homo sapiens
tatcacaggtgtgatttacatt

SEQ ID NO: 8372414 - DNA, 22 bp, Homo sapiens
tataaagtgtgaactgtgagta

SEQ ID NO: 8372415 - DNA, 22 bp, Homo sapiens
tataaagagtctcaaagaagtt

SEQ ID NO: 8372416 - DNA, 22 bp, Homo sapiens
tataaagctgactcatgaaact

SEQ ID NO: 8372417 - DNA, 22 bp, Homo sapiens
tatgaaattgccatttttatgg

SEQ ID NO: 8372418 - DNA, 22 bp, Homo sapiens
tatgaaatttaaacacagatca

SEQ ID NO: 8372419 - DNA, 22 bp, Homo sapiens
tatgaaatttaaacacagatca

SEQ ID NO: 8372420 - DNA, 22 bp, Homo sapiens
tatgaaatttaaacacagatca

SEQ ID NO: 8372421 - DNA, 22 bp, Homo sapiens
tatgaaatttctagttctgctt

SEQ ID NO: 8372422 - DNA, 22 bp, Homo sapiens
tatgaaatgatggggaaaatag

SEQ ID NO: 8372423 - DNA, 22 bp, Homo sapiens
tatgaaatgatggggaaaatag

SEQ ID NO: 8372424 - DNA, 22 bp, Homo sapiens
tatgaaatggtagtaggaaggg

SEQ ID NO: 8372425 - DNA, 22 bp, Homo sapiens
tatgaaatggtagtaggaaggg

SEQ ID NO: 8372426 - DNA, 22 bp, Homo sapiens
tatgaaattgccatttttatgg

SEQ ID NO: 8372427 - DNA, 22 bp, Homo sapiens
tatgaattctcttgtgtatagt

SEQ ID NO: 8372428 - DNA, 22 bp, Homo sapiens
tatgaattctgttcattgatga

SEQ ID NO: 8372429 - DNA, 22 bp, Homo sapiens
tatcttttgagttctcaagatg

SEQ ID NO: 8372430 - DNA, 22 bp, Homo sapiens
tatgaaaatttagctgaagcat

SEQ ID NO: 8372431 - DNA, 22 bp, Homo sapiens
tatgaaaaggtggccaatgtag

SEQ ID NO: 8372432 - DNA, 22 bp, Homo sapiens
tatgaaacattcatacaaataa

SEQ ID NO: 8372433 - DNA, 22 bp, Homo sapiens
tatgaaaatttagctgaagcat

SEQ ID NO: 8372434 - DNA, 22 bp, Homo sapiens
tatgaaaatttagctgaagcat

SEQ ID NO: 8372435 - DNA, 22 bp, Homo sapiens
tatcatttagagtatttcttca

SEQ ID NO: 8372436 - DNA, 22 bp, Homo sapiens
tatcaggaattgaatggcttca

SEQ ID NO: 8372437 - DNA, 22 bp, Homo sapiens
tatcattttactgtgacatttt

SEQ ID NO: 8372438 - DNA, 22 bp, Homo sapiens
tatcattttactgtgacatttt

SEQ ID NO: 8372439 - DNA, 22 bp, Homo sapiens
tagggggctgtcctgtgcatta

SEQ ID NO: 8372440 - DNA, 22 bp, Homo sapiens
tagggggctttgctgcttgaca

SEQ ID NO: 8372441 - DNA, 21 bp, Homo sapiens
tagggggcagtgggatgctta

SEQ ID NO: 8372442 - DNA, 22 bp, Homo sapiens
tagtgcatacctaacatttttg

SEQ ID NO: 8372443 - DNA, 22 bp, Homo sapiens
tagtgcttaacacaaagtgatt

SEQ ID NO: 8372444 - DNA, 22 bp, Homo sapiens
tagtgcttattactgtgctgtc

SEQ ID NO: 8372445 - DNA, 22 bp, Homo sapiens
tagttacagagaaatgatttga

SEQ ID NO: 8372446 - DNA, 22 bp, Homo sapiens
tagttacagcaggcaggatata

SEQ ID NO: 8372447 - DNA, 22 bp, Homo sapiens
tagttatggagtaattttaagc

SEQ ID NO: 8372448 - DNA, 22 bp, Homo sapiens
tagttcaaagtctgtcaaagga

SEQ ID NO: 8372449 - DNA, 22 bp, Homo sapiens
tagttcaaagtctgtcaaagga

SEQ ID NO: 8372450 - DNA, 22 bp, Homo sapiens
tagttcaggaagagaaacaaca

SEQ ID NO: 8372451 - DNA, 22 bp, Homo sapiens
tagtttagaatgttgcaataca

SEQ ID NO: 8372452 - DNA, 22 bp, Homo sapiens
tagttcttcatgaattcagctt

SEQ ID NO: 8372453 - DNA, 22 bp, Homo sapiens
tagttctgtgtagctcaagagt

SEQ ID NO: 8372454 - DNA, 22 bp, Homo sapiens
tagttttatgaattggtataat

SEQ ID NO: 8372455 - DNA, 18 bp, Homo sapiens
tagtttctaatggccttt

SEQ ID NO: 8372456 - DNA, 22 bp, Homo sapiens
tagtttctaaactgaactgtca

SEQ ID NO: 8372457 - DNA, 22 bp, Homo sapiens
tagtttctaaagcttcctaggt

SEQ ID NO: 8372458 - DNA, 22 bp, Homo sapiens
tagttttataatgttaacatct

SEQ ID NO: 8372459 - DNA, 22 bp, Homo sapiens
tagttttatgaattggtataat

SEQ ID NO: 8372460 - DNA, 22 bp, Homo sapiens
tagttttataatgttaacatct

SEQ ID NO: 8372461 - DNA, 22 bp, Homo sapiens
tagtttatgctgctgcagtgag

SEQ ID NO: 8372462 - DNA, 22 bp, Homo sapiens
tagtttatgctgctgcagtgag

SEQ ID NO: 8372463 - DNA, 22 bp, Homo sapiens
tagtttcatctccaccctgccc

SEQ ID NO: 8372464 - DNA, 22 bp, Homo sapiens
tagtttatgattttttggaagg

SEQ ID NO: 8372465 - DNA, 22 bp, Homo sapiens
tagggcagctgcatcaggcact

SEQ ID NO: 8372466 - DNA, 23 bp, Homo sapiens
tagggcagctgggagggacatgc

SEQ ID NO: 8372467 - DNA, 22 bp, Homo sapiens
tagggcagattcggtggagttt

SEQ ID NO: 8372468 - DNA, 22 bp, Homo sapiens
tagggcagccacccaggctgct

SEQ ID NO: 8372469 - DNA, 22 bp, Homo sapiens
tagggcagagtccaggatgggc

SEQ ID NO: 8372470 - DNA, 22 bp, Homo sapiens
tagggctgaggcaacaagggag

SEQ ID NO: 8372471 - DNA, 22 bp, Homo sapiens
tagggctgtttaaaagtgaggt

SEQ ID NO: 8372472 - DNA, 22 bp, Homo sapiens
tagggcttagaaaagaatttac

SEQ ID NO: 8372473 - DNA, 22 bp, Homo sapiens
tagggctgtgtctccaggacca

SEQ ID NO: 8372474 - DNA, 22 bp, Homo sapiens
tagggctgggtacactcttgcc

SEQ ID NO: 8372475 - DNA, 22 bp, Homo sapiens
tagggctgtggtcagtcctcta

SEQ ID NO: 8372476 - DNA, 22 bp, Homo sapiens
tagggctggcgtgctcagggaa

SEQ ID NO: 8372477 - DNA, 23 bp, Homo sapiens
taggcaggactcagatatgacag

SEQ ID NO: 8372478 - DNA, 22 bp, Homo sapiens
taggcagcgcttggctgtgctt

SEQ ID NO: 8372479 - DNA, 22 bp, Homo sapiens
taggcagattccatattttggc

SEQ ID NO: 8372480 - DNA, 21 bp, Homo sapiens
taggcagaggagcaggtatct

SEQ ID NO: 8372481 - DNA, 22 bp, Homo sapiens
taggcagaggtatggtaaggac

SEQ ID NO: 8372482 - DNA, 22 bp, Homo sapiens
taggcagagtttaatggttaag

SEQ ID NO: 8372483 - DNA, 22 bp, Homo sapiens
taggcagatgttaacaggaaaa

SEQ ID NO: 8372484 - DNA, 22 bp, Homo sapiens
taggcagatgttaacaggaaaa

SEQ ID NO: 8372485 - DNA, 22 bp, Homo sapiens
taggcagattccatattttggc

SEQ ID NO: 8372486 - DNA, 22 bp, Homo sapiens
taggccaggacagagcttccag

SEQ ID NO: 8372487 - DNA, 22 bp, Homo sapiens
taggccagttggtggccctgga

SEQ ID NO: 8372488 - DNA, 23 bp, Homo sapiens
taggccagggtgacctggggaga

SEQ ID NO: 8372489 - DNA, 22 bp, Homo sapiens
taggccagattactagagtagg

SEQ ID NO: 8372490 - DNA, 22 bp, Homo sapiens
tagctgtggagcagaggtctcc

SEQ ID NO: 8372491 - DNA, 22 bp, Homo sapiens
taggcagaattgttgaatgaag

SEQ ID NO: 8372492 - DNA, 22 bp, Homo sapiens
taggcagaattgttgaatgaag

SEQ ID NO: 8372493 - DNA, 22 bp, Homo sapiens
taggcagaattgtgggctctaa

SEQ ID NO: 8372494 - DNA, 22 bp, Homo sapiens
taggcagaattcattgtgctgc

SEQ ID NO: 8372495 - DNA, 20 bp, Homo sapiens
taggcagagctgtgcagcct

SEQ ID NO: 8372496 - DNA, 20 bp, Homo sapiens
taggcagagctgtgcagcct

SEQ ID NO: 8372497 - DNA, 22 bp, Homo sapiens
taggcagagaggccataagaat

SEQ ID NO: 8372498 - DNA, 22 bp, Homo sapiens
tagctgtgtaacatgagaatgt

SEQ ID NO: 8372499 - DNA, 22 bp, Homo sapiens
tagctgttacccataaaagcca

SEQ ID NO: 8372500 - DNA, 22 bp, Homo sapiens
tagctgttaagttgtttggaaa

SEQ ID NO: 8372501 - DNA, 22 bp, Homo sapiens
tagatgaaggggttcagcatgg

SEQ ID NO: 8372502 - DNA, 22 bp, Homo sapiens
tagatctgatacaattcatctg

SEQ ID NO: 8372503 - DNA, 22 bp, Homo sapiens
tagcaaaatgtggatgtagttg

SEQ ID NO: 8372504 - DNA, 22 bp, Homo sapiens
tagcaaatgtgttatgctatgc

SEQ ID NO: 8372505 - DNA, 22 bp, Homo sapiens
tagcaaatgtgttatgctatgc

SEQ ID NO: 8372506 - DNA, 22 bp, Homo sapiens
tagcaaatgtaaaatgcctaca

SEQ ID NO: 8372507 - DNA, 22 bp, Homo sapiens
tagcaaataaaacagtattgaa

SEQ ID NO: 8372508 - DNA, 22 bp, Homo sapiens
tagcaaataaaacagtattgaa

SEQ ID NO: 8372509 - DNA, 22 bp, Homo sapiens
tagcaaaggatgactatgtacc

SEQ ID NO: 8372510 - DNA, 22 bp, Homo sapiens
tagcaaaggccttggacacgct

SEQ ID NO: 8372511 - DNA, 22 bp, Homo sapiens
tagcaaaggatgactatgtacc

SEQ ID NO: 8372512 - DNA, 22 bp, Homo sapiens
tagcagggagggccagtgtcaa

SEQ ID NO: 8372513 - DNA, 22 bp, Homo sapiens
tagcagggatacaaggtcgcct

SEQ ID NO: 8372514 - DNA, 22 bp, Homo sapiens
tagcaggaattggctgcagctg

SEQ ID NO: 8372515 - DNA, 22 bp, Homo sapiens
tagcaggaagaaagctactcag

SEQ ID NO: 8372516 - DNA, 22 bp, Homo sapiens
tagcagggtccaatgtgaggca

SEQ ID NO: 8372517 - DNA, 22 bp, Homo sapiens
tagcagggtccaatgtgaggca

SEQ ID NO: 8372518 - DNA, 22 bp, Homo sapiens
tagctgacgctaaataaatgtt

SEQ ID NO: 8372519 - DNA, 21 bp, Homo sapiens
tagagaaaagaagctgttcct

SEQ ID NO: 8372520 - DNA, 21 bp, Homo sapiens
tagagaaaagaagctgttcct

SEQ ID NO: 8372521 - DNA, 21 bp, Homo sapiens
tagagaaaagaagctgttcct

SEQ ID NO: 8372522 - DNA, 22 bp, Homo sapiens
tagagaaaaccactggtgagct

SEQ ID NO: 8372523 - DNA, 22 bp, Homo sapiens
tagactttgatattgtacaccc

SEQ ID NO: 8372524 - DNA, 23 bp, Homo sapiens
tagagaaagccaccgagtctctc

SEQ ID NO: 8372525 - DNA, 22 bp, Homo sapiens
tagagaaaagcagggatcagga

SEQ ID NO: 8372526 - DNA, 22 bp, Homo sapiens
tagagtcagagaatcattacag

SEQ ID NO: 8372527 - DNA, 22 bp, Homo sapiens
tagatacagtgttaagtgtgga

SEQ ID NO: 8372528 - DNA, 22 bp, Homo sapiens
tagagtccttcattctgtgcag

SEQ ID NO: 8372529 - DNA, 22 bp, Homo sapiens
tagagtcctgtgtgctctgtgg

SEQ ID NO: 8372530 - DNA, 22 bp, Homo sapiens
tagataggtgattaggaaaagc

SEQ ID NO: 8372531 - DNA, 22 bp, Homo sapiens
tagatatgtgtttattatgctg

SEQ ID NO: 8372532 - DNA, 22 bp, Homo sapiens
tagatatgtatacttgtttgag

SEQ ID NO: 8372533 - DNA, 22 bp, Homo sapiens
tagatcaggctgcttagataga

SEQ ID NO: 8372534 - DNA, 22 bp, Homo sapiens
tagatatggccgtctgttttaa

SEQ ID NO: 8372535 - DNA, 22 bp, Homo sapiens
tagatatgatgagtcacttgag

SEQ ID NO: 8372536 - DNA, 22 bp, Homo sapiens
tagaccattttacaatagtgtg

SEQ ID NO: 8372537 - DNA, 22 bp, Homo sapiens
tagaagattccagaggcaaagc

SEQ ID NO: 8372538 - DNA, 22 bp, Homo sapiens
tagaagattctaaagtggagag

SEQ ID NO: 8372539 - DNA, 22 bp, Homo sapiens
tagaagaaaagcacttagagat

SEQ ID NO: 8372540 - DNA, 22 bp, Homo sapiens
tagaagaaagtgaagctgggga

SEQ ID NO: 8372541 - DNA, 22 bp, Homo sapiens
tagaagaacatgtcaaactata

SEQ ID NO: 8372542 - DNA, 23 bp, Homo sapiens
tagaacatcggtgtcttggagca

SEQ ID NO: 8372543 - DNA, 22 bp, Homo sapiens
tagaacatgtgaaaatatagcc

SEQ ID NO: 8372544 - DNA, 22 bp, Homo sapiens
tagaaatgggttacatttagag

SEQ ID NO: 8372545 - DNA, 22 bp, Homo sapiens
tacttacattagcaaacaaggt

SEQ ID NO: 8372546 - DNA, 22 bp, Homo sapiens
tacttacattagcaaacaaggt

SEQ ID NO: 8372547 - DNA, 22 bp, Homo sapiens
tagaaatggggaagtagttagg

SEQ ID NO: 8372548 - DNA, 22 bp, Homo sapiens
tcaacactaaagaataatcttt

SEQ ID NO: 8372549 - DNA, 22 bp, Homo sapiens
tcaacaatgggtctgtaatgga

SEQ ID NO: 8372550 - DNA, 22 bp, Homo sapiens
tcaacaataggatatagcaggt

SEQ ID NO: 8372551 - DNA, 22 bp, Homo sapiens
tcaaatgcacctctcatttgtt

SEQ ID NO: 8372552 - DNA, 22 bp, Homo sapiens
tcaacagacatttttaagcact

SEQ ID NO: 8372553 - DNA, 22 bp, Homo sapiens
tcaacagaagtgatagctatta

SEQ ID NO: 8372554 - DNA, 22 bp, Homo sapiens
tcaacagaagtgatagctatta

SEQ ID NO: 8372555 - DNA, 22 bp, Homo sapiens
tcacagtgacagccaatgtttt

SEQ ID NO: 8372556 - DNA, 22 bp, Homo sapiens
tcacagtgacttacagagattg

SEQ ID NO: 8372557 - DNA, 22 bp, Homo sapiens
tcacagtgagaaatttgttggc

SEQ ID NO: 8372558 - DNA, 22 bp, Homo sapiens
tcaagaaactgtgctacagagt

SEQ ID NO: 8372559 - DNA, 22 bp, Homo sapiens
tcaagaaactgtgctacagagt

SEQ ID NO: 8372560 - DNA, 22 bp, Homo sapiens
tcaagaaaatgcctgctggtgt

SEQ ID NO: 8372561 - DNA, 22 bp, Homo sapiens
tcaagaaaatgacgccaacctt

SEQ ID NO: 8372562 - DNA, 22 bp, Homo sapiens
tcaactcatgttattctgtgaa

SEQ ID NO: 8372563 - DNA, 22 bp, Homo sapiens
tcaactcacaagaatgagcaag

SEQ ID NO: 8372564 - DNA, 23 bp, Homo sapiens
tcacatttaacccctcagacctc

SEQ ID NO: 8372565 - DNA, 22 bp, Homo sapiens
tcacatttatactccatttgca

SEQ ID NO: 8372566 - DNA, 22 bp, Homo sapiens
tcacattgttcttagtttacct

SEQ ID NO: 8372567 - DNA, 22 bp, Homo sapiens
tcacatttaaacaggaggatta

SEQ ID NO: 8372568 - DNA, 22 bp, Homo sapiens
tcacatttctcagcactgatga

SEQ ID NO: 8372569 - DNA, 22 bp, Homo sapiens
tcacatttcacatgggaggagg

SEQ ID NO: 8372570 - DNA, 22 bp, Homo sapiens
tcacatttcgcatcagtccgat

SEQ ID NO: 8372571 - DNA, 22 bp, Homo sapiens
tcacatttatttcaaagttact

SEQ ID NO: 8372572 - DNA, 22 bp, Homo sapiens
tcacatttcaagtgctcaaaag

SEQ ID NO: 8372573 - DNA, 22 bp, Homo sapiens
tcacatttcaagtgctcaaaag

SEQ ID NO: 8372574 - DNA, 21 bp, Homo sapiens
tcacatttctcatgggtaaat

SEQ ID NO: 8372575 - DNA, 22 bp, Homo sapiens
tcacatttctgattataccaaa

SEQ ID NO: 8372576 - DNA, 22 bp, Homo sapiens
tcacatttctttatgtagtctt

SEQ ID NO: 8372577 - DNA, 22 bp, Homo sapiens
tcacatttgataatgcccattg

SEQ ID NO: 8372578 - DNA, 22 bp, Homo sapiens
tcacagtgcaggatcagttaat

SEQ ID NO: 8372579 - DNA, 19 bp, Homo sapiens
tcacagtgcagaaccctcc

SEQ ID NO: 8372580 - DNA, 22 bp, Homo sapiens
tcacagtgcacccctcacaggg

SEQ ID NO: 8372581 - DNA, 22 bp, Homo sapiens
tcacagtgctctgggtggcaga

SEQ ID NO: 8372582 - DNA, 22 bp, Homo sapiens
tcacagtggagccaccaaggta

SEQ ID NO: 8372583 - DNA, 18 bp, Homo sapiens
tcacagtgctcttgccta

SEQ ID NO: 8372584 - DNA, 22 bp, Homo sapiens
tcacagtggagccaccaaggta

SEQ ID NO: 8372585 - DNA, 22 bp, Homo sapiens
tcacagtgatgacgtgggagca

SEQ ID NO: 8372586 - DNA, 22 bp, Homo sapiens
tcacagtgcacagcaggcgtgg

SEQ ID NO: 8372587 - DNA, 22 bp, Homo sapiens
tcacagtgcaccagtgtgaagc

SEQ ID NO: 8372588 - DNA, 22 bp, Homo sapiens
tcacagtgataactaagtcctg

SEQ ID NO: 8372589 - DNA, 22 bp, Homo sapiens
tcacagtgaggcagttcttgta

SEQ ID NO: 8372590 - DNA, 22 bp, Homo sapiens
tcacagtgaggagttacagttt

SEQ ID NO: 8372591 - DNA, 22 bp, Homo sapiens
tcacagtgagccatgtcagaga

SEQ ID NO: 8372592 - DNA, 22 bp, Homo sapiens
tcacagtgtcacaatgcctgga

SEQ ID NO: 8372593 - DNA, 22 bp, Homo sapiens
tcacagtgggacttttatcgct

SEQ ID NO: 8372594 - DNA, 22 bp, Homo sapiens
tcacagtgtcgtccttgggtgt

SEQ ID NO: 8372595 - DNA, 22 bp, Homo sapiens
tcacagtgtgaaggtcagtcac

SEQ ID NO: 8372596 - DNA, 23 bp, Homo sapiens
tcacataatccttcatccacagg

SEQ ID NO: 8372597 - DNA, 22 bp, Homo sapiens
tcacatacactaggatattttt

SEQ ID NO: 8372598 - DNA, 22 bp, Homo sapiens
tcacatactgaaagtccagtga

SEQ ID NO: 8372599 - DNA, 22 bp, Homo sapiens
tcacataaattatacaatttca

SEQ ID NO: 8372600 - DNA, 22 bp, Homo sapiens
tcacataaattatacaatttca

SEQ ID NO: 8372601 - DNA, 22 bp, Homo sapiens
tcacatttgtgttttattagag

SEQ ID NO: 8372602 - DNA, 22 bp, Homo sapiens
tcacatttgttcctctgcactt

SEQ ID NO: 8372603 - DNA, 22 bp, Homo sapiens
tcacattttagtaccatgattt

SEQ ID NO: 8372604 - DNA, 22 bp, Homo sapiens
tcacattttagtaccatgattt

SEQ ID NO: 8372605 - DNA, 22 bp, Homo sapiens
tcacatttgttcttgaatctaa

SEQ ID NO: 8372606 - DNA, 22 bp, Homo sapiens
tcacatttgttcttgaatctaa

SEQ ID NO: 8372607 - DNA, 22 bp, Homo sapiens
tcacatttgttcttgaatctaa

SEQ ID NO: 8372608 - DNA, 22 bp, Homo sapiens
tcacatttgtgttttattagag

SEQ ID NO: 8372609 - DNA, 22 bp, Homo sapiens
tcacatttggagaaagcctgcc

SEQ ID NO: 8372610 - DNA, 22 bp, Homo sapiens
tcacatttgctatcccactcct

SEQ ID NO: 8372611 - DNA, 22 bp, Homo sapiens
tcacatttgcaattgcattgtt

SEQ ID NO: 8372612 - DNA, 22 bp, Homo sapiens
tcacatttgcaattgcattgtt

SEQ ID NO: 8372613 - DNA, 22 bp, Homo sapiens
tcactgcaacctccacctcccg

SEQ ID NO: 8372614 - DNA, 22 bp, Homo sapiens
tcactgcaacctccacctcccg

SEQ ID NO: 8372615 - DNA, 22 bp, Homo sapiens
tcacattttatctattttaagt

SEQ ID NO: 8372616 - DNA, 22 bp, Homo sapiens
tcacattttatatctctggttt

SEQ ID NO: 8372617 - DNA, 22 bp, Homo sapiens
tcacattttatatctctggttt

SEQ ID NO: 8372618 - DNA, 22 bp, Homo sapiens
tcacattttatctattttaagt

SEQ ID NO: 8372619 - DNA, 22 bp, Homo sapiens
tcactgcaacctccacctcctg

SEQ ID NO: 8372620 - DNA, 22 bp, Homo sapiens
tcactgcatcccatctccagcc

SEQ ID NO: 8372621 - DNA, 22 bp, Homo sapiens
tcactgctacacaagtttctgc

SEQ ID NO: 8372622 - DNA, 22 bp, Homo sapiens
tcactgcaacctccacctcctg

SEQ ID NO: 8372623 - DNA, 22 bp, Homo sapiens
tcagaaaatgaaatggactctc

SEQ ID NO: 8372624 - DNA, 22 bp, Homo sapiens
tcactgctcagtctgtactaca

SEQ ID NO: 8372625 - DNA, 22 bp, Homo sapiens
tcagaaacagaaactaagaacc

SEQ ID NO: 8372626 - DNA, 22 bp, Homo sapiens
tcagaaagaacacaggcagtag

SEQ ID NO: 8372627 - DNA, 22 bp, Homo sapiens
tcagaaagaacacaggcagtag

SEQ ID NO: 8372628 - DNA, 22 bp, Homo sapiens
tcagaaagacgaaacagatggg

SEQ ID NO: 8372629 - DNA, 22 bp, Homo sapiens
tcagaaagaacacaggcagtag

SEQ ID NO: 8372630 - DNA, 22 bp, Homo sapiens
tcagaaagcttagtgtcttgca

SEQ ID NO: 8372631 - DNA, 22 bp, Homo sapiens
tcagaaagctatatggtgtgtc

SEQ ID NO: 8372632 - DNA, 22 bp, Homo sapiens
tcagaaagctatatggtgtgtc

SEQ ID NO: 8372633 - DNA, 22 bp, Homo sapiens
tcagaacactttctctactgac

SEQ ID NO: 8372634 - DNA, 22 bp, Homo sapiens
tcagaaaggttgagtcatgtgc

SEQ ID NO: 8372635 - DNA, 22 bp, Homo sapiens
tcagaaaggccacatggtgcag

SEQ ID NO: 8372636 - DNA, 22 bp, Homo sapiens
tcagaaaggttctatgttttac

SEQ ID NO: 8372637 - DNA, 22 bp, Homo sapiens
tcagaaagcttttacttaaaca

SEQ ID NO: 8372638 - DNA, 22 bp, Homo sapiens
tcagaaaggagttagaggtctc

SEQ ID NO: 8372639 - DNA, 22 bp, Homo sapiens
tcagaaaggccacatggtgcag

SEQ ID NO: 8372640 - DNA, 22 bp, Homo sapiens
tcagaagccggaagtgctcctc

SEQ ID NO: 8372641 - DNA, 22 bp, Homo sapiens
tcagaagccgggcaggttttgg

SEQ ID NO: 8372642 - DNA, 22 bp, Homo sapiens
tcagaagctaaatttgatattt

SEQ ID NO: 8372643 - DNA, 22 bp, Homo sapiens
tcagaacagcacagggtgattt

SEQ ID NO: 8372644 - DNA, 22 bp, Homo sapiens
tcagaataaacatgggcatggg

SEQ ID NO: 8372645 - DNA, 20 bp, Homo sapiens
tcagaagtttcctggagcat

SEQ ID NO: 8372646 - DNA, 22 bp, Homo sapiens
tcaggagaacttccttctaccc

SEQ ID NO: 8372647 - DNA, 22 bp, Homo sapiens
tcaggacagccagggtgcagac

SEQ ID NO: 8372648 - DNA, 22 bp, Homo sapiens
tcaggacagccagggtgcagac

SEQ ID NO: 8372649 - DNA, 23 bp, Homo sapiens
tcagctgcttcctcctgcctgcc

SEQ ID NO: 8372650 - DNA, 22 bp, Homo sapiens
tcagctggtgccactcagtcaa

SEQ ID NO: 8372651 - DNA, 21 bp, Homo sapiens
tcagctgtagagattacattc

SEQ ID NO: 8372652 - DNA, 22 bp, Homo sapiens
tcaggaagggtggtccacaggg

SEQ ID NO: 8372653 - DNA, 22 bp, Homo sapiens
tcaggaagtataatcagattca

SEQ ID NO: 8372654 - DNA, 22 bp, Homo sapiens
tcaggacaacaagacttgttta

SEQ ID NO: 8372655 - DNA, 20 bp, Homo sapiens
tcagcatgttctcctccggt

SEQ ID NO: 8372656 - DNA, 22 bp, Homo sapiens
tcagcatgtacttctcctccat

SEQ ID NO: 8372657 - DNA, 20 bp, Homo sapiens
tcagcatgctcctcagacat

SEQ ID NO: 8372658 - DNA, 22 bp, Homo sapiens
tcagcagttgccccctcccagc

SEQ ID NO: 8372659 - DNA, 22 bp, Homo sapiens
tcagcagttcaaccccgtcaga

SEQ ID NO: 8372660 - DNA, 22 bp, Homo sapiens
tcagcagttattcccctacaga

SEQ ID NO: 8372661 - DNA, 22 bp, Homo sapiens
tcagcagtgtcagttcccagag

SEQ ID NO: 8372662 - DNA, 22 bp, Homo sapiens
tcagcagtgtgcccagaggctg

SEQ ID NO: 8372663 - DNA, 22 bp, Homo sapiens
tcagccaagcgtaggatattgg

SEQ ID NO: 8372664 - DNA, 22 bp, Homo sapiens
tcagccagaggcttcttggttt

SEQ ID NO: 8372665 - DNA, 22 bp, Homo sapiens
tcagctgccccgggcactgccc

SEQ ID NO: 8372666 - DNA, 22 bp, Homo sapiens
tcagctgctctgttgagctgaa

SEQ ID NO: 8372667 - DNA, 22 bp, Homo sapiens
tcagctgcgacaggggcctgag

SEQ ID NO: 8372668 - DNA, 22 bp, Homo sapiens
tcagctgctctgttgagctgaa

SEQ ID NO: 8372669 - DNA, 22 bp, Homo sapiens
tcagccaggcacaatggcagct

SEQ ID NO: 8372670 - DNA, 22 bp, Homo sapiens
tcagcaagaagctgtgggcttc

SEQ ID NO: 8372671 - DNA, 22 bp, Homo sapiens
tcagcaggcagaaatctgcaga

SEQ ID NO: 8372672 - DNA, 22 bp, Homo sapiens
tcagcaggcagaaatctgcaga

SEQ ID NO: 8372673 - DNA, 22 bp, Homo sapiens
tcagcaggcaggaggcatgcca

SEQ ID NO: 8372674 - DNA, 22 bp, Homo sapiens
tcagcaggcccatcctccaggc

SEQ ID NO: 8372675 - DNA, 22 bp, Homo sapiens
tcagcaggcggttccttgtggg

SEQ ID NO: 8372676 - DNA, 22 bp, Homo sapiens
tcagcaggcccatcctccaggc

SEQ ID NO: 8372677 - DNA, 22 bp, Homo sapiens
tcagcaggcccatcctccaggc

SEQ ID NO: 8372678 - DNA, 22 bp, Homo sapiens
tcagcaggcagtgggtcacaat

SEQ ID NO: 8372679 - DNA, 22 bp, Homo sapiens
tcagcaggcagtgggtcacaat

SEQ ID NO: 8372680 - DNA, 22 bp, Homo sapiens
tcagcaggcaggaggcatgcca

SEQ ID NO: 8372681 - DNA, 22 bp, Homo sapiens
tcagcaggcaggaggcatgcca

SEQ ID NO: 8372682 - DNA, 22 bp, Homo sapiens
tcagcaggctgtcagcaggggc

SEQ ID NO: 8372683 - DNA, 22 bp, Homo sapiens
tcagcaggctgtcagcaggggc

SEQ ID NO: 8372684 - DNA, 22 bp, Homo sapiens
tcagcaggctgtcagcaggggc

SEQ ID NO: 8372685 - DNA, 22 bp, Homo sapiens
tcagcaggctgtcagcaggggc

SEQ ID NO: 8372686 - DNA, 22 bp, Homo sapiens
tcagcaggctctggttgaccat

SEQ ID NO: 8372687 - DNA, 22 bp, Homo sapiens
tcagcaggctctggttgaccat

SEQ ID NO: 8372688 - DNA, 22 bp, Homo sapiens
tcagcaggctctggttgaccat

SEQ ID NO: 8372689 - DNA, 22 bp, Homo sapiens
tcagcaggcggttccttgtggg

SEQ ID NO: 8372690 - DNA, 22 bp, Homo sapiens
tcagcagggctgggagctgtga

SEQ ID NO: 8372691 - DNA, 22 bp, Homo sapiens
tcagcagggctgtggtgtggct

SEQ ID NO: 8372692 - DNA, 22 bp, Homo sapiens
tcagcagggctgtggtgtggct

SEQ ID NO: 8372693 - DNA, 22 bp, Homo sapiens
tcagcagggcctccttgtgcag

SEQ ID NO: 8372694 - DNA, 22 bp, Homo sapiens
tcagcagggctgggagctgtga

SEQ ID NO: 8372695 - DNA, 22 bp, Homo sapiens
tcagcagggctgggagctgtga

SEQ ID NO: 8372696 - DNA, 22 bp, Homo sapiens
tcagcaggggccgttgggtgga

SEQ ID NO: 8372697 - DNA, 22 bp, Homo sapiens
tcagcaggggccgttgggtgga

SEQ ID NO: 8372698 - DNA, 22 bp, Homo sapiens
tcagcagtgtcagttcccagag

SEQ ID NO: 8372699 - DNA, 17 bp, Homo sapiens
tcagcaggggccaagct

SEQ ID NO: 8372700 - DNA, 17 bp, Homo sapiens
tcagcaggggccaagct

SEQ ID NO: 8372701 - DNA, 17 bp, Homo sapiens
tcagcaggggccaagct

SEQ ID NO: 8372702 - DNA, 22 bp, Homo sapiens
tcagcagggcctccttgtgcag

SEQ ID NO: 8372703 - DNA, 22 bp, Homo sapiens
tcagcagggccatgctctctct

SEQ ID NO: 8372704 - DNA, 22 bp, Homo sapiens
tcagcagggccatgctctctct

SEQ ID NO: 8372705 - DNA, 22 bp, Homo sapiens
tcagcagggcatactgagccta

SEQ ID NO: 8372706 - DNA, 22 bp, Homo sapiens
tcagcagggcatactgagccta

SEQ ID NO: 8372707 - DNA, 22 bp, Homo sapiens
tcagcagggccatgctctctct

SEQ ID NO: 8372708 - DNA, 22 bp, Homo sapiens
tcagcagggcatactgagccta

SEQ ID NO: 8372709 - DNA, 22 bp, Homo sapiens
tcagcagggcatactgagccta

SEQ ID NO: 8372710 - DNA, 22 bp, Homo sapiens
tcagcagggagaggagaatgca

SEQ ID NO: 8372711 - DNA, 22 bp, Homo sapiens
tcagcagggagaggagaatgca

SEQ ID NO: 8372712 - DNA, 22 bp, Homo sapiens
tcagcaggctgtcagcaggggc

SEQ ID NO: 8372713 - DNA, 22 bp, Homo sapiens
tcagcagggagaggagaatgca

SEQ ID NO: 8372714 - DNA, 22 bp, Homo sapiens
tcagcagggaggctctgtgccc

SEQ ID NO: 8372715 - DNA, 22 bp, Homo sapiens
tcagcagggaggctctgtgccc

SEQ ID NO: 8372716 - DNA, 22 bp, Homo sapiens
tcagcagggaggctctgtgccc

SEQ ID NO: 8372717 - DNA, 22 bp, Homo sapiens
tcagatgttgaaaaggaaaagt

SEQ ID NO: 8372718 - DNA, 22 bp, Homo sapiens
tcagacaagttgatgtacctgg

SEQ ID NO: 8372719 - DNA, 22 bp, Homo sapiens
tcagacacagatgagacaagga

SEQ ID NO: 8372720 - DNA, 22 bp, Homo sapiens
tcagacagaggagctcgtgcag

SEQ ID NO: 8372721 - DNA, 22 bp, Homo sapiens
tcagagtgtggtgagatgtgca

SEQ ID NO: 8372722 - DNA, 23 bp, Homo sapiens
tcagaattccagtttctttgaag

SEQ ID NO: 8372723 - DNA, 21 bp, Homo sapiens
tcagaattacccctggatctg

SEQ ID NO: 8372724 - DNA, 22 bp, Homo sapiens
tcagacaactctggaggctggc

SEQ ID NO: 8372725 - DNA, 22 bp, Homo sapiens
tcagaattttctggaatggagc

SEQ ID NO: 8372726 - DNA, 22 bp, Homo sapiens
tcagggcaggcgagcagctgct

SEQ ID NO: 8372727 - DNA, 22 bp, Homo sapiens
tcagggcaggttaacttgggtg

SEQ ID NO: 8372728 - DNA, 22 bp, Homo sapiens
tcagggcaggttaacttgggtg

SEQ ID NO: 8372729 - DNA, 21 bp, Homo sapiens
tcagggcagtgggaggttcct

SEQ ID NO: 8372730 - DNA, 19 bp, Homo sapiens
tcagggcagtccggtcccc

SEQ ID NO: 8372731 - DNA, 22 bp, Homo sapiens
tcagggcaggcgagcagctgct

SEQ ID NO: 8372732 - DNA, 22 bp, Homo sapiens
tcagggcaggacagtgtaggcc

SEQ ID NO: 8372733 - DNA, 22 bp, Homo sapiens
tcaggctgttagccacctcctc

SEQ ID NO: 8372734 - DNA, 22 bp, Homo sapiens
tcaggctttgaagtctagctgg

SEQ ID NO: 8372735 - DNA, 22 bp, Homo sapiens
tcaggcttccaggctctgctga

SEQ ID NO: 8372736 - DNA, 17 bp, Homo sapiens
tcaggctgggtgcagtg

SEQ ID NO: 8372737 - DNA, 21 bp, Homo sapiens
tcaggagagcccatctacaaa

SEQ ID NO: 8372738 - DNA, 22 bp, Homo sapiens
tcaggagagagaaattggggct

SEQ ID NO: 8372739 - DNA, 22 bp, Homo sapiens
tcaggagagagttgggtaggct

SEQ ID NO: 8372740 - DNA, 22 bp, Homo sapiens
tcaggctggtggtcagatggct

SEQ ID NO: 8372741 - DNA, 22 bp, Homo sapiens
tcaggctggtccccacagtgga

SEQ ID NO: 8372742 - DNA, 22 bp, Homo sapiens
tcagggcatccattgcctgttg

SEQ ID NO: 8372743 - DNA, 22 bp, Homo sapiens
tcagggcatactcttcaaggtc

SEQ ID NO: 8372744 - DNA, 21 bp, Homo sapiens
tcagggcagtgggaggttcct

SEQ ID NO: 8372745 - DNA, 22 bp, Homo sapiens
tcagggcatactcttcaaggtc

SEQ ID NO: 8372746 - DNA, 22 bp, Homo sapiens
tcagggctgcatacaggagata

SEQ ID NO: 8372747 - DNA, 22 bp, Homo sapiens
tcagtaatattctttaaaatac

SEQ ID NO: 8372748 - DNA, 22 bp, Homo sapiens
tcagtaatattctttaaaatac

SEQ ID NO: 8372749 - DNA, 22 bp, Homo sapiens
tcagtatccacaaatgctcaaa

SEQ ID NO: 8372750 - DNA, 22 bp, Homo sapiens
tcagtagttttgatctgagcag

SEQ ID NO: 8372751 - DNA, 22 bp, Homo sapiens
tcagtagttcagcaaatatttt

SEQ ID NO: 8372752 - DNA, 23 bp, Homo sapiens
tcagtagtgcattgaataagtgc

SEQ ID NO: 8372753 - DNA, 22 bp, Homo sapiens
tcagtaaatgaatgaatatatg

SEQ ID NO: 8372754 - DNA, 22 bp, Homo sapiens
tcagtaaagttctttcttgctg

SEQ ID NO: 8372755 - DNA, 22 bp, Homo sapiens
tcataaagttgttttaatggga

SEQ ID NO: 8372756 - DNA, 22 bp, Homo sapiens
tcataaagttctaagaattgta

SEQ ID NO: 8372757 - DNA, 22 bp, Homo sapiens
tcataaagttacccaaatttta

SEQ ID NO: 8372758 - DNA, 22 bp, Homo sapiens
tcagttacctgacagtggttat

SEQ ID NO: 8372759 - DNA, 22 bp, Homo sapiens
tcataaatcatactccatttgc

SEQ ID NO: 8372760 - DNA, 22 bp, Homo sapiens
tcataaatcatactccatttgc

SEQ ID NO: 8372761 - DNA, 22 bp, Homo sapiens
tcagtgtttgtggcaaatgtta

SEQ ID NO: 8372762 - DNA, 22 bp, Homo sapiens
tcagtgttcttatttaattagg

SEQ ID NO: 8372763 - DNA, 22 bp, Homo sapiens
tcagtgttggtcaagaatcagt

SEQ ID NO: 8372764 - DNA, 22 bp, Homo sapiens
tcagtgttggcattcagaaatg

SEQ ID NO: 8372765 - DNA, 22 bp, Homo sapiens
tcagtgttggcattcagaaatg

SEQ ID NO: 8372766 - DNA, 22 bp, Homo sapiens
tcagtgtttattcaatgttatt

SEQ ID NO: 8372767 - DNA, 22 bp, Homo sapiens
tcatgaaaatagatcagaaatt

SEQ ID NO: 8372768 - DNA, 22 bp, Homo sapiens
tcatgcagataagaataagtaa

SEQ ID NO: 8372769 - DNA, 22 bp, Homo sapiens
tcatctttcctcaaaagatcca

SEQ ID NO: 8372770 - DNA, 22 bp, Homo sapiens
tcatctgttgattttaagtctt

SEQ ID NO: 8372771 - DNA, 22 bp, Homo sapiens
tcatctgttatttatgcctgag

SEQ ID NO: 8372772 - DNA, 22 bp, Homo sapiens
tcatctgttcatacacatgcgt

SEQ ID NO: 8372773 - DNA, 22 bp, Homo sapiens
tcatctgtgaataatgaactgg

SEQ ID NO: 8372774 - DNA, 22 bp, Homo sapiens
tcatctgtgagtaaaggcacat

SEQ ID NO: 8372775 - DNA, 22 bp, Homo sapiens
tcatctgtcaaattgcaataag

SEQ ID NO: 8372776 - DNA, 22 bp, Homo sapiens
tcatctgtcatccacaaagctg

SEQ ID NO: 8372777 - DNA, 22 bp, Homo sapiens
tcataaattctggtgctgtgag

SEQ ID NO: 8372778 - DNA, 22 bp, Homo sapiens
tcatagaaatatcacgtctttt

SEQ ID NO: 8372779 - DNA, 22 bp, Homo sapiens
tcatacattcagcagatatttg

SEQ ID NO: 8372780 - DNA, 22 bp, Homo sapiens
tcatagaagtagtatccacatt

SEQ ID NO: 8372781 - DNA, 17 bp, Homo sapiens
tcatttctaggcactcc

SEQ ID NO: 8372782 - DNA, 22 bp, Homo sapiens
tcatttcatgtctcaggcactg

SEQ ID NO: 8372783 - DNA, 23 bp, Homo sapiens
tcatttcatccagccttgagagt

SEQ ID NO: 8372784 - DNA, 22 bp, Homo sapiens
tcatttatcatttgtgctgtag

SEQ ID NO: 8372785 - DNA, 22 bp, Homo sapiens
tcatttatattgtattctgtag

SEQ ID NO: 8372786 - DNA, 22 bp, Homo sapiens
tcatttatattgtattctgtag

SEQ ID NO: 8372787 - DNA, 22 bp, Homo sapiens
tcatttatattgtattctgtag

SEQ ID NO: 8372788 - DNA, 22 bp, Homo sapiens
tcatttatcatttgtgctgtag

SEQ ID NO: 8372789 - DNA, 22 bp, Homo sapiens
tcatttatcatttgtgctgtag

SEQ ID NO: 8372790 - DNA, 23 bp, Homo sapiens
tcatttcacagtgagcttcctag

SEQ ID NO: 8372791 - DNA, 22 bp, Homo sapiens
tcatttcagccatttttaaatg

SEQ ID NO: 8372792 - DNA, 22 bp, Homo sapiens
tcatttcagccatttttaaatg

SEQ ID NO: 8372793 - DNA, 22 bp, Homo sapiens
tcatttcagatgcatttagaat

SEQ ID NO: 8372794 - DNA, 22 bp, Homo sapiens
tcatttctcctaagtgaaatat

SEQ ID NO: 8372795 - DNA, 22 bp, Homo sapiens
tcatttctgttgtgcatcactg

SEQ ID NO: 8372796 - DNA, 22 bp, Homo sapiens
tcatttctgttgtgcatcactg

SEQ ID NO: 8372797 - DNA, 22 bp, Homo sapiens
tcatgcatctgggctggctggt

SEQ ID NO: 8372798 - DNA, 22 bp, Homo sapiens
tcatgcatatttgtagtagttc

SEQ ID NO: 8372799 - DNA, 22 bp, Homo sapiens
tcattgtattaaaatattggtt

SEQ ID NO: 8372800 - DNA, 22 bp, Homo sapiens
tcattgtattcagaactgaaga

SEQ ID NO: 8372801 - DNA, 22 bp, Homo sapiens
tcattgtatactttatttatga

SEQ ID NO: 8372802 - DNA, 22 bp, Homo sapiens
tcattgtagggcatttagagag

SEQ ID NO: 8372803 - DNA, 22 bp, Homo sapiens
tcatttacagactgtgtgggtg

SEQ ID NO: 8372804 - DNA, 22 bp, Homo sapiens
tcatttacaggtgaagcaacta

SEQ ID NO: 8372805 - DNA, 22 bp, Homo sapiens
tcatttaattggttttgctcgt

SEQ ID NO: 8372806 - DNA, 22 bp, Homo sapiens
tcatttatagctaaccttgaat

SEQ ID NO: 8372807 - DNA, 22 bp, Homo sapiens
tcatttatattgtattctgtag

SEQ ID NO: 8372808 - DNA, 22 bp, Homo sapiens
tcatttatagctaaccttgaat

SEQ ID NO: 8372809 - DNA, 22 bp, Homo sapiens
tcatttataaggatgcaattaa

SEQ ID NO: 8372810 - DNA, 22 bp, Homo sapiens
tcatttataaggatgcaattaa

SEQ ID NO: 8372811 - DNA, 22 bp, Homo sapiens
tcatttatagaagtgggcagta

SEQ ID NO: 8372812 - DNA, 22 bp, Homo sapiens
tcatttacatgtctttctctga

SEQ ID NO: 8372813 - DNA, 19 bp, Homo sapiens
tcatttacggttttgatga

SEQ ID NO: 8372814 - DNA, 22 bp, Homo sapiens
tcatttgtaccattttttaaga

SEQ ID NO: 8372815 - DNA, 21 bp, Homo sapiens
tcatttttattgctaccttgc

SEQ ID NO: 8372816 - DNA, 22 bp, Homo sapiens
tcatttttctcttacacgtaga

SEQ ID NO: 8372817 - DNA, 22 bp, Homo sapiens
tcatttttgaccatgggtagga

SEQ ID NO: 8372818 - DNA, 22 bp, Homo sapiens
tccaaaaaacgtttgaatagtt

SEQ ID NO: 8372819 - DNA, 21 bp, Homo sapiens
tccaaaaaggagcgtccttct

SEQ ID NO: 8372820 - DNA, 22 bp, Homo sapiens
tcattttttgcatacctgtgtc

SEQ ID NO: 8372821 - DNA, 22 bp, Homo sapiens
tccaaaggaagaggctgtcagt

SEQ ID NO: 8372822 - DNA, 19 bp, Homo sapiens
tccaaaggacccacctcca

SEQ ID NO: 8372823 - DNA, 22 bp, Homo sapiens
tccaaaggcaaaactgtggtgt

SEQ ID NO: 8372824 - DNA, 22 bp, Homo sapiens
tccaaaggggcagtgtccagcc

SEQ ID NO: 8372825 - DNA, 22 bp, Homo sapiens
tccaaatacatttactgtattt

SEQ ID NO: 8372826 - DNA, 18 bp, Homo sapiens
tccaaaatcatgtatttt

SEQ ID NO: 8372827 - DNA, 22 bp, Homo sapiens
tccaaagcatctgagtgtgcat

SEQ ID NO: 8372828 - DNA, 22 bp, Homo sapiens
tccaaagccccatgcactttct

SEQ ID NO: 8372829 - DNA, 22 bp, Homo sapiens
tccaaagaggttaagaacgaga

SEQ ID NO: 8372830 - DNA, 22 bp, Homo sapiens
tccaactttctcctccggcttg

SEQ ID NO: 8372831 - DNA, 22 bp, Homo sapiens
tccaactttctcctccggcttg

SEQ ID NO: 8372832 - DNA, 22 bp, Homo sapiens
tccaaattctagggccttggtt

SEQ ID NO: 8372833 - DNA, 22 bp, Homo sapiens
tccaaatattcatctacttctg

SEQ ID NO: 8372834 - DNA, 22 bp, Homo sapiens
tccaaggacattgttctagttg

SEQ ID NO: 8372835 - DNA, 22 bp, Homo sapiens
tccaaggcatagacacagtgcc

SEQ ID NO: 8372836 - DNA, 22 bp, Homo sapiens
tccaaggccgcaggctgggcct

SEQ ID NO: 8372837 - DNA, 22 bp, Homo sapiens
tccaagtttcttctgcacaaca

SEQ ID NO: 8372838 - DNA, 20 bp, Homo sapiens
tccaagttataaagtgccaa

SEQ ID NO: 8372839 - DNA, 22 bp, Homo sapiens
tccaagttctaggaactgctgc

SEQ ID NO: 8372840 - DNA, 22 bp, Homo sapiens
tcctgagaatagagttgcatgt

SEQ ID NO: 8372841 - DNA, 22 bp, Homo sapiens
tcctgaagcagttagcatgagc

SEQ ID NO: 8372842 - DNA, 22 bp, Homo sapiens
tcctgaaaaattacatgttcag

SEQ ID NO: 8372843 - DNA, 22 bp, Homo sapiens
tcctgaaatgtgcacatgacat

SEQ ID NO: 8372844 - DNA, 22 bp, Homo sapiens
tcctctttctcaacattagtta

SEQ ID NO: 8372845 - DNA, 22 bp, Homo sapiens
tcctcttctgcctatatctgcc

SEQ ID NO: 8372846 - DNA, 22 bp, Homo sapiens
tcctctgtggaccgggctttgg

SEQ ID NO: 8372847 - DNA, 22 bp, Homo sapiens
tcctctggttatacttgcaccc

SEQ ID NO: 8372848 - DNA, 22 bp, Homo sapiens
tcctcttcaaaatagctctgaa

SEQ ID NO: 8372849 - DNA, 22 bp, Homo sapiens
tcctctggtcctgcagcagatc

SEQ ID NO: 8372850 - DNA, 22 bp, Homo sapiens
tcctctggtacttaaagtgctt

SEQ ID NO: 8372851 - DNA, 22 bp, Homo sapiens
tcctctggtcttcggtgtggac

SEQ ID NO: 8372852 - DNA, 22 bp, Homo sapiens
tcctctggggtcagggcactac

SEQ ID NO: 8372853 - DNA, 22 bp, Homo sapiens
tcctctggggcgtggtcctgga

SEQ ID NO: 8372854 - DNA, 22 bp, Homo sapiens
tcctctgggctccctgcaacag

SEQ ID NO: 8372855 - DNA, 22 bp, Homo sapiens
tcctcaggtgactaggtatctt

SEQ ID NO: 8372856 - DNA, 22 bp, Homo sapiens
tcctgagctttacagtaaggac

SEQ ID NO: 8372857 - DNA, 22 bp, Homo sapiens
tcctgagctcccatgaacaggc

SEQ ID NO: 8372858 - DNA, 22 bp, Homo sapiens
tcctgagctgccgcatcagcag

SEQ ID NO: 8372859 - DNA, 22 bp, Homo sapiens
tcctgatggaggggtcatcttt

SEQ ID NO: 8372860 - DNA, 22 bp, Homo sapiens
tcctgaggagaagagtgctagg

SEQ ID NO: 8372861 - DNA, 22 bp, Homo sapiens
tcctgaggcacaatcctagaat

SEQ ID NO: 8372862 - DNA, 22 bp, Homo sapiens
tcctgaggcctctgtgatgtga

SEQ ID NO: 8372863 - DNA, 22 bp, Homo sapiens
tcctgaggctaaagtgcagtgg

SEQ ID NO: 8372864 - DNA, 22 bp, Homo sapiens
tcctgagccctgtaggaccctg

SEQ ID NO: 8372865 - DNA, 22 bp, Homo sapiens
tcctgagctacagtagtatgat

SEQ ID NO: 8372866 - DNA, 22 bp, Homo sapiens
tcctgagccctggggtcagtgt

SEQ ID NO: 8372867 - DNA, 22 bp, Homo sapiens
tcctgagcacagagacaaggaa

SEQ ID NO: 8372868 - DNA, 22 bp, Homo sapiens
tcctgagataaatctcatgtga

SEQ ID NO: 8372869 - DNA, 22 bp, Homo sapiens
tcctgcctcttgccttcttcac

SEQ ID NO: 8372870 - DNA, 22 bp, Homo sapiens
tcctgcctcttttcttattcca

SEQ ID NO: 8372871 - DNA, 22 bp, Homo sapiens
tcctgcctgcaatcccagcact

SEQ ID NO: 8372872 - DNA, 22 bp, Homo sapiens
tcctgcctgcaatcccagcact

SEQ ID NO: 8372873 - DNA, 22 bp, Homo sapiens
tcctgcctgagcgtggaggagg

SEQ ID NO: 8372874 - DNA, 22 bp, Homo sapiens
tcctgcctcacagttgaagttt

SEQ ID NO: 8372875 - DNA, 22 bp, Homo sapiens
tcctgcctctccatgctaacta

SEQ ID NO: 8372876 - DNA, 22 bp, Homo sapiens
tcctgcctcaggctctggagta

SEQ ID NO: 8372877 - DNA, 22 bp, Homo sapiens
tcctgcctaccttgcggaggtg

SEQ ID NO: 8372878 - DNA, 22 bp, Homo sapiens
tcctgcctagcaggtgacctat

SEQ ID NO: 8372879 - DNA, 22 bp, Homo sapiens
tcctgcagctgaagctcatgtg

SEQ ID NO: 8372880 - DNA, 22 bp, Homo sapiens
tcctgcagctctgagaagcatc

SEQ ID NO: 8372881 - DNA, 22 bp, Homo sapiens
tcctgcaggcctgttcccagta

SEQ ID NO: 8372882 - DNA, 22 bp, Homo sapiens
tcctgcagtctgcactctgcct

SEQ ID NO: 8372883 - DNA, 20 bp, Homo sapiens
tcctgcagtcgctagcgccc

SEQ ID NO: 8372884 - DNA, 19 bp, Homo sapiens
tcctgcaggtggcttgcag

SEQ ID NO: 8372885 - DNA, 22 bp, Homo sapiens
tcctgcagccaagggtcatcga

SEQ ID NO: 8372886 - DNA, 22 bp, Homo sapiens
tcctgcagccactgcaggcaga

SEQ ID NO: 8372887 - DNA, 19 bp, Homo sapiens
tcctgcagaccagacctgt

SEQ ID NO: 8372888 - DNA, 22 bp, Homo sapiens
tcctgcagagacagaggcctca

SEQ ID NO: 8372889 - DNA, 22 bp, Homo sapiens
tcctgcagacctcagtcaggtc

SEQ ID NO: 8372890 - DNA, 23 bp, Homo sapiens
tccagtagggagtctgcttactt

SEQ ID NO: 8372891 - DNA, 19 bp, Homo sapiens
tccagggctttatggcttt

SEQ ID NO: 8372892 - DNA, 22 bp, Homo sapiens
tccagggacacagagtccttct

SEQ ID NO: 8372893 - DNA, 22 bp, Homo sapiens
tccagggacacagagtccttct

SEQ ID NO: 8372894 - DNA, 22 bp, Homo sapiens
tccagggacagcgctggagcta

SEQ ID NO: 8372895 - DNA, 21 bp, Homo sapiens
tccagggaatttcaactttta

SEQ ID NO: 8372896 - DNA, 22 bp, Homo sapiens
tccagggaaggtgtgaggctgg

SEQ ID NO: 8372897 - DNA, 22 bp, Homo sapiens
tccagggaaggtgtgaggctgg

SEQ ID NO: 8372898 - DNA, 22 bp, Homo sapiens
tccagggaagagcagaggctac

SEQ ID NO: 8372899 - DNA, 22 bp, Homo sapiens
tccagggaagagcagaggctac

SEQ ID NO: 8372900 - DNA, 22 bp, Homo sapiens
tccagggaaggtgtgaggctgg

SEQ ID NO: 8372901 - DNA, 22 bp, Homo sapiens
tccagggaagagcagaggctac

SEQ ID NO: 8372902 - DNA, 21 bp, Homo sapiens
tccagggaacttctcaggaat

SEQ ID NO: 8372903 - DNA, 21 bp, Homo sapiens
tccagggaacttctcaggaat

SEQ ID NO: 8372904 - DNA, 22 bp, Homo sapiens
tccaggcctgcaatgacaaagc

SEQ ID NO: 8372905 - DNA, 22 bp, Homo sapiens
tccaggcctgactataaatgta

SEQ ID NO: 8372906 - DNA, 21 bp, Homo sapiens
tccacaagttagaaggaaatt

SEQ ID NO: 8372907 - DNA, 22 bp, Homo sapiens
tccacaaggcagctcctccagg

SEQ ID NO: 8372908 - DNA, 22 bp, Homo sapiens
tccacaagatgataaagagagg

SEQ ID NO: 8372909 - DNA, 22 bp, Homo sapiens
tccaggccttgacaggtcagtt

SEQ ID NO: 8372910 - DNA, 20 bp, Homo sapiens
tccaggccttgttctcagat

SEQ ID NO: 8372911 - DNA, 22 bp, Homo sapiens
tccaggcctttgcacatgttgt

SEQ ID NO: 8372912 - DNA, 22 bp, Homo sapiens
tccaggctggctcttcaaaatt

SEQ ID NO: 8372913 - DNA, 22 bp, Homo sapiens
tcccagagatttcctctccttc

SEQ ID NO: 8372914 - DNA, 22 bp, Homo sapiens
tcccagagatttcctctccttc

SEQ ID NO: 8372915 - DNA, 22 bp, Homo sapiens
tcccagagatttcctctccttc

SEQ ID NO: 8372916 - DNA, 22 bp, Homo sapiens
tcccagagacatcatttctccg

SEQ ID NO: 8372917 - DNA, 22 bp, Homo sapiens
tcccagagacagagcctcctcc

SEQ ID NO: 8372918 - DNA, 22 bp, Homo sapiens
tcccagagacagagcctcctcc

SEQ ID NO: 8372919 - DNA, 22 bp, Homo sapiens
tcccagagccaagctatggatg

SEQ ID NO: 8372920 - DNA, 22 bp, Homo sapiens
tcccagagccaagctatggatg

SEQ ID NO: 8372921 - DNA, 22 bp, Homo sapiens
tcccagagcagtactccaggag

SEQ ID NO: 8372922 - DNA, 22 bp, Homo sapiens
tcccagagcagtactccaggag

SEQ ID NO: 8372923 - DNA, 22 bp, Homo sapiens
tcccagagcagatgtgctaaag

SEQ ID NO: 8372924 - DNA, 22 bp, Homo sapiens
tcccaagatgacacagtggacg

SEQ ID NO: 8372925 - DNA, 22 bp, Homo sapiens
tcccaaatataatgcaagagac

SEQ ID NO: 8372926 - DNA, 22 bp, Homo sapiens
tcccaaagtcaagctgtgtctt

SEQ ID NO: 8372927 - DNA, 22 bp, Homo sapiens
tcccaagacgatgtgcttggcc

SEQ ID NO: 8372928 - DNA, 22 bp, Homo sapiens
tcccaagacctggcatccaagt

SEQ ID NO: 8372929 - DNA, 22 bp, Homo sapiens
tccattgtgattatatacaaaa

SEQ ID NO: 8372930 - DNA, 22 bp, Homo sapiens
tccatttactattctcatatcg

SEQ ID NO: 8372931 - DNA, 22 bp, Homo sapiens
tccatttactattctcatatcg

SEQ ID NO: 8372932 - DNA, 22 bp, Homo sapiens
tccatttagctggcaaacaatg

SEQ ID NO: 8372933 - DNA, 22 bp, Homo sapiens
tccattatacttctgattcaaa

SEQ ID NO: 8372934 - DNA, 22 bp, Homo sapiens
tccattaatgattatttctgtg

SEQ ID NO: 8372935 - DNA, 22 bp, Homo sapiens
tccatgtgttttcctgtccaca

SEQ ID NO: 8372936 - DNA, 22 bp, Homo sapiens
tccatgtggcaataggagacag

SEQ ID NO: 8372937 - DNA, 22 bp, Homo sapiens
tccatgtgcttcctcaggggaa

SEQ ID NO: 8372938 - DNA, 22 bp, Homo sapiens
tccatgctcttgtctagcctcc

SEQ ID NO: 8372939 - DNA, 22 bp, Homo sapiens
tccatggagatggatgactgta

SEQ ID NO: 8372940 - DNA, 22 bp, Homo sapiens
tcccagaggttgagtcacttat

SEQ ID NO: 8372941 - DNA, 22 bp, Homo sapiens
tcccagaggtctctgctggttc

SEQ ID NO: 8372942 - DNA, 22 bp, Homo sapiens
tcccagaggctccagtctctat

SEQ ID NO: 8372943 - DNA, 22 bp, Homo sapiens
tcccagaggctccagtctctat

SEQ ID NO: 8372944 - DNA, 22 bp, Homo sapiens
tcccagcattaatgcctgtcag

SEQ ID NO: 8372945 - DNA, 22 bp, Homo sapiens
tcccagcccaggtatgatgata

SEQ ID NO: 8372946 - DNA, 22 bp, Homo sapiens
tcccagccggtgcctgggtccc

SEQ ID NO: 8372947 - DNA, 22 bp, Homo sapiens
tcccagcctcctgacagttttg

SEQ ID NO: 8372948 - DNA, 22 bp, Homo sapiens
tcccagccttccttgtggtgaa

SEQ ID NO: 8372949 - DNA, 22 bp, Homo sapiens
tcccagcctttctttctccagc

SEQ ID NO: 8372950 - DNA, 22 bp, Homo sapiens
tcccaggcgcctggtggggagc

SEQ ID NO: 8372951 - DNA, 22 bp, Homo sapiens
tcccaggccataaaactcagag

SEQ ID NO: 8372952 - DNA, 16 bp, Homo sapiens
tcccaggccaggtgga

SEQ ID NO: 8372953 - DNA, 22 bp, Homo sapiens
tcccagccttccagtctggttt

SEQ ID NO: 8372954 - DNA, 22 bp, Homo sapiens
tcccagccttatctcccctggc

SEQ ID NO: 8372955 - DNA, 22 bp, Homo sapiens
tcccagcctgacagtgcatcaa

SEQ ID NO: 8372956 - DNA, 22 bp, Homo sapiens
tcccagcctggaccctgccagt

SEQ ID NO: 8372957 - DNA, 22 bp, Homo sapiens
tcctcagatataaatgagggtg

SEQ ID NO: 8372958 - DNA, 22 bp, Homo sapiens
tcctcagagcatagcgctgtct

SEQ ID NO: 8372959 - DNA, 22 bp, Homo sapiens
tcctcagcatggaatctggact

SEQ ID NO: 8372960 - DNA, 23 bp, Homo sapiens
tcctcagcatgttttgtcatgta

SEQ ID NO: 8372961 - DNA, 23 bp, Homo sapiens
tcctcagcatgttttgtcatgta

SEQ ID NO: 8372962 - DNA, 22 bp, Homo sapiens
tcctcagcaggtctgtgtacca

SEQ ID NO: 8372963 - DNA, 19 bp, Homo sapiens
tcctcaggggctcacagac

SEQ ID NO: 8372964 - DNA, 21 bp, Homo sapiens
tcctcagggccccagagcact

SEQ ID NO: 8372965 - DNA, 22 bp, Homo sapiens
tcctcaggtcaaagcaggagaa

SEQ ID NO: 8372966 - DNA, 22 bp, Homo sapiens
tcctcaggtcaaagcaggagaa

SEQ ID NO: 8372967 - DNA, 22 bp, Homo sapiens
tcctcaggggtttcaggtgtac

SEQ ID NO: 8372968 - DNA, 22 bp, Homo sapiens
tcctcactgcagtgctccgagc

SEQ ID NO: 8372969 - DNA, 22 bp, Homo sapiens
tcctcagaatcacctggcagct

SEQ ID NO: 8372970 - DNA, 22 bp, Homo sapiens
tcctcagaatggatggcagggg

SEQ ID NO: 8372971 - DNA, 22 bp, Homo sapiens
tcctcagaaacccctgtgaggt

SEQ ID NO: 8372972 - DNA, 22 bp, Homo sapiens
tcctcagaagaacccctagatt

SEQ ID NO: 8372973 - DNA, 22 bp, Homo sapiens
tccctgggaccggcagctcaca

SEQ ID NO: 8372974 - DNA, 22 bp, Homo sapiens
tccctgggaccggcagctcaca

SEQ ID NO: 8372975 - DNA, 22 bp, Homo sapiens
tccctggcctggaaggatatca

SEQ ID NO: 8372976 - DNA, 22 bp, Homo sapiens
tccctggcagctaagggtggtc

SEQ ID NO: 8372977 - DNA, 22 bp, Homo sapiens
tccctgggagatgatgatgagg

SEQ ID NO: 8372978 - DNA, 22 bp, Homo sapiens
tccctgggcaagtttactcttc

SEQ ID NO: 8372979 - DNA, 22 bp, Homo sapiens
tccgtggggcctgtggcttccg

SEQ ID NO: 8372980 - DNA, 22 bp, Homo sapiens
tcctagaatagtgtgtctggag

SEQ ID NO: 8372981 - DNA, 22 bp, Homo sapiens
tcctagaataatctttgactgc

SEQ ID NO: 8372982 - DNA, 22 bp, Homo sapiens
tcctagaaggatcattctagtg

SEQ ID NO: 8372983 - DNA, 19 bp, Homo sapiens
tcctagaatgagggtgttg

SEQ ID NO: 8372984 - DNA, 22 bp, Homo sapiens
tcctagagagtaatacagtttt

SEQ ID NO: 8372985 - DNA, 22 bp, Homo sapiens
tcctaggatctggggtgttttt

SEQ ID NO: 8372986 - DNA, 19 bp, Homo sapiens
tcctagcacctggcacata

SEQ ID NO: 8372987 - DNA, 22 bp, Homo sapiens
tccctgcctcctggcagtgcca

SEQ ID NO: 8372988 - DNA, 22 bp, Homo sapiens
tccctgccctgccttcatggtt

SEQ ID NO: 8372989 - DNA, 22 bp, Homo sapiens
tccctgagaaagcccaggaggt

SEQ ID NO: 8372990 - DNA, 22 bp, Homo sapiens
tccctgaagccagggaaggaag

SEQ ID NO: 8372991 - DNA, 22 bp, Homo sapiens
tccctgaaatttgaagaggaat

SEQ ID NO: 8372992 - DNA, 22 bp, Homo sapiens
tccctgaatctcgaactagcct

SEQ ID NO: 8372993 - DNA, 22 bp, Homo sapiens
tccctgaaacatctctgtggat

SEQ ID NO: 8372994 - DNA, 22 bp, Homo sapiens
tccctgaaatttgaagaggaat

SEQ ID NO: 8372995 - DNA, 22 bp, Homo sapiens
tccctgaaacataatagatgcc

SEQ ID NO: 8372996 - DNA, 22 bp, Homo sapiens
tccctccccacttctgagcttt

SEQ ID NO: 8372997 - DNA, 22 bp, Homo sapiens
tccctccaggcagctgggtact

SEQ ID NO: 8372998 - DNA, 20 bp, Homo sapiens
tccctccctccagctctggg

SEQ ID NO: 8372999 - DNA, 22 bp, Homo sapiens
tcccagggactggatgatgcag

SEQ ID NO: 8373000 - DNA, 22 bp, Homo sapiens
tcccgcttcttccgaatcgcga

SEQ ID NO: 8373001 - DNA, 21 bp, Homo sapiens
tccctcagacagggtgcctat

SEQ ID NO: 8373002 - DNA, 22 bp, Homo sapiens
tccctcagattggcaattagat

SEQ ID NO: 8373003 - DNA, 22 bp, Homo sapiens
tcccaggctaccagtgaggtca

SEQ ID NO: 8373004 - DNA, 22 bp, Homo sapiens
tcccaggctaggcctctgcgtt

SEQ ID NO: 8373005 - DNA, 20 bp, Homo sapiens
tcccaggctccaccctagac

SEQ ID NO: 8373006 - DNA, 22 bp, Homo sapiens
tcccaggctggcaggcagcagt

SEQ ID NO: 8373007 - DNA, 22 bp, Homo sapiens
tcccaggctggcaggcagcagt

SEQ ID NO: 8373008 - DNA, 20 bp, Homo sapiens
tcccaggctccaccctagac

SEQ ID NO: 8373009 - DNA, 23 bp, Homo sapiens
tcccagggaaggtgagcgaggct

SEQ ID NO: 8373010 - DNA, 23 bp, Homo sapiens
tcccagggaaggtgagcgaggct

SEQ ID NO: 8373011 - DNA, 22 bp, Homo sapiens
tcccaggctggggccaggtgac

SEQ ID NO: 8373012 - DNA, 22 bp, Homo sapiens
tcccaggctggggccaggtgac

SEQ ID NO: 8373013 - DNA, 20 bp, Homo sapiens
tcccaggctgggctccagct

SEQ ID NO: 8373014 - DNA, 22 bp, Homo sapiens
gagggccaggcagcaagaaggc

SEQ ID NO: 8373015 - DNA, 22 bp, Homo sapiens
gagggccagagtcctggggtca

SEQ ID NO: 8373016 - DNA, 22 bp, Homo sapiens
gagggccagatcccaggaggaa

SEQ ID NO: 8373017 - DNA, 22 bp, Homo sapiens
gagggccacttgaatgttttca

SEQ ID NO: 8373018 - DNA, 22 bp, Homo sapiens
gagggccagaaagttattgaga

SEQ ID NO: 8373019 - DNA, 22 bp, Homo sapiens
gagggaccccaggctggccctt

SEQ ID NO: 8373020 - DNA, 22 bp, Homo sapiens
gagggagaaggactatcaggct

SEQ ID NO: 8373021 - DNA, 22 bp, Homo sapiens
gagggagaaggactatcaggct

SEQ ID NO: 8373022 - DNA, 22 bp, Homo sapiens
gagggaagtcataatgttctag

SEQ ID NO: 8373023 - DNA, 22 bp, Homo sapiens
gagggaagtcataatgttctag

SEQ ID NO: 8373024 - DNA, 22 bp, Homo sapiens
gaggctggtttgccttttggca

SEQ ID NO: 8373025 - DNA, 22 bp, Homo sapiens
gaggctgtctgttagcctggga

SEQ ID NO: 8373026 - DNA, 21 bp, Homo sapiens
gaggctgtctgctgctggcct

SEQ ID NO: 8373027 - DNA, 22 bp, Homo sapiens
gagggaagaggcctgacatttt

SEQ ID NO: 8373028 - DNA, 22 bp, Homo sapiens
gagggaagagggtttgaattca

SEQ ID NO: 8373029 - DNA, 22 bp, Homo sapiens
gagggaagagggtttgaattca

SEQ ID NO: 8373030 - DNA, 22 bp, Homo sapiens
gagggaagattccccatatggg

SEQ ID NO: 8373031 - DNA, 22 bp, Homo sapiens
gagggaagattccccatatggg

SEQ ID NO: 8373032 - DNA, 22 bp, Homo sapiens
gagggaagattccccatatggg

SEQ ID NO: 8373033 - DNA, 22 bp, Homo sapiens
gagggaaggtcacccttgtagc

SEQ ID NO: 8373034 - DNA, 22 bp, Homo sapiens
gagggaaggtcacccttgtagc

SEQ ID NO: 8373035 - DNA, 22 bp, Homo sapiens
gagggaaggtcacccttgtagc

SEQ ID NO: 8373036 - DNA, 22 bp, Homo sapiens
gagggaagattccccatatggg

SEQ ID NO: 8373037 - DNA, 22 bp, Homo sapiens
gagggaaggacccattttaagt

SEQ ID NO: 8373038 - DNA, 22 bp, Homo sapiens
gagggaaggagagttgtagctg

SEQ ID NO: 8373039 - DNA, 22 bp, Homo sapiens
gaggcctggtttgcatgagaat

SEQ ID NO: 8373040 - DNA, 22 bp, Homo sapiens
gaggcctgtagtcatggatgta

SEQ ID NO: 8373041 - DNA, 19 bp, Homo sapiens
gaggcgaggcgtgcaggag

SEQ ID NO: 8373042 - DNA, 22 bp, Homo sapiens
gaggccttcagaaggcattagt

SEQ ID NO: 8373043 - DNA, 22 bp, Homo sapiens
gaggccttcctctcaagcacat

SEQ ID NO: 8373044 - DNA, 22 bp, Homo sapiens
gaggctggttcccttgatcttt

SEQ ID NO: 8373045 - DNA, 22 bp, Homo sapiens
gaggctggttcccttgatcttt

SEQ ID NO: 8373046 - DNA, 22 bp, Homo sapiens
gaggctggttctgaagtactgt

SEQ ID NO: 8373047 - DNA, 22 bp, Homo sapiens
gaggctggttctgaagtactgt

SEQ ID NO: 8373048 - DNA, 22 bp, Homo sapiens
gaggctggtcagccctaagatc

SEQ ID NO: 8373049 - DNA, 22 bp, Homo sapiens
gaggctggtggttagttccatt

SEQ ID NO: 8373050 - DNA, 22 bp, Homo sapiens
gaggctggtaggaaaggaaaca

SEQ ID NO: 8373051 - DNA, 22 bp, Homo sapiens
gaggctggggtctgcctttctg

SEQ ID NO: 8373052 - DNA, 22 bp, Homo sapiens
gaggcggcggccgagcctggct

SEQ ID NO: 8373053 - DNA, 23 bp, Homo sapiens
gaggtgtgaattctgggtgctgc

SEQ ID NO: 8373054 - DNA, 22 bp, Homo sapiens
gaggtgggagggcagtccctaa

SEQ ID NO: 8373055 - DNA, 22 bp, Homo sapiens
gagtaaaagttggattacaaag

SEQ ID NO: 8373056 - DNA, 22 bp, Homo sapiens
gagtaaggctgctgatggagtg

SEQ ID NO: 8373057 - DNA, 22 bp, Homo sapiens
gaggtggctccttcagggaata

SEQ ID NO: 8373058 - DNA, 22 bp, Homo sapiens
gaggtggctgcttgctgggaaa

SEQ ID NO: 8373059 - DNA, 22 bp, Homo sapiens
gaggtggctggctcagagccag

SEQ ID NO: 8373060 - DNA, 22 bp, Homo sapiens
gaggtgagaagggggtcagatg

SEQ ID NO: 8373061 - DNA, 22 bp, Homo sapiens
gaggtgagtggatcacgaggtc

SEQ ID NO: 8373062 - DNA, 22 bp, Homo sapiens
gaggtgagaagggggtcagatg

SEQ ID NO: 8373063 - DNA, 22 bp, Homo sapiens
gagggtgggtttcttgcacgtc

SEQ ID NO: 8373064 - DNA, 22 bp, Homo sapiens
gagggtgggctcctatctgggt

SEQ ID NO: 8373065 - DNA, 22 bp, Homo sapiens
gagggtggggaatagactgcta

SEQ ID NO: 8373066 - DNA, 22 bp, Homo sapiens
gagggtggggaatagactgcta

SEQ ID NO: 8373067 - DNA, 22 bp, Homo sapiens
gagggtggaaagggtgtacctg

SEQ ID NO: 8373068 - DNA, 22 bp, Homo sapiens
gagggtggctcctccctgggcc

SEQ ID NO: 8373069 - DNA, 22 bp, Homo sapiens
gagggtggcctttagagcccat

SEQ ID NO: 8373070 - DNA, 22 bp, Homo sapiens
gagggtggcctttagagcccat

SEQ ID NO: 8373071 - DNA, 22 bp, Homo sapiens
gaggccagaagtgcctcgggct

SEQ ID NO: 8373072 - DNA, 22 bp, Homo sapiens
gaggcaaagcatgtggctcagg

SEQ ID NO: 8373073 - DNA, 22 bp, Homo sapiens
gaggatggtgagcaggacccag

SEQ ID NO: 8373074 - DNA, 22 bp, Homo sapiens
gaggatggtgagcaggacccag

SEQ ID NO: 8373075 - DNA, 22 bp, Homo sapiens
gaggactctgcaggctgctcct

SEQ ID NO: 8373076 - DNA, 22 bp, Homo sapiens
gaggaccacagatgagcctgca

SEQ ID NO: 8373077 - DNA, 22 bp, Homo sapiens
gaggagagaagctaacggtgct

SEQ ID NO: 8373078 - DNA, 22 bp, Homo sapiens
gaggagagaacattcctccata

SEQ ID NO: 8373079 - DNA, 22 bp, Homo sapiens
gaggagagaacattcctccata

SEQ ID NO: 8373080 - DNA, 22 bp, Homo sapiens
gaggactgaaacttacaggaaa

SEQ ID NO: 8373081 - DNA, 18 bp, Homo sapiens
gaggatggaaggagatgc

SEQ ID NO: 8373082 - DNA, 18 bp, Homo sapiens
gaggatggaaggagatgc

SEQ ID NO: 8373083 - DNA, 18 bp, Homo sapiens
gaggatggaaggagatgc

SEQ ID NO: 8373084 - DNA, 22 bp, Homo sapiens
gaggatggaggcagttagggcc

SEQ ID NO: 8373085 - DNA, 22 bp, Homo sapiens
gaggagtgtattccacaccact

SEQ ID NO: 8373086 - DNA, 22 bp, Homo sapiens
gaggagtgggttagtgcttatt

SEQ ID NO: 8373087 - DNA, 22 bp, Homo sapiens
gaggagtggagttgctgggttg

SEQ ID NO: 8373088 - DNA, 22 bp, Homo sapiens
gaggagagagggactgtctgca

SEQ ID NO: 8373089 - DNA, 22 bp, Homo sapiens
gaggagagaagctaacggtgct

SEQ ID NO: 8373090 - DNA, 22 bp, Homo sapiens
gaggagtgccagccgtggagtc

SEQ ID NO: 8373091 - DNA, 22 bp, Homo sapiens
gaggagtctttttagggcctga

SEQ ID NO: 8373092 - DNA, 22 bp, Homo sapiens
gaggagtctttttagggcctga

SEQ ID NO: 8373093 - DNA, 17 bp, Homo sapiens
gaggacagggaagtagg

SEQ ID NO: 8373094 - DNA, 22 bp, Homo sapiens
gagcaggcctggggtgaggcct

SEQ ID NO: 8373095 - DNA, 19 bp, Homo sapiens
gagcaggccacacatgtgt

SEQ ID NO: 8373096 - DNA, 22 bp, Homo sapiens
gagcaggccagcaatggaaggg

SEQ ID NO: 8373097 - DNA, 22 bp, Homo sapiens
gagctcagactcgggcctgggg

SEQ ID NO: 8373098 - DNA, 22 bp, Homo sapiens
gagcaggcattctagtggctga

SEQ ID NO: 8373099 - DNA, 22 bp, Homo sapiens
gagcaggacgtgggaatgggaa

SEQ ID NO: 8373100 - DNA, 22 bp, Homo sapiens
gagcaggatgggagctggggcc

SEQ ID NO: 8373101 - DNA, 22 bp, Homo sapiens
gagcaggcaaagatgaaaggag

SEQ ID NO: 8373102 - DNA, 22 bp, Homo sapiens
gagcaggcaaagatgaaaggag

SEQ ID NO: 8373103 - DNA, 22 bp, Homo sapiens
gagctcagcactaaaatcatgt

SEQ ID NO: 8373104 - DNA, 22 bp, Homo sapiens
gagctcagattctggtgtcaga

SEQ ID NO: 8373105 - DNA, 22 bp, Homo sapiens
gagctcagcaaaggtctgtgtg

SEQ ID NO: 8373106 - DNA, 22 bp, Homo sapiens
gagctcagcctgaggcctggct

SEQ ID NO: 8373107 - DNA, 22 bp, Homo sapiens
gagctccagcatctctgccaaa

SEQ ID NO: 8373108 - DNA, 22 bp, Homo sapiens
gagctccagcatctctgccaaa

SEQ ID NO: 8373109 - DNA, 22 bp, Homo sapiens
gagctccacttagcaaggccac

SEQ ID NO: 8373110 - DNA, 22 bp, Homo sapiens
gagctccaccaccttcaggcag

SEQ ID NO: 8373111 - DNA, 22 bp, Homo sapiens
gagctcattgtggatggatggg

SEQ ID NO: 8373112 - DNA, 22 bp, Homo sapiens
gagctcaggtggtcaaaacaat

SEQ ID NO: 8373113 - DNA, 22 bp, Homo sapiens
gagctcagggcattgagcaaga

SEQ ID NO: 8373114 - DNA, 22 bp, Homo sapiens
gagctcagtgtagtcatggctt

SEQ ID NO: 8373115 - DNA, 22 bp, Homo sapiens
gaattacatagtttctaggttc

SEQ ID NO: 8373116 - DNA, 22 bp, Homo sapiens
gaattacataataaaatgagag

SEQ ID NO: 8373117 - DNA, 22 bp, Homo sapiens
gaattacataataaaatgagag

SEQ ID NO: 8373118 - DNA, 22 bp, Homo sapiens
gaattacagccagaagaatgaa

SEQ ID NO: 8373119 - DNA, 22 bp, Homo sapiens
gaatgtttttaggaatgttatg

SEQ ID NO: 8373120 - DNA, 22 bp, Homo sapiens
gaatgtttgtgcagagtcatct

SEQ ID NO: 8373121 - DNA, 22 bp, Homo sapiens
gaattaaaatagttttggtcga

SEQ ID NO: 8373122 - DNA, 22 bp, Homo sapiens
gaatgctttgggaattcagaat

SEQ ID NO: 8373123 - DNA, 22 bp, Homo sapiens
gaatggcatagctttctttaca

SEQ ID NO: 8373124 - DNA, 22 bp, Homo sapiens
gaatgctgtagacagactctat

SEQ ID NO: 8373125 - DNA, 22 bp, Homo sapiens
gaatgcttggaacctgaagttc

SEQ ID NO: 8373126 - DNA, 22 bp, Homo sapiens
gaatgctgagtcttatctctta

SEQ ID NO: 8373127 - DNA, 22 bp, Homo sapiens
gaatggctgaatgtcttaaatt

SEQ ID NO: 8373128 - DNA, 23 bp, Homo sapiens
gaatggctaagcacatagacttg

SEQ ID NO: 8373129 - DNA, 22 bp, Homo sapiens
gaatggctatcggattattagg

SEQ ID NO: 8373130 - DNA, 19 bp, Homo sapiens
gaatgtttgtattcagcgc

SEQ ID NO: 8373131 - DNA, 21 bp, Homo sapiens
gaagacaaatgggaatagctg

SEQ ID NO: 8373132 - DNA, 22 bp, Homo sapiens
gaatgctaagcatgtgggagtt

SEQ ID NO: 8373133 - DNA, 22 bp, Homo sapiens
gaatgcattctcttagcatcta

SEQ ID NO: 8373134 - DNA, 22 bp, Homo sapiens
gaatgcattctcttagcatcta

SEQ ID NO: 8373135 - DNA, 22 bp, Homo sapiens
gaatgctaagcatgtgggagtt

SEQ ID NO: 8373136 - DNA, 22 bp, Homo sapiens
gaatgcatgtgaagcaaagaat

SEQ ID NO: 8373137 - DNA, 22 bp, Homo sapiens
gaagaatattcttgatcttaga

SEQ ID NO: 8373138 - DNA, 22 bp, Homo sapiens
gaagaatatggctctcagcaat

SEQ ID NO: 8373139 - DNA, 22 bp, Homo sapiens
gaagaagtgtaagtctgtttca

SEQ ID NO: 8373140 - DNA, 22 bp, Homo sapiens
gaagaagtcattctgtctttca

SEQ ID NO: 8373141 - DNA, 22 bp, Homo sapiens
gacaaaggatcagaggttggga

SEQ ID NO: 8373142 - DNA, 22 bp, Homo sapiens
gacaaagcagacaagataattc

SEQ ID NO: 8373143 - DNA, 22 bp, Homo sapiens
gacagcaggatgtgaggggatg

SEQ ID NO: 8373144 - DNA, 22 bp, Homo sapiens
gacagcaggatgtgaggggatg

SEQ ID NO: 8373145 - DNA, 22 bp, Homo sapiens
gacagcagggacatgtaggaag

SEQ ID NO: 8373146 - DNA, 22 bp, Homo sapiens
gacagcagggaaagtccagacc

SEQ ID NO: 8373147 - DNA, 22 bp, Homo sapiens
gacagcagggaaagtccagacc

SEQ ID NO: 8373148 - DNA, 22 bp, Homo sapiens
gacagcagggaaagtccagacc

SEQ ID NO: 8373149 - DNA, 22 bp, Homo sapiens
gacagcagccacagggagaggg

SEQ ID NO: 8373150 - DNA, 22 bp, Homo sapiens
gacagcagccacagggagaggg

SEQ ID NO: 8373151 - DNA, 22 bp, Homo sapiens
gacaaaagtgttttgaacaagg

SEQ ID NO: 8373152 - DNA, 21 bp, Homo sapiens
gacaaacatttcatagcttta

SEQ ID NO: 8373153 - DNA, 22 bp, Homo sapiens
gacaaaactgagatcacactgt

SEQ ID NO: 8373154 - DNA, 22 bp, Homo sapiens
gacaaaactgagatcacactgt

SEQ ID NO: 8373155 - DNA, 18 bp, Homo sapiens
gacaaaagtacagacaga

SEQ ID NO: 8373156 - DNA, 20 bp, Homo sapiens
gaattttatgaacactacca

SEQ ID NO: 8373157 - DNA, 20 bp, Homo sapiens
gaattttatgaacactacca

SEQ ID NO: 8373158 - DNA, 22 bp, Homo sapiens
gaatttaaggaccaagcatttt

SEQ ID NO: 8373159 - DNA, 22 bp, Homo sapiens
gaatttttctggaagcaattat

SEQ ID NO: 8373160 - DNA, 22 bp, Homo sapiens
gaattttattactagtcaactg

SEQ ID NO: 8373161 - DNA, 22 bp, Homo sapiens
gacaaaacacattagtttaaaa

SEQ ID NO: 8373162 - DNA, 22 bp, Homo sapiens
gaatttttctggaagcaattat

SEQ ID NO: 8373163 - DNA, 22 bp, Homo sapiens
gaatttttctggaagcaattat

SEQ ID NO: 8373164 - DNA, 22 bp, Homo sapiens
gaatttttctggaagcaattat

SEQ ID NO: 8373165 - DNA, 22 bp, Homo sapiens
gacatgttatctctggcttcaa

SEQ ID NO: 8373166 - DNA, 22 bp, Homo sapiens
gacctgctccacgacaagtggt

SEQ ID NO: 8373167 - DNA, 22 bp, Homo sapiens
gacctgcccactctgaggacat

SEQ ID NO: 8373168 - DNA, 22 bp, Homo sapiens
gacatgaatgttatactttatt

SEQ ID NO: 8373169 - DNA, 22 bp, Homo sapiens
gacatgcagttctcaagggtag

SEQ ID NO: 8373170 - DNA, 22 bp, Homo sapiens
gacatgcatgaatgcaggtctc

SEQ ID NO: 8373171 - DNA, 22 bp, Homo sapiens
gacatgtattagtcatgcacag

SEQ ID NO: 8373172 - DNA, 22 bp, Homo sapiens
gacctggtgcaggtggacagag

SEQ ID NO: 8373173 - DNA, 22 bp, Homo sapiens
gacctggtgctagctggtgtgt

SEQ ID NO: 8373174 - DNA, 22 bp, Homo sapiens
gaccttctgttggaggcattta

SEQ ID NO: 8373175 - DNA, 22 bp, Homo sapiens
gaccttccttctttgctccggg

SEQ ID NO: 8373176 - DNA, 22 bp, Homo sapiens
gaccttccatgccttcttccaa

SEQ ID NO: 8373177 - DNA, 22 bp, Homo sapiens
gaccttgtgatccacccgcctt

SEQ ID NO: 8373178 - DNA, 22 bp, Homo sapiens
gactatctgccaggtcccaggg

SEQ ID NO: 8373179 - DNA, 22 bp, Homo sapiens
gacagcctcatgtgcatgaact

SEQ ID NO: 8373180 - DNA, 22 bp, Homo sapiens
gacagcctcatgtgcatgaact

SEQ ID NO: 8373181 - DNA, 22 bp, Homo sapiens
gacagcctcatgaggagcaaaa

SEQ ID NO: 8373182 - DNA, 22 bp, Homo sapiens
gacagcattccatctgcaggtt

SEQ ID NO: 8373183 - DNA, 22 bp, Homo sapiens
gacagcatctgtgtggcaggag

SEQ ID NO: 8373184 - DNA, 22 bp, Homo sapiens
gacagcatccaagagggaggga

SEQ ID NO: 8373185 - DNA, 22 bp, Homo sapiens
gacagcatgatcaaggagccca

SEQ ID NO: 8373186 - DNA, 22 bp, Homo sapiens
gacagcagtcctggagttccca

SEQ ID NO: 8373187 - DNA, 22 bp, Homo sapiens
gacagcagtcctggagttccca

SEQ ID NO: 8373188 - DNA, 22 bp, Homo sapiens
gacagcaggtgcttgggaaagg

SEQ ID NO: 8373189 - DNA, 22 bp, Homo sapiens
gacagcagggacatgtaggaag

SEQ ID NO: 8373190 - DNA, 22 bp, Homo sapiens
gacagcagggacatgtaggaag

SEQ ID NO: 8373191 - DNA, 22 bp, Homo sapiens
gacagcaggtaattagttaaca

SEQ ID NO: 8373192 - DNA, 22 bp, Homo sapiens
gacagcaggtgcttgggaaagg

SEQ ID NO: 8373193 - DNA, 22 bp, Homo sapiens
gacatcaggaagacatgagagg

SEQ ID NO: 8373194 - DNA, 22 bp, Homo sapiens
gacatctgaatattagagagaa

SEQ ID NO: 8373195 - DNA, 22 bp, Homo sapiens
gacatctgaggccctcagagcc

SEQ ID NO: 8373196 - DNA, 22 bp, Homo sapiens
gacagtctgggcacacatgaaa

SEQ ID NO: 8373197 - DNA, 22 bp, Homo sapiens
gacagtgcatttcctggcatgg

SEQ ID NO: 8373198 - DNA, 22 bp, Homo sapiens
gacagctgtacactcctggtta

SEQ ID NO: 8373199 - DNA, 22 bp, Homo sapiens
gagcacagtaaagcagtgtcac

SEQ ID NO: 8373200 - DNA, 22 bp, Homo sapiens
gagcacagtgtgttgtgatttc

SEQ ID NO: 8373201 - DNA, 22 bp, Homo sapiens
gagcacgttgaagcgcactgtc

SEQ ID NO: 8373202 - DNA, 22 bp, Homo sapiens
gagcactgatttatttttgtct

SEQ ID NO: 8373203 - DNA, 22 bp, Homo sapiens
gagcagagacagtacaactggc

SEQ ID NO: 8373204 - DNA, 19 bp, Homo sapiens
gagcagcttcctatctggt

SEQ ID NO: 8373205 - DNA, 22 bp, Homo sapiens
gagcaggaactgaaaatgagac

SEQ ID NO: 8373206 - DNA, 22 bp, Homo sapiens
gagcaggaaggccagaagggtc

SEQ ID NO: 8373207 - DNA, 22 bp, Homo sapiens
gagcacagaaggagaaatatgg

SEQ ID NO: 8373208 - DNA, 22 bp, Homo sapiens
gagcacagaactaaatgctggt

SEQ ID NO: 8373209 - DNA, 22 bp, Homo sapiens
gagcacagaactaaatgctggt

SEQ ID NO: 8373210 - DNA, 22 bp, Homo sapiens
gagcacagaactaaatgctggt

SEQ ID NO: 8373211 - DNA, 22 bp, Homo sapiens
gagcaaggtagctctctggggc

SEQ ID NO: 8373212 - DNA, 22 bp, Homo sapiens
gagcaaggcggcatctctctga

SEQ ID NO: 8373213 - DNA, 22 bp, Homo sapiens
gagcaacactccacattgctag

SEQ ID NO: 8373214 - DNA, 22 bp, Homo sapiens
gagcaaatggagcttgtctact

SEQ ID NO: 8373215 - DNA, 22 bp, Homo sapiens
gagatttttcaacaagaatagg

SEQ ID NO: 8373216 - DNA, 22 bp, Homo sapiens
gagcaaaataaattctgacaaa

SEQ ID NO: 8373217 - DNA, 22 bp, Homo sapiens
gagaggcagaggcctgaaaccg

SEQ ID NO: 8373218 - DNA, 22 bp, Homo sapiens
gagaggcaggaatcctgggtga

SEQ ID NO: 8373219 - DNA, 22 bp, Homo sapiens
gagaggcaggcgctgcaatggt

SEQ ID NO: 8373220 - DNA, 22 bp, Homo sapiens
gagaggcaggaatcctgggtga

SEQ ID NO: 8373221 - DNA, 18 bp, Homo sapiens
gagaggagccagaatttt

SEQ ID NO: 8373222 - DNA, 18 bp, Homo sapiens
gagaggagccagaatttt

SEQ ID NO: 8373223 - DNA, 22 bp, Homo sapiens
gagaggaggtggctatgacagc

SEQ ID NO: 8373224 - DNA, 22 bp, Homo sapiens
gagaggagtaggctgatggtgc

SEQ ID NO: 8373225 - DNA, 22 bp, Homo sapiens
gagaggagtccctatcacagtt

SEQ ID NO: 8373226 - DNA, 22 bp, Homo sapiens
gagagctgtcagcgtagcaccg

SEQ ID NO: 8373227 - DNA, 22 bp, Homo sapiens
gagagctgtccggctgagcagc

SEQ ID NO: 8373228 - DNA, 22 bp, Homo sapiens
gagagctgtccggctgagcagc

SEQ ID NO: 8373229 - DNA, 22 bp, Homo sapiens
gagaggagacttatccagattg

SEQ ID NO: 8373230 - DNA, 22 bp, Homo sapiens
gagaggagaagcctgcgcttca

SEQ ID NO: 8373231 - DNA, 22 bp, Homo sapiens
gagagccctacaaggcgttttg

SEQ ID NO: 8373232 - DNA, 18 bp, Homo sapiens
gagagcccagcaggtggt

SEQ ID NO: 8373233 - DNA, 18 bp, Homo sapiens
gagagcccagcaggtggt

SEQ ID NO: 8373234 - DNA, 22 bp, Homo sapiens
gagagccagcagtaaagacatt

SEQ ID NO: 8373235 - DNA, 22 bp, Homo sapiens
gagagcaggctctcgggggcca

SEQ ID NO: 8373236 - DNA, 22 bp, Homo sapiens
gagagcaggaggcagcgggacg

SEQ ID NO: 8373237 - DNA, 22 bp, Homo sapiens
gagagcaggaggcagcgggacg

SEQ ID NO: 8373238 - DNA, 22 bp, Homo sapiens
gagagcaggaggcagcgggacg

SEQ ID NO: 8373239 - DNA, 22 bp, Homo sapiens
gagagagaaggcctgtgggtgt

SEQ ID NO: 8373240 - DNA, 22 bp, Homo sapiens
gagagagaaccccgtgcccttc

SEQ ID NO: 8373241 - DNA, 22 bp, Homo sapiens
gagaagaaatagaatcacattt

SEQ ID NO: 8373242 - DNA, 22 bp, Homo sapiens
gagaagaaaattccgtgaacac

SEQ ID NO: 8373243 - DNA, 22 bp, Homo sapiens
gagaagaacttgggcaaagtca

SEQ ID NO: 8373244 - DNA, 22 bp, Homo sapiens
gagaagcaatcagcagccaccc

SEQ ID NO: 8373245 - DNA, 22 bp, Homo sapiens
gagaactcagacgcaggtcatg

SEQ ID NO: 8373246 - DNA, 19 bp, Homo sapiens
gactccaactttaagcatg

SEQ ID NO: 8373247 - DNA, 22 bp, Homo sapiens
gagaaagggaacttacagagtg

SEQ ID NO: 8373248 - DNA, 22 bp, Homo sapiens
gagaagcaatcagtggccaccc

SEQ ID NO: 8373249 - DNA, 22 bp, Homo sapiens
gagaagcaatcagtggccaccc

SEQ ID NO: 8373250 - DNA, 22 bp, Homo sapiens
gagaagcaggtttagcagacaa

SEQ ID NO: 8373251 - DNA, 22 bp, Homo sapiens
gagaagccgagtcagctgagcc

SEQ ID NO: 8373252 - DNA, 22 bp, Homo sapiens
gagagaagaacaatgtcattca

SEQ ID NO: 8373253 - DNA, 22 bp, Homo sapiens
gagagaagaacaatgtcattca

SEQ ID NO: 8373254 - DNA, 22 bp, Homo sapiens
gagagaagggggatatgagcct

SEQ ID NO: 8373255 - DNA, 22 bp, Homo sapiens
cttgcctgctggagcagggctc

SEQ ID NO: 8373256 - DNA, 22 bp, Homo sapiens
cttgctggtattttctctctca

SEQ ID NO: 8373257 - DNA, 22 bp, Homo sapiens
cttgctggtggtgttttctatg

SEQ ID NO: 8373258 - DNA, 22 bp, Homo sapiens
cttgctggtgtcgtgccttcac

SEQ ID NO: 8373259 - DNA, 22 bp, Homo sapiens
cttcttctggacaggcagctcc

SEQ ID NO: 8373260 - DNA, 22 bp, Homo sapiens
cttcttcatgtattgatagtct

SEQ ID NO: 8373261 - DNA, 22 bp, Homo sapiens
cttcttccaagcttatgctcaa

SEQ ID NO: 8373262 - DNA, 22 bp, Homo sapiens
cttggaaaggaatcttttacca

SEQ ID NO: 8373263 - DNA, 22 bp, Homo sapiens
cttggaaagttatcattttcct

SEQ ID NO: 8373264 - DNA, 22 bp, Homo sapiens
cttgctttgtccagaaattcag

SEQ ID NO: 8373265 - DNA, 22 bp, Homo sapiens
cttgctttccaaatgactcact

SEQ ID NO: 8373266 - DNA, 22 bp, Homo sapiens
cttggaaagaatatatgatgct

SEQ ID NO: 8373267 - DNA, 22 bp, Homo sapiens
cttgcttttgctgatgattaag

SEQ ID NO: 8373268 - DNA, 22 bp, Homo sapiens
cttgctgttgtgggagactggg

SEQ ID NO: 8373269 - DNA, 22 bp, Homo sapiens
cttgctttatctggtttctcat

SEQ ID NO: 8373270 - DNA, 22 bp, Homo sapiens
cttgctttcagtctcggcctca

SEQ ID NO: 8373271 - DNA, 22 bp, Homo sapiens
cttggagaaaggaaagggcttg

SEQ ID NO: 8373272 - DNA, 22 bp, Homo sapiens
cttggacccactcccagaattg

SEQ ID NO: 8373273 - DNA, 22 bp, Homo sapiens
cttggaatggggcagaaaatgg

SEQ ID NO: 8373274 - DNA, 22 bp, Homo sapiens
cttggaaggctggttctccctc

SEQ ID NO: 8373275 - DNA, 22 bp, Homo sapiens
cttggagacaggacaggcagaa

SEQ ID NO: 8373276 - DNA, 22 bp, Homo sapiens
ctttcctccactccctaggctt

SEQ ID NO: 8373277 - DNA, 22 bp, Homo sapiens
ctttcctctggcactgtctggt

SEQ ID NO: 8373278 - DNA, 22 bp, Homo sapiens
ctttccttctcgtggttctcac

SEQ ID NO: 8373279 - DNA, 22 bp, Homo sapiens
ctttccttaataagcaggtata

SEQ ID NO: 8373280 - DNA, 22 bp, Homo sapiens
ctttcctagtagttacagaatg

SEQ ID NO: 8373281 - DNA, 22 bp, Homo sapiens
ctttcctagttggtcccagcac

SEQ ID NO: 8373282 - DNA, 22 bp, Homo sapiens
cttggaggaaggggctcttctg

SEQ ID NO: 8373283 - DNA, 22 bp, Homo sapiens
cttggaggatgtgcggctgccc

SEQ ID NO: 8373284 - DNA, 22 bp, Homo sapiens
ctttctccctgtcccaaactgg

SEQ ID NO: 8373285 - DNA, 22 bp, Homo sapiens
ctttctcagtgttaattacttt

SEQ ID NO: 8373286 - DNA, 20 bp, Homo sapiens
ctttctctaatttataagta

SEQ ID NO: 8373287 - DNA, 20 bp, Homo sapiens
ctttctctaatttataagta

SEQ ID NO: 8373288 - DNA, 20 bp, Homo sapiens
ctttctctaatttataagta

SEQ ID NO: 8373289 - DNA, 22 bp, Homo sapiens
ctttggaacaagaagaaatggc

SEQ ID NO: 8373290 - DNA, 22 bp, Homo sapiens
ctttggaacacatgggcatggt

SEQ ID NO: 8373291 - DNA, 22 bp, Homo sapiens
ctttctctgtgtttcacatgct

SEQ ID NO: 8373292 - DNA, 22 bp, Homo sapiens
ctttctctgtgtttcacatgct

SEQ ID NO: 8373293 - DNA, 22 bp, Homo sapiens
ctttctcttcactgtcatgatc

SEQ ID NO: 8373294 - DNA, 22 bp, Homo sapiens
cttcagaaactagtaacagcta

SEQ ID NO: 8373295 - DNA, 22 bp, Homo sapiens
cttcactgtttggttcacagca

SEQ ID NO: 8373296 - DNA, 22 bp, Homo sapiens
cttcactgtttggttcacagca

SEQ ID NO: 8373297 - DNA, 22 bp, Homo sapiens
cttcagaaccagccagaagagg

SEQ ID NO: 8373298 - DNA, 22 bp, Homo sapiens
cttcagaaataacaacaattac

SEQ ID NO: 8373299 - DNA, 22 bp, Homo sapiens
cttcagaaataacaacaattac

SEQ ID NO: 8373300 - DNA, 22 bp, Homo sapiens
cttcagaaataacaacaattac

SEQ ID NO: 8373301 - DNA, 22 bp, Homo sapiens
cttcacattagtttggatcaaa

SEQ ID NO: 8373302 - DNA, 22 bp, Homo sapiens
cttcacattgggcttgatatga

SEQ ID NO: 8373303 - DNA, 22 bp, Homo sapiens
cttcacattgggcttgatatga

SEQ ID NO: 8373304 - DNA, 22 bp, Homo sapiens
cttcacatttgcgaaggccaaa

SEQ ID NO: 8373305 - DNA, 22 bp, Homo sapiens
cttcacatctccctaaaacagc

SEQ ID NO: 8373306 - DNA, 22 bp, Homo sapiens
cttcacataaacaaagggccat

SEQ ID NO: 8373307 - DNA, 22 bp, Homo sapiens
cttcacatgttggagtcctttg

SEQ ID NO: 8373308 - DNA, 19 bp, Homo sapiens
cttcacatctgtgagggga

SEQ ID NO: 8373309 - DNA, 19 bp, Homo sapiens
cttcacatctgtgagggga

SEQ ID NO: 8373310 - DNA, 22 bp, Homo sapiens
cttcacatgggtactgctgatc

SEQ ID NO: 8373311 - DNA, 22 bp, Homo sapiens
cttcacatgatgtccgtgctgt

SEQ ID NO: 8373312 - DNA, 22 bp, Homo sapiens
ctgttaaagatagttaagcttc

SEQ ID NO: 8373313 - DNA, 22 bp, Homo sapiens
ctgttaaagtgatcctttgtta

SEQ ID NO: 8373314 - DNA, 22 bp, Homo sapiens
ctgttaaatagactgcagtgca

SEQ ID NO: 8373315 - DNA, 22 bp, Homo sapiens
ctgttaaaatgtggtcttaaaa

SEQ ID NO: 8373316 - DNA, 20 bp, Homo sapiens
ctgttaaaaggtatgaattc

SEQ ID NO: 8373317 - DNA, 22 bp, Homo sapiens
ctgttaaaaagaccaatggatt

SEQ ID NO: 8373318 - DNA, 22 bp, Homo sapiens
ctgttaaaagcactgccatcct

SEQ ID NO: 8373319 - DNA, 22 bp, Homo sapiens
cttcaaatccccctgagtttga

SEQ ID NO: 8373320 - DNA, 22 bp, Homo sapiens
cttcaaatcctgtgtagggcta

SEQ ID NO: 8373321 - DNA, 22 bp, Homo sapiens
cttcaaatacaagtagattatg

SEQ ID NO: 8373322 - DNA, 22 bp, Homo sapiens
ctgttaaatgagaaagcagact

SEQ ID NO: 8373323 - DNA, 22 bp, Homo sapiens
cttcaaatgtgattttaataac

SEQ ID NO: 8373324 - DNA, 22 bp, Homo sapiens
cttcacagcatgagctttggag

SEQ ID NO: 8373325 - DNA, 22 bp, Homo sapiens
cttcacagtaaatccagaagaa

SEQ ID NO: 8373326 - DNA, 22 bp, Homo sapiens
cttcttcaagagaatgggagac

SEQ ID NO: 8373327 - DNA, 22 bp, Homo sapiens
cttcttcaacctgaaagtttca

SEQ ID NO: 8373328 - DNA, 22 bp, Homo sapiens
cttcccttctgtgcagggcaga

SEQ ID NO: 8373329 - DNA, 22 bp, Homo sapiens
cttcttcatctgtaaaacttgg

SEQ ID NO: 8373330 - DNA, 22 bp, Homo sapiens
cttcttcataggcagtcctgtt

SEQ ID NO: 8373331 - DNA, 22 bp, Homo sapiens
cttcttcagaggccagcctctg

SEQ ID NO: 8373332 - DNA, 22 bp, Homo sapiens
cttcttcaatagcaagcgcata

SEQ ID NO: 8373333 - DNA, 20 bp, Homo sapiens
cttcttcagcctatgcttca

SEQ ID NO: 8373334 - DNA, 22 bp, Homo sapiens
cttcttcagcacaatattgatg

SEQ ID NO: 8373335 - DNA, 19 bp, Homo sapiens
cttcccctgttacctcact

SEQ ID NO: 8373336 - DNA, 19 bp, Homo sapiens
cttcccctgttacctcact

SEQ ID NO: 8373337 - DNA, 22 bp, Homo sapiens
cttccctgataagagcctcaga

SEQ ID NO: 8373338 - DNA, 22 bp, Homo sapiens
cttccctgagctttctcaggct

SEQ ID NO: 8373339 - DNA, 22 bp, Homo sapiens
cttccctgataagagcctcaga

SEQ ID NO: 8373340 - DNA, 22 bp, Homo sapiens
cttccctggtgttagcccaatg

SEQ ID NO: 8373341 - DNA, 22 bp, Homo sapiens
cttcccatataactaatttctg

SEQ ID NO: 8373342 - DNA, 22 bp, Homo sapiens
cttcccagcacctcagtctggc

SEQ ID NO: 8373343 - DNA, 22 bp, Homo sapiens
gaaatgtttccttttgtatgct

SEQ ID NO: 8373344 - DNA, 23 bp, Homo sapiens
gaaatgtttcttgattaatccta

SEQ ID NO: 8373345 - DNA, 22 bp, Homo sapiens
gaaatgtgttgttcatttctaa

SEQ ID NO: 8373346 - DNA, 22 bp, Homo sapiens
gaaatgttatgagatatgtact

SEQ ID NO: 8373347 - DNA, 22 bp, Homo sapiens
gaaattcaaaatgtcagtatag

SEQ ID NO: 8373348 - DNA, 22 bp, Homo sapiens
gaaattattgctagagactgca

SEQ ID NO: 8373349 - DNA, 22 bp, Homo sapiens
gaaattcaggacaaagactctt

SEQ ID NO: 8373350 - DNA, 22 bp, Homo sapiens
gaaattcactgtatttcttggg

SEQ ID NO: 8373351 - DNA, 22 bp, Homo sapiens
gaagaagacatggaacaatagt

SEQ ID NO: 8373352 - DNA, 22 bp, Homo sapiens
gaagaaggaagatcatgcttga

SEQ ID NO: 8373353 - DNA, 22 bp, Homo sapiens
gaagaaggaagatcatgcttga

SEQ ID NO: 8373354 - DNA, 22 bp, Homo sapiens
gaacttataattattaagattg

SEQ ID NO: 8373355 - DNA, 22 bp, Homo sapiens
gaagaactaactgaccatgaat

SEQ ID NO: 8373356 - DNA, 22 bp, Homo sapiens
gaagaaattgaattcatgagct

SEQ ID NO: 8373357 - DNA, 22 bp, Homo sapiens
gaagaaattgaattcatgagct

SEQ ID NO: 8373358 - DNA, 22 bp, Homo sapiens
gaaatgtaggcataattatttt

SEQ ID NO: 8373359 - DNA, 22 bp, Homo sapiens
gaaatattgggactcagagctt

SEQ ID NO: 8373360 - DNA, 22 bp, Homo sapiens
gaaatattgtactggagatgtt

SEQ ID NO: 8373361 - DNA, 22 bp, Homo sapiens
gaaagacatagttgcaagatgg

SEQ ID NO: 8373362 - DNA, 22 bp, Homo sapiens
gaaagacatagttgcaagatgg

SEQ ID NO: 8373363 - DNA, 22 bp, Homo sapiens
gaaagactaactagaaagtgca

SEQ ID NO: 8373364 - DNA, 22 bp, Homo sapiens
gaaagacttcctttgagagtac

SEQ ID NO: 8373365 - DNA, 22 bp, Homo sapiens
gaaagagaacctgggcctagat

SEQ ID NO: 8373366 - DNA, 22 bp, Homo sapiens
gaaagagaacctgggcctagat

SEQ ID NO: 8373367 - DNA, 22 bp, Homo sapiens
gaaatacaggaatgccacacag

SEQ ID NO: 8373368 - DNA, 22 bp, Homo sapiens
gaaatattcttgtcttgttttc

SEQ ID NO: 8373369 - DNA, 22 bp, Homo sapiens
gaaatattcttgtcttgttttc

SEQ ID NO: 8373370 - DNA, 22 bp, Homo sapiens
gaaatattacagtggaggggat

SEQ ID NO: 8373371 - DNA, 22 bp, Homo sapiens
ctttggaaggaagacctttcag

SEQ ID NO: 8373372 - DNA, 22 bp, Homo sapiens
ctttggaaggtcgtccgtgtgg

SEQ ID NO: 8373373 - DNA, 22 bp, Homo sapiens
ctttggaaggcagagctctgtg

SEQ ID NO: 8373374 - DNA, 22 bp, Homo sapiens
ctttggaacatactgctgagct

SEQ ID NO: 8373375 - DNA, 22 bp, Homo sapiens
ctttggaacacccagctctgtg

SEQ ID NO: 8373376 - DNA, 22 bp, Homo sapiens
ctttggaactgtaaggagatgg

SEQ ID NO: 8373377 - DNA, 22 bp, Homo sapiens
ctttggaagccaggcagttcac

SEQ ID NO: 8373378 - DNA, 22 bp, Homo sapiens
ctttggaaggaacaggattctc

SEQ ID NO: 8373379 - DNA, 22 bp, Homo sapiens
ctttggaataatcaagctctga

SEQ ID NO: 8373380 - DNA, 22 bp, Homo sapiens
ctttggaataatttcctggagt

SEQ ID NO: 8373381 - DNA, 22 bp, Homo sapiens
ctttggaatcattgcttattca

SEQ ID NO: 8373382 - DNA, 22 bp, Homo sapiens
ctttggaatcattgcttattca

SEQ ID NO: 8373383 - DNA, 22 bp, Homo sapiens
ctttggaatattttattgagaa

SEQ ID NO: 8373384 - DNA, 22 bp, Homo sapiens
ctttggaatattttattgagaa

SEQ ID NO: 8373385 - DNA, 22 bp, Homo sapiens
ctttggaagtgaccacaatcct

SEQ ID NO: 8373386 - DNA, 22 bp, Homo sapiens
ctttggaagtgaccacaatcct

SEQ ID NO: 8373387 - DNA, 22 bp, Homo sapiens
ctttggaagtaaagtcagcagg

SEQ ID NO: 8373388 - DNA, 22 bp, Homo sapiens
ctttggaataaaattagttgtt

SEQ ID NO: 8373389 - DNA, 22 bp, Homo sapiens
ctttggaagtgatagatatgat

SEQ ID NO: 8373390 - DNA, 20 bp, Homo sapiens
ctttggagaaagatgcaata

SEQ ID NO: 8373391 - DNA, 20 bp, Homo sapiens
ctttggagaaagctaacaga

SEQ ID NO: 8373392 - DNA, 22 bp, Homo sapiens
ctttggaatgcacagaggtgta

SEQ ID NO: 8373393 - DNA, 22 bp, Homo sapiens
ctttggaggacctatgtgcaat

SEQ ID NO: 8373394 - DNA, 22 bp, Homo sapiens
ctttggaggaaaattgaggtca

SEQ ID NO: 8373395 - DNA, 22 bp, Homo sapiens
ctttggaggaaaattgaggtca

SEQ ID NO: 8373396 - DNA, 19 bp, Homo sapiens
ctttggaggatgaggctgg

SEQ ID NO: 8373397 - DNA, 22 bp, Homo sapiens
ctttggaggtcatagccaagag

SEQ ID NO: 8373398 - DNA, 22 bp, Homo sapiens
ctttggatttttatcaggcaat

SEQ ID NO: 8373399 - DNA, 22 bp, Homo sapiens
ctttttctaatcataattgtct

SEQ ID NO: 8373400 - DNA, 20 bp, Homo sapiens
ctttttctccagctctgagc

SEQ ID NO: 8373401 - DNA, 22 bp, Homo sapiens
ctttttgcaagagtttctcatc

SEQ ID NO: 8373402 - DNA, 22 bp, Homo sapiens
ctttttcttctaggtgtgcctg

SEQ ID NO: 8373403 - DNA, 22 bp, Homo sapiens
ctttttctgatgttccatgatt

SEQ ID NO: 8373404 - DNA, 20 bp, Homo sapiens
ctttttctccagctctgagc

SEQ ID NO: 8373405 - DNA, 22 bp, Homo sapiens
cttttgcagccattattgctgc

SEQ ID NO: 8373406 - DNA, 22 bp, Homo sapiens
cttttgttaggagaaaacatca

SEQ ID NO: 8373407 - DNA, 22 bp, Homo sapiens
cttttgttctacagctggggaa

SEQ ID NO: 8373408 - DNA, 22 bp, Homo sapiens
gaaaaatgagctgatgtcaggg

SEQ ID NO: 8373409 - DNA, 22 bp, Homo sapiens
gaaaaaggataaatacagtgtt

SEQ ID NO: 8373410 - DNA, 22 bp, Homo sapiens
gaaaaaggataaatacagtgtt

SEQ ID NO: 8373411 - DNA, 22 bp, Homo sapiens
ctttttgtctctgtcctgatga

SEQ ID NO: 8373412 - DNA, 22 bp, Homo sapiens
cttttttaaggtagctcctcct

SEQ ID NO: 8373413 - DNA, 22 bp, Homo sapiens
cttttttaaggtagctcctcct

SEQ ID NO: 8373414 - DNA, 22 bp, Homo sapiens
gaaacccaaactaagacagtag

SEQ ID NO: 8373415 - DNA, 22 bp, Homo sapiens
gaaacgttaaaccatatgtaat

SEQ ID NO: 8373416 - DNA, 22 bp, Homo sapiens
gaaacgttggcataagtttatg

SEQ ID NO: 8373417 - DNA, 22 bp, Homo sapiens
gaaacgttgtggaaaatcctct

SEQ ID NO: 8373418 - DNA, 22 bp, Homo sapiens
gaaacttttaaacctcatgagt

SEQ ID NO: 8373419 - DNA, 22 bp, Homo sapiens
gaaacttttaaacctcatgagt

SEQ ID NO: 8373420 - DNA, 22 bp, Homo sapiens
gaaactttcatgaatataagat

SEQ ID NO: 8373421 - DNA, 22 bp, Homo sapiens
gaaactttcatgaatataagat

SEQ ID NO: 8373422 - DNA, 22 bp, Homo sapiens
gaaactttggctaaaagccaga

SEQ ID NO: 8373423 - DNA, 22 bp, Homo sapiens
gaaactgtgaggatcttaactt

SEQ ID NO: 8373424 - DNA, 22 bp, Homo sapiens
gaaactgtttctggctttggtg

SEQ ID NO: 8373425 - DNA, 22 bp, Homo sapiens
gaaactgtttctggctttggtg

SEQ ID NO: 8373426 - DNA, 22 bp, Homo sapiens
gaaacttcttgtctcacagttc

SEQ ID NO: 8373427 - DNA, 22 bp, Homo sapiens
gaaacttacttactcacatttc

SEQ ID NO: 8373428 - DNA, 22 bp, Homo sapiens
ctgtggggaaagggtcctgctc

SEQ ID NO: 8373429 - DNA, 22 bp, Homo sapiens
ctgtggtgagcaactgactgaa

SEQ ID NO: 8373430 - DNA, 23 bp, Homo sapiens
ctgtggtgaggccctagaatctg

SEQ ID NO: 8373431 - DNA, 22 bp, Homo sapiens
ctgtggtgagcaactgactgaa

SEQ ID NO: 8373432 - DNA, 22 bp, Homo sapiens
ctgtggtgagcaactgactgaa

SEQ ID NO: 8373433 - DNA, 22 bp, Homo sapiens
ctgtgtgtgagaagcaggttga

SEQ ID NO: 8373434 - DNA, 22 bp, Homo sapiens
ctgtgttttgattaaaaagcaa

SEQ ID NO: 8373435 - DNA, 22 bp, Homo sapiens
ctgtgtttggacaacttttcag

SEQ ID NO: 8373436 - DNA, 22 bp, Homo sapiens
ctgtgttttgagatattattaa

SEQ ID NO: 8373437 - DNA, 22 bp, Homo sapiens
ctgtgtttgatgagaagccacc

SEQ ID NO: 8373438 - DNA, 22 bp, Homo sapiens
ctgtgtttgctatgcaaagaca

SEQ ID NO: 8373439 - DNA, 22 bp, Homo sapiens
ctgtgttcccctgctgctgagg

SEQ ID NO: 8373440 - DNA, 22 bp, Homo sapiens
ctgtgtttctcttgacccaagt

SEQ ID NO: 8373441 - DNA, 22 bp, Homo sapiens
ctgtgtttctgagaagtgggga

SEQ ID NO: 8373442 - DNA, 17 bp, Homo sapiens
ctgtggccacctggatg

SEQ ID NO: 8373443 - DNA, 22 bp, Homo sapiens
ctgtgggagcactggggaccga

SEQ ID NO: 8373444 - DNA, 22 bp, Homo sapiens
ctgtgggagcactggggaccga

SEQ ID NO: 8373445 - DNA, 22 bp, Homo sapiens
ctgtgggagggaaggcgcggcc

SEQ ID NO: 8373446 - DNA, 22 bp, Homo sapiens
ctgtgggagggaaggcgcggcc

SEQ ID NO: 8373447 - DNA, 22 bp, Homo sapiens
ctgtgggagcagcaccaaggac

SEQ ID NO: 8373448 - DNA, 22 bp, Homo sapiens
ctgtgggagcagcaccaaggac

SEQ ID NO: 8373449 - DNA, 22 bp, Homo sapiens
ctgtgggatcccatgactttcc

SEQ ID NO: 8373450 - DNA, 22 bp, Homo sapiens
ctgtgggagggaaggcgcggcc

SEQ ID NO: 8373451 - DNA, 22 bp, Homo sapiens
ctgtgggagggtgagagaacca

SEQ ID NO: 8373452 - DNA, 22 bp, Homo sapiens
ctgtgggagggtgagagaacca

SEQ ID NO: 8373453 - DNA, 22 bp, Homo sapiens
ctgtgggattcatgacattaat

SEQ ID NO: 8373454 - DNA, 22 bp, Homo sapiens
ctgtgggatgggacctcagctg

SEQ ID NO: 8373455 - DNA, 22 bp, Homo sapiens
ctgtgggcctgatgttcttctc

SEQ ID NO: 8373456 - DNA, 22 bp, Homo sapiens
ctgtgggctcccagcttctctc

SEQ ID NO: 8373457 - DNA, 22 bp, Homo sapiens
ctgtggcattgccgaggctggc

SEQ ID NO: 8373458 - DNA, 20 bp, Homo sapiens
ctgtggcatcttgaaggagg

SEQ ID NO: 8373459 - DNA, 22 bp, Homo sapiens
ctgtggcagggaagaggccatg

SEQ ID NO: 8373460 - DNA, 22 bp, Homo sapiens
ctgtggcagggaagaggccatg

SEQ ID NO: 8373461 - DNA, 22 bp, Homo sapiens
ctgtggcagaggtgacacctct

SEQ ID NO: 8373462 - DNA, 22 bp, Homo sapiens
ctgtggcaggaagggactagca

SEQ ID NO: 8373463 - DNA, 22 bp, Homo sapiens
ctgtggcactcaagaagcctcc

SEQ ID NO: 8373464 - DNA, 22 bp, Homo sapiens
ctgtggcaccaatacatttttc

SEQ ID NO: 8373465 - DNA, 22 bp, Homo sapiens
ctgtggcaagtctgcctgtcac

SEQ ID NO: 8373466 - DNA, 22 bp, Homo sapiens
ctgtggcaaatgatacctccca

SEQ ID NO: 8373467 - DNA, 23 bp, Homo sapiens
ctgtggcaagtcctgcacctgcc

SEQ ID NO: 8373468 - DNA, 22 bp, Homo sapiens
ctgtcccctgtgctttcacttg

SEQ ID NO: 8373469 - DNA, 22 bp, Homo sapiens
ctgtccagtgcagagaacagag

SEQ ID NO: 8373470 - DNA, 22 bp, Homo sapiens
ctgtcccaggatcctgactcca

SEQ ID NO: 8373471 - DNA, 22 bp, Homo sapiens
ctggtttagctgtaaggttccc

SEQ ID NO: 8373472 - DNA, 22 bp, Homo sapiens
ctggtttactctgcactgctca

SEQ ID NO: 8373473 - DNA, 22 bp, Homo sapiens
ctggtttaagcttatatagttg

SEQ ID NO: 8373474 - DNA, 22 bp, Homo sapiens
ctggtttacccaagatttgctg

SEQ ID NO: 8373475 - DNA, 22 bp, Homo sapiens
ctggtttaaccatgtatcctgg

SEQ ID NO: 8373476 - DNA, 22 bp, Homo sapiens
ctggtttaaaattactggttaa

SEQ ID NO: 8373477 - DNA, 19 bp, Homo sapiens
ctggtttaggtagtgagtc

SEQ ID NO: 8373478 - DNA, 22 bp, Homo sapiens
ctggtttagtcataatggagaa

SEQ ID NO: 8373479 - DNA, 22 bp, Homo sapiens
ctggtttagtaggggactgaag

SEQ ID NO: 8373480 - DNA, 22 bp, Homo sapiens
ctggtttattcgtcacaccgga

SEQ ID NO: 8373481 - DNA, 22 bp, Homo sapiens
ctggtttatgtatcatctagaa

SEQ ID NO: 8373482 - DNA, 17 bp, Homo sapiens
ctggtttatgggcagtg

SEQ ID NO: 8373483 - DNA, 22 bp, Homo sapiens
ctggtttagtgaaataggccag

SEQ ID NO: 8373484 - DNA, 22 bp, Homo sapiens
ctggtttatgagggaagggatg

SEQ ID NO: 8373485 - DNA, 22 bp, Homo sapiens
ctggtttataaatctgtggcca

SEQ ID NO: 8373486 - DNA, 22 bp, Homo sapiens
ctggttcatggtggaatgacat

SEQ ID NO: 8373487 - DNA, 22 bp, Homo sapiens
ctggttcccagcaggagtgtag

SEQ ID NO: 8373488 - DNA, 22 bp, Homo sapiens
ctggttcaatactaaacttctt

SEQ ID NO: 8373489 - DNA, 22 bp, Homo sapiens
ctggttcagtgaaaggcatggg

SEQ ID NO: 8373490 - DNA, 22 bp, Homo sapiens
ctggttcatataggcaagttta

SEQ ID NO: 8373491 - DNA, 23 bp, Homo sapiens
ctggttcatagtcaagagattga

SEQ ID NO: 8373492 - DNA, 22 bp, Homo sapiens
ctggttctgatgttcttggctt

SEQ ID NO: 8373493 - DNA, 22 bp, Homo sapiens
ctggttcctccatcagcaggaa

SEQ ID NO: 8373494 - DNA, 22 bp, Homo sapiens
ctggtttgtcttgggaggatgt

SEQ ID NO: 8373495 - DNA, 21 bp, Homo sapiens
ctgtccctctttgcttccctc

SEQ ID NO: 8373496 - DNA, 21 bp, Homo sapiens
ctgtccctctttgcttccctc

SEQ ID NO: 8373497 - DNA, 22 bp, Homo sapiens
ctgtctgttgaccatagtttgc

SEQ ID NO: 8373498 - DNA, 22 bp, Homo sapiens
ctgtgacccagttcctggcacc

SEQ ID NO: 8373499 - DNA, 22 bp, Homo sapiens
ctgtgacagtttctcagacttt

SEQ ID NO: 8373500 - DNA, 22 bp, Homo sapiens
ctgtgacagtttctcagaattt

SEQ ID NO: 8373501 - DNA, 22 bp, Homo sapiens
ctgtgacagagcttgagtgaga

SEQ ID NO: 8373502 - DNA, 22 bp, Homo sapiens
ctgtgacagggatcagaatgca

SEQ ID NO: 8373503 - DNA, 22 bp, Homo sapiens
ctgtgaaatgctttgcgatggt

SEQ ID NO: 8373504 - DNA, 22 bp, Homo sapiens
ctgtgaggccctgggtgctgga

SEQ ID NO: 8373505 - DNA, 21 bp, Homo sapiens
ctgtggacaggctggggcatg

SEQ ID NO: 8373506 - DNA, 22 bp, Homo sapiens
ctgtgactttgaataagaggga

SEQ ID NO: 8373507 - DNA, 22 bp, Homo sapiens
ctgtgacttgccaaaggtcatt

SEQ ID NO: 8373508 - DNA, 22 bp, Homo sapiens
ctgtgagaaaggtgatggaggt

SEQ ID NO: 8373509 - DNA, 22 bp, Homo sapiens
ctgtgagaaataaatgtttgct

SEQ ID NO: 8373510 - DNA, 22 bp, Homo sapiens
ctgtgagacctgatttcttcat

SEQ ID NO: 8373511 - DNA, 22 bp, Homo sapiens
ctgtgagaagaatcccacctga

SEQ ID NO: 8373512 - DNA, 22 bp, Homo sapiens
ctgtgagaaataaatgtttgct

SEQ ID NO: 8373513 - DNA, 22 bp, Homo sapiens
ctgtgagatttttaaataactt

SEQ ID NO: 8373514 - DNA, 22 bp, Homo sapiens
ctgtgagatttttaaataactt

SEQ ID NO: 8373515 - DNA, 22 bp, Homo sapiens
ctgtgagatgtttctggttaga

SEQ ID NO: 8373516 - DNA, 22 bp, Homo sapiens
ctgtgagatgaccaactgactg

SEQ ID NO: 8373517 - DNA, 22 bp, Homo sapiens
ctgtgagactgatagggaagag

SEQ ID NO: 8373518 - DNA, 22 bp, Homo sapiens
ctgtgagagtggtggcctaggc

SEQ ID NO: 8373519 - DNA, 22 bp, Homo sapiens
ctgtgagagtggtggcctaggc

SEQ ID NO: 8373520 - DNA, 22 bp, Homo sapiens
ctgtgagatatgcatatgctct

SEQ ID NO: 8373521 - DNA, 22 bp, Homo sapiens
ctgtgagatatgcatatgctct

SEQ ID NO: 8373522 - DNA, 22 bp, Homo sapiens
ctgtgactggaatctggctctt

SEQ ID NO: 8373523 - DNA, 22 bp, Homo sapiens
ctgtgacttccggatgacatga

SEQ ID NO: 8373524 - DNA, 22 bp, Homo sapiens
ctgtgacttccggatgacatga

SEQ ID NO: 8373525 - DNA, 22 bp, Homo sapiens
ctgtgacttagagtgagtagag

SEQ ID NO: 8373526 - DNA, 22 bp, Homo sapiens
ctgtgactagacctgcaggaga

SEQ ID NO: 8373527 - DNA, 21 bp, Homo sapiens
ctgtgactccctgggcaatcc

SEQ ID NO: 8373528 - DNA, 22 bp, Homo sapiens
ctggagctcagcccaggttcca

SEQ ID NO: 8373529 - DNA, 22 bp, Homo sapiens
ctggagccttcaccaggggaaa

SEQ ID NO: 8373530 - DNA, 22 bp, Homo sapiens
ctggagctaataatccatctga

SEQ ID NO: 8373531 - DNA, 22 bp, Homo sapiens
ctggagctccagggtctcctct

SEQ ID NO: 8373532 - DNA, 22 bp, Homo sapiens
ctggagctccagggtctcctct

SEQ ID NO: 8373533 - DNA, 22 bp, Homo sapiens
ctggagctccagggtctcctct

SEQ ID NO: 8373534 - DNA, 22 bp, Homo sapiens
ctgggatcagcagtagtgatga

SEQ ID NO: 8373535 - DNA, 22 bp, Homo sapiens
ctgggccagatccagcctcaca

SEQ ID NO: 8373536 - DNA, 22 bp, Homo sapiens
ctgggccaggaccagggttgaa

SEQ ID NO: 8373537 - DNA, 22 bp, Homo sapiens
ctgggccaggaccagggttgaa

SEQ ID NO: 8373538 - DNA, 22 bp, Homo sapiens
ctgggccagcaactgcaatgga

SEQ ID NO: 8373539 - DNA, 22 bp, Homo sapiens
ctgggctcaagaagtcttccct

SEQ ID NO: 8373540 - DNA, 22 bp, Homo sapiens
ctgggctcagcaggccaaggcc

SEQ ID NO: 8373541 - DNA, 22 bp, Homo sapiens
ctgggcctccagctctgccagc

SEQ ID NO: 8373542 - DNA, 22 bp, Homo sapiens
ctgggctcagtggctcatggct

SEQ ID NO: 8373543 - DNA, 22 bp, Homo sapiens
ctgggctctaagggagcaccgt

SEQ ID NO: 8373544 - DNA, 22 bp, Homo sapiens
ctggggggagctgcgtccagca

SEQ ID NO: 8373545 - DNA, 22 bp, Homo sapiens
ctgggggccttacggaactcca

SEQ ID NO: 8373546 - DNA, 22 bp, Homo sapiens
ctggggctggtgaggcaggctc

SEQ ID NO: 8373547 - DNA, 22 bp, Homo sapiens
ctggggctggtgaggcaggctc

SEQ ID NO: 8373548 - DNA, 22 bp, Homo sapiens
ctgggctctagaaaggaaagaa

SEQ ID NO: 8373549 - DNA, 22 bp, Homo sapiens
ctggggtgtctcgtctgccatt

SEQ ID NO: 8373550 - DNA, 22 bp, Homo sapiens
ctggggtggatgggtccaagtt

SEQ ID NO: 8373551 - DNA, 22 bp, Homo sapiens
ctggggggctactgacagagga

SEQ ID NO: 8373552 - DNA, 22 bp, Homo sapiens
ctgggtggaaagtgctgagaat

SEQ ID NO: 8373553 - DNA, 22 bp, Homo sapiens
ctgggtggttttgatgtgaatt

SEQ ID NO: 8373554 - DNA, 22 bp, Homo sapiens
ctgggtggttttgatgtgaatt

SEQ ID NO: 8373555 - DNA, 22 bp, Homo sapiens
ctgggtggttctaactgttgat

SEQ ID NO: 8373556 - DNA, 22 bp, Homo sapiens
ctgggttccatgtagccaagag

SEQ ID NO: 8373557 - DNA, 22 bp, Homo sapiens
ctgggttcttggcacagcagga

SEQ ID NO: 8373558 - DNA, 22 bp, Homo sapiens
ctgggttcttggcacagcagga

SEQ ID NO: 8373559 - DNA, 22 bp, Homo sapiens
ctggtgtccagcatgtgtggaa

SEQ ID NO: 8373560 - DNA, 22 bp, Homo sapiens
ttagcaaactctgttagattct

SEQ ID NO: 8373561 - DNA, 22 bp, Homo sapiens
ttagcaaatatcttgaaacagg

SEQ ID NO: 8373562 - DNA, 22 bp, Homo sapiens
ttagcaaagtttgccatctagt

SEQ ID NO: 8373563 - DNA, 21 bp, Homo sapiens
ttagcaaagcaaacacatgct

SEQ ID NO: 8373564 - DNA, 22 bp, Homo sapiens
ttagcaaagaagatgtgagttt

SEQ ID NO: 8373565 - DNA, 22 bp, Homo sapiens
ccttgaaagccaggcagaggaa

SEQ ID NO: 8373566 - DNA, 22 bp, Homo sapiens
ttagcaccctgatactagaatg

SEQ ID NO: 8373567 - DNA, 22 bp, Homo sapiens
ttagcacctcattcccaccttc

SEQ ID NO: 8373568 - DNA, 18 bp, Homo sapiens
ttagcacctatgtgggta

SEQ ID NO: 8373569 - DNA, 22 bp, Homo sapiens
ttagcaccttaactgtggagat

SEQ ID NO: 8373570 - DNA, 22 bp, Homo sapiens
ttagcaccttgaacagaccctg

SEQ ID NO: 8373571 - DNA, 22 bp, Homo sapiens
ttagcacccgggccagcggctg

SEQ ID NO: 8373572 - DNA, 22 bp, Homo sapiens
ttagcaccagctatggatgtgc

SEQ ID NO: 8373573 - DNA, 22 bp, Homo sapiens
ttagcaccacacactttagagg

SEQ ID NO: 8373574 - DNA, 22 bp, Homo sapiens
ttagcaagaaagattgcagcac

SEQ ID NO: 8373575 - DNA, 22 bp, Homo sapiens
ttagcaaatatcttgaaacagg

SEQ ID NO: 8373576 - DNA, 22 bp, Homo sapiens
ttagcaagataacagtaatttt

SEQ ID NO: 8373577 - DNA, 22 bp, Homo sapiens
ttacataaaagttcacgtaggc

SEQ ID NO: 8373578 - DNA, 22 bp, Homo sapiens
ttacataacggtatgaaaaatg

SEQ ID NO: 8373579 - DNA, 20 bp, Homo sapiens
ccttcagaacttacatagta

SEQ ID NO: 8373580 - DNA, 22 bp, Homo sapiens
ccttcaaggcaaggagggctgg

SEQ ID NO: 8373581 - DNA, 22 bp, Homo sapiens
ccttcagaatgaaattctaatg

SEQ ID NO: 8373582 - DNA, 22 bp, Homo sapiens
ccttcagacctagacaggaatc

SEQ ID NO: 8373583 - DNA, 23 bp, Homo sapiens
ccttcagaagaagtaacaggggc

SEQ ID NO: 8373584 - DNA, 22 bp, Homo sapiens
ccttcagcctcaagatccttca

SEQ ID NO: 8373585 - DNA, 22 bp, Homo sapiens
ccttcagccttcatccttcctt

SEQ ID NO: 8373586 - DNA, 22 bp, Homo sapiens
ccttcagaggtgtagattgcgt

SEQ ID NO: 8373587 - DNA, 20 bp, Homo sapiens
ccttcagatgactttttcag

SEQ ID NO: 8373588 - DNA, 20 bp, Homo sapiens
ccttgccagtagggctggga

SEQ ID NO: 8373589 - DNA, 22 bp, Homo sapiens
ccttgcaggggaacaggcagtg

SEQ ID NO: 8373590 - DNA, 22 bp, Homo sapiens
ccttgcagcatatagagtccct

SEQ ID NO: 8373591 - DNA, 22 bp, Homo sapiens
ccttgcagggaaactggaccca

SEQ ID NO: 8373592 - DNA, 22 bp, Homo sapiens
ccttgcagagcataggagccct

SEQ ID NO: 8373593 - DNA, 22 bp, Homo sapiens
ccttgagatgagctaatttttt

SEQ ID NO: 8373594 - DNA, 22 bp, Homo sapiens
ccttgagaggaagtttgtagaa

SEQ ID NO: 8373595 - DNA, 22 bp, Homo sapiens
ccttgactgccttcaggctggg

SEQ ID NO: 8373596 - DNA, 22 bp, Homo sapiens
ttataaagattgttatgtatct

SEQ ID NO: 8373597 - DNA, 22 bp, Homo sapiens
ttataaacttgccaagaaggag

SEQ ID NO: 8373598 - DNA, 22 bp, Homo sapiens
ttatcaagggagaaacaggagg

SEQ ID NO: 8373599 - DNA, 22 bp, Homo sapiens
ttatcaagggagaaacaggagg

SEQ ID NO: 8373600 - DNA, 22 bp, Homo sapiens
ttatatttctggtagccttcag

SEQ ID NO: 8373601 - DNA, 22 bp, Homo sapiens
ttatatttctggtagccttcag

SEQ ID NO: 8373602 - DNA, 22 bp, Homo sapiens
ttatattgtgtaataagtgaag

SEQ ID NO: 8373603 - DNA, 22 bp, Homo sapiens
ttatcagttgtgtgtatacacg

SEQ ID NO: 8373604 - DNA, 22 bp, Homo sapiens
ttatcataagtaattgaaataa

SEQ ID NO: 8373605 - DNA, 22 bp, Homo sapiens
ttatcataagtaattgaaataa

SEQ ID NO: 8373606 - DNA, 22 bp, Homo sapiens
ttatcatagtgcagttttctga

SEQ ID NO: 8373607 - DNA, 22 bp, Homo sapiens
ttatcatgacttcaagcatcca

SEQ ID NO: 8373608 - DNA, 22 bp, Homo sapiens
ttataaaggtttgtgcatattt

SEQ ID NO: 8373609 - DNA, 22 bp, Homo sapiens
ttatattagttagacttgctgt

SEQ ID NO: 8373610 - DNA, 22 bp, Homo sapiens
ttaagatttgtagagaaaaagc

SEQ ID NO: 8373611 - DNA, 22 bp, Homo sapiens
ttaaattttagaaacagactct

SEQ ID NO: 8373612 - DNA, 22 bp, Homo sapiens
ttaaattttagaaacagactct

SEQ ID NO: 8373613 - DNA, 22 bp, Homo sapiens
ttaaatttctacgtgatccagg

SEQ ID NO: 8373614 - DNA, 22 bp, Homo sapiens
ttaaatttctacgtgatccagg

SEQ ID NO: 8373615 - DNA, 22 bp, Homo sapiens
ttaaatttctacgtgatccagg

SEQ ID NO: 8373616 - DNA, 22 bp, Homo sapiens
ttaaattttagaaacagactct

SEQ ID NO: 8373617 - DNA, 22 bp, Homo sapiens
tgtcagcagaagtggtgcactc

SEQ ID NO: 8373618 - DNA, 22 bp, Homo sapiens
tgtcagcatttaaggagtaagg

SEQ ID NO: 8373619 - DNA, 21 bp, Homo sapiens
tgtcagagcttgtaggacatt

SEQ ID NO: 8373620 - DNA, 22 bp, Homo sapiens
tgtcagagagcaggcagtagaa

SEQ ID NO: 8373621 - DNA, 20 bp, Homo sapiens
tgtcaatagcactgaggctg

SEQ ID NO: 8373622 - DNA, 20 bp, Homo sapiens
tgtcagcaattaggagaaaa

SEQ ID NO: 8373623 - DNA, 22 bp, Homo sapiens
ttacagttgttctatcagcatg

SEQ ID NO: 8373624 - DNA, 22 bp, Homo sapiens
ttacagtttagtccaagccaga

SEQ ID NO: 8373625 - DNA, 22 bp, Homo sapiens
ttacagtttaccaagaatattg

SEQ ID NO: 8373626 - DNA, 22 bp, Homo sapiens
ttacagttgcccccagcctcgc

SEQ ID NO: 8373627 - DNA, 22 bp, Homo sapiens
ttacagttggtattagaccaaa

SEQ ID NO: 8373628 - DNA, 22 bp, Homo sapiens
ttacagaagtgaaggcctttaa

SEQ ID NO: 8373629 - DNA, 22 bp, Homo sapiens
ttacaaagcgctttacctctga

SEQ ID NO: 8373630 - DNA, 22 bp, Homo sapiens
ttacaaagcaggtcagctgaaa

SEQ ID NO: 8373631 - DNA, 22 bp, Homo sapiens
ttacaaagcaggtcagctgaaa

SEQ ID NO: 8373632 - DNA, 21 bp, Homo sapiens
ttacaaagcaagtgctgtgtc

SEQ ID NO: 8373633 - DNA, 22 bp, Homo sapiens
ttacaaagattatattcagtta

SEQ ID NO: 8373634 - DNA, 22 bp, Homo sapiens
ttacaaagattatattcagtta

SEQ ID NO: 8373635 - DNA, 22 bp, Homo sapiens
ttacaaagattatattcagtta

SEQ ID NO: 8373636 - DNA, 22 bp, Homo sapiens
ttaagcatggaagtgaaataat

SEQ ID NO: 8373637 - DNA, 22 bp, Homo sapiens
ttaagcatggaagtgaaataat

SEQ ID NO: 8373638 - DNA, 22 bp, Homo sapiens
cctgtgtgtctgtcactgcaca

SEQ ID NO: 8373639 - DNA, 22 bp, Homo sapiens
ccttaaattctccatttgaaag

SEQ ID NO: 8373640 - DNA, 23 bp, Homo sapiens
ccttaaatatctaccctgtggca

SEQ ID NO: 8373641 - DNA, 22 bp, Homo sapiens
ccttaaaagaactatctcttct

SEQ ID NO: 8373642 - DNA, 22 bp, Homo sapiens
ccttacactgcctggggccacg

SEQ ID NO: 8373643 - DNA, 22 bp, Homo sapiens
ccttacaatgcagtttacttag

SEQ ID NO: 8373644 - DNA, 22 bp, Homo sapiens
ccttacctgattgctggcatcc

SEQ ID NO: 8373645 - DNA, 22 bp, Homo sapiens
ccttagaaggctgaataattct

SEQ ID NO: 8373646 - DNA, 22 bp, Homo sapiens
ttacaaagagtgttcttttcca

SEQ ID NO: 8373647 - DNA, 22 bp, Homo sapiens
cgctgcctccaggtgcagcagg

SEQ ID NO: 8373648 - DNA, 22 bp, Homo sapiens
ttcaaagtaccgtacttaatgg

SEQ ID NO: 8373649 - DNA, 21 bp, Homo sapiens
cgctgccttgggagtggacct

SEQ ID NO: 8373650 - DNA, 22 bp, Homo sapiens
cgcctctctttttctcccagac

SEQ ID NO: 8373651 - DNA, 22 bp, Homo sapiens
ttatttcatgtaaaatttatgt

SEQ ID NO: 8373652 - DNA, 16 bp, Homo sapiens
cgcctccctccctcgc

SEQ ID NO: 8373653 - DNA, 22 bp, Homo sapiens
ttatttcatgtaaaatttatgt

SEQ ID NO: 8373654 - DNA, 22 bp, Homo sapiens
ttatttcatataatgttatcaa

SEQ ID NO: 8373655 - DNA, 22 bp, Homo sapiens
ttatttatgttaacagtcgaga

SEQ ID NO: 8373656 - DNA, 22 bp, Homo sapiens
ttatttattgtgtacctactgt

SEQ ID NO: 8373657 - DNA, 22 bp, Homo sapiens
ttatttattcattctgtctgtc

SEQ ID NO: 8373658 - DNA, 22 bp, Homo sapiens
ttatttattgtgtacctactgt

SEQ ID NO: 8373659 - DNA, 22 bp, Homo sapiens
ttatttattgtgtacctactgt

SEQ ID NO: 8373660 - DNA, 20 bp, Homo sapiens
ttatttcagttgctagattg

SEQ ID NO: 8373661 - DNA, 22 bp, Homo sapiens
ttatttcatataatgttatcaa

SEQ ID NO: 8373662 - DNA, 22 bp, Homo sapiens
ttatttcatataatgttatcaa

SEQ ID NO: 8373663 - DNA, 17 bp, Homo sapiens
ttattgcagtgctgaag

SEQ ID NO: 8373664 - DNA, 22 bp, Homo sapiens
ttattcagcatttagaggaagg

SEQ ID NO: 8373665 - DNA, 22 bp, Homo sapiens
ttattgagtatctgcttggtgt

SEQ ID NO: 8373666 - DNA, 22 bp, Homo sapiens
ttattgagttgtaagagctctt

SEQ ID NO: 8373667 - DNA, 22 bp, Homo sapiens
ccttttttctatgccaactctg

SEQ ID NO: 8373668 - DNA, 22 bp, Homo sapiens
cctttttctgagttgtagcttc

SEQ ID NO: 8373669 - DNA, 19 bp, Homo sapiens
ccttttttaacttcagcaa

SEQ ID NO: 8373670 - DNA, 22 bp, Homo sapiens
cgagagccggaaggggcggtgc

SEQ ID NO: 8373671 - DNA, 22 bp, Homo sapiens
ttatccactttagtttcagtat

SEQ ID NO: 8373672 - DNA, 22 bp, Homo sapiens
ttatccaagcagaagctgcaca

SEQ ID NO: 8373673 - DNA, 22 bp, Homo sapiens
ccttttgctctcccatccagaa

SEQ ID NO: 8373674 - DNA, 22 bp, Homo sapiens
ccttttgttggggtgtattcaa

SEQ ID NO: 8373675 - DNA, 22 bp, Homo sapiens
ccttttctgtttcctgtcactg

SEQ ID NO: 8373676 - DNA, 22 bp, Homo sapiens
cggcaggacctcatttccttct

SEQ ID NO: 8373677 - DNA, 22 bp, Homo sapiens
cggcagggttggttttctctga

SEQ ID NO: 8373678 - DNA, 22 bp, Homo sapiens
cggcagggctccatgcatttct

SEQ ID NO: 8373679 - DNA, 22 bp, Homo sapiens
cggcagagccctgagtcagcct

SEQ ID NO: 8373680 - DNA, 22 bp, Homo sapiens
cggcagagcttcctgctcagcg

SEQ ID NO: 8373681 - DNA, 22 bp, Homo sapiens
cggcagagcttcctgctcagcg

SEQ ID NO: 8373682 - DNA, 22 bp, Homo sapiens
ttcaaatctctcctaatccact

SEQ ID NO: 8373683 - DNA, 22 bp, Homo sapiens
ttcaaatgatggcagtcctggc

SEQ ID NO: 8373684 - DNA, 22 bp, Homo sapiens
ttcaaatccctgctccactatt

SEQ ID NO: 8373685 - DNA, 22 bp, Homo sapiens
ttcaaatacattctttgccact

SEQ ID NO: 8373686 - DNA, 22 bp, Homo sapiens
ttcaaagtcctgtcaggtagcc

SEQ ID NO: 8373687 - DNA, 20 bp, Homo sapiens
ttcaaagtgtatgatatgca

SEQ ID NO: 8373688 - DNA, 22 bp, Homo sapiens
ttcaaagttgcatgacagctta

SEQ ID NO: 8373689 - DNA, 22 bp, Homo sapiens
ttcaaattaccacatttgctta

SEQ ID NO: 8373690 - DNA, 22 bp, Homo sapiens
ttcaaattaccacatttgctta

SEQ ID NO: 8373691 - DNA, 22 bp, Homo sapiens
cggagtcttgctatgttgccca

SEQ ID NO: 8373692 - DNA, 22 bp, Homo sapiens
cggagtgcctgtcatgcaggtt

SEQ ID NO: 8373693 - DNA, 22 bp, Homo sapiens
cggggctgacagcaggtgtgct

SEQ ID NO: 8373694 - DNA, 22 bp, Homo sapiens
cggggctgcgctcttcctgccg

SEQ ID NO: 8373695 - DNA, 22 bp, Homo sapiens
cgtgggtcgggactccgcctcg

SEQ ID NO: 8373696 - DNA, 21 bp, Homo sapiens
cgtgactgggtccgtctggct

SEQ ID NO: 8373697 - DNA, 22 bp, Homo sapiens
cgtgagcaaaatggacactccc

SEQ ID NO: 8373698 - DNA, 22 bp, Homo sapiens
cggggcaccgacctcctgccgc

SEQ ID NO: 8373699 - DNA, 22 bp, Homo sapiens
cggggcaggagtccctgtagag

SEQ ID NO: 8373700 - DNA, 22 bp, Homo sapiens
ttctatgtggatatagaactgc

SEQ ID NO: 8373701 - DNA, 22 bp, Homo sapiens
ttctatgtcagtgtgctctgtg

SEQ ID NO: 8373702 - DNA, 22 bp, Homo sapiens
ttctatttccagtccttcagag

SEQ ID NO: 8373703 - DNA, 22 bp, Homo sapiens
ttctgcagtgttaacaatgtca

SEQ ID NO: 8373704 - DNA, 22 bp, Homo sapiens
ttctgcataggctatatttgtt

SEQ ID NO: 8373705 - DNA, 22 bp, Homo sapiens
ttctgcatcccagaagaggaca

SEQ ID NO: 8373706 - DNA, 22 bp, Homo sapiens
ttctgcatacactgaatgtagt

SEQ ID NO: 8373707 - DNA, 22 bp, Homo sapiens
ttctgcatggttggggagaagc

SEQ ID NO: 8373708 - DNA, 17 bp, Homo sapiens
ttctgcatgtgaagatg

SEQ ID NO: 8373709 - DNA, 22 bp, Homo sapiens
ttctgcatggagaaactgagtc

SEQ ID NO: 8373710 - DNA, 22 bp, Homo sapiens
ttctgcatgatattaaatgtaa

SEQ ID NO: 8373711 - DNA, 22 bp, Homo sapiens
ttctgcatgaacagtttattcc

SEQ ID NO: 8373712 - DNA, 22 bp, Homo sapiens
ttctgcatgaaaagaactgaac

SEQ ID NO: 8373713 - DNA, 22 bp, Homo sapiens
ttctgcatctatttttctgctg

SEQ ID NO: 8373714 - DNA, 22 bp, Homo sapiens
ttctgcatctcacagccagtgc

SEQ ID NO: 8373715 - DNA, 22 bp, Homo sapiens
ttctggaaccaacatgccagtt

SEQ ID NO: 8373716 - DNA, 22 bp, Homo sapiens
ttctgcatgtgtttcaaatact

SEQ ID NO: 8373717 - DNA, 22 bp, Homo sapiens
ttctggaaggcagggagaaccc

SEQ ID NO: 8373718 - DNA, 22 bp, Homo sapiens
ttctggaagctgggcagcaccc

SEQ ID NO: 8373719 - DNA, 22 bp, Homo sapiens
ttctggaagccatgggaacagg

SEQ ID NO: 8373720 - DNA, 22 bp, Homo sapiens
ttctggaagccccagagtcaga

SEQ ID NO: 8373721 - DNA, 22 bp, Homo sapiens
ttctggaagccccagagtcaga

SEQ ID NO: 8373722 - DNA, 22 bp, Homo sapiens
cgtgtacagtctatcttttttc

SEQ ID NO: 8373723 - DNA, 22 bp, Homo sapiens
cgtgtacacgcacacgtgtcct

SEQ ID NO: 8373724 - DNA, 17 bp, Homo sapiens
cgtgtgcttgtgtgcac

SEQ ID NO: 8373725 - DNA, 22 bp, Homo sapiens
ctaaaaatccacactaggtgaa

SEQ ID NO: 8373726 - DNA, 22 bp, Homo sapiens
ctaaaaactctacgatgcacag

SEQ ID NO: 8373727 - DNA, 22 bp, Homo sapiens
ctagatccattttctgtctctg

SEQ ID NO: 8373728 - DNA, 19 bp, Homo sapiens
ctagatccagaaagtggta

SEQ ID NO: 8373729 - DNA, 22 bp, Homo sapiens
ctagagtaagaagtacagttgc

SEQ ID NO: 8373730 - DNA, 22 bp, Homo sapiens
ctagagaattgtcttgagagtt

SEQ ID NO: 8373731 - DNA, 22 bp, Homo sapiens
ctagagaattgtcttgagagtt

SEQ ID NO: 8373732 - DNA, 22 bp, Homo sapiens
ctagagaaaggcagtggagcaa

SEQ ID NO: 8373733 - DNA, 22 bp, Homo sapiens
ctagagaaaccccatgagcttt

SEQ ID NO: 8373734 - DNA, 22 bp, Homo sapiens
ctagagaaaatgttaatacagt

SEQ ID NO: 8373735 - DNA, 22 bp, Homo sapiens
ctaaaaatccacactaggtgaa

SEQ ID NO: 8373736 - DNA, 22 bp, Homo sapiens
ctcagaaagggttgctgagggc

SEQ ID NO: 8373737 - DNA, 22 bp, Homo sapiens
ctcagagaagtctttgctaaac

SEQ ID NO: 8373738 - DNA, 22 bp, Homo sapiens
ctcagagaagatggatgaggta

SEQ ID NO: 8373739 - DNA, 21 bp, Homo sapiens
ctcagagaaatgtctgggagc

SEQ ID NO: 8373740 - DNA, 21 bp, Homo sapiens
ctcagagaaatgtctgggagc

SEQ ID NO: 8373741 - DNA, 22 bp, Homo sapiens
ctcagagaaatgtcacaacaat

SEQ ID NO: 8373742 - DNA, 22 bp, Homo sapiens
ctcagagaaaaggagcaagggt

SEQ ID NO: 8373743 - DNA, 22 bp, Homo sapiens
ctcagagaaaaggagcaagggt

SEQ ID NO: 8373744 - DNA, 22 bp, Homo sapiens
ttctttctctactagcagagct

SEQ ID NO: 8373745 - DNA, 22 bp, Homo sapiens
ttctttctctccacaaggcttg

SEQ ID NO: 8373746 - DNA, 21 bp, Homo sapiens
ctcagagacaaatgccatccc

SEQ ID NO: 8373747 - DNA, 22 bp, Homo sapiens
ctcagagagtgaattcctgcct

SEQ ID NO: 8373748 - DNA, 19 bp, Homo sapiens
ctcagagaggggcagtgcc

SEQ ID NO: 8373749 - DNA, 22 bp, Homo sapiens
ctcagagcaatgaacatgcaaa

SEQ ID NO: 8373750 - DNA, 22 bp, Homo sapiens
ctcagagcacagtttatgacag

SEQ ID NO: 8373751 - DNA, 22 bp, Homo sapiens
ctcagagcacttttgaaagctc

SEQ ID NO: 8373752 - DNA, 22 bp, Homo sapiens
ctcagagccagttagcaggtgc

SEQ ID NO: 8373753 - DNA, 21 bp, Homo sapiens
ctcagagcagttcagagggat

SEQ ID NO: 8373754 - DNA, 17 bp, Homo sapiens
ctcagagcaggacagaa

SEQ ID NO: 8373755 - DNA, 22 bp, Homo sapiens
ctcagagcccagggtacacccg

SEQ ID NO: 8373756 - DNA, 22 bp, Homo sapiens
ctcagagccccaggagggtgtg

SEQ ID NO: 8373757 - DNA, 22 bp, Homo sapiens
ctcagagctcgtgggaccttgg

SEQ ID NO: 8373758 - DNA, 22 bp, Homo sapiens
ctcagagctcagctttgttagt

SEQ ID NO: 8373759 - DNA, 22 bp, Homo sapiens
ctcagaggcaagcaaggagctg

SEQ ID NO: 8373760 - DNA, 22 bp, Homo sapiens
ctcagagctgaggccagggaca

SEQ ID NO: 8373761 - DNA, 22 bp, Homo sapiens
ctcacctataagtctcacagtc

SEQ ID NO: 8373762 - DNA, 22 bp, Homo sapiens
ctcacccctgtaattccagcac

SEQ ID NO: 8373763 - DNA, 22 bp, Homo sapiens
ctcaccatggatcttccatttc

SEQ ID NO: 8373764 - DNA, 22 bp, Homo sapiens
ctatagaaaattgtatcacacg

SEQ ID NO: 8373765 - DNA, 22 bp, Homo sapiens
ctatagaaacaacctctctttc

SEQ ID NO: 8373766 - DNA, 22 bp, Homo sapiens
ctataattatgctcaaaatgta

SEQ ID NO: 8373767 - DNA, 22 bp, Homo sapiens
ctataattatgctcaaaatgta

SEQ ID NO: 8373768 - DNA, 22 bp, Homo sapiens
ttctggcttagttgttgtatat

SEQ ID NO: 8373769 - DNA, 23 bp, Homo sapiens
ttctggctgtgggtggcgtctct

SEQ ID NO: 8373770 - DNA, 22 bp, Homo sapiens
ttctggcttacttcactcattt

SEQ ID NO: 8373771 - DNA, 22 bp, Homo sapiens
ttctggctttaggcttttcaag

SEQ ID NO: 8373772 - DNA, 22 bp, Homo sapiens
ttctggcttgacccctacttcc

SEQ ID NO: 8373773 - DNA, 22 bp, Homo sapiens
ttctggctcatatgctaagaag

SEQ ID NO: 8373774 - DNA, 22 bp, Homo sapiens
ttctggctccagatgcttctgt

SEQ ID NO: 8373775 - DNA, 23 bp, Homo sapiens
ttctggctccgagctccatcttc

SEQ ID NO: 8373776 - DNA, 23 bp, Homo sapiens
ttctggctccgagctccatcttc

SEQ ID NO: 8373777 - DNA, 22 bp, Homo sapiens
ttggaagattacttagttttct

SEQ ID NO: 8373778 - DNA, 22 bp, Homo sapiens
ttggaagatctaacagaggcat

SEQ ID NO: 8373779 - DNA, 22 bp, Homo sapiens
ttggaaggagcctaaaagagac

SEQ ID NO: 8373780 - DNA, 22 bp, Homo sapiens
ttggaaaagtgaaactagatgc

SEQ ID NO: 8373781 - DNA, 22 bp, Homo sapiens
ttggatcactctgaagccttac

SEQ ID NO: 8373782 - DNA, 22 bp, Homo sapiens
ttggatccatctcaggcatagg

SEQ ID NO: 8373783 - DNA, 22 bp, Homo sapiens
ctccactcaccagatgccagga

SEQ ID NO: 8373784 - DNA, 23 bp, Homo sapiens
ttggaagggaagagcatttgaga

SEQ ID NO: 8373785 - DNA, 22 bp, Homo sapiens
ttggagggtcttccacagccat

SEQ ID NO: 8373786 - DNA, 22 bp, Homo sapiens
ttggaggggccactgcagagct

SEQ ID NO: 8373787 - DNA, 22 bp, Homo sapiens
ttggaggggccactgcagagct

SEQ ID NO: 8373788 - DNA, 22 bp, Homo sapiens
ttggagggactgagcttcagtc

SEQ ID NO: 8373789 - DNA, 22 bp, Homo sapiens
ttggctctgtgtctccactcaa

SEQ ID NO: 8373790 - DNA, 22 bp, Homo sapiens
ttggctctcattttccccatta

SEQ ID NO: 8373791 - DNA, 22 bp, Homo sapiens
ttggctctgaaacccaagctct

SEQ ID NO: 8373792 - DNA, 22 bp, Homo sapiens
ttggctctgaaacccaagctct

SEQ ID NO: 8373793 - DNA, 22 bp, Homo sapiens
ctccagaggatgcaggtgaggg

SEQ ID NO: 8373794 - DNA, 22 bp, Homo sapiens
ctccagaggatgcaggtgaggg

SEQ ID NO: 8373795 - DNA, 22 bp, Homo sapiens
ctccagaggaaagcacatagtg

SEQ ID NO: 8373796 - DNA, 22 bp, Homo sapiens
ttggctctgtgtctccactcaa

SEQ ID NO: 8373797 - DNA, 22 bp, Homo sapiens
ttggctctttctcagtcacgtt

SEQ ID NO: 8373798 - DNA, 22 bp, Homo sapiens
ctccaggaccagggctcctgga

SEQ ID NO: 8373799 - DNA, 22 bp, Homo sapiens
ctccaggacagattcagggcca

SEQ ID NO: 8373800 - DNA, 22 bp, Homo sapiens
ctcaggtcttagttctgtcatc

SEQ ID NO: 8373801 - DNA, 22 bp, Homo sapiens
ctcagtactttatgtatatgat

SEQ ID NO: 8373802 - DNA, 22 bp, Homo sapiens
ctcagtcagtttttgtgagaga

SEQ ID NO: 8373803 - DNA, 22 bp, Homo sapiens
ctcaggtcacaggatggccagg

SEQ ID NO: 8373804 - DNA, 22 bp, Homo sapiens
ctcaggtcacaggatggccagg

SEQ ID NO: 8373805 - DNA, 18 bp, Homo sapiens
ctcagggcatcagtctgg

SEQ ID NO: 8373806 - DNA, 22 bp, Homo sapiens
ctcagggccaaggatgctgttg

SEQ ID NO: 8373807 - DNA, 22 bp, Homo sapiens
ttgcatatcctccaacacatgg

SEQ ID NO: 8373808 - DNA, 22 bp, Homo sapiens
ttgcatcagaattacttggagg

SEQ ID NO: 8373809 - DNA, 22 bp, Homo sapiens
ttgcatcaattccttgtcctga

SEQ ID NO: 8373810 - DNA, 22 bp, Homo sapiens
ttgcccaggctggagtgcagta

SEQ ID NO: 8373811 - DNA, 22 bp, Homo sapiens
ttgcccaggctggagtgcagtg

SEQ ID NO: 8373812 - DNA, 22 bp, Homo sapiens
ttgcccaggctggagtgcagta

SEQ ID NO: 8373813 - DNA, 22 bp, Homo sapiens
ttgcccagagtccacagcgtac

SEQ ID NO: 8373814 - DNA, 22 bp, Homo sapiens
ttgcccagagtcacccagctca

SEQ ID NO: 8373815 - DNA, 22 bp, Homo sapiens
ttgcccaggctggagtgcagtg

SEQ ID NO: 8373816 - DNA, 22 bp, Homo sapiens
ctcaggagacagtgtccacatg

SEQ ID NO: 8373817 - DNA, 22 bp, Homo sapiens
ctcaggagagtcttatatctcc

SEQ ID NO: 8373818 - DNA, 22 bp, Homo sapiens
ctcaggacccaccttattagga

SEQ ID NO: 8373819 - DNA, 22 bp, Homo sapiens
ctcaggacttggttagtgtttt

SEQ ID NO: 8373820 - DNA, 22 bp, Homo sapiens
ctcaggaagcacaggccctaca

SEQ ID NO: 8373821 - DNA, 22 bp, Homo sapiens
ctcaggaagcacaggccctaca

SEQ ID NO: 8373822 - DNA, 22 bp, Homo sapiens
ctcaggaagcctgtaatgtggg

SEQ ID NO: 8373823 - DNA, 22 bp, Homo sapiens
ctcaggaagcctgtaatgtggg

SEQ ID NO: 8373824 - DNA, 22 bp, Homo sapiens
ctcagccccaatttgccctctt

SEQ ID NO: 8373825 - DNA, 23 bp, Homo sapiens
ctcagaggcctgtccagggtggt

SEQ ID NO: 8373826 - DNA, 22 bp, Homo sapiens
ctcaggaaaatattgaagaagt

SEQ ID NO: 8373827 - DNA, 22 bp, Homo sapiens
ctcaggaaaatattgaagaagt

SEQ ID NO: 8373828 - DNA, 22 bp, Homo sapiens
ctcaggaaaggccatgcaaggg

SEQ ID NO: 8373829 - DNA, 22 bp, Homo sapiens
ctcagcttcatttgttccatga

SEQ ID NO: 8373830 - DNA, 22 bp, Homo sapiens
ctcaggaggtggtagaggccct

SEQ ID NO: 8373831 - DNA, 22 bp, Homo sapiens
ctcaggaggtggtagaggccct

SEQ ID NO: 8373832 - DNA, 22 bp, Homo sapiens
ctcaggagtagttcagcagctg

SEQ ID NO: 8373833 - DNA, 22 bp, Homo sapiens
ctcaggaggaggaagttcattg

SEQ ID NO: 8373834 - DNA, 22 bp, Homo sapiens
ttgcagaaaacagttttcttgt

SEQ ID NO: 8373835 - DNA, 22 bp, Homo sapiens
tttctcaagtactgcacatgaa

SEQ ID NO: 8373836 - DNA, 18 bp, Homo sapiens
tttctcaaggctgacatt

SEQ ID NO: 8373837 - DNA, 22 bp, Homo sapiens
tttctcaacctcaacactattt

SEQ ID NO: 8373838 - DNA, 18 bp, Homo sapiens
ctctctggtctggatccc

SEQ ID NO: 8373839 - DNA, 19 bp, Homo sapiens
ctctctggcggtgtctgcg

SEQ ID NO: 8373840 - DNA, 17 bp, Homo sapiens
tttctacagttggcagc

SEQ ID NO: 8373841 - DNA, 22 bp, Homo sapiens
tttctacatgtcagtaactgat

SEQ ID NO: 8373842 - DNA, 22 bp, Homo sapiens
tttctacatgtcagtaactgat

SEQ ID NO: 8373843 - DNA, 22 bp, Homo sapiens
tttctacatgtcaatccaaacc

SEQ ID NO: 8373844 - DNA, 22 bp, Homo sapiens
tttctattttaaaggcatatgg

SEQ ID NO: 8373845 - DNA, 22 bp, Homo sapiens
tttctcaacagagtatgccctt

SEQ ID NO: 8373846 - DNA, 22 bp, Homo sapiens
tttctcaaaagacagaagtgaa

SEQ ID NO: 8373847 - DNA, 23 bp, Homo sapiens
tttctcaaagagtggcagcttca

SEQ ID NO: 8373848 - DNA, 22 bp, Homo sapiens
ctctctttgatgtataaataat

SEQ ID NO: 8373849 - DNA, 22 bp, Homo sapiens
ctctctttgatgtataaataat

SEQ ID NO: 8373850 - DNA, 18 bp, Homo sapiens
ctctctttccactctttg

SEQ ID NO: 8373851 - DNA, 18 bp, Homo sapiens
ctctctttccactctttg

SEQ ID NO: 8373852 - DNA, 18 bp, Homo sapiens
ctctctttccactctttg

SEQ ID NO: 8373853 - DNA, 22 bp, Homo sapiens
tttccaagtgtcaggtgcaaaa

SEQ ID NO: 8373854 - DNA, 22 bp, Homo sapiens
tttccaagataatacacagaaa

SEQ ID NO: 8373855 - DNA, 18 bp, Homo sapiens
tttccaagaagagagctc

SEQ ID NO: 8373856 - DNA, 18 bp, Homo sapiens
tttcattataaagcaggc

SEQ ID NO: 8373857 - DNA, 22 bp, Homo sapiens
tttcattagtatgacagcacgc

SEQ ID NO: 8373858 - DNA, 22 bp, Homo sapiens
tttcattaaagtcaaatctggt

SEQ ID NO: 8373859 - DNA, 22 bp, Homo sapiens
tttcattacgtgtttgacttgt

SEQ ID NO: 8373860 - DNA, 22 bp, Homo sapiens
tttcatgtttatggaaaatgag

SEQ ID NO: 8373861 - DNA, 22 bp, Homo sapiens
tttcatgttacatttaaaatgt

SEQ ID NO: 8373862 - DNA, 22 bp, Homo sapiens
tttcatgttacatttaaaatgt

SEQ ID NO: 8373863 - DNA, 22 bp, Homo sapiens
tttccacaatgtttttgcagga

SEQ ID NO: 8373864 - DNA, 22 bp, Homo sapiens
tttccactcctattgcatctca

SEQ ID NO: 8373865 - DNA, 22 bp, Homo sapiens
tttcctttccaaaattctgcct

SEQ ID NO: 8373866 - DNA, 22 bp, Homo sapiens
tttccacagctgtataaaataa

SEQ ID NO: 8373867 - DNA, 22 bp, Homo sapiens
tttctacaatttttggcatgag

SEQ ID NO: 8373868 - DNA, 22 bp, Homo sapiens
tttctacaacacttctgaatct

SEQ ID NO: 8373869 - DNA, 22 bp, Homo sapiens
tttcctttctcaagagccggca

SEQ ID NO: 8373870 - DNA, 22 bp, Homo sapiens
tttcctttctagaagcctaaat

SEQ ID NO: 8373871 - DNA, 22 bp, Homo sapiens
tttctacagaagatacactgct

SEQ ID NO: 8373872 - DNA, 22 bp, Homo sapiens
tttctacagctggtgcaacttt

SEQ ID NO: 8373873 - DNA, 22 bp, Homo sapiens
tttattcatcatctgttcatat

SEQ ID NO: 8373874 - DNA, 22 bp, Homo sapiens
tttattcattgtttcgtcgcag

SEQ ID NO: 8373875 - DNA, 22 bp, Homo sapiens
tttcacatataggggaagctac

SEQ ID NO: 8373876 - DNA, 22 bp, Homo sapiens
tttcacatatcaactctatcct

SEQ ID NO: 8373877 - DNA, 22 bp, Homo sapiens
tttcagaaatggcactgaaatc

SEQ ID NO: 8373878 - DNA, 22 bp, Homo sapiens
tttcacatataggggaagctac

SEQ ID NO: 8373879 - DNA, 22 bp, Homo sapiens
tttcagaaattatattagatgc

SEQ ID NO: 8373880 - DNA, 22 bp, Homo sapiens
tttcagaaatggcactgaaatc

SEQ ID NO: 8373881 - DNA, 22 bp, Homo sapiens
tttcagaaccaagagagacatc

SEQ ID NO: 8373882 - DNA, 22 bp, Homo sapiens
tttcagaaggggagaaaggtca

SEQ ID NO: 8373883 - DNA, 22 bp, Homo sapiens
tttcagaaccgctaaaataaat

SEQ ID NO: 8373884 - DNA, 22 bp, Homo sapiens
tttcagaaccaagagagacatc

SEQ ID NO: 8373885 - DNA, 22 bp, Homo sapiens
ctccttcccctactcagcatcc

SEQ ID NO: 8373886 - DNA, 22 bp, Homo sapiens
ctccttcctggttagcacctta

SEQ ID NO: 8373887 - DNA, 22 bp, Homo sapiens
ctccttcctgccccagtgataa

SEQ ID NO: 8373888 - DNA, 22 bp, Homo sapiens
ctccttcctgcagatctgagat

SEQ ID NO: 8373889 - DNA, 22 bp, Homo sapiens
tttcagtttatgtcttgaatta

SEQ ID NO: 8373890 - DNA, 22 bp, Homo sapiens
tttcatgttacagtgtaaaagt

SEQ ID NO: 8373891 - DNA, 22 bp, Homo sapiens
tttcagaagtcacagttgactg

SEQ ID NO: 8373892 - DNA, 22 bp, Homo sapiens
tttcagaatagcaaagcaagct

SEQ ID NO: 8373893 - DNA, 22 bp, Homo sapiens
tttcagaatagcaaagcaagct

SEQ ID NO: 8373894 - DNA, 22 bp, Homo sapiens
ctccttcatgtcatgtgtccgg

SEQ ID NO: 8373895 - DNA, 22 bp, Homo sapiens
ctccttcatgtcatgtgtccgg

SEQ ID NO: 8373896 - DNA, 22 bp, Homo sapiens
tttatgcacacttagacatggc

SEQ ID NO: 8373897 - DNA, 22 bp, Homo sapiens
tttatgcagcctcagtatcaga

SEQ ID NO: 8373898 - DNA, 23 bp, Homo sapiens
tttatgcagcatgtagaacatgg

SEQ ID NO: 8373899 - DNA, 22 bp, Homo sapiens
tttatgctactcaatagtcagt

SEQ ID NO: 8373900 - DNA, 19 bp, Homo sapiens
tttattcacctttaccttg

SEQ ID NO: 8373901 - DNA, 22 bp, Homo sapiens
tttatgtaagtggaatgatgcc

SEQ ID NO: 8373902 - DNA, 22 bp, Homo sapiens
tttatgtaatttcataggtgtg

SEQ ID NO: 8373903 - DNA, 22 bp, Homo sapiens
tttatgtaagtggaatgatgcc

SEQ ID NO: 8373904 - DNA, 22 bp, Homo sapiens
tttattcacttcagtgccaaag

SEQ ID NO: 8373905 - DNA, 22 bp, Homo sapiens
tttattcagcagcagcagtggt

SEQ ID NO: 8373906 - DNA, 22 bp, Homo sapiens
tttattcagcagcagcagtggt

SEQ ID NO: 8373907 - DNA, 23 bp, Homo sapiens
tttatattcctaatgtcttgagc

SEQ ID NO: 8373908 - DNA, 22 bp, Homo sapiens
tttatgattattttaaagcagc

SEQ ID NO: 8373909 - DNA, 19 bp, Homo sapiens
ctccaggatggctgggcga

SEQ ID NO: 8373910 - DNA, 22 bp, Homo sapiens
ctccaggagtggcctggacacc

SEQ ID NO: 8373911 - DNA, 22 bp, Homo sapiens
ctccaggagggggatggctgta

SEQ ID NO: 8373912 - DNA, 22 bp, Homo sapiens
tttgttctaacttctgcagaca

SEQ ID NO: 8373913 - DNA, 22 bp, Homo sapiens
tttgttcattttgagctcatca

SEQ ID NO: 8373914 - DNA, 22 bp, Homo sapiens
ctctgtgccctactgctcagct

SEQ ID NO: 8373915 - DNA, 22 bp, Homo sapiens
ctctgtggaagaagaaagaagg

SEQ ID NO: 8373916 - DNA, 22 bp, Homo sapiens
ctctgtgggggagaggcagctg

SEQ ID NO: 8373917 - DNA, 22 bp, Homo sapiens
ctctgtgggccagagaggcccc

SEQ ID NO: 8373918 - DNA, 21 bp, Homo sapiens
ttttgctgttttagaatgaga

SEQ ID NO: 8373919 - DNA, 22 bp, Homo sapiens
ctctgtgttccgggttgctgct

SEQ ID NO: 8373920 - DNA, 22 bp, Homo sapiens
ttttctcttccctctggacctg

SEQ ID NO: 8373921 - DNA, 22 bp, Homo sapiens
ttttgcctaagaatctctctga

SEQ ID NO: 8373922 - DNA, 22 bp, Homo sapiens
ctctgtgtatccaagttcaggt

SEQ ID NO: 8373923 - DNA, 22 bp, Homo sapiens
ctctgtgtcagctgggtgtgca

SEQ ID NO: 8373924 - DNA, 22 bp, Homo sapiens
ctctgtgtggtcctctgtattg

SEQ ID NO: 8373925 - DNA, 22 bp, Homo sapiens
ctctgtgttcagcctagcagaa

SEQ ID NO: 8373926 - DNA, 22 bp, Homo sapiens
ctctggctatctgtttctatgt

SEQ ID NO: 8373927 - DNA, 22 bp, Homo sapiens
ctctggctatggcacggcgctc

SEQ ID NO: 8373928 - DNA, 22 bp, Homo sapiens
ctctggctatctgtttctatgt

SEQ ID NO: 8373929 - DNA, 22 bp, Homo sapiens
ctctggctatctgtttctatgt

SEQ ID NO: 8373930 - DNA, 22 bp, Homo sapiens
ctctggctccatttccctatgt

SEQ ID NO: 8373931 - DNA, 22 bp, Homo sapiens
ctctggctccatttccctatgt

SEQ ID NO: 8373932 - DNA, 22 bp, Homo sapiens
tttggaagtcctgaaatagagg

SEQ ID NO: 8373933 - DNA, 22 bp, Homo sapiens
ctctggctcccgcagcccccat

SEQ ID NO: 8373934 - DNA, 22 bp, Homo sapiens
tttggaatgacagatatcaata

SEQ ID NO: 8373935 - DNA, 19 bp, Homo sapiens
ctctgggctgcatcttggt

SEQ ID NO: 8373936 - DNA, 22 bp, Homo sapiens
tttggaatgtagtttaatcatc

SEQ ID NO: 8373937 - DNA, 22 bp, Homo sapiens
ctctgggtgagacagacctggt

SEQ ID NO: 8373938 - DNA, 23 bp, Homo sapiens
ctctgggtccgatgtcctgacag

SEQ ID NO: 8373939 - DNA, 17 bp, Homo sapiens
ctctgggtctcctgctt

SEQ ID NO: 8373940 - DNA, 21 bp, Homo sapiens
tttgttcaggcaagttacagt

SEQ ID NO: 8373941 - DNA, 22 bp, Homo sapiens
ctctgggtgttaatgtcagtgt

SEQ ID NO: 8373942 - DNA, 22 bp, Homo sapiens
ctctggcagagctgtagacttc

SEQ ID NO: 8373943 - DNA, 22 bp, Homo sapiens
ctctggcctgcagatccatgct

SEQ ID NO: 8373944 - DNA, 22 bp, Homo sapiens
tttgcaaagaaattattgctgt

SEQ ID NO: 8373945 - DNA, 22 bp, Homo sapiens
tttgcaaagaaattattgctgt

SEQ ID NO: 8373946 - DNA, 22 bp, Homo sapiens
ctctggagtgcagcctggtggc

SEQ ID NO: 8373947 - DNA, 22 bp, Homo sapiens
tttgagaaaggggatttaattc

SEQ ID NO: 8373948 - DNA, 22 bp, Homo sapiens
tttgagaaaggggatttaattc

SEQ ID NO: 8373949 - DNA, 22 bp, Homo sapiens
tttgagaaactgattattatgg

SEQ ID NO: 8373950 - DNA, 22 bp, Homo sapiens
tttgagaaactgattattatgg

SEQ ID NO: 8373951 - DNA, 22 bp, Homo sapiens
tttgagaactttggtattttcc

SEQ ID NO: 8373952 - DNA, 22 bp, Homo sapiens
tttgagaaccctgtattttaag

SEQ ID NO: 8373953 - DNA, 22 bp, Homo sapiens
tttgagaaccctgtattttaag

SEQ ID NO: 8373954 - DNA, 22 bp, Homo sapiens
tttgagaagatgtaatgttaag

SEQ ID NO: 8373955 - DNA, 22 bp, Homo sapiens
tttgcaaacacttaagaagaga

SEQ ID NO: 8373956 - DNA, 22 bp, Homo sapiens
tttgcaaacggccctgagtccc

SEQ ID NO: 8373957 - DNA, 22 bp, Homo sapiens
tttgcaaaccggagctctgcaa

SEQ ID NO: 8373958 - DNA, 22 bp, Homo sapiens
tttgcaaacacttaagaagaga

SEQ ID NO: 8373959 - DNA, 22 bp, Homo sapiens
tttgcaaacattcagggctcca

SEQ ID NO: 8373960 - DNA, 22 bp, Homo sapiens
tttgaaagaatttatgtacttt

SEQ ID NO: 8373961 - DNA, 22 bp, Homo sapiens
tttgaaagaaaccagtgagtga

SEQ ID NO: 8373962 - DNA, 22 bp, Homo sapiens
tttgaaaaaggcctttggtatg

SEQ ID NO: 8373963 - DNA, 22 bp, Homo sapiens
tttgaaaaaggcctttggtatg

SEQ ID NO: 8373964 - DNA, 22 bp, Homo sapiens
tttgaaaagaaccatcgcctta

SEQ ID NO: 8373965 - DNA, 22 bp, Homo sapiens
ctctgaggtttcctcacaagct

SEQ ID NO: 8373966 - DNA, 22 bp, Homo sapiens
tttgaaagagctgatacatgaa

SEQ ID NO: 8373967 - DNA, 22 bp, Homo sapiens
tttgaaagacagaatatttttg

SEQ ID NO: 8373968 - DNA, 22 bp, Homo sapiens
tttgaaagagctgatacatgaa

SEQ ID NO: 8373969 - DNA, 19 bp, Homo sapiens
tttgaaagagttttattgg

SEQ ID NO: 8373970 - DNA, 22 bp, Homo sapiens
ctctgaggtctaggaccatggc

SEQ ID NO: 8373971 - DNA, 22 bp, Homo sapiens
ctctgcaacttctagcagtgtc

SEQ ID NO: 8373972 - DNA, 20 bp, Homo sapiens
tttgactaggtaagtgcttt

SEQ ID NO: 8373973 - DNA, 22 bp, Homo sapiens
tttgaataatcactgggcatta

SEQ ID NO: 8373974 - DNA, 22 bp, Homo sapiens
tttgacattggcttattctgtt

SEQ ID NO: 8373975 - DNA, 22 bp, Homo sapiens
ctctgcagaatttgagctgctc

SEQ ID NO: 8373976 - DNA, 22 bp, Homo sapiens
ctctgcagaatttgagctgctc

SEQ ID NO: 8373977 - DNA, 22 bp, Homo sapiens
ctggagccccaggctgtgcaga

SEQ ID NO: 8373978 - DNA, 22 bp, Homo sapiens
ctggagcaggtttaggagtccc

SEQ ID NO: 8373979 - DNA, 22 bp, Homo sapiens
ctggagcctaggttgacctggg

SEQ ID NO: 8373980 - DNA, 22 bp, Homo sapiens
ctggagccctgaatgggcagga

SEQ ID NO: 8373981 - DNA, 22 bp, Homo sapiens
ctggagccgcatggagcaggga

SEQ ID NO: 8373982 - DNA, 22 bp, Homo sapiens
ctggagccgcatggagcaggga

SEQ ID NO: 8373983 - DNA, 22 bp, Homo sapiens
ctggagccggaccagggacggt

SEQ ID NO: 8373984 - DNA, 22 bp, Homo sapiens
ctggagccggaccagggacggt

SEQ ID NO: 8373985 - DNA, 22 bp, Homo sapiens
ctggagagatcctcctgaaaaa

SEQ ID NO: 8373986 - DNA, 22 bp, Homo sapiens
ctggagagtaatctctgtgtta

SEQ ID NO: 8373987 - DNA, 22 bp, Homo sapiens
ctggagcagcaggtggccaggg

SEQ ID NO: 8373988 - DNA, 22 bp, Homo sapiens
ctggaaggcggaggttgtagtg

SEQ ID NO: 8373989 - DNA, 22 bp, Homo sapiens
ctggaaggcagaggttgcagtg

SEQ ID NO: 8373990 - DNA, 22 bp, Homo sapiens
ctggaagggtcagagtgatgag

SEQ ID NO: 8373991 - DNA, 22 bp, Homo sapiens
ctggaaggttcctcccagctcc

SEQ ID NO: 8373992 - DNA, 22 bp, Homo sapiens
ctggagaacagagctgtttaga

SEQ ID NO: 8373993 - DNA, 22 bp, Homo sapiens
ctgctgtgagtttggaggtcta

SEQ ID NO: 8373994 - DNA, 22 bp, Homo sapiens
ctggaaagtgaggagagttcca

SEQ ID NO: 8373995 - DNA, 22 bp, Homo sapiens
ctgctgtctcactggtgtggtt

SEQ ID NO: 8373996 - DNA, 22 bp, Homo sapiens
ctgctgtctcactggtgtggtt

SEQ ID NO: 8373997 - DNA, 20 bp, Homo sapiens
ctggaagcctttccagagca

SEQ ID NO: 8373998 - DNA, 22 bp, Homo sapiens
ctggaagcttgtttgccagtct

SEQ ID NO: 8373999 - DNA, 22 bp, Homo sapiens
ctggaaggagaaggaggctgtg

SEQ ID NO: 8374000 - DNA, 22 bp, Homo sapiens
ctggaagaggaagccagctgga

SEQ ID NO: 8374001 - DNA, 22 bp, Homo sapiens
ctgctggtgcagagtggggctg

SEQ ID NO: 8374002 - DNA, 19 bp, Homo sapiens
ctgctgggtgctgagggag

SEQ ID NO: 8374003 - DNA, 19 bp, Homo sapiens
ctgctgggtgctgagggag

SEQ ID NO: 8374004 - DNA, 22 bp, Homo sapiens
ctgctgggtctatgcaagtgga

SEQ ID NO: 8374005 - DNA, 22 bp, Homo sapiens
ctgctgggcagaggctgcatga

SEQ ID NO: 8374006 - DNA, 22 bp, Homo sapiens
ctgctgagagctgaaggctgta

SEQ ID NO: 8374007 - DNA, 20 bp, Homo sapiens
ctgctgagagcctggcttgc

SEQ ID NO: 8374008 - DNA, 22 bp, Homo sapiens
ctgctgagcatcagggctgccc

SEQ ID NO: 8374009 - DNA, 22 bp, Homo sapiens
ctgctgggaaggtctgctcagt

SEQ ID NO: 8374010 - DNA, 22 bp, Homo sapiens
ctgctgggcagaggctgcatga

SEQ ID NO: 8374011 - DNA, 22 bp, Homo sapiens
ctgctgagaaaagactgaggga

SEQ ID NO: 8374012 - DNA, 22 bp, Homo sapiens
ctgctgagactggctttgtgtc

SEQ ID NO: 8374013 - DNA, 22 bp, Homo sapiens
ctgccttccaaccccagactcc

SEQ ID NO: 8374014 - DNA, 22 bp, Homo sapiens
ctgccttcatctctgagctggg

SEQ ID NO: 8374015 - DNA, 22 bp, Homo sapiens
ctgcctgtttcctcttgctccc

SEQ ID NO: 8374016 - DNA, 22 bp, Homo sapiens
ctgcctgtgggtacaagtggaa

SEQ ID NO: 8374017 - DNA, 22 bp, Homo sapiens
ctgctctgaccctttcaccttc

SEQ ID NO: 8374018 - DNA, 21 bp, Homo sapiens
ctgctctgacagtgaggccag

SEQ ID NO: 8374019 - DNA, 22 bp, Homo sapiens
ctgctctgtggtccatgagaca

SEQ ID NO: 8374020 - DNA, 22 bp, Homo sapiens
ctgctctgtttcttagctgggt

SEQ ID NO: 8374021 - DNA, 22 bp, Homo sapiens
ctgctctgttcccccatcatct

SEQ ID NO: 8374022 - DNA, 22 bp, Homo sapiens
ctgcgcaggggtggcgccagaa

SEQ ID NO: 8374023 - DNA, 22 bp, Homo sapiens
ctgcctttgcccttgacactgt

SEQ ID NO: 8374024 - DNA, 22 bp, Homo sapiens
ctcttctgtacctcggcctcca

SEQ ID NO: 8374025 - DNA, 22 bp, Homo sapiens
ctcttcctagtgtgcagcgtgg

SEQ ID NO: 8374026 - DNA, 22 bp, Homo sapiens
ctcttcctctcatgcggtcata

SEQ ID NO: 8374027 - DNA, 22 bp, Homo sapiens
ctcttcctacagtctgctatgc

SEQ ID NO: 8374028 - DNA, 22 bp, Homo sapiens
ctcttccttaagactataaaga

SEQ ID NO: 8374029 - DNA, 22 bp, Homo sapiens
ctcttcctttcccttgagggtg

SEQ ID NO: 8374030 - DNA, 22 bp, Homo sapiens
ctcttcctttcccttgagggtg

SEQ ID NO: 8374031 - DNA, 22 bp, Homo sapiens
ttttggaacacagacattagaa

SEQ ID NO: 8374032 - DNA, 22 bp, Homo sapiens
ttttggaacacagacattagaa

SEQ ID NO: 8374033 - DNA, 22 bp, Homo sapiens
ttttggaacacagacattagaa

SEQ ID NO: 8374034 - DNA, 22 bp, Homo sapiens
ttttggaatcatttacagagca

SEQ ID NO: 8374035 - DNA, 22 bp, Homo sapiens
ttttggaatcatttacagagca

SEQ ID NO: 8374036 - DNA, 22 bp, Homo sapiens
ttttggaagccgcggctgggca

SEQ ID NO: 8374037 - DNA, 22 bp, Homo sapiens
ttttggaaccaacagtgcacct

SEQ ID NO: 8374038 - DNA, 22 bp, Homo sapiens
ttttggaaccaacagtgcacct

SEQ ID NO: 8374039 - DNA, 19 bp, Homo sapiens
ttttggaaatgtgaacagc

SEQ ID NO: 8374040 - DNA, 19 bp, Homo sapiens
ttttggaaatgtgaacagc

SEQ ID NO: 8374041 - DNA, 22 bp, Homo sapiens
ctgagcagcgtggggagctggc

SEQ ID NO: 8374042 - DNA, 22 bp, Homo sapiens
ctgagcagctgttacagagtgt

SEQ ID NO: 8374043 - DNA, 22 bp, Homo sapiens
ctgagcaggatattcacagcag

SEQ ID NO: 8374044 - DNA, 22 bp, Homo sapiens
ctgagcaggacagtgggagacc

SEQ ID NO: 8374045 - DNA, 22 bp, Homo sapiens
ctgagcaggacagtgggagacc

SEQ ID NO: 8374046 - DNA, 22 bp, Homo sapiens
ctgagcagtctgactcaagcta

SEQ ID NO: 8374047 - DNA, 22 bp, Homo sapiens
ctgagcagtctgactcaagcta

SEQ ID NO: 8374048 - DNA, 22 bp, Homo sapiens
ctgagcagtgctttgcagtggg

SEQ ID NO: 8374049 - DNA, 22 bp, Homo sapiens
ctgagcagtggttcttgagcgc

SEQ ID NO: 8374050 - DNA, 22 bp, Homo sapiens
ctgagcagtttcttagggctca

SEQ ID NO: 8374051 - DNA, 22 bp, Homo sapiens
ctgagcaggcggtggagcggct

SEQ ID NO: 8374052 - DNA, 22 bp, Homo sapiens
ctgagcagtctagccaggtgtt

SEQ ID NO: 8374053 - DNA, 22 bp, Homo sapiens
ctgagcagtctagccaggtgtt

SEQ ID NO: 8374054 - DNA, 22 bp, Homo sapiens
ctgagcagtctagccaggtgtt

SEQ ID NO: 8374055 - DNA, 22 bp, Homo sapiens
ctgagcagtagagggtctcttt

SEQ ID NO: 8374056 - DNA, 22 bp, Homo sapiens
ctgaggctggagtgcagtggtg

SEQ ID NO: 8374057 - DNA, 22 bp, Homo sapiens
ctgaggctggagtgcagtggtg

SEQ ID NO: 8374058 - DNA, 22 bp, Homo sapiens
ctgaggctgcccagggccaggt

SEQ ID NO: 8374059 - DNA, 22 bp, Homo sapiens
ctgaggctgcccagggccaggt

SEQ ID NO: 8374060 - DNA, 22 bp, Homo sapiens
ctgaggctctgggtgtcactgt

SEQ ID NO: 8374061 - DNA, 22 bp, Homo sapiens
ctgaggctgaagagggcctacg

SEQ ID NO: 8374062 - DNA, 22 bp, Homo sapiens
ctgaggctccctcgggtctgct

SEQ ID NO: 8374063 - DNA, 18 bp, Homo sapiens
ctgaggctggcaggagcc

SEQ ID NO: 8374064 - DNA, 18 bp, Homo sapiens
ctgaggctggcaggagcc

SEQ ID NO: 8374065 - DNA, 18 bp, Homo sapiens
ctgaggctggcaggagcc

SEQ ID NO: 8374066 - DNA, 17 bp, Homo sapiens
ctgaggggagtgctgtg

SEQ ID NO: 8374067 - DNA, 22 bp, Homo sapiens
ctgaggtccttgactgcttgcc

SEQ ID NO: 8374068 - DNA, 22 bp, Homo sapiens
ctgaggtcctcagagggaaagg

SEQ ID NO: 8374069 - DNA, 22 bp, Homo sapiens
ctgaggctcaagggcaggtggg

SEQ ID NO: 8374070 - DNA, 22 bp, Homo sapiens
ctgaggctcaagggcaggtggg

SEQ ID NO: 8374071 - DNA, 22 bp, Homo sapiens
ctgagcatccagcaggtactgc

SEQ ID NO: 8374072 - DNA, 22 bp, Homo sapiens
ctgagcatgctacatgcagcac

SEQ ID NO: 8374073 - DNA, 22 bp, Homo sapiens
ctgagccaaaaagcagagcttg

SEQ ID NO: 8374074 - DNA, 22 bp, Homo sapiens
ctgagcatttgtgcagcttctc

SEQ ID NO: 8374075 - DNA, 22 bp, Homo sapiens
ctgagccaaccacagcaggagc

SEQ ID NO: 8374076 - DNA, 22 bp, Homo sapiens
ctgaggccgttggtgggcctta

SEQ ID NO: 8374077 - DNA, 22 bp, Homo sapiens
ctgcccctgccaggcagctgtc

SEQ ID NO: 8374078 - DNA, 22 bp, Homo sapiens
ctgccccaccccaacctgaggt

SEQ ID NO: 8374079 - DNA, 22 bp, Homo sapiens
ctgcccagtttgggagcctttc

SEQ ID NO: 8374080 - DNA, 22 bp, Homo sapiens
ctgcccagtttgggagcctttc

SEQ ID NO: 8374081 - DNA, 22 bp, Homo sapiens
ctgcccaggctgaaggaacatc

SEQ ID NO: 8374082 - DNA, 22 bp, Homo sapiens
ctgcccaggggagtgctgtcgg

SEQ ID NO: 8374083 - DNA, 22 bp, Homo sapiens
ctgcccaggggagtgctgtcgg

SEQ ID NO: 8374084 - DNA, 22 bp, Homo sapiens
ctgcccaggctgaaggaacatc

SEQ ID NO: 8374085 - DNA, 22 bp, Homo sapiens
ctgcccaggctgaaggaacatc

SEQ ID NO: 8374086 - DNA, 22 bp, Homo sapiens
ctgcccaggctgaaggaacatc

SEQ ID NO: 8374087 - DNA, 22 bp, Homo sapiens
ctgcccaggaaccagaggggca

SEQ ID NO: 8374088 - DNA, 22 bp, Homo sapiens
ctgcccaggaaggagaggatgg

SEQ ID NO: 8374089 - DNA, 20 bp, Homo sapiens
ctgcccagccactgagggat

SEQ ID NO: 8374090 - DNA, 20 bp, Homo sapiens
ctgcccagccactgagggat

SEQ ID NO: 8374091 - DNA, 22 bp, Homo sapiens
ctgcccagattttaccacctgc

SEQ ID NO: 8374092 - DNA, 22 bp, Homo sapiens
ctgcccagattttaccacctgc

SEQ ID NO: 8374093 - DNA, 22 bp, Homo sapiens
ctgccattggattttcacattt

SEQ ID NO: 8374094 - DNA, 22 bp, Homo sapiens
ctgcaggatttcatgggctgac

SEQ ID NO: 8374095 - DNA, 22 bp, Homo sapiens
ctgcaggatttcatgggctgac

SEQ ID NO: 8374096 - DNA, 22 bp, Homo sapiens
ctgcaggcatctaactgtgggc

SEQ ID NO: 8374097 - DNA, 22 bp, Homo sapiens
ctgcaggagcaaagcctctgct

SEQ ID NO: 8374098 - DNA, 22 bp, Homo sapiens
ctgcagctgggccagggccacc

SEQ ID NO: 8374099 - DNA, 22 bp, Homo sapiens
ctgcagctgtctctactgggca

SEQ ID NO: 8374100 - DNA, 22 bp, Homo sapiens
ctgcagctgtctctactgggca

SEQ ID NO: 8374101 - DNA, 22 bp, Homo sapiens
ctgcagctgtagaggacagtgg

SEQ ID NO: 8374102 - DNA, 22 bp, Homo sapiens
ctgcagcttaaaggagttcaat

SEQ ID NO: 8374103 - DNA, 22 bp, Homo sapiens
ctgcagctgtgagtgctggatg

SEQ ID NO: 8374104 - DNA, 22 bp, Homo sapiens
ctgcagcttaagggaggggttg

SEQ ID NO: 8374105 - DNA, 22 bp, Homo sapiens
ctgcagcttatttgctgtgtga

SEQ ID NO: 8374106 - DNA, 22 bp, Homo sapiens
ctgcaggactgaaagatgaggt

SEQ ID NO: 8374107 - DNA, 22 bp, Homo sapiens
ctgcagctttggaaacctgttt

SEQ ID NO: 8374108 - DNA, 22 bp, Homo sapiens
ctgcagcttatttgctgtgtga

SEQ ID NO: 8374109 - DNA, 22 bp, Homo sapiens
ctgcagcttatttgctgtgtga

SEQ ID NO: 8374110 - DNA, 22 bp, Homo sapiens
ctgcagctttcgctccatcagc

SEQ ID NO: 8374111 - DNA, 22 bp, Homo sapiens
ctgcagctttttgtgcttgtaa

SEQ ID NO: 8374112 - DNA, 22 bp, Homo sapiens
ctgcagctttttgtgcttgtaa

SEQ ID NO: 8374113 - DNA, 22 bp, Homo sapiens
ctgcagctttttgtgcttgtaa

SEQ ID NO: 8374114 - DNA, 22 bp, Homo sapiens
ctgaggtgagaggaggccatgt

SEQ ID NO: 8374115 - DNA, 22 bp, Homo sapiens
ctgaggtgctagggtccctgct

SEQ ID NO: 8374116 - DNA, 22 bp, Homo sapiens
ctgaggtgatggcccgttttcc

SEQ ID NO: 8374117 - DNA, 22 bp, Homo sapiens
ctgaggtgtgctttcaatgggt

SEQ ID NO: 8374118 - DNA, 22 bp, Homo sapiens
ctgaggtgttgatgacctatgc

SEQ ID NO: 8374119 - DNA, 22 bp, Homo sapiens
ctgaggtgtggtctgggagtat

SEQ ID NO: 8374120 - DNA, 22 bp, Homo sapiens
ctgaggtgtttagtaggggcgg

SEQ ID NO: 8374121 - DNA, 22 bp, Homo sapiens
ctgaggtggggcctgggcatca

SEQ ID NO: 8374122 - DNA, 22 bp, Homo sapiens
ctgaggtggcatcctagctcta

SEQ ID NO: 8374123 - DNA, 22 bp, Homo sapiens
ccctgcagccggccagctcatt

SEQ ID NO: 8374124 - DNA, 17 bp, Homo sapiens
ccctgcaccctactctc

SEQ ID NO: 8374125 - DNA, 22 bp, Homo sapiens
ccctgcctgtgggcatcaacat

SEQ ID NO: 8374126 - DNA, 22 bp, Homo sapiens
ccctgcctctgaagctgctcag

SEQ ID NO: 8374127 - DNA, 22 bp, Homo sapiens
ccctgcctacagggttttcttt

SEQ ID NO: 8374128 - DNA, 22 bp, Homo sapiens
tggacagttactgagcttgagt

SEQ ID NO: 8374129 - DNA, 22 bp, Homo sapiens
ccctgccttggggtccacaccg

SEQ ID NO: 8374130 - DNA, 22 bp, Homo sapiens
ccctgccttcttggcctttaaa

SEQ ID NO: 8374131 - DNA, 22 bp, Homo sapiens
ccctgccttgttggagcctatg

SEQ ID NO: 8374132 - DNA, 22 bp, Homo sapiens
ccctgccttgtctgggctaggt

SEQ ID NO: 8374133 - DNA, 22 bp, Homo sapiens
ccctgctcttctgactcaagct

SEQ ID NO: 8374134 - DNA, 22 bp, Homo sapiens
ccctgctgaatcccatggagtc

SEQ ID NO: 8374135 - DNA, 22 bp, Homo sapiens
tggaggtgaaatgagattttgt

SEQ ID NO: 8374136 - DNA, 22 bp, Homo sapiens
tggaggtcttacccagggctat

SEQ ID NO: 8374137 - DNA, 22 bp, Homo sapiens
tggaggtctctgtctgggcagg

SEQ ID NO: 8374138 - DNA, 22 bp, Homo sapiens
ccctagaaatgaaagcatacgt

SEQ ID NO: 8374139 - DNA, 19 bp, Homo sapiens
ccctagagtaagactgcat

SEQ ID NO: 8374140 - DNA, 22 bp, Homo sapiens
tggaaagacattcagccgctgg

SEQ ID NO: 8374141 - DNA, 22 bp, Homo sapiens
tggaaagacatgtccttcatta

SEQ ID NO: 8374142 - DNA, 22 bp, Homo sapiens
tggaaagagaaactcttgctaa

SEQ ID NO: 8374143 - DNA, 22 bp, Homo sapiens
tggaaagacattcagccgctgg

SEQ ID NO: 8374144 - DNA, 22 bp, Homo sapiens
tggaagaagctacaagcggtga

SEQ ID NO: 8374145 - DNA, 22 bp, Homo sapiens
tggaaggcgtctcgaaggccta

SEQ ID NO: 8374146 - DNA, 22 bp, Homo sapiens
tggaaggctaggtgctaggccc

SEQ ID NO: 8374147 - DNA, 19 bp, Homo sapiens
tggaaggctaagacacttg

SEQ ID NO: 8374148 - DNA, 22 bp, Homo sapiens
tggaagacatactgttttctta

SEQ ID NO: 8374149 - DNA, 22 bp, Homo sapiens
tgctttcagctggtaaagaaac

SEQ ID NO: 8374150 - DNA, 22 bp, Homo sapiens
tgctttcaatgaattgtatact

SEQ ID NO: 8374151 - DNA, 19 bp, Homo sapiens
tgcctgctcctggcttcca

SEQ ID NO: 8374152 - DNA, 22 bp, Homo sapiens
tgctttattgcatcagtgtggg

SEQ ID NO: 8374153 - DNA, 23 bp, Homo sapiens
tgcctccaccgagggccaggcat

SEQ ID NO: 8374154 - DNA, 17 bp, Homo sapiens
tgcctccagcagggtga

SEQ ID NO: 8374155 - DNA, 22 bp, Homo sapiens
tgcctccatgtttcagcatcta

SEQ ID NO: 8374156 - DNA, 22 bp, Homo sapiens
tgcctccaggaggggcagctct

SEQ ID NO: 8374157 - DNA, 22 bp, Homo sapiens
tgcctcagtttcatctgcagaa

SEQ ID NO: 8374158 - DNA, 22 bp, Homo sapiens
tgcctcagtttctccatatgaa

SEQ ID NO: 8374159 - DNA, 22 bp, Homo sapiens
tgcctgccctttccacacagcc

SEQ ID NO: 8374160 - DNA, 18 bp, Homo sapiens
tgcctgccccgtaagggt

SEQ ID NO: 8374161 - DNA, 22 bp, Homo sapiens
tgcctgcctgcatagtcccacg

SEQ ID NO: 8374162 - DNA, 22 bp, Homo sapiens
ccggagagtcagagcgcggccc

SEQ ID NO: 8374163 - DNA, 22 bp, Homo sapiens
ccctttccatggctctcctagg

SEQ ID NO: 8374164 - DNA, 22 bp, Homo sapiens
ccctgtggatttcagtttgtgt

SEQ ID NO: 8374165 - DNA, 22 bp, Homo sapiens
ccctgtggcaggaggaggagca

SEQ ID NO: 8374166 - DNA, 22 bp, Homo sapiens
ccctgtggaggaggagagcagt

SEQ ID NO: 8374167 - DNA, 22 bp, Homo sapiens
ccctgtggaggcagcatcctgc

SEQ ID NO: 8374168 - DNA, 22 bp, Homo sapiens
ccctgtgccagagaggcaggag

SEQ ID NO: 8374169 - DNA, 22 bp, Homo sapiens
ccctgtgctgtcatgctgggcg

SEQ ID NO: 8374170 - DNA, 22 bp, Homo sapiens
ccctgtgatgtagctagagtag

SEQ ID NO: 8374171 - DNA, 20 bp, Homo sapiens
ccctgtgattggcaagtgtc

SEQ ID NO: 8374172 - DNA, 22 bp, Homo sapiens
ccctgtgcagatggcagctggg

SEQ ID NO: 8374173 - DNA, 22 bp, Homo sapiens
ccctgtgcagatggcagctggg

SEQ ID NO: 8374174 - DNA, 22 bp, Homo sapiens
ccctgggataccagacaccaga

SEQ ID NO: 8374175 - DNA, 22 bp, Homo sapiens
ccctgggataccagacaccaga

SEQ ID NO: 8374176 - DNA, 22 bp, Homo sapiens
ccctggtggtacggcactggca

SEQ ID NO: 8374177 - DNA, 22 bp, Homo sapiens
ccctggtgtggatgtgattggc

SEQ ID NO: 8374178 - DNA, 22 bp, Homo sapiens
ccctggttcaggtttctctgaa

SEQ ID NO: 8374179 - DNA, 22 bp, Homo sapiens
ccctggtgtccactggaggaag

SEQ ID NO: 8374180 - DNA, 22 bp, Homo sapiens
cctatttgtaggctgggccagt

SEQ ID NO: 8374181 - DNA, 22 bp, Homo sapiens
cctaaagaattttcatagagct

SEQ ID NO: 8374182 - DNA, 22 bp, Homo sapiens
cctcacagaggggcagccatct

SEQ ID NO: 8374183 - DNA, 22 bp, Homo sapiens
cctcacagcccttggcccagga

SEQ ID NO: 8374184 - DNA, 22 bp, Homo sapiens
cctcacagggccaggcccctca

SEQ ID NO: 8374185 - DNA, 20 bp, Homo sapiens
cctcacagggcagagagggg

SEQ ID NO: 8374186 - DNA, 22 bp, Homo sapiens
cctcacatgaatgtaagctcca

SEQ ID NO: 8374187 - DNA, 22 bp, Homo sapiens
cctcacccagtcacctaggtgg

SEQ ID NO: 8374188 - DNA, 22 bp, Homo sapiens
ccgggagcaggcgccaccgcca

SEQ ID NO: 8374189 - DNA, 22 bp, Homo sapiens
ccgggcctcgggacaccgggta

SEQ ID NO: 8374190 - DNA, 22 bp, Homo sapiens
ccgggcctcgggacaccgggta

SEQ ID NO: 8374191 - DNA, 21 bp, Homo sapiens
ccgtgctcggctatggaccac

SEQ ID NO: 8374192 - DNA, 22 bp, Homo sapiens
cctcccctcagacagagactgg

SEQ ID NO: 8374193 - DNA, 22 bp, Homo sapiens
cctcccctgctcagaactctgg

SEQ ID NO: 8374194 - DNA, 22 bp, Homo sapiens
tggctcagcggtggcagcagac

SEQ ID NO: 8374195 - DNA, 22 bp, Homo sapiens
tggctcagcggtggcagcagac

SEQ ID NO: 8374196 - DNA, 22 bp, Homo sapiens
tggctcagcggtggcagcagac

SEQ ID NO: 8374197 - DNA, 22 bp, Homo sapiens
cctccctctttcagtcccacag

SEQ ID NO: 8374198 - DNA, 22 bp, Homo sapiens
cctccctctttcagtcccacag

SEQ ID NO: 8374199 - DNA, 22 bp, Homo sapiens
cctccctctgttagagctgtct

SEQ ID NO: 8374200 - DNA, 22 bp, Homo sapiens
cctccctctgttagagctgtct

SEQ ID NO: 8374201 - DNA, 19 bp, Homo sapiens
cctccccttggaccagcaa

SEQ ID NO: 8374202 - DNA, 19 bp, Homo sapiens
cctccccttggaccagcaa

SEQ ID NO: 8374203 - DNA, 22 bp, Homo sapiens
tggctcagcgcggcctggtctt

SEQ ID NO: 8374204 - DNA, 20 bp, Homo sapiens
tggctagcattaaaatgact

SEQ ID NO: 8374205 - DNA, 22 bp, Homo sapiens
tggctaatcttaaggcttttgc

SEQ ID NO: 8374206 - DNA, 22 bp, Homo sapiens
tggctacatcacagagaattcc

SEQ ID NO: 8374207 - DNA, 22 bp, Homo sapiens
tggctacctgatttcttttcag

SEQ ID NO: 8374208 - DNA, 22 bp, Homo sapiens
tggcctcaatctgtcctccagc

SEQ ID NO: 8374209 - DNA, 22 bp, Homo sapiens
tggcctcaatctgtcctccagc

SEQ ID NO: 8374210 - DNA, 22 bp, Homo sapiens
cctcagctgcttccctggagcc

SEQ ID NO: 8374211 - DNA, 22 bp, Homo sapiens
cctcagccttggccccaggcag

SEQ ID NO: 8374212 - DNA, 23 bp, Homo sapiens
cctcagcatggcaggagcccagc

SEQ ID NO: 8374213 - DNA, 22 bp, Homo sapiens
tggcctctctaccaggcagcct

SEQ ID NO: 8374214 - DNA, 22 bp, Homo sapiens
tggcctctcctggcagcatcca

SEQ ID NO: 8374215 - DNA, 23 bp, Homo sapiens
tggcctctccccacctggcagaa

SEQ ID NO: 8374216 - DNA, 22 bp, Homo sapiens
tggcctcggcatccagcaagag

SEQ ID NO: 8374217 - DNA, 22 bp, Homo sapiens
tggcctcggcatccagcaagag

SEQ ID NO: 8374218 - DNA, 22 bp, Homo sapiens
tggcctcggcatccagcaagag

SEQ ID NO: 8374219 - DNA, 22 bp, Homo sapiens
cctggagcttttccagttgaca

SEQ ID NO: 8374220 - DNA, 22 bp, Homo sapiens
cctggaggagcgctgaccagct

SEQ ID NO: 8374221 - DNA, 22 bp, Homo sapiens
cctggagcttttccatcctgga

SEQ ID NO: 8374222 - DNA, 22 bp, Homo sapiens
tgtcaacaggctttctaaggca

SEQ ID NO: 8374223 - DNA, 22 bp, Homo sapiens
tgtcaacattggctgacagttg

SEQ ID NO: 8374224 - DNA, 22 bp, Homo sapiens
tgtcaacatttatcaagttatt

SEQ ID NO: 8374225 - DNA, 22 bp, Homo sapiens
tgtcaacacacctatctcaatt

SEQ ID NO: 8374226 - DNA, 22 bp, Homo sapiens
tgtcaacagatactagagagct

SEQ ID NO: 8374227 - DNA, 22 bp, Homo sapiens
tgtcaagagtgcacacatctgc

SEQ ID NO: 8374228 - DNA, 22 bp, Homo sapiens
tgtattctaaatacatcttacc

SEQ ID NO: 8374229 - DNA, 22 bp, Homo sapiens
tgtaagtagtaatggaaggaca

SEQ ID NO: 8374230 - DNA, 22 bp, Homo sapiens
cctgctgttttcttcacttcag

SEQ ID NO: 8374231 - DNA, 20 bp, Homo sapiens
cctgctgtttccatggggcc

SEQ ID NO: 8374232 - DNA, 22 bp, Homo sapiens
cctgctgtgtgacgggatgtta

SEQ ID NO: 8374233 - DNA, 22 bp, Homo sapiens
tgtacattgtcactcatcaagt

SEQ ID NO: 8374234 - DNA, 22 bp, Homo sapiens
tgtaattttacgtgacacagtt

SEQ ID NO: 8374235 - DNA, 22 bp, Homo sapiens
tgtaattaaactgaagacagaa

SEQ ID NO: 8374236 - DNA, 22 bp, Homo sapiens
tgtaattaacgttcttgttaga

SEQ ID NO: 8374237 - DNA, 22 bp, Homo sapiens
tgtaatttgcatggctgaatgc

SEQ ID NO: 8374238 - DNA, 22 bp, Homo sapiens
tgtaatttcctgatgttagaac

SEQ ID NO: 8374239 - DNA, 22 bp, Homo sapiens
tgtaatttcctgatgttagaac

SEQ ID NO: 8374240 - DNA, 22 bp, Homo sapiens
cctgctggtttttacaaagatg

SEQ ID NO: 8374241 - DNA, 22 bp, Homo sapiens
cctgctgtccctctgggctcca

SEQ ID NO: 8374242 - DNA, 22 bp, Homo sapiens
cctgctgtcagtggggcaggca

SEQ ID NO: 8374243 - DNA, 22 bp, Homo sapiens
cctgctgtgaagccaggcctgt

SEQ ID NO: 8374244 - DNA, 22 bp, Homo sapiens
cctgctgtgaccggggagcagg

SEQ ID NO: 8374245 - DNA, 22 bp, Homo sapiens
cctgctgtgaccggggagcagg

SEQ ID NO: 8374246 - DNA, 22 bp, Homo sapiens
cctgctgtgaaactggcatatg

SEQ ID NO: 8374247 - DNA, 22 bp, Homo sapiens
cctgctgtctctgggcaggcag

SEQ ID NO: 8374248 - DNA, 22 bp, Homo sapiens
cctgctgtctctgggcaggcag

SEQ ID NO: 8374249 - DNA, 22 bp, Homo sapiens
cctgctggcggggacccagtga

SEQ ID NO: 8374250 - DNA, 22 bp, Homo sapiens
cctgctggcgcttgtctgggag

SEQ ID NO: 8374251 - DNA, 22 bp, Homo sapiens
cctgctggccagtggagggctg

SEQ ID NO: 8374252 - DNA, 22 bp, Homo sapiens
cctgctggcagagggggttact

SEQ ID NO: 8374253 - DNA, 22 bp, Homo sapiens
cctgctgggcctgagcaatgag

SEQ ID NO: 8374254 - DNA, 22 bp, Homo sapiens
cctgctgggacgtgtggttgcc

SEQ ID NO: 8374255 - DNA, 22 bp, Homo sapiens
cctgctggcgtggctggcgccc

SEQ ID NO: 8374256 - DNA, 22 bp, Homo sapiens
tggtctgctgaacagccgtatc

SEQ ID NO: 8374257 - DNA, 22 bp, Homo sapiens
cctgctggacctcaacacattt

SEQ ID NO: 8374258 - DNA, 22 bp, Homo sapiens
cctgctggacgtggaggagggg

SEQ ID NO: 8374259 - DNA, 22 bp, Homo sapiens
cctgctcggggtgcagtgggct

SEQ ID NO: 8374260 - DNA, 22 bp, Homo sapiens
cctgccttccagccttgggctc

SEQ ID NO: 8374261 - DNA, 22 bp, Homo sapiens
cctgcctgtccctcagtccaca

SEQ ID NO: 8374262 - DNA, 22 bp, Homo sapiens
cctgcctgtaagatgggtacaa

SEQ ID NO: 8374263 - DNA, 22 bp, Homo sapiens
tgggtcacaaaggccagatgat

SEQ ID NO: 8374264 - DNA, 22 bp, Homo sapiens
tgggtcaccacttcagaggaga

SEQ ID NO: 8374265 - DNA, 22 bp, Homo sapiens
tgggtcactatttgcagagacg

SEQ ID NO: 8374266 - DNA, 22 bp, Homo sapiens
tgggtcactctatcctgcttag

SEQ ID NO: 8374267 - DNA, 23 bp, Homo sapiens
tgggtcactgtttcaccattgct

SEQ ID NO: 8374268 - DNA, 22 bp, Homo sapiens
cctgccaggcgagtctaggcca

SEQ ID NO: 8374269 - DNA, 22 bp, Homo sapiens
tgggagcccaagggagctgccg

SEQ ID NO: 8374270 - DNA, 22 bp, Homo sapiens
tgggagcctggcaggccagagg

SEQ ID NO: 8374271 - DNA, 23 bp, Homo sapiens
tgggagctcaagggaggctgccc

SEQ ID NO: 8374272 - DNA, 22 bp, Homo sapiens
tgggagcccaagggagctgccg

SEQ ID NO: 8374273 - DNA, 22 bp, Homo sapiens
tgggagcccaagggagctgccg

SEQ ID NO: 8374274 - DNA, 22 bp, Homo sapiens
tgggagccattttagaggctgc

SEQ ID NO: 8374275 - DNA, 22 bp, Homo sapiens
tgggagccattttagaggctgc

SEQ ID NO: 8374276 - DNA, 22 bp, Homo sapiens
tgggagccattttagaggctgc

SEQ ID NO: 8374277 - DNA, 22 bp, Homo sapiens
tgggagcagttcaggtgtggct

SEQ ID NO: 8374278 - DNA, 20 bp, Homo sapiens
tggctctctctagtaagtgg

SEQ ID NO: 8374279 - DNA, 22 bp, Homo sapiens
tggctctctgggaggtcctggc

SEQ ID NO: 8374280 - DNA, 22 bp, Homo sapiens
tggctctcttgtaaggtagtag

SEQ ID NO: 8374281 - DNA, 22 bp, Homo sapiens
tggctctctgggaggtcctggc

SEQ ID NO: 8374282 - DNA, 22 bp, Homo sapiens
tgggagcaggaagcaggaagta

SEQ ID NO: 8374283 - DNA, 22 bp, Homo sapiens
tgggagcaggtgtgctagggaa

SEQ ID NO: 8374284 - DNA, 22 bp, Homo sapiens
tgggagcaggtgtgctagggaa

SEQ ID NO: 8374285 - DNA, 22 bp, Homo sapiens
tggctctcagctcccagcagcc

SEQ ID NO: 8374286 - DNA, 22 bp, Homo sapiens
cctccctgcgctcctgcggcgg

SEQ ID NO: 8374287 - DNA, 22 bp, Homo sapiens
tggctctctacaggtcaagacc

SEQ ID NO: 8374288 - DNA, 22 bp, Homo sapiens
tggctctcccaatacctttctg

SEQ ID NO: 8374289 - DNA, 22 bp, Homo sapiens
tggctctcagctcccagcagcc

SEQ ID NO: 8374290 - DNA, 22 bp, Homo sapiens
tggctctccagagcctatggta

SEQ ID NO: 8374291 - DNA, 22 bp, Homo sapiens
tggctctcaggcctgctgcgtt

SEQ ID NO: 8374292 - DNA, 22 bp, Homo sapiens
tggctctccagagcctatggta

SEQ ID NO: 8374293 - DNA, 22 bp, Homo sapiens
cctgaatactggtgctgaaagt

SEQ ID NO: 8374294 - DNA, 18 bp, Homo sapiens
cctgaagcctgtgtcttt

SEQ ID NO: 8374295 - DNA, 22 bp, Homo sapiens
cctcttgatttggctgtgaagt

SEQ ID NO: 8374296 - DNA, 22 bp, Homo sapiens
cctcttgattggttggaagcgg

SEQ ID NO: 8374297 - DNA, 21 bp, Homo sapiens
cctcttgatttttagctctgg

SEQ ID NO: 8374298 - DNA, 22 bp, Homo sapiens
cctcttgagttctttaaaagct

SEQ ID NO: 8374299 - DNA, 22 bp, Homo sapiens
cctcttgagtgtctgttttcca

SEQ ID NO: 8374300 - DNA, 22 bp, Homo sapiens
cctcttgattggttggaagcgg

SEQ ID NO: 8374301 - DNA, 20 bp, Homo sapiens
cctcttgcaaaagagatgac

SEQ ID NO: 8374302 - DNA, 22 bp, Homo sapiens
cctctttaatcccatccatgtg

SEQ ID NO: 8374303 - DNA, 22 bp, Homo sapiens
tgggccagcaattgctgctcag

SEQ ID NO: 8374304 - DNA, 22 bp, Homo sapiens
cctcttctgcttcaggagcact

SEQ ID NO: 8374305 - DNA, 22 bp, Homo sapiens
cctcttgactctaaatcccgcg

SEQ ID NO: 8374306 - DNA, 22 bp, Homo sapiens
cctcttgacagcctctgtttcc

SEQ ID NO: 8374307 - DNA, 22 bp, Homo sapiens
cctcttgaggccgggccggatc

SEQ ID NO: 8374308 - DNA, 22 bp, Homo sapiens
cctcttgagaggcactcaggtt

SEQ ID NO: 8374309 - DNA, 22 bp, Homo sapiens
cctcttgaatgccaggaaggac

SEQ ID NO: 8374310 - DNA, 22 bp, Homo sapiens
cctcttgaagagaagagttact

SEQ ID NO: 8374311 - DNA, 22 bp, Homo sapiens
cctcttgaacctaggcaagact

SEQ ID NO: 8374312 - DNA, 22 bp, Homo sapiens
cctctggccacatgggacatag

SEQ ID NO: 8374313 - DNA, 22 bp, Homo sapiens
tgggccagaagtatgcatgttt

SEQ ID NO: 8374314 - DNA, 22 bp, Homo sapiens
tgggccagaagtatgcatgttt

SEQ ID NO: 8374315 - DNA, 22 bp, Homo sapiens
tgggccagagagtaagaaaggt

SEQ ID NO: 8374316 - DNA, 22 bp, Homo sapiens
tgggccagaggcatggagctat

SEQ ID NO: 8374317 - DNA, 22 bp, Homo sapiens
tgggccagatccatggcaataa

SEQ ID NO: 8374318 - DNA, 21 bp, Homo sapiens
tgggccagatctgagtttcta

SEQ ID NO: 8374319 - DNA, 21 bp, Homo sapiens
tgggccagatctgagtttcta

SEQ ID NO: 8374320 - DNA, 22 bp, Homo sapiens
tgggccagcaattgctgctcag

SEQ ID NO: 8374321 - DNA, 22 bp, Homo sapiens
cctgaggtcatggtccagtgtt

SEQ ID NO: 8374322 - DNA, 22 bp, Homo sapiens
cctgagggtcaaggagccctag

SEQ ID NO: 8374323 - DNA, 21 bp, Homo sapiens
cctgagggtggttgtgaagat

SEQ ID NO: 8374324 - DNA, 21 bp, Homo sapiens
cctgagggtggttgtgaagat

SEQ ID NO: 8374325 - DNA, 19 bp, Homo sapiens
tggggtcaagagaggcttc

SEQ ID NO: 8374326 - DNA, 22 bp, Homo sapiens
cctgcaccaggcccagcatggt

SEQ ID NO: 8374327 - DNA, 20 bp, Homo sapiens
tggggtcctggaggggatcc

SEQ ID NO: 8374328 - DNA, 22 bp, Homo sapiens
cctgatggctgtctgggcctga

SEQ ID NO: 8374329 - DNA, 22 bp, Homo sapiens
cctgattagggtctttcaaatg

SEQ ID NO: 8374330 - DNA, 22 bp, Homo sapiens
cctgattattgtaaatatattt

SEQ ID NO: 8374331 - DNA, 22 bp, Homo sapiens
cctgcacctgagcagcctgact

SEQ ID NO: 8374332 - DNA, 22 bp, Homo sapiens
cctgcagaagagtccagctcat

SEQ ID NO: 8374333 - DNA, 22 bp, Homo sapiens
cctgcacttctcacagctgctg

SEQ ID NO: 8374334 - DNA, 22 bp, Homo sapiens
cctgagaataacaaattgctgc

SEQ ID NO: 8374335 - DNA, 22 bp, Homo sapiens
cctgagaataattctccatagc

SEQ ID NO: 8374336 - DNA, 22 bp, Homo sapiens
cctgagaagctggacctggcag

SEQ ID NO: 8374337 - DNA, 22 bp, Homo sapiens
cctgagaaatagcatcattttt

SEQ ID NO: 8374338 - DNA, 22 bp, Homo sapiens
cctgagaagagcttatgagtga

SEQ ID NO: 8374339 - DNA, 22 bp, Homo sapiens
cctgagaagactgtttctttga

SEQ ID NO: 8374340 - DNA, 22 bp, Homo sapiens
cctgagaatttgtggttcagga

SEQ ID NO: 8374341 - DNA, 22 bp, Homo sapiens
cctgagaatgtttaacagagaa

SEQ ID NO: 8374342 - DNA, 22 bp, Homo sapiens
cctgactctggccaggccagct

SEQ ID NO: 8374343 - DNA, 22 bp, Homo sapiens
cctgagaaacctggtgcaatta

SEQ ID NO: 8374344 - DNA, 22 bp, Homo sapiens
cctgacctatttttctcagctg

SEQ ID NO: 8374345 - DNA, 22 bp, Homo sapiens
cctgacaggagaagcgcagcat

SEQ ID NO: 8374346 - DNA, 22 bp, Homo sapiens
cctgacagcgtgtccctggccc

SEQ ID NO: 8374347 - DNA, 22 bp, Homo sapiens
cctgacaggcggaggctgcagt

SEQ ID NO: 8374348 - DNA, 22 bp, Homo sapiens
cctgacagtggtagccttggca

SEQ ID NO: 8374349 - DNA, 22 bp, Homo sapiens
cctgagggaacatgcacccaat

SEQ ID NO: 8374350 - DNA, 22 bp, Homo sapiens
cctgagggagggtataggctgt

SEQ ID NO: 8374351 - DNA, 22 bp, Homo sapiens
cctgaggggaagcttcccaaga

SEQ ID NO: 8374352 - DNA, 22 bp, Homo sapiens
cctgaggggctgcaggccagct

SEQ ID NO: 8374353 - DNA, 22 bp, Homo sapiens
cctgaggggctgcaggccagct

SEQ ID NO: 8374354 - DNA, 22 bp, Homo sapiens
cctgagggatctgtggaatagc

SEQ ID NO: 8374355 - DNA, 22 bp, Homo sapiens
cctgagggcgccgagctcccag

SEQ ID NO: 8374356 - DNA, 22 bp, Homo sapiens
cctgagggcgtaattaacagtg

SEQ ID NO: 8374357 - DNA, 22 bp, Homo sapiens
cctgagggctcagcccccagcc

SEQ ID NO: 8374358 - DNA, 22 bp, Homo sapiens
cctgagcttgatccttctgtct

SEQ ID NO: 8374359 - DNA, 22 bp, Homo sapiens
cctgagcttgatccttctgtct

SEQ ID NO: 8374360 - DNA, 22 bp, Homo sapiens
cctgaggctccacctccagaga

SEQ ID NO: 8374361 - DNA, 23 bp, Homo sapiens
cccacatgtctgagtcagtgcca

SEQ ID NO: 8374362 - DNA, 22 bp, Homo sapiens
cccaccacgtgctttgctggag

SEQ ID NO: 8374363 - DNA, 22 bp, Homo sapiens
cccaccagccatctgagagtgt

SEQ ID NO: 8374364 - DNA, 22 bp, Homo sapiens
cccacccagcctggctgagggg

SEQ ID NO: 8374365 - DNA, 22 bp, Homo sapiens
tgcagagatagaactactttct

SEQ ID NO: 8374366 - DNA, 22 bp, Homo sapiens
tgcagaggtttccaggcaagtt

SEQ ID NO: 8374367 - DNA, 22 bp, Homo sapiens
tgcagaggtgttgctgagataa

SEQ ID NO: 8374368 - DNA, 22 bp, Homo sapiens
tgcagaggtgaaagactagcaa

SEQ ID NO: 8374369 - DNA, 22 bp, Homo sapiens
tgcagaggtgaaagactagcaa

SEQ ID NO: 8374370 - DNA, 22 bp, Homo sapiens
cccacaggccctgctgccttga

SEQ ID NO: 8374371 - DNA, 22 bp, Homo sapiens
cccacaggcaggtgcatgggct

SEQ ID NO: 8374372 - DNA, 20 bp, Homo sapiens
cccaaggtcacagctagcag

SEQ ID NO: 8374373 - DNA, 20 bp, Homo sapiens
cccaaggtcacagctagcag

SEQ ID NO: 8374374 - DNA, 22 bp, Homo sapiens
cccacaggctaggggtagggca

SEQ ID NO: 8374375 - DNA, 22 bp, Homo sapiens
cccagagaatctttcagaaagg

SEQ ID NO: 8374376 - DNA, 22 bp, Homo sapiens
tgcagaggtttgtggtgttgct

SEQ ID NO: 8374377 - DNA, 19 bp, Homo sapiens
cccagagagatctcttgcc

SEQ ID NO: 8374378 - DNA, 19 bp, Homo sapiens
cccagagagatctcttgcc

SEQ ID NO: 8374379 - DNA, 22 bp, Homo sapiens
cccagagaggtaaaacagcctt

SEQ ID NO: 8374380 - DNA, 22 bp, Homo sapiens
cccagagggtggaggttgcagt

SEQ ID NO: 8374381 - DNA, 22 bp, Homo sapiens
cccagcactcagcaggctcata

SEQ ID NO: 8374382 - DNA, 22 bp, Homo sapiens
cccagcactcagcaggctcata

SEQ ID NO: 8374383 - DNA, 22 bp, Homo sapiens
cccagaggtgaaggaggtggga

SEQ ID NO: 8374384 - DNA, 22 bp, Homo sapiens
cccagaggtgaaggaggtggga

SEQ ID NO: 8374385 - DNA, 22 bp, Homo sapiens
cccagcagaccgctgtgatggc

SEQ ID NO: 8374386 - DNA, 23 bp, Homo sapiens
cccagcagagatgaggaggggtc

SEQ ID NO: 8374387 - DNA, 22 bp, Homo sapiens
cccagcagaccgctgtgatggc

SEQ ID NO: 8374388 - DNA, 22 bp, Homo sapiens
cccagcagaccgctgtgatggc

SEQ ID NO: 8374389 - DNA, 23 bp, Homo sapiens
cccagcagagatgaggaggggtc

SEQ ID NO: 8374390 - DNA, 22 bp, Homo sapiens
cccagcagatggctatgtgcta

SEQ ID NO: 8374391 - DNA, 22 bp, Homo sapiens
cccagcagatggctatgtgcta

SEQ ID NO: 8374392 - DNA, 22 bp, Homo sapiens
cccagcagaatctgatgagggc

SEQ ID NO: 8374393 - DNA, 22 bp, Homo sapiens
cccagcactttgaatatgtcac

SEQ ID NO: 8374394 - DNA, 22 bp, Homo sapiens
cccagcagaatctgatgagggc

SEQ ID NO: 8374395 - DNA, 22 bp, Homo sapiens
cccagcagaatctgatgagggc

SEQ ID NO: 8374396 - DNA, 22 bp, Homo sapiens
cccagcagaatctgatgagggc

SEQ ID NO: 8374397 - DNA, 22 bp, Homo sapiens
cccagcagccagaatgaggagc

SEQ ID NO: 8374398 - DNA, 22 bp, Homo sapiens
cccagcagccagaatgaggagc

SEQ ID NO: 8374399 - DNA, 23 bp, Homo sapiens
cccagcagattgtaaagtgtcca

SEQ ID NO: 8374400 - DNA, 22 bp, Homo sapiens
cccagcagccagaatgaggagc

SEQ ID NO: 8374401 - DNA, 22 bp, Homo sapiens
cccagcagccagaatgaggagc

SEQ ID NO: 8374402 - DNA, 22 bp, Homo sapiens
tgcagcaggtatggcaagctcc

SEQ ID NO: 8374403 - DNA, 22 bp, Homo sapiens
ccatggccaggaaagccaaggt

SEQ ID NO: 8374404 - DNA, 22 bp, Homo sapiens
ccatggccaattgcaccttgct

SEQ ID NO: 8374405 - DNA, 22 bp, Homo sapiens
ccatggcattttatgtgtctta

SEQ ID NO: 8374406 - DNA, 23 bp, Homo sapiens
ccatggccaatgtcaagctacta

SEQ ID NO: 8374407 - DNA, 22 bp, Homo sapiens
ccatggagttcctctggtctat

SEQ ID NO: 8374408 - DNA, 22 bp, Homo sapiens
ccatggcaaaggagatgttttc

SEQ ID NO: 8374409 - DNA, 22 bp, Homo sapiens
ccatggcagccatgggagccac

SEQ ID NO: 8374410 - DNA, 22 bp, Homo sapiens
ccatttttcataaactatccaa

SEQ ID NO: 8374411 - DNA, 22 bp, Homo sapiens
ccattgtaaattctgtggaagt

SEQ ID NO: 8374412 - DNA, 22 bp, Homo sapiens
ccattgtagtatctgttttagt

SEQ ID NO: 8374413 - DNA, 22 bp, Homo sapiens
cccaacactcacctccggatta

SEQ ID NO: 8374414 - DNA, 23 bp, Homo sapiens
cccaacacattccttttcttctg

SEQ ID NO: 8374415 - DNA, 22 bp, Homo sapiens
cccaagccagaccctgaccctg

SEQ ID NO: 8374416 - DNA, 22 bp, Homo sapiens
tgattagacaaaggaatcatgc

SEQ ID NO: 8374417 - DNA, 22 bp, Homo sapiens
tgattacagtatttgagatcca

SEQ ID NO: 8374418 - DNA, 22 bp, Homo sapiens
tgaggcagtgctgggaagcctg

SEQ ID NO: 8374419 - DNA, 22 bp, Homo sapiens
tgaggcagtgatgtttaagcac

SEQ ID NO: 8374420 - DNA, 22 bp, Homo sapiens
tgatgaccgccaacgtttaggt

SEQ ID NO: 8374421 - DNA, 23 bp, Homo sapiens
ccagtgtggctctgtccgctctc

SEQ ID NO: 8374422 - DNA, 22 bp, Homo sapiens
tgaggcagtattttagtgactt

SEQ ID NO: 8374423 - DNA, 22 bp, Homo sapiens
tgaggcagtattttagtgactt

SEQ ID NO: 8374424 - DNA, 22 bp, Homo sapiens
tgaggcagtcaccccctcctgc

SEQ ID NO: 8374425 - DNA, 18 bp, Homo sapiens
tgaggcagtcagtgatgg

SEQ ID NO: 8374426 - DNA, 18 bp, Homo sapiens
tgaggcagtcagtgatgg

SEQ ID NO: 8374427 - DNA, 22 bp, Homo sapiens
tgaggcaggtaagcaagttttg

SEQ ID NO: 8374428 - DNA, 22 bp, Homo sapiens
tgaggcaggtggattacaaggt

SEQ ID NO: 8374429 - DNA, 22 bp, Homo sapiens
tgaggcagtattctccattcca

SEQ ID NO: 8374430 - DNA, 22 bp, Homo sapiens
cccagcccatctcaaaggtcta

SEQ ID NO: 8374431 - DNA, 22 bp, Homo sapiens
cccagcagtaaccagtggaaat

SEQ ID NO: 8374432 - DNA, 22 bp, Homo sapiens
cccagcatgcacgctgacactc

SEQ ID NO: 8374433 - DNA, 22 bp, Homo sapiens
cccagccaaaagcaagtttacc

SEQ ID NO: 8374434 - DNA, 22 bp, Homo sapiens
tgcagcagtttaatgcagggtt

SEQ ID NO: 8374435 - DNA, 22 bp, Homo sapiens
cccagcaggtgccatcactctg

SEQ ID NO: 8374436 - DNA, 22 bp, Homo sapiens
tgcagtggaagaggtggagatc

SEQ ID NO: 8374437 - DNA, 22 bp, Homo sapiens
tgcagtcttccagctgcacaaa

SEQ ID NO: 8374438 - DNA, 22 bp, Homo sapiens
tgcaggtgctgtgtcaagagag

SEQ ID NO: 8374439 - DNA, 22 bp, Homo sapiens
tgcagtggaggccgtgagacag

SEQ ID NO: 8374440 - DNA, 22 bp, Homo sapiens
cccaggaattggaggctgcagt

SEQ ID NO: 8374441 - DNA, 21 bp, Homo sapiens
cccaggagaagaaaagatgca

SEQ ID NO: 8374442 - DNA, 21 bp, Homo sapiens
cccaggagaagaaaagatgca

SEQ ID NO: 8374443 - DNA, 22 bp, Homo sapiens
cccaggagaatataatgttctt

SEQ ID NO: 8374444 - DNA, 22 bp, Homo sapiens
cccaggactcttcactgcagcc

SEQ ID NO: 8374445 - DNA, 22 bp, Homo sapiens
cccagctcccatgttctccaat

SEQ ID NO: 8374446 - DNA, 22 bp, Homo sapiens
cccagctcccatgttctccaat

SEQ ID NO: 8374447 - DNA, 22 bp, Homo sapiens
cccagctccagagccagaaaca

SEQ ID NO: 8374448 - DNA, 22 bp, Homo sapiens
cccaggaaagtggaggcggctg

SEQ ID NO: 8374449 - DNA, 22 bp, Homo sapiens
cccaggaattggaggctgcagt

SEQ ID NO: 8374450 - DNA, 22 bp, Homo sapiens
cccaggaattcagggctcaagg

SEQ ID NO: 8374451 - DNA, 22 bp, Homo sapiens
cccaggaaatagccaggaggtg

SEQ ID NO: 8374452 - DNA, 21 bp, Homo sapiens
tgcatatataagtgcatacac

SEQ ID NO: 8374453 - DNA, 22 bp, Homo sapiens
cccaggagacagaaacagaggt

SEQ ID NO: 8374454 - DNA, 22 bp, Homo sapiens
tgcatatttgtatgatgtttag

SEQ ID NO: 8374455 - DNA, 22 bp, Homo sapiens
cccaggaggacattccataccc

SEQ ID NO: 8374456 - DNA, 22 bp, Homo sapiens
cccaggaggcagaggttggagc

SEQ ID NO: 8374457 - DNA, 22 bp, Homo sapiens
cccaggaggcagatgttgcagt

SEQ ID NO: 8374458 - DNA, 22 bp, Homo sapiens
cccaggaggcgcaggttgcggt

SEQ ID NO: 8374459 - DNA, 22 bp, Homo sapiens
cccaggaggcagagcttgcagt

SEQ ID NO: 8374460 - DNA, 22 bp, Homo sapiens
cccaggaggcagagatagcagt

SEQ ID NO: 8374461 - DNA, 22 bp, Homo sapiens
cccaggaggaggaaaaagctcg

SEQ ID NO: 8374462 - DNA, 23 bp, Homo sapiens
tgcctcagtggaatgtgagggtg

SEQ ID NO: 8374463 - DNA, 22 bp, Homo sapiens
cccaggagttagaggttgtggt

SEQ ID NO: 8374464 - DNA, 22 bp, Homo sapiens
cccaggaggttggggctacagt

SEQ ID NO: 8374465 - DNA, 22 bp, Homo sapiens
cccaggaggttgaggctgcagt

SEQ ID NO: 8374466 - DNA, 22 bp, Homo sapiens
cccaggagtaagtgacattgtt

SEQ ID NO: 8374467 - DNA, 22 bp, Homo sapiens
cccaggagtaagtgacattgtt

SEQ ID NO: 8374468 - DNA, 19 bp, Homo sapiens
cccaggagtctggctggtt

SEQ ID NO: 8374469 - DNA, 22 bp, Homo sapiens
cccaggaggcggaggttgtggt

SEQ ID NO: 8374470 - DNA, 21 bp, Homo sapiens
cccaggaggctgagaagagca

SEQ ID NO: 8374471 - DNA, 22 bp, Homo sapiens
tgcccagcttcttacttttaaa

SEQ ID NO: 8374472 - DNA, 22 bp, Homo sapiens
tgcccagcttcttacttttaaa

SEQ ID NO: 8374473 - DNA, 22 bp, Homo sapiens
tgccctcttaggtctgcgcagc

SEQ ID NO: 8374474 - DNA, 22 bp, Homo sapiens
tgccctctgcaggccgccatgg

SEQ ID NO: 8374475 - DNA, 22 bp, Homo sapiens
ccaggtcctgttttcaccacag

SEQ ID NO: 8374476 - DNA, 22 bp, Homo sapiens
ccagggtgtagggattccagat

SEQ ID NO: 8374477 - DNA, 22 bp, Homo sapiens
ccagggtggcgtagatgctggg

SEQ ID NO: 8374478 - DNA, 22 bp, Homo sapiens
tgagagttattctgaatttagc

SEQ ID NO: 8374479 - DNA, 22 bp, Homo sapiens
tgagagtgaaatgtcacatgtc

SEQ ID NO: 8374480 - DNA, 22 bp, Homo sapiens
tgagacgaagtcttgctctgtt

SEQ ID NO: 8374481 - DNA, 22 bp, Homo sapiens
tgagaggtcattaggccatgag

SEQ ID NO: 8374482 - DNA, 22 bp, Homo sapiens
tgagaggtgaggcatgaggcat

SEQ ID NO: 8374483 - DNA, 22 bp, Homo sapiens
tgagataagcaaggataaaggt

SEQ ID NO: 8374484 - DNA, 22 bp, Homo sapiens
tgagataacaaaattatcttca

SEQ ID NO: 8374485 - DNA, 22 bp, Homo sapiens
tgagataactattctgtcaact

SEQ ID NO: 8374486 - DNA, 22 bp, Homo sapiens
tgagataacatggaagagtagc

SEQ ID NO: 8374487 - DNA, 22 bp, Homo sapiens
tgagagttttgacgcttgtaac

SEQ ID NO: 8374488 - DNA, 22 bp, Homo sapiens
tgagataataaacatctcctta

SEQ ID NO: 8374489 - DNA, 22 bp, Homo sapiens
tgagcaccgccgcatttccaag

SEQ ID NO: 8374490 - DNA, 22 bp, Homo sapiens
tgagcacctactgtattccagg

SEQ ID NO: 8374491 - DNA, 22 bp, Homo sapiens
tgaggaagttgtttctcttcta

SEQ ID NO: 8374492 - DNA, 22 bp, Homo sapiens
tgaggaagttgtttctcttcta

SEQ ID NO: 8374493 - DNA, 22 bp, Homo sapiens
tgaggacatgagtgggacagag

SEQ ID NO: 8374494 - DNA, 22 bp, Homo sapiens
tgaggacattaggaagtgaagg

SEQ ID NO: 8374495 - DNA, 22 bp, Homo sapiens
tgaggacattgagactggagac

SEQ ID NO: 8374496 - DNA, 22 bp, Homo sapiens
tgaggacattgagactggagac

SEQ ID NO: 8374497 - DNA, 22 bp, Homo sapiens
tgaggacattggtcaggacatg

SEQ ID NO: 8374498 - DNA, 22 bp, Homo sapiens
tgaggacatttatcttggcgca

SEQ ID NO: 8374499 - DNA, 22 bp, Homo sapiens
ccagtgtgccaatttacagctg

SEQ ID NO: 8374500 - DNA, 22 bp, Homo sapiens
tgagcagagacgggggcctcca

SEQ ID NO: 8374501 - DNA, 22 bp, Homo sapiens
tgagcagactctgcagagccac

SEQ ID NO: 8374502 - DNA, 22 bp, Homo sapiens
tgagcagacttgatgaggcagc

SEQ ID NO: 8374503 - DNA, 22 bp, Homo sapiens
tgagcagaacacgggatccatg

SEQ ID NO: 8374504 - DNA, 22 bp, Homo sapiens
tgagcagaaaagaatgctgagc

SEQ ID NO: 8374505 - DNA, 22 bp, Homo sapiens
tgagcagaagccctcctggact

SEQ ID NO: 8374506 - DNA, 22 bp, Homo sapiens
tgactttaaagctcactctttt

SEQ ID NO: 8374507 - DNA, 22 bp, Homo sapiens
tgactttaaaataacaagttta

SEQ ID NO: 8374508 - DNA, 22 bp, Homo sapiens
tgactttaagctatctgattct

SEQ ID NO: 8374509 - DNA, 22 bp, Homo sapiens
tgactttaataggattttgcat

SEQ ID NO: 8374510 - DNA, 22 bp, Homo sapiens
tgactttaagctatctgattct

SEQ ID NO: 8374511 - DNA, 22 bp, Homo sapiens
tgactttacagatatgtttcct

SEQ ID NO: 8374512 - DNA, 22 bp, Homo sapiens
tgactttagaattttatccaga

SEQ ID NO: 8374513 - DNA, 22 bp, Homo sapiens
tgactttagacttagtcaagtt

SEQ ID NO: 8374514 - DNA, 22 bp, Homo sapiens
tgactttagacttagtcaagtt

SEQ ID NO: 8374515 - DNA, 22 bp, Homo sapiens
tgactttggactagtgatttaa

SEQ ID NO: 8374516 - DNA, 17 bp, Homo sapiens
tgactttatttgcttgg

SEQ ID NO: 8374517 - DNA, 22 bp, Homo sapiens
tgactttagaattttatccaga

SEQ ID NO: 8374518 - DNA, 17 bp, Homo sapiens
tgactttatttgcttgg

SEQ ID NO: 8374519 - DNA, 21 bp, Homo sapiens
tgactttatattgtgtcagga

SEQ ID NO: 8374520 - DNA, 22 bp, Homo sapiens
tgagaaaactcaaagacagatc

SEQ ID NO: 8374521 - DNA, 22 bp, Homo sapiens
ccagggtcttcgaggcagcaat

SEQ ID NO: 8374522 - DNA, 22 bp, Homo sapiens
tgactttgtgccatttttataa

SEQ ID NO: 8374523 - DNA, 22 bp, Homo sapiens
tgacttttggacctcactgtcc

SEQ ID NO: 8374524 - DNA, 22 bp, Homo sapiens
tgagaaaacagtttgtaataat

SEQ ID NO: 8374525 - DNA, 22 bp, Homo sapiens
tgaccactgaatatgactgcct

SEQ ID NO: 8374526 - DNA, 22 bp, Homo sapiens
tgaccactgaaaacatggctag

SEQ ID NO: 8374527 - DNA, 22 bp, Homo sapiens
tgaccatttgatctacattcca

SEQ ID NO: 8374528 - DNA, 22 bp, Homo sapiens
tgaccaggatactgcagggatg

SEQ ID NO: 8374529 - DNA, 22 bp, Homo sapiens
tgaccagacatcaatttcaaag

SEQ ID NO: 8374530 - DNA, 22 bp, Homo sapiens
ccagggccagtaagattggcat

SEQ ID NO: 8374531 - DNA, 22 bp, Homo sapiens
tgacagagtcggggcaagctgt

SEQ ID NO: 8374532 - DNA, 22 bp, Homo sapiens
ccagggcatgggaagaactgaa

SEQ ID NO: 8374533 - DNA, 22 bp, Homo sapiens
ccagggcatgtaactaatggtg

SEQ ID NO: 8374534 - DNA, 22 bp, Homo sapiens
tgacagaggagctggaatgatt

SEQ ID NO: 8374535 - DNA, 22 bp, Homo sapiens
tgacagagcatgtagtgacagc

SEQ ID NO: 8374536 - DNA, 22 bp, Homo sapiens
tgacagagcatgtagtgacagc

SEQ ID NO: 8374537 - DNA, 22 bp, Homo sapiens
tgacagagcaagatctagataa

SEQ ID NO: 8374538 - DNA, 22 bp, Homo sapiens
tgacagagacttcagagccaaa

SEQ ID NO: 8374539 - DNA, 22 bp, Homo sapiens
tgacagagagatgggaaagggc

SEQ ID NO: 8374540 - DNA, 22 bp, Homo sapiens
ccagggaagaaagatgaagtgc

SEQ ID NO: 8374541 - DNA, 22 bp, Homo sapiens
ccagggaaattaatgagttaat

SEQ ID NO: 8374542 - DNA, 22 bp, Homo sapiens
ccagggaaaggaggttgacttg

SEQ ID NO: 8374543 - DNA, 21 bp, Homo sapiens
ccagggaagaaatgagggcag

SEQ ID NO: 8374544 - DNA, 22 bp, Homo sapiens
ccagggaagaataggtgtggtt

SEQ ID NO: 8374545 - DNA, 22 bp, Homo sapiens
ccagggaagaccacttcctgga

SEQ ID NO: 8374546 - DNA, 22 bp, Homo sapiens
ccagggaaactttggagtggag

SEQ ID NO: 8374547 - DNA, 22 bp, Homo sapiens
ccagggaaacagcccagtgtga

SEQ ID NO: 8374548 - DNA, 22 bp, Homo sapiens
ccagggaaacagcccagtgtga

SEQ ID NO: 8374549 - DNA, 22 bp, Homo sapiens
ccagggaaaatcaacttctact

SEQ ID NO: 8374550 - DNA, 22 bp, Homo sapiens
tgaaagcttgttggaaatgtag

SEQ ID NO: 8374551 - DNA, 21 bp, Homo sapiens
tgaaacagatggaagtatttg

SEQ ID NO: 8374552 - DNA, 22 bp, Homo sapiens
ccaggctgcagtcaaggggcat

SEQ ID NO: 8374553 - DNA, 22 bp, Homo sapiens
ccaggctgcagtcaaggggcat

SEQ ID NO: 8374554 - DNA, 22 bp, Homo sapiens
ccaggctgctcacaagctgccc

SEQ ID NO: 8374555 - DNA, 22 bp, Homo sapiens
tgaagaggccgtgtgcaggtga

SEQ ID NO: 8374556 - DNA, 22 bp, Homo sapiens
tgaagagtattaggttatttga

SEQ ID NO: 8374557 - DNA, 22 bp, Homo sapiens
tgaagagtgattcatgcagtca

SEQ ID NO: 8374558 - DNA, 22 bp, Homo sapiens
tgaagagtcatttcattcccag

SEQ ID NO: 8374559 - DNA, 22 bp, Homo sapiens
tgaagagttaattatgaggtgc

SEQ ID NO: 8374560 - DNA, 22 bp, Homo sapiens
tgaagagtgcttgagattttaa

SEQ ID NO: 8374561 - DNA, 20 bp, Homo sapiens
tgaagagtgcgcacattgcc

SEQ ID NO: 8374562 - DNA, 22 bp, Homo sapiens
tgaagaggccaaactatcattg

SEQ ID NO: 8374563 - DNA, 20 bp, Homo sapiens
tgaagaggaagaggacggcc

SEQ ID NO: 8374564 - DNA, 22 bp, Homo sapiens
tgaacactgtatattcttcttg

SEQ ID NO: 8374565 - DNA, 19 bp, Homo sapiens
tgaacagagaggactctgg

SEQ ID NO: 8374566 - DNA, 22 bp, Homo sapiens
tgaacagctatcttgtcagtgt

SEQ ID NO: 8374567 - DNA, 18 bp, Homo sapiens
tgaacagatgagttgaag

SEQ ID NO: 8374568 - DNA, 22 bp, Homo sapiens
tgaaggaatgagtatactgttt

SEQ ID NO: 8374569 - DNA, 22 bp, Homo sapiens
tgaaggagaaatggaaagtggg

SEQ ID NO: 8374570 - DNA, 22 bp, Homo sapiens
tgaaggaatgagggagtgggtc

SEQ ID NO: 8374571 - DNA, 22 bp, Homo sapiens
tgaaggaaagagggaacatccc

SEQ ID NO: 8374572 - DNA, 17 bp, Homo sapiens
tgaagatgcatggcagc

SEQ ID NO: 8374573 - DNA, 22 bp, Homo sapiens
tgaagagtgtgactgcacctag

SEQ ID NO: 8374574 - DNA, 22 bp, Homo sapiens
tgaagagtttccagcctgcttg

SEQ ID NO: 8374575 - DNA, 21 bp, Homo sapiens
ccagcctcagatcagggagct

SEQ ID NO: 8374576 - DNA, 22 bp, Homo sapiens
tcttggttaggggaaataggca

SEQ ID NO: 8374577 - DNA, 22 bp, Homo sapiens
tcttgttaaagtgaagatactg

SEQ ID NO: 8374578 - DNA, 22 bp, Homo sapiens
tcttgtgtggtggaagatatgg

SEQ ID NO: 8374579 - DNA, 22 bp, Homo sapiens
tcttgttatcaggaaaacagta

SEQ ID NO: 8374580 - DNA, 21 bp, Homo sapiens
tcttgtgtgggaaacaatttg

SEQ ID NO: 8374581 - DNA, 22 bp, Homo sapiens
tctttaaagttggagcttgcaa

SEQ ID NO: 8374582 - DNA, 22 bp, Homo sapiens
tctttaaagttggagcttgcaa

SEQ ID NO: 8374583 - DNA, 22 bp, Homo sapiens
ccagcctcactggcatcaccta

SEQ ID NO: 8374584 - DNA, 22 bp, Homo sapiens
ccagcctcactggcatcaccta

SEQ ID NO: 8374585 - DNA, 22 bp, Homo sapiens
ccagccctttgtggttcactga

SEQ ID NO: 8374586 - DNA, 22 bp, Homo sapiens
ccagcccttgctgaagggtggc

SEQ ID NO: 8374587 - DNA, 22 bp, Homo sapiens
tctttcaaagctgtagtagatt

SEQ ID NO: 8374588 - DNA, 19 bp, Homo sapiens
ccaggcctggcgtctccgc

SEQ ID NO: 8374589 - DNA, 23 bp, Homo sapiens
ccaggctaaatgttagagtctga

SEQ ID NO: 8374590 - DNA, 22 bp, Homo sapiens
tctttattttatgcttgtgcaa

SEQ ID NO: 8374591 - DNA, 22 bp, Homo sapiens
tctttattttatgcttgtgcaa

SEQ ID NO: 8374592 - DNA, 22 bp, Homo sapiens
tctttaagagttcatttgcatg

SEQ ID NO: 8374593 - DNA, 22 bp, Homo sapiens
tctttatttaagtctgttgtaa

SEQ ID NO: 8374594 - DNA, 22 bp, Homo sapiens
tctttatttctgaatcccccat

SEQ ID NO: 8374595 - DNA, 17 bp, Homo sapiens
ccaggctccatcactgt

SEQ ID NO: 8374596 - DNA, 17 bp, Homo sapiens
ccaggctccatcactgt

SEQ ID NO: 8374597 - DNA, 22 bp, Homo sapiens
ccaggctcactgactaccacat

SEQ ID NO: 8374598 - DNA, 22 bp, Homo sapiens
tcacaaatgtctcctgtcctgt

SEQ ID NO: 8374599 - DNA, 22 bp, Homo sapiens
tcacaaatgtttgcatgtgtct

SEQ ID NO: 8374600 - DNA, 22 bp, Homo sapiens
tcacaaatcattttatctgtgt

SEQ ID NO: 8374601 - DNA, 22 bp, Homo sapiens
tcacaacaggaaggaccagctg

SEQ ID NO: 8374602 - DNA, 22 bp, Homo sapiens
tcacaagacaagacaaattgca

SEQ ID NO: 8374603 - DNA, 22 bp, Homo sapiens
tcacaagaatttgtagatgaaa

SEQ ID NO: 8374604 - DNA, 22 bp, Homo sapiens
tcacaagaatttgtagatgaaa

SEQ ID NO: 8374605 - DNA, 22 bp, Homo sapiens
tcacaaatattttaacagtagg

SEQ ID NO: 8374606 - DNA, 22 bp, Homo sapiens
tcacaaatattttaacagtagg

SEQ ID NO: 8374607 - DNA, 22 bp, Homo sapiens
tcaatgaagagatttaaatcat

SEQ ID NO: 8374608 - DNA, 22 bp, Homo sapiens
cagtgagctcctgtctgtccct

SEQ ID NO: 8374609 - DNA, 22 bp, Homo sapiens
cagtgaggaagctgtctggacc

SEQ ID NO: 8374610 - DNA, 22 bp, Homo sapiens
cagtgagataccacagagcaaa

SEQ ID NO: 8374611 - DNA, 22 bp, Homo sapiens
cagtgagataccacagagcaaa

SEQ ID NO: 8374612 - DNA, 22 bp, Homo sapiens
tcacagactcttgattgtctaa

SEQ ID NO: 8374613 - DNA, 22 bp, Homo sapiens
cagtgaagttctactgaatggt

SEQ ID NO: 8374614 - DNA, 22 bp, Homo sapiens
tcacaagactgagcttgcttga

SEQ ID NO: 8374615 - DNA, 22 bp, Homo sapiens
tcacaagactgagcttgcttga

SEQ ID NO: 8374616 - DNA, 22 bp, Homo sapiens
cagtgacgtaaactgcatgtgc

SEQ ID NO: 8374617 - DNA, 22 bp, Homo sapiens
cagtgacgtaaactgcatgtgc

SEQ ID NO: 8374618 - DNA, 22 bp, Homo sapiens
tcacaggagggagagacaccca

SEQ ID NO: 8374619 - DNA, 22 bp, Homo sapiens
tcacaggagggagagacaccca

SEQ ID NO: 8374620 - DNA, 22 bp, Homo sapiens
tcacagtgtggcaactcacaga

SEQ ID NO: 8374621 - DNA, 22 bp, Homo sapiens
tcacagtgttaaacctttcttt

SEQ ID NO: 8374622 - DNA, 22 bp, Homo sapiens
tcacagtgttggaatcagagct

SEQ ID NO: 8374623 - DNA, 20 bp, Homo sapiens
cagtgcattgcttctgattt

SEQ ID NO: 8374624 - DNA, 17 bp, Homo sapiens
tcacagttggtctcagt

SEQ ID NO: 8374625 - DNA, 22 bp, Homo sapiens
tcacaggaccctgagggtggcg

SEQ ID NO: 8374626 - DNA, 22 bp, Homo sapiens
tcacaggagcccaggggagctg

SEQ ID NO: 8374627 - DNA, 22 bp, Homo sapiens
tcacagcttcttgcgggtctga

SEQ ID NO: 8374628 - DNA, 22 bp, Homo sapiens
tcacagactgtgttgctactca

SEQ ID NO: 8374629 - DNA, 22 bp, Homo sapiens
tcacagagaaaagctatcacaa

SEQ ID NO: 8374630 - DNA, 22 bp, Homo sapiens
cagtccagagcccaccagagga

SEQ ID NO: 8374631 - DNA, 22 bp, Homo sapiens
cagtcccaaggaggaagcagtc

SEQ ID NO: 8374632 - DNA, 22 bp, Homo sapiens
cagtcccaaggaggaagcagtc

SEQ ID NO: 8374633 - DNA, 20 bp, Homo sapiens
cagtcccaatccagggccag

SEQ ID NO: 8374634 - DNA, 22 bp, Homo sapiens
tatttctttcaggtatgtgttg

SEQ ID NO: 8374635 - DNA, 22 bp, Homo sapiens
tatttcttttcgtgacttattg

SEQ ID NO: 8374636 - DNA, 22 bp, Homo sapiens
tatttccacctattattttctg

SEQ ID NO: 8374637 - DNA, 22 bp, Homo sapiens
tatttccacttaggtgcctgtt

SEQ ID NO: 8374638 - DNA, 22 bp, Homo sapiens
tatttccaaaagcctattatga

SEQ ID NO: 8374639 - DNA, 21 bp, Homo sapiens
tatttccaaccctttatcctt

SEQ ID NO: 8374640 - DNA, 22 bp, Homo sapiens
tatttccaagctgaatccaatg

SEQ ID NO: 8374641 - DNA, 22 bp, Homo sapiens
cagtagggaatgtgggaggctg

SEQ ID NO: 8374642 - DNA, 22 bp, Homo sapiens
cagtaggaaggatgcagaaaaa

SEQ ID NO: 8374643 - DNA, 22 bp, Homo sapiens
cagggtggggaaatagcgccct

SEQ ID NO: 8374644 - DNA, 22 bp, Homo sapiens
tatttcagtcacttcttctctg

SEQ ID NO: 8374645 - DNA, 22 bp, Homo sapiens
tatttcagggggtacaagaaga

SEQ ID NO: 8374646 - DNA, 22 bp, Homo sapiens
tatttataacagtgagaacggg

SEQ ID NO: 8374647 - DNA, 22 bp, Homo sapiens
tatttccaaaaaggccatattc

SEQ ID NO: 8374648 - DNA, 22 bp, Homo sapiens
tatttcattctttatcaggagc

SEQ ID NO: 8374649 - DNA, 22 bp, Homo sapiens
tatttcatctggaacaaggtaa

SEQ ID NO: 8374650 - DNA, 22 bp, Homo sapiens
tatttcatgtgcaccataattc

SEQ ID NO: 8374651 - DNA, 22 bp, Homo sapiens
caggtttacaaagtaaagtgtg

SEQ ID NO: 8374652 - DNA, 22 bp, Homo sapiens
caggttctggagatgcagagat

SEQ ID NO: 8374653 - DNA, 22 bp, Homo sapiens
cagtggggtttctgtgggtgct

SEQ ID NO: 8374654 - DNA, 21 bp, Homo sapiens
cagtgggctgctgcgctccag

SEQ ID NO: 8374655 - DNA, 23 bp, Homo sapiens
cagtgggaggactgagataaaac

SEQ ID NO: 8374656 - DNA, 22 bp, Homo sapiens
cagtgggaaagtgaagagcatt

SEQ ID NO: 8374657 - DNA, 22 bp, Homo sapiens
cagtgccaaggctcttggtctg

SEQ ID NO: 8374658 - DNA, 22 bp, Homo sapiens
cagtggcaggggaagcaggtgt

SEQ ID NO: 8374659 - DNA, 22 bp, Homo sapiens
cagtggcagttagaaaatattc

SEQ ID NO: 8374660 - DNA, 22 bp, Homo sapiens
cagttaaaatgtgctataagaa

SEQ ID NO: 8374661 - DNA, 22 bp, Homo sapiens
tcagagaaatgacaatatatag

SEQ ID NO: 8374662 - DNA, 22 bp, Homo sapiens
tcagagaaatgacaatatatag

SEQ ID NO: 8374663 - DNA, 22 bp, Homo sapiens
tcagagaaatgctgagctcatg

SEQ ID NO: 8374664 - DNA, 22 bp, Homo sapiens
tcagagaaataattgctgagtt

SEQ ID NO: 8374665 - DNA, 22 bp, Homo sapiens
tcagagaaataattgctgagtt

SEQ ID NO: 8374666 - DNA, 21 bp, Homo sapiens
tcagagaacccggcaggcaag

SEQ ID NO: 8374667 - DNA, 22 bp, Homo sapiens
tcagagaacacagaggtgatgt

SEQ ID NO: 8374668 - DNA, 22 bp, Homo sapiens
tcagagaacacagaggtgatgt

SEQ ID NO: 8374669 - DNA, 22 bp, Homo sapiens
tcagagaaatgctgagctcatg

SEQ ID NO: 8374670 - DNA, 22 bp, Homo sapiens
tcagagaacacagaggtgatgt

SEQ ID NO: 8374671 - DNA, 23 bp, Homo sapiens
tcagaagtgggatacaaagctga

SEQ ID NO: 8374672 - DNA, 21 bp, Homo sapiens
tcagacttgagctcttctaca

SEQ ID NO: 8374673 - DNA, 22 bp, Homo sapiens
tcagacttcagtttttagttgt

SEQ ID NO: 8374674 - DNA, 22 bp, Homo sapiens
tcagcagagcgagaccaagtca

SEQ ID NO: 8374675 - DNA, 22 bp, Homo sapiens
tcagcagactaggcagattact

SEQ ID NO: 8374676 - DNA, 22 bp, Homo sapiens
tcagcagagcgagaccaagtca

SEQ ID NO: 8374677 - DNA, 22 bp, Homo sapiens
tcagcagaatgtggcatgtcac

SEQ ID NO: 8374678 - DNA, 22 bp, Homo sapiens
tcagcagacagttagctatatt

SEQ ID NO: 8374679 - DNA, 22 bp, Homo sapiens
tcagcagatgatttccatacaa

SEQ ID NO: 8374680 - DNA, 19 bp, Homo sapiens
tcagcagattttgcaaaca

SEQ ID NO: 8374681 - DNA, 22 bp, Homo sapiens
tcagcagaggggaaggcatctg

SEQ ID NO: 8374682 - DNA, 22 bp, Homo sapiens
tcagcagaggcagactctcctt

SEQ ID NO: 8374683 - DNA, 23 bp, Homo sapiens
tcagcagcagaagtgctgggatg

SEQ ID NO: 8374684 - DNA, 22 bp, Homo sapiens
tcagcagcagctcagcatgttt

SEQ ID NO: 8374685 - DNA, 21 bp, Homo sapiens
tcagcagcatctgcctagagt

SEQ ID NO: 8374686 - DNA, 22 bp, Homo sapiens
cagtttaaggcaggacatggga

SEQ ID NO: 8374687 - DNA, 19 bp, Homo sapiens
cagtttaactaattttatc

SEQ ID NO: 8374688 - DNA, 22 bp, Homo sapiens
tcagcagccgcagctgactcag

SEQ ID NO: 8374689 - DNA, 22 bp, Homo sapiens
cagttgttcccagcaatgaaag

SEQ ID NO: 8374690 - DNA, 22 bp, Homo sapiens
cagtttaaagaaggatgggagt

SEQ ID NO: 8374691 - DNA, 18 bp, Homo sapiens
cagttacaccttcattca

SEQ ID NO: 8374692 - DNA, 22 bp, Homo sapiens
tcagcagaatcttcctacacct

SEQ ID NO: 8374693 - DNA, 22 bp, Homo sapiens
tcagcagaagtatagaggccat

SEQ ID NO: 8374694 - DNA, 22 bp, Homo sapiens
cagttaatcttgccattatatc

SEQ ID NO: 8374695 - DNA, 22 bp, Homo sapiens
cagttaatgtcctatacaatag

SEQ ID NO: 8374696 - DNA, 22 bp, Homo sapiens
cagttaaatttggctgttttct

SEQ ID NO: 8374697 - DNA, 22 bp, Homo sapiens
cagtttacctatatgtaaattt

SEQ ID NO: 8374698 - DNA, 22 bp, Homo sapiens
tcagctgccccagtggccccag

SEQ ID NO: 8374699 - DNA, 22 bp, Homo sapiens
tcagctttgatctcaggcaatc

SEQ ID NO: 8374700 - DNA, 22 bp, Homo sapiens
tcagctttgggggtctcaggag

SEQ ID NO: 8374701 - DNA, 22 bp, Homo sapiens
tcagctttgcaagttagaaaat

SEQ ID NO: 8374702 - DNA, 18 bp, Homo sapiens
tcagcttttgaaaaccaa

SEQ ID NO: 8374703 - DNA, 22 bp, Homo sapiens
tcagcttttaaaaacaagaagt

SEQ ID NO: 8374704 - DNA, 22 bp, Homo sapiens
cataaactcttgagattcttgt

SEQ ID NO: 8374705 - DNA, 22 bp, Homo sapiens
cataaaatggcttgttctttaa

SEQ ID NO: 8374706 - DNA, 22 bp, Homo sapiens
cataaaatggcttgttctttaa

SEQ ID NO: 8374707 - DNA, 22 bp, Homo sapiens
tcaggaaagagtaatgtataca

SEQ ID NO: 8374708 - DNA, 22 bp, Homo sapiens
tcaggaaaatactgcttatcca

SEQ ID NO: 8374709 - DNA, 22 bp, Homo sapiens
tcagctttttacatgtgaaata

SEQ ID NO: 8374710 - DNA, 22 bp, Homo sapiens
taggaacacagggacttgatga

SEQ ID NO: 8374711 - DNA, 22 bp, Homo sapiens
taggaaattttactggtctggg

SEQ ID NO: 8374712 - DNA, 22 bp, Homo sapiens
taggaaatttgaaatatgtggg

SEQ ID NO: 8374713 - DNA, 22 bp, Homo sapiens
taggaaattggaaactcttcac

SEQ ID NO: 8374714 - DNA, 22 bp, Homo sapiens
taggaaattggaaactcttcac

SEQ ID NO: 8374715 - DNA, 22 bp, Homo sapiens
taggaaattggaaactcttcac

SEQ ID NO: 8374716 - DNA, 22 bp, Homo sapiens
taggaaatttcatttgaggtct

SEQ ID NO: 8374717 - DNA, 22 bp, Homo sapiens
taggaaatttatagaggtgttt

SEQ ID NO: 8374718 - DNA, 22 bp, Homo sapiens
taggaaatttcatttgaggtct

SEQ ID NO: 8374719 - DNA, 22 bp, Homo sapiens
taggaaatttgaaatatgtggg

SEQ ID NO: 8374720 - DNA, 22 bp, Homo sapiens
taggaaatttgaaatatgtggg

SEQ ID NO: 8374721 - DNA, 22 bp, Homo sapiens
taggaaattgccaatatatgac

SEQ ID NO: 8374722 - DNA, 22 bp, Homo sapiens
taggaaattgccaatatatgac

SEQ ID NO: 8374723 - DNA, 22 bp, Homo sapiens
taggaaattgccaatatatgac

SEQ ID NO: 8374724 - DNA, 22 bp, Homo sapiens
taggaaattgacacctgcttga

SEQ ID NO: 8374725 - DNA, 22 bp, Homo sapiens
taggaaattgacacctgcttga

SEQ ID NO: 8374726 - DNA, 22 bp, Homo sapiens
taggaaattgacacctgcttga

SEQ ID NO: 8374727 - DNA, 22 bp, Homo sapiens
taggaaattgacacctgcttga

SEQ ID NO: 8374728 - DNA, 22 bp, Homo sapiens
tagctttaataagctgctgaat

SEQ ID NO: 8374729 - DNA, 22 bp, Homo sapiens
taggaaattctcttgctaagtt

SEQ ID NO: 8374730 - DNA, 22 bp, Homo sapiens
taggaaattctcttgctaagtt

SEQ ID NO: 8374731 - DNA, 22 bp, Homo sapiens
taggaaattagaacttggaaac

SEQ ID NO: 8374732 - DNA, 22 bp, Homo sapiens
taggaaattaagtctcttttgt

SEQ ID NO: 8374733 - DNA, 22 bp, Homo sapiens
taggaaattaagtctcttttgt

SEQ ID NO: 8374734 - DNA, 22 bp, Homo sapiens
taggaaattaagtctcttttgt

SEQ ID NO: 8374735 - DNA, 22 bp, Homo sapiens
cagggcagagggaaactccttt

SEQ ID NO: 8374736 - DNA, 22 bp, Homo sapiens
cagggcagagccaggatttcaa

SEQ ID NO: 8374737 - DNA, 22 bp, Homo sapiens
cagggcagccaggccccgtggg

SEQ ID NO: 8374738 - DNA, 22 bp, Homo sapiens
cagggcagccaggccccgtggg

SEQ ID NO: 8374739 - DNA, 22 bp, Homo sapiens
tagctcaaaggttaagtgtgga

SEQ ID NO: 8374740 - DNA, 22 bp, Homo sapiens
tagctcaaaggttaagtgtgga

SEQ ID NO: 8374741 - DNA, 22 bp, Homo sapiens
tagctcaaaggttaagtgtgga

SEQ ID NO: 8374742 - DNA, 22 bp, Homo sapiens
tagctcacttgagctctgctag

SEQ ID NO: 8374743 - DNA, 22 bp, Homo sapiens
tagctcactatttcaggctttt

SEQ ID NO: 8374744 - DNA, 22 bp, Homo sapiens
tagctcaaaggttaagtgtgga

SEQ ID NO: 8374745 - DNA, 22 bp, Homo sapiens
tagctattcacttgttgatgga

SEQ ID NO: 8374746 - DNA, 22 bp, Homo sapiens
tagctacatacttggccattct

SEQ ID NO: 8374747 - DNA, 22 bp, Homo sapiens
taggagagctgaactattgtct

SEQ ID NO: 8374748 - DNA, 22 bp, Homo sapiens
taggagagctgaactattgtct

SEQ ID NO: 8374749 - DNA, 22 bp, Homo sapiens
taggagaggtgaatggcacact

SEQ ID NO: 8374750 - DNA, 22 bp, Homo sapiens
taggagaggtgaatggcacact

SEQ ID NO: 8374751 - DNA, 18 bp, Homo sapiens
taggagagaatttattta

SEQ ID NO: 8374752 - DNA, 21 bp, Homo sapiens
cagggctagagagaatgacaa

SEQ ID NO: 8374753 - DNA, 22 bp, Homo sapiens
cagggcctgtacaagtcccacc

SEQ ID NO: 8374754 - DNA, 22 bp, Homo sapiens
cagggccttatcctgccattga

SEQ ID NO: 8374755 - DNA, 22 bp, Homo sapiens
cagggctcaggaaatcagacgt

SEQ ID NO: 8374756 - DNA, 22 bp, Homo sapiens
cagggctcaggctctgggattc

SEQ ID NO: 8374757 - DNA, 22 bp, Homo sapiens
cagggctcactcggctggcgtc

SEQ ID NO: 8374758 - DNA, 22 bp, Homo sapiens
cagggctcaccactgggatcct

SEQ ID NO: 8374759 - DNA, 22 bp, Homo sapiens
cagggctagggagccctcctgg

SEQ ID NO: 8374760 - DNA, 22 bp, Homo sapiens
cagggctcagaagacagacctc

SEQ ID NO: 8374761 - DNA, 22 bp, Homo sapiens
tagggaaggagaccaagccaca

SEQ ID NO: 8374762 - DNA, 21 bp, Homo sapiens
tagggcaggcattggaagaga

SEQ ID NO: 8374763 - DNA, 22 bp, Homo sapiens
tagggcaggtgaagaaaagcta

SEQ ID NO: 8374764 - DNA, 22 bp, Homo sapiens
tagggcaggggaggaatctgaa

SEQ ID NO: 8374765 - DNA, 22 bp, Homo sapiens
tagggcctgacattcagtaggt

SEQ ID NO: 8374766 - DNA, 22 bp, Homo sapiens
taggtacagctaaaaattatct

SEQ ID NO: 8374767 - DNA, 22 bp, Homo sapiens
taggtagatacatgtgttggct

SEQ ID NO: 8374768 - DNA, 22 bp, Homo sapiens
taggtaggtgcaattaaaagta

SEQ ID NO: 8374769 - DNA, 22 bp, Homo sapiens
taggtagctttggcgtttcttg

SEQ ID NO: 8374770 - DNA, 22 bp, Homo sapiens
tagggtggttagaaggagtatg

SEQ ID NO: 8374771 - DNA, 22 bp, Homo sapiens
tagggtggagactggaagcagg

SEQ ID NO: 8374772 - DNA, 22 bp, Homo sapiens
caggggacagtatggtggatga

SEQ ID NO: 8374773 - DNA, 22 bp, Homo sapiens
caggggacactcctgcttgggc

SEQ ID NO: 8374774 - DNA, 22 bp, Homo sapiens
cagggctttgtgtgcctgggga

SEQ ID NO: 8374775 - DNA, 22 bp, Homo sapiens
tagtgaaatgataacagagcag

SEQ ID NO: 8374776 - DNA, 22 bp, Homo sapiens
tagtgaaatgataacagagcag

SEQ ID NO: 8374777 - DNA, 22 bp, Homo sapiens
tagtgaaagtcaaagacagcta

SEQ ID NO: 8374778 - DNA, 22 bp, Homo sapiens
tagtgaaagtcaaagacagcta

SEQ ID NO: 8374779 - DNA, 22 bp, Homo sapiens
tatcaggaggaaatttccattg

SEQ ID NO: 8374780 - DNA, 22 bp, Homo sapiens
tatcaggacttcattcctttta

SEQ ID NO: 8374781 - DNA, 22 bp, Homo sapiens
tatattgtaggtgctatttgaa

SEQ ID NO: 8374782 - DNA, 22 bp, Homo sapiens
tagtctttttaataaataatgc

SEQ ID NO: 8374783 - DNA, 22 bp, Homo sapiens
tagtctttttaataaataatgc

SEQ ID NO: 8374784 - DNA, 19 bp, Homo sapiens
tagtctttattcttaattt

SEQ ID NO: 8374785 - DNA, 19 bp, Homo sapiens
tagtctttattcttaattt

SEQ ID NO: 8374786 - DNA, 22 bp, Homo sapiens
tagtcttttgagaagtatatct

SEQ ID NO: 8374787 - DNA, 22 bp, Homo sapiens
tagtcttttgagaagtatatct

SEQ ID NO: 8374788 - DNA, 22 bp, Homo sapiens
tagtctttcatttggagcattt

SEQ ID NO: 8374789 - DNA, 22 bp, Homo sapiens
caggggagtgagtccctctctg

SEQ ID NO: 8374790 - DNA, 22 bp, Homo sapiens
cagggtggccctgtggtctcat

SEQ ID NO: 8374791 - DNA, 22 bp, Homo sapiens
cagggtggccaggtagataata

SEQ ID NO: 8374792 - DNA, 22 bp, Homo sapiens
cagggtggcaggcaccatggcc

SEQ ID NO: 8374793 - DNA, 22 bp, Homo sapiens
tatcattatacagacgtataca

SEQ ID NO: 8374794 - DNA, 22 bp, Homo sapiens
tatcatgtctggagatactttt

SEQ ID NO: 8374795 - DNA, 22 bp, Homo sapiens
tatcatgtgactccaatgtgga

SEQ ID NO: 8374796 - DNA, 22 bp, Homo sapiens
tatcataagttaattaaacagt

SEQ ID NO: 8374797 - DNA, 22 bp, Homo sapiens
tatcataagttaattaaacagt

SEQ ID NO: 8374798 - DNA, 22 bp, Homo sapiens
tatcaggagttgacagttgcta

SEQ ID NO: 8374799 - DNA, 22 bp, Homo sapiens
tatcagtttattctataaatag

SEQ ID NO: 8374800 - DNA, 22 bp, Homo sapiens
cagggcagaaggcactctactc

SEQ ID NO: 8374801 - DNA, 22 bp, Homo sapiens
cagggcagaacatatagatagt

SEQ ID NO: 8374802 - DNA, 22 bp, Homo sapiens
cagggcacttaaattgcctcgt

SEQ ID NO: 8374803 - DNA, 22 bp, Homo sapiens
cagggcacagatcggggcgcac

SEQ ID NO: 8374804 - DNA, 22 bp, Homo sapiens
cagggcacagatcggggcgcac

SEQ ID NO: 8374805 - DNA, 21 bp, Homo sapiens
cagggcacacagaggatggta

SEQ ID NO: 8374806 - DNA, 20 bp, Homo sapiens
cagggcacactgcagcctcg

SEQ ID NO: 8374807 - DNA, 20 bp, Homo sapiens
cagggcacactgcagcctcg

SEQ ID NO: 8374808 - DNA, 20 bp, Homo sapiens
cagggcacactgcagcctcg

SEQ ID NO: 8374809 - DNA, 22 bp, Homo sapiens
cagggcaaagagagcacatgct

SEQ ID NO: 8374810 - DNA, 21 bp, Homo sapiens
cagggcaaccaagtccagaga

SEQ ID NO: 8374811 - DNA, 22 bp, Homo sapiens
tagataatttggcatcatattg

SEQ ID NO: 8374812 - DNA, 19 bp, Homo sapiens
tagataaggcatttaatct

SEQ ID NO: 8374813 - DNA, 22 bp, Homo sapiens
tagataatttggcatcatattg

SEQ ID NO: 8374814 - DNA, 22 bp, Homo sapiens
tagcaagtgttggtgaagatgt

SEQ ID NO: 8374815 - DNA, 22 bp, Homo sapiens
tagcaagtgttggtgaagatgt

SEQ ID NO: 8374816 - DNA, 22 bp, Homo sapiens
tagcaaggacaacatatgagag

SEQ ID NO: 8374817 - DNA, 22 bp, Homo sapiens
tagctacaatcactgtcctttg

SEQ ID NO: 8374818 - DNA, 22 bp, Homo sapiens
tagctacaatcactgtcctttg

SEQ ID NO: 8374819 - DNA, 22 bp, Homo sapiens
tagctacaaatctgataagtgg

SEQ ID NO: 8374820 - DNA, 22 bp, Homo sapiens
tagcaatatttggtgaaggtta

SEQ ID NO: 8374821 - DNA, 17 bp, Homo sapiens
tagagctggttcaggag

SEQ ID NO: 8374822 - DNA, 22 bp, Homo sapiens
tagagctggaaaactgcaggta

SEQ ID NO: 8374823 - DNA, 21 bp, Homo sapiens
tagagtgtctgtgtgggaatt

SEQ ID NO: 8374824 - DNA, 22 bp, Homo sapiens
tagagtgtcataacagtgccca

SEQ ID NO: 8374825 - DNA, 22 bp, Homo sapiens
tagagtgtcataacagtgccca

SEQ ID NO: 8374826 - DNA, 22 bp, Homo sapiens
caggctgggctccggagataaa

SEQ ID NO: 8374827 - DNA, 22 bp, Homo sapiens
caggctgggctggtgttagagt

SEQ ID NO: 8374828 - DNA, 22 bp, Homo sapiens
caggctggtcccagagcattgc

SEQ ID NO: 8374829 - DNA, 22 bp, Homo sapiens
tagacattttctcaacatctct

SEQ ID NO: 8374830 - DNA, 22 bp, Homo sapiens
tagacattttctcaacatctct

SEQ ID NO: 8374831 - DNA, 22 bp, Homo sapiens
caggctgggcagcctccccggc

SEQ ID NO: 8374832 - DNA, 21 bp, Homo sapiens
tagaatcactaataagatgta

SEQ ID NO: 8374833 - DNA, 21 bp, Homo sapiens
tagaatcactaataagatgta

SEQ ID NO: 8374834 - DNA, 22 bp, Homo sapiens
tagaatatgtggtgtatacttt

SEQ ID NO: 8374835 - DNA, 22 bp, Homo sapiens
gtgagggcaaattagaatcaaa

SEQ ID NO: 8374836 - DNA, 20 bp, Homo sapiens
cagccctgtgacctggccct

SEQ ID NO: 8374837 - DNA, 20 bp, Homo sapiens
cagccctgtgacctggccct

SEQ ID NO: 8374838 - DNA, 22 bp, Homo sapiens
tactattgaatcattgtcaatc

SEQ ID NO: 8374839 - DNA, 22 bp, Homo sapiens
tactatgttcttcctaaatagt

SEQ ID NO: 8374840 - DNA, 22 bp, Homo sapiens
tacctctggacattgtggagca

SEQ ID NO: 8374841 - DNA, 22 bp, Homo sapiens
tacctgaaccaagcccagctct

SEQ ID NO: 8374842 - DNA, 22 bp, Homo sapiens
tacctgaagtaacaatgaatat

SEQ ID NO: 8374843 - DNA, 22 bp, Homo sapiens
tactatgtgaaaatactatagt

SEQ ID NO: 8374844 - DNA, 22 bp, Homo sapiens
tactgtattgttggctcttttg

SEQ ID NO: 8374845 - DNA, 22 bp, Homo sapiens
tactgtatttgataagtgaagt

SEQ ID NO: 8374846 - DNA, 22 bp, Homo sapiens
tactgtctaataagattgatgg

SEQ ID NO: 8374847 - DNA, 22 bp, Homo sapiens
tactgtctaataagattgatgg

SEQ ID NO: 8374848 - DNA, 22 bp, Homo sapiens
tactgtctatacacttgattac

SEQ ID NO: 8374849 - DNA, 22 bp, Homo sapiens
tactgtctatacacttgattac

SEQ ID NO: 8374850 - DNA, 22 bp, Homo sapiens
tactgtctgcttcttatagctt

SEQ ID NO: 8374851 - DNA, 22 bp, Homo sapiens
tactgtctggcaattaagaatc

SEQ ID NO: 8374852 - DNA, 22 bp, Homo sapiens
tactattttgacatgaaattga

SEQ ID NO: 8374853 - DNA, 22 bp, Homo sapiens
tactattttgacatgaaattga

SEQ ID NO: 8374854 - DNA, 22 bp, Homo sapiens
tactatttttgcaacgtataca

SEQ ID NO: 8374855 - DNA, 22 bp, Homo sapiens
tactcaaactcactaagacaga

SEQ ID NO: 8374856 - DNA, 22 bp, Homo sapiens
tactcatcagactccagggtgg

SEQ ID NO: 8374857 - DNA, 22 bp, Homo sapiens
tactcatttcaaacagcacaaa

SEQ ID NO: 8374858 - DNA, 22 bp, Homo sapiens
tactcacattctgtttcttgct

SEQ ID NO: 8374859 - DNA, 20 bp, Homo sapiens
tactcacaaatggtttagca

SEQ ID NO: 8374860 - DNA, 22 bp, Homo sapiens
tactcaatttcttatgggtttc

SEQ ID NO: 8374861 - DNA, 22 bp, Homo sapiens
tactcaatctaggtggcttacc

SEQ ID NO: 8374862 - DNA, 22 bp, Homo sapiens
tactcaatgaagtagcctggtt

SEQ ID NO: 8374863 - DNA, 22 bp, Homo sapiens
caggctggagtgcaatggtgct

SEQ ID NO: 8374864 - DNA, 22 bp, Homo sapiens
caggctggagtgcagtggcgcc

SEQ ID NO: 8374865 - DNA, 22 bp, Homo sapiens
caggctggagtgcaatgacgcc

SEQ ID NO: 8374866 - DNA, 22 bp, Homo sapiens
caggctggagtgcaatggcaca

SEQ ID NO: 8374867 - DNA, 22 bp, Homo sapiens
tactgtgaatacaaaataaatt

SEQ ID NO: 8374868 - DNA, 22 bp, Homo sapiens
caggctggagtgagtgtagtgg

SEQ ID NO: 8374869 - DNA, 22 bp, Homo sapiens
caggctgcctggaagaggactg

SEQ ID NO: 8374870 - DNA, 22 bp, Homo sapiens
caggctggagtgcagtggggcg

SEQ ID NO: 8374871 - DNA, 22 bp, Homo sapiens
caggctggagtgcagtggcgct

SEQ ID NO: 8374872 - DNA, 22 bp, Homo sapiens
tagaacataagtcattcatttg

SEQ ID NO: 8374873 - DNA, 22 bp, Homo sapiens
tagaataagttgatgatatatg

SEQ ID NO: 8374874 - DNA, 22 bp, Homo sapiens
tccagactctgtcacttcctag

SEQ ID NO: 8374875 - DNA, 22 bp, Homo sapiens
tccagagaattctacgcagtgc

SEQ ID NO: 8374876 - DNA, 22 bp, Homo sapiens
tccagagaacgatgaaagctgg

SEQ ID NO: 8374877 - DNA, 23 bp, Homo sapiens
tccagctgcagtgggatggggaa

SEQ ID NO: 8374878 - DNA, 21 bp, Homo sapiens
tccagctgcacaagcatgggg

SEQ ID NO: 8374879 - DNA, 22 bp, Homo sapiens
tccagctgacagttcaaaatga

SEQ ID NO: 8374880 - DNA, 22 bp, Homo sapiens
tccagctcttgttgcccactgc

SEQ ID NO: 8374881 - DNA, 20 bp, Homo sapiens
tccagctgacattctctttc

SEQ ID NO: 8374882 - DNA, 22 bp, Homo sapiens
tccagctgcaaggggcacagct

SEQ ID NO: 8374883 - DNA, 22 bp, Homo sapiens
tccagcctcatttctcctgctt

SEQ ID NO: 8374884 - DNA, 22 bp, Homo sapiens
tccagcctaatgttcttcccac

SEQ ID NO: 8374885 - DNA, 22 bp, Homo sapiens
tccagcctaggggaacagctgc

SEQ ID NO: 8374886 - DNA, 17 bp, Homo sapiens
tccagcctcctctgctg

SEQ ID NO: 8374887 - DNA, 22 bp, Homo sapiens
tccagcctcctatttaccctaa

SEQ ID NO: 8374888 - DNA, 22 bp, Homo sapiens
tccagctcttcagttctgcaaa

SEQ ID NO: 8374889 - DNA, 17 bp, Homo sapiens
tccagcctcctctgctg

SEQ ID NO: 8374890 - DNA, 22 bp, Homo sapiens
tccaggcccatggagcagagct

SEQ ID NO: 8374891 - DNA, 22 bp, Homo sapiens
tccagctggcccggccatgaat

SEQ ID NO: 8374892 - DNA, 20 bp, Homo sapiens
tccaggcagctcagagtgtc

SEQ ID NO: 8374893 - DNA, 22 bp, Homo sapiens
tccaggccccagcaccttggga

SEQ ID NO: 8374894 - DNA, 22 bp, Homo sapiens
catgttaaaatatacattctga

SEQ ID NO: 8374895 - DNA, 22 bp, Homo sapiens
catgttaaaatatacattctga

SEQ ID NO: 8374896 - DNA, 22 bp, Homo sapiens
catgtgtgtgagggaaacatgt

SEQ ID NO: 8374897 - DNA, 22 bp, Homo sapiens
catgtgtgtggacgagcgtggc

SEQ ID NO: 8374898 - DNA, 22 bp, Homo sapiens
catgtgtgtggacgagcgtggc

SEQ ID NO: 8374899 - DNA, 22 bp, Homo sapiens
catgtgtgtccatgtgactaag

SEQ ID NO: 8374900 - DNA, 22 bp, Homo sapiens
catgtgtggttacctacttgac

SEQ ID NO: 8374901 - DNA, 18 bp, Homo sapiens
tccaggctccaggctaac

SEQ ID NO: 8374902 - DNA, 22 bp, Homo sapiens
tcattcttgatcactagttagt

SEQ ID NO: 8374903 - DNA, 22 bp, Homo sapiens
tcattgaaaactcagcatctac

SEQ ID NO: 8374904 - DNA, 22 bp, Homo sapiens
tcattctctgggatgcagtttg

SEQ ID NO: 8374905 - DNA, 22 bp, Homo sapiens
tcattctcagactcttggcctc

SEQ ID NO: 8374906 - DNA, 22 bp, Homo sapiens
tcattctcagactcttggcctc

SEQ ID NO: 8374907 - DNA, 22 bp, Homo sapiens
tcattccctccagctgtggcta

SEQ ID NO: 8374908 - DNA, 22 bp, Homo sapiens
tcattccatttccagctctgaa

SEQ ID NO: 8374909 - DNA, 22 bp, Homo sapiens
tcatttatgtctttgccatcca

SEQ ID NO: 8374910 - DNA, 22 bp, Homo sapiens
tcatttatgtctttgccatcca

SEQ ID NO: 8374911 - DNA, 21 bp, Homo sapiens
tcatttattgagaaatgactg

SEQ ID NO: 8374912 - DNA, 22 bp, Homo sapiens
tcatttatcgctgccttttaaa

SEQ ID NO: 8374913 - DNA, 22 bp, Homo sapiens
tcatttatgcaggaatggcata

SEQ ID NO: 8374914 - DNA, 22 bp, Homo sapiens
tccacagtggtggaattgttca

SEQ ID NO: 8374915 - DNA, 21 bp, Homo sapiens
tcatttattgagaaatgactg

SEQ ID NO: 8374916 - DNA, 22 bp, Homo sapiens
tcatttatttataccattgcct

SEQ ID NO: 8374917 - DNA, 22 bp, Homo sapiens
tcatttatttgactttggagtg

SEQ ID NO: 8374918 - DNA, 22 bp, Homo sapiens
tcatttatttgactttggagtg

SEQ ID NO: 8374919 - DNA, 22 bp, Homo sapiens
tccacagggcctttctggtgtg

SEQ ID NO: 8374920 - DNA, 22 bp, Homo sapiens
tccacatgacttctaataactg

SEQ ID NO: 8374921 - DNA, 20 bp, Homo sapiens
tccacatcttttgagatgtg

SEQ ID NO: 8374922 - DNA, 22 bp, Homo sapiens
tccacatctctcgccaaccaat

SEQ ID NO: 8374923 - DNA, 22 bp, Homo sapiens
tccacagttttgccactagctg

SEQ ID NO: 8374924 - DNA, 22 bp, Homo sapiens
tccacatcaagggcagagaggt

SEQ ID NO: 8374925 - DNA, 22 bp, Homo sapiens
tccacatagagcttagaagcaa

SEQ ID NO: 8374926 - DNA, 22 bp, Homo sapiens
tccacatccattgcttgacttt

SEQ ID NO: 8374927 - DNA, 22 bp, Homo sapiens
tccacatctaggtttgtcaaca

SEQ ID NO: 8374928 - DNA, 22 bp, Homo sapiens
tccacatccattgcttgacttt

SEQ ID NO: 8374929 - DNA, 14 bp, Homo sapiens
tccacatcagcagt

SEQ ID NO: 8374930 - DNA, 22 bp, Homo sapiens
tcatgaaaatagatcagaaatt

SEQ ID NO: 8374931 - DNA, 23 bp, Homo sapiens
tcatgagtggctgcggggctgag

SEQ ID NO: 8374932 - DNA, 22 bp, Homo sapiens
catcttttggcctattctgagg

SEQ ID NO: 8374933 - DNA, 20 bp, Homo sapiens
tcattccaaatagttcagca

SEQ ID NO: 8374934 - DNA, 22 bp, Homo sapiens
tcattcatgaggtgctagtgct

SEQ ID NO: 8374935 - DNA, 22 bp, Homo sapiens
tcattcatcagttggtagagat

SEQ ID NO: 8374936 - DNA, 22 bp, Homo sapiens
catgaaaaatttactgttaaca

SEQ ID NO: 8374937 - DNA, 22 bp, Homo sapiens
catgaaaaatttactgttaaca

SEQ ID NO: 8374938 - DNA, 22 bp, Homo sapiens
catttgtatgttcctccttagg

SEQ ID NO: 8374939 - DNA, 21 bp, Homo sapiens
tcctctccatgatctgtttgt

SEQ ID NO: 8374940 - DNA, 22 bp, Homo sapiens
tcctctccatattttctgattt

SEQ ID NO: 8374941 - DNA, 22 bp, Homo sapiens
catttgtaggatgcttcttgtt

SEQ ID NO: 8374942 - DNA, 22 bp, Homo sapiens
catttgtagttaaaaatgtctc

SEQ ID NO: 8374943 - DNA, 22 bp, Homo sapiens
catttgtatagtgcttagacca

SEQ ID NO: 8374944 - DNA, 22 bp, Homo sapiens
catttgtatcatatgtatctta

SEQ ID NO: 8374945 - DNA, 22 bp, Homo sapiens
catttgtatagtgcttagacca

SEQ ID NO: 8374946 - DNA, 22 bp, Homo sapiens
catttggccattccagtcacat

SEQ ID NO: 8374947 - DNA, 22 bp, Homo sapiens
catttggaccaaaatagccaac

SEQ ID NO: 8374948 - DNA, 22 bp, Homo sapiens
catttggtcattaggtctcctt

SEQ ID NO: 8374949 - DNA, 22 bp, Homo sapiens
catttgtacagaacagctttat

SEQ ID NO: 8374950 - DNA, 22 bp, Homo sapiens
catttgtactgttcaatgtcat

SEQ ID NO: 8374951 - DNA, 22 bp, Homo sapiens
tccctagtcgcatctgtggaga

SEQ ID NO: 8374952 - DNA, 22 bp, Homo sapiens
tccctagtcgcatctgtggaga

SEQ ID NO: 8374953 - DNA, 22 bp, Homo sapiens
tccctagtagacccagatcatt

SEQ ID NO: 8374954 - DNA, 22 bp, Homo sapiens
tccctaggtcctagtcacagta

SEQ ID NO: 8374955 - DNA, 20 bp, Homo sapiens
tccctaggcaggagggcact

SEQ ID NO: 8374956 - DNA, 22 bp, Homo sapiens
tccctcactggttctgcatccc

SEQ ID NO: 8374957 - DNA, 22 bp, Homo sapiens
tcctcaggctgcctggaagact

SEQ ID NO: 8374958 - DNA, 22 bp, Homo sapiens
tcctcaggcggtgaggaggggc

SEQ ID NO: 8374959 - DNA, 22 bp, Homo sapiens
tccccagattcatgtctgctgt

SEQ ID NO: 8374960 - DNA, 22 bp, Homo sapiens
tccccagcattgagggtctctc

SEQ ID NO: 8374961 - DNA, 22 bp, Homo sapiens
tccccagcttgctacttctgct

SEQ ID NO: 8374962 - DNA, 22 bp, Homo sapiens
tccctagaggtcttcacaagat

SEQ ID NO: 8374963 - DNA, 22 bp, Homo sapiens
tcccgtcttgctgttgtctgcg

SEQ ID NO: 8374964 - DNA, 22 bp, Homo sapiens
cattgaaatatggaaactgatg

SEQ ID NO: 8374965 - DNA, 22 bp, Homo sapiens
cattgaaagagataaagccttt

SEQ ID NO: 8374966 - DNA, 22 bp, Homo sapiens
cattgcaacttcaaactcctgg

SEQ ID NO: 8374967 - DNA, 22 bp, Homo sapiens
cattgagaatctgggctacagc

SEQ ID NO: 8374968 - DNA, 22 bp, Homo sapiens
tcccagggtcctcttctggaat

SEQ ID NO: 8374969 - DNA, 22 bp, Homo sapiens
cattgcaccacattgcatccct

SEQ ID NO: 8374970 - DNA, 22 bp, Homo sapiens
tcccagcccagatttgtgtgac

SEQ ID NO: 8374971 - DNA, 22 bp, Homo sapiens
tcccagcccagacttctccagt

SEQ ID NO: 8374972 - DNA, 22 bp, Homo sapiens
tcccagccattcctttaggtgt

SEQ ID NO: 8374973 - DNA, 22 bp, Homo sapiens
tcccagccaggctctaccactt

SEQ ID NO: 8374974 - DNA, 22 bp, Homo sapiens
tcccagccacagtttccacctg

SEQ ID NO: 8374975 - DNA, 22 bp, Homo sapiens
tcccaggaattgaagccagtgt

SEQ ID NO: 8374976 - DNA, 22 bp, Homo sapiens
tcccaggaatccgtcctctaga

SEQ ID NO: 8374977 - DNA, 22 bp, Homo sapiens
tcccaggacatgggctctgctc

SEQ ID NO: 8374978 - DNA, 22 bp, Homo sapiens
tcccagagcctctgccactctg

SEQ ID NO: 8374979 - DNA, 22 bp, Homo sapiens
tcccagaggaaatggcagctga

SEQ ID NO: 8374980 - DNA, 22 bp, Homo sapiens
tcccagccacaggtgtagccct

SEQ ID NO: 8374981 - DNA, 22 bp, Homo sapiens
tcccagaggaaatggcagctga

SEQ ID NO: 8374982 - DNA, 22 bp, Homo sapiens
tcccactgagcatatgcagatg

SEQ ID NO: 8374983 - DNA, 21 bp, Homo sapiens
tcccactctaaatggactgaa

SEQ ID NO: 8374984 - DNA, 22 bp, Homo sapiens
tcccagagcccaagttggagag

SEQ ID NO: 8374985 - DNA, 22 bp, Homo sapiens
cattcacaactgagcattgttg

SEQ ID NO: 8374986 - DNA, 22 bp, Homo sapiens
cattcacaatagttgaaaggtg

SEQ ID NO: 8374987 - DNA, 22 bp, Homo sapiens
cattcacagagggggaagcatc

SEQ ID NO: 8374988 - DNA, 22 bp, Homo sapiens
cattcacaatggattgcttcaa

SEQ ID NO: 8374989 - DNA, 22 bp, Homo sapiens
cattcacagcaggtcagctgaa

SEQ ID NO: 8374990 - DNA, 22 bp, Homo sapiens
cattcacaaagctgattgatgg

SEQ ID NO: 8374991 - DNA, 22 bp, Homo sapiens
cattcacaaaaccacatgccat

SEQ ID NO: 8374992 - DNA, 22 bp, Homo sapiens
cattcaaatgtgccactgtcct

SEQ ID NO: 8374993 - DNA, 22 bp, Homo sapiens
cattcaaattaagattttgtta

SEQ ID NO: 8374994 - DNA, 22 bp, Homo sapiens
cattcacattcttcttactgtt

SEQ ID NO: 8374995 - DNA, 22 bp, Homo sapiens
cattcagagctttcttatcata

SEQ ID NO: 8374996 - DNA, 21 bp, Homo sapiens
cattcacagtctggctcttga

SEQ ID NO: 8374997 - DNA, 21 bp, Homo sapiens
cattcacagtctggctcttga

SEQ ID NO: 8374998 - DNA, 22 bp, Homo sapiens
cattcacatcttgttccatcac

SEQ ID NO: 8374999 - DNA, 22 bp, Homo sapiens
cattcacatcttgttccatcac

SEQ ID NO: 8375000 - DNA, 22 bp, Homo sapiens
cattcataagactttgctcttg

SEQ ID NO: 8375001 - DNA, 22 bp, Homo sapiens
cattcagtcatgctggttttga

SEQ ID NO: 8375002 - DNA, 22 bp, Homo sapiens
cattcatctatcaaatggtacc

SEQ ID NO: 8375003 - DNA, 22 bp, Homo sapiens
cattatattacagcactgttaa

SEQ ID NO: 8375004 - DNA, 22 bp, Homo sapiens
cattcaaaggcatgtcctattt

SEQ ID NO: 8375005 - DNA, 22 bp, Homo sapiens
catgtttctgatgcagctttta

SEQ ID NO: 8375006 - DNA, 22 bp, Homo sapiens
catgttgtagtatcataatggt

SEQ ID NO: 8375007 - DNA, 22 bp, Homo sapiens
catgttaatatgcattgagtac

SEQ ID NO: 8375008 - DNA, 22 bp, Homo sapiens
catgttaactaagattaactat

SEQ ID NO: 8375009 - DNA, 22 bp, Homo sapiens
catgttctaatattgtgacata

SEQ ID NO: 8375010 - DNA, 22 bp, Homo sapiens
catgttgaatggccttgatttt

SEQ ID NO: 8375011 - DNA, 22 bp, Homo sapiens
catgttctcttaatgttaacta

SEQ ID NO: 8375012 - DNA, 22 bp, Homo sapiens
ccagcagccctcttccaagact

SEQ ID NO: 8375013 - DNA, 22 bp, Homo sapiens
ccagcagcccacaggcgtccct

SEQ ID NO: 8375014 - DNA, 22 bp, Homo sapiens
ccagcagcccctcaatgatctg

SEQ ID NO: 8375015 - DNA, 22 bp, Homo sapiens
ccagcagccaccttctcgaaat

SEQ ID NO: 8375016 - DNA, 22 bp, Homo sapiens
ccagcagccaccttctcgaaat

SEQ ID NO: 8375017 - DNA, 22 bp, Homo sapiens
ccagcagccagagaaggacctc

SEQ ID NO: 8375018 - DNA, 22 bp, Homo sapiens
ccagcagcatcctgcagcactt

SEQ ID NO: 8375019 - DNA, 22 bp, Homo sapiens
ccagcagcaggccaggccctcc

SEQ ID NO: 8375020 - DNA, 22 bp, Homo sapiens
ccagcagagttggtttctggta

SEQ ID NO: 8375021 - DNA, 22 bp, Homo sapiens
ccagcagcagcgtccaaggaga

SEQ ID NO: 8375022 - DNA, 22 bp, Homo sapiens
ccagcagagggtcttggccatt

SEQ ID NO: 8375023 - DNA, 22 bp, Homo sapiens
ccagcagagggtcttggccatt

SEQ ID NO: 8375024 - DNA, 22 bp, Homo sapiens
ccagcagggcagtgccctggac

SEQ ID NO: 8375025 - DNA, 22 bp, Homo sapiens
ccagcaggggaatatttttagg

SEQ ID NO: 8375026 - DNA, 22 bp, Homo sapiens
ccagcagggcagtgccctggac

SEQ ID NO: 8375027 - DNA, 22 bp, Homo sapiens
ccagcagggcagtgccctggac

SEQ ID NO: 8375028 - DNA, 22 bp, Homo sapiens
ccagcagggcagtgccctggac

SEQ ID NO: 8375029 - DNA, 22 bp, Homo sapiens
ccagcagctttattggctctcc

SEQ ID NO: 8375030 - DNA, 22 bp, Homo sapiens
ccagcagctgtggctttgcctc

SEQ ID NO: 8375031 - DNA, 22 bp, Homo sapiens
ccagcagctgtggctttgcctc

SEQ ID NO: 8375032 - DNA, 22 bp, Homo sapiens
ccagcagggaaaaacccaccaa

SEQ ID NO: 8375033 - DNA, 22 bp, Homo sapiens
ccagcagctttattggctctcc

SEQ ID NO: 8375034 - DNA, 22 bp, Homo sapiens
ccagcagctcagctactggtca

SEQ ID NO: 8375035 - DNA, 21 bp, Homo sapiens
ccagcagctcaaggatctctt

SEQ ID NO: 8375036 - DNA, 22 bp, Homo sapiens
ccagcagcgatagggtgagtgc

SEQ ID NO: 8375037 - DNA, 22 bp, Homo sapiens
ccagcagctccctcagggtccg

SEQ ID NO: 8375038 - DNA, 22 bp, Homo sapiens
ccagcagctccctcagggtccg

SEQ ID NO: 8375039 - DNA, 22 bp, Homo sapiens
ccagcagctgacaccagtccca

SEQ ID NO: 8375040 - DNA, 22 bp, Homo sapiens
ccagcagctgcaaagcctgggt

SEQ ID NO: 8375041 - DNA, 22 bp, Homo sapiens
ccagcagctgcaaagcctgggt

SEQ ID NO: 8375042 - DNA, 22 bp, Homo sapiens
ccagcagctgcaaagcctgggt

SEQ ID NO: 8375043 - DNA, 22 bp, Homo sapiens
ccagcagctgctatgtggtttt

SEQ ID NO: 8375044 - DNA, 22 bp, Homo sapiens
tctctgggacactgggtcagtt

SEQ ID NO: 8375045 - DNA, 22 bp, Homo sapiens
tctctgggacactgggtcagtt

SEQ ID NO: 8375046 - DNA, 22 bp, Homo sapiens
tctctgcccatcctcagtccac

SEQ ID NO: 8375047 - DNA, 22 bp, Homo sapiens
tctctgcccatgagcaatctgc

SEQ ID NO: 8375048 - DNA, 22 bp, Homo sapiens
tctctgcccatcctcagtccac

SEQ ID NO: 8375049 - DNA, 17 bp, Homo sapiens
tctcctggctctatcag

SEQ ID NO: 8375050 - DNA, 23 bp, Homo sapiens
tctcctggctgcactgtggccac

SEQ ID NO: 8375051 - DNA, 22 bp, Homo sapiens
tctcctggctctaaaaggctgt

SEQ ID NO: 8375052 - DNA, 22 bp, Homo sapiens
tctcctggctcaccaggctgga

SEQ ID NO: 8375053 - DNA, 22 bp, Homo sapiens
tctcctggcctttaggttaagg

SEQ ID NO: 8375054 - DNA, 22 bp, Homo sapiens
tctcctggccgggctgtcccct

SEQ ID NO: 8375055 - DNA, 22 bp, Homo sapiens
tctcctggcctttaggttaagg

SEQ ID NO: 8375056 - DNA, 22 bp, Homo sapiens
tctctgagttttaaggatgatg

SEQ ID NO: 8375057 - DNA, 22 bp, Homo sapiens
tctctgagttgtaaaaaatagt

SEQ ID NO: 8375058 - DNA, 22 bp, Homo sapiens
tctctcttgtcaccccatctgc

SEQ ID NO: 8375059 - DNA, 22 bp, Homo sapiens
tctctgatgattggaagcttag

SEQ ID NO: 8375060 - DNA, 22 bp, Homo sapiens
tctctgatgacctatgatgttg

SEQ ID NO: 8375061 - DNA, 22 bp, Homo sapiens
ccagccacagcttccagctcct

SEQ ID NO: 8375062 - DNA, 22 bp, Homo sapiens
ccagccctgcctctcagggccc

SEQ ID NO: 8375063 - DNA, 22 bp, Homo sapiens
tctgagagcaaggcattagcag

SEQ ID NO: 8375064 - DNA, 22 bp, Homo sapiens
tctgagagctgccatctcattt

SEQ ID NO: 8375065 - DNA, 22 bp, Homo sapiens
tctgagaggtgaattcagcaaa

SEQ ID NO: 8375066 - DNA, 22 bp, Homo sapiens
tctgcagaaggaatcagctgag

SEQ ID NO: 8375067 - DNA, 19 bp, Homo sapiens
tctgcagaaggcatacatg

SEQ ID NO: 8375068 - DNA, 22 bp, Homo sapiens
tctgatattggacaattcaggg

SEQ ID NO: 8375069 - DNA, 22 bp, Homo sapiens
tctgagagtacgggctgcgcgc

SEQ ID NO: 8375070 - DNA, 22 bp, Homo sapiens
tctgatatcgcactaaactctg

SEQ ID NO: 8375071 - DNA, 22 bp, Homo sapiens
tctgatatgaatgtctagctct

SEQ ID NO: 8375072 - DNA, 22 bp, Homo sapiens
tctgatatctctccctgggtca

SEQ ID NO: 8375073 - DNA, 21 bp, Homo sapiens
tctgatatatccccaagttac

SEQ ID NO: 8375074 - DNA, 22 bp, Homo sapiens
tctgatataaaagtgacattca

SEQ ID NO: 8375075 - DNA, 22 bp, Homo sapiens
ccagcatctaacgctcctggga

SEQ ID NO: 8375076 - DNA, 19 bp, Homo sapiens
ccagcaggttcatttcagg

SEQ ID NO: 8375077 - DNA, 22 bp, Homo sapiens
tctctgtgtgccttcatctgcc

SEQ ID NO: 8375078 - DNA, 22 bp, Homo sapiens
tctctgtgtgccttcatctgcc

SEQ ID NO: 8375079 - DNA, 23 bp, Homo sapiens
tctctgtgtgcctcagtttcttc

SEQ ID NO: 8375080 - DNA, 19 bp, Homo sapiens
ccagcaggttcatttcagg

SEQ ID NO: 8375081 - DNA, 22 bp, Homo sapiens
ccagcaggtgtagggctcatgg

SEQ ID NO: 8375082 - DNA, 22 bp, Homo sapiens
ccagcaggtgtagggctcatgg

SEQ ID NO: 8375083 - DNA, 22 bp, Homo sapiens
ccagcaggtgtagggctcatgg

SEQ ID NO: 8375084 - DNA, 22 bp, Homo sapiens
ccagcaggggaatatttttagg

SEQ ID NO: 8375085 - DNA, 22 bp, Homo sapiens
ccagcagggttggtttcttctg

SEQ ID NO: 8375086 - DNA, 22 bp, Homo sapiens
ccagcagggttggtttcttctg

SEQ ID NO: 8375087 - DNA, 22 bp, Homo sapiens
ccagcaggtgtagggctcatgg

SEQ ID NO: 8375088 - DNA, 22 bp, Homo sapiens
tctctgtgtgttggctgtatat

SEQ ID NO: 8375089 - DNA, 22 bp, Homo sapiens
tctctgtgttccctgttttctc

SEQ ID NO: 8375090 - DNA, 22 bp, Homo sapiens
tctctgtgtgttggctgtatat

SEQ ID NO: 8375091 - DNA, 22 bp, Homo sapiens
tctctgtgtgttggctgtatat

SEQ ID NO: 8375092 - DNA, 22 bp, Homo sapiens
tctctgttcatggcactatgtc

SEQ ID NO: 8375093 - DNA, 22 bp, Homo sapiens
tctcaagcttgttggtatgttt

SEQ ID NO: 8375094 - DNA, 22 bp, Homo sapiens
tctcaagactggttttcacagc

SEQ ID NO: 8375095 - DNA, 22 bp, Homo sapiens
tctcaaatttgctggaccagta

SEQ ID NO: 8375096 - DNA, 22 bp, Homo sapiens
tctcaaatttatacagagttca

SEQ ID NO: 8375097 - DNA, 22 bp, Homo sapiens
tctcaaatttgttagataaaat

SEQ ID NO: 8375098 - DNA, 22 bp, Homo sapiens
ccacctcctaggcctggagaag

SEQ ID NO: 8375099 - DNA, 22 bp, Homo sapiens
ccacctcctcggccatgtgacg

SEQ ID NO: 8375100 - DNA, 22 bp, Homo sapiens
ccacctcctaggcctggagaag

SEQ ID NO: 8375101 - DNA, 22 bp, Homo sapiens
tctatattatacatccaggatt

SEQ ID NO: 8375102 - DNA, 22 bp, Homo sapiens
tctatagtttctgagtttcttc

SEQ ID NO: 8375103 - DNA, 22 bp, Homo sapiens
tctcaaatgtaaagcatgattt

SEQ ID NO: 8375104 - DNA, 22 bp, Homo sapiens
tctccactattttctagctctt

SEQ ID NO: 8375105 - DNA, 22 bp, Homo sapiens
tctccacagtcccacctcgctt

SEQ ID NO: 8375106 - DNA, 22 bp, Homo sapiens
tctccacaagtgttgagagtac

SEQ ID NO: 8375107 - DNA, 22 bp, Homo sapiens
tctccacaagtgttgagagtac

SEQ ID NO: 8375108 - DNA, 20 bp, Homo sapiens
tctcagtttctagagtcagg

SEQ ID NO: 8375109 - DNA, 22 bp, Homo sapiens
tctcagtttctcattataaaag

SEQ ID NO: 8375110 - DNA, 22 bp, Homo sapiens
ccactttgagaagctgatgaaa

SEQ ID NO: 8375111 - DNA, 22 bp, Homo sapiens
ccacttttctacccactgtgac

SEQ ID NO: 8375112 - DNA, 22 bp, Homo sapiens
ccacttttcactaagatgaatt

SEQ ID NO: 8375113 - DNA, 22 bp, Homo sapiens
ccacttttttctccatctctga

SEQ ID NO: 8375114 - DNA, 22 bp, Homo sapiens
ccactttttagagaacaaaact

SEQ ID NO: 8375115 - DNA, 22 bp, Homo sapiens
tctccaggaaagacactggact

SEQ ID NO: 8375116 - DNA, 18 bp, Homo sapiens
tctccacttctgtgagaa

SEQ ID NO: 8375117 - DNA, 18 bp, Homo sapiens
tctccacttctgtgagaa

SEQ ID NO: 8375118 - DNA, 22 bp, Homo sapiens
tctccactctgagtgcctttca

SEQ ID NO: 8375119 - DNA, 22 bp, Homo sapiens
ccagagagagtactgggctctg

SEQ ID NO: 8375120 - DNA, 21 bp, Homo sapiens
ccagagagagggaagtgggtt

SEQ ID NO: 8375121 - DNA, 22 bp, Homo sapiens
ccagagagagtactgggctctg

SEQ ID NO: 8375122 - DNA, 22 bp, Homo sapiens
ccagagagctacaaggcataaa

SEQ ID NO: 8375123 - DNA, 22 bp, Homo sapiens
ccagagagctacaaggcataaa

SEQ ID NO: 8375124 - DNA, 19 bp, Homo sapiens
ccagagagctaggtacaga

SEQ ID NO: 8375125 - DNA, 22 bp, Homo sapiens
ccagagaggcaaaactccttcc

SEQ ID NO: 8375126 - DNA, 22 bp, Homo sapiens
tctcccttggtcacagattcct

SEQ ID NO: 8375127 - DNA, 22 bp, Homo sapiens
tctcctggccctgtcgccatct

SEQ ID NO: 8375128 - DNA, 20 bp, Homo sapiens
tctccctgcccatctcagat

SEQ ID NO: 8375129 - DNA, 20 bp, Homo sapiens
tctccctgcccatctcagat

SEQ ID NO: 8375130 - DNA, 22 bp, Homo sapiens
tctccctctttgtctgctttgg

SEQ ID NO: 8375131 - DNA, 22 bp, Homo sapiens
tctccctctcagatttattcac

SEQ ID NO: 8375132 - DNA, 22 bp, Homo sapiens
ccagagaggccttggcaagaca

SEQ ID NO: 8375133 - DNA, 22 bp, Homo sapiens
ccacattttgctttgcctaggt

SEQ ID NO: 8375134 - DNA, 20 bp, Homo sapiens
ccacattttactgtttgcca

SEQ ID NO: 8375135 - DNA, 22 bp, Homo sapiens
ccacatttttgatactctcact

SEQ ID NO: 8375136 - DNA, 22 bp, Homo sapiens
ccaccacatttgcctagacttt

SEQ ID NO: 8375137 - DNA, 22 bp, Homo sapiens
ccaccacttctggcttctggtg

SEQ ID NO: 8375138 - DNA, 22 bp, Homo sapiens
ccaccagatttactttactatt

SEQ ID NO: 8375139 - DNA, 22 bp, Homo sapiens
ccaccagctttggcggtgacag

SEQ ID NO: 8375140 - DNA, 22 bp, Homo sapiens
tcctttccagcctcacctcagc

SEQ ID NO: 8375141 - DNA, 22 bp, Homo sapiens
tcgcgcccccaagcgtcattgg

SEQ ID NO: 8375142 - DNA, 22 bp, Homo sapiens
tcgctcaggcttgagtgtagtg

SEQ ID NO: 8375143 - DNA, 22 bp, Homo sapiens
ccaccgctgaaggcactggcat

SEQ ID NO: 8375144 - DNA, 22 bp, Homo sapiens
ccacccttgggttcggaggccg

SEQ ID NO: 8375145 - DNA, 22 bp, Homo sapiens
tcggtggcgcccgcgcgggacc

SEQ ID NO: 8375146 - DNA, 22 bp, Homo sapiens
tcggagtgaatcttcacaatgt

SEQ ID NO: 8375147 - DNA, 22 bp, Homo sapiens
tcggcgcgcccagtcgatgggg

SEQ ID NO: 8375148 - DNA, 22 bp, Homo sapiens
tcgggtgcttttagatatgtag

SEQ ID NO: 8375149 - DNA, 22 bp, Homo sapiens
ccacatgatgaggaagctgaac

SEQ ID NO: 8375150 - DNA, 22 bp, Homo sapiens
ccacatgaatcttggaagcagg

SEQ ID NO: 8375151 - DNA, 22 bp, Homo sapiens
ccacagtgattcacttttgaag

SEQ ID NO: 8375152 - DNA, 22 bp, Homo sapiens
ccacagtgatccctgcctgcga

SEQ ID NO: 8375153 - DNA, 22 bp, Homo sapiens
ccacatttggagaagatacttt

SEQ ID NO: 8375154 - DNA, 22 bp, Homo sapiens
ccacatttcttcacttgtccca

SEQ ID NO: 8375155 - DNA, 22 bp, Homo sapiens
ccacatttactggatgctcagg

SEQ ID NO: 8375156 - DNA, 22 bp, Homo sapiens
ccacatttactggatgctcagg

SEQ ID NO: 8375157 - DNA, 22 bp, Homo sapiens
ccacatttactgatgtatgtat

SEQ ID NO: 8375158 - DNA, 22 bp, Homo sapiens
ccacatgtgcactgctgtatgg

SEQ ID NO: 8375159 - DNA, 22 bp, Homo sapiens
tcctctgacaccttgtgcagtg

SEQ ID NO: 8375160 - DNA, 22 bp, Homo sapiens
tcctctgaaatctagattgtga

SEQ ID NO: 8375161 - DNA, 18 bp, Homo sapiens
tcctctctttccccaggg

SEQ ID NO: 8375162 - DNA, 22 bp, Homo sapiens
tcctctccatgtctcacgccac

SEQ ID NO: 8375163 - DNA, 22 bp, Homo sapiens
tttttataggtcagggcaagtc

SEQ ID NO: 8375164 - DNA, 22 bp, Homo sapiens
tttttatactttgctcaagatt

SEQ ID NO: 8375165 - DNA, 22 bp, Homo sapiens
tttttcaagacaacctgcatgt

SEQ ID NO: 8375166 - DNA, 19 bp, Homo sapiens
tttttacaagtaggtgtga

SEQ ID NO: 8375167 - DNA, 22 bp, Homo sapiens
tttttacacttagcattgagcg

SEQ ID NO: 8375168 - DNA, 22 bp, Homo sapiens
tttttagagtgttaccagtata

SEQ ID NO: 8375169 - DNA, 22 bp, Homo sapiens
tttttacagtcatggtcactca

SEQ ID NO: 8375170 - DNA, 22 bp, Homo sapiens
tttttagaattggctgagaatt

SEQ ID NO: 8375171 - DNA, 22 bp, Homo sapiens
tttttataccacctctcactta

SEQ ID NO: 8375172 - DNA, 22 bp, Homo sapiens
tttttataactcttttgtgaca

SEQ ID NO: 8375173 - DNA, 22 bp, Homo sapiens
tttgtaaaaggaggaagcatgg

SEQ ID NO: 8375174 - DNA, 22 bp, Homo sapiens
tttgtaaaaggaggaagcatgg

SEQ ID NO: 8375175 - DNA, 22 bp, Homo sapiens
tttgtaaagtctgttctgagtt

SEQ ID NO: 8375176 - DNA, 22 bp, Homo sapiens
tttgtaaatagcagtactcatg

SEQ ID NO: 8375177 - DNA, 22 bp, Homo sapiens
tttgtaaatagcagtactcatg

SEQ ID NO: 8375178 - DNA, 21 bp, Homo sapiens
tttgtgtgtcacgtgcacagg

SEQ ID NO: 8375179 - DNA, 22 bp, Homo sapiens
tttgtgtggcgttggccggcgg

SEQ ID NO: 8375180 - DNA, 22 bp, Homo sapiens
tttgtgtggatggaaggcagta

SEQ ID NO: 8375181 - DNA, 22 bp, Homo sapiens
tttgttataacaataaaaagtc

SEQ ID NO: 8375182 - DNA, 22 bp, Homo sapiens
tttgttaattcttatgttagag

SEQ ID NO: 8375183 - DNA, 22 bp, Homo sapiens
tttgttaaggagtattgcttct

SEQ ID NO: 8375184 - DNA, 22 bp, Homo sapiens
tttgttaagatgctgttctgct

SEQ ID NO: 8375185 - DNA, 22 bp, Homo sapiens
tttgttaaatatttattgagtg

SEQ ID NO: 8375186 - DNA, 22 bp, Homo sapiens
tttgtgttttagctggtgaggc

SEQ ID NO: 8375187 - DNA, 22 bp, Homo sapiens
tttgtgttttcactagcagtgt

SEQ ID NO: 8375188 - DNA, 22 bp, Homo sapiens
tttgttaaaatgcagattctgt

SEQ ID NO: 8375189 - DNA, 22 bp, Homo sapiens
tttgtgttgttttaagccacta

SEQ ID NO: 8375190 - DNA, 22 bp, Homo sapiens
tttgtgtttaatacaaggacct

SEQ ID NO: 8375191 - DNA, 22 bp, Homo sapiens
tttgtgtttgtacaatgcacta

SEQ ID NO: 8375192 - DNA, 22 bp, Homo sapiens
ttttaacttaaaatacatagat

SEQ ID NO: 8375193 - DNA, 22 bp, Homo sapiens
ttttaacttaaaatacatagat

SEQ ID NO: 8375194 - DNA, 21 bp, Homo sapiens
ttttaacaaggatttccctag

SEQ ID NO: 8375195 - DNA, 22 bp, Homo sapiens
ttttaacactcagcactatctc

SEQ ID NO: 8375196 - DNA, 22 bp, Homo sapiens
ttttaaaggctgtatgaccaag

SEQ ID NO: 8375197 - DNA, 22 bp, Homo sapiens
ttttaaaggctgtatgaccaag

SEQ ID NO: 8375198 - DNA, 22 bp, Homo sapiens
ttttaaaggcagattatggctt

SEQ ID NO: 8375199 - DNA, 22 bp, Homo sapiens
ttttaaaggatactcttgtcta

SEQ ID NO: 8375200 - DNA, 22 bp, Homo sapiens
ttttaaagagatgctgtgcata

SEQ ID NO: 8375201 - DNA, 22 bp, Homo sapiens
ttttaatgggcgactattatgg

SEQ ID NO: 8375202 - DNA, 22 bp, Homo sapiens
ttttaagaaatgtatgactgtc

SEQ ID NO: 8375203 - DNA, 22 bp, Homo sapiens
ttttaatactgctattgtagga

SEQ ID NO: 8375204 - DNA, 23 bp, Homo sapiens
ttttaatttggacataagaagat

SEQ ID NO: 8375205 - DNA, 22 bp, Homo sapiens
ttttaattgcaattatggtccc

SEQ ID NO: 8375206 - DNA, 22 bp, Homo sapiens
ttttatgtaatccttactgtcg

SEQ ID NO: 8375207 - DNA, 20 bp, Homo sapiens
ttttatgtcaccttcctgtc

SEQ ID NO: 8375208 - DNA, 22 bp, Homo sapiens
ttttatgtaatccttactgtcg

SEQ ID NO: 8375209 - DNA, 22 bp, Homo sapiens
ttttcagtttgcactgcagtgc

SEQ ID NO: 8375210 - DNA, 22 bp, Homo sapiens
ttttcacacaaggtgataagtt

SEQ ID NO: 8375211 - DNA, 22 bp, Homo sapiens
ttttcattgtaaatcaggaaac

SEQ ID NO: 8375212 - DNA, 22 bp, Homo sapiens
ttttcattgagcacctgagtaa

SEQ ID NO: 8375213 - DNA, 22 bp, Homo sapiens
ttttcattgttactatgagcta

SEQ ID NO: 8375214 - DNA, 22 bp, Homo sapiens
ttttattagtggctagatgggg

SEQ ID NO: 8375215 - DNA, 22 bp, Homo sapiens
ttttatgttcctgaagctatct

SEQ ID NO: 8375216 - DNA, 22 bp, Homo sapiens
ttttatgttcctgaagctatct

SEQ ID NO: 8375217 - DNA, 22 bp, Homo sapiens
ttttatgttcctgaagctatct

SEQ ID NO: 8375218 - DNA, 22 bp, Homo sapiens
ttttattagtggctagatgggg

SEQ ID NO: 8375219 - DNA, 22 bp, Homo sapiens
ttttatgtgtgaaatgctgtct

SEQ ID NO: 8375220 - DNA, 22 bp, Homo sapiens
ttttatgttcctctttatgcga

SEQ ID NO: 8375221 - DNA, 22 bp, Homo sapiens
ttttatgttcctgaagctatct

SEQ ID NO: 8375222 - DNA, 22 bp, Homo sapiens
ttttatgttcctctttatgcga

SEQ ID NO: 8375223 - DNA, 22 bp, Homo sapiens
ttttattatctttgaatgggac

SEQ ID NO: 8375224 - DNA, 22 bp, Homo sapiens
ttttattggagtgataccaagc

SEQ ID NO: 8375225 - DNA, 22 bp, Homo sapiens
ttttctgacctatctacattta

SEQ ID NO: 8375226 - DNA, 22 bp, Homo sapiens
ttttctgaagtttaagacattt

SEQ ID NO: 8375227 - DNA, 22 bp, Homo sapiens
ttttctcttgttaatgtactga

SEQ ID NO: 8375228 - DNA, 22 bp, Homo sapiens
ttttctcttgttaatgtactga

SEQ ID NO: 8375229 - DNA, 22 bp, Homo sapiens
ttttctattcattgtctatggt

SEQ ID NO: 8375230 - DNA, 22 bp, Homo sapiens
ttttctcagctgcactgtatta

SEQ ID NO: 8375231 - DNA, 19 bp, Homo sapiens
ttttctcagcttctagcgg

SEQ ID NO: 8375232 - DNA, 22 bp, Homo sapiens
ttttcatttacattagggaaga

SEQ ID NO: 8375233 - DNA, 22 bp, Homo sapiens
ttttcatttacattagggaaga

SEQ ID NO: 8375234 - DNA, 22 bp, Homo sapiens
ttttcattgttcctcgagcatt

SEQ ID NO: 8375235 - DNA, 22 bp, Homo sapiens
ttttccaaagtaccatgtccct

SEQ ID NO: 8375236 - DNA, 22 bp, Homo sapiens
ttttccaaattagaagtagaga

SEQ ID NO: 8375237 - DNA, 22 bp, Homo sapiens
ttttcttatgtgcagctatatg

SEQ ID NO: 8375238 - DNA, 22 bp, Homo sapiens
ttttcttatggtgaagcacaaa

SEQ ID NO: 8375239 - DNA, 22 bp, Homo sapiens
ttttcttatggtgaagcacaaa

SEQ ID NO: 8375240 - DNA, 22 bp, Homo sapiens
ttttcttatagagcttaaagtt

SEQ ID NO: 8375241 - DNA, 22 bp, Homo sapiens
ttttcttaggtgctccaagtag

SEQ ID NO: 8375242 - DNA, 22 bp, Homo sapiens
ttttcttactgtctgtgatcct

SEQ ID NO: 8375243 - DNA, 22 bp, Homo sapiens
ttttcttactgtctgtgatcct

SEQ ID NO: 8375244 - DNA, 22 bp, Homo sapiens
ttttcttactgtctgtgatcct

SEQ ID NO: 8375245 - DNA, 22 bp, Homo sapiens
ttttctgagctcagtgacttac

SEQ ID NO: 8375246 - DNA, 22 bp, Homo sapiens
ttttctgactctattgaggtat

SEQ ID NO: 8375247 - DNA, 22 bp, Homo sapiens
ttttctgacctatctacattta

SEQ ID NO: 8375248 - DNA, 22 bp, Homo sapiens
tttgataatacacaagagaaag

SEQ ID NO: 8375249 - DNA, 22 bp, Homo sapiens
tttgataatacacaagagaaag

SEQ ID NO: 8375250 - DNA, 22 bp, Homo sapiens
tttgataacagtgaatatcatg

SEQ ID NO: 8375251 - DNA, 22 bp, Homo sapiens
tttgaggttagctagcagatca

SEQ ID NO: 8375252 - DNA, 18 bp, Homo sapiens
tttgaggaaatgtcctga

SEQ ID NO: 8375253 - DNA, 22 bp, Homo sapiens
tttgaggacattttagaaagtt

SEQ ID NO: 8375254 - DNA, 22 bp, Homo sapiens
tttgacagatccttaactcagc

SEQ ID NO: 8375255 - DNA, 19 bp, Homo sapiens
tttgatatctgaattatgc

SEQ ID NO: 8375256 - DNA, 22 bp, Homo sapiens
tttgatatgcaaaattatggac

SEQ ID NO: 8375257 - DNA, 22 bp, Homo sapiens
tttgatactttgtgcaatttct

SEQ ID NO: 8375258 - DNA, 22 bp, Homo sapiens
tttgatatcctatacaagtaaa

SEQ ID NO: 8375259 - DNA, 22 bp, Homo sapiens
tttgatttactataagcagcac

SEQ ID NO: 8375260 - DNA, 22 bp, Homo sapiens
tttgctttctgttgaacagagt

SEQ ID NO: 8375261 - DNA, 22 bp, Homo sapiens
tttgctttctgttgaacagagt

SEQ ID NO: 8375262 - DNA, 18 bp, Homo sapiens
tttgctttccttcttcag

SEQ ID NO: 8375263 - DNA, 22 bp, Homo sapiens
tttgctttcccttgtagaaagt

SEQ ID NO: 8375264 - DNA, 22 bp, Homo sapiens
tttgctttcccttgtagaaagt

SEQ ID NO: 8375265 - DNA, 22 bp, Homo sapiens
tttgctttcttgattcagatta

SEQ ID NO: 8375266 - DNA, 22 bp, Homo sapiens
tttgctttcttgattcagatta

SEQ ID NO: 8375267 - DNA, 22 bp, Homo sapiens
tttgctttgactgtcagcaagt

SEQ ID NO: 8375268 - DNA, 22 bp, Homo sapiens
tttgctttgactgtcagcaagt

SEQ ID NO: 8375269 - DNA, 22 bp, Homo sapiens
tttgctttgactgtcagcaagt

SEQ ID NO: 8375270 - DNA, 22 bp, Homo sapiens
tttgctttgggaggttgtctgg

SEQ ID NO: 8375271 - DNA, 22 bp, Homo sapiens
tttgctttgggaggttgtctgg

SEQ ID NO: 8375272 - DNA, 22 bp, Homo sapiens
tttggaaagtgtacaaatttga

SEQ ID NO: 8375273 - DNA, 17 bp, Homo sapiens
tttggaaagtgatcatt

SEQ ID NO: 8375274 - DNA, 22 bp, Homo sapiens
tttggaaaggtttggccattat

SEQ ID NO: 8375275 - DNA, 22 bp, Homo sapiens
tttggaaagtgtgatttcaagg

SEQ ID NO: 8375276 - DNA, 22 bp, Homo sapiens
tttggaaagttgtcactttaga

SEQ ID NO: 8375277 - DNA, 22 bp, Homo sapiens
tttggaaatgagaagccacctt

SEQ ID NO: 8375278 - DNA, 22 bp, Homo sapiens
tttggaaattactcattgtcct

SEQ ID NO: 8375279 - DNA, 22 bp, Homo sapiens
tttggaaatttcatcaatagcc

SEQ ID NO: 8375280 - DNA, 22 bp, Homo sapiens
tttggaaattttcatccagaca

SEQ ID NO: 8375281 - DNA, 22 bp, Homo sapiens
tttggaaataattccatctcat

SEQ ID NO: 8375282 - DNA, 22 bp, Homo sapiens
tttggaaatacgcgtaggcaga

SEQ ID NO: 8375283 - DNA, 22 bp, Homo sapiens
tttggaaatgaccccgtctaag

SEQ ID NO: 8375284 - DNA, 22 bp, Homo sapiens
tttgcttttgtgctctagtggt

SEQ ID NO: 8375285 - DNA, 22 bp, Homo sapiens
tttgctttgtttaaaagtggta

SEQ ID NO: 8375286 - DNA, 22 bp, Homo sapiens
tttggaaaatattgaactggtt

SEQ ID NO: 8375287 - DNA, 22 bp, Homo sapiens
tttggaaaaagacagcttatga

SEQ ID NO: 8375288 - DNA, 22 bp, Homo sapiens
tttggaaaaagcctgaacatag

SEQ ID NO: 8375289 - DNA, 22 bp, Homo sapiens
tttggaaaaagcctgaacatag

SEQ ID NO: 8375290 - DNA, 22 bp, Homo sapiens
tttggaaactgatggtacattc

SEQ ID NO: 8375291 - DNA, 22 bp, Homo sapiens
tttggaaactgatggtacattc

SEQ ID NO: 8375292 - DNA, 22 bp, Homo sapiens
tttggaaagacacacagtttta

SEQ ID NO: 8375293 - DNA, 22 bp, Homo sapiens
tttggaaactgcctcagctctt

SEQ ID NO: 8375294 - DNA, 22 bp, Homo sapiens
tttggaaacacggtcatcttcc

SEQ ID NO: 8375295 - DNA, 22 bp, Homo sapiens
tttggaaaattttctaagtctg

SEQ ID NO: 8375296 - DNA, 22 bp, Homo sapiens
tttggaaacatctcagaaaata

SEQ ID NO: 8375297 - DNA, 22 bp, Homo sapiens
tttgtaaaagcccaagctgtag

SEQ ID NO: 8375298 - DNA, 22 bp, Homo sapiens
tttggtttgcctgagtaccctc

SEQ ID NO: 8375299 - DNA, 22 bp, Homo sapiens
tttggtttagggtcatttaaca

SEQ ID NO: 8375300 - DNA, 22 bp, Homo sapiens
tttggttaatttaggcttgcat

SEQ ID NO: 8375301 - DNA, 22 bp, Homo sapiens
tttggtgagctgcgagtgagga

SEQ ID NO: 8375302 - DNA, 22 bp, Homo sapiens
tttggtcaaatattatcctgag

SEQ ID NO: 8375303 - DNA, 22 bp, Homo sapiens
tttggtattgcacactgtcttc

SEQ ID NO: 8375304 - DNA, 22 bp, Homo sapiens
tttggtcagggtaggacagttg

SEQ ID NO: 8375305 - DNA, 22 bp, Homo sapiens
tttcccttctttcctgagtaat

SEQ ID NO: 8375306 - DNA, 22 bp, Homo sapiens
tttccctctgtgccagcttctc

SEQ ID NO: 8375307 - DNA, 22 bp, Homo sapiens
tttccctacttgtaactggaaa

SEQ ID NO: 8375308 - DNA, 17 bp, Homo sapiens
tttccctccttccactc

SEQ ID NO: 8375309 - DNA, 22 bp, Homo sapiens
tttcccttgttccttcctctga

SEQ ID NO: 8375310 - DNA, 22 bp, Homo sapiens
tttccctttgcactctacaatt

SEQ ID NO: 8375311 - DNA, 22 bp, Homo sapiens
tttcctctaaacgcatttgctt

SEQ ID NO: 8375312 - DNA, 22 bp, Homo sapiens
tttcctctgactgctcccctgc

SEQ ID NO: 8375313 - DNA, 22 bp, Homo sapiens
tttcctctgagtgagctgggag

SEQ ID NO: 8375314 - DNA, 22 bp, Homo sapiens
tttcctctccggggcctccagg

SEQ ID NO: 8375315 - DNA, 22 bp, Homo sapiens
tttcctctccggggcctccagg

SEQ ID NO: 8375316 - DNA, 22 bp, Homo sapiens
tttcttttacagtgtggctatt

SEQ ID NO: 8375317 - DNA, 22 bp, Homo sapiens
tttcctctgatgctgacttgga

SEQ ID NO: 8375318 - DNA, 21 bp, Homo sapiens
tttctttctggctctcacagt

SEQ ID NO: 8375319 - DNA, 22 bp, Homo sapiens
tttcttttgccctgtgggttag

SEQ ID NO: 8375320 - DNA, 22 bp, Homo sapiens
tttcttttgaatagtgtgtggt

SEQ ID NO: 8375321 - DNA, 22 bp, Homo sapiens
tttgacaagagggcatcttcag

SEQ ID NO: 8375322 - DNA, 22 bp, Homo sapiens
tttgacaagagcaaatgttctt

SEQ ID NO: 8375323 - DNA, 22 bp, Homo sapiens
tttgacaacagcaaatgtcaca

SEQ ID NO: 8375324 - DNA, 22 bp, Homo sapiens
tttgacaacacgttatttgcct

SEQ ID NO: 8375325 - DNA, 22 bp, Homo sapiens
tttgacaaataggggaataagg

SEQ ID NO: 8375326 - DNA, 22 bp, Homo sapiens
tttgacaaaggaaaaatgcaca

SEQ ID NO: 8375327 - DNA, 22 bp, Homo sapiens
tttgaatgtgtgagttaacttt

SEQ ID NO: 8375328 - DNA, 22 bp, Homo sapiens
tttgaatggactgagaatcttg

SEQ ID NO: 8375329 - DNA, 19 bp, Homo sapiens
tttgaaaggattgttattt

SEQ ID NO: 8375330 - DNA, 17 bp, Homo sapiens
tttgaaaggatgtcagt

SEQ ID NO: 8375331 - DNA, 22 bp, Homo sapiens
tttgaaagggttatgagactga

SEQ ID NO: 8375332 - DNA, 22 bp, Homo sapiens
tttgaaaggaattaggatgaca

SEQ ID NO: 8375333 - DNA, 22 bp, Homo sapiens
tttgaaaggaagttaatacttt

SEQ ID NO: 8375334 - DNA, 22 bp, Homo sapiens
tttgaaaggagctttatccaga

SEQ ID NO: 8375335 - DNA, 21 bp, Homo sapiens
tttgaaagctacatctatagc

SEQ ID NO: 8375336 - DNA, 22 bp, Homo sapiens
tttgaaagcctggcttttctct

SEQ ID NO: 8375337 - DNA, 21 bp, Homo sapiens
tttgaaagctacatctatagc

SEQ ID NO: 8375338 - DNA, 22 bp, Homo sapiens
tttgaaagcaccatttgagtag

SEQ ID NO: 8375339 - DNA, 21 bp, Homo sapiens
tttgaaagccctatgttttca

SEQ ID NO: 8375340 - DNA, 22 bp, Homo sapiens
tttgaagactactgggagtgaa

SEQ ID NO: 8375341 - DNA, 22 bp, Homo sapiens
tttgaagagccacagtgaaatt

SEQ ID NO: 8375342 - DNA, 22 bp, Homo sapiens
tttgaatatgtgcttgttaaat

SEQ ID NO: 8375343 - DNA, 22 bp, Homo sapiens
tttgaatatacttcaaacaaag

SEQ ID NO: 8375344 - DNA, 19 bp, Homo sapiens
tttagaagttgaaactctg

SEQ ID NO: 8375345 - DNA, 22 bp, Homo sapiens
tttagaagttcacacatttaaa

SEQ ID NO: 8375346 - DNA, 22 bp, Homo sapiens
tttagaagttcacacatttaaa

SEQ ID NO: 8375347 - DNA, 20 bp, Homo sapiens
tttagaagaatgagcacttt

SEQ ID NO: 8375348 - DNA, 22 bp, Homo sapiens
tttaccaaggcatagtaatctc

SEQ ID NO: 8375349 - DNA, 22 bp, Homo sapiens
tttaccaaggcatagtaatctc

SEQ ID NO: 8375350 - DNA, 22 bp, Homo sapiens
tttaccaagctttaattacata

SEQ ID NO: 8375351 - DNA, 22 bp, Homo sapiens
tttaccaaagtactctgaggca

SEQ ID NO: 8375352 - DNA, 22 bp, Homo sapiens
tttacagtctgtctagcaatgt

SEQ ID NO: 8375353 - DNA, 22 bp, Homo sapiens
tttagagaccctctgctatttt

SEQ ID NO: 8375354 - DNA, 22 bp, Homo sapiens
tttagagagaattttcaaagtg

SEQ ID NO: 8375355 - DNA, 22 bp, Homo sapiens
tttagagagaaataaatgagat

SEQ ID NO: 8375356 - DNA, 22 bp, Homo sapiens
tttagagaggctctgtaaaatg

SEQ ID NO: 8375357 - DNA, 22 bp, Homo sapiens
tttagagagtgtaaaaatatat

SEQ ID NO: 8375358 - DNA, 22 bp, Homo sapiens
tttagcagtgaagtgaagtgaa

SEQ ID NO: 8375359 - DNA, 22 bp, Homo sapiens
tttagcatccaaggttatgact

SEQ ID NO: 8375360 - DNA, 22 bp, Homo sapiens
tttagcatatcctataaaacta

SEQ ID NO: 8375361 - DNA, 16 bp, Homo sapiens
tttagcactggcatac

SEQ ID NO: 8375362 - DNA, 22 bp, Homo sapiens
tttagcactgaaagtccaggaa

SEQ ID NO: 8375363 - DNA, 22 bp, Homo sapiens
tttagcaccttcactttctctg

SEQ ID NO: 8375364 - DNA, 20 bp, Homo sapiens
tttagcacattgtacaaaac

SEQ ID NO: 8375365 - DNA, 22 bp, Homo sapiens
tttagcactaatcagctgtggc

SEQ ID NO: 8375366 - DNA, 23 bp, Homo sapiens
tttagcacgtcgcccagggaggc

SEQ ID NO: 8375367 - DNA, 22 bp, Homo sapiens
tttagcacggtaacacataaag

SEQ ID NO: 8375368 - DNA, 22 bp, Homo sapiens
tttagcacagaactccactcac

SEQ ID NO: 8375369 - DNA, 23 bp, Homo sapiens
tttatattcctaatgtcttgagc

SEQ ID NO: 8375370 - DNA, 22 bp, Homo sapiens
tttatattgtaaaaatggttct

SEQ ID NO: 8375371 - DNA, 22 bp, Homo sapiens
tttatctgaggaaagcagacaa

SEQ ID NO: 8375372 - DNA, 22 bp, Homo sapiens
tttatctgagctgatagatagt

SEQ ID NO: 8375373 - DNA, 22 bp, Homo sapiens
tttatccatcatctgctgaagg

SEQ ID NO: 8375374 - DNA, 22 bp, Homo sapiens
tttatctattgtattgttgatg

SEQ ID NO: 8375375 - DNA, 22 bp, Homo sapiens
tttatcatcttgtttttaaagc

SEQ ID NO: 8375376 - DNA, 22 bp, Homo sapiens
tttatcatcttgtttttaaagc

SEQ ID NO: 8375377 - DNA, 22 bp, Homo sapiens
tttatcatcttgtttttaaagc

SEQ ID NO: 8375378 - DNA, 22 bp, Homo sapiens
tttatcaaacaaattatccagc

SEQ ID NO: 8375379 - DNA, 22 bp, Homo sapiens
tttatcacagaataagaagtca

SEQ ID NO: 8375380 - DNA, 22 bp, Homo sapiens
tttatcagaagttagagaaaga

SEQ ID NO: 8375381 - DNA, 22 bp, Homo sapiens
tttaagcacagggataaagtta

SEQ ID NO: 8375382 - DNA, 22 bp, Homo sapiens
tttaagcacagggataaagtta

SEQ ID NO: 8375383 - DNA, 22 bp, Homo sapiens
tttaagcagagaaatgatgtat

SEQ ID NO: 8375384 - DNA, 22 bp, Homo sapiens
tttaagcagagaaatgatgtat

SEQ ID NO: 8375385 - DNA, 19 bp, Homo sapiens
tttaagcaatagtatcttg

SEQ ID NO: 8375386 - DNA, 22 bp, Homo sapiens
tttaagcacagggataaagtta

SEQ ID NO: 8375387 - DNA, 22 bp, Homo sapiens
tttaagcacagggataaagtta

SEQ ID NO: 8375388 - DNA, 22 bp, Homo sapiens
tttaagatggtattttataaag

SEQ ID NO: 8375389 - DNA, 22 bp, Homo sapiens
tttaagattcagtaaggcaaac

SEQ ID NO: 8375390 - DNA, 22 bp, Homo sapiens
tttaatcttcaaaatagtctta

SEQ ID NO: 8375391 - DNA, 22 bp, Homo sapiens
tttaatctattccctaaacacc

SEQ ID NO: 8375392 - DNA, 22 bp, Homo sapiens
tttaaggatgtaaaggaagaag

SEQ ID NO: 8375393 - DNA, 22 bp, Homo sapiens
tttaaggcaatatagaattcat

SEQ ID NO: 8375394 - DNA, 22 bp, Homo sapiens
tttaaggcagtgaaactattct

SEQ ID NO: 8375395 - DNA, 22 bp, Homo sapiens
tttaaggtacagctagcagcat

SEQ ID NO: 8375396 - DNA, 22 bp, Homo sapiens
tttaatgatagctgtttcacat

SEQ ID NO: 8375397 - DNA, 22 bp, Homo sapiens
tttaatgatagtcttacgaaaa

SEQ ID NO: 8375398 - DNA, 22 bp, Homo sapiens
tttaaataggactcctgggggt

SEQ ID NO: 8375399 - DNA, 22 bp, Homo sapiens
tttaagatggtattttataaag

SEQ ID NO: 8375400 - DNA, 22 bp, Homo sapiens
tttaagatctatcccattttgt

SEQ ID NO: 8375401 - DNA, 17 bp, Homo sapiens
tttaaactactacaagg

SEQ ID NO: 8375402 - DNA, 22 bp, Homo sapiens
tttaaagagaatgtgaaggagt

SEQ ID NO: 8375403 - DNA, 22 bp, Homo sapiens
tttaaagaaattcctcatcttt

SEQ ID NO: 8375404 - DNA, 22 bp, Homo sapiens
tttattctataggcattaagca

SEQ ID NO: 8375405 - DNA, 22 bp, Homo sapiens
tttattctataggcattaagca

SEQ ID NO: 8375406 - DNA, 22 bp, Homo sapiens
tttattctagctcagaatagtt

SEQ ID NO: 8375407 - DNA, 22 bp, Homo sapiens
tttattctgtgctacatgaaga

SEQ ID NO: 8375408 - DNA, 23 bp, Homo sapiens
tttattctcagatacataggtct

SEQ ID NO: 8375409 - DNA, 22 bp, Homo sapiens
tttattcttgagagtgagaaga

SEQ ID NO: 8375410 - DNA, 22 bp, Homo sapiens
tttattgaacacttgcactggc

SEQ ID NO: 8375411 - DNA, 22 bp, Homo sapiens
tttcaaaggttttgtcatgtct

SEQ ID NO: 8375412 - DNA, 22 bp, Homo sapiens
tttcaaaggtggaagagtgaat

SEQ ID NO: 8375413 - DNA, 22 bp, Homo sapiens
tttcaacagaatatgatcagag

SEQ ID NO: 8375414 - DNA, 22 bp, Homo sapiens
tttcaacaccagagaccatgcg

SEQ ID NO: 8375415 - DNA, 23 bp, Homo sapiens
tttcaacaatgcttagagaaaac

SEQ ID NO: 8375416 - DNA, 22 bp, Homo sapiens
tttattgagtatctactatgtg

SEQ ID NO: 8375417 - DNA, 20 bp, Homo sapiens
tttattgagcacgtactgtg

SEQ ID NO: 8375418 - DNA, 22 bp, Homo sapiens
tttcaaagggaagttatgaagt

SEQ ID NO: 8375419 - DNA, 22 bp, Homo sapiens
tttattgacttcagtgagtctt

SEQ ID NO: 8375420 - DNA, 22 bp, Homo sapiens
tttattgacttcagtgagtctt

SEQ ID NO: 8375421 - DNA, 22 bp, Homo sapiens
tttattgagcacccgttgtgcg

SEQ ID NO: 8375422 - DNA, 22 bp, Homo sapiens
tttattgacccaaagcgagagt

SEQ ID NO: 8375423 - DNA, 22 bp, Homo sapiens
tttcacagatcctacagcttgt

SEQ ID NO: 8375424 - DNA, 22 bp, Homo sapiens
tttcacagaaagaagctagttt

SEQ ID NO: 8375425 - DNA, 20 bp, Homo sapiens
tttcacaatgaacatgtctc

SEQ ID NO: 8375426 - DNA, 23 bp, Homo sapiens
tttcacaatgagcattacagaat

SEQ ID NO: 8375427 - DNA, 22 bp, Homo sapiens
tttcacacaacgtgaatatact

SEQ ID NO: 8375428 - DNA, 22 bp, Homo sapiens
tttcacaattttaaggagcaaa

SEQ ID NO: 8375429 - DNA, 22 bp, Homo sapiens
tttcacaatgcaatcctacttc

SEQ ID NO: 8375430 - DNA, 22 bp, Homo sapiens
tttcaacatataccataatgcc

SEQ ID NO: 8375431 - DNA, 17 bp, Homo sapiens
tttcaacatcactcagc

SEQ ID NO: 8375432 - DNA, 22 bp, Homo sapiens
tttcaacagctctcaaatgatc

SEQ ID NO: 8375433 - DNA, 22 bp, Homo sapiens
tttcaacagctctcaaatgatc

SEQ ID NO: 8375434 - DNA, 23 bp, Homo sapiens
tttcaacaggcagagaagactta

SEQ ID NO: 8375435 - DNA, 22 bp, Homo sapiens
tttcaacttgaagaattgatac

SEQ ID NO: 8375436 - DNA, 23 bp, Homo sapiens
tttcaactcctgccattatttct

SEQ ID NO: 8375437 - DNA, 22 bp, Homo sapiens
tttcaactagcccctaagtcct

SEQ ID NO: 8375438 - DNA, 22 bp, Homo sapiens
tttcaactcatgctaaaggaag

SEQ ID NO: 8375439 - DNA, 22 bp, Homo sapiens
tttcatgtctgaattctttagt

SEQ ID NO: 8375440 - DNA, 22 bp, Homo sapiens
tttcatgtctgaattctttagt

SEQ ID NO: 8375441 - DNA, 22 bp, Homo sapiens
tttcatgtgcaattagcaatat

SEQ ID NO: 8375442 - DNA, 22 bp, Homo sapiens
tttcatgtggcgatgtctctgg

SEQ ID NO: 8375443 - DNA, 22 bp, Homo sapiens
tttcatgttacagtgtaaaagt

SEQ ID NO: 8375444 - DNA, 22 bp, Homo sapiens
tttcatgtgttgaatgtgtaca

SEQ ID NO: 8375445 - DNA, 22 bp, Homo sapiens
tttcatgtgttgaatgtgtaca

SEQ ID NO: 8375446 - DNA, 22 bp, Homo sapiens
tttcatgcctggaattgccctt

SEQ ID NO: 8375447 - DNA, 22 bp, Homo sapiens
tttcatgaggggcaaaatctca

SEQ ID NO: 8375448 - DNA, 22 bp, Homo sapiens
tttcccattctaattactcatt

SEQ ID NO: 8375449 - DNA, 19 bp, Homo sapiens
tttcccagtcccaggagtg

SEQ ID NO: 8375450 - DNA, 22 bp, Homo sapiens
tttcccagttagtgaagacatg

SEQ ID NO: 8375451 - DNA, 22 bp, Homo sapiens
tttcccagcctcctttgcagct

SEQ ID NO: 8375452 - DNA, 22 bp, Homo sapiens
tttcccagcctcagctcagcag

SEQ ID NO: 8375453 - DNA, 21 bp, Homo sapiens
tttcccagcagagatagctgg

SEQ ID NO: 8375454 - DNA, 22 bp, Homo sapiens
tttcactgttaggagtatgcta

SEQ ID NO: 8375455 - DNA, 22 bp, Homo sapiens
tttcacattttatacttaagcc

SEQ ID NO: 8375456 - DNA, 22 bp, Homo sapiens
tttcacatttgttttaagaagt

SEQ ID NO: 8375457 - DNA, 22 bp, Homo sapiens
tttcacagcagtgtgctgcttt

SEQ ID NO: 8375458 - DNA, 22 bp, Homo sapiens
tttcacagctgggtggcagagt

SEQ ID NO: 8375459 - DNA, 22 bp, Homo sapiens
tttcagaaagctgaacatatga

SEQ ID NO: 8375460 - DNA, 22 bp, Homo sapiens
tttcagaaatcaaaaccagggt

SEQ ID NO: 8375461 - DNA, 22 bp, Homo sapiens
tttcagaaatggcactgaaatc

SEQ ID NO: 8375462 - DNA, 22 bp, Homo sapiens
tttcagaaatggcactgaaatc

SEQ ID NO: 8375463 - DNA, 22 bp, Homo sapiens
tttcagaaagcatcatcaaagt

SEQ ID NO: 8375464 - DNA, 22 bp, Homo sapiens
tttcagaaagcatcatcaaagt

SEQ ID NO: 8375465 - DNA, 22 bp, Homo sapiens
tttcagaaagcatcatcaaagt

SEQ ID NO: 8375466 - DNA, 22 bp, Homo sapiens
tttcagactccaaattcataag

SEQ ID NO: 8375467 - DNA, 22 bp, Homo sapiens
tttcagagaaagcccaaagact

SEQ ID NO: 8375468 - DNA, 22 bp, Homo sapiens
tttcagagaaagcccaaagact

SEQ ID NO: 8375469 - DNA, 19 bp, Homo sapiens
tttcagacatttcaaattt

SEQ ID NO: 8375470 - DNA, 22 bp, Homo sapiens
tttcagagagatcaacatagct

SEQ ID NO: 8375471 - DNA, 22 bp, Homo sapiens
tttcagagaattagaagctgat

SEQ ID NO: 8375472 - DNA, 22 bp, Homo sapiens
tttcagagaactgagtccttgc

SEQ ID NO: 8375473 - DNA, 22 bp, Homo sapiens
tttcagagatgtctagcctatt

SEQ ID NO: 8375474 - DNA, 22 bp, Homo sapiens
tttcagagcctttatctctcta

SEQ ID NO: 8375475 - DNA, 22 bp, Homo sapiens
ttgcagaattaagcagagagcc

SEQ ID NO: 8375476 - DNA, 22 bp, Homo sapiens
ttgcagaatctcaggaaggaga

SEQ ID NO: 8375477 - DNA, 22 bp, Homo sapiens
ttgcagaagcctgttgttcctg

SEQ ID NO: 8375478 - DNA, 22 bp, Homo sapiens
ttgcagaagggcacagtgatca

SEQ ID NO: 8375479 - DNA, 22 bp, Homo sapiens
ttgcagaatacttattctgtat

SEQ ID NO: 8375480 - DNA, 22 bp, Homo sapiens
ttgcacaaaaaattgttgaata

SEQ ID NO: 8375481 - DNA, 22 bp, Homo sapiens
ttgcaattgctatggagagcgt

SEQ ID NO: 8375482 - DNA, 22 bp, Homo sapiens
ttgacagagctaggtcaactct

SEQ ID NO: 8375483 - DNA, 22 bp, Homo sapiens
ttgacagagctaggtcaactct

SEQ ID NO: 8375484 - DNA, 22 bp, Homo sapiens
ttgacaaatacccattagacca

SEQ ID NO: 8375485 - DNA, 22 bp, Homo sapiens
ttgacaaagtttagtaataatc

SEQ ID NO: 8375486 - DNA, 23 bp, Homo sapiens
ttgaatttctcttgcaatattta

SEQ ID NO: 8375487 - DNA, 22 bp, Homo sapiens
ttgacaaaaacctcatttcacc

SEQ ID NO: 8375488 - DNA, 22 bp, Homo sapiens
ttgacaaagatatattcatgct

SEQ ID NO: 8375489 - DNA, 22 bp, Homo sapiens
ttgacaaagatatattcatgct

SEQ ID NO: 8375490 - DNA, 22 bp, Homo sapiens
ttgacaaaggaattgaatctct

SEQ ID NO: 8375491 - DNA, 22 bp, Homo sapiens
ttgacaaaggaattgaatctct

SEQ ID NO: 8375492 - DNA, 22 bp, Homo sapiens
ttgcagctgttactgatagata

SEQ ID NO: 8375493 - DNA, 22 bp, Homo sapiens
ttgcagctgtgagctttacacg

SEQ ID NO: 8375494 - DNA, 22 bp, Homo sapiens
ttgcagctgtgagctttacacg

SEQ ID NO: 8375495 - DNA, 22 bp, Homo sapiens
ttgcagctggtggtggccgtgt

SEQ ID NO: 8375496 - DNA, 22 bp, Homo sapiens
ttgcagctgcagtaaatgttca

SEQ ID NO: 8375497 - DNA, 22 bp, Homo sapiens
ttgcagctgctgttcctcatgg

SEQ ID NO: 8375498 - DNA, 22 bp, Homo sapiens
ttgcagctgctgttcctcatgg

SEQ ID NO: 8375499 - DNA, 22 bp, Homo sapiens
ttgcagctgttgcaaagtctct

SEQ ID NO: 8375500 - DNA, 22 bp, Homo sapiens
ttgcagcttagtgatgttatct

SEQ ID NO: 8375501 - DNA, 22 bp, Homo sapiens
ttgcagcttcaagcaggttgac

SEQ ID NO: 8375502 - DNA, 22 bp, Homo sapiens
ttgcagcttcgagtctatctgt

SEQ ID NO: 8375503 - DNA, 22 bp, Homo sapiens
ttgcagattaaaacactgagct

SEQ ID NO: 8375504 - DNA, 22 bp, Homo sapiens
ttgcagcatattgatctcctgt

SEQ ID NO: 8375505 - DNA, 22 bp, Homo sapiens
ttgcagctagaagattcactgt

SEQ ID NO: 8375506 - DNA, 22 bp, Homo sapiens
ttgcagctagaagattcactgt

SEQ ID NO: 8375507 - DNA, 22 bp, Homo sapiens
ttgcagctctgatccagggacc

SEQ ID NO: 8375508 - DNA, 22 bp, Homo sapiens
ttgcagctccattttaatggct

SEQ ID NO: 8375509 - DNA, 22 bp, Homo sapiens
ttgcagctctctgaaggttgca

SEQ ID NO: 8375510 - DNA, 22 bp, Homo sapiens
ttgcagctgaggaaattgaagc

SEQ ID NO: 8375511 - DNA, 22 bp, Homo sapiens
ttgcagcttcgagtctatctgt

SEQ ID NO: 8375512 - DNA, 22 bp, Homo sapiens
ttgcagcttctaacagcttcag

SEQ ID NO: 8375513 - DNA, 22 bp, Homo sapiens
ttgcagcttctaacagcttcag

SEQ ID NO: 8375514 - DNA, 22 bp, Homo sapiens
ttgcagcttctaccactgtttc

SEQ ID NO: 8375515 - DNA, 22 bp, Homo sapiens
ttgcagcttcttgcatcagaaa

SEQ ID NO: 8375516 - DNA, 22 bp, Homo sapiens
ttgcaggttttgccattagaag

SEQ ID NO: 8375517 - DNA, 22 bp, Homo sapiens
ttgcaggttgaatcagcagact

SEQ ID NO: 8375518 - DNA, 23 bp, Homo sapiens
ttgcatggagcctgggattcctc

SEQ ID NO: 8375519 - DNA, 22 bp, Homo sapiens
ttgcatggaggaacatggccca

SEQ ID NO: 8375520 - DNA, 22 bp, Homo sapiens
ttgcaggtgaaatgggcctggc

SEQ ID NO: 8375521 - DNA, 22 bp, Homo sapiens
ttgcaggtgagggaaatgactg

SEQ ID NO: 8375522 - DNA, 22 bp, Homo sapiens
ttgcaggtggtttggccataga

SEQ ID NO: 8375523 - DNA, 22 bp, Homo sapiens
ttgcaggttagagacctgtgga

SEQ ID NO: 8375524 - DNA, 22 bp, Homo sapiens
ttgcaggttcaagaaactgatt

SEQ ID NO: 8375525 - DNA, 18 bp, Homo sapiens
ttgcaggtacctctatct

SEQ ID NO: 8375526 - DNA, 22 bp, Homo sapiens
ttgcaggtatatttacttttcc

SEQ ID NO: 8375527 - DNA, 22 bp, Homo sapiens
ttgcaggtccggaacctcgccg

SEQ ID NO: 8375528 - DNA, 22 bp, Homo sapiens
ttgcaggtctccatgagtgcga

SEQ ID NO: 8375529 - DNA, 22 bp, Homo sapiens
ttgcaggtctgggggtcctggt

SEQ ID NO: 8375530 - DNA, 18 bp, Homo sapiens
ttgctcttctatgtcaat

SEQ ID NO: 8375531 - DNA, 22 bp, Homo sapiens
ttgctctgtcagggcctcagtc

SEQ ID NO: 8375532 - DNA, 22 bp, Homo sapiens
ttgctctgattaggtggaaaca

SEQ ID NO: 8375533 - DNA, 22 bp, Homo sapiens
ttgctccaggctgcagactctg

SEQ ID NO: 8375534 - DNA, 22 bp, Homo sapiens
ttgctctatgtttgtaaacaga

SEQ ID NO: 8375535 - DNA, 22 bp, Homo sapiens
ttgctgaaaggtagctgtgtgg

SEQ ID NO: 8375536 - DNA, 22 bp, Homo sapiens
ttgctgaaaacaggtcatcagg

SEQ ID NO: 8375537 - DNA, 22 bp, Homo sapiens
ttggaattgaggatttacatag

SEQ ID NO: 8375538 - DNA, 22 bp, Homo sapiens
ttggaatttagtaaaataatgc

SEQ ID NO: 8375539 - DNA, 22 bp, Homo sapiens
ttggacagaatttatcttcagt

SEQ ID NO: 8375540 - DNA, 22 bp, Homo sapiens
ttggacagaatttatcttcagt

SEQ ID NO: 8375541 - DNA, 22 bp, Homo sapiens
ttggaattttccaggtacagtg

SEQ ID NO: 8375542 - DNA, 22 bp, Homo sapiens
ttggaatttgagaccaagaaaa

SEQ ID NO: 8375543 - DNA, 22 bp, Homo sapiens
ttggaatttgcttcagctaata

SEQ ID NO: 8375544 - DNA, 22 bp, Homo sapiens
ttggaaatgatttctattatta

SEQ ID NO: 8375545 - DNA, 22 bp, Homo sapiens
ttggaaatgcaaatatattgaa

SEQ ID NO: 8375546 - DNA, 22 bp, Homo sapiens
ttggaaatacgagtagtatcat

SEQ ID NO: 8375547 - DNA, 23 bp, Homo sapiens
ttggaaatggggagaacagattc

SEQ ID NO: 8375548 - DNA, 21 bp, Homo sapiens
ttggaacaagcagcagtttgc

SEQ ID NO: 8375549 - DNA, 22 bp, Homo sapiens
ttggaaactttcaagcataatg

SEQ ID NO: 8375550 - DNA, 22 bp, Homo sapiens
ttggaaagaagggctgagcaag

SEQ ID NO: 8375551 - DNA, 22 bp, Homo sapiens
ttggaaagtctcacccagttga

SEQ ID NO: 8375552 - DNA, 22 bp, Homo sapiens
ttgcttcagagggagacacttt

SEQ ID NO: 8375553 - DNA, 22 bp, Homo sapiens
ttgcttatttgattaaatgtct

SEQ ID NO: 8375554 - DNA, 22 bp, Homo sapiens
ttgtaaatagtagtaagatgcc

SEQ ID NO: 8375555 - DNA, 22 bp, Homo sapiens
ttgtaaatagtagtaagatgcc

SEQ ID NO: 8375556 - DNA, 22 bp, Homo sapiens
ttgtaaactgttaaaagccaga

SEQ ID NO: 8375557 - DNA, 22 bp, Homo sapiens
ttgtaagaatatgaatacaaat

SEQ ID NO: 8375558 - DNA, 21 bp, Homo sapiens
ttgtaaatggctttttccttc

SEQ ID NO: 8375559 - DNA, 22 bp, Homo sapiens
ttgtaaatgaccttttctaatt

SEQ ID NO: 8375560 - DNA, 22 bp, Homo sapiens
ttgtaagtcacaccagggcagg

SEQ ID NO: 8375561 - DNA, 22 bp, Homo sapiens
ttgtacaagttttgagcttaag

SEQ ID NO: 8375562 - DNA, 22 bp, Homo sapiens
ttgtacaagtattatgtgaaca

SEQ ID NO: 8375563 - DNA, 22 bp, Homo sapiens
ttgtacaatggatgccagatga

SEQ ID NO: 8375564 - DNA, 22 bp, Homo sapiens
ttgtacattctgaatctgtcct

SEQ ID NO: 8375565 - DNA, 22 bp, Homo sapiens
ttgtattttttcctggcggtgg

SEQ ID NO: 8375566 - DNA, 22 bp, Homo sapiens
ttgtgtctatggtttgagcatc

SEQ ID NO: 8375567 - DNA, 20 bp, Homo sapiens
ttgtgtaggtctaatgcata

SEQ ID NO: 8375568 - DNA, 22 bp, Homo sapiens
ttgtgggatggctcttcccaaa

SEQ ID NO: 8375569 - DNA, 16 bp, Homo sapiens
ttgtggcttttgcaca

SEQ ID NO: 8375570 - DNA, 22 bp, Homo sapiens
ttgtgggatctccctgttgctc

SEQ ID NO: 8375571 - DNA, 22 bp, Homo sapiens
ttgtggctcgtgagatgttagg

SEQ ID NO: 8375572 - DNA, 22 bp, Homo sapiens
ttgtggctcttgaggctctcgt

SEQ ID NO: 8375573 - DNA, 22 bp, Homo sapiens
ttgtggctgtcgagaattgagg

SEQ ID NO: 8375574 - DNA, 22 bp, Homo sapiens
ttgtggctgtgcaccgctgcct

SEQ ID NO: 8375575 - DNA, 22 bp, Homo sapiens
ttgtggcttctacgcccacagg

SEQ ID NO: 8375576 - DNA, 22 bp, Homo sapiens
ttgtggctcatcttcagctccc

SEQ ID NO: 8375577 - DNA, 22 bp, Homo sapiens
ttgtccagcagctcagtctacg

SEQ ID NO: 8375578 - DNA, 23 bp, Homo sapiens
ttgtccagctggtttgggccaca

SEQ ID NO: 8375579 - DNA, 22 bp, Homo sapiens
ttgtccagtttctagaggcctc

SEQ ID NO: 8375580 - DNA, 22 bp, Homo sapiens
ttgtccagtttctagaggcctc

SEQ ID NO: 8375581 - DNA, 22 bp, Homo sapiens
ttgtccagaaaaaagccaaggg

SEQ ID NO: 8375582 - DNA, 22 bp, Homo sapiens
ttgggcagggaaaggacaggca

SEQ ID NO: 8375583 - DNA, 22 bp, Homo sapiens
ttgggcaggtgtggctctcctt

SEQ ID NO: 8375584 - DNA, 22 bp, Homo sapiens
ttgggagatattgttctttaca

SEQ ID NO: 8375585 - DNA, 22 bp, Homo sapiens
ttgggagatggggagataatat

SEQ ID NO: 8375586 - DNA, 17 bp, Homo sapiens
ttgggagagaaaggtat

SEQ ID NO: 8375587 - DNA, 22 bp, Homo sapiens
ttgggagaaggctgggacttta

SEQ ID NO: 8375588 - DNA, 22 bp, Homo sapiens
ttgggacatctggcatacagtt

SEQ ID NO: 8375589 - DNA, 22 bp, Homo sapiens
ttgggacattatcagtctgcag

SEQ ID NO: 8375590 - DNA, 22 bp, Homo sapiens
ttgggacatgtaagctggaagt

SEQ ID NO: 8375591 - DNA, 22 bp, Homo sapiens
ttggccatctaagcccagccac

SEQ ID NO: 8375592 - DNA, 22 bp, Homo sapiens
ttggccagtggaaagaggagga

SEQ ID NO: 8375593 - DNA, 22 bp, Homo sapiens
ttggccaggtgtccagcccagg

SEQ ID NO: 8375594 - DNA, 22 bp, Homo sapiens
ttggccaggtgtaggtcacacc

SEQ ID NO: 8375595 - DNA, 22 bp, Homo sapiens
ttggccagtgaaccaggcctgg

SEQ ID NO: 8375596 - DNA, 22 bp, Homo sapiens
ttggccagctctggaaagtggt

SEQ ID NO: 8375597 - DNA, 22 bp, Homo sapiens
ttggcatcagtgtaggacctgt

SEQ ID NO: 8375598 - DNA, 17 bp, Homo sapiens
ttggcagtttggcggcc

SEQ ID NO: 8375599 - DNA, 22 bp, Homo sapiens
ttggcccacagtaccatgctgt

SEQ ID NO: 8375600 - DNA, 22 bp, Homo sapiens
ttggcccactctcagaatgtgg

SEQ ID NO: 8375601 - DNA, 22 bp, Homo sapiens
ttgggaaggcgtggaagcagaa

SEQ ID NO: 8375602 - DNA, 22 bp, Homo sapiens
ttgggacagaaaaggagaagat

SEQ ID NO: 8375603 - DNA, 22 bp, Homo sapiens
ttgggacagcaaccatctgcta

SEQ ID NO: 8375604 - DNA, 22 bp, Homo sapiens
ttgggacagctgtggtagtgag

SEQ ID NO: 8375605 - DNA, 22 bp, Homo sapiens
ttgggacagcaacggttctgtt

SEQ ID NO: 8375606 - DNA, 22 bp, Homo sapiens
ttgggacagcaacggttctgtt

SEQ ID NO: 8375607 - DNA, 22 bp, Homo sapiens
ttggaggaggcattggaggatt

SEQ ID NO: 8375608 - DNA, 22 bp, Homo sapiens
ttggcagtgatgcagcttgttc

SEQ ID NO: 8375609 - DNA, 22 bp, Homo sapiens
ttggcagtgctttaatttccag

SEQ ID NO: 8375610 - DNA, 22 bp, Homo sapiens
ttggcagtgtcactagggagcc

SEQ ID NO: 8375611 - DNA, 22 bp, Homo sapiens
ttggcagtgtctgcaaaatgga

SEQ ID NO: 8375612 - DNA, 20 bp, Homo sapiens
ttggcagttaagaatcttac

SEQ ID NO: 8375613 - DNA, 21 bp, Homo sapiens
ttggcagtcagaaatgtgagg

SEQ ID NO: 8375614 - DNA, 22 bp, Homo sapiens
ttggcagtcaccatcgtgtaga

SEQ ID NO: 8375615 - DNA, 22 bp, Homo sapiens
ttggcagtagtggtagtacatt

SEQ ID NO: 8375616 - DNA, 22 bp, Homo sapiens
ttggcagtcagtcttggtgctt

SEQ ID NO: 8375617 - DNA, 22 bp, Homo sapiens
ttggcagtccaggattaatata

SEQ ID NO: 8375618 - DNA, 22 bp, Homo sapiens
ttggcagtctcagtcagatggc

SEQ ID NO: 8375619 - DNA, 22 bp, Homo sapiens
ttggcagtgactgcgggccccg

SEQ ID NO: 8375620 - DNA, 22 bp, Homo sapiens
ttggcagtaaaagaaaatgctt

SEQ ID NO: 8375621 - DNA, 22 bp, Homo sapiens
ttggcagtagtctcggctaccc

SEQ ID NO: 8375622 - DNA, 22 bp, Homo sapiens
ttggaccaaggtctgctctttc

SEQ ID NO: 8375623 - DNA, 22 bp, Homo sapiens
ttggacagtgcagatctacacg

SEQ ID NO: 8375624 - DNA, 22 bp, Homo sapiens
ttggacagtgcagatctacacg

SEQ ID NO: 8375625 - DNA, 18 bp, Homo sapiens
ttggacctgtgtcagggc

SEQ ID NO: 8375626 - DNA, 22 bp, Homo sapiens
ttggagaatgttttcctgcagt

SEQ ID NO: 8375627 - DNA, 22 bp, Homo sapiens
ttatataactcaggtgggctca

SEQ ID NO: 8375628 - DNA, 22 bp, Homo sapiens
ttatagtattaggtactcaaca

SEQ ID NO: 8375629 - DNA, 22 bp, Homo sapiens
ttatagcagcatgatttataat

SEQ ID NO: 8375630 - DNA, 22 bp, Homo sapiens
ttatagcagcatgatttacaat

SEQ ID NO: 8375631 - DNA, 22 bp, Homo sapiens
ttatagcagcatgatttatagt

SEQ ID NO: 8375632 - DNA, 22 bp, Homo sapiens
ttatagatgccttgagtaaatg

SEQ ID NO: 8375633 - DNA, 22 bp, Homo sapiens
ttatactttatactacatcatt

SEQ ID NO: 8375634 - DNA, 22 bp, Homo sapiens
ttaggaaacgctgctattgact

SEQ ID NO: 8375635 - DNA, 22 bp, Homo sapiens
ttaggaaaggaacattgaaacg

SEQ ID NO: 8375636 - DNA, 22 bp, Homo sapiens
ttaggaaagttcttcagacatg

SEQ ID NO: 8375637 - DNA, 22 bp, Homo sapiens
ttatacatgtgttttgagatga

SEQ ID NO: 8375638 - DNA, 22 bp, Homo sapiens
ttatacagtttatacttagaat

SEQ ID NO: 8375639 - DNA, 22 bp, Homo sapiens
ttatacatgtttataaggttga

SEQ ID NO: 8375640 - DNA, 22 bp, Homo sapiens
tcctgctggaatggaaaatgaa

SEQ ID NO: 8375641 - DNA, 22 bp, Homo sapiens
tcctgctggaagtagggaatga

SEQ ID NO: 8375642 - DNA, 22 bp, Homo sapiens
tcctgctggaaacttcctcttg

SEQ ID NO: 8375643 - DNA, 22 bp, Homo sapiens
tcctgctgctcttgggaaacct

SEQ ID NO: 8375644 - DNA, 22 bp, Homo sapiens
ttagccattgtcagcacatggc

SEQ ID NO: 8375645 - DNA, 22 bp, Homo sapiens
ttagccattctgataggtatgt

SEQ ID NO: 8375646 - DNA, 23 bp, Homo sapiens
ttagccattccactgacatttga

SEQ ID NO: 8375647 - DNA, 22 bp, Homo sapiens
ttagccatgttgaagatttaga

SEQ ID NO: 8375648 - DNA, 22 bp, Homo sapiens
ttagccatggactgaattgact

SEQ ID NO: 8375649 - DNA, 22 bp, Homo sapiens
ttagccatgcttcttgggtcta

SEQ ID NO: 8375650 - DNA, 22 bp, Homo sapiens
ttagccatatagaaaaagagct

SEQ ID NO: 8375651 - DNA, 22 bp, Homo sapiens
ttagccataattgtttttccca

SEQ ID NO: 8375652 - DNA, 22 bp, Homo sapiens
ttagccatgccctagaagagga

SEQ ID NO: 8375653 - DNA, 22 bp, Homo sapiens
ttagccatgatgagtatatttg

SEQ ID NO: 8375654 - DNA, 22 bp, Homo sapiens
ttagccatatagtgctcttgta

SEQ ID NO: 8375655 - DNA, 22 bp, Homo sapiens
ttagctcagaaaatttaaactt

SEQ ID NO: 8375656 - DNA, 22 bp, Homo sapiens
ttagctcagaaaatttaaactt

SEQ ID NO: 8375657 - DNA, 22 bp, Homo sapiens
ttagctgagattaagtgaactt

SEQ ID NO: 8375658 - DNA, 22 bp, Homo sapiens
ttagctgaaaaaattcatgcaa

SEQ ID NO: 8375659 - DNA, 18 bp, Homo sapiens
tcctgcctgtgccccagg

SEQ ID NO: 8375660 - DNA, 19 bp, Homo sapiens
tcctgcctggggccgcctg

SEQ ID NO: 8375661 - DNA, 22 bp, Homo sapiens
tcctgcctgtttacctgtactt

SEQ ID NO: 8375662 - DNA, 18 bp, Homo sapiens
tcctgcctgcgggctccc

SEQ ID NO: 8375663 - DNA, 19 bp, Homo sapiens
tcctgcctggggccgcctg

SEQ ID NO: 8375664 - DNA, 20 bp, Homo sapiens
tcctgctgaccttcacaagc

SEQ ID NO: 8375665 - DNA, 22 bp, Homo sapiens
tcctgctgaccagtaaatgaat

SEQ ID NO: 8375666 - DNA, 21 bp, Homo sapiens
tcctgctgagaaacagatggt

SEQ ID NO: 8375667 - DNA, 21 bp, Homo sapiens
tcctgctgagaaacagatggt

SEQ ID NO: 8375668 - DNA, 22 bp, Homo sapiens
tcctgctgagcatgttctgccc

SEQ ID NO: 8375669 - DNA, 22 bp, Homo sapiens
tcctgctgctacctggcccacg

SEQ ID NO: 8375670 - DNA, 20 bp, Homo sapiens
tcctgctgccacctcttctt

SEQ ID NO: 8375671 - DNA, 22 bp, Homo sapiens
tcctgctgccatttcaagtgct

SEQ ID NO: 8375672 - DNA, 22 bp, Homo sapiens
ttcaaacagatgactctgctct

SEQ ID NO: 8375673 - DNA, 22 bp, Homo sapiens
ttcaaacagttgcacaacttat

SEQ ID NO: 8375674 - DNA, 22 bp, Homo sapiens
ttattgagcacatagtatgtgg

SEQ ID NO: 8375675 - DNA, 22 bp, Homo sapiens
ttattgagcacctactatgtgt

SEQ ID NO: 8375676 - DNA, 18 bp, Homo sapiens
ttattggtgctgctgttc

SEQ ID NO: 8375677 - DNA, 22 bp, Homo sapiens
ttattgacttgtttgtcctggt

SEQ ID NO: 8375678 - DNA, 21 bp, Homo sapiens
ttattgaatgtttaccgtgtg

SEQ ID NO: 8375679 - DNA, 22 bp, Homo sapiens
ttattcttttctccagaatccc

SEQ ID NO: 8375680 - DNA, 22 bp, Homo sapiens
ttattatagattatgcaagatt

SEQ ID NO: 8375681 - DNA, 22 bp, Homo sapiens
ttattctttaaacatatatgtt

SEQ ID NO: 8375682 - DNA, 22 bp, Homo sapiens
ttattctttaaacatatatgtt

SEQ ID NO: 8375683 - DNA, 22 bp, Homo sapiens
ttattctttaaacatatatgtt

SEQ ID NO: 8375684 - DNA, 22 bp, Homo sapiens
ttattacactgaaagaattgcg

SEQ ID NO: 8375685 - DNA, 22 bp, Homo sapiens
ttattacactgaaagaattgcg

SEQ ID NO: 8375686 - DNA, 22 bp, Homo sapiens
ttattagagatatttggttagg

SEQ ID NO: 8375687 - DNA, 22 bp, Homo sapiens
ttattagtgttgatattaggat

SEQ ID NO: 8375688 - DNA, 22 bp, Homo sapiens
ttattagagatatttggttagg

SEQ ID NO: 8375689 - DNA, 22 bp, Homo sapiens
ttattaaaatgcggatttggct

SEQ ID NO: 8375690 - DNA, 22 bp, Homo sapiens
ttatatgattgaagtgcataag

SEQ ID NO: 8375691 - DNA, 22 bp, Homo sapiens
ttatatgagtatcatatcactt

SEQ ID NO: 8375692 - DNA, 22 bp, Homo sapiens
ttatatcagaaggtgagattga

SEQ ID NO: 8375693 - DNA, 22 bp, Homo sapiens
ttatatatcttgatttgttcca

SEQ ID NO: 8375694 - DNA, 22 bp, Homo sapiens
ttatatatatgtagaggtcacg

SEQ ID NO: 8375695 - DNA, 22 bp, Homo sapiens
ttattaatgagtacaagttatt

SEQ ID NO: 8375696 - DNA, 22 bp, Homo sapiens
ttattaatgagtacaagttatt

SEQ ID NO: 8375697 - DNA, 22 bp, Homo sapiens
ttattaatgagtacaagttatt

SEQ ID NO: 8375698 - DNA, 22 bp, Homo sapiens
ttattaataaagtggcatagcc

SEQ ID NO: 8375699 - DNA, 22 bp, Homo sapiens
ttattaagtgcctacaataaag

SEQ ID NO: 8375700 - DNA, 22 bp, Homo sapiens
ttattaaaatgcggatttggct

SEQ ID NO: 8375701 - DNA, 22 bp, Homo sapiens
ttattaagtgcctacaataaag

SEQ ID NO: 8375702 - DNA, 22 bp, Homo sapiens
ttccagtacccagcgaaggcac

SEQ ID NO: 8375703 - DNA, 22 bp, Homo sapiens
ttccagggctaattcctgtgga

SEQ ID NO: 8375704 - DNA, 22 bp, Homo sapiens
ttccaggctcctgcagtttcta

SEQ ID NO: 8375705 - DNA, 22 bp, Homo sapiens
ttcatttgtccaaatactatgt

SEQ ID NO: 8375706 - DNA, 20 bp, Homo sapiens
ttcatttgggaaaatctgcg

SEQ ID NO: 8375707 - DNA, 22 bp, Homo sapiens
ttcatttggcctctgcttaaaa

SEQ ID NO: 8375708 - DNA, 22 bp, Homo sapiens
ttcatttgccatcagtgtaatg

SEQ ID NO: 8375709 - DNA, 22 bp, Homo sapiens
ttcatttgccatcagtgtaatg

SEQ ID NO: 8375710 - DNA, 22 bp, Homo sapiens
ttcatttgtggttatttacaat

SEQ ID NO: 8375711 - DNA, 22 bp, Homo sapiens
ttcatttgtctgctatagatcc

SEQ ID NO: 8375712 - DNA, 22 bp, Homo sapiens
ttcatttgtggtgaatgaagtg

SEQ ID NO: 8375713 - DNA, 22 bp, Homo sapiens
ttcattttataaaccctgctga

SEQ ID NO: 8375714 - DNA, 21 bp, Homo sapiens
ttcataaaccattctcatgca

SEQ ID NO: 8375715 - DNA, 21 bp, Homo sapiens
ttcataaaccattctcatgca

SEQ ID NO: 8375716 - DNA, 21 bp, Homo sapiens
ttcataaaccattctcatgca

SEQ ID NO: 8375717 - DNA, 22 bp, Homo sapiens
ttcagttttgcttttaatcatg

SEQ ID NO: 8375718 - DNA, 22 bp, Homo sapiens
ttcagtttgtttgactgttaga

SEQ ID NO: 8375719 - DNA, 22 bp, Homo sapiens
ttcagtgtgtgatacctgctgt

SEQ ID NO: 8375720 - DNA, 22 bp, Homo sapiens
ttcagtgttaaattcaaagagt

SEQ ID NO: 8375721 - DNA, 22 bp, Homo sapiens
ttcagtgttaaattcaaagagt

SEQ ID NO: 8375722 - DNA, 22 bp, Homo sapiens
ttcagtgtgtcagtttcagcag

SEQ ID NO: 8375723 - DNA, 22 bp, Homo sapiens
ttcagtgtggtgcacagttttg

SEQ ID NO: 8375724 - DNA, 22 bp, Homo sapiens
ttcagtgtggaatgtgaactgc

SEQ ID NO: 8375725 - DNA, 22 bp, Homo sapiens
ttcagtgtggtgcacagttttg

SEQ ID NO: 8375726 - DNA, 22 bp, Homo sapiens
ttcagtgtggcccatgaagagg

SEQ ID NO: 8375727 - DNA, 22 bp, Homo sapiens
ttcagtgttcttttctgttagc

SEQ ID NO: 8375728 - DNA, 22 bp, Homo sapiens
ttcagtgttactcaaggggcag

SEQ ID NO: 8375729 - DNA, 22 bp, Homo sapiens
ttcagtgttaatcttgggagaa

SEQ ID NO: 8375730 - DNA, 22 bp, Homo sapiens
ttcagtgtttgtagagataact

SEQ ID NO: 8375731 - DNA, 22 bp, Homo sapiens
ttcatttgcactggattactgg

SEQ ID NO: 8375732 - DNA, 22 bp, Homo sapiens
ttcatttgagtttatagttgct

SEQ ID NO: 8375733 - DNA, 22 bp, Homo sapiens
ttcatttgagtttatagttgct

SEQ ID NO: 8375734 - DNA, 22 bp, Homo sapiens
ttcatttattcagcaggtattt

SEQ ID NO: 8375735 - DNA, 23 bp, Homo sapiens
ttcatttaggagttcataagagc

SEQ ID NO: 8375736 - DNA, 22 bp, Homo sapiens
ttcatttaatcagaatctctaa

SEQ ID NO: 8375737 - DNA, 22 bp, Homo sapiens
ttcattgcattccagcctgggt

SEQ ID NO: 8375738 - DNA, 22 bp, Homo sapiens
ttcattgtagcttgactaatta

SEQ ID NO: 8375739 - DNA, 22 bp, Homo sapiens
ttcagagaaactgaggtttaga

SEQ ID NO: 8375740 - DNA, 22 bp, Homo sapiens
ttcagagaacttcatggaagag

SEQ ID NO: 8375741 - DNA, 22 bp, Homo sapiens
ttcagagaacttcatggaagag

SEQ ID NO: 8375742 - DNA, 22 bp, Homo sapiens
ttcagagaaagcagatttactc

SEQ ID NO: 8375743 - DNA, 22 bp, Homo sapiens
ttcagagaaagcagatttactc

SEQ ID NO: 8375744 - DNA, 22 bp, Homo sapiens
ttcagagaaaggaaagccggat

SEQ ID NO: 8375745 - DNA, 22 bp, Homo sapiens
ttcagagaattggataattcgt

SEQ ID NO: 8375746 - DNA, 22 bp, Homo sapiens
ttcagagacagcaaccaggaca

SEQ ID NO: 8375747 - DNA, 22 bp, Homo sapiens
ttcagagacagcaaccaggaca

SEQ ID NO: 8375748 - DNA, 22 bp, Homo sapiens
ttcagagaagcaaaggcagatt

SEQ ID NO: 8375749 - DNA, 22 bp, Homo sapiens
ttcagagaagcaaaggcagatt

SEQ ID NO: 8375750 - DNA, 22 bp, Homo sapiens
ttcagagaagtgcacaaaatca

SEQ ID NO: 8375751 - DNA, 22 bp, Homo sapiens
ttcagagacatgttctagatca

SEQ ID NO: 8375752 - DNA, 22 bp, Homo sapiens
ttcagagagaaaccagtgggaa

SEQ ID NO: 8375753 - DNA, 22 bp, Homo sapiens
ttcagagagtacagttgctggc

SEQ ID NO: 8375754 - DNA, 22 bp, Homo sapiens
ttcagagagtacagttgctggc

SEQ ID NO: 8375755 - DNA, 22 bp, Homo sapiens
ttcagagagaccaagtggcgtg

SEQ ID NO: 8375756 - DNA, 22 bp, Homo sapiens
ttcagagagaccaagtggcgtg

SEQ ID NO: 8375757 - DNA, 22 bp, Homo sapiens
ttcagagagaaaccagtgggaa

SEQ ID NO: 8375758 - DNA, 22 bp, Homo sapiens
ttcagagatgacacctggtgtt

SEQ ID NO: 8375759 - DNA, 22 bp, Homo sapiens
ttcagagatgacacctggtgtt

SEQ ID NO: 8375760 - DNA, 22 bp, Homo sapiens
ttcagagatggaaggcagaatg

SEQ ID NO: 8375761 - DNA, 22 bp, Homo sapiens
ttcagagcagatattgaagggt

SEQ ID NO: 8375762 - DNA, 22 bp, Homo sapiens
ttcagagatggaaggcagaatg

SEQ ID NO: 8375763 - DNA, 22 bp, Homo sapiens
ttcagagagtttgtgagtcctt

SEQ ID NO: 8375764 - DNA, 20 bp, Homo sapiens
ttcagagatagggtctttaa

SEQ ID NO: 8375765 - DNA, 20 bp, Homo sapiens
ttcagagatagggtctttaa

SEQ ID NO: 8375766 - DNA, 22 bp, Homo sapiens
ttcagagagtttgtgagtcctt

SEQ ID NO: 8375767 - DNA, 22 bp, Homo sapiens
ttcagagagtccagtatgcagt

SEQ ID NO: 8375768 - DNA, 22 bp, Homo sapiens
ttcagagagtccagtatgcagt

SEQ ID NO: 8375769 - DNA, 22 bp, Homo sapiens
ttcagtgtccctagtagaagtt

SEQ ID NO: 8375770 - DNA, 22 bp, Homo sapiens
ttcagtgtccctagtagaagtt

SEQ ID NO: 8375771 - DNA, 22 bp, Homo sapiens
ttcagtgtgcttcaggacgtta

SEQ ID NO: 8375772 - DNA, 19 bp, Homo sapiens
ttcagtgtgctggctcctg

SEQ ID NO: 8375773 - DNA, 22 bp, Homo sapiens
ttcagtgtgcctaagtcagttg

SEQ ID NO: 8375774 - DNA, 22 bp, Homo sapiens
ttcagtgtgaagcttctgaaag

SEQ ID NO: 8375775 - DNA, 18 bp, Homo sapiens
ttcagcagcagacacact

SEQ ID NO: 8375776 - DNA, 22 bp, Homo sapiens
ttcagcaactcaaacctattag

SEQ ID NO: 8375777 - DNA, 16 bp, Homo sapiens
ttcagagcggctcata

SEQ ID NO: 8375778 - DNA, 22 bp, Homo sapiens
ttcagagctggtgtctacagct

SEQ ID NO: 8375779 - DNA, 22 bp, Homo sapiens
ttcagagctcagaaaagtgtct

SEQ ID NO: 8375780 - DNA, 22 bp, Homo sapiens
ttcagagcccaaatggagatta

SEQ ID NO: 8375781 - DNA, 22 bp, Homo sapiens
ttcagagcatctctaaagccag

SEQ ID NO: 8375782 - DNA, 22 bp, Homo sapiens
ttcagagccacttcaagtctaa

SEQ ID NO: 8375783 - DNA, 22 bp, Homo sapiens
ttcagagccagcaacactaggc

SEQ ID NO: 8375784 - DNA, 22 bp, Homo sapiens
ttcagagcttagaatggactac

SEQ ID NO: 8375785 - DNA, 22 bp, Homo sapiens
ttcagcaaatggcttgagataa

SEQ ID NO: 8375786 - DNA, 22 bp, Homo sapiens
ttcaaagataattaccaaacat

SEQ ID NO: 8375787 - DNA, 23 bp, Homo sapiens
ttcaaagatcttctgaaatctgt

SEQ ID NO: 8375788 - DNA, 22 bp, Homo sapiens
ttcaaagatggagggatagatt

SEQ ID NO: 8375789 - DNA, 22 bp, Homo sapiens
ttcacaatggcaaaccattaaa

SEQ ID NO: 8375790 - DNA, 22 bp, Homo sapiens
ttcacaataggagcatgcaaat

SEQ ID NO: 8375791 - DNA, 23 bp, Homo sapiens
ttcaaagcttaagctctttccac

SEQ ID NO: 8375792 - DNA, 22 bp, Homo sapiens
ttcacaataggagcatgcaaat

SEQ ID NO: 8375793 - DNA, 22 bp, Homo sapiens
ttcaaagataatgtagcatttt

SEQ ID NO: 8375794 - DNA, 21 bp, Homo sapiens
ttcaaagagtgggcattgtca

SEQ ID NO: 8375795 - DNA, 22 bp, Homo sapiens
ttcaaagataatgtagcatttt

SEQ ID NO: 8375796 - DNA, 22 bp, Homo sapiens
ttcaaagataattaccaaacat

SEQ ID NO: 8375797 - DNA, 22 bp, Homo sapiens
ttcaaagagaaattgtattttc

SEQ ID NO: 8375798 - DNA, 22 bp, Homo sapiens
ttcacagctcatactgttctca

SEQ ID NO: 8375799 - DNA, 22 bp, Homo sapiens
ttcacagctaagagctaagtaa

SEQ ID NO: 8375800 - DNA, 22 bp, Homo sapiens
ttcacagcttaataaggctcag

SEQ ID NO: 8375801 - DNA, 19 bp, Homo sapiens
ttcacagctctgtgtcagt

SEQ ID NO: 8375802 - DNA, 19 bp, Homo sapiens
ttcacagctctgtgtcagt

SEQ ID NO: 8375803 - DNA, 22 bp, Homo sapiens
ttctgtgtcttcttgttctgtg

SEQ ID NO: 8375804 - DNA, 22 bp, Homo sapiens
ttctgtgcccattttaaaatgg

SEQ ID NO: 8375805 - DNA, 22 bp, Homo sapiens
ttctgtgaatggccatgacaag

SEQ ID NO: 8375806 - DNA, 22 bp, Homo sapiens
ttctgtctggaaaaggacatag

SEQ ID NO: 8375807 - DNA, 22 bp, Homo sapiens
ttctgtctggaaaaggacatag

SEQ ID NO: 8375808 - DNA, 22 bp, Homo sapiens
ttctgtctctgtgtttacatta

SEQ ID NO: 8375809 - DNA, 22 bp, Homo sapiens
ttctgtctgatggtgccagaac

SEQ ID NO: 8375810 - DNA, 22 bp, Homo sapiens
ttctgtctgtaaacttctcaat

SEQ ID NO: 8375811 - DNA, 22 bp, Homo sapiens
ttcttacattagtctgtgcttt

SEQ ID NO: 8375812 - DNA, 22 bp, Homo sapiens
ttcttacattagtctgtgcttt

SEQ ID NO: 8375813 - DNA, 22 bp, Homo sapiens
ttctgttacaagtgaaaaaatg

SEQ ID NO: 8375814 - DNA, 22 bp, Homo sapiens
ttctgtgtgcttactggtgttc

SEQ ID NO: 8375815 - DNA, 22 bp, Homo sapiens
ttctgtgtgccagagttgtgct

SEQ ID NO: 8375816 - DNA, 22 bp, Homo sapiens
ttcttagaagaaacatctaaaa

SEQ ID NO: 8375817 - DNA, 22 bp, Homo sapiens
ttcttagagatggttaaaaata

SEQ ID NO: 8375818 - DNA, 22 bp, Homo sapiens
ttcttatattgggtcatggata

SEQ ID NO: 8375819 - DNA, 22 bp, Homo sapiens
ttcttatgttcacataattcca

SEQ ID NO: 8375820 - DNA, 22 bp, Homo sapiens
ttcttatagaagcaaccattgt

SEQ ID NO: 8375821 - DNA, 22 bp, Homo sapiens
ttcttataagttaatatttcca

SEQ ID NO: 8375822 - DNA, 22 bp, Homo sapiens
ttctggagaggaacagaaaggt

SEQ ID NO: 8375823 - DNA, 22 bp, Homo sapiens
ttctggaattcttgcagccact

SEQ ID NO: 8375824 - DNA, 22 bp, Homo sapiens
ttctggagacccagcaacaggg

SEQ ID NO: 8375825 - DNA, 22 bp, Homo sapiens
ttctctgggttaggggaactat

SEQ ID NO: 8375826 - DNA, 22 bp, Homo sapiens
ttctctgggttaggggaactat

SEQ ID NO: 8375827 - DNA, 22 bp, Homo sapiens
ttctctggggactgtctctatt

SEQ ID NO: 8375828 - DNA, 22 bp, Homo sapiens
ttctctggggttcagtatctct

SEQ ID NO: 8375829 - DNA, 22 bp, Homo sapiens
ttctctggggttcagtatctct

SEQ ID NO: 8375830 - DNA, 22 bp, Homo sapiens
ttctctggacagtgaagagagg

SEQ ID NO: 8375831 - DNA, 22 bp, Homo sapiens
ttctctgggacaggaacagttt

SEQ ID NO: 8375832 - DNA, 22 bp, Homo sapiens
ttcttattcttgaaatgtggga

SEQ ID NO: 8375833 - DNA, 22 bp, Homo sapiens
ttcttattcttgaaatgtggga

SEQ ID NO: 8375834 - DNA, 23 bp, Homo sapiens
ttcttatttactttggaatctcc

SEQ ID NO: 8375835 - DNA, 22 bp, Homo sapiens
ttcttcagactactgatgattg

SEQ ID NO: 8375836 - DNA, 22 bp, Homo sapiens
ttcttcaaagtaatagagacta

SEQ ID NO: 8375837 - DNA, 22 bp, Homo sapiens
ttcttcaacaaggacactgtta

SEQ ID NO: 8375838 - DNA, 22 bp, Homo sapiens
ttcttttaattgtgggggagtg

SEQ ID NO: 8375839 - DNA, 22 bp, Homo sapiens
ttcttttaattgtgggggagtg

SEQ ID NO: 8375840 - DNA, 22 bp, Homo sapiens
ttcttttaatagagatcctgtg

SEQ ID NO: 8375841 - DNA, 22 bp, Homo sapiens
ttcttttaaaagagagcagaaa

SEQ ID NO: 8375842 - DNA, 22 bp, Homo sapiens
ttcttttaatgtctggctttca

SEQ ID NO: 8375843 - DNA, 22 bp, Homo sapiens
ttcttttaatgttctgaagttt

SEQ ID NO: 8375844 - DNA, 22 bp, Homo sapiens
ttctttggtgttacccagctca

SEQ ID NO: 8375845 - DNA, 19 bp, Homo sapiens
ttctttggtggtggtgacc

SEQ ID NO: 8375846 - DNA, 22 bp, Homo sapiens
ttctttgtagcaaaacgtgtat

SEQ ID NO: 8375847 - DNA, 22 bp, Homo sapiens
ttgaaatatggattgaccttga

SEQ ID NO: 8375848 - DNA, 22 bp, Homo sapiens
ttgaaatgaaatatttaagctc

SEQ ID NO: 8375849 - DNA, 22 bp, Homo sapiens
ttgaaatgcatcatcatttaga

SEQ ID NO: 8375850 - DNA, 22 bp, Homo sapiens
ttgaaatgcagattccaatcca

SEQ ID NO: 8375851 - DNA, 22 bp, Homo sapiens
ttgaaatgagcaaactgtcagc

SEQ ID NO: 8375852 - DNA, 22 bp, Homo sapiens
ttgaaatgagcaaactgtcagc

SEQ ID NO: 8375853 - DNA, 22 bp, Homo sapiens
ttgaaatgagactaattgattg

SEQ ID NO: 8375854 - DNA, 22 bp, Homo sapiens
ttgaaatgagactaattgattg

SEQ ID NO: 8375855 - DNA, 22 bp, Homo sapiens
ttcttttgggaattacgtatgc

SEQ ID NO: 8375856 - DNA, 22 bp, Homo sapiens
ttcttttctttaggcattgtgt

SEQ ID NO: 8375857 - DNA, 22 bp, Homo sapiens
ttcttttgcaagactattgatt

SEQ ID NO: 8375858 - DNA, 20 bp, Homo sapiens
ttcttttgataagcttgaca

SEQ ID NO: 8375859 - DNA, 20 bp, Homo sapiens
ttcttttgataagcttgaca

SEQ ID NO: 8375860 - DNA, 22 bp, Homo sapiens
ttgaacattaacttcagtctat

SEQ ID NO: 8375861 - DNA, 22 bp, Homo sapiens
ttgaacagctgttacattgtta

SEQ ID NO: 8375862 - DNA, 22 bp, Homo sapiens
ttgaacaatttggtatacaaac

SEQ ID NO: 8375863 - DNA, 19 bp, Homo sapiens
ttgaaattgtttgatatgg

SEQ ID NO: 8375864 - DNA, 19 bp, Homo sapiens
ttgaaattgtttgatatgg

SEQ ID NO: 8375865 - DNA, 19 bp, Homo sapiens
ttgaaattgtttgatatgg

SEQ ID NO: 8375866 - DNA, 22 bp, Homo sapiens
ttgaaattgggtgtggctgtca

SEQ ID NO: 8375867 - DNA, 22 bp, Homo sapiens
ttgaaatgtagtcctgccttca

SEQ ID NO: 8375868 - DNA, 20 bp, Homo sapiens
ttgaaattggatggtagcta

SEQ ID NO: 8375869 - DNA, 22 bp, Homo sapiens
ttgaaatggcagcagctgacct

SEQ ID NO: 8375870 - DNA, 22 bp, Homo sapiens
ttgaaatggcagcagctgacct

SEQ ID NO: 8375871 - DNA, 22 bp, Homo sapiens
ttgaagaaagtcatatataatg

SEQ ID NO: 8375872 - DNA, 23 bp, Homo sapiens
ttgaatttctcttgcaatattta

SEQ ID NO: 8375873 - DNA, 22 bp, Homo sapiens
ttcctgggtggtcctggtagag

SEQ ID NO: 8375874 - DNA, 22 bp, Homo sapiens
ttcctggggcttagcaatggag

SEQ ID NO: 8375875 - DNA, 22 bp, Homo sapiens
ttccttcttccaaacccatcat

SEQ ID NO: 8375876 - DNA, 22 bp, Homo sapiens
ttccttcttcattgtgttacag

SEQ ID NO: 8375877 - DNA, 18 bp, Homo sapiens
ttccttgattagagagaa

SEQ ID NO: 8375878 - DNA, 22 bp, Homo sapiens
ttccttgattagtacatgaagg

SEQ ID NO: 8375879 - DNA, 22 bp, Homo sapiens
ttccttgcctcggggtaccttg

SEQ ID NO: 8375880 - DNA, 22 bp, Homo sapiens
ttccttgccctctgggatcttg

SEQ ID NO: 8375881 - DNA, 18 bp, Homo sapiens
ttccttgattagagagaa

SEQ ID NO: 8375882 - DNA, 22 bp, Homo sapiens
ttccttgaccactgcataatga

SEQ ID NO: 8375883 - DNA, 22 bp, Homo sapiens
ttccttgagaaaggcacaagtt

SEQ ID NO: 8375884 - DNA, 22 bp, Homo sapiens
ttccttgaaagctggacatggg

SEQ ID NO: 8375885 - DNA, 22 bp, Homo sapiens
ttccttgaaagtttgaactgac

SEQ ID NO: 8375886 - DNA, 21 bp, Homo sapiens
ttcctggggacttccgtggga

SEQ ID NO: 8375887 - DNA, 17 bp, Homo sapiens
ttccagtttagtattgt

SEQ ID NO: 8375888 - DNA, 22 bp, Homo sapiens
ttcctgaatataaagacactag

SEQ ID NO: 8375889 - DNA, 22 bp, Homo sapiens
ttcctgcaaagccagatgtcga

SEQ ID NO: 8375890 - DNA, 22 bp, Homo sapiens
ttcctgcagcaaggagaagctg

SEQ ID NO: 8375891 - DNA, 22 bp, Homo sapiens
ttcctgatagaacactttccaa

SEQ ID NO: 8375892 - DNA, 22 bp, Homo sapiens
ttctctcctcctagaggctttt

SEQ ID NO: 8375893 - DNA, 22 bp, Homo sapiens
ttctctcccatgaagcttctat

SEQ ID NO: 8375894 - DNA, 22 bp, Homo sapiens
ttctctcccatgaagcttctat

SEQ ID NO: 8375895 - DNA, 22 bp, Homo sapiens
ttctctaatacattttgacaaa

SEQ ID NO: 8375896 - DNA, 22 bp, Homo sapiens
ttctctaaggtcccgttctgga

SEQ ID NO: 8375897 - DNA, 22 bp, Homo sapiens
ttctctaagctggctgaggtct

SEQ ID NO: 8375898 - DNA, 22 bp, Homo sapiens
ttctctaaggcttggcttccct

SEQ ID NO: 8375899 - DNA, 22 bp, Homo sapiens
ttctctaagccttagtttcttc

SEQ ID NO: 8375900 - DNA, 22 bp, Homo sapiens
ttctctacttcacaagggatgg

SEQ ID NO: 8375901 - DNA, 22 bp, Homo sapiens
ttctctaatggtgatgattaga

SEQ ID NO: 8375902 - DNA, 22 bp, Homo sapiens
ttctctatgtgtgttgtagttt

SEQ ID NO: 8375903 - DNA, 19 bp, Homo sapiens
ttctctattatgtcttctc

SEQ ID NO: 8375904 - DNA, 22 bp, Homo sapiens
ttctctattacagaaatggaat

SEQ ID NO: 8375905 - DNA, 22 bp, Homo sapiens
ttctctaggttttagatgaaga

SEQ ID NO: 8375906 - DNA, 23 bp, Homo sapiens
ttctctagatgaggtgaagatgg

SEQ ID NO: 8375907 - DNA, 22 bp, Homo sapiens
ttctctcttttgggtaggaggt

SEQ ID NO: 8375908 - DNA, 22 bp, Homo sapiens
ttctctcttactgccatgctgt

SEQ ID NO: 8375909 - DNA, 22 bp, Homo sapiens
ttctctcttccagttcccactt

SEQ ID NO: 8375910 - DNA, 22 bp, Homo sapiens
ttctctcttactgccatgctgt

SEQ ID NO: 8375911 - DNA, 22 bp, Homo sapiens
ttctctcttactgccatgctgt

SEQ ID NO: 8375912 - DNA, 22 bp, Homo sapiens
ttctctctgtggtcccattttg

SEQ ID NO: 8375913 - DNA, 22 bp, Homo sapiens
ttctctctgtgtcattatggac

SEQ ID NO: 8375914 - DNA, 22 bp, Homo sapiens
ttctctgctctcacatacagaa

SEQ ID NO: 8375915 - DNA, 22 bp, Homo sapiens
ttctctggaaggctctacggga

SEQ ID NO: 8375916 - DNA, 22 bp, Homo sapiens
ttctctgcattgtaaagagcca

SEQ ID NO: 8375917 - DNA, 22 bp, Homo sapiens
ttctctgctacatactagggct

SEQ ID NO: 8375918 - DNA, 22 bp, Homo sapiens
ttctcaggaactcagtgtcagc

SEQ ID NO: 8375919 - DNA, 22 bp, Homo sapiens
ttctcaggcccctgcctggact

SEQ ID NO: 8375920 - DNA, 22 bp, Homo sapiens
ttctcagggtctggatggcctg

SEQ ID NO: 8375921 - DNA, 22 bp, Homo sapiens
ttctcaggctgtggagccgtct

SEQ ID NO: 8375922 - DNA, 22 bp, Homo sapiens
ttctcctctgttggccttccct

SEQ ID NO: 8375923 - DNA, 22 bp, Homo sapiens
ttctctaagagatgcagaagtt

SEQ ID NO: 8375924 - DNA, 22 bp, Homo sapiens
ttctctaagagttatatgaatt

SEQ ID NO: 8375925 - DNA, 23 bp, Homo sapiens
ttctcctgaggaagcagggactg

SEQ ID NO: 8375926 - DNA, 22 bp, Homo sapiens
ttctccagacaggcagagggaa

SEQ ID NO: 8375927 - DNA, 22 bp, Homo sapiens
ttctccagaccctcctgcagac

SEQ ID NO: 8375928 - DNA, 22 bp, Homo sapiens
ttctccagaccttgtgactatg

SEQ ID NO: 8375929 - DNA, 22 bp, Homo sapiens
ttctccaatagctgctcatggc

SEQ ID NO: 8375930 - DNA, 22 bp, Homo sapiens
ttctccaatagctgctcatggc

SEQ ID NO: 8375931 - DNA, 22 bp, Homo sapiens
ttctccaagtagaagctaagtt

SEQ ID NO: 8375932 - DNA, 22 bp, Homo sapiens
ttctccaaggatacagtcctgt

SEQ ID NO: 8375933 - DNA, 22 bp, Homo sapiens
ttctcaggtagtgctgatgctg

SEQ ID NO: 8375934 - DNA, 22 bp, Homo sapiens
ttctcaggtcaccagggtgcca

SEQ ID NO: 8375935 - DNA, 22 bp, Homo sapiens
cagctcccagtggcagctcctt

SEQ ID NO: 8375936 - DNA, 22 bp, Homo sapiens
cagctcccagagtgaccagcag

SEQ ID NO: 8375937 - DNA, 21 bp, Homo sapiens
cagctccactaaagcagctgt

SEQ ID NO: 8375938 - DNA, 22 bp, Homo sapiens
gtgctgagattacaggtgtgag

SEQ ID NO: 8375939 - DNA, 22 bp, Homo sapiens
cagccctgtgcggagggccctg

SEQ ID NO: 8375940 - DNA, 22 bp, Homo sapiens
cagccctgtgctaagcaccctc

SEQ ID NO: 8375941 - DNA, 22 bp, Homo sapiens
cagccctgtgcggagggccctg

SEQ ID NO: 8375942 - DNA, 22 bp, Homo sapiens
gtgcatctgtaagtggctttgc

SEQ ID NO: 8375943 - DNA, 22 bp, Homo sapiens
gtgcatgcagtaagtgttttaa

SEQ ID NO: 8375944 - DNA, 22 bp, Homo sapiens
gtgcctgggacacgagattttc

SEQ ID NO: 8375945 - DNA, 22 bp, Homo sapiens
gtgcctgggacacagcagatac

SEQ ID NO: 8375946 - DNA, 22 bp, Homo sapiens
gtgcctggggttgagctatgaa

SEQ ID NO: 8375947 - DNA, 22 bp, Homo sapiens
gtgcctgggcatgagcttgttg

SEQ ID NO: 8375948 - DNA, 22 bp, Homo sapiens
cagccctttccttctcagcttt

SEQ ID NO: 8375949 - DNA, 22 bp, Homo sapiens
cagccctgttgcgcttccggcg

SEQ ID NO: 8375950 - DNA, 22 bp, Homo sapiens
cagctctgaggaacactccttt

SEQ ID NO: 8375951 - DNA, 22 bp, Homo sapiens
cagctctgatgaaatgtaccag

SEQ ID NO: 8375952 - DNA, 22 bp, Homo sapiens
cagctcctctgttagccctggg

SEQ ID NO: 8375953 - DNA, 22 bp, Homo sapiens
cagctcctagatcggcgaagtg

SEQ ID NO: 8375954 - DNA, 22 bp, Homo sapiens
cagcaggtctcagcagctcctt

SEQ ID NO: 8375955 - DNA, 22 bp, Homo sapiens
cagcaggtctcagcagctcctt

SEQ ID NO: 8375956 - DNA, 22 bp, Homo sapiens
cagcaggtcctgggcgtggcct

SEQ ID NO: 8375957 - DNA, 22 bp, Homo sapiens
cagcaggtcctgggcgtggcct

SEQ ID NO: 8375958 - DNA, 22 bp, Homo sapiens
cagcaggtcatgaaagaaaacc

SEQ ID NO: 8375959 - DNA, 22 bp, Homo sapiens
cagcaggtatgtttgttcagca

SEQ ID NO: 8375960 - DNA, 22 bp, Homo sapiens
cagcaggtatgtttgttcagca

SEQ ID NO: 8375961 - DNA, 22 bp, Homo sapiens
cagcaggtcccactgagggccc

SEQ ID NO: 8375962 - DNA, 22 bp, Homo sapiens
cagcagagctgtgtgggaaggg

SEQ ID NO: 8375963 - DNA, 22 bp, Homo sapiens
cagcagagctgtgtgggaaggg

SEQ ID NO: 8375964 - DNA, 18 bp, Homo sapiens
cagcaggtagagtttggt

SEQ ID NO: 8375965 - DNA, 22 bp, Homo sapiens
cagcagagacggtaagcagaac

SEQ ID NO: 8375966 - DNA, 22 bp, Homo sapiens
cagcagagatgagattcctata

SEQ ID NO: 8375967 - DNA, 23 bp, Homo sapiens
cagcagagagcagacctttgtgt

SEQ ID NO: 8375968 - DNA, 22 bp, Homo sapiens
cagcagagcatttggtaggagg

SEQ ID NO: 8375969 - DNA, 22 bp, Homo sapiens
cagcagagctgggctttgaatt

SEQ ID NO: 8375970 - DNA, 22 bp, Homo sapiens
cagcagtggctgcaggcagctg

SEQ ID NO: 8375971 - DNA, 22 bp, Homo sapiens
cagcagtctgtttcaacaggtc

SEQ ID NO: 8375972 - DNA, 22 bp, Homo sapiens
cagcagtctgtttcaacaggtc

SEQ ID NO: 8375973 - DNA, 22 bp, Homo sapiens
cagcagtcaggcctgtgggaga

SEQ ID NO: 8375974 - DNA, 22 bp, Homo sapiens
cagcaggtggacacactcacct

SEQ ID NO: 8375975 - DNA, 22 bp, Homo sapiens
cagcaggtgctgcctgtcaccc

SEQ ID NO: 8375976 - DNA, 22 bp, Homo sapiens
cagcaggtgctgcctgtcaccc

SEQ ID NO: 8375977 - DNA, 22 bp, Homo sapiens
cagcaggtgcaggtgcggccgc

SEQ ID NO: 8375978 - DNA, 22 bp, Homo sapiens
cagcaggtgcaggtgcggccgc

SEQ ID NO: 8375979 - DNA, 22 bp, Homo sapiens
cagcaggtctgcatttgaggtc

SEQ ID NO: 8375980 - DNA, 22 bp, Homo sapiens
cagcaggtcttgttgctgctga

SEQ ID NO: 8375981 - DNA, 21 bp, Homo sapiens
cagcaggtggagcctcttgtc

SEQ ID NO: 8375982 - DNA, 22 bp, Homo sapiens
cagcaggtgggctttgcggatg

SEQ ID NO: 8375983 - DNA, 22 bp, Homo sapiens
cagcaggtgggctttgcggatg

SEQ ID NO: 8375984 - DNA, 22 bp, Homo sapiens
cagcaggtgtccttttggtgga

SEQ ID NO: 8375985 - DNA, 22 bp, Homo sapiens
cagcaggtgtctagcaagggtc

SEQ ID NO: 8375986 - DNA, 22 bp, Homo sapiens
cagcaggtgtctagcaagggtc

SEQ ID NO: 8375987 - DNA, 22 bp, Homo sapiens
cagcagtaactcccgtgcagca

SEQ ID NO: 8375988 - DNA, 22 bp, Homo sapiens
cagcaggttctacgggtgagat

SEQ ID NO: 8375989 - DNA, 22 bp, Homo sapiens
cagcaggttaacagaggctggt

SEQ ID NO: 8375990 - DNA, 22 bp, Homo sapiens
cagcaggttaacagaggctggt

SEQ ID NO: 8375991 - DNA, 22 bp, Homo sapiens
cagcaggtgtctagcaagggtc

SEQ ID NO: 8375992 - DNA, 22 bp, Homo sapiens
cagcagtaattagtgctgcatg

SEQ ID NO: 8375993 - DNA, 22 bp, Homo sapiens
cagcaggttctacgggtgagat

SEQ ID NO: 8375994 - DNA, 22 bp, Homo sapiens
cagcagtagtctctgtggcttt

SEQ ID NO: 8375995 - DNA, 22 bp, Homo sapiens
cagcagtcacacaaactctgga

SEQ ID NO: 8375996 - DNA, 22 bp, Homo sapiens
gtcctctgtgtaggctgcagac

SEQ ID NO: 8375997 - DNA, 22 bp, Homo sapiens
cagcagtggctgcaggcagctg

SEQ ID NO: 8375998 - DNA, 22 bp, Homo sapiens
cagcagtggctgcaggcagctg

SEQ ID NO: 8375999 - DNA, 22 bp, Homo sapiens
cagcagtggctgcaggcagctg

SEQ ID NO: 8376000 - DNA, 22 bp, Homo sapiens
gtccgtagtggctgatgctttg

SEQ ID NO: 8376001 - DNA, 22 bp, Homo sapiens
gtccgattggtatcggtgatca

SEQ ID NO: 8376002 - DNA, 22 bp, Homo sapiens
gtcctagagggtgagctaggct

SEQ ID NO: 8376003 - DNA, 22 bp, Homo sapiens
gtcctgagccctcagcacagca

SEQ ID NO: 8376004 - DNA, 22 bp, Homo sapiens
gtcctgagatgtcacaaggttt

SEQ ID NO: 8376005 - DNA, 22 bp, Homo sapiens
gtcctctgttagaaatgtgctt

SEQ ID NO: 8376006 - DNA, 22 bp, Homo sapiens
gtctcaagggggaactcactgt

SEQ ID NO: 8376007 - DNA, 22 bp, Homo sapiens
cagcatgcagcccctggcagct

SEQ ID NO: 8376008 - DNA, 22 bp, Homo sapiens
cagcatgcagcccctggcagct

SEQ ID NO: 8376009 - DNA, 22 bp, Homo sapiens
cagcatgcattttctctctttg

SEQ ID NO: 8376010 - DNA, 22 bp, Homo sapiens
cagcatcttctagatccaggct

SEQ ID NO: 8376011 - DNA, 22 bp, Homo sapiens
cagcatcttattttctatggaa

SEQ ID NO: 8376012 - DNA, 22 bp, Homo sapiens
cagcatcttcatgtgcatctcc

SEQ ID NO: 8376013 - DNA, 22 bp, Homo sapiens
cagcatgagaaaatgaatcaga

SEQ ID NO: 8376014 - DNA, 22 bp, Homo sapiens
cagcatgaccctggagcctgca

SEQ ID NO: 8376015 - DNA, 22 bp, Homo sapiens
cagcatgacagtctgcagcaga

SEQ ID NO: 8376016 - DNA, 22 bp, Homo sapiens
gtctcaggtattgaatgggaac

SEQ ID NO: 8376017 - DNA, 22 bp, Homo sapiens
gtctctgggttaagcagtgcat

SEQ ID NO: 8376018 - DNA, 22 bp, Homo sapiens
gtctctgggttaagcagtgcat

SEQ ID NO: 8376019 - DNA, 22 bp, Homo sapiens
gtctcttagaatcgcatattgt

SEQ ID NO: 8376020 - DNA, 22 bp, Homo sapiens
gtctcttagaatcgcatattgt

SEQ ID NO: 8376021 - DNA, 18 bp, Homo sapiens
gtctttggagtggaggta

SEQ ID NO: 8376022 - DNA, 22 bp, Homo sapiens
gtctttggatgtaagataaagt

SEQ ID NO: 8376023 - DNA, 22 bp, Homo sapiens
gtctttggaggcactgttgagt

SEQ ID NO: 8376024 - DNA, 18 bp, Homo sapiens
gtctttggagtggaggta

SEQ ID NO: 8376025 - DNA, 22 bp, Homo sapiens
gtctttggagaggtgccatttc

SEQ ID NO: 8376026 - DNA, 22 bp, Homo sapiens
gtctttggaaagacaaagttca

SEQ ID NO: 8376027 - DNA, 22 bp, Homo sapiens
gtcttagatttcaccgataatg

SEQ ID NO: 8376028 - DNA, 22 bp, Homo sapiens
gtctcttagtctcattttctgc

SEQ ID NO: 8376029 - DNA, 22 bp, Homo sapiens
gtctcttagtcaatattttctg

SEQ ID NO: 8376030 - DNA, 22 bp, Homo sapiens
gtctttcttaaacaacagaaca

SEQ ID NO: 8376031 - DNA, 22 bp, Homo sapiens
gtctttctgctgcacggactgc

SEQ ID NO: 8376032 - DNA, 22 bp, Homo sapiens
gtctttctgccatgtgaagaga

SEQ ID NO: 8376033 - DNA, 22 bp, Homo sapiens
gtctttctatgcatagagcaga

SEQ ID NO: 8376034 - DNA, 22 bp, Homo sapiens
gtctttctatgcatagagcaga

SEQ ID NO: 8376035 - DNA, 22 bp, Homo sapiens
gtctttctctggaacagtaaaa

SEQ ID NO: 8376036 - DNA, 22 bp, Homo sapiens
gtgcagctgcccaagcctgagc

SEQ ID NO: 8376037 - DNA, 22 bp, Homo sapiens
gtgcagctgcaggagtcaggtc

SEQ ID NO: 8376038 - DNA, 22 bp, Homo sapiens
gtgcagctgcaggagtcaggtc

SEQ ID NO: 8376039 - DNA, 22 bp, Homo sapiens
gtgcagctgagggcctcttcta

SEQ ID NO: 8376040 - DNA, 22 bp, Homo sapiens
gtgcagctgagggcctcttcta

SEQ ID NO: 8376041 - DNA, 22 bp, Homo sapiens
gtgcagctcagttgaaatgcag

SEQ ID NO: 8376042 - DNA, 22 bp, Homo sapiens
gtgcagctcagttgaaatgcag

SEQ ID NO: 8376043 - DNA, 22 bp, Homo sapiens
gtgcagctgaaggctggccagc

SEQ ID NO: 8376044 - DNA, 22 bp, Homo sapiens
gtgcagctgaaggctggccagc

SEQ ID NO: 8376045 - DNA, 22 bp, Homo sapiens
gtgcagctggtggagtctgggg

SEQ ID NO: 8376046 - DNA, 22 bp, Homo sapiens
gtgcagctgggcgctgaccttc

SEQ ID NO: 8376047 - DNA, 22 bp, Homo sapiens
gtgcagctgcttgcctggttag

SEQ ID NO: 8376048 - DNA, 22 bp, Homo sapiens
gtgcagctgggcgctgaccttc

SEQ ID NO: 8376049 - DNA, 22 bp, Homo sapiens
gtgcagctgcccaagcctgagc

SEQ ID NO: 8376050 - DNA, 22 bp, Homo sapiens
gtgcagctgccgatcagatagg

SEQ ID NO: 8376051 - DNA, 16 bp, Homo sapiens
gtgcagctgcctggta

SEQ ID NO: 8376052 - DNA, 22 bp, Homo sapiens
gtgcagctgcttgcctggttag

SEQ ID NO: 8376053 - DNA, 22 bp, Homo sapiens
gtgcagctgccgatcagatagg

SEQ ID NO: 8376054 - DNA, 16 bp, Homo sapiens
gtgcagctgcctggta

SEQ ID NO: 8376055 - DNA, 22 bp, Homo sapiens
gtgcaggagcaggagccatgtc

SEQ ID NO: 8376056 - DNA, 22 bp, Homo sapiens
gtgcaggagccaggggtaggaa

SEQ ID NO: 8376057 - DNA, 22 bp, Homo sapiens
gtgcagctgtgtgagagctcca

SEQ ID NO: 8376058 - DNA, 22 bp, Homo sapiens
gtgcagctgtgtgagagctcca

SEQ ID NO: 8376059 - DNA, 22 bp, Homo sapiens
gtgcagcttcctggtctcagcc

SEQ ID NO: 8376060 - DNA, 22 bp, Homo sapiens
gtgcagcttcctggtctcagcc

SEQ ID NO: 8376061 - DNA, 22 bp, Homo sapiens
gtgcagctggtggagtctgggg

SEQ ID NO: 8376062 - DNA, 22 bp, Homo sapiens
gtgcagctgtggtggagccagg

SEQ ID NO: 8376063 - DNA, 22 bp, Homo sapiens
gtgcagctgtggtggagccagg

SEQ ID NO: 8376064 - DNA, 22 bp, Homo sapiens
gtgcaaatgtaattgcagtttt

SEQ ID NO: 8376065 - DNA, 22 bp, Homo sapiens
gtgcagctactccttggtccta

SEQ ID NO: 8376066 - DNA, 22 bp, Homo sapiens
gtgcagctactccttggtccta

SEQ ID NO: 8376067 - DNA, 22 bp, Homo sapiens
gtgaatggttgtgaacatcttt

SEQ ID NO: 8376068 - DNA, 17 bp, Homo sapiens
gtgaatggcatagtcgg

SEQ ID NO: 8376069 - DNA, 22 bp, Homo sapiens
gtgaagttttagtatatgtaga

SEQ ID NO: 8376070 - DNA, 22 bp, Homo sapiens
gtgaagttggccagtttagttt

SEQ ID NO: 8376071 - DNA, 22 bp, Homo sapiens
cagaggctgccagccatgtgca

SEQ ID NO: 8376072 - DNA, 22 bp, Homo sapiens
cagaggcaggataagaactgcg

SEQ ID NO: 8376073 - DNA, 22 bp, Homo sapiens
cagagtgaaaactgagctcaaa

SEQ ID NO: 8376074 - DNA, 22 bp, Homo sapiens
cagagtgtttctttgggtgggt

SEQ ID NO: 8376075 - DNA, 22 bp, Homo sapiens
cagagtttcggtaagcatagaa

SEQ ID NO: 8376076 - DNA, 22 bp, Homo sapiens
ggggtcacactgtggtgactgg

SEQ ID NO: 8376077 - DNA, 22 bp, Homo sapiens
ggggtccctgcaccagcatgtc

SEQ ID NO: 8376078 - DNA, 22 bp, Homo sapiens
ggggtctcactatgttacccag

SEQ ID NO: 8376079 - DNA, 22 bp, Homo sapiens
ggtgcagagtccacagaaagct

SEQ ID NO: 8376080 - DNA, 22 bp, Homo sapiens
ggtgcagagcagtgtcagagca

SEQ ID NO: 8376081 - DNA, 22 bp, Homo sapiens
ggtgcagagcagtgtcagagca

SEQ ID NO: 8376082 - DNA, 22 bp, Homo sapiens
ggtgcagagcagtgtcagagca

SEQ ID NO: 8376083 - DNA, 22 bp, Homo sapiens
ggtgcagaggagccagctgggg

SEQ ID NO: 8376084 - DNA, 22 bp, Homo sapiens
ggtgcagaaggaagggagctgg

SEQ ID NO: 8376085 - DNA, 22 bp, Homo sapiens
ggtgcagaagaaagcagtcatt

SEQ ID NO: 8376086 - DNA, 22 bp, Homo sapiens
ggtgcaaggccaccatctagtg

SEQ ID NO: 8376087 - DNA, 22 bp, Homo sapiens
ggtgcacttcttgctagtcttt

SEQ ID NO: 8376088 - DNA, 22 bp, Homo sapiens
ggtgcagaagaaagcagtcatt

SEQ ID NO: 8376089 - DNA, 22 bp, Homo sapiens
ggtgagaggcagaggacagctt

SEQ ID NO: 8376090 - DNA, 22 bp, Homo sapiens
cagatactcaagcttagacttt

SEQ ID NO: 8376091 - DNA, 22 bp, Homo sapiens
cagataggaaaagctaggcata

SEQ ID NO: 8376092 - DNA, 22 bp, Homo sapiens
cagataaatagatagataaact

SEQ ID NO: 8376093 - DNA, 22 bp, Homo sapiens
cagataaaggcttactagtagt

SEQ ID NO: 8376094 - DNA, 20 bp, Homo sapiens
cagataaacgggaaagaagc

SEQ ID NO: 8376095 - DNA, 22 bp, Homo sapiens
cagagttttgtgaacaacttgg

SEQ ID NO: 8376096 - DNA, 22 bp, Homo sapiens
cagatgcttttgattctggggt

SEQ ID NO: 8376097 - DNA, 22 bp, Homo sapiens
ggtgctggttcagggtggctgt

SEQ ID NO: 8376098 - DNA, 18 bp, Homo sapiens
ggtggcaggtcagatgcc

SEQ ID NO: 8376099 - DNA, 22 bp, Homo sapiens
ggtggcagtagcactgggcctg

SEQ ID NO: 8376100 - DNA, 22 bp, Homo sapiens
ggtggcagtcttaagagatctt

SEQ ID NO: 8376101 - DNA, 22 bp, Homo sapiens
ggtggcagtagcactgggcctg

SEQ ID NO: 8376102 - DNA, 22 bp, Homo sapiens
ggtggcagttacaggggcaaat

SEQ ID NO: 8376103 - DNA, 18 bp, Homo sapiens
ggtgggaagccagggcct

SEQ ID NO: 8376104 - DNA, 22 bp, Homo sapiens
ggtgggaaggccactgaaggtt

SEQ ID NO: 8376105 - DNA, 22 bp, Homo sapiens
ggtgggaaggggccagtgtgcg

SEQ ID NO: 8376106 - DNA, 22 bp, Homo sapiens
ggtgtctgatggtggcttctca

SEQ ID NO: 8376107 - DNA, 22 bp, Homo sapiens
ggtgtctgcttccctccagctg

SEQ ID NO: 8376108 - DNA, 22 bp, Homo sapiens
ggtgtctggacagtgagccagg

SEQ ID NO: 8376109 - DNA, 20 bp, Homo sapiens
cagcagagacccatggggag

SEQ ID NO: 8376110 - DNA, 18 bp, Homo sapiens
cagcagagacattcaaaa

SEQ ID NO: 8376111 - DNA, 22 bp, Homo sapiens
cagcagagaaattaaacttctg

SEQ ID NO: 8376112 - DNA, 22 bp, Homo sapiens
cagcagagaaattacatatttg

SEQ ID NO: 8376113 - DNA, 22 bp, Homo sapiens
cagcagagaaattacatatttg

SEQ ID NO: 8376114 - DNA, 22 bp, Homo sapiens
cagcagactgaccttcaacccc

SEQ ID NO: 8376115 - DNA, 22 bp, Homo sapiens
cagcagaagtccgactccagtc

SEQ ID NO: 8376116 - DNA, 22 bp, Homo sapiens
cagcagaagtgcatttgtgatt

SEQ ID NO: 8376117 - DNA, 20 bp, Homo sapiens
cagcagagacccatggggag

SEQ ID NO: 8376118 - DNA, 20 bp, Homo sapiens
cagcagagacccatggggag

SEQ ID NO: 8376119 - DNA, 22 bp, Homo sapiens
gtaacctgtcggaaagccttgt

SEQ ID NO: 8376120 - DNA, 22 bp, Homo sapiens
gtaacctgggatgtagcacaga

SEQ ID NO: 8376121 - DNA, 22 bp, Homo sapiens
gtaacatttacagttcctagag

SEQ ID NO: 8376122 - DNA, 22 bp, Homo sapiens
gtaacattttgagcagtaggct

SEQ ID NO: 8376123 - DNA, 22 bp, Homo sapiens
gtaacattttgagcagtaggct

SEQ ID NO: 8376124 - DNA, 22 bp, Homo sapiens
gtaacatttacagttcctagag

SEQ ID NO: 8376125 - DNA, 16 bp, Homo sapiens
gtaacattctgtagcc

SEQ ID NO: 8376126 - DNA, 22 bp, Homo sapiens
gtaacattctagaaacttaaca

SEQ ID NO: 8376127 - DNA, 22 bp, Homo sapiens
gtaacattctagaaacttaaca

SEQ ID NO: 8376128 - DNA, 16 bp, Homo sapiens
gtaacattctgtagcc

SEQ ID NO: 8376129 - DNA, 22 bp, Homo sapiens
gtaacattattcatgagataca

SEQ ID NO: 8376130 - DNA, 22 bp, Homo sapiens
gggctcaggcctggcctctcac

SEQ ID NO: 8376131 - DNA, 18 bp, Homo sapiens
gggctctgatccttcacc

SEQ ID NO: 8376132 - DNA, 22 bp, Homo sapiens
cagaggaaatgggaaggagata

SEQ ID NO: 8376133 - DNA, 22 bp, Homo sapiens
cagaggaaatgggaaggagata

SEQ ID NO: 8376134 - DNA, 22 bp, Homo sapiens
cagaggaacgtttggattgatt

SEQ ID NO: 8376135 - DNA, 22 bp, Homo sapiens
cagaggaagagatacaagccct

SEQ ID NO: 8376136 - DNA, 22 bp, Homo sapiens
cagagctttttacattaatgat

SEQ ID NO: 8376137 - DNA, 22 bp, Homo sapiens
cagagctgtcatttgccagtga

SEQ ID NO: 8376138 - DNA, 22 bp, Homo sapiens
cagaggcagccgggggagaacg

SEQ ID NO: 8376139 - DNA, 22 bp, Homo sapiens
cagaggcagaggtcatctctgg

SEQ ID NO: 8376140 - DNA, 22 bp, Homo sapiens
gggggcagtaacctcaaagtgt

SEQ ID NO: 8376141 - DNA, 22 bp, Homo sapiens
gggggcagtaacctcaaagtgt

SEQ ID NO: 8376142 - DNA, 19 bp, Homo sapiens
cagaggcactttctcttag

SEQ ID NO: 8376143 - DNA, 22 bp, Homo sapiens
cagaggacctgtgtggccagag

SEQ ID NO: 8376144 - DNA, 22 bp, Homo sapiens
cagaggaagcagacacatcttg

SEQ ID NO: 8376145 - DNA, 22 bp, Homo sapiens
cagaggaagcagacacatcttg

SEQ ID NO: 8376146 - DNA, 22 bp, Homo sapiens
cagaggaagctgggtgtggagt

SEQ ID NO: 8376147 - DNA, 22 bp, Homo sapiens
cagaggaagttccttgatgaga

SEQ ID NO: 8376148 - DNA, 23 bp, Homo sapiens
cagaagcacctgttgactgctgc

SEQ ID NO: 8376149 - DNA, 22 bp, Homo sapiens
cagaagcagaacactagattta

SEQ ID NO: 8376150 - DNA, 22 bp, Homo sapiens
cagaagcaagtagtgattcttt

SEQ ID NO: 8376151 - DNA, 22 bp, Homo sapiens
cagaagatgctttgtaaaatga

SEQ ID NO: 8376152 - DNA, 22 bp, Homo sapiens
cagaagagtagctgaacaagtt

SEQ ID NO: 8376153 - DNA, 22 bp, Homo sapiens
cagagacctgcccatttacgct

SEQ ID NO: 8376154 - DNA, 20 bp, Homo sapiens
cagagacctgtcttcacaga

SEQ ID NO: 8376155 - DNA, 18 bp, Homo sapiens
cagaagcaggcagtgcag

SEQ ID NO: 8376156 - DNA, 22 bp, Homo sapiens
cagagacagtttcacagggtct

SEQ ID NO: 8376157 - DNA, 22 bp, Homo sapiens
cagagagaatcttggcagctga

SEQ ID NO: 8376158 - DNA, 22 bp, Homo sapiens
cagagagaatcttggcagctga

SEQ ID NO: 8376159 - DNA, 22 bp, Homo sapiens
cagagagagcaggaaacctccg

SEQ ID NO: 8376160 - DNA, 19 bp, Homo sapiens
cagagagaccaaggcgcca

SEQ ID NO: 8376161 - DNA, 22 bp, Homo sapiens
cagagagagtctgtccctgaag

SEQ ID NO: 8376162 - DNA, 22 bp, Homo sapiens
cagagagaggggctgcctggcc

SEQ ID NO: 8376163 - DNA, 22 bp, Homo sapiens
cagagagaggggctgcctggcc

SEQ ID NO: 8376164 - DNA, 22 bp, Homo sapiens
cagagagagtggggtgtggatt

SEQ ID NO: 8376165 - DNA, 22 bp, Homo sapiens
cagagagagtggggtgtggatt

SEQ ID NO: 8376166 - DNA, 22 bp, Homo sapiens
cagagagagtctgtccctgaag

SEQ ID NO: 8376167 - DNA, 21 bp, Homo sapiens
cagagagctagaacttcatga

SEQ ID NO: 8376168 - DNA, 16 bp, Homo sapiens
cagagaggacagaggc

SEQ ID NO: 8376169 - DNA, 22 bp, Homo sapiens
gggccaggagtggagatatggg

SEQ ID NO: 8376170 - DNA, 18 bp, Homo sapiens
cagagcagaggtggagcg

SEQ ID NO: 8376171 - DNA, 22 bp, Homo sapiens
cagagcagatttctaagtattg

SEQ ID NO: 8376172 - DNA, 22 bp, Homo sapiens
gggccctggctttcctgttctt

SEQ ID NO: 8376173 - DNA, 22 bp, Homo sapiens
cagagcaggcccactgccctcc

SEQ ID NO: 8376174 - DNA, 22 bp, Homo sapiens
cagagcaggaatagggtgttga

SEQ ID NO: 8376175 - DNA, 22 bp, Homo sapiens
cagagcaggaatagggtgttga

SEQ ID NO: 8376176 - DNA, 22 bp, Homo sapiens
cagagcagcctccagggggagc

SEQ ID NO: 8376177 - DNA, 22 bp, Homo sapiens
cagagcagcctccagggggagc

SEQ ID NO: 8376178 - DNA, 22 bp, Homo sapiens
cagagcagcctccagggggagc

SEQ ID NO: 8376179 - DNA, 22 bp, Homo sapiens
caatggcctcccaagcaggggg

SEQ ID NO: 8376180 - DNA, 22 bp, Homo sapiens
caatggctggagacaatctgct

SEQ ID NO: 8376181 - DNA, 22 bp, Homo sapiens
caatggctttatgtatcatctc

SEQ ID NO: 8376182 - DNA, 22 bp, Homo sapiens
caatgcttgctgactccctgtc

SEQ ID NO: 8376183 - DNA, 22 bp, Homo sapiens
caatgcttctgagggaattaca

SEQ ID NO: 8376184 - DNA, 22 bp, Homo sapiens
caatgctttatttcctcccctt

SEQ ID NO: 8376185 - DNA, 22 bp, Homo sapiens
caatgcttttagcttcagcttg

SEQ ID NO: 8376186 - DNA, 22 bp, Homo sapiens
caatgtaaatattttctaatca

SEQ ID NO: 8376187 - DNA, 20 bp, Homo sapiens
gcttccagaggaggccccgt

SEQ ID NO: 8376188 - DNA, 22 bp, Homo sapiens
gcttccagatcccatgctctta

SEQ ID NO: 8376189 - DNA, 22 bp, Homo sapiens
gcttccagagactgagctcttc

SEQ ID NO: 8376190 - DNA, 22 bp, Homo sapiens
gcttccagacgatcatgtaaga

SEQ ID NO: 8376191 - DNA, 22 bp, Homo sapiens
ggaacacaaatgggagagctgg

SEQ ID NO: 8376192 - DNA, 22 bp, Homo sapiens
ggaacacagtgccttacaaact

SEQ ID NO: 8376193 - DNA, 22 bp, Homo sapiens
ggaaatggtggaggaaggctta

SEQ ID NO: 8376194 - DNA, 22 bp, Homo sapiens
gcttccaggcttcctacctttg

SEQ ID NO: 8376195 - DNA, 22 bp, Homo sapiens
gcttccagggctcagtcactgc

SEQ ID NO: 8376196 - DNA, 22 bp, Homo sapiens
ggaaatcttccttcactctttc

SEQ ID NO: 8376197 - DNA, 22 bp, Homo sapiens
ggaaacaaaccactcatggtgg

SEQ ID NO: 8376198 - DNA, 22 bp, Homo sapiens
ggaaatctggtggtagatggga

SEQ ID NO: 8376199 - DNA, 19 bp, Homo sapiens
gcttccagcactgcaggag

SEQ ID NO: 8376200 - DNA, 19 bp, Homo sapiens
gcttccagcactgcaggag

SEQ ID NO: 8376201 - DNA, 22 bp, Homo sapiens
gcttccagcaccagcagagggg

SEQ ID NO: 8376202 - DNA, 22 bp, Homo sapiens
gctgggctcaccaggccactag

SEQ ID NO: 8376203 - DNA, 22 bp, Homo sapiens
caagtggggcagattctcttcc

SEQ ID NO: 8376204 - DNA, 22 bp, Homo sapiens
caagtgtgtaattactgggagc

SEQ ID NO: 8376205 - DNA, 22 bp, Homo sapiens
caagtgtcttcaaaggctaaaa

SEQ ID NO: 8376206 - DNA, 22 bp, Homo sapiens
caagtgtccatgatagtcttag

SEQ ID NO: 8376207 - DNA, 22 bp, Homo sapiens
caagttcattgtagcattattg

SEQ ID NO: 8376208 - DNA, 22 bp, Homo sapiens
caagttcaagtcctggctctgc

SEQ ID NO: 8376209 - DNA, 22 bp, Homo sapiens
gctggtctccgccgctccctga

SEQ ID NO: 8376210 - DNA, 17 bp, Homo sapiens
gctggtccttggtaact

SEQ ID NO: 8376211 - DNA, 22 bp, Homo sapiens
gctggtggcagagctccgcggc

SEQ ID NO: 8376212 - DNA, 22 bp, Homo sapiens
gctggtggcagagacatcaggt

SEQ ID NO: 8376213 - DNA, 22 bp, Homo sapiens
gctggtgctctgggccctgagg

SEQ ID NO: 8376214 - DNA, 22 bp, Homo sapiens
caatctataaatatcagtttcc

SEQ ID NO: 8376215 - DNA, 22 bp, Homo sapiens
gctgggagcaaagccatgcata

SEQ ID NO: 8376216 - DNA, 22 bp, Homo sapiens
gctgggagccccgagccagcgc

SEQ ID NO: 8376217 - DNA, 22 bp, Homo sapiens
gctgggagccgtacctgtcacg

SEQ ID NO: 8376218 - DNA, 22 bp, Homo sapiens
gctgggagccgtacctgtcacg

SEQ ID NO: 8376219 - DNA, 22 bp, Homo sapiens
gctgggagccgtacctgtcacg

SEQ ID NO: 8376220 - DNA, 22 bp, Homo sapiens
gctgggaggaatttggggaata

SEQ ID NO: 8376221 - DNA, 22 bp, Homo sapiens
gctgggccagagcagcagcact

SEQ ID NO: 8376222 - DNA, 22 bp, Homo sapiens
gctgggcccagatcccaggatc

SEQ ID NO: 8376223 - DNA, 20 bp, Homo sapiens
gctgggctaccactggccct

SEQ ID NO: 8376224 - DNA, 22 bp, Homo sapiens
gctgggccccttgaaaggcgtc

SEQ ID NO: 8376225 - DNA, 22 bp, Homo sapiens
gctggcagagagctggtgagga

SEQ ID NO: 8376226 - DNA, 22 bp, Homo sapiens
gctggcagagagctggtgagga

SEQ ID NO: 8376227 - DNA, 22 bp, Homo sapiens
gctggcagagctctgggctggg

SEQ ID NO: 8376228 - DNA, 22 bp, Homo sapiens
gctggcagagctctgggctggg

SEQ ID NO: 8376229 - DNA, 22 bp, Homo sapiens
gctggcagccaagtgaagaggg

SEQ ID NO: 8376230 - DNA, 22 bp, Homo sapiens
gctggcagccaagtgaagaggg

SEQ ID NO: 8376231 - DNA, 19 bp, Homo sapiens
gctggcagatgtggccgtg

SEQ ID NO: 8376232 - DNA, 20 bp, Homo sapiens
gctggcagatgtcttgagat

SEQ ID NO: 8376233 - DNA, 20 bp, Homo sapiens
gctggcagatgtcttgagat

SEQ ID NO: 8376234 - DNA, 22 bp, Homo sapiens
gctggcagcattagaccctggg

SEQ ID NO: 8376235 - DNA, 22 bp, Homo sapiens
gctggcagcattagaccctggg

SEQ ID NO: 8376236 - DNA, 22 bp, Homo sapiens
caaatttaagtgaggtctttgt

SEQ ID NO: 8376237 - DNA, 22 bp, Homo sapiens
caaattcagaaaattggtagag

SEQ ID NO: 8376238 - DNA, 22 bp, Homo sapiens
caaatttaggtaacagtctgta

SEQ ID NO: 8376239 - DNA, 22 bp, Homo sapiens
caaatttaggtaacagtctgta

SEQ ID NO: 8376240 - DNA, 22 bp, Homo sapiens
cacagcctttagggtacacaca

SEQ ID NO: 8376241 - DNA, 22 bp, Homo sapiens
cacagccttgagcgaggacaag

SEQ ID NO: 8376242 - DNA, 22 bp, Homo sapiens
cacagcctttagggtacacaca

SEQ ID NO: 8376243 - DNA, 22 bp, Homo sapiens
cacagcctttagggtacacaca

SEQ ID NO: 8376244 - DNA, 22 bp, Homo sapiens
cacagcctgctgcactcaagaa

SEQ ID NO: 8376245 - DNA, 22 bp, Homo sapiens
cacagccttactgagatccact

SEQ ID NO: 8376246 - DNA, 22 bp, Homo sapiens
cacagccttactgagatccact

SEQ ID NO: 8376247 - DNA, 22 bp, Homo sapiens
cacagccttgagcgaggacaag

SEQ ID NO: 8376248 - DNA, 22 bp, Homo sapiens
cacagccttgagcgaggacaag

SEQ ID NO: 8376249 - DNA, 22 bp, Homo sapiens
cacagccttactgagatccact

SEQ ID NO: 8376250 - DNA, 22 bp, Homo sapiens
cacagcctccttcagagagcat

SEQ ID NO: 8376251 - DNA, 22 bp, Homo sapiens
cacagcctccttcagagagcat

SEQ ID NO: 8376252 - DNA, 22 bp, Homo sapiens
cacagcctcctctggctcacgg

SEQ ID NO: 8376253 - DNA, 22 bp, Homo sapiens
ggagggcaacttttcagtaggt

SEQ ID NO: 8376254 - DNA, 22 bp, Homo sapiens
ggaggggcagccatggaactcc

SEQ ID NO: 8376255 - DNA, 22 bp, Homo sapiens
ggaggggccggctgcctgccac

SEQ ID NO: 8376256 - DNA, 22 bp, Homo sapiens
cacaggagaggttaatgggggc

SEQ ID NO: 8376257 - DNA, 22 bp, Homo sapiens
cacaggagagctgggaggtgcc

SEQ ID NO: 8376258 - DNA, 22 bp, Homo sapiens
cacaggagagctgggaggtgcc

SEQ ID NO: 8376259 - DNA, 22 bp, Homo sapiens
cacaggagagctgggaggtgcc

SEQ ID NO: 8376260 - DNA, 22 bp, Homo sapiens
cacaggagagctgggaggtgcc

SEQ ID NO: 8376261 - DNA, 22 bp, Homo sapiens
ggaggagagaggttgcaaacac

SEQ ID NO: 8376262 - DNA, 22 bp, Homo sapiens
ggaggagattcccctctcactt

SEQ ID NO: 8376263 - DNA, 22 bp, Homo sapiens
ggagcagcttgcatgctcaggg

SEQ ID NO: 8376264 - DNA, 22 bp, Homo sapiens
ggagcagcttgcatgctcaggg

SEQ ID NO: 8376265 - DNA, 22 bp, Homo sapiens
ggagcagcttgcatgctcaggg

SEQ ID NO: 8376266 - DNA, 22 bp, Homo sapiens
cacagccatgtcctcattcttc

SEQ ID NO: 8376267 - DNA, 22 bp, Homo sapiens
ggagcagccacgtctcagggca

SEQ ID NO: 8376268 - DNA, 22 bp, Homo sapiens
ggagcagccgcgtctcagggca

SEQ ID NO: 8376269 - DNA, 22 bp, Homo sapiens
cacagcataatgaaatatactt

SEQ ID NO: 8376270 - DNA, 23 bp, Homo sapiens
ggacacagagataagtgagacaa

SEQ ID NO: 8376271 - DNA, 19 bp, Homo sapiens
ggacacagaaagctgcatt

SEQ ID NO: 8376272 - DNA, 19 bp, Homo sapiens
ggacacagaaagctgcatt

SEQ ID NO: 8376273 - DNA, 22 bp, Homo sapiens
ggacacagataatcacacagat

SEQ ID NO: 8376274 - DNA, 22 bp, Homo sapiens
ggacagagggttgacagagtat

SEQ ID NO: 8376275 - DNA, 22 bp, Homo sapiens
ggaagagaggttcagccctaag

SEQ ID NO: 8376276 - DNA, 22 bp, Homo sapiens
ggaagagattctttacattcat

SEQ ID NO: 8376277 - DNA, 19 bp, Homo sapiens
ggaagagaggaaaggtgga

SEQ ID NO: 8376278 - DNA, 22 bp, Homo sapiens
ggaagagagatcccatagatgt

SEQ ID NO: 8376279 - DNA, 22 bp, Homo sapiens
ggaacactgtggttccatagca

SEQ ID NO: 8376280 - DNA, 22 bp, Homo sapiens
ggaacaggaaaggagggatgct

SEQ ID NO: 8376281 - DNA, 22 bp, Homo sapiens
ggaagagaatgatggctatggg

SEQ ID NO: 8376282 - DNA, 22 bp, Homo sapiens
ggaagagaaatgagtcaagact

SEQ ID NO: 8376283 - DNA, 22 bp, Homo sapiens
ggaacagggatttggcctggtt

SEQ ID NO: 8376284 - DNA, 22 bp, Homo sapiens
ggaagagaaatgagtcaagact

SEQ ID NO: 8376285 - DNA, 22 bp, Homo sapiens
ggaagagaaatgagtcaagact

SEQ ID NO: 8376286 - DNA, 22 bp, Homo sapiens
ggagatactatctttacaattc

SEQ ID NO: 8376287 - DNA, 22 bp, Homo sapiens
cacagagaactgtgggagtgtg

SEQ ID NO: 8376288 - DNA, 22 bp, Homo sapiens
cacagagaatactgctcttgct

SEQ ID NO: 8376289 - DNA, 22 bp, Homo sapiens
cacagagacagaagcacttatg

SEQ ID NO: 8376290 - DNA, 22 bp, Homo sapiens
cacagagacagaagcacttatg

SEQ ID NO: 8376291 - DNA, 22 bp, Homo sapiens
cacagagaattcccatatgtga

SEQ ID NO: 8376292 - DNA, 22 bp, Homo sapiens
cacagagaattcccatatgtga

SEQ ID NO: 8376293 - DNA, 22 bp, Homo sapiens
cacagagacagatctattttgc

SEQ ID NO: 8376294 - DNA, 22 bp, Homo sapiens
cacagcaaaggcttcggctgat

SEQ ID NO: 8376295 - DNA, 22 bp, Homo sapiens
ggacagcccatacacatgtctg

SEQ ID NO: 8376296 - DNA, 22 bp, Homo sapiens
ggacagcattcctagttccaaa

SEQ ID NO: 8376297 - DNA, 22 bp, Homo sapiens
ggacagcattctactgtaggca

SEQ ID NO: 8376298 - DNA, 22 bp, Homo sapiens
ggacagcatatcagcagggcag

SEQ ID NO: 8376299 - DNA, 22 bp, Homo sapiens
ggacagcatatcagcagggcag

SEQ ID NO: 8376300 - DNA, 22 bp, Homo sapiens
ggacagcacagctcttgacaac

SEQ ID NO: 8376301 - DNA, 22 bp, Homo sapiens
ggacagcatatcagcagggcag

SEQ ID NO: 8376302 - DNA, 18 bp, Homo sapiens
ggagagtgacagagtcgt

SEQ ID NO: 8376303 - DNA, 18 bp, Homo sapiens
ggagagtgacagagtcgt

SEQ ID NO: 8376304 - DNA, 18 bp, Homo sapiens
ggagagtgacagagtcgt

SEQ ID NO: 8376305 - DNA, 22 bp, Homo sapiens
ggagagtctgagcctgctggag

SEQ ID NO: 8376306 - DNA, 22 bp, Homo sapiens
ggagagtctgagcctgctggag

SEQ ID NO: 8376307 - DNA, 22 bp, Homo sapiens
ggagagctgaagcatggacagg

SEQ ID NO: 8376308 - DNA, 22 bp, Homo sapiens
ggagagctgacatcatgatgtt

SEQ ID NO: 8376309 - DNA, 22 bp, Homo sapiens
ggccagctcagggtccttgggc

SEQ ID NO: 8376310 - DNA, 22 bp, Homo sapiens
cacccagccttcacacaggagt

SEQ ID NO: 8376311 - DNA, 22 bp, Homo sapiens
ggccagggccaaggctttccca

SEQ ID NO: 8376312 - DNA, 22 bp, Homo sapiens
cacccaggctagagtgcagtgg

SEQ ID NO: 8376313 - DNA, 22 bp, Homo sapiens
cacccaggcaggtggctgagaa

SEQ ID NO: 8376314 - DNA, 22 bp, Homo sapiens
cacccaggaggttgggaagggc

SEQ ID NO: 8376315 - DNA, 21 bp, Homo sapiens
cacatttgaacctcacagcaa

SEQ ID NO: 8376316 - DNA, 22 bp, Homo sapiens
cacatttgggacaggagataaa

SEQ ID NO: 8376317 - DNA, 19 bp, Homo sapiens
cacattttgagtctgagat

SEQ ID NO: 8376318 - DNA, 19 bp, Homo sapiens
cacattttgagtctgagat

SEQ ID NO: 8376319 - DNA, 19 bp, Homo sapiens
cacattttgagtctgagat

SEQ ID NO: 8376320 - DNA, 22 bp, Homo sapiens
caccactgaattgttcactttc

SEQ ID NO: 8376321 - DNA, 22 bp, Homo sapiens
ggccagcctggggctcccagac

SEQ ID NO: 8376322 - DNA, 22 bp, Homo sapiens
ggcccagcccgagtcagccttc

SEQ ID NO: 8376323 - DNA, 22 bp, Homo sapiens
ggccccagcagaccctcctctg

SEQ ID NO: 8376324 - DNA, 22 bp, Homo sapiens
ggccccagcagaccctcctctg

SEQ ID NO: 8376325 - DNA, 22 bp, Homo sapiens
ggcccagcatcttgtgaagttt

SEQ ID NO: 8376326 - DNA, 21 bp, Homo sapiens
ggccccagcccatgggttctc

SEQ ID NO: 8376327 - DNA, 22 bp, Homo sapiens
ggccccagcctcagtcccctga

SEQ ID NO: 8376328 - DNA, 22 bp, Homo sapiens
ggccccagcctcagtcccctga

SEQ ID NO: 8376329 - DNA, 19 bp, Homo sapiens
ggccccagccagggtatca

SEQ ID NO: 8376330 - DNA, 22 bp, Homo sapiens
ggccccagcagtgcttgtttat

SEQ ID NO: 8376331 - DNA, 22 bp, Homo sapiens
ggcccagagctccctggcacct

SEQ ID NO: 8376332 - DNA, 22 bp, Homo sapiens
ggcccagcacagtgcttggggg

SEQ ID NO: 8376333 - DNA, 22 bp, Homo sapiens
ggcccagcacagtgcttggggg

SEQ ID NO: 8376334 - DNA, 22 bp, Homo sapiens
ggccccagcttcaaccccgtgg

SEQ ID NO: 8376335 - DNA, 22 bp, Homo sapiens
ggccccagctgtggtgaataga

SEQ ID NO: 8376336 - DNA, 22 bp, Homo sapiens
ggccccaggacctccacggtcc

SEQ ID NO: 8376337 - DNA, 22 bp, Homo sapiens
ggccccagggattaggccaacc

SEQ ID NO: 8376338 - DNA, 22 bp, Homo sapiens
ggccccaggcctttggtctggc

SEQ ID NO: 8376339 - DNA, 22 bp, Homo sapiens
ggccccagggaagaaggtggtc

SEQ ID NO: 8376340 - DNA, 22 bp, Homo sapiens
ggcgccagcggtaagtaagaca

SEQ ID NO: 8376341 - DNA, 22 bp, Homo sapiens
ggcgccagcggtaagtaagaca

SEQ ID NO: 8376342 - DNA, 22 bp, Homo sapiens
ggcgccagcactgcagcgcctc

SEQ ID NO: 8376343 - DNA, 22 bp, Homo sapiens
ggcgccagcactgcagcgcctc

SEQ ID NO: 8376344 - DNA, 22 bp, Homo sapiens
ggcgagggagcagtgcggtggg

SEQ ID NO: 8376345 - DNA, 22 bp, Homo sapiens
ggcgaggccgggacaggctgga

SEQ ID NO: 8376346 - DNA, 20 bp, Homo sapiens
ggcaggacccggtagggagc

SEQ ID NO: 8376347 - DNA, 20 bp, Homo sapiens
ggcaggaccccagtggcatc

SEQ ID NO: 8376348 - DNA, 22 bp, Homo sapiens
ggcaggagaaaggtctcttctt

SEQ ID NO: 8376349 - DNA, 23 bp, Homo sapiens
cacatgcaggcagtggccttcaa

SEQ ID NO: 8376350 - DNA, 22 bp, Homo sapiens
cacatgcataaggataattact

SEQ ID NO: 8376351 - DNA, 22 bp, Homo sapiens
cacatgcatacctatgtgtata

SEQ ID NO: 8376352 - DNA, 22 bp, Homo sapiens
cacatgcagttttccagcagtc

SEQ ID NO: 8376353 - DNA, 22 bp, Homo sapiens
cacatgcattggcaaaagtgta

SEQ ID NO: 8376354 - DNA, 22 bp, Homo sapiens
cacatgcatctgtcatgtttgg

SEQ ID NO: 8376355 - DNA, 22 bp, Homo sapiens
ggcaggtgtggtgaccagagat

SEQ ID NO: 8376356 - DNA, 22 bp, Homo sapiens
ggcaggtgtgagatcgaggcca

SEQ ID NO: 8376357 - DNA, 22 bp, Homo sapiens
ggcaggtgtggtgaccagagat

SEQ ID NO: 8376358 - DNA, 22 bp, Homo sapiens
ggcagtagccagggactggcag

SEQ ID NO: 8376359 - DNA, 22 bp, Homo sapiens
ggcagtcaagagggagtctgaa

SEQ ID NO: 8376360 - DNA, 22 bp, Homo sapiens
cacatttctaggaaattaaatg

SEQ ID NO: 8376361 - DNA, 22 bp, Homo sapiens
ggcagtcacttttgcttgtgcc

SEQ ID NO: 8376362 - DNA, 22 bp, Homo sapiens
ggcagtcacaggggagactggg

SEQ ID NO: 8376363 - DNA, 19 bp, Homo sapiens
ggcagtcacggtcaggagc

SEQ ID NO: 8376364 - DNA, 22 bp, Homo sapiens
cacatttctctacctcacacaa

SEQ ID NO: 8376365 - DNA, 22 bp, Homo sapiens
ggcaggaagaggagggtgaact

SEQ ID NO: 8376366 - DNA, 22 bp, Homo sapiens
ggcaggaagaggagggtgaact

SEQ ID NO: 8376367 - DNA, 22 bp, Homo sapiens
ggcagctgcaaatctgctctgt

SEQ ID NO: 8376368 - DNA, 22 bp, Homo sapiens
ggatcctgatatgtgtttctca

SEQ ID NO: 8376369 - DNA, 22 bp, Homo sapiens
ggcagcttttatccctgacaga

SEQ ID NO: 8376370 - DNA, 22 bp, Homo sapiens
ggcaggaaaacaatgagccagg

SEQ ID NO: 8376371 - DNA, 22 bp, Homo sapiens
ggagtgactcacagctgggaca

SEQ ID NO: 8376372 - DNA, 22 bp, Homo sapiens
ggagtgaatcactagatgcaga

SEQ ID NO: 8376373 - DNA, 22 bp, Homo sapiens
ggagtgaagcaaataatgctgg

SEQ ID NO: 8376374 - DNA, 22 bp, Homo sapiens
ggagtctgttttacatgcagga

SEQ ID NO: 8376375 - DNA, 22 bp, Homo sapiens
ggagtctgggaattggagagaa

SEQ ID NO: 8376376 - DNA, 22 bp, Homo sapiens
ggagtctgggaattggagagaa

SEQ ID NO: 8376377 - DNA, 22 bp, Homo sapiens
cacaggagattgatctattggt

SEQ ID NO: 8376378 - DNA, 20 bp, Homo sapiens
ggctgctggtttggctctgt

SEQ ID NO: 8376379 - DNA, 21 bp, Homo sapiens
ggctgctgtcaccgctgtcac

SEQ ID NO: 8376380 - DNA, 22 bp, Homo sapiens
cagaaatagacaatggcagtgg

SEQ ID NO: 8376381 - DNA, 22 bp, Homo sapiens
cagaaatggtctgttcagctta

SEQ ID NO: 8376382 - DNA, 22 bp, Homo sapiens
cagaaatgtttatgcttttgaa

SEQ ID NO: 8376383 - DNA, 22 bp, Homo sapiens
cagaaatgtactgacatgcagt

SEQ ID NO: 8376384 - DNA, 22 bp, Homo sapiens
cagaacagaaacgttgttccat

SEQ ID NO: 8376385 - DNA, 22 bp, Homo sapiens
cagaacagaaacgttgttccat

SEQ ID NO: 8376386 - DNA, 23 bp, Homo sapiens
ggctgggagctccgggtgcacgt

SEQ ID NO: 8376387 - DNA, 22 bp, Homo sapiens
ggctgggagccccacagagtca

SEQ ID NO: 8376388 - DNA, 19 bp, Homo sapiens
cagaacagaggtcatggcc

SEQ ID NO: 8376389 - DNA, 23 bp, Homo sapiens
cagaacagtaaaagatgccatgg

SEQ ID NO: 8376390 - DNA, 22 bp, Homo sapiens
cagaacagtacctagcacatag

SEQ ID NO: 8376391 - DNA, 22 bp, Homo sapiens
cagaacagtacctagcacatag

SEQ ID NO: 8376392 - DNA, 22 bp, Homo sapiens
cagaagaggactgggtagctca

SEQ ID NO: 8376393 - DNA, 22 bp, Homo sapiens
cagaagagtagctgaacaagtt

SEQ ID NO: 8376394 - DNA, 22 bp, Homo sapiens
cagaagagtagctgaacaagtt

SEQ ID NO: 8376395 - DNA, 22 bp, Homo sapiens
cagaacagtcgcctgcatggat

SEQ ID NO: 8376396 - DNA, 22 bp, Homo sapiens
ggcttggaaattgcaggacaca

SEQ ID NO: 8376397 - DNA, 22 bp, Homo sapiens
cagaacagacttaacagggctg

SEQ ID NO: 8376398 - DNA, 22 bp, Homo sapiens
ggcttgcacacagcctcagttt

SEQ ID NO: 8376399 - DNA, 22 bp, Homo sapiens
ggctgggagctggacaggccgg

SEQ ID NO: 8376400 - DNA, 22 bp, Homo sapiens
ggcttcttcctggctcctatta

SEQ ID NO: 8376401 - DNA, 22 bp, Homo sapiens
ggcttcttgctattttccaatg

SEQ ID NO: 8376402 - DNA, 22 bp, Homo sapiens
ggctccagtttccccttggggc

SEQ ID NO: 8376403 - DNA, 20 bp, Homo sapiens
cactgaggtgcagctcatgc

SEQ ID NO: 8376404 - DNA, 20 bp, Homo sapiens
cactgaggtgcagctcatgc

SEQ ID NO: 8376405 - DNA, 22 bp, Homo sapiens
cactgaggtttgttaactgagt

SEQ ID NO: 8376406 - DNA, 21 bp, Homo sapiens
cactgaggtcaggggtagggt

SEQ ID NO: 8376407 - DNA, 22 bp, Homo sapiens
ggcgcggagctggcttttggcc

SEQ ID NO: 8376408 - DNA, 22 bp, Homo sapiens
cactgagggcggagcccaggga

SEQ ID NO: 8376409 - DNA, 22 bp, Homo sapiens
cactgcccaggacctgccaccc

SEQ ID NO: 8376410 - DNA, 20 bp, Homo sapiens
cactgccctccagcctgagc

SEQ ID NO: 8376411 - DNA, 22 bp, Homo sapiens
cactgtccctgtttcctggaaa

SEQ ID NO: 8376412 - DNA, 19 bp, Homo sapiens
cactgtcctagtcgaggcc

SEQ ID NO: 8376413 - DNA, 22 bp, Homo sapiens
cactgcctccccaggctccaca

SEQ ID NO: 8376414 - DNA, 22 bp, Homo sapiens
ggctgcctcaattaatcttaca

SEQ ID NO: 8376415 - DNA, 22 bp, Homo sapiens
ggctgccttgaccctggctccg

SEQ ID NO: 8376416 - DNA, 22 bp, Homo sapiens
ggctgcctcagatttgctgact

SEQ ID NO: 8376417 - DNA, 22 bp, Homo sapiens
cactgtgaaaaatggagtggtc

SEQ ID NO: 8376418 - DNA, 22 bp, Homo sapiens
ggctgcctttagaacggatgct

SEQ ID NO: 8376419 - DNA, 19 bp, Homo sapiens
ggctgcctttccttaccag

SEQ ID NO: 8376420 - DNA, 22 bp, Homo sapiens
ggctgctcacgcagccctccct

SEQ ID NO: 8376421 - DNA, 21 bp, Homo sapiens
ggctgctcacctaggtcccaa

SEQ ID NO: 8376422 - DNA, 22 bp, Homo sapiens
ggctgctcaaggactctgatcg

SEQ ID NO: 8376423 - DNA, 18 bp, Homo sapiens
ggctgctcctctccctac

SEQ ID NO: 8376424 - DNA, 22 bp, Homo sapiens
ggctgctcctttaccctggcag

SEQ ID NO: 8376425 - DNA, 22 bp, Homo sapiens
cttgagaatcttgatgtctacc

SEQ ID NO: 8376426 - DNA, 22 bp, Homo sapiens
cttgagaatcttgatgtctacc

SEQ ID NO: 8376427 - DNA, 22 bp, Homo sapiens
cttgagaatcttgatgtctacc

SEQ ID NO: 8376428 - DNA, 22 bp, Homo sapiens
cttgagaacagggttaggtaac

SEQ ID NO: 8376429 - DNA, 22 bp, Homo sapiens
cttgagaagagatttatatttg

SEQ ID NO: 8376430 - DNA, 22 bp, Homo sapiens
atcttcccaggctggggagagg

SEQ ID NO: 8376431 - DNA, 22 bp, Homo sapiens
cttgagaaaggaacaggaagct

SEQ ID NO: 8376432 - DNA, 22 bp, Homo sapiens
atcttcaattgaaaactagcct

SEQ ID NO: 8376433 - DNA, 22 bp, Homo sapiens
atcttcaaggaaaaaatacagt

SEQ ID NO: 8376434 - DNA, 22 bp, Homo sapiens
atcttcaactttggggctgcct

SEQ ID NO: 8376435 - DNA, 22 bp, Homo sapiens
cttgagctgaagccagttgaaa

SEQ ID NO: 8376436 - DNA, 23 bp, Homo sapiens
cttgagctcaggaagagctgagt

SEQ ID NO: 8376437 - DNA, 18 bp, Homo sapiens
cttgagctaagggacccc

SEQ ID NO: 8376438 - DNA, 22 bp, Homo sapiens
atgaagttctcaataatcatgt

SEQ ID NO: 8376439 - DNA, 22 bp, Homo sapiens
cttgaggttttgactcagcttt

SEQ ID NO: 8376440 - DNA, 22 bp, Homo sapiens
atgaatcaaagttcatttgatc

SEQ ID NO: 8376441 - DNA, 22 bp, Homo sapiens
atgaattgaggaaaacagtcgt

SEQ ID NO: 8376442 - DNA, 22 bp, Homo sapiens
gaaaaccacctcccatcaagca

SEQ ID NO: 8376443 - DNA, 22 bp, Homo sapiens
gaaaaccacctcccatcaagca

SEQ ID NO: 8376444 - DNA, 22 bp, Homo sapiens
gaaaacatccagagatagacct

SEQ ID NO: 8376445 - DNA, 22 bp, Homo sapiens
atgaatgctgaattatgaactg

SEQ ID NO: 8376446 - DNA, 22 bp, Homo sapiens
atgaatgctgggacaaatatat

SEQ ID NO: 8376447 - DNA, 22 bp, Homo sapiens
atgaatgctgggacaaatatat

SEQ ID NO: 8376448 - DNA, 22 bp, Homo sapiens
atgaatgcttattaaattgaaa

SEQ ID NO: 8376449 - DNA, 22 bp, Homo sapiens
atgaatgcatgcttattttgca

SEQ ID NO: 8376450 - DNA, 22 bp, Homo sapiens
atgaatgcagcactgtttttct

SEQ ID NO: 8376451 - DNA, 22 bp, Homo sapiens
gaaaactaacggaaaagttagg

SEQ ID NO: 8376452 - DNA, 22 bp, Homo sapiens
gaaaactaacggaaaagttagg

SEQ ID NO: 8376453 - DNA, 22 bp, Homo sapiens
gaaaagagaacatctgaggatc

SEQ ID NO: 8376454 - DNA, 22 bp, Homo sapiens
gaaaatagttcatcacaatgat

SEQ ID NO: 8376455 - DNA, 22 bp, Homo sapiens
gaaaatctgcttatattatttt

SEQ ID NO: 8376456 - DNA, 22 bp, Homo sapiens
gaaaataggctgcatctccttc

SEQ ID NO: 8376457 - DNA, 22 bp, Homo sapiens
atgcaaatgcagccattgcaga

SEQ ID NO: 8376458 - DNA, 22 bp, Homo sapiens
gaagaaagattggcatgcttca

SEQ ID NO: 8376459 - DNA, 22 bp, Homo sapiens
gaagaaagggaattaacttgag

SEQ ID NO: 8376460 - DNA, 22 bp, Homo sapiens
gaagaaactgaaaggggttggt

SEQ ID NO: 8376461 - DNA, 22 bp, Homo sapiens
gaagaaacaggggcttggggag

SEQ ID NO: 8376462 - DNA, 22 bp, Homo sapiens
gaagaaacaggggcttggggag

SEQ ID NO: 8376463 - DNA, 22 bp, Homo sapiens
gaagaaactgaaaggggttggt

SEQ ID NO: 8376464 - DNA, 22 bp, Homo sapiens
gaagaaactgaaaggggttggt

SEQ ID NO: 8376465 - DNA, 22 bp, Homo sapiens
atgcacaacagtggctgccttg

SEQ ID NO: 8376466 - DNA, 22 bp, Homo sapiens
atgcaatcatatggcatacagc

SEQ ID NO: 8376467 - DNA, 22 bp, Homo sapiens
atgcaatgttacagaatgtact

SEQ ID NO: 8376468 - DNA, 22 bp, Homo sapiens
atgcaatatagggaagatagat

SEQ ID NO: 8376469 - DNA, 22 bp, Homo sapiens
atgcaatatagggaagatagat

SEQ ID NO: 8376470 - DNA, 22 bp, Homo sapiens
gaacatttatgatgcaatacct

SEQ ID NO: 8376471 - DNA, 22 bp, Homo sapiens
gaacatttatgatgcaatacct

SEQ ID NO: 8376472 - DNA, 23 bp, Homo sapiens
gaacattcattggttgctttaga

SEQ ID NO: 8376473 - DNA, 22 bp, Homo sapiens
gaacatttatattagatagcta

SEQ ID NO: 8376474 - DNA, 22 bp, Homo sapiens
gaacattattgtacaaatgtct

SEQ ID NO: 8376475 - DNA, 23 bp, Homo sapiens
gaacattcattggttgctttaga

SEQ ID NO: 8376476 - DNA, 22 bp, Homo sapiens
gaacattcacagactcaccatt

SEQ ID NO: 8376477 - DNA, 22 bp, Homo sapiens
gaacatacaagaattaagtaca

SEQ ID NO: 8376478 - DNA, 22 bp, Homo sapiens
atgaggcatgtgaggagaaggg

SEQ ID NO: 8376479 - DNA, 22 bp, Homo sapiens
atgaggcatctgcagtcactag

SEQ ID NO: 8376480 - DNA, 22 bp, Homo sapiens
atgaggcatctaacattgcaaa

SEQ ID NO: 8376481 - DNA, 22 bp, Homo sapiens
atgaggcatatcctcctatggt

SEQ ID NO: 8376482 - DNA, 22 bp, Homo sapiens
gaaatctgcttcttgcatagta

SEQ ID NO: 8376483 - DNA, 22 bp, Homo sapiens
gaaatcttccaatggtcacatc

SEQ ID NO: 8376484 - DNA, 22 bp, Homo sapiens
gaaatcttgctcattgtgacaa

SEQ ID NO: 8376485 - DNA, 22 bp, Homo sapiens
gaaatctttatggaaataacaa

SEQ ID NO: 8376486 - DNA, 22 bp, Homo sapiens
gaaatctttatggaaataacaa

SEQ ID NO: 8376487 - DNA, 22 bp, Homo sapiens
gaaatcttttcatctcatttga

SEQ ID NO: 8376488 - DNA, 22 bp, Homo sapiens
gaaatcttttaaccattcattt

SEQ ID NO: 8376489 - DNA, 22 bp, Homo sapiens
gaaatgaaacaggcttttaagg

SEQ ID NO: 8376490 - DNA, 22 bp, Homo sapiens
gaaatgaaatagcaccaaggtt

SEQ ID NO: 8376491 - DNA, 22 bp, Homo sapiens
gaaatgaactgattatcattgc

SEQ ID NO: 8376492 - DNA, 22 bp, Homo sapiens
gaaaatgagcctcagctacatt

SEQ ID NO: 8376493 - DNA, 22 bp, Homo sapiens
gaaatctgaacaacagctgtca

SEQ ID NO: 8376494 - DNA, 18 bp, Homo sapiens
gaaatctcaagagacaga

SEQ ID NO: 8376495 - DNA, 22 bp, Homo sapiens
atgcttttccaggagaaatata

SEQ ID NO: 8376496 - DNA, 22 bp, Homo sapiens
atgcttttccaggagaaatata

SEQ ID NO: 8376497 - DNA, 22 bp, Homo sapiens
atgcttttaactcctttatccc

SEQ ID NO: 8376498 - DNA, 22 bp, Homo sapiens
atgctttcttctttcctgtaag

SEQ ID NO: 8376499 - DNA, 22 bp, Homo sapiens
atgctttattgttaggtcatgt

SEQ ID NO: 8376500 - DNA, 22 bp, Homo sapiens
gactttggattcattatctgga

SEQ ID NO: 8376501 - DNA, 21 bp, Homo sapiens
gactttcttaccagatttttg

SEQ ID NO: 8376502 - DNA, 22 bp, Homo sapiens
gactttcttgcagaaatattcc

SEQ ID NO: 8376503 - DNA, 22 bp, Homo sapiens
gactttcttgtagtgtctgatg

SEQ ID NO: 8376504 - DNA, 22 bp, Homo sapiens
gactttctgctatactttctgt

SEQ ID NO: 8376505 - DNA, 22 bp, Homo sapiens
gactttctgctatactttctgt

SEQ ID NO: 8376506 - DNA, 22 bp, Homo sapiens
gactttctgtccagtgatttct

SEQ ID NO: 8376507 - DNA, 21 bp, Homo sapiens
gactttcttaccagatttttg

SEQ ID NO: 8376508 - DNA, 22 bp, Homo sapiens
gaccctggaactttcagcagag

SEQ ID NO: 8376509 - DNA, 22 bp, Homo sapiens
gaccctgagcaaaagcagttct

SEQ ID NO: 8376510 - DNA, 22 bp, Homo sapiens
gactttctaatgctctgtagat

SEQ ID NO: 8376511 - DNA, 22 bp, Homo sapiens
gacccgtggcaggctgcctgct

SEQ ID NO: 8376512 - DNA, 22 bp, Homo sapiens
gaccctccactcactgctgtgt

SEQ ID NO: 8376513 - DNA, 22 bp, Homo sapiens
gaccccagaggaaggggcgccg

SEQ ID NO: 8376514 - DNA, 19 bp, Homo sapiens
atgctttatgttatttctt

SEQ ID NO: 8376515 - DNA, 22 bp, Homo sapiens
gacagggaggagcagagcttct

SEQ ID NO: 8376516 - DNA, 22 bp, Homo sapiens
gacagggcgcccagcctgtttc

SEQ ID NO: 8376517 - DNA, 22 bp, Homo sapiens
gacagggcgagactcagtctca

SEQ ID NO: 8376518 - DNA, 22 bp, Homo sapiens
gacagggccaaaccggctgatc

SEQ ID NO: 8376519 - DNA, 22 bp, Homo sapiens
gacagtttaggttcaaatctca

SEQ ID NO: 8376520 - DNA, 22 bp, Homo sapiens
gacagtggttccaaggcagctt

SEQ ID NO: 8376521 - DNA, 23 bp, Homo sapiens
gacagggctgacttggcagctgc

SEQ ID NO: 8376522 - DNA, 22 bp, Homo sapiens
gacagtggtgttttccattgca

SEQ ID NO: 8376523 - DNA, 22 bp, Homo sapiens
gacagttttgctgaaattgagc

SEQ ID NO: 8376524 - DNA, 22 bp, Homo sapiens
atgcttaagctcagttatatat

SEQ ID NO: 8376525 - DNA, 22 bp, Homo sapiens
atgcttaacttcctagtctata

SEQ ID NO: 8376526 - DNA, 22 bp, Homo sapiens
atgcttaatacactgttaaagg

SEQ ID NO: 8376527 - DNA, 22 bp, Homo sapiens
atgcttgtactaaaaaaatatt

SEQ ID NO: 8376528 - DNA, 22 bp, Homo sapiens
atgccccaggaggtgccatcca

SEQ ID NO: 8376529 - DNA, 22 bp, Homo sapiens
atgccatttgctggaaggaagt

SEQ ID NO: 8376530 - DNA, 22 bp, Homo sapiens
atgccacttcattccagcctcg

SEQ ID NO: 8376531 - DNA, 22 bp, Homo sapiens
atgccacttcattccagcctcg

SEQ ID NO: 8376532 - DNA, 22 bp, Homo sapiens
atgcccaatgtcacaatttttg

SEQ ID NO: 8376533 - DNA, 22 bp, Homo sapiens
atgcccaatgtcacaatttttg

SEQ ID NO: 8376534 - DNA, 22 bp, Homo sapiens
gacagggacgaggcttcaggca

SEQ ID NO: 8376535 - DNA, 22 bp, Homo sapiens
atgcctggactgacatgcactg

SEQ ID NO: 8376536 - DNA, 22 bp, Homo sapiens
gacaggaaaggggtctgttttc

SEQ ID NO: 8376537 - DNA, 22 bp, Homo sapiens
gacaggaaatatgggggttgtt

SEQ ID NO: 8376538 - DNA, 22 bp, Homo sapiens
gacaggaaatatgggggttgtt

SEQ ID NO: 8376539 - DNA, 22 bp, Homo sapiens
atgcctctgctcttggtcctca

SEQ ID NO: 8376540 - DNA, 20 bp, Homo sapiens
atgcctctaattttgcaaac

SEQ ID NO: 8376541 - DNA, 22 bp, Homo sapiens
gaatgtcttctgttcccagctg

SEQ ID NO: 8376542 - DNA, 22 bp, Homo sapiens
atgcataagtgcagcagatttg

SEQ ID NO: 8376543 - DNA, 22 bp, Homo sapiens
gaatgtttgactaaaggtagct

SEQ ID NO: 8376544 - DNA, 20 bp, Homo sapiens
gaatgtttcacttgctccat

SEQ ID NO: 8376545 - DNA, 22 bp, Homo sapiens
atgcatataaggcacatgtatt

SEQ ID NO: 8376546 - DNA, 22 bp, Homo sapiens
atgcatactgtatgtgtattta

SEQ ID NO: 8376547 - DNA, 22 bp, Homo sapiens
atgcatatatacatacacagtc

SEQ ID NO: 8376548 - DNA, 22 bp, Homo sapiens
atgcatatagaacatttgacat

SEQ ID NO: 8376549 - DNA, 22 bp, Homo sapiens
gaagcacaaagtgtagttccga

SEQ ID NO: 8376550 - DNA, 22 bp, Homo sapiens
gaagcacatggctgtgagcaac

SEQ ID NO: 8376551 - DNA, 22 bp, Homo sapiens
gaagcacatggctgtgagcaac

SEQ ID NO: 8376552 - DNA, 22 bp, Homo sapiens
gaagcagaagtacgatttacta

SEQ ID NO: 8376553 - DNA, 23 bp, Homo sapiens
gaagcagatgtctgagtaggcag

SEQ ID NO: 8376554 - DNA, 22 bp, Homo sapiens
gaggctgttagggcctgaggta

SEQ ID NO: 8376555 - DNA, 22 bp, Homo sapiens
gaggcttcccgcccatgctgga

SEQ ID NO: 8376556 - DNA, 22 bp, Homo sapiens
gaggcttgcaccatgagcacca

SEQ ID NO: 8376557 - DNA, 22 bp, Homo sapiens
gaggcttctggaaagcctggca

SEQ ID NO: 8376558 - DNA, 22 bp, Homo sapiens
gagggaaaataaaattgcagta

SEQ ID NO: 8376559 - DNA, 22 bp, Homo sapiens
gagggaaaataaaattgcagta

SEQ ID NO: 8376560 - DNA, 22 bp, Homo sapiens
gagggaaaataaaattgcagta

SEQ ID NO: 8376561 - DNA, 22 bp, Homo sapiens
gagggaagaaagaattgatgcg

SEQ ID NO: 8376562 - DNA, 22 bp, Homo sapiens
gagggaagaaagaattgatgcg

SEQ ID NO: 8376563 - DNA, 22 bp, Homo sapiens
gagggaagaaagaattgatgcg

SEQ ID NO: 8376564 - DNA, 22 bp, Homo sapiens
gagggaagaaagaattgatgcg

SEQ ID NO: 8376565 - DNA, 22 bp, Homo sapiens
gagggaaacagatgggttgtgg

SEQ ID NO: 8376566 - DNA, 22 bp, Homo sapiens
gagggaaacagatgggttgtgg

SEQ ID NO: 8376567 - DNA, 22 bp, Homo sapiens
gagggaaaggttaatacatgat

SEQ ID NO: 8376568 - DNA, 22 bp, Homo sapiens
gagggaaaggttaatacatgat

SEQ ID NO: 8376569 - DNA, 22 bp, Homo sapiens
gagggatggtgtgagaggctca

SEQ ID NO: 8376570 - DNA, 22 bp, Homo sapiens
gaggccaagttggagaccaggt

SEQ ID NO: 8376571 - DNA, 22 bp, Homo sapiens
gaggccaactttggagaacagg

SEQ ID NO: 8376572 - DNA, 22 bp, Homo sapiens
gaggcattaaagggaatcttct

SEQ ID NO: 8376573 - DNA, 22 bp, Homo sapiens
atgtcacattggagctgctgga

SEQ ID NO: 8376574 - DNA, 22 bp, Homo sapiens
atgtcaccagtttccaaatttg

SEQ ID NO: 8376575 - DNA, 22 bp, Homo sapiens
atgtcacagttgcaacatgaat

SEQ ID NO: 8376576 - DNA, 22 bp, Homo sapiens
atgtcacatggtcacctctagc

SEQ ID NO: 8376577 - DNA, 22 bp, Homo sapiens
atgtcacatggcctgtactttg

SEQ ID NO: 8376578 - DNA, 22 bp, Homo sapiens
gaggctgtgtgtccctctggac

SEQ ID NO: 8376579 - DNA, 22 bp, Homo sapiens
gaggccacagtcctgaggcatc

SEQ ID NO: 8376580 - DNA, 22 bp, Homo sapiens
gagtccaggctgttgctcatct

SEQ ID NO: 8376581 - DNA, 22 bp, Homo sapiens
gagtccaggatttgagctctgt

SEQ ID NO: 8376582 - DNA, 22 bp, Homo sapiens
gaggtactttctggttcaggtg

SEQ ID NO: 8376583 - DNA, 22 bp, Homo sapiens
gaggtagccacagatagagact

SEQ ID NO: 8376584 - DNA, 22 bp, Homo sapiens
gaggtagcgagtggacagtgca

SEQ ID NO: 8376585 - DNA, 22 bp, Homo sapiens
gaggtaggaggtaggtattgtg

SEQ ID NO: 8376586 - DNA, 22 bp, Homo sapiens
gagggggcgtgcaaggctccgc

SEQ ID NO: 8376587 - DNA, 22 bp, Homo sapiens
gagggggcgtgcaaggctccgc

SEQ ID NO: 8376588 - DNA, 22 bp, Homo sapiens
gagggcagaaaattatgcggtg

SEQ ID NO: 8376589 - DNA, 22 bp, Homo sapiens
gagggcactgggtttcaatgtc

SEQ ID NO: 8376590 - DNA, 22 bp, Homo sapiens
gagggcactcgagactacggca

SEQ ID NO: 8376591 - DNA, 20 bp, Homo sapiens
gagggcacattgttccgtgc

SEQ ID NO: 8376592 - DNA, 22 bp, Homo sapiens
gagggcaccagaagagccagat

SEQ ID NO: 8376593 - DNA, 22 bp, Homo sapiens
gagggcaccttcagtaatagct

SEQ ID NO: 8376594 - DNA, 22 bp, Homo sapiens
gagggggtctatgaggtagagc

SEQ ID NO: 8376595 - DNA, 22 bp, Homo sapiens
gagggggctctgccaacctgtc

SEQ ID NO: 8376596 - DNA, 22 bp, Homo sapiens
gagggggctccctgaagccagt

SEQ ID NO: 8376597 - DNA, 22 bp, Homo sapiens
gagggggctccctgaagccagt

SEQ ID NO: 8376598 - DNA, 22 bp, Homo sapiens
gagggggctagcgcagtgccca

SEQ ID NO: 8376599 - DNA, 22 bp, Homo sapiens
gagggggctagcgcagtgccca

SEQ ID NO: 8376600 - DNA, 22 bp, Homo sapiens
atgtttcatgactgagcaaaat

SEQ ID NO: 8376601 - DNA, 22 bp, Homo sapiens
atgtttattgttttaagctgct

SEQ ID NO: 8376602 - DNA, 22 bp, Homo sapiens
atgtttatgttgggctatattt

SEQ ID NO: 8376603 - DNA, 22 bp, Homo sapiens
atgtttcaccagcaaattacct

SEQ ID NO: 8376604 - DNA, 22 bp, Homo sapiens
gagtccagttagtgaggctggg

SEQ ID NO: 8376605 - DNA, 20 bp, Homo sapiens
gagtccaggggcctgtagca

SEQ ID NO: 8376606 - DNA, 22 bp, Homo sapiens
gagtccagtgatgttcctggtc

SEQ ID NO: 8376607 - DNA, 17 bp, Homo sapiens
gagtgcagacacaagca

SEQ ID NO: 8376608 - DNA, 22 bp, Homo sapiens
gagtgcagatgccagccccagt

SEQ ID NO: 8376609 - DNA, 22 bp, Homo sapiens
gagtgcagatgccagccccagt

SEQ ID NO: 8376610 - DNA, 22 bp, Homo sapiens
gagtgcaggcctgagcaccatc

SEQ ID NO: 8376611 - DNA, 22 bp, Homo sapiens
gagtgcaggcctgagcaccatc

SEQ ID NO: 8376612 - DNA, 22 bp, Homo sapiens
gagttaattcgaatattctagc

SEQ ID NO: 8376613 - DNA, 22 bp, Homo sapiens
gagttagagccatagagcacgg

SEQ ID NO: 8376614 - DNA, 22 bp, Homo sapiens
gagttagaagacagaatgtaaa

SEQ ID NO: 8376615 - DNA, 22 bp, Homo sapiens
gatctgcactctgagaggcttg

SEQ ID NO: 8376616 - DNA, 22 bp, Homo sapiens
gatctggaatctgaaggctgag

SEQ ID NO: 8376617 - DNA, 22 bp, Homo sapiens
atgtttcccataagattttctg

SEQ ID NO: 8376618 - DNA, 22 bp, Homo sapiens
atgtttcatttagatatcaggc

SEQ ID NO: 8376619 - DNA, 22 bp, Homo sapiens
gatctgggagcctcatggagac

SEQ ID NO: 8376620 - DNA, 22 bp, Homo sapiens
atgtcacagttgcaacatgaat

SEQ ID NO: 8376621 - DNA, 22 bp, Homo sapiens
atgtcacaggcaacaagattgc

SEQ ID NO: 8376622 - DNA, 22 bp, Homo sapiens
atgtcacagcaggagtattctt

SEQ ID NO: 8376623 - DNA, 22 bp, Homo sapiens
atgtcaacaggcctttaaacat

SEQ ID NO: 8376624 - DNA, 22 bp, Homo sapiens
atgtacaacctgcatgacagtc

SEQ ID NO: 8376625 - DNA, 22 bp, Homo sapiens
atgtacaacctgcatgacagtc

SEQ ID NO: 8376626 - DNA, 22 bp, Homo sapiens
atgtacaatctagggtttgcat

SEQ ID NO: 8376627 - DNA, 22 bp, Homo sapiens
atgtacaagctgttttactgca

SEQ ID NO: 8376628 - DNA, 22 bp, Homo sapiens
atgtacaaaatgccactgaatt

SEQ ID NO: 8376629 - DNA, 22 bp, Homo sapiens
atgtacaaaatgttttgaaatg

SEQ ID NO: 8376630 - DNA, 22 bp, Homo sapiens
atgtacaaaatgttttgaaatg

SEQ ID NO: 8376631 - DNA, 22 bp, Homo sapiens
atgtaatttgccctcaagttaa

SEQ ID NO: 8376632 - DNA, 22 bp, Homo sapiens
atgtaattgtagcaaaatgatg

SEQ ID NO: 8376633 - DNA, 22 bp, Homo sapiens
atgtaacaaatggtatacatgt

SEQ ID NO: 8376634 - DNA, 22 bp, Homo sapiens
atgtaacattgaattatatagt

SEQ ID NO: 8376635 - DNA, 22 bp, Homo sapiens
atgtaaattgtactgacacacg

SEQ ID NO: 8376636 - DNA, 22 bp, Homo sapiens
atgtaaattgtactgacacacg

SEQ ID NO: 8376637 - DNA, 22 bp, Homo sapiens
gagcttgggtgccatgctgagc

SEQ ID NO: 8376638 - DNA, 22 bp, Homo sapiens
gagcttggtgctgcctgttgtc

SEQ ID NO: 8376639 - DNA, 22 bp, Homo sapiens
gagctctgggtgtgttgtcagt

SEQ ID NO: 8376640 - DNA, 22 bp, Homo sapiens
gaggaagctgcgtggcatttca

SEQ ID NO: 8376641 - DNA, 22 bp, Homo sapiens
gaggaagccccattgaagccag

SEQ ID NO: 8376642 - DNA, 22 bp, Homo sapiens
gagcttttactgctgtattgaa

SEQ ID NO: 8376643 - DNA, 22 bp, Homo sapiens
gaggaaggatttagtttgaggg

SEQ ID NO: 8376644 - DNA, 22 bp, Homo sapiens
gaggaaggaatgcagtgtatgc

SEQ ID NO: 8376645 - DNA, 22 bp, Homo sapiens
gaggaaggaatgcagtgtatgc

SEQ ID NO: 8376646 - DNA, 23 bp, Homo sapiens
gagctctgcactaggccctggga

SEQ ID NO: 8376647 - DNA, 22 bp, Homo sapiens
gagcgattgcgggggtcagagg

SEQ ID NO: 8376648 - DNA, 22 bp, Homo sapiens
gagcctgggactgggggtcatg

SEQ ID NO: 8376649 - DNA, 22 bp, Homo sapiens
gagcagtaggagaaccctgagc

SEQ ID NO: 8376650 - DNA, 22 bp, Homo sapiens
gagcagtagagtacatggctcc

SEQ ID NO: 8376651 - DNA, 22 bp, Homo sapiens
gagcagggcttgtcctcctcat

SEQ ID NO: 8376652 - DNA, 22 bp, Homo sapiens
gagcagggcttgtcctcctcat

SEQ ID NO: 8376653 - DNA, 17 bp, Homo sapiens
gagcagggatgcggttc

SEQ ID NO: 8376654 - DNA, 22 bp, Homo sapiens
gagcagctgagctggaatgaga

SEQ ID NO: 8376655 - DNA, 22 bp, Homo sapiens
gagcagggagacaactctggtg

SEQ ID NO: 8376656 - DNA, 22 bp, Homo sapiens
gagcagggagacaactctggtg

SEQ ID NO: 8376657 - DNA, 17 bp, Homo sapiens
gagcagggatgcggttc

SEQ ID NO: 8376658 - DNA, 22 bp, Homo sapiens
gagcagctctgtgcctggagac

SEQ ID NO: 8376659 - DNA, 22 bp, Homo sapiens
gagcagctctgggtgacccagt

SEQ ID NO: 8376660 - DNA, 22 bp, Homo sapiens
gagcagctgagctggaatgaga

SEQ ID NO: 8376661 - DNA, 22 bp, Homo sapiens
gagaggctgaaatcacaggagc

SEQ ID NO: 8376662 - DNA, 22 bp, Homo sapiens
gagaggctgactggctgtcctg

SEQ ID NO: 8376663 - DNA, 22 bp, Homo sapiens
gagaggctgatcctgcagagaa

SEQ ID NO: 8376664 - DNA, 22 bp, Homo sapiens
gagaggaatatcattatattag

SEQ ID NO: 8376665 - DNA, 22 bp, Homo sapiens
gagaggctccgccactgctcag

SEQ ID NO: 8376666 - DNA, 22 bp, Homo sapiens
gagcagctagataaagcccttc

SEQ ID NO: 8376667 - DNA, 22 bp, Homo sapiens
gagcagctaaaattctcatgca

SEQ ID NO: 8376668 - DNA, 22 bp, Homo sapiens
gagcagctaaaattctcatgca

SEQ ID NO: 8376669 - DNA, 22 bp, Homo sapiens
gagcacagtaaagcagtgtcac

SEQ ID NO: 8376670 - DNA, 22 bp, Homo sapiens
gagcacagtaaagcagtgtcac

SEQ ID NO: 8376671 - DNA, 22 bp, Homo sapiens
gagcagctccagccgcatgact

SEQ ID NO: 8376672 - DNA, 22 bp, Homo sapiens
gagcagctcgagaaggaagcag

SEQ ID NO: 8376673 - DNA, 22 bp, Homo sapiens
gcagatcaattgattgttcact

SEQ ID NO: 8376674 - DNA, 22 bp, Homo sapiens
gcagatcaacactctctttcaa

SEQ ID NO: 8376675 - DNA, 22 bp, Homo sapiens
gcagaggggaagctgaggaatt

SEQ ID NO: 8376676 - DNA, 22 bp, Homo sapiens
gcagagggcaggggtgtttgtt

SEQ ID NO: 8376677 - DNA, 22 bp, Homo sapiens
gcagaagggaataaggagcttt

SEQ ID NO: 8376678 - DNA, 22 bp, Homo sapiens
gcagaaggtcaaagcaagatgt

SEQ ID NO: 8376679 - DNA, 22 bp, Homo sapiens
gcactgtgacccagagcaggtg

SEQ ID NO: 8376680 - DNA, 22 bp, Homo sapiens
gcactgtgacccagagcaggtg

SEQ ID NO: 8376681 - DNA, 22 bp, Homo sapiens
gcactgtgacccagagcaggtg

SEQ ID NO: 8376682 - DNA, 22 bp, Homo sapiens
gcagaaggttgtttgggaaagg

SEQ ID NO: 8376683 - DNA, 22 bp, Homo sapiens
gcagaatattatggaaaaagta

SEQ ID NO: 8376684 - DNA, 22 bp, Homo sapiens
gcagaattctacagatgataaa

SEQ ID NO: 8376685 - DNA, 22 bp, Homo sapiens
gcagaatgtccaagctgggccc

SEQ ID NO: 8376686 - DNA, 22 bp, Homo sapiens
gcagaatactgagagctgattg

SEQ ID NO: 8376687 - DNA, 22 bp, Homo sapiens
gcagaatacattttgttttcct

SEQ ID NO: 8376688 - DNA, 22 bp, Homo sapiens
gcagaataatagaaaggcacac

SEQ ID NO: 8376689 - DNA, 21 bp, Homo sapiens
gcagaggaatggtatacataa

SEQ ID NO: 8376690 - DNA, 22 bp, Homo sapiens
gcagaattgaaatgtgtcactt

SEQ ID NO: 8376691 - DNA, 17 bp, Homo sapiens
gcagcctcttggtagtg

SEQ ID NO: 8376692 - DNA, 22 bp, Homo sapiens
gcagcctgaggccctttctggc

SEQ ID NO: 8376693 - DNA, 22 bp, Homo sapiens
gcagcctgatgatctgggttgt

SEQ ID NO: 8376694 - DNA, 22 bp, Homo sapiens
gcagcctgttgtaccagcctgt

SEQ ID NO: 8376695 - DNA, 22 bp, Homo sapiens
gcagcctgggcaacagagtgag

SEQ ID NO: 8376696 - DNA, 22 bp, Homo sapiens
gcagcctttggaattagagact

SEQ ID NO: 8376697 - DNA, 22 bp, Homo sapiens
gcagccttccgtggacctggac

SEQ ID NO: 8376698 - DNA, 22 bp, Homo sapiens
gcagccttcagtttggcaggag

SEQ ID NO: 8376699 - DNA, 22 bp, Homo sapiens
gcagccttggttgtgagatgaa

SEQ ID NO: 8376700 - DNA, 22 bp, Homo sapiens
gcagccttatcattagagtgtt

SEQ ID NO: 8376701 - DNA, 22 bp, Homo sapiens
gcaggagagtctgtgccaggtt

SEQ ID NO: 8376702 - DNA, 22 bp, Homo sapiens
gcaggagagtctgtgccaggtt

SEQ ID NO: 8376703 - DNA, 18 bp, Homo sapiens
gcaggagatgggtggggt

SEQ ID NO: 8376704 - DNA, 22 bp, Homo sapiens
gcagcaggtccgcatcatcatc

SEQ ID NO: 8376705 - DNA, 22 bp, Homo sapiens
gcagcaggtccgcatcatcatc

SEQ ID NO: 8376706 - DNA, 22 bp, Homo sapiens
gcagatgccactaggtgaagtg

SEQ ID NO: 8376707 - DNA, 19 bp, Homo sapiens
gcagccaggtgctctacct

SEQ ID NO: 8376708 - DNA, 22 bp, Homo sapiens
gcagccagggctaagctgggga

SEQ ID NO: 8376709 - DNA, 22 bp, Homo sapiens
gcagccagggagagaaccaggg

SEQ ID NO: 8376710 - DNA, 22 bp, Homo sapiens
atgtttctacagcgtccactga

SEQ ID NO: 8376711 - DNA, 22 bp, Homo sapiens
atgtttctagttgtatgtcact

SEQ ID NO: 8376712 - DNA, 22 bp, Homo sapiens
atgtttctcactgtttctctat

SEQ ID NO: 8376713 - DNA, 22 bp, Homo sapiens
gatttctgggctttatttcaga

SEQ ID NO: 8376714 - DNA, 20 bp, Homo sapiens
gcaaaataggctctgttggt

SEQ ID NO: 8376715 - DNA, 20 bp, Homo sapiens
gcaaaataggctctgttggt

SEQ ID NO: 8376716 - DNA, 22 bp, Homo sapiens
gcaaaaattccagggacgactc

SEQ ID NO: 8376717 - DNA, 22 bp, Homo sapiens
gcaacagcattctcattgacat

SEQ ID NO: 8376718 - DNA, 22 bp, Homo sapiens
gcaacagcccaggttctgtgtg

SEQ ID NO: 8376719 - DNA, 22 bp, Homo sapiens
gcaaatgtttttgagtgtttac

SEQ ID NO: 8376720 - DNA, 22 bp, Homo sapiens
gcaaacaagctgcctgaagatt

SEQ ID NO: 8376721 - DNA, 22 bp, Homo sapiens
gcacagggagcaggtctctggt

SEQ ID NO: 8376722 - DNA, 22 bp, Homo sapiens
gcacagggagacagccgtggcc

SEQ ID NO: 8376723 - DNA, 22 bp, Homo sapiens
gcacagggagacagccgtggcc

SEQ ID NO: 8376724 - DNA, 22 bp, Homo sapiens
gcacagggagacagccgtggcc

SEQ ID NO: 8376725 - DNA, 22 bp, Homo sapiens
gcacagaggaagcacagactct

SEQ ID NO: 8376726 - DNA, 22 bp, Homo sapiens
gcacagagctggccctccaggc

SEQ ID NO: 8376727 - DNA, 22 bp, Homo sapiens
gcacagagctggccctccaggc

SEQ ID NO: 8376728 - DNA, 22 bp, Homo sapiens
gcacagagcctggtaccgagaa

SEQ ID NO: 8376729 - DNA, 18 bp, Homo sapiens
gcacagagcccaggctct

SEQ ID NO: 8376730 - DNA, 20 bp, Homo sapiens
gcacagagatgagcaaagta

SEQ ID NO: 8376731 - DNA, 22 bp, Homo sapiens
gcactggtgtgaaacagtagat

SEQ ID NO: 8376732 - DNA, 22 bp, Homo sapiens
gcactgtgaatatactagcaaa

SEQ ID NO: 8376733 - DNA, 22 bp, Homo sapiens
gcactgtgaatatactagcaaa

SEQ ID NO: 8376734 - DNA, 22 bp, Homo sapiens
gcactgtgaatatactagcaaa

SEQ ID NO: 8376735 - DNA, 22 bp, Homo sapiens
gcacagggcaacaggtctgtta

SEQ ID NO: 8376736 - DNA, 22 bp, Homo sapiens
gcacagggaggctggcctggcc

SEQ ID NO: 8376737 - DNA, 22 bp, Homo sapiens
gcacagggaggctggcctggcc

SEQ ID NO: 8376738 - DNA, 22 bp, Homo sapiens
gcacagggaggctggcctggcc

SEQ ID NO: 8376739 - DNA, 22 bp, Homo sapiens
gcacagggccctgtgcgtaggt

SEQ ID NO: 8376740 - DNA, 22 bp, Homo sapiens
gcacagggccctgtgcgtaggt

SEQ ID NO: 8376741 - DNA, 22 bp, Homo sapiens
gcactcagtaccaggtcactgc

SEQ ID NO: 8376742 - DNA, 22 bp, Homo sapiens
gcactgggggcagcagtgaggg

SEQ ID NO: 8376743 - DNA, 22 bp, Homo sapiens
gcagggattgtgcagggggcta

SEQ ID NO: 8376744 - DNA, 22 bp, Homo sapiens
gcagggaggtttgctgacctgg

SEQ ID NO: 8376745 - DNA, 21 bp, Homo sapiens
gcagggtcctttccattccta

SEQ ID NO: 8376746 - DNA, 22 bp, Homo sapiens
gcagggtaggtgacaggtagtc

SEQ ID NO: 8376747 - DNA, 22 bp, Homo sapiens
gcagggtacattgggatgggat

SEQ ID NO: 8376748 - DNA, 22 bp, Homo sapiens
gcagggtctgaggccacagagg

SEQ ID NO: 8376749 - DNA, 16 bp, Homo sapiens
gcaggtggatcacctg

SEQ ID NO: 8376750 - DNA, 22 bp, Homo sapiens
gcaggtggatcacctgaggtca

SEQ ID NO: 8376751 - DNA, 22 bp, Homo sapiens
gcaggtggatcacctgaggtca

SEQ ID NO: 8376752 - DNA, 22 bp, Homo sapiens
gcaggtggagcagtagtctggt

SEQ ID NO: 8376753 - DNA, 22 bp, Homo sapiens
gcagggtgaaggtcacatagaa

SEQ ID NO: 8376754 - DNA, 22 bp, Homo sapiens
gcagggtgaaggtcacatagaa

SEQ ID NO: 8376755 - DNA, 22 bp, Homo sapiens
gcaggtggatattgctacttga

SEQ ID NO: 8376756 - DNA, 14 bp, Homo sapiens
gcaggtggatcacc

SEQ ID NO: 8376757 - DNA, 22 bp, Homo sapiens
gcaggtggatcaccacgtcagg

SEQ ID NO: 8376758 - DNA, 14 bp, Homo sapiens
gcaggtggatcact

SEQ ID NO: 8376759 - DNA, 15 bp, Homo sapiens
gcaggtggatcactt

SEQ ID NO: 8376760 - DNA, 22 bp, Homo sapiens
attggttaactctgtgtgtcaa

SEQ ID NO: 8376761 - DNA, 22 bp, Homo sapiens
attggttaccactttaaatctt

SEQ ID NO: 8376762 - DNA, 22 bp, Homo sapiens
attggttaagacgcatcatgct

SEQ ID NO: 8376763 - DNA, 22 bp, Homo sapiens
attggttacggcttttcaaatt

SEQ ID NO: 8376764 - DNA, 22 bp, Homo sapiens
attggttactcaatttgactga

SEQ ID NO: 8376765 - DNA, 22 bp, Homo sapiens
attggttagaagtagtatgact

SEQ ID NO: 8376766 - DNA, 22 bp, Homo sapiens
attggttagagtaacacctatt

SEQ ID NO: 8376767 - DNA, 22 bp, Homo sapiens
attgtaaatagtgccacaataa

SEQ ID NO: 8376768 - DNA, 22 bp, Homo sapiens
attgtaaagtactgtgtacaat

SEQ ID NO: 8376769 - DNA, 22 bp, Homo sapiens
gcaggctggtctgaccatccct

SEQ ID NO: 8376770 - DNA, 22 bp, Homo sapiens
gcaggctgtagacaccaaacta

SEQ ID NO: 8376771 - DNA, 22 bp, Homo sapiens
gcaggctgtctaaagttagagt

SEQ ID NO: 8376772 - DNA, 22 bp, Homo sapiens
gcaggctgtgaggctcagatgg

SEQ ID NO: 8376773 - DNA, 22 bp, Homo sapiens
gcagggactgtgatctcacaga

SEQ ID NO: 8376774 - DNA, 22 bp, Homo sapiens
gcagggacgccagggacagcaa

SEQ ID NO: 8376775 - DNA, 22 bp, Homo sapiens
gcaggctgtggtatgttgggca

SEQ ID NO: 8376776 - DNA, 22 bp, Homo sapiens
gcaggagcagtcaggggcagct

SEQ ID NO: 8376777 - DNA, 22 bp, Homo sapiens
gcaggagcagtcaggggcagct

SEQ ID NO: 8376778 - DNA, 22 bp, Homo sapiens
gcaggagccacttcagggatgc

SEQ ID NO: 8376779 - DNA, 22 bp, Homo sapiens
gcaggagcaatggcctatcaga

SEQ ID NO: 8376780 - DNA, 22 bp, Homo sapiens
gcaggagcagtcaggggcagct

SEQ ID NO: 8376781 - DNA, 14 bp, Homo sapiens
gcaggcggatcact

SEQ ID NO: 8376782 - DNA, 22 bp, Homo sapiens
attgttctgtagtgacatgtag

SEQ ID NO: 8376783 - DNA, 22 bp, Homo sapiens
attgttgagtgcttcagctgta

SEQ ID NO: 8376784 - DNA, 22 bp, Homo sapiens
attgttctggatatttacattg

SEQ ID NO: 8376785 - DNA, 22 bp, Homo sapiens
attgttctaagggtttaattaa

SEQ ID NO: 8376786 - DNA, 22 bp, Homo sapiens
attgttgatcttctggtaagcc

SEQ ID NO: 8376787 - DNA, 22 bp, Homo sapiens
attgttcaatgtaataattttg

SEQ ID NO: 8376788 - DNA, 22 bp, Homo sapiens
attgttatgaaaataagatgtt

SEQ ID NO: 8376789 - DNA, 22 bp, Homo sapiens
attgttcactgtgaatcttgat

SEQ ID NO: 8376790 - DNA, 22 bp, Homo sapiens
attgttcactgtgaatcttgat

SEQ ID NO: 8376791 - DNA, 18 bp, Homo sapiens
attgttaatagagtactt

SEQ ID NO: 8376792 - DNA, 22 bp, Homo sapiens
attgtaattttagagaaagtgg

SEQ ID NO: 8376793 - DNA, 22 bp, Homo sapiens
attgtaacatgttcagatcact

SEQ ID NO: 8376794 - DNA, 22 bp, Homo sapiens
attgtaattttagagaaagtgg

SEQ ID NO: 8376795 - DNA, 22 bp, Homo sapiens
attgttttaattccattgtgaa

SEQ ID NO: 8376796 - DNA, 22 bp, Homo sapiens
attgttttaattccattgtgaa

SEQ ID NO: 8376797 - DNA, 22 bp, Homo sapiens
attgttttattaaatgagccct

SEQ ID NO: 8376798 - DNA, 22 bp, Homo sapiens
gccactgtcctgtgcctgtgct

SEQ ID NO: 8376799 - DNA, 20 bp, Homo sapiens
attgtttcatttaatgtaca

SEQ ID NO: 8376800 - DNA, 22 bp, Homo sapiens
attgtttccccggaattattca

SEQ ID NO: 8376801 - DNA, 22 bp, Homo sapiens
gccactgtcataccctggcaat

SEQ ID NO: 8376802 - DNA, 22 bp, Homo sapiens
gccactgtcatcttgtgaagca

SEQ ID NO: 8376803 - DNA, 22 bp, Homo sapiens
gccactgtactccagcctgcga

SEQ ID NO: 8376804 - DNA, 22 bp, Homo sapiens
gccactgtagagtatggacaag

SEQ ID NO: 8376805 - DNA, 16 bp, Homo sapiens
attgttttcaattaga

SEQ ID NO: 8376806 - DNA, 22 bp, Homo sapiens
attgttttccaaagatgctgct

SEQ ID NO: 8376807 - DNA, 23 bp, Homo sapiens
attgtttttggctctcagggaat

SEQ ID NO: 8376808 - DNA, 22 bp, Homo sapiens
attgttttgtttcccagtgact

SEQ ID NO: 8376809 - DNA, 22 bp, Homo sapiens
attgttttgtagaatgaccctt

SEQ ID NO: 8376810 - DNA, 22 bp, Homo sapiens
atttaaatgcttaagagggttt

SEQ ID NO: 8376811 - DNA, 22 bp, Homo sapiens
gcattcaggaaccggaagggta

SEQ ID NO: 8376812 - DNA, 22 bp, Homo sapiens
gcattcaggaaccggaagggta

SEQ ID NO: 8376813 - DNA, 20 bp, Homo sapiens
gccacagttttctcactgca

SEQ ID NO: 8376814 - DNA, 22 bp, Homo sapiens
gccacagtcaggacggggagag

SEQ ID NO: 8376815 - DNA, 22 bp, Homo sapiens
gccactggagacagtggggaag

SEQ ID NO: 8376816 - DNA, 18 bp, Homo sapiens
gccagaggtactactgat

SEQ ID NO: 8376817 - DNA, 18 bp, Homo sapiens
gccagagggcccaaggtc

SEQ ID NO: 8376818 - DNA, 22 bp, Homo sapiens
gccagaggtatcaaagatagta

SEQ ID NO: 8376819 - DNA, 22 bp, Homo sapiens
gcccagccacagtcactttcat

SEQ ID NO: 8376820 - DNA, 22 bp, Homo sapiens
gcccagccacagtcactttcat

SEQ ID NO: 8376821 - DNA, 22 bp, Homo sapiens
gcccagcccagaaaggttcgga

SEQ ID NO: 8376822 - DNA, 22 bp, Homo sapiens
gcccagcccagaaaggttcgga

SEQ ID NO: 8376823 - DNA, 22 bp, Homo sapiens
gcccagccagagctgtgtgatg

SEQ ID NO: 8376824 - DNA, 22 bp, Homo sapiens
gcccagccagagctgtgtgatg

SEQ ID NO: 8376825 - DNA, 22 bp, Homo sapiens
atttacataatagactttaggt

SEQ ID NO: 8376826 - DNA, 22 bp, Homo sapiens
atttacataatagactttaggt

SEQ ID NO: 8376827 - DNA, 23 bp, Homo sapiens
atttacaggttaaatgaaatcag

SEQ ID NO: 8376828 - DNA, 22 bp, Homo sapiens
gccagagggattcctggtgtgt

SEQ ID NO: 8376829 - DNA, 22 bp, Homo sapiens
atttaccagctgtgcactgata

SEQ ID NO: 8376830 - DNA, 22 bp, Homo sapiens
gccctcccctctgggtggtgag

SEQ ID NO: 8376831 - DNA, 23 bp, Homo sapiens
gccctccctcccaggtgggtgtt

SEQ ID NO: 8376832 - DNA, 22 bp, Homo sapiens
gccctgccctctcggcactcgc

SEQ ID NO: 8376833 - DNA, 22 bp, Homo sapiens
atttcttccttctcctagaaga

SEQ ID NO: 8376834 - DNA, 22 bp, Homo sapiens
gccctgccctgagccgtagacc

SEQ ID NO: 8376835 - DNA, 22 bp, Homo sapiens
gccctgccctgagccgtagacc

SEQ ID NO: 8376836 - DNA, 22 bp, Homo sapiens
gccctccaccagagcccttctc

SEQ ID NO: 8376837 - DNA, 22 bp, Homo sapiens
gccctccagctgttgcgcgtcg

SEQ ID NO: 8376838 - DNA, 22 bp, Homo sapiens
gcccaggagttgaagggctgac

SEQ ID NO: 8376839 - DNA, 22 bp, Homo sapiens
gcccaggagttgaagggctgac

SEQ ID NO: 8376840 - DNA, 22 bp, Homo sapiens
gcccaggagttcaagtctagtg

SEQ ID NO: 8376841 - DNA, 22 bp, Homo sapiens
gcccaggagttcaagtctagtg

SEQ ID NO: 8376842 - DNA, 22 bp, Homo sapiens
gcccaggagttcaaggctgcag

SEQ ID NO: 8376843 - DNA, 22 bp, Homo sapiens
gcccaggaggtggaggtgcagt

SEQ ID NO: 8376844 - DNA, 22 bp, Homo sapiens
gcccagcccctgggtggacgtg

SEQ ID NO: 8376845 - DNA, 22 bp, Homo sapiens
gcccagcccctgggtggacgtg

SEQ ID NO: 8376846 - DNA, 22 bp, Homo sapiens
atttcttccttctcctagaaga

SEQ ID NO: 8376847 - DNA, 22 bp, Homo sapiens
atttgcataatagtgatttgta

SEQ ID NO: 8376848 - DNA, 22 bp, Homo sapiens
atttgcatatctgatagactaa

SEQ ID NO: 8376849 - DNA, 22 bp, Homo sapiens
atttgtctgcttgctgccttcc

SEQ ID NO: 8376850 - DNA, 22 bp, Homo sapiens
atttgtctctgcactttactca

SEQ ID NO: 8376851 - DNA, 22 bp, Homo sapiens
attttaaggcttatttaaaggc

SEQ ID NO: 8376852 - DNA, 22 bp, Homo sapiens
attttaaggcttatttaaaggc

SEQ ID NO: 8376853 - DNA, 22 bp, Homo sapiens
atttgcatttagaaagatcact

SEQ ID NO: 8376854 - DNA, 22 bp, Homo sapiens
atttgcatttacatagcataga

SEQ ID NO: 8376855 - DNA, 22 bp, Homo sapiens
atttgcatttacatagcataga

SEQ ID NO: 8376856 - DNA, 21 bp, Homo sapiens
atttgcattaaaatattacgc

SEQ ID NO: 8376857 - DNA, 21 bp, Homo sapiens
atttgcattaaaatattacgc

SEQ ID NO: 8376858 - DNA, 22 bp, Homo sapiens
atttgcatgcttctattgtgaa

SEQ ID NO: 8376859 - DNA, 22 bp, Homo sapiens
attttctagatagatgatgcat

SEQ ID NO: 8376860 - DNA, 22 bp, Homo sapiens
gcctgcctagaattgcagcttt

SEQ ID NO: 8376861 - DNA, 21 bp, Homo sapiens
gcctgccctctgtgatggcca

SEQ ID NO: 8376862 - DNA, 22 bp, Homo sapiens
gcctgcccacggggctggcata

SEQ ID NO: 8376863 - DNA, 22 bp, Homo sapiens
attttactactccaattaatga

SEQ ID NO: 8376864 - DNA, 22 bp, Homo sapiens
attttactactccaattaatga

SEQ ID NO: 8376865 - DNA, 22 bp, Homo sapiens
attttactaagtggatatctgt

SEQ ID NO: 8376866 - DNA, 22 bp, Homo sapiens
attttacataaggaaggtttaa

SEQ ID NO: 8376867 - DNA, 22 bp, Homo sapiens
attttgaaaccaagttatttcc

SEQ ID NO: 8376868 - DNA, 22 bp, Homo sapiens
attttgaaaagcatttgagtaa

SEQ ID NO: 8376869 - DNA, 22 bp, Homo sapiens
attttgaaatacttgaaggaaa

SEQ ID NO: 8376870 - DNA, 22 bp, Homo sapiens
attttgaaaccaagttatttcc

SEQ ID NO: 8376871 - DNA, 22 bp, Homo sapiens
attttgaaaccaagttatttcc

SEQ ID NO: 8376872 - DNA, 22 bp, Homo sapiens
attttgaaaagcatttgagtaa

SEQ ID NO: 8376873 - DNA, 22 bp, Homo sapiens
attttctagatagatgatgcat

SEQ ID NO: 8376874 - DNA, 18 bp, Homo sapiens
attttgaactgggaatat

SEQ ID NO: 8376875 - DNA, 18 bp, Homo sapiens
attttgaacaatgctgta

SEQ ID NO: 8376876 - DNA, 18 bp, Homo sapiens
attttgaacaatgctgta

SEQ ID NO: 8376877 - DNA, 22 bp, Homo sapiens
attttgaaatacttgaaggaaa

SEQ ID NO: 8376878 - DNA, 22 bp, Homo sapiens
attttgaagggaattgaagttc

SEQ ID NO: 8376879 - DNA, 22 bp, Homo sapiens
gcctggctcctaagagcacaac

SEQ ID NO: 8376880 - DNA, 22 bp, Homo sapiens
gctctgagaggtgcagcagtaa

SEQ ID NO: 8376881 - DNA, 22 bp, Homo sapiens
gctctgagacagtagagatggc

SEQ ID NO: 8376882 - DNA, 20 bp, Homo sapiens
caaatccctgctctgtgctg

SEQ ID NO: 8376883 - DNA, 22 bp, Homo sapiens
caaatctaggatgcatgtagtg

SEQ ID NO: 8376884 - DNA, 22 bp, Homo sapiens
caaatctctgctactagctatg

SEQ ID NO: 8376885 - DNA, 22 bp, Homo sapiens
caaatctccttaaaggtaaaat

SEQ ID NO: 8376886 - DNA, 22 bp, Homo sapiens
gctgaggacatcatggaaggaa

SEQ ID NO: 8376887 - DNA, 22 bp, Homo sapiens
gctgaggaaaggctggaaggga

SEQ ID NO: 8376888 - DNA, 22 bp, Homo sapiens
gctgagctgggacagtcctggg

SEQ ID NO: 8376889 - DNA, 22 bp, Homo sapiens
gctgaggaaaccaatgctcaga

SEQ ID NO: 8376890 - DNA, 22 bp, Homo sapiens
gctgagaacagagctctgagct

SEQ ID NO: 8376891 - DNA, 22 bp, Homo sapiens
gctgagaacagagctctgagct

SEQ ID NO: 8376892 - DNA, 22 bp, Homo sapiens
gctgagaaatgcagacatgctg

SEQ ID NO: 8376893 - DNA, 22 bp, Homo sapiens
gctgagaaatgcagacatgctg

SEQ ID NO: 8376894 - DNA, 22 bp, Homo sapiens
gctgactttgcctgtctttagc

SEQ ID NO: 8376895 - DNA, 22 bp, Homo sapiens
gctaagggaggcatgccgtggt

SEQ ID NO: 8376896 - DNA, 22 bp, Homo sapiens
gctaagaggctatatctttctc

SEQ ID NO: 8376897 - DNA, 22 bp, Homo sapiens
gctaaaataactgagtttttgc

SEQ ID NO: 8376898 - DNA, 22 bp, Homo sapiens
gcgccccatctacagtactttt

SEQ ID NO: 8376899 - DNA, 22 bp, Homo sapiens
gcgccccatctacagtactttt

SEQ ID NO: 8376900 - DNA, 22 bp, Homo sapiens
gctacagactgagcatggctct

SEQ ID NO: 8376901 - DNA, 22 bp, Homo sapiens
gctatttattaaaatagtgaag

SEQ ID NO: 8376902 - DNA, 22 bp, Homo sapiens
gctatttttgagccatttataa

SEQ ID NO: 8376903 - DNA, 22 bp, Homo sapiens
gctatttattaaaatggtgaag

SEQ ID NO: 8376904 - DNA, 22 bp, Homo sapiens
gctcaaagaatattcagaatga

SEQ ID NO: 8376905 - DNA, 22 bp, Homo sapiens
gctcaaagaccagacagaggag

SEQ ID NO: 8376906 - DNA, 23 bp, Homo sapiens
gctcaggcatcattcttcctggc

SEQ ID NO: 8376907 - DNA, 22 bp, Homo sapiens
gctcaaagcataagacatctaa

SEQ ID NO: 8376908 - DNA, 22 bp, Homo sapiens
gctcaggtcttacccatgcctg

SEQ ID NO: 8376909 - DNA, 23 bp, Homo sapiens
gctcaggtggctcagggactgat

SEQ ID NO: 8376910 - DNA, 20 bp, Homo sapiens
gctcaggtttgggctttgtg

SEQ ID NO: 8376911 - DNA, 22 bp, Homo sapiens
gctccaggcgagctggaccaga

SEQ ID NO: 8376912 - DNA, 22 bp, Homo sapiens
gctccaggcgagctggaccaga

SEQ ID NO: 8376913 - DNA, 22 bp, Homo sapiens
gctccaggcagcatagtggatg

SEQ ID NO: 8376914 - DNA, 19 bp, Homo sapiens
gctcagtctcctgattgct

SEQ ID NO: 8376915 - DNA, 19 bp, Homo sapiens
gctcagtctcctgattgct

SEQ ID NO: 8376916 - DNA, 23 bp, Homo sapiens
gctctatcaggaacaagccaggt

SEQ ID NO: 8376917 - DNA, 21 bp, Homo sapiens
gctctatcaggccaaaatgtc

SEQ ID NO: 8376918 - DNA, 22 bp, Homo sapiens
gctccaggctgctctgtcccat

SEQ ID NO: 8376919 - DNA, 22 bp, Homo sapiens
gctcctggatgttcaagtcggc

SEQ ID NO: 8376920 - DNA, 22 bp, Homo sapiens
gctcggtggccagcctgaggcc

SEQ ID NO: 8376921 - DNA, 22 bp, Homo sapiens
gctcggccccttccctttcttg

SEQ ID NO: 8376922 - DNA, 17 bp, Homo sapiens
gctccttctaacttcca

SEQ ID NO: 8376923 - DNA, 18 bp, Homo sapiens
aggcctgggaagctgagg

SEQ ID NO: 8376924 - DNA, 22 bp, Homo sapiens
ccaggaaggcaggcctccccgc

SEQ ID NO: 8376925 - DNA, 22 bp, Homo sapiens
ccaggaaggcaggcctccccgc

SEQ ID NO: 8376926 - DNA, 22 bp, Homo sapiens
aggcctggcatgagacctgaga

SEQ ID NO: 8376927 - DNA, 22 bp, Homo sapiens
ccaggacaagccagagggacag

SEQ ID NO: 8376928 - DNA, 22 bp, Homo sapiens
ccaggacaagccagagggacag

SEQ ID NO: 8376929 - DNA, 22 bp, Homo sapiens
ccaggaaggtatgggaagaaaa

SEQ ID NO: 8376930 - DNA, 22 bp, Homo sapiens
ccaggacaagccagagggacag

SEQ ID NO: 8376931 - DNA, 22 bp, Homo sapiens
ccaggaagtatgacccaacaga

SEQ ID NO: 8376932 - DNA, 22 bp, Homo sapiens
ccagcaggagagaacatttccc

SEQ ID NO: 8376933 - DNA, 22 bp, Homo sapiens
ccagcaggagactagcaacata

SEQ ID NO: 8376934 - DNA, 22 bp, Homo sapiens
ccagcaggagagaacatttccc

SEQ ID NO: 8376935 - DNA, 22 bp, Homo sapiens
ccagcaggagatgcctgtgtct

SEQ ID NO: 8376936 - DNA, 22 bp, Homo sapiens
ccagcaggagatgcctgtgtct

SEQ ID NO: 8376937 - DNA, 22 bp, Homo sapiens
ccagcaggcagtcatatccttt

SEQ ID NO: 8376938 - DNA, 22 bp, Homo sapiens
ccagctggaacggcagcccagc

SEQ ID NO: 8376939 - DNA, 22 bp, Homo sapiens
ccagctcttttggctgagtgag

SEQ ID NO: 8376940 - DNA, 22 bp, Homo sapiens
ccagctggaagagtgcagaact

SEQ ID NO: 8376941 - DNA, 22 bp, Homo sapiens
ccagctggagctcgcagatagg

SEQ ID NO: 8376942 - DNA, 22 bp, Homo sapiens
ccagctggcaggagagtcaggg

SEQ ID NO: 8376943 - DNA, 22 bp, Homo sapiens
ccagctggcactgtggctgccc

SEQ ID NO: 8376944 - DNA, 22 bp, Homo sapiens
ccagagctccagggctacagaa

SEQ ID NO: 8376945 - DNA, 22 bp, Homo sapiens
ccagagctgaggagatgggctt

SEQ ID NO: 8376946 - DNA, 22 bp, Homo sapiens
aggccagaaatgtcagggagtg

SEQ ID NO: 8376947 - DNA, 22 bp, Homo sapiens
aggccagaaaaagacagctcca

SEQ ID NO: 8376948 - DNA, 22 bp, Homo sapiens
aggccagtgcagctggaacaga

SEQ ID NO: 8376949 - DNA, 19 bp, Homo sapiens
ccagcagctttgattctct

SEQ ID NO: 8376950 - DNA, 19 bp, Homo sapiens
ccagcagctttgattctct

SEQ ID NO: 8376951 - DNA, 22 bp, Homo sapiens
ccagcaggaaagtgacgtttga

SEQ ID NO: 8376952 - DNA, 22 bp, Homo sapiens
ccagcagctttgcatacactaa

SEQ ID NO: 8376953 - DNA, 22 bp, Homo sapiens
ccagcaggaaagtgacgtttga

SEQ ID NO: 8376954 - DNA, 22 bp, Homo sapiens
ccagcaggactttggaaatatg

SEQ ID NO: 8376955 - DNA, 22 bp, Homo sapiens
ccagcaggactttggaaatatg

SEQ ID NO: 8376956 - DNA, 22 bp, Homo sapiens
ccagcaggagactagcaacata

SEQ ID NO: 8376957 - DNA, 22 bp, Homo sapiens
ccagcaggactttggaaatatg

SEQ ID NO: 8376958 - DNA, 22 bp, Homo sapiens
aggcccagactcagcggggcgg

SEQ ID NO: 8376959 - DNA, 22 bp, Homo sapiens
aggccacagttgaggccagcaa

SEQ ID NO: 8376960 - DNA, 22 bp, Homo sapiens
ccagaacacagtggaagaatat

SEQ ID NO: 8376961 - DNA, 22 bp, Homo sapiens
ccagaaagttcagctgtgaatg

SEQ ID NO: 8376962 - DNA, 22 bp, Homo sapiens
ccagaaaggtaaacactggatt

SEQ ID NO: 8376963 - DNA, 22 bp, Homo sapiens
ccagaagacaagaatgttctta

SEQ ID NO: 8376964 - DNA, 22 bp, Homo sapiens
ccagaagaccggggagtcaggg

SEQ ID NO: 8376965 - DNA, 22 bp, Homo sapiens
ccagaagaacttaattcaaaac

SEQ ID NO: 8376966 - DNA, 22 bp, Homo sapiens
ccagaagaacttaattcaaaac

SEQ ID NO: 8376967 - DNA, 22 bp, Homo sapiens
ccagaagacaagaatgttctta

SEQ ID NO: 8376968 - DNA, 22 bp, Homo sapiens
ccagaaccaaaagcatggagta

SEQ ID NO: 8376969 - DNA, 22 bp, Homo sapiens
ccactgggggctgcaggcactc

SEQ ID NO: 8376970 - DNA, 22 bp, Homo sapiens
ccagaaagataggaaatcaagt

SEQ ID NO: 8376971 - DNA, 22 bp, Homo sapiens
ccagaaagaatgaactgaaccc

SEQ ID NO: 8376972 - DNA, 22 bp, Homo sapiens
aggctggagtgcaatggcgtga

SEQ ID NO: 8376973 - DNA, 22 bp, Homo sapiens
aggctggcccacctcttgtctt

SEQ ID NO: 8376974 - DNA, 22 bp, Homo sapiens
aggctggcccacctcttgtctt

SEQ ID NO: 8376975 - DNA, 22 bp, Homo sapiens
aggctggagtgtagcagtgcag

SEQ ID NO: 8376976 - DNA, 22 bp, Homo sapiens
aggctggagtgtagcagtgcag

SEQ ID NO: 8376977 - DNA, 22 bp, Homo sapiens
aggctggagagtgcagtggcgt

SEQ ID NO: 8376978 - DNA, 22 bp, Homo sapiens
aggctggagagtgcagtggcgt

SEQ ID NO: 8376979 - DNA, 22 bp, Homo sapiens
aggctggagacccgccaagaaa

SEQ ID NO: 8376980 - DNA, 19 bp, Homo sapiens
aggctggagacaccaggcc

SEQ ID NO: 8376981 - DNA, 22 bp, Homo sapiens
aggctggagagtgcagtggcgt

SEQ ID NO: 8376982 - DNA, 22 bp, Homo sapiens
aggctggaaagggaccagagtg

SEQ ID NO: 8376983 - DNA, 19 bp, Homo sapiens
aggctggagacaccaggcc

SEQ ID NO: 8376984 - DNA, 22 bp, Homo sapiens
ccaggtgactgtcagaggtttt

SEQ ID NO: 8376985 - DNA, 22 bp, Homo sapiens
ccatttgtcacctctgcactcc

SEQ ID NO: 8376986 - DNA, 22 bp, Homo sapiens
ccatttgtaaccttagagcaat

SEQ ID NO: 8376987 - DNA, 22 bp, Homo sapiens
aggctggctggggatgcgtctt

SEQ ID NO: 8376988 - DNA, 22 bp, Homo sapiens
aggctggcctatttctttatcg

SEQ ID NO: 8376989 - DNA, 17 bp, Homo sapiens
aggctggccttcacagt

SEQ ID NO: 8376990 - DNA, 22 bp, Homo sapiens
aggctggccctactggctgcct

SEQ ID NO: 8376991 - DNA, 22 bp, Homo sapiens
aggctggcgacatctggcgggc

SEQ ID NO: 8376992 - DNA, 22 bp, Homo sapiens
aggctggcggtgactgctctga

SEQ ID NO: 8376993 - DNA, 22 bp, Homo sapiens
aggctggcgtcaggggctgtac

SEQ ID NO: 8376994 - DNA, 22 bp, Homo sapiens
ccatttatagatgtatttggct

SEQ ID NO: 8376995 - DNA, 22 bp, Homo sapiens
ccatttaacacagagttttcca

SEQ ID NO: 8376996 - DNA, 22 bp, Homo sapiens
ccatttggcaaacattttacag

SEQ ID NO: 8376997 - DNA, 22 bp, Homo sapiens
aggcgtggttgaggcgagcata

SEQ ID NO: 8376998 - DNA, 22 bp, Homo sapiens
aggctacaaataagcatgtaat

SEQ ID NO: 8376999 - DNA, 22 bp, Homo sapiens
aggctaatatggcacatgaaca

SEQ ID NO: 8377000 - DNA, 22 bp, Homo sapiens
aggctaatatggcacatgaaca

SEQ ID NO: 8377001 - DNA, 22 bp, Homo sapiens
aggctaatatttatgaaaccaa

SEQ ID NO: 8377002 - DNA, 22 bp, Homo sapiens
aggctagaggcttctggcttca

SEQ ID NO: 8377003 - DNA, 22 bp, Homo sapiens
aggctacaataattcccatgca

SEQ ID NO: 8377004 - DNA, 22 bp, Homo sapiens
aggctacagcctcaagagtgca

SEQ ID NO: 8377005 - DNA, 22 bp, Homo sapiens
aggctacagatacagaggctac

SEQ ID NO: 8377006 - DNA, 22 bp, Homo sapiens
ccaggctggagtatagtggcgc

SEQ ID NO: 8377007 - DNA, 22 bp, Homo sapiens
ccaggctgcttagccttatctt

SEQ ID NO: 8377008 - DNA, 22 bp, Homo sapiens
ccaggctgggctacaagttgag

SEQ ID NO: 8377009 - DNA, 22 bp, Homo sapiens
ccaggctgggcggggaacctgg

SEQ ID NO: 8377010 - DNA, 22 bp, Homo sapiens
ccagggctggtgggagatgctg

SEQ ID NO: 8377011 - DNA, 22 bp, Homo sapiens
aggctgaggatccctgtgttct

SEQ ID NO: 8377012 - DNA, 22 bp, Homo sapiens
ccagggctggtggctgcagagg

SEQ ID NO: 8377013 - DNA, 22 bp, Homo sapiens
aggctgaggcaagaggatcact

SEQ ID NO: 8377014 - DNA, 22 bp, Homo sapiens
aggctgaggcaggtggatcacc

SEQ ID NO: 8377015 - DNA, 22 bp, Homo sapiens
ccagggcctgccacttagcaag

SEQ ID NO: 8377016 - DNA, 22 bp, Homo sapiens
ccagggcctgagggcgacgccc

SEQ ID NO: 8377017 - DNA, 22 bp, Homo sapiens
ccagggctcaggctcccagtgg

SEQ ID NO: 8377018 - DNA, 22 bp, Homo sapiens
ccagggctcaggctcccagtgg

SEQ ID NO: 8377019 - DNA, 19 bp, Homo sapiens
ccagggctccaagctgagt

SEQ ID NO: 8377020 - DNA, 23 bp, Homo sapiens
cccaggagcctgagtcctctctg

SEQ ID NO: 8377021 - DNA, 22 bp, Homo sapiens
cccaggagatggtgcgtggtct

SEQ ID NO: 8377022 - DNA, 19 bp, Homo sapiens
cccaggagcagtattgatg

SEQ ID NO: 8377023 - DNA, 19 bp, Homo sapiens
cccaggagcagtattgatg

SEQ ID NO: 8377024 - DNA, 22 bp, Homo sapiens
cccaggaatgggaaggaggaat

SEQ ID NO: 8377025 - DNA, 22 bp, Homo sapiens
cccaggagatgcactccattgg

SEQ ID NO: 8377026 - DNA, 22 bp, Homo sapiens
cccaggagcttctctctgcctc

SEQ ID NO: 8377027 - DNA, 20 bp, Homo sapiens
cccaggagctgtgccccatc

SEQ ID NO: 8377028 - DNA, 22 bp, Homo sapiens
aggctggtgattagaagcagcc

SEQ ID NO: 8377029 - DNA, 22 bp, Homo sapiens
aggctggtgcttcctagggcag

SEQ ID NO: 8377030 - DNA, 22 bp, Homo sapiens
aggctgtgaaatgtggcaagga

SEQ ID NO: 8377031 - DNA, 22 bp, Homo sapiens
aggctgtgaaatgtggcaagga

SEQ ID NO: 8377032 - DNA, 22 bp, Homo sapiens
cccaggaatgaggggcggaggc

SEQ ID NO: 8377033 - DNA, 21 bp, Homo sapiens
aggctgtcctttgccagccct

SEQ ID NO: 8377034 - DNA, 22 bp, Homo sapiens
aggctgtcttcctccctcttgg

SEQ ID NO: 8377035 - DNA, 22 bp, Homo sapiens
cccagtttcaactttccagtgg

SEQ ID NO: 8377036 - DNA, 22 bp, Homo sapiens
cccagttttctgattgaagagc

SEQ ID NO: 8377037 - DNA, 22 bp, Homo sapiens
cccagtattgagctacaggcct

SEQ ID NO: 8377038 - DNA, 22 bp, Homo sapiens
cccagtattgagctacaggcct

SEQ ID NO: 8377039 - DNA, 22 bp, Homo sapiens
cccaggctgtctgtcctttgct

SEQ ID NO: 8377040 - DNA, 22 bp, Homo sapiens
cccaggaggtcaaggctgcagt

SEQ ID NO: 8377041 - DNA, 22 bp, Homo sapiens
cccaggaggtcgaagctgcagt

SEQ ID NO: 8377042 - DNA, 22 bp, Homo sapiens
cccaggaggtcgaagctgcagt

SEQ ID NO: 8377043 - DNA, 22 bp, Homo sapiens
cccaggctgatgttcagcgggt

SEQ ID NO: 8377044 - DNA, 22 bp, Homo sapiens
ccctgcacagcctggctctctt

SEQ ID NO: 8377045 - DNA, 22 bp, Homo sapiens
ccctcccaggagtggccagaga

SEQ ID NO: 8377046 - DNA, 22 bp, Homo sapiens
ccctccattaaaacagacctat

SEQ ID NO: 8377047 - DNA, 23 bp, Homo sapiens
ccctgcccattgagcaggacgtc

SEQ ID NO: 8377048 - DNA, 21 bp, Homo sapiens
ccctgccctcaaggacagtgc

SEQ ID NO: 8377049 - DNA, 22 bp, Homo sapiens
ccctgcccaccacatgctggga

SEQ ID NO: 8377050 - DNA, 22 bp, Homo sapiens
ccctgcccatcggggcggcctg

SEQ ID NO: 8377051 - DNA, 22 bp, Homo sapiens
ccctgccctgggcagaagtggg

SEQ ID NO: 8377052 - DNA, 19 bp, Homo sapiens
ccctgccctggtgactggg

SEQ ID NO: 8377053 - DNA, 22 bp, Homo sapiens
ccctgctgcaggcttcaggagg

SEQ ID NO: 8377054 - DNA, 22 bp, Homo sapiens
ccctgctgtcaggtgctgggag

SEQ ID NO: 8377055 - DNA, 22 bp, Homo sapiens
ccctgctgtgtagcggaggaac

SEQ ID NO: 8377056 - DNA, 22 bp, Homo sapiens
ccccttccacagtgcttcctaa

SEQ ID NO: 8377057 - DNA, 22 bp, Homo sapiens
ccctcacttcacgctctgcaga

SEQ ID NO: 8377058 - DNA, 22 bp, Homo sapiens
ccctcaccaggctccaggcatg

SEQ ID NO: 8377059 - DNA, 22 bp, Homo sapiens
ccctagggtttggccagagccc

SEQ ID NO: 8377060 - DNA, 22 bp, Homo sapiens
cccatgctgagtggcctgagat

SEQ ID NO: 8377061 - DNA, 22 bp, Homo sapiens
ccccagaaagcctggcactagg

SEQ ID NO: 8377062 - DNA, 22 bp, Homo sapiens
ccccactttgagtagcacttga

SEQ ID NO: 8377063 - DNA, 22 bp, Homo sapiens
ccccacttgctcagcatgtcca

SEQ ID NO: 8377064 - DNA, 22 bp, Homo sapiens
ccccagagagcaccatgaagcc

SEQ ID NO: 8377065 - DNA, 22 bp, Homo sapiens
ccccagagaaagtcagcagcat

SEQ ID NO: 8377066 - DNA, 22 bp, Homo sapiens
ccccagagaaagtcagcagcat

SEQ ID NO: 8377067 - DNA, 22 bp, Homo sapiens
aggggaggtgtccccaaatctc

SEQ ID NO: 8377068 - DNA, 22 bp, Homo sapiens
aggggaggcagcgataaacctg

SEQ ID NO: 8377069 - DNA, 22 bp, Homo sapiens
aggggaggagcttttcttgcct

SEQ ID NO: 8377070 - DNA, 22 bp, Homo sapiens
agggctggccacatgatttggt

SEQ ID NO: 8377071 - DNA, 22 bp, Homo sapiens
agggctggcatctctaatgctg

SEQ ID NO: 8377072 - DNA, 22 bp, Homo sapiens
agggctggcatctctaatgctg

SEQ ID NO: 8377073 - DNA, 22 bp, Homo sapiens
agggctggctccgttaccttga

SEQ ID NO: 8377074 - DNA, 22 bp, Homo sapiens
agggctggctaggtgcgttccc

SEQ ID NO: 8377075 - DNA, 22 bp, Homo sapiens
cctcttccactgggccccatcc

SEQ ID NO: 8377076 - DNA, 22 bp, Homo sapiens
cctgaaacagtccttgccctca

SEQ ID NO: 8377077 - DNA, 22 bp, Homo sapiens
aggggcacttctcaggctgtgg

SEQ ID NO: 8377078 - DNA, 20 bp, Homo sapiens
aggggcacctgcgacggggc

SEQ ID NO: 8377079 - DNA, 22 bp, Homo sapiens
aggggcacgagtagagctctag

SEQ ID NO: 8377080 - DNA, 22 bp, Homo sapiens
aggggcactagaatgggagact

SEQ ID NO: 8377081 - DNA, 19 bp, Homo sapiens
aggggcactgtctctagag

SEQ ID NO: 8377082 - DNA, 22 bp, Homo sapiens
aggggatggagctggaaggcag

SEQ ID NO: 8377083 - DNA, 22 bp, Homo sapiens
cctgaagcaagggtaggcaggt

SEQ ID NO: 8377084 - DNA, 20 bp, Homo sapiens
cctgaagagtttctctttct

SEQ ID NO: 8377085 - DNA, 22 bp, Homo sapiens
cctgaaacatcttctgtaaata

SEQ ID NO: 8377086 - DNA, 22 bp, Homo sapiens
agggtcacctgcttgccagggc

SEQ ID NO: 8377087 - DNA, 22 bp, Homo sapiens
agggtcacaatgtgtgaattgg

SEQ ID NO: 8377088 - DNA, 22 bp, Homo sapiens
agggtcaccagttcataggcac

SEQ ID NO: 8377089 - DNA, 22 bp, Homo sapiens
ccctgctttgcacccaggctgg

SEQ ID NO: 8377090 - DNA, 22 bp, Homo sapiens
ccctggaaatgaggcatgtgcg

SEQ ID NO: 8377091 - DNA, 22 bp, Homo sapiens
agggctggagccacagctggga

SEQ ID NO: 8377092 - DNA, 22 bp, Homo sapiens
agggctggagccacagctggga

SEQ ID NO: 8377093 - DNA, 22 bp, Homo sapiens
agggctggagggtactagttta

SEQ ID NO: 8377094 - DNA, 22 bp, Homo sapiens
agggctggagccacagctggga

SEQ ID NO: 8377095 - DNA, 22 bp, Homo sapiens
agggctggcaagggattgaaat

SEQ ID NO: 8377096 - DNA, 22 bp, Homo sapiens
agggctggcatctctaatgctg

SEQ ID NO: 8377097 - DNA, 22 bp, Homo sapiens
cctcaggcaggaaactgtcccg

SEQ ID NO: 8377098 - DNA, 22 bp, Homo sapiens
agggcgacaatggagagcgttt

SEQ ID NO: 8377099 - DNA, 22 bp, Homo sapiens
aggcagcttaagccctggccca

SEQ ID NO: 8377100 - DNA, 22 bp, Homo sapiens
aggcagcttctgattagcagcg

SEQ ID NO: 8377101 - DNA, 22 bp, Homo sapiens
aggcagctttcagtgtctctca

SEQ ID NO: 8377102 - DNA, 22 bp, Homo sapiens
aggcagctttctggtgcaccat

SEQ ID NO: 8377103 - DNA, 22 bp, Homo sapiens
aggcagctttctgtaggggtgt

SEQ ID NO: 8377104 - DNA, 22 bp, Homo sapiens
aggcaggaaaatcgcttgaacc

SEQ ID NO: 8377105 - DNA, 22 bp, Homo sapiens
aggcagctttgtagtaaagcta

SEQ ID NO: 8377106 - DNA, 22 bp, Homo sapiens
aggcagcgtagcaaggctagta

SEQ ID NO: 8377107 - DNA, 19 bp, Homo sapiens
aggcagaggcttggctagc

SEQ ID NO: 8377108 - DNA, 22 bp, Homo sapiens
aggcagctggcagcacccaggg

SEQ ID NO: 8377109 - DNA, 21 bp, Homo sapiens
aggcagcgtgagggccactca

SEQ ID NO: 8377110 - DNA, 20 bp, Homo sapiens
aggcagctggccaggcaggt

SEQ ID NO: 8377111 - DNA, 22 bp, Homo sapiens
aggcagctgtgaggactggatt

SEQ ID NO: 8377112 - DNA, 23 bp, Homo sapiens
aggcagagccaaggtcaaaaccc

SEQ ID NO: 8377113 - DNA, 20 bp, Homo sapiens
aggcagagcgcacttttaga

SEQ ID NO: 8377114 - DNA, 22 bp, Homo sapiens
aggcagagctgatgttctgtga

SEQ ID NO: 8377115 - DNA, 22 bp, Homo sapiens
aggcagagctgatgttctgtga

SEQ ID NO: 8377116 - DNA, 22 bp, Homo sapiens
aggcagaggagaatgatcttcc

SEQ ID NO: 8377117 - DNA, 22 bp, Homo sapiens
aggcagaggaagggtggatttg

SEQ ID NO: 8377118 - DNA, 22 bp, Homo sapiens
aggcaggccctgggccatcccg

SEQ ID NO: 8377119 - DNA, 22 bp, Homo sapiens
aggcaggccctgggccatcccg

SEQ ID NO: 8377120 - DNA, 22 bp, Homo sapiens
aggcaggccgtgtccctcctca

SEQ ID NO: 8377121 - DNA, 22 bp, Homo sapiens
aggcaggccctctggaaaggta

SEQ ID NO: 8377122 - DNA, 22 bp, Homo sapiens
aggcaggccctctggaaaggta

SEQ ID NO: 8377123 - DNA, 22 bp, Homo sapiens
aggcaggcctacacaatgggag

SEQ ID NO: 8377124 - DNA, 22 bp, Homo sapiens
aggcaggcctacacaatgggag

SEQ ID NO: 8377125 - DNA, 22 bp, Homo sapiens
aggcaggctcaggcccatgctt

SEQ ID NO: 8377126 - DNA, 22 bp, Homo sapiens
aggcaggctcaatgcccagtct

SEQ ID NO: 8377127 - DNA, 22 bp, Homo sapiens
aggcaggctcaatgcccagtct

SEQ ID NO: 8377128 - DNA, 22 bp, Homo sapiens
aggcaggctagtcgcttgagcc

SEQ ID NO: 8377129 - DNA, 22 bp, Homo sapiens
aggcaggctctgggtatgtgca

SEQ ID NO: 8377130 - DNA, 22 bp, Homo sapiens
aggcaggcccctgagaatagac

SEQ ID NO: 8377131 - DNA, 21 bp, Homo sapiens
aggcaggattcaaacacagag

SEQ ID NO: 8377132 - DNA, 21 bp, Homo sapiens
ccaaagaactgccatttgtca

SEQ ID NO: 8377133 - DNA, 21 bp, Homo sapiens
ccaaagaactgccatttgtca

SEQ ID NO: 8377134 - DNA, 22 bp, Homo sapiens
ccaaaccatccatctccaggct

SEQ ID NO: 8377135 - DNA, 22 bp, Homo sapiens
ccaaacaaatccccattcttag

SEQ ID NO: 8377136 - DNA, 22 bp, Homo sapiens
ccaaaattattacatttgtagg

SEQ ID NO: 8377137 - DNA, 22 bp, Homo sapiens
ccaaaatattagtgcttaagta

SEQ ID NO: 8377138 - DNA, 22 bp, Homo sapiens
ccaaaataacagcccaattcac

SEQ ID NO: 8377139 - DNA, 22 bp, Homo sapiens
ccaaaatattagtgcttaagta

SEQ ID NO: 8377140 - DNA, 22 bp, Homo sapiens
aggcactgattctgttttccat

SEQ ID NO: 8377141 - DNA, 22 bp, Homo sapiens
aggcactgattctcagagttac

SEQ ID NO: 8377142 - DNA, 22 bp, Homo sapiens
aggcactgagaggctgtgttgc

SEQ ID NO: 8377143 - DNA, 22 bp, Homo sapiens
aggcagagagcagtggccgtct

SEQ ID NO: 8377144 - DNA, 22 bp, Homo sapiens
aggcactgactcaagggagcca

SEQ ID NO: 8377145 - DNA, 22 bp, Homo sapiens
aggcactgacctgcttccttga

SEQ ID NO: 8377146 - DNA, 22 bp, Homo sapiens
aggcactgacaattctggactg

SEQ ID NO: 8377147 - DNA, 23 bp, Homo sapiens
aggcactgaatgtgtcagtgagt

SEQ ID NO: 8377148 - DNA, 22 bp, Homo sapiens
aggcactgacaattctggactg

SEQ ID NO: 8377149 - DNA, 23 bp, Homo sapiens
aggcactgaatgtgtcagtgagt

SEQ ID NO: 8377150 - DNA, 23 bp, Homo sapiens
aggcactgaatgtgtcagtgagt

SEQ ID NO: 8377151 - DNA, 22 bp, Homo sapiens
aggcactgacagattctgtgtc

SEQ ID NO: 8377152 - DNA, 22 bp, Homo sapiens
aggcactgacaattctggactg

SEQ ID NO: 8377153 - DNA, 22 bp, Homo sapiens
aggcactgaagaactctttttg

SEQ ID NO: 8377154 - DNA, 22 bp, Homo sapiens
aggcactgaaggaagcttgcgc

SEQ ID NO: 8377155 - DNA, 22 bp, Homo sapiens
aggcactgaagtggtaaatgta

SEQ ID NO: 8377156 - DNA, 22 bp, Homo sapiens
aggcactgaatatccagtaaaa

SEQ ID NO: 8377157 - DNA, 22 bp, Homo sapiens
aggcactgaaaggtggccagag

SEQ ID NO: 8377158 - DNA, 22 bp, Homo sapiens
aggcactgaaaggtggccagag

SEQ ID NO: 8377159 - DNA, 22 bp, Homo sapiens
aggcacagtgcctggaatcaaa

SEQ ID NO: 8377160 - DNA, 22 bp, Homo sapiens
aggcacaggtggacttcacagt

SEQ ID NO: 8377161 - DNA, 22 bp, Homo sapiens
aggcacagtggctcacacctgt

SEQ ID NO: 8377162 - DNA, 20 bp, Homo sapiens
aggcacagttcctagttggg

SEQ ID NO: 8377163 - DNA, 22 bp, Homo sapiens
aggcacagtggccctgtttggg

SEQ ID NO: 8377164 - DNA, 22 bp, Homo sapiens
aggatgaatatttagtgggata

SEQ ID NO: 8377165 - DNA, 22 bp, Homo sapiens
catgtgtctttatggagccaca

SEQ ID NO: 8377166 - DNA, 22 bp, Homo sapiens
catgtgtgaagactgcgggcca

SEQ ID NO: 8377167 - DNA, 22 bp, Homo sapiens
catgtgtgaatcttgtgatcat

SEQ ID NO: 8377168 - DNA, 22 bp, Homo sapiens
catgtgtgaatcttgtgatcat

SEQ ID NO: 8377169 - DNA, 22 bp, Homo sapiens
catgtgtgaatcttgtgatcat

SEQ ID NO: 8377170 - DNA, 22 bp, Homo sapiens
aggcacaggtggacttcacagt

SEQ ID NO: 8377171 - DNA, 22 bp, Homo sapiens
catgtgtgggacccttaggttg

SEQ ID NO: 8377172 - DNA, 22 bp, Homo sapiens
catgtgtggtctgtggctatct

SEQ ID NO: 8377173 - DNA, 23 bp, Homo sapiens
catgtgtgacagtatcactgttt

SEQ ID NO: 8377174 - DNA, 22 bp, Homo sapiens
catgtgtgagtatatcttatcc

SEQ ID NO: 8377175 - DNA, 22 bp, Homo sapiens
catgtgtggagggcatgcatgg

SEQ ID NO: 8377176 - DNA, 22 bp, Homo sapiens
catgtgtgagtgagcagtcttc

SEQ ID NO: 8377177 - DNA, 22 bp, Homo sapiens
aggatcctttttctgctgtttg

SEQ ID NO: 8377178 - DNA, 20 bp, Homo sapiens
aggatctgagatagaatgga

SEQ ID NO: 8377179 - DNA, 22 bp, Homo sapiens
aggatctgtgcctcaacccaga

SEQ ID NO: 8377180 - DNA, 22 bp, Homo sapiens
aggatcaggccctctagggtag

SEQ ID NO: 8377181 - DNA, 22 bp, Homo sapiens
aggatcaaatgaaatattttga

SEQ ID NO: 8377182 - DNA, 22 bp, Homo sapiens
aggagtggtgcaggacctgcca

SEQ ID NO: 8377183 - DNA, 22 bp, Homo sapiens
aggagtgggggcgagaagttaa

SEQ ID NO: 8377184 - DNA, 20 bp, Homo sapiens
catcattttaaaatctctcc

SEQ ID NO: 8377185 - DNA, 22 bp, Homo sapiens
aggagggtttcaatgggatgag

SEQ ID NO: 8377186 - DNA, 22 bp, Homo sapiens
aggaggtgacagcctgcatctg

SEQ ID NO: 8377187 - DNA, 22 bp, Homo sapiens
aggaggtgagcggtcatgtggt

SEQ ID NO: 8377188 - DNA, 21 bp, Homo sapiens
aggaggctgtctctttcagct

SEQ ID NO: 8377189 - DNA, 22 bp, Homo sapiens
aggaggctggttcaggccatat

SEQ ID NO: 8377190 - DNA, 22 bp, Homo sapiens
aggaggctggttcaggccatat

SEQ ID NO: 8377191 - DNA, 22 bp, Homo sapiens
aggagggtggcctcatgtgagt

SEQ ID NO: 8377192 - DNA, 22 bp, Homo sapiens
aggagggttctctggacagagg

SEQ ID NO: 8377193 - DNA, 22 bp, Homo sapiens
aggagggttctctggacagagg

SEQ ID NO: 8377194 - DNA, 22 bp, Homo sapiens
aggaggctgggcacagtggcct

SEQ ID NO: 8377195 - DNA, 22 bp, Homo sapiens
aggaggctgggcacagtggcct

SEQ ID NO: 8377196 - DNA, 19 bp, Homo sapiens
catcagagggcataggatg

SEQ ID NO: 8377197 - DNA, 19 bp, Homo sapiens
catcagagggcataggatg

SEQ ID NO: 8377198 - DNA, 22 bp, Homo sapiens
aggaggctgcaaccctgaggcc

SEQ ID NO: 8377199 - DNA, 19 bp, Homo sapiens
catcagagggcataggatg

SEQ ID NO: 8377200 - DNA, 22 bp, Homo sapiens
aggaggctgcaaccctgaggcc

SEQ ID NO: 8377201 - DNA, 22 bp, Homo sapiens
catcactggctgctgacagatg

SEQ ID NO: 8377202 - DNA, 22 bp, Homo sapiens
catcacttttaaaggtgatcga

SEQ ID NO: 8377203 - DNA, 22 bp, Homo sapiens
catcactgtcctcagcattcca

SEQ ID NO: 8377204 - DNA, 20 bp, Homo sapiens
catcagaaatcctgacccac

SEQ ID NO: 8377205 - DNA, 22 bp, Homo sapiens
catcagaaggaaggacgattat

SEQ ID NO: 8377206 - DNA, 22 bp, Homo sapiens
catcagaagatggctctggaaa

SEQ ID NO: 8377207 - DNA, 22 bp, Homo sapiens
catcagaacgtgagctccttgt

SEQ ID NO: 8377208 - DNA, 22 bp, Homo sapiens
catattttagttgctgaacagc

SEQ ID NO: 8377209 - DNA, 22 bp, Homo sapiens
catcacatttaattaaaatgtc

SEQ ID NO: 8377210 - DNA, 22 bp, Homo sapiens
cagttcaagagaaatactactg

SEQ ID NO: 8377211 - DNA, 22 bp, Homo sapiens
cagttcaaagttaagcagcagt

SEQ ID NO: 8377212 - DNA, 22 bp, Homo sapiens
aggagctgggctgctgctggga

SEQ ID NO: 8377213 - DNA, 17 bp, Homo sapiens
aggagctgggggtggtg

SEQ ID NO: 8377214 - DNA, 22 bp, Homo sapiens
aggagctgggcccaaggatgct

SEQ ID NO: 8377215 - DNA, 22 bp, Homo sapiens
aggagctgggcccaaggatgct

SEQ ID NO: 8377216 - DNA, 22 bp, Homo sapiens
aggagctggccactaggatgca

SEQ ID NO: 8377217 - DNA, 22 bp, Homo sapiens
aggagctggcctagaaaggaga

SEQ ID NO: 8377218 - DNA, 22 bp, Homo sapiens
aggagctggccactaggatgca

SEQ ID NO: 8377219 - DNA, 22 bp, Homo sapiens
aggagctgatagtctatggaga

SEQ ID NO: 8377220 - DNA, 22 bp, Homo sapiens
aggagctgatagtctatggaga

SEQ ID NO: 8377221 - DNA, 22 bp, Homo sapiens
cagtggaaatcagagtgagagt

SEQ ID NO: 8377222 - DNA, 22 bp, Homo sapiens
aggagcagcccactcctgtcct

SEQ ID NO: 8377223 - DNA, 22 bp, Homo sapiens
aggagcagcttctgaaccatgt

SEQ ID NO: 8377224 - DNA, 21 bp, Homo sapiens
aggagcattgttgtggtggag

SEQ ID NO: 8377225 - DNA, 22 bp, Homo sapiens
aggagccaaattactagctctg

SEQ ID NO: 8377226 - DNA, 22 bp, Homo sapiens
aggagccaaggaaaacagtatt

SEQ ID NO: 8377227 - DNA, 22 bp, Homo sapiens
cagtgcttttcaaagttctatg

SEQ ID NO: 8377228 - DNA, 22 bp, Homo sapiens
cagtgcttttttaccttccaac

SEQ ID NO: 8377229 - DNA, 22 bp, Homo sapiens
cagtgcttggggagcggagaga

SEQ ID NO: 8377230 - DNA, 22 bp, Homo sapiens
cagtgctttgggaggctgagga

SEQ ID NO: 8377231 - DNA, 22 bp, Homo sapiens
aggagccacctaggagctgttt

SEQ ID NO: 8377232 - DNA, 17 bp, Homo sapiens
cagtgcttctgcttctt

SEQ ID NO: 8377233 - DNA, 22 bp, Homo sapiens
cagtgcagctgccccgctggta

SEQ ID NO: 8377234 - DNA, 22 bp, Homo sapiens
cagtgcagctgccccgctggta

SEQ ID NO: 8377235 - DNA, 22 bp, Homo sapiens
cagtgcagccaaggacaggcac

SEQ ID NO: 8377236 - DNA, 22 bp, Homo sapiens
cagtgcaggaagtgagatgcct

SEQ ID NO: 8377237 - DNA, 22 bp, Homo sapiens
cagtgcaggcttgtggccgcag

SEQ ID NO: 8377238 - DNA, 22 bp, Homo sapiens
cagtgcaggcttgtggccgcag

SEQ ID NO: 8377239 - DNA, 22 bp, Homo sapiens
cagtgcaggctgggggccctgc

SEQ ID NO: 8377240 - DNA, 23 bp, Homo sapiens
cagtgcagggcaactcagactcc

SEQ ID NO: 8377241 - DNA, 23 bp, Homo sapiens
cagtgcagggcaactcagactcc

SEQ ID NO: 8377242 - DNA, 22 bp, Homo sapiens
aggagatcagcttagggaaggt

SEQ ID NO: 8377243 - DNA, 22 bp, Homo sapiens
cagtgaggctctgctgagcggt

SEQ ID NO: 8377244 - DNA, 22 bp, Homo sapiens
cagtgagggaagatctcagcac

SEQ ID NO: 8377245 - DNA, 22 bp, Homo sapiens
cagtgaggctctgctgagcggt

SEQ ID NO: 8377246 - DNA, 17 bp, Homo sapiens
cagtgaggcctttcctc

SEQ ID NO: 8377247 - DNA, 21 bp, Homo sapiens
cagtgaggccctcctgttccc

SEQ ID NO: 8377248 - DNA, 22 bp, Homo sapiens
cagtgagggcccccttccaggt

SEQ ID NO: 8377249 - DNA, 22 bp, Homo sapiens
cagtgagggcccccttccaggt

SEQ ID NO: 8377250 - DNA, 22 bp, Homo sapiens
cagtgagggcccccttccaggt

SEQ ID NO: 8377251 - DNA, 17 bp, Homo sapiens
cagtgcagataagtgag

SEQ ID NO: 8377252 - DNA, 22 bp, Homo sapiens
cagtgagggcattcagtgctgg

SEQ ID NO: 8377253 - DNA, 22 bp, Homo sapiens
aggacaaaggaccagatctgga

SEQ ID NO: 8377254 - DNA, 22 bp, Homo sapiens
aggacaaaggaccagatctgga

SEQ ID NO: 8377255 - DNA, 18 bp, Homo sapiens
cagtgaggatgaagggtt

SEQ ID NO: 8377256 - DNA, 22 bp, Homo sapiens
cagtgaggagtccagggcagag

SEQ ID NO: 8377257 - DNA, 18 bp, Homo sapiens
cagtgaggatgaagggtt

SEQ ID NO: 8377258 - DNA, 22 bp, Homo sapiens
cagtgaggatgataattaaggt

SEQ ID NO: 8377259 - DNA, 22 bp, Homo sapiens
cagtgaggagtccagggcagag

SEQ ID NO: 8377260 - DNA, 22 bp, Homo sapiens
cagtgaggagtccagggcagag

SEQ ID NO: 8377261 - DNA, 22 bp, Homo sapiens
cagtgaggagtccagggcagag

SEQ ID NO: 8377262 - DNA, 22 bp, Homo sapiens
cagtgaggagtccagggcagag

SEQ ID NO: 8377263 - DNA, 22 bp, Homo sapiens
cagtgaggagtccagggcagag

SEQ ID NO: 8377264 - DNA, 22 bp, Homo sapiens
aggaattttaatatgcttgtct

SEQ ID NO: 8377265 - DNA, 22 bp, Homo sapiens
aggaatttggggttacatgatg

SEQ ID NO: 8377266 - DNA, 22 bp, Homo sapiens
agctgcctcagtcactcatggc

SEQ ID NO: 8377267 - DNA, 22 bp, Homo sapiens
agctgcccttaataggcattca

SEQ ID NO: 8377268 - DNA, 22 bp, Homo sapiens
agctgccctgtggggagggttg

SEQ ID NO: 8377269 - DNA, 22 bp, Homo sapiens
agctgccagatgacagtgctat

SEQ ID NO: 8377270 - DNA, 20 bp, Homo sapiens
agctgcccctgggcactgcc

SEQ ID NO: 8377271 - DNA, 21 bp, Homo sapiens
agctgctttcagctcctagag

SEQ ID NO: 8377272 - DNA, 22 bp, Homo sapiens
agctggaacgtcacaggagcag

SEQ ID NO: 8377273 - DNA, 22 bp, Homo sapiens
agctggaacccgggtgggcagc

SEQ ID NO: 8377274 - DNA, 22 bp, Homo sapiens
agctggaaagaaggtggcagcc

SEQ ID NO: 8377275 - DNA, 17 bp, Homo sapiens
agctgcctctcccacca

SEQ ID NO: 8377276 - DNA, 22 bp, Homo sapiens
agctgcctctcttgaggttacg

SEQ ID NO: 8377277 - DNA, 22 bp, Homo sapiens
agctgcctgcatttatatcctg

SEQ ID NO: 8377278 - DNA, 22 bp, Homo sapiens
caggaagaccagggctgtggct

SEQ ID NO: 8377279 - DNA, 22 bp, Homo sapiens
caggaagaagggtggtgagtcc

SEQ ID NO: 8377280 - DNA, 22 bp, Homo sapiens
caggaacctgctccaagaggca

SEQ ID NO: 8377281 - DNA, 22 bp, Homo sapiens
caggaacctgtgcgtagggatg

SEQ ID NO: 8377282 - DNA, 22 bp, Homo sapiens
caggaagaaagaggtgaggtgt

SEQ ID NO: 8377283 - DNA, 22 bp, Homo sapiens
caggaaatgaacaggaatgaac

SEQ ID NO: 8377284 - DNA, 23 bp, Homo sapiens
caggaaatgaatccaggaggatg

SEQ ID NO: 8377285 - DNA, 23 bp, Homo sapiens
caggaaatgaatccaggaggatg

SEQ ID NO: 8377286 - DNA, 22 bp, Homo sapiens
caggaaatgaaagctagctaat

SEQ ID NO: 8377287 - DNA, 22 bp, Homo sapiens
caggaaatgaacaggaatgaac

SEQ ID NO: 8377288 - DNA, 22 bp, Homo sapiens
caggaaatgcgtagttgaactt

SEQ ID NO: 8377289 - DNA, 22 bp, Homo sapiens
caggaaatgctatcatagctga

SEQ ID NO: 8377290 - DNA, 22 bp, Homo sapiens
caggaaatgaggctgaagggtg

SEQ ID NO: 8377291 - DNA, 15 bp, Homo sapiens
caggaaatgaatctg

SEQ ID NO: 8377292 - DNA, 22 bp, Homo sapiens
caggaaatgaggctgaagggtg

SEQ ID NO: 8377293 - DNA, 22 bp, Homo sapiens
caggaaatgcgtagttgaactt

SEQ ID NO: 8377294 - DNA, 22 bp, Homo sapiens
caggaaccaggagagtccctga

SEQ ID NO: 8377295 - DNA, 22 bp, Homo sapiens
caggaaccaggagagtccctga

SEQ ID NO: 8377296 - DNA, 23 bp, Homo sapiens
caggaaatgcttggaggggctgg

SEQ ID NO: 8377297 - DNA, 23 bp, Homo sapiens
caggaaatgcttggaggggctgg

SEQ ID NO: 8377298 - DNA, 23 bp, Homo sapiens
caggaaatgcttggaggggctgg

SEQ ID NO: 8377299 - DNA, 22 bp, Homo sapiens
caggaacccaatgggccaggcc

SEQ ID NO: 8377300 - DNA, 22 bp, Homo sapiens
caggaaccattttctctttata

SEQ ID NO: 8377301 - DNA, 22 bp, Homo sapiens
caggaacccccactctcagctc

SEQ ID NO: 8377302 - DNA, 22 bp, Homo sapiens
caggaaatatctcaacacttta

SEQ ID NO: 8377303 - DNA, 22 bp, Homo sapiens
caggaaatatctcaacacttta

SEQ ID NO: 8377304 - DNA, 22 bp, Homo sapiens
caggaaatataggaaaaggaac

SEQ ID NO: 8377305 - DNA, 22 bp, Homo sapiens
caggaaatataggaaaaggaac

SEQ ID NO: 8377306 - DNA, 22 bp, Homo sapiens
caggaaatataggaaaaggaac

SEQ ID NO: 8377307 - DNA, 22 bp, Homo sapiens
caggaaatatctcctggcagag

SEQ ID NO: 8377308 - DNA, 22 bp, Homo sapiens
caggaaatatctcctggcagag

SEQ ID NO: 8377309 - DNA, 22 bp, Homo sapiens
caggaaatcactctgattttgg

SEQ ID NO: 8377310 - DNA, 23 bp, Homo sapiens
caggaaatcaattcttccagcat

SEQ ID NO: 8377311 - DNA, 22 bp, Homo sapiens
caggaaatcagaactcaagtgg

SEQ ID NO: 8377312 - DNA, 22 bp, Homo sapiens
caggaaatcagaactcaagtgg

SEQ ID NO: 8377313 - DNA, 21 bp, Homo sapiens
caggaaatcagtgtgaattag

SEQ ID NO: 8377314 - DNA, 21 bp, Homo sapiens
caggaaatcagtgtgaattag

SEQ ID NO: 8377315 - DNA, 22 bp, Homo sapiens
caggaaatcagaactcaagtgg

SEQ ID NO: 8377316 - DNA, 22 bp, Homo sapiens
agctcttttgctctccaagttt

SEQ ID NO: 8377317 - DNA, 22 bp, Homo sapiens
agctgaaacttcccattaattg

SEQ ID NO: 8377318 - DNA, 22 bp, Homo sapiens
agctgaaacccaggcctcagct

SEQ ID NO: 8377319 - DNA, 21 bp, Homo sapiens
agctgaaaagttgtttacaag

SEQ ID NO: 8377320 - DNA, 22 bp, Homo sapiens
agctgaaagggtgttggagtgt

SEQ ID NO: 8377321 - DNA, 22 bp, Homo sapiens
agctgaaattctttgtcctcag

SEQ ID NO: 8377322 - DNA, 22 bp, Homo sapiens
agctgaaattttactgagtata

SEQ ID NO: 8377323 - DNA, 17 bp, Homo sapiens
agctgaaattgctgaag

SEQ ID NO: 8377324 - DNA, 22 bp, Homo sapiens
agctgaagaaatgggaagcatt

SEQ ID NO: 8377325 - DNA, 20 bp, Homo sapiens
caggcagaggatgctgacca

SEQ ID NO: 8377326 - DNA, 22 bp, Homo sapiens
caggcagaggaggccttctcct

SEQ ID NO: 8377327 - DNA, 22 bp, Homo sapiens
caggcagaggaagtctgggtct

SEQ ID NO: 8377328 - DNA, 22 bp, Homo sapiens
caggcagaggaagtctgggtct

SEQ ID NO: 8377329 - DNA, 22 bp, Homo sapiens
caggcagagtgagaagcccttg

SEQ ID NO: 8377330 - DNA, 22 bp, Homo sapiens
caggcagagtgagaagcccttg

SEQ ID NO: 8377331 - DNA, 22 bp, Homo sapiens
caggcagagtcagattagactt

SEQ ID NO: 8377332 - DNA, 22 bp, Homo sapiens
caggcagaggtaccaagattga

SEQ ID NO: 8377333 - DNA, 22 bp, Homo sapiens
caggcagaggcttttcatggct

SEQ ID NO: 8377334 - DNA, 22 bp, Homo sapiens
caggcagaggcttttcatggct

SEQ ID NO: 8377335 - DNA, 22 bp, Homo sapiens
agctggaattacaggagcccat

SEQ ID NO: 8377336 - DNA, 22 bp, Homo sapiens
agctgggcctgagctggaagct

SEQ ID NO: 8377337 - DNA, 21 bp, Homo sapiens
agctgggcctcagcctgcagt

SEQ ID NO: 8377338 - DNA, 22 bp, Homo sapiens
agctggaggagtttctcctagc

SEQ ID NO: 8377339 - DNA, 22 bp, Homo sapiens
agctggaggataactcacttct

SEQ ID NO: 8377340 - DNA, 22 bp, Homo sapiens
caggctgtgaaactgagatgcg

SEQ ID NO: 8377341 - DNA, 22 bp, Homo sapiens
caggctgtggatcaggagcctt

SEQ ID NO: 8377342 - DNA, 22 bp, Homo sapiens
caggctgtgttcctggaacccc

SEQ ID NO: 8377343 - DNA, 22 bp, Homo sapiens
caggcttaggagtcagcctgct

SEQ ID NO: 8377344 - DNA, 22 bp, Homo sapiens
caggcttgattattcagacaat

SEQ ID NO: 8377345 - DNA, 22 bp, Homo sapiens
agctttcaggataatgaaaaag

SEQ ID NO: 8377346 - DNA, 22 bp, Homo sapiens
agctttcacgatttggaacagg

SEQ ID NO: 8377347 - DNA, 22 bp, Homo sapiens
agctttcagtctctgaaggaac

SEQ ID NO: 8377348 - DNA, 22 bp, Homo sapiens
agctttcgttccttagacacat

SEQ ID NO: 8377349 - DNA, 22 bp, Homo sapiens
agctttctagactctgtggtca

SEQ ID NO: 8377350 - DNA, 22 bp, Homo sapiens
agcttctgttcatcttccaggc

SEQ ID NO: 8377351 - DNA, 22 bp, Homo sapiens
agcttctgttcatcttccaggc

SEQ ID NO: 8377352 - DNA, 22 bp, Homo sapiens
agcttctggaaggcaaggcttg

SEQ ID NO: 8377353 - DNA, 22 bp, Homo sapiens
agcttctggaagcctggcagca

SEQ ID NO: 8377354 - DNA, 22 bp, Homo sapiens
agcttctcctggtacagaactg

SEQ ID NO: 8377355 - DNA, 22 bp, Homo sapiens
agcttctccctttcctattggt

SEQ ID NO: 8377356 - DNA, 22 bp, Homo sapiens
agcttctctggtcttctgccaa

SEQ ID NO: 8377357 - DNA, 22 bp, Homo sapiens
agctttgggccactggctggat

SEQ ID NO: 8377358 - DNA, 22 bp, Homo sapiens
agctttggggacagccaaggtt

SEQ ID NO: 8377359 - DNA, 22 bp, Homo sapiens
cagggacatgactggtctctgt

SEQ ID NO: 8377360 - DNA, 22 bp, Homo sapiens
cagggacatgactggtctctgt

SEQ ID NO: 8377361 - DNA, 22 bp, Homo sapiens
cagggacatgactggtctctgt

SEQ ID NO: 8377362 - DNA, 22 bp, Homo sapiens
cagggacattggtggccaggtt

SEQ ID NO: 8377363 - DNA, 22 bp, Homo sapiens
cagggacatttccaagagaatt

SEQ ID NO: 8377364 - DNA, 22 bp, Homo sapiens
cagggacatttccaagagaatt

SEQ ID NO: 8377365 - DNA, 22 bp, Homo sapiens
cagggacatgactggtctctgt

SEQ ID NO: 8377366 - DNA, 22 bp, Homo sapiens
cagggacataagaggaacatgg

SEQ ID NO: 8377367 - DNA, 22 bp, Homo sapiens
cagggacataagaggaacatgg

SEQ ID NO: 8377368 - DNA, 20 bp, Homo sapiens
cagggacagtggcagattca

SEQ ID NO: 8377369 - DNA, 22 bp, Homo sapiens
cagggacaggggagaaaagatg

SEQ ID NO: 8377370 - DNA, 22 bp, Homo sapiens
cagggacagcgggactctgaca

SEQ ID NO: 8377371 - DNA, 22 bp, Homo sapiens
cagggacagcgggactctgaca

SEQ ID NO: 8377372 - DNA, 22 bp, Homo sapiens
agctttctcttctttagaaagt

SEQ ID NO: 8377373 - DNA, 22 bp, Homo sapiens
agctttctctcagccaggctgc

SEQ ID NO: 8377374 - DNA, 22 bp, Homo sapiens
agctttctagatttggaattgt

SEQ ID NO: 8377375 - DNA, 22 bp, Homo sapiens
agctttctatatatgagttgct

SEQ ID NO: 8377376 - DNA, 20 bp, Homo sapiens
agctttctccttggagctcc

SEQ ID NO: 8377377 - DNA, 22 bp, Homo sapiens
agctttctccctgacgctttgg

SEQ ID NO: 8377378 - DNA, 21 bp, Homo sapiens
aggaaaattgagggttgttgt

SEQ ID NO: 8377379 - DNA, 22 bp, Homo sapiens
aggaaacaacttggcatgagcc

SEQ ID NO: 8377380 - DNA, 22 bp, Homo sapiens
aggaaacaacttggcatgagcc

SEQ ID NO: 8377381 - DNA, 22 bp, Homo sapiens
aggaaacaacttggcatgagcc

SEQ ID NO: 8377382 - DNA, 22 bp, Homo sapiens
aggaaaatgaaacagcaactgt

SEQ ID NO: 8377383 - DNA, 22 bp, Homo sapiens
aggaaaatgaaacagcaactgt

SEQ ID NO: 8377384 - DNA, 22 bp, Homo sapiens
aggaaaagtgtgaagtatggag

SEQ ID NO: 8377385 - DNA, 22 bp, Homo sapiens
aggaaaacagaccaaggagctc

SEQ ID NO: 8377386 - DNA, 22 bp, Homo sapiens
aggaaaacacagtattgatgga

SEQ ID NO: 8377387 - DNA, 20 bp, Homo sapiens
aggaaaaatggaaactggag

SEQ ID NO: 8377388 - DNA, 20 bp, Homo sapiens
aggaaaagggtggtggtaga

SEQ ID NO: 8377389 - DNA, 22 bp, Homo sapiens
aggaaaagtgtgaagtatggag

SEQ ID NO: 8377390 - DNA, 22 bp, Homo sapiens
aggaaaaataaggcagcagggc

SEQ ID NO: 8377391 - DNA, 20 bp, Homo sapiens
aggaaaaatggaaactggag

SEQ ID NO: 8377392 - DNA, 22 bp, Homo sapiens
caggtccctgcgccccggcctc

SEQ ID NO: 8377393 - DNA, 22 bp, Homo sapiens
caggtcctctgagatgggaggt

SEQ ID NO: 8377394 - DNA, 22 bp, Homo sapiens
caggtcctggcatcaggcaggt

SEQ ID NO: 8377395 - DNA, 22 bp, Homo sapiens
caggtcctggcatcaggcaggt

SEQ ID NO: 8377396 - DNA, 22 bp, Homo sapiens
caggtcctggcatcaggcaggt

SEQ ID NO: 8377397 - DNA, 22 bp, Homo sapiens
aggaatgtcgtcataaacatga

SEQ ID NO: 8377398 - DNA, 22 bp, Homo sapiens
aggaatgtggcaatcttcaagt

SEQ ID NO: 8377399 - DNA, 21 bp, Homo sapiens
aggaatgtgtatatatacaat

SEQ ID NO: 8377400 - DNA, 20 bp, Homo sapiens
aggaagtattgtcatgaagg

SEQ ID NO: 8377401 - DNA, 20 bp, Homo sapiens
aggaagtattgtcatgaagg

SEQ ID NO: 8377402 - DNA, 22 bp, Homo sapiens
aggaaggtgcagtagggtgtgc

SEQ ID NO: 8377403 - DNA, 22 bp, Homo sapiens
aggaaggtaatgaactgaggag

SEQ ID NO: 8377404 - DNA, 22 bp, Homo sapiens
caggtcccctcccctaccaggc

SEQ ID NO: 8377405 - DNA, 22 bp, Homo sapiens
caggtccccagggtacctacct

SEQ ID NO: 8377406 - DNA, 22 bp, Homo sapiens
caggtcccgccccgggctgacc

SEQ ID NO: 8377407 - DNA, 22 bp, Homo sapiens
caggtcccgttccccagagatt

SEQ ID NO: 8377408 - DNA, 20 bp, Homo sapiens
caggtccagcacgtgcacgg

SEQ ID NO: 8377409 - DNA, 17 bp, Homo sapiens
caggtcccagggtctct

SEQ ID NO: 8377410 - DNA, 22 bp, Homo sapiens
caggtccagtcactggtctgca

SEQ ID NO: 8377411 - DNA, 22 bp, Homo sapiens
aggaagggtgtcatgagccctt

SEQ ID NO: 8377412 - DNA, 22 bp, Homo sapiens
aggaagggttctttctgtttat

SEQ ID NO: 8377413 - DNA, 22 bp, Homo sapiens
aggaagggttctttgtgaaaga

SEQ ID NO: 8377414 - DNA, 22 bp, Homo sapiens
aggaaacatgaatctgccttga

SEQ ID NO: 8377415 - DNA, 22 bp, Homo sapiens
aggaaacatgaatctgccttga

SEQ ID NO: 8377416 - DNA, 22 bp, Homo sapiens
aggaaacatccttatctattct

SEQ ID NO: 8377417 - DNA, 22 bp, Homo sapiens
aggaaacatgaatctgccttga

SEQ ID NO: 8377418 - DNA, 22 bp, Homo sapiens
aggaaacatccttatctattct

SEQ ID NO: 8377419 - DNA, 17 bp, Homo sapiens
aggaaacattttctttc

SEQ ID NO: 8377420 - DNA, 22 bp, Homo sapiens
aggaaacattgatattgggaaa

SEQ ID NO: 8377421 - DNA, 22 bp, Homo sapiens
aggaaacagtgaacttggcagg

SEQ ID NO: 8377422 - DNA, 22 bp, Homo sapiens
aggaaacagtgaacttggcagg

SEQ ID NO: 8377423 - DNA, 22 bp, Homo sapiens
aggaaacaggcagcctttgaac

SEQ ID NO: 8377424 - DNA, 22 bp, Homo sapiens
aggaaacaggcagcctttgaac

SEQ ID NO: 8377425 - DNA, 22 bp, Homo sapiens
aggaaacagagtgaagcttggg

SEQ ID NO: 8377426 - DNA, 22 bp, Homo sapiens
aggaaacagagtgaagcttggg

SEQ ID NO: 8377427 - DNA, 22 bp, Homo sapiens
aggaaacatccttatctattct

SEQ ID NO: 8377428 - DNA, 22 bp, Homo sapiens
aggaaacagttggtaatgcata

SEQ ID NO: 8377429 - DNA, 22 bp, Homo sapiens
aggaaacagttggtaatgcata

SEQ ID NO: 8377430 - DNA, 22 bp, Homo sapiens
cagggtggtgaatagctatagt

SEQ ID NO: 8377431 - DNA, 22 bp, Homo sapiens
cagggtggtgaatagctatagt

SEQ ID NO: 8377432 - DNA, 22 bp, Homo sapiens
cagggtgtgaacagtgtaaaac

SEQ ID NO: 8377433 - DNA, 22 bp, Homo sapiens
cagggtggtaccagcatctagt

SEQ ID NO: 8377434 - DNA, 22 bp, Homo sapiens
cagggtggtaccagcatctagt

SEQ ID NO: 8377435 - DNA, 22 bp, Homo sapiens
aggaagcactggaaggggttgg

SEQ ID NO: 8377436 - DNA, 22 bp, Homo sapiens
aggaagaggtgtgcaatggtgt

SEQ ID NO: 8377437 - DNA, 22 bp, Homo sapiens
cagggtttcaccatgttagcag

SEQ ID NO: 8377438 - DNA, 22 bp, Homo sapiens
aggaagagggtggcagataatc

SEQ ID NO: 8377439 - DNA, 22 bp, Homo sapiens
aggaagagggtggcagataatc

SEQ ID NO: 8377440 - DNA, 22 bp, Homo sapiens
aggaagaggtagctgtcaaggg

SEQ ID NO: 8377441 - DNA, 22 bp, Homo sapiens
ctggccagactacacatgtgtg

SEQ ID NO: 8377442 - DNA, 22 bp, Homo sapiens
ctggcctcacctcagacttact

SEQ ID NO: 8377443 - DNA, 22 bp, Homo sapiens
ctggcctcagagggtcatggtg

SEQ ID NO: 8377444 - DNA, 22 bp, Homo sapiens
ctggcctcatagccaagctgtg

SEQ ID NO: 8377445 - DNA, 22 bp, Homo sapiens
ctggcctcggcagcaggaacag

SEQ ID NO: 8377446 - DNA, 22 bp, Homo sapiens
ctggcctaaaaatacagaacaa

SEQ ID NO: 8377447 - DNA, 22 bp, Homo sapiens
ctggcctaaaattgcttctgca

SEQ ID NO: 8377448 - DNA, 22 bp, Homo sapiens
ctggccggtatttgcctctggg

SEQ ID NO: 8377449 - DNA, 22 bp, Homo sapiens
ctggcaggtttggtgtctggtg

SEQ ID NO: 8377450 - DNA, 22 bp, Homo sapiens
ctggcaggtttggtgtctggtg

SEQ ID NO: 8377451 - DNA, 22 bp, Homo sapiens
ctggcaggtggaggttgcagtg

SEQ ID NO: 8377452 - DNA, 22 bp, Homo sapiens
ctggcaggtccagctggactca

SEQ ID NO: 8377453 - DNA, 22 bp, Homo sapiens
ctggcagcttattagaaatgca

SEQ ID NO: 8377454 - DNA, 22 bp, Homo sapiens
ctggcaggtggatggggactcc

SEQ ID NO: 8377455 - DNA, 22 bp, Homo sapiens
ctggagtgcagtggcatgatca

SEQ ID NO: 8377456 - DNA, 22 bp, Homo sapiens
ctggcaagtactgggccagctc

SEQ ID NO: 8377457 - DNA, 20 bp, Homo sapiens
atacacattcatagaaaaat

SEQ ID NO: 8377458 - DNA, 22 bp, Homo sapiens
atacacattactttctgtctga

SEQ ID NO: 8377459 - DNA, 22 bp, Homo sapiens
ctggcacagagtgagcattcaa

SEQ ID NO: 8377460 - DNA, 22 bp, Homo sapiens
ctggcacagccactgcaggcag

SEQ ID NO: 8377461 - DNA, 22 bp, Homo sapiens
ctggcacaactccacctcagcg

SEQ ID NO: 8377462 - DNA, 23 bp, Homo sapiens
atacatggccggatatgatgttc

SEQ ID NO: 8377463 - DNA, 22 bp, Homo sapiens
atacatggaagatgcttagcac

SEQ ID NO: 8377464 - DNA, 17 bp, Homo sapiens
atacatgtaaagtgctt

SEQ ID NO: 8377465 - DNA, 22 bp, Homo sapiens
ctggcacataattagtgatcct

SEQ ID NO: 8377466 - DNA, 22 bp, Homo sapiens
atacatgtcatcatatgtttgt

SEQ ID NO: 8377467 - DNA, 22 bp, Homo sapiens
atacatgtgggtctaaacatat

SEQ ID NO: 8377468 - DNA, 22 bp, Homo sapiens
atacatgtcatcatatgtttgt

SEQ ID NO: 8377469 - DNA, 22 bp, Homo sapiens
atacatgtaactgcattgtaat

SEQ ID NO: 8377470 - DNA, 22 bp, Homo sapiens
atacatgtacataaatgtagca

SEQ ID NO: 8377471 - DNA, 22 bp, Homo sapiens
atacatgtgtccctgatttatt

SEQ ID NO: 8377472 - DNA, 22 bp, Homo sapiens
atacatgtgtccctgatttatt

SEQ ID NO: 8377473 - DNA, 22 bp, Homo sapiens
atataaagtgtttagaaagctg

SEQ ID NO: 8377474 - DNA, 22 bp, Homo sapiens
ctggctctttcctagctaggct

SEQ ID NO: 8377475 - DNA, 22 bp, Homo sapiens
atataaagagcttagtatagtg

SEQ ID NO: 8377476 - DNA, 23 bp, Homo sapiens
atagttttccctggttcttgcca

SEQ ID NO: 8377477 - DNA, 22 bp, Homo sapiens
ctggctcacaggtgagatgcat

SEQ ID NO: 8377478 - DNA, 22 bp, Homo sapiens
ctggcgagggtcgctggggact

SEQ ID NO: 8377479 - DNA, 22 bp, Homo sapiens
ctggctcaatttgtactgctgt

SEQ ID NO: 8377480 - DNA, 22 bp, Homo sapiens
ctggctcaataaatattagctg

SEQ ID NO: 8377481 - DNA, 22 bp, Homo sapiens
ctggccttggtgcttgcagaca

SEQ ID NO: 8377482 - DNA, 22 bp, Homo sapiens
ctggcctctctgagcagggagc

SEQ ID NO: 8377483 - DNA, 22 bp, Homo sapiens
ctggcctctctgagcagggagc

SEQ ID NO: 8377484 - DNA, 22 bp, Homo sapiens
ctggcctgtgggctgtctccgg

SEQ ID NO: 8377485 - DNA, 19 bp, Homo sapiens
ctggcctgtgtcctgtgct

SEQ ID NO: 8377486 - DNA, 22 bp, Homo sapiens
atatacagggagaaacagctta

SEQ ID NO: 8377487 - DNA, 22 bp, Homo sapiens
atatacagggagaaacagctta

SEQ ID NO: 8377488 - DNA, 22 bp, Homo sapiens
ctggctgatctcaatcatggct

SEQ ID NO: 8377489 - DNA, 22 bp, Homo sapiens
ctgggagctggaatgggagaag

SEQ ID NO: 8377490 - DNA, 22 bp, Homo sapiens
atatacttggagactatcattg

SEQ ID NO: 8377491 - DNA, 22 bp, Homo sapiens
ctgggagctgtcaggagcgtgt

SEQ ID NO: 8377492 - DNA, 22 bp, Homo sapiens
ctgggagctggaatgggagaag

SEQ ID NO: 8377493 - DNA, 22 bp, Homo sapiens
atatacttgatttaactgagca

SEQ ID NO: 8377494 - DNA, 22 bp, Homo sapiens
atatacttccccattatggggg

SEQ ID NO: 8377495 - DNA, 22 bp, Homo sapiens
atatactgatagctgcacttct

SEQ ID NO: 8377496 - DNA, 22 bp, Homo sapiens
atatactgaggagactttatat

SEQ ID NO: 8377497 - DNA, 20 bp, Homo sapiens
atataccatcccacaacagg

SEQ ID NO: 8377498 - DNA, 22 bp, Homo sapiens
ctgctggggtcagagcactggg

SEQ ID NO: 8377499 - DNA, 22 bp, Homo sapiens
ctgctgtgcttgtggccacccg

SEQ ID NO: 8377500 - DNA, 18 bp, Homo sapiens
ctgctgtgtcgtctgggc

SEQ ID NO: 8377501 - DNA, 22 bp, Homo sapiens
ctgctgtgtcagagtccagggg

SEQ ID NO: 8377502 - DNA, 22 bp, Homo sapiens
atacacatatgtgtgtatatgt

SEQ ID NO: 8377503 - DNA, 20 bp, Homo sapiens
atacacatattcttgcaact

SEQ ID NO: 8377504 - DNA, 22 bp, Homo sapiens
atacacatgcacacatgtgtgt

SEQ ID NO: 8377505 - DNA, 22 bp, Homo sapiens
atacacatatcaggtgtataca

SEQ ID NO: 8377506 - DNA, 21 bp, Homo sapiens
atacacatacacataaatgtg

SEQ ID NO: 8377507 - DNA, 22 bp, Homo sapiens
atacacagctacattgaacaat

SEQ ID NO: 8377508 - DNA, 22 bp, Homo sapiens
atacaagttgcccaaatgatta

SEQ ID NO: 8377509 - DNA, 22 bp, Homo sapiens
ctgctgggctcctcatgtgact

SEQ ID NO: 8377510 - DNA, 22 bp, Homo sapiens
ctgctgggctcctcatgtgact

SEQ ID NO: 8377511 - DNA, 22 bp, Homo sapiens
ctgctgcccagtgtgcattggg

SEQ ID NO: 8377512 - DNA, 22 bp, Homo sapiens
ctgctcaagtgcgcacccaggg

SEQ ID NO: 8377513 - DNA, 22 bp, Homo sapiens
ctgctagggttcagcagtgcct

SEQ ID NO: 8377514 - DNA, 22 bp, Homo sapiens
ctgcctgtgccaatgctccttt

SEQ ID NO: 8377515 - DNA, 22 bp, Homo sapiens
ctgcctgtgatttttctctagt

SEQ ID NO: 8377516 - DNA, 22 bp, Homo sapiens
ctgcctgtattgtctgcttggg

SEQ ID NO: 8377517 - DNA, 22 bp, Homo sapiens
ctgcctgtaactttctgaagca

SEQ ID NO: 8377518 - DNA, 22 bp, Homo sapiens
ctgcctgggttcaagtcctgtt

SEQ ID NO: 8377519 - DNA, 22 bp, Homo sapiens
ctgcctggtactttaggcactt

SEQ ID NO: 8377520 - DNA, 22 bp, Homo sapiens
ataaaggaaattccatgtctaa

SEQ ID NO: 8377521 - DNA, 22 bp, Homo sapiens
agttctggttgcccatgacatc

SEQ ID NO: 8377522 - DNA, 22 bp, Homo sapiens
agttctggcccagggtttcttg

SEQ ID NO: 8377523 - DNA, 22 bp, Homo sapiens
agttctctttagctcatatggt

SEQ ID NO: 8377524 - DNA, 22 bp, Homo sapiens
agttctctggctcctttccaga

SEQ ID NO: 8377525 - DNA, 22 bp, Homo sapiens
agttccttttatctgagtctaa

SEQ ID NO: 8377526 - DNA, 22 bp, Homo sapiens
agttctcattgcatgagacaga

SEQ ID NO: 8377527 - DNA, 22 bp, Homo sapiens
agttctcagaattgcacctcaa

SEQ ID NO: 8377528 - DNA, 17 bp, Homo sapiens
agttttgatataatggc

SEQ ID NO: 8377529 - DNA, 22 bp, Homo sapiens
ataaaaactgacccatcctttg

SEQ ID NO: 8377530 - DNA, 22 bp, Homo sapiens
ataaaaatgagggcggtagcta

SEQ ID NO: 8377531 - DNA, 22 bp, Homo sapiens
ataaaaaggacagatgtggtct

SEQ ID NO: 8377532 - DNA, 22 bp, Homo sapiens
ataaaagatcccttctgagctc

SEQ ID NO: 8377533 - DNA, 22 bp, Homo sapiens
ctgcaggctcgaagacacggat

SEQ ID NO: 8377534 - DNA, 22 bp, Homo sapiens
ataaagcaaataggactattgc

SEQ ID NO: 8377535 - DNA, 22 bp, Homo sapiens
ataaagcaggtccccagacact

SEQ ID NO: 8377536 - DNA, 22 bp, Homo sapiens
ataaactgggtatcaagaggcc

SEQ ID NO: 8377537 - DNA, 22 bp, Homo sapiens
ataaagcaaataggactattgc

SEQ ID NO: 8377538 - DNA, 22 bp, Homo sapiens
ataaagatttctttttctctac

SEQ ID NO: 8377539 - DNA, 22 bp, Homo sapiens
ataaagagtctgggaggcccac

SEQ ID NO: 8377540 - DNA, 22 bp, Homo sapiens
ataaacctatgctaagctgtgg

SEQ ID NO: 8377541 - DNA, 22 bp, Homo sapiens
ataaactgaagggaacactgag

SEQ ID NO: 8377542 - DNA, 22 bp, Homo sapiens
atcacagagattgcttttaaaa

SEQ ID NO: 8377543 - DNA, 22 bp, Homo sapiens
ctgtaaatatgaagaatatatg

SEQ ID NO: 8377544 - DNA, 22 bp, Homo sapiens
atcacaaagggttttctctgag

SEQ ID NO: 8377545 - DNA, 22 bp, Homo sapiens
atcacaaaggctgcttcatgat

SEQ ID NO: 8377546 - DNA, 22 bp, Homo sapiens
atcacaaaggtctcagagcaca

SEQ ID NO: 8377547 - DNA, 22 bp, Homo sapiens
atcacacagagcattaggggcc

SEQ ID NO: 8377548 - DNA, 22 bp, Homo sapiens
atcacaaaggtctcagagcaca

SEQ ID NO: 8377549 - DNA, 22 bp, Homo sapiens
atcagagccctgatgacagact

SEQ ID NO: 8377550 - DNA, 22 bp, Homo sapiens
atcagagcccggcaatttattt

SEQ ID NO: 8377551 - DNA, 22 bp, Homo sapiens
atcagagccctgatgacagact

SEQ ID NO: 8377552 - DNA, 22 bp, Homo sapiens
atcagagccttatgcttctcat

SEQ ID NO: 8377553 - DNA, 22 bp, Homo sapiens
atcagagctagtacttgcaggt

SEQ ID NO: 8377554 - DNA, 22 bp, Homo sapiens
atcagcagaccattttccaaat

SEQ ID NO: 8377555 - DNA, 22 bp, Homo sapiens
atcagtttggaacattcaggcc

SEQ ID NO: 8377556 - DNA, 22 bp, Homo sapiens
atcataaaccactttgtaatct

SEQ ID NO: 8377557 - DNA, 22 bp, Homo sapiens
atcataaaccactttgtaatct

SEQ ID NO: 8377558 - DNA, 22 bp, Homo sapiens
atcataaaattgcaccatttct

SEQ ID NO: 8377559 - DNA, 22 bp, Homo sapiens
atcataaaccactttgtaatct

SEQ ID NO: 8377560 - DNA, 22 bp, Homo sapiens
atcataaaccactttgtaatct

SEQ ID NO: 8377561 - DNA, 22 bp, Homo sapiens
atcagggtcttctttcagccta

SEQ ID NO: 8377562 - DNA, 22 bp, Homo sapiens
atcaggtagatttaatattctg

SEQ ID NO: 8377563 - DNA, 22 bp, Homo sapiens
ctgtctcctccactgcatggga

SEQ ID NO: 8377564 - DNA, 22 bp, Homo sapiens
atcaggaaaaattgtgaaaggg

SEQ ID NO: 8377565 - DNA, 22 bp, Homo sapiens
atcaggaaaaattgtgaaaggg

SEQ ID NO: 8377566 - DNA, 22 bp, Homo sapiens
atcagcttaattctcaacaggt

SEQ ID NO: 8377567 - DNA, 22 bp, Homo sapiens
ctgtctcagcaggaagtcatca

SEQ ID NO: 8377568 - DNA, 22 bp, Homo sapiens
ctgtctcagcaggaagtcatca

SEQ ID NO: 8377569 - DNA, 22 bp, Homo sapiens
ctgtctcaagactgcaggcact

SEQ ID NO: 8377570 - DNA, 22 bp, Homo sapiens
ctgtctatcccttccttccttt

SEQ ID NO: 8377571 - DNA, 20 bp, Homo sapiens
ctgggaggtcttccaaatca

SEQ ID NO: 8377572 - DNA, 22 bp, Homo sapiens
ctgggaggggtagccaatccta

SEQ ID NO: 8377573 - DNA, 22 bp, Homo sapiens
ctgggaggattcattgaggtga

SEQ ID NO: 8377574 - DNA, 22 bp, Homo sapiens
ctgggaggacaacttggagctc

SEQ ID NO: 8377575 - DNA, 22 bp, Homo sapiens
ctgggagcttgttaggaatgca

SEQ ID NO: 8377576 - DNA, 19 bp, Homo sapiens
ctggggctttggtactgcc

SEQ ID NO: 8377577 - DNA, 19 bp, Homo sapiens
ctggggctttggtactgcc

SEQ ID NO: 8377578 - DNA, 22 bp, Homo sapiens
ctgggggcaatggtcagagtgt

SEQ ID NO: 8377579 - DNA, 22 bp, Homo sapiens
atattattctagtaacagtgat

SEQ ID NO: 8377580 - DNA, 22 bp, Homo sapiens
atattattctagctcttgtgtg

SEQ ID NO: 8377581 - DNA, 22 bp, Homo sapiens
ctggggctgtgggagacaaggc

SEQ ID NO: 8377582 - DNA, 22 bp, Homo sapiens
ctggggcatgggcccctagagg

SEQ ID NO: 8377583 - DNA, 22 bp, Homo sapiens
ctgggtggctgtccagccagcc

SEQ ID NO: 8377584 - DNA, 22 bp, Homo sapiens
ctggtcaggggatggggctcag

SEQ ID NO: 8377585 - DNA, 22 bp, Homo sapiens
ctggtcaggaaggtggggacag

SEQ ID NO: 8377586 - DNA, 22 bp, Homo sapiens
ctggtcaggggatggggctcag

SEQ ID NO: 8377587 - DNA, 17 bp, Homo sapiens
ctggtcccaccaagccc

SEQ ID NO: 8377588 - DNA, 22 bp, Homo sapiens
ctggtcccagctctgccaccaa

SEQ ID NO: 8377589 - DNA, 22 bp, Homo sapiens
ctggtcccatcctggcttcatg

SEQ ID NO: 8377590 - DNA, 22 bp, Homo sapiens
ctggtcccagcagagctctgag

SEQ ID NO: 8377591 - DNA, 22 bp, Homo sapiens
ctggtccctgcagtgtgctggg

SEQ ID NO: 8377592 - DNA, 22 bp, Homo sapiens
ctggtccctgagtagttatgca

SEQ ID NO: 8377593 - DNA, 22 bp, Homo sapiens
ctggtccccagactgggcttag

SEQ ID NO: 8377594 - DNA, 22 bp, Homo sapiens
ctgggtggatcgcagccccagg

SEQ ID NO: 8377595 - DNA, 22 bp, Homo sapiens
ctgggtggagcctggtcatctg

SEQ ID NO: 8377596 - DNA, 18 bp, Homo sapiens
ctgggtctccaggctgcc

SEQ ID NO: 8377597 - DNA, 20 bp, Homo sapiens
ctgggtggcaagcaaggggg

SEQ ID NO: 8377598 - DNA, 20 bp, Homo sapiens
ctgggtggcaagcaaggggg

SEQ ID NO: 8377599 - DNA, 22 bp, Homo sapiens
ctgggtggcagagcctgcagtg

SEQ ID NO: 8377600 - DNA, 22 bp, Homo sapiens
atattcaagtgaggatggctaa

SEQ ID NO: 8377601 - DNA, 22 bp, Homo sapiens
atattcacactgtttagttaca

SEQ ID NO: 8377602 - DNA, 22 bp, Homo sapiens
atattcaaattacatttactaa

SEQ ID NO: 8377603 - DNA, 22 bp, Homo sapiens
atattcaaattacatttactaa

SEQ ID NO: 8377604 - DNA, 22 bp, Homo sapiens
atattcaaattacatttactaa

SEQ ID NO: 8377605 - DNA, 22 bp, Homo sapiens
atattattttccctggagttgt

SEQ ID NO: 8377606 - DNA, 22 bp, Homo sapiens
atattattctagtaacagtgat

SEQ ID NO: 8377607 - DNA, 22 bp, Homo sapiens
atattattctagtaacagtgat

SEQ ID NO: 8377608 - DNA, 22 bp, Homo sapiens
cttctgagatgttgttttacag

SEQ ID NO: 8377609 - DNA, 22 bp, Homo sapiens
cttctgagatgttgttttacag

SEQ ID NO: 8377610 - DNA, 22 bp, Homo sapiens
cttctgagttaacagtagattt

SEQ ID NO: 8377611 - DNA, 22 bp, Homo sapiens
cttctgaggactctaaagagga

SEQ ID NO: 8377612 - DNA, 22 bp, Homo sapiens
cttcctttcagaggaaggcctg

SEQ ID NO: 8377613 - DNA, 22 bp, Homo sapiens
cttcctttcagaggaaggcctg

SEQ ID NO: 8377614 - DNA, 22 bp, Homo sapiens
atctggctcacttagtctagga

SEQ ID NO: 8377615 - DNA, 22 bp, Homo sapiens
atctggctcgctaggctctggg

SEQ ID NO: 8377616 - DNA, 22 bp, Homo sapiens
atctggctcattcagggaacgg

SEQ ID NO: 8377617 - DNA, 22 bp, Homo sapiens
atctggctcctacacttgaaga

SEQ ID NO: 8377618 - DNA, 22 bp, Homo sapiens
atctggctctctcatttacaaa

SEQ ID NO: 8377619 - DNA, 22 bp, Homo sapiens
atctggctctctcatttacaaa

SEQ ID NO: 8377620 - DNA, 22 bp, Homo sapiens
atctggctcttcctggagttcc

SEQ ID NO: 8377621 - DNA, 22 bp, Homo sapiens
atctggtgctaacaaatgtgga

SEQ ID NO: 8377622 - DNA, 22 bp, Homo sapiens
atctggtgacacgaggagctgg

SEQ ID NO: 8377623 - DNA, 22 bp, Homo sapiens
atctgtaaatgcaaatgtagct

SEQ ID NO: 8377624 - DNA, 22 bp, Homo sapiens
atctgtaaagataatcatatgt

SEQ ID NO: 8377625 - DNA, 22 bp, Homo sapiens
atctgtaattttgaatgcaaat

SEQ ID NO: 8377626 - DNA, 22 bp, Homo sapiens
atctgttcccctatgctctcta

SEQ ID NO: 8377627 - DNA, 22 bp, Homo sapiens
atcttatttaacacagcaaaac

SEQ ID NO: 8377628 - DNA, 22 bp, Homo sapiens
atcttatttaacacagcaaaac

SEQ ID NO: 8377629 - DNA, 22 bp, Homo sapiens
atctgttaggtcaggtatggaa

SEQ ID NO: 8377630 - DNA, 22 bp, Homo sapiens
atctgtgtgttattgtttatca

SEQ ID NO: 8377631 - DNA, 22 bp, Homo sapiens
atctgtgtatgtgaccttatct

SEQ ID NO: 8377632 - DNA, 22 bp, Homo sapiens
atctgtcttgccttgcatattt

SEQ ID NO: 8377633 - DNA, 22 bp, Homo sapiens
atctgtcttgccttgcatattt

SEQ ID NO: 8377634 - DNA, 22 bp, Homo sapiens
atctgtcttccaccacacatcc

SEQ ID NO: 8377635 - DNA, 22 bp, Homo sapiens
atctgtgatcaagacagacagt

SEQ ID NO: 8377636 - DNA, 22 bp, Homo sapiens
atctgtcttttattcatgagct

SEQ ID NO: 8377637 - DNA, 21 bp, Homo sapiens
cttcaattcaacactgccatg

SEQ ID NO: 8377638 - DNA, 22 bp, Homo sapiens
cttcacaaagctctctttatgt

SEQ ID NO: 8377639 - DNA, 22 bp, Homo sapiens
cttcacaaaatatttcattata

SEQ ID NO: 8377640 - DNA, 22 bp, Homo sapiens
cttcacaaatggcctagagttc

SEQ ID NO: 8377641 - DNA, 22 bp, Homo sapiens
cttcctctatgttcaggtagaa

SEQ ID NO: 8377642 - DNA, 22 bp, Homo sapiens
cttcctctatgttcaggtagaa

SEQ ID NO: 8377643 - DNA, 21 bp, Homo sapiens
cttattcactgttatttatca

SEQ ID NO: 8377644 - DNA, 22 bp, Homo sapiens
cttcaaatgtgattttaataac

SEQ ID NO: 8377645 - DNA, 22 bp, Homo sapiens
cttcaaatgtgattttaataac

SEQ ID NO: 8377646 - DNA, 22 bp, Homo sapiens
cttattaatggaatcctaatga

SEQ ID NO: 8377647 - DNA, 22 bp, Homo sapiens
cttattaatggaatcctaatga

SEQ ID NO: 8377648 - DNA, 22 bp, Homo sapiens
atcatagaacacctacctacct

SEQ ID NO: 8377649 - DNA, 22 bp, Homo sapiens
atcatacatgtaactaagtaaa

SEQ ID NO: 8377650 - DNA, 22 bp, Homo sapiens
ctgtttctccacactcttccca

SEQ ID NO: 8377651 - DNA, 22 bp, Homo sapiens
cttaacaagcccaactttcatt

SEQ ID NO: 8377652 - DNA, 21 bp, Homo sapiens
cttaacattttaaatgaaagg

SEQ ID NO: 8377653 - DNA, 22 bp, Homo sapiens
cttaactctacactgcacttta

SEQ ID NO: 8377654 - DNA, 22 bp, Homo sapiens
cttaacatggggggtaagtctg

SEQ ID NO: 8377655 - DNA, 22 bp, Homo sapiens
cttaacatcctgcatttttctt

SEQ ID NO: 8377656 - DNA, 22 bp, Homo sapiens
cttaagaagcaagtctcagcaa

SEQ ID NO: 8377657 - DNA, 22 bp, Homo sapiens
cttaagaagcaagtctcagcaa

SEQ ID NO: 8377658 - DNA, 22 bp, Homo sapiens
cttaagcaaaatattctttcac

SEQ ID NO: 8377659 - DNA, 22 bp, Homo sapiens
cttaataaatggtagctgttat

SEQ ID NO: 8377660 - DNA, 22 bp, Homo sapiens
atccatcttgatgtaatagcca

SEQ ID NO: 8377661 - DNA, 20 bp, Homo sapiens
atccatgagagtctggattc

SEQ ID NO: 8377662 - DNA, 22 bp, Homo sapiens
atccatccactgatgtttctga

SEQ ID NO: 8377663 - DNA, 22 bp, Homo sapiens
atccatcccatcttcaccaggg

SEQ ID NO: 8377664 - DNA, 22 bp, Homo sapiens
cttagatgaagtcacagaaccc

SEQ ID NO: 8377665 - DNA, 22 bp, Homo sapiens
atccatgattagtaggataaag

SEQ ID NO: 8377666 - DNA, 23 bp, Homo sapiens
atccatgtgagaatagactagca

SEQ ID NO: 8377667 - DNA, 21 bp, Homo sapiens
atccattctccggttaatgag

SEQ ID NO: 8377668 - DNA, 22 bp, Homo sapiens
atccattctatgtgaaatgtcc

SEQ ID NO: 8377669 - DNA, 22 bp, Homo sapiens
agtcaatattcaagtgtaaata

SEQ ID NO: 8377670 - DNA, 22 bp, Homo sapiens
agtaggcatttaataaacatga

SEQ ID NO: 8377671 - DNA, 22 bp, Homo sapiens
agtaggcatttaataaacatga

SEQ ID NO: 8377672 - DNA, 22 bp, Homo sapiens
agtaggcattgtgaaactgcat

SEQ ID NO: 8377673 - DNA, 22 bp, Homo sapiens
agtaggcatcccacagtctcct

SEQ ID NO: 8377674 - DNA, 22 bp, Homo sapiens
agtaggcatagaaagaagcacc

SEQ ID NO: 8377675 - DNA, 22 bp, Homo sapiens
agtaggcagggaataatacaaa

SEQ ID NO: 8377676 - DNA, 22 bp, Homo sapiens
agtaggcagaagtggcattcgg

SEQ ID NO: 8377677 - DNA, 22 bp, Homo sapiens
agtaggactaggggttgaggca

SEQ ID NO: 8377678 - DNA, 20 bp, Homo sapiens
agtaggcaaaggaaagatct

SEQ ID NO: 8377679 - DNA, 22 bp, Homo sapiens
agtaggcagaagtggcattcgg

SEQ ID NO: 8377680 - DNA, 22 bp, Homo sapiens
agtacatacttcaaatgtactt

SEQ ID NO: 8377681 - DNA, 22 bp, Homo sapiens
agtagaaatgtaagaaggatta

SEQ ID NO: 8377682 - DNA, 22 bp, Homo sapiens
agtagattccagtgatagttaa

SEQ ID NO: 8377683 - DNA, 22 bp, Homo sapiens
agtagataccagttctttgact

SEQ ID NO: 8377684 - DNA, 22 bp, Homo sapiens
agtagcacaattttgtccctaa

SEQ ID NO: 8377685 - DNA, 22 bp, Homo sapiens
agtagatttttgaatgtaagtt

SEQ ID NO: 8377686 - DNA, 22 bp, Homo sapiens
agtagcaccagggaagcagggc

SEQ ID NO: 8377687 - DNA, 22 bp, Homo sapiens
agtagacaataattcaactccc

SEQ ID NO: 8377688 - DNA, 22 bp, Homo sapiens
ccttccagggctctccagaacc

SEQ ID NO: 8377689 - DNA, 21 bp, Homo sapiens
ccttctccattacagtaagct

SEQ ID NO: 8377690 - DNA, 22 bp, Homo sapiens
ccttctctctgaagaccccaaa

SEQ ID NO: 8377691 - DNA, 22 bp, Homo sapiens
ccttctctaccatgtgaggaaa

SEQ ID NO: 8377692 - DNA, 22 bp, Homo sapiens
ccttctccctctgagaggaacc

SEQ ID NO: 8377693 - DNA, 22 bp, Homo sapiens
ccttctcctgccttgggttcat

SEQ ID NO: 8377694 - DNA, 18 bp, Homo sapiens
agtaaatggtttattttc

SEQ ID NO: 8377695 - DNA, 18 bp, Homo sapiens
agtaaagcttattacatg

SEQ ID NO: 8377696 - DNA, 22 bp, Homo sapiens
agtaaagcggtgtcacagaatg

SEQ ID NO: 8377697 - DNA, 22 bp, Homo sapiens
agtaaagcagagttgcagtaca

SEQ ID NO: 8377698 - DNA, 22 bp, Homo sapiens
ctagctgtaagagggatgtggc

SEQ ID NO: 8377699 - DNA, 22 bp, Homo sapiens
ctagcttagggaaactgacaga

SEQ ID NO: 8377700 - DNA, 22 bp, Homo sapiens
agtcacatggactcaggatgac

SEQ ID NO: 8377701 - DNA, 22 bp, Homo sapiens
agtcacatgggattagaaccca

SEQ ID NO: 8377702 - DNA, 22 bp, Homo sapiens
agtcacatgggattagaaccca

SEQ ID NO: 8377703 - DNA, 22 bp, Homo sapiens
ctaggaaatactgtttcaaggc

SEQ ID NO: 8377704 - DNA, 22 bp, Homo sapiens
ctaggaaagtgattcttcaatt

SEQ ID NO: 8377705 - DNA, 22 bp, Homo sapiens
ctaggaaagacacagagagttt

SEQ ID NO: 8377706 - DNA, 20 bp, Homo sapiens
agtcacatgcatacacaagt

SEQ ID NO: 8377707 - DNA, 22 bp, Homo sapiens
agtcacaggcaagagggctcca

SEQ ID NO: 8377708 - DNA, 22 bp, Homo sapiens
agtcacagaaacccaggtgtgg

SEQ ID NO: 8377709 - DNA, 22 bp, Homo sapiens
ctatattctggaatgtccattt

SEQ ID NO: 8377710 - DNA, 22 bp, Homo sapiens
agtcagcagtgaaagcacagcc

SEQ ID NO: 8377711 - DNA, 22 bp, Homo sapiens
agtcagcagcctggccaggaga

SEQ ID NO: 8377712 - DNA, 22 bp, Homo sapiens
agtcagcattttcactgagcta

SEQ ID NO: 8377713 - DNA, 22 bp, Homo sapiens
agtcagcatctgcactgtgctg

SEQ ID NO: 8377714 - DNA, 22 bp, Homo sapiens
agtcagcttggctcctcccatg

SEQ ID NO: 8377715 - DNA, 22 bp, Homo sapiens
ctatttatctatttctgaatga

SEQ ID NO: 8377716 - DNA, 22 bp, Homo sapiens
ctatctgtaaatttgaggttct

SEQ ID NO: 8377717 - DNA, 22 bp, Homo sapiens
ctatcccatccttctagctgac

SEQ ID NO: 8377718 - DNA, 22 bp, Homo sapiens
ctatcccatccttctagctgac

SEQ ID NO: 8377719 - DNA, 18 bp, Homo sapiens
ctatccctggagcttggg

SEQ ID NO: 8377720 - DNA, 22 bp, Homo sapiens
ctattctagattacagtataaa

SEQ ID NO: 8377721 - DNA, 22 bp, Homo sapiens
ctattctgattaccagatattg

SEQ ID NO: 8377722 - DNA, 22 bp, Homo sapiens
ctatgaccccagcatgaataag

SEQ ID NO: 8377723 - DNA, 22 bp, Homo sapiens
ctattccattccatagtagaaa

SEQ ID NO: 8377724 - DNA, 22 bp, Homo sapiens
cctgggaggctgaggctgcagt

SEQ ID NO: 8377725 - DNA, 22 bp, Homo sapiens
aggtcagtgtagtggtttgggc

SEQ ID NO: 8377726 - DNA, 18 bp, Homo sapiens
aggtcaggaaagcagagt

SEQ ID NO: 8377727 - DNA, 22 bp, Homo sapiens
aggtcacatggataatgatcag

SEQ ID NO: 8377728 - DNA, 20 bp, Homo sapiens
aggtcactgttagggcattc

SEQ ID NO: 8377729 - DNA, 22 bp, Homo sapiens
aggtcagaaaaggagagcattg

SEQ ID NO: 8377730 - DNA, 22 bp, Homo sapiens
aggtaacatgtggtgctataag

SEQ ID NO: 8377731 - DNA, 22 bp, Homo sapiens
aggtaacactacttagtatact

SEQ ID NO: 8377732 - DNA, 22 bp, Homo sapiens
aggtaagcatggtggctgctgt

SEQ ID NO: 8377733 - DNA, 22 bp, Homo sapiens
aggtaaggctgtaagctaagcc

SEQ ID NO: 8377734 - DNA, 22 bp, Homo sapiens
aggtaaggctgtaagctaagcc

SEQ ID NO: 8377735 - DNA, 22 bp, Homo sapiens
aggtaattttgtgttaatgatt

SEQ ID NO: 8377736 - DNA, 22 bp, Homo sapiens
aggtaaggtttggaggcagtgg

SEQ ID NO: 8377737 - DNA, 22 bp, Homo sapiens
aggtaatgcaactactttgcta

SEQ ID NO: 8377738 - DNA, 18 bp, Homo sapiens
cctgaggtgggaggaagg

SEQ ID NO: 8377739 - DNA, 22 bp, Homo sapiens
cctgaggtggctgcagcactgc

SEQ ID NO: 8377740 - DNA, 22 bp, Homo sapiens
cctgagtagctggaattaaagg

SEQ ID NO: 8377741 - DNA, 22 bp, Homo sapiens
ccttccagaggcgtgacaccct

SEQ ID NO: 8377742 - DNA, 22 bp, Homo sapiens
ccttccaagtgcttgccgcttt

SEQ ID NO: 8377743 - DNA, 22 bp, Homo sapiens
ccttccaagtgctgctttttcc

SEQ ID NO: 8377744 - DNA, 22 bp, Homo sapiens
cctgtttatctatctagagatg

SEQ ID NO: 8377745 - DNA, 22 bp, Homo sapiens
ccttccaaaggagccacatctg

SEQ ID NO: 8377746 - DNA, 22 bp, Homo sapiens
cctgtttaccactgaggggcag

SEQ ID NO: 8377747 - DNA, 22 bp, Homo sapiens
aggtggcaggaggtcagagaaa

SEQ ID NO: 8377748 - DNA, 22 bp, Homo sapiens
aggtggcagccgagacataagg

SEQ ID NO: 8377749 - DNA, 22 bp, Homo sapiens
cctgtgggcctgcacgtgggga

SEQ ID NO: 8377750 - DNA, 22 bp, Homo sapiens
cctgtgggccctggacagagac

SEQ ID NO: 8377751 - DNA, 22 bp, Homo sapiens
cctgtgggccctggacagagac

SEQ ID NO: 8377752 - DNA, 22 bp, Homo sapiens
cctgtgggccaaggacctgcca

SEQ ID NO: 8377753 - DNA, 22 bp, Homo sapiens
cctgtgggagggagcggctgga

SEQ ID NO: 8377754 - DNA, 22 bp, Homo sapiens
cctgtgggagcccaggcagata

SEQ ID NO: 8377755 - DNA, 22 bp, Homo sapiens
cctgtgggaggttctgtgagtc

SEQ ID NO: 8377756 - DNA, 22 bp, Homo sapiens
cctgtgggaggttctgtgagtc

SEQ ID NO: 8377757 - DNA, 22 bp, Homo sapiens
cctgtgggcttgagtgtagggt

SEQ ID NO: 8377758 - DNA, 22 bp, Homo sapiens
cctgtgggcgcagctggagtca

SEQ ID NO: 8377759 - DNA, 22 bp, Homo sapiens
cctgtggggctgaaagaggctt

SEQ ID NO: 8377760 - DNA, 22 bp, Homo sapiens
cctgtgggtacaacagggtcac

SEQ ID NO: 8377761 - DNA, 22 bp, Homo sapiens
aggtggcagagctggcccagcg

SEQ ID NO: 8377762 - DNA, 22 bp, Homo sapiens
aggtggcagagtgacaggctga

SEQ ID NO: 8377763 - DNA, 22 bp, Homo sapiens
aggtggcagaggactcctcctg

SEQ ID NO: 8377764 - DNA, 21 bp, Homo sapiens
cctgtgccagtctatgtgttc

SEQ ID NO: 8377765 - DNA, 22 bp, Homo sapiens
agtgtctttctctctccaagtg

SEQ ID NO: 8377766 - DNA, 22 bp, Homo sapiens
agtgtctttgtcaaattacagg

SEQ ID NO: 8377767 - DNA, 22 bp, Homo sapiens
agtgtgagatgattgaggagca

SEQ ID NO: 8377768 - DNA, 22 bp, Homo sapiens
agtgtcaactcggaataaggat

SEQ ID NO: 8377769 - DNA, 22 bp, Homo sapiens
agtgtcaaattaaataatctgg

SEQ ID NO: 8377770 - DNA, 22 bp, Homo sapiens
agtgtcaaatgtgtgccaagct

SEQ ID NO: 8377771 - DNA, 22 bp, Homo sapiens
agtgtcaaatcagcatctgggt

SEQ ID NO: 8377772 - DNA, 22 bp, Homo sapiens
agtgtattctgcatgggagact

SEQ ID NO: 8377773 - DNA, 22 bp, Homo sapiens
agtgtattatgcagcggaggtc

SEQ ID NO: 8377774 - DNA, 22 bp, Homo sapiens
agtgtcagcctgggcaaggaac

SEQ ID NO: 8377775 - DNA, 22 bp, Homo sapiens
agtgtcatttccacgacattca

SEQ ID NO: 8377776 - DNA, 22 bp, Homo sapiens
agtgtcataaggagaaattaca

SEQ ID NO: 8377777 - DNA, 22 bp, Homo sapiens
agtgtcatgaatcaaagattat

SEQ ID NO: 8377778 - DNA, 22 bp, Homo sapiens
agtgtcaattctcaaatctcgg

SEQ ID NO: 8377779 - DNA, 17 bp, Homo sapiens
agtgtcagaagacagtt

SEQ ID NO: 8377780 - DNA, 22 bp, Homo sapiens
agtgtcaatgccaacagtatat

SEQ ID NO: 8377781 - DNA, 22 bp, Homo sapiens
agtgtcaatgctctgttaaaaa

SEQ ID NO: 8377782 - DNA, 22 bp, Homo sapiens
agtgtcaataatttctttttgg

SEQ ID NO: 8377783 - DNA, 22 bp, Homo sapiens
agtgtcaagtgaggagggaaag

SEQ ID NO: 8377784 - DNA, 22 bp, Homo sapiens
agtgtcaagtacatggtagtga

SEQ ID NO: 8377785 - DNA, 22 bp, Homo sapiens
agtgtcaaggttgagaaaccct

SEQ ID NO: 8377786 - DNA, 22 bp, Homo sapiens
agtgtcaactgtctacagggag

SEQ ID NO: 8377787 - DNA, 22 bp, Homo sapiens
agtgggtggcgcagaggaggaa

SEQ ID NO: 8377788 - DNA, 22 bp, Homo sapiens
agtggcctggagccccgcctgg

SEQ ID NO: 8377789 - DNA, 22 bp, Homo sapiens
agtggctcagagtctattgagg

SEQ ID NO: 8377790 - DNA, 22 bp, Homo sapiens
agtggctcttgggtcactgggc

SEQ ID NO: 8377791 - DNA, 22 bp, Homo sapiens
agtggctccaaaccgtagtcat

SEQ ID NO: 8377792 - DNA, 22 bp, Homo sapiens
agtggctcccatgtcttgcact

SEQ ID NO: 8377793 - DNA, 21 bp, Homo sapiens
agtggctctcagcttgctaag

SEQ ID NO: 8377794 - DNA, 22 bp, Homo sapiens
agtggctctccaagaagtcaca

SEQ ID NO: 8377795 - DNA, 22 bp, Homo sapiens
agtgtgagtgctcatgtccatc

SEQ ID NO: 8377796 - DNA, 22 bp, Homo sapiens
agtgtggaccttcacacagaga

SEQ ID NO: 8377797 - DNA, 22 bp, Homo sapiens
agtgtggacttttcctaggagg

SEQ ID NO: 8377798 - DNA, 22 bp, Homo sapiens
agtgtgggccacgcagctgagc

SEQ ID NO: 8377799 - DNA, 22 bp, Homo sapiens
agtgtgggcccccaggttagcc

SEQ ID NO: 8377800 - DNA, 18 bp, Homo sapiens
agtgttctcgttttataa

SEQ ID NO: 8377801 - DNA, 22 bp, Homo sapiens
agtgtttctggaatcagtgttt

SEQ ID NO: 8377802 - DNA, 22 bp, Homo sapiens
agtgtttcaccgtatgttctca

SEQ ID NO: 8377803 - DNA, 22 bp, Homo sapiens
agtgtttcctgagtgttatcat

SEQ ID NO: 8377804 - DNA, 20 bp, Homo sapiens
agtgtttctcaacatggggc

SEQ ID NO: 8377805 - DNA, 22 bp, Homo sapiens
agtgtttctaagtagatgtgaa

SEQ ID NO: 8377806 - DNA, 17 bp, Homo sapiens
agtgtttccttatcatt

SEQ ID NO: 8377807 - DNA, 22 bp, Homo sapiens
agtgttttggagtgggaaggca

SEQ ID NO: 8377808 - DNA, 22 bp, Homo sapiens
agtgtttttgggtagggtgagt

SEQ ID NO: 8377809 - DNA, 22 bp, Homo sapiens
agttaaagtctgaaatagagaa

SEQ ID NO: 8377810 - DNA, 22 bp, Homo sapiens
agttaaagaaagataattcgcc

SEQ ID NO: 8377811 - DNA, 22 bp, Homo sapiens
agttccatgtctgggtttgtga

SEQ ID NO: 8377812 - DNA, 22 bp, Homo sapiens
agttcccaaattacaggccaca

SEQ ID NO: 8377813 - DNA, 22 bp, Homo sapiens
agttccttacatgtactgttaa

SEQ ID NO: 8377814 - DNA, 18 bp, Homo sapiens
agttccttaaattggtgt

SEQ ID NO: 8377815 - DNA, 22 bp, Homo sapiens
ctgagctgctttgcttttgggg

SEQ ID NO: 8377816 - DNA, 22 bp, Homo sapiens
agttatttcagtaacataatag

SEQ ID NO: 8377817 - DNA, 22 bp, Homo sapiens
agttatttcagtaacataatag

SEQ ID NO: 8377818 - DNA, 22 bp, Homo sapiens
ctgagctattttccactactat

SEQ ID NO: 8377819 - DNA, 22 bp, Homo sapiens
ctgagctcagtcccagctctac

SEQ ID NO: 8377820 - DNA, 22 bp, Homo sapiens
ctgagccagctggcatgtgcta

SEQ ID NO: 8377821 - DNA, 22 bp, Homo sapiens
agttaacatttgagctaaaagg

SEQ ID NO: 8377822 - DNA, 22 bp, Homo sapiens
agttaacacatccagaatagag

SEQ ID NO: 8377823 - DNA, 22 bp, Homo sapiens
ctgagcagccccaccagccatt

SEQ ID NO: 8377824 - DNA, 22 bp, Homo sapiens
agtggcaagagggtctattgtt

SEQ ID NO: 8377825 - DNA, 22 bp, Homo sapiens
agtggcaagtcaatgatagtga

SEQ ID NO: 8377826 - DNA, 22 bp, Homo sapiens
agtggagtgagtggcagaagga

SEQ ID NO: 8377827 - DNA, 20 bp, Homo sapiens
agtggcagggaaatggaaag

SEQ ID NO: 8377828 - DNA, 22 bp, Homo sapiens
agtggcagtggggcagggccct

SEQ ID NO: 8377829 - DNA, 22 bp, Homo sapiens
agtggcaatgtagagagtgatc

SEQ ID NO: 8377830 - DNA, 20 bp, Homo sapiens
agtggccactgcagagatgc

SEQ ID NO: 8377831 - DNA, 22 bp, Homo sapiens
agtggcagtttgggagctacag

SEQ ID NO: 8377832 - DNA, 22 bp, Homo sapiens
agtggcagtggggcagggccct

SEQ ID NO: 8377833 - DNA, 22 bp, Homo sapiens
agtggagaccccacttctacat

SEQ ID NO: 8377834 - DNA, 22 bp, Homo sapiens
agtggaggttacagctgtacat

SEQ ID NO: 8377835 - DNA, 22 bp, Homo sapiens
agtggaggcactaattggattt

SEQ ID NO: 8377836 - DNA, 22 bp, Homo sapiens
agtgccaaggtattaatttata

SEQ ID NO: 8377837 - DNA, 20 bp, Homo sapiens
agtgatttatctttttccac

SEQ ID NO: 8377838 - DNA, 22 bp, Homo sapiens
agtgatttcatcattttatcaa

SEQ ID NO: 8377839 - DNA, 22 bp, Homo sapiens
agtgatgtgggagagtatagct

SEQ ID NO: 8377840 - DNA, 22 bp, Homo sapiens
agtgatgttgactagctataag

SEQ ID NO: 8377841 - DNA, 22 bp, Homo sapiens
agtgaggtaattagagctgctg

SEQ ID NO: 8377842 - DNA, 22 bp, Homo sapiens
agtgaggtcatactggagaggg

SEQ ID NO: 8377843 - DNA, 22 bp, Homo sapiens
agtgatcttttaaaaagaagtg

SEQ ID NO: 8377844 - DNA, 22 bp, Homo sapiens
agtgaaataaagctgcctatgg

SEQ ID NO: 8377845 - DNA, 22 bp, Homo sapiens
agtgaaaacctaatcatgcagt

SEQ ID NO: 8377846 - DNA, 22 bp, Homo sapiens
agtgaaaggaaaaactgatatt

SEQ ID NO: 8377847 - DNA, 22 bp, Homo sapiens
agtgaaatcctggtcaacaggt

SEQ ID NO: 8377848 - DNA, 19 bp, Homo sapiens
agtgaaatggagtattcaa

SEQ ID NO: 8377849 - DNA, 22 bp, Homo sapiens
agtgaggctaataggcaatggt

SEQ ID NO: 8377850 - DNA, 22 bp, Homo sapiens
agtctcaagtgttagtattatt

SEQ ID NO: 8377851 - DNA, 23 bp, Homo sapiens
agtctcaagctggagaattacct

SEQ ID NO: 8377852 - DNA, 23 bp, Homo sapiens
agtctcaagctggagaattacct

SEQ ID NO: 8377853 - DNA, 22 bp, Homo sapiens
agtctcaagtgttagtattatt

SEQ ID NO: 8377854 - DNA, 22 bp, Homo sapiens
agtctcaagtgttagtattatt

SEQ ID NO: 8377855 - DNA, 22 bp, Homo sapiens
agtctcaagcaccgaaagctgt

SEQ ID NO: 8377856 - DNA, 22 bp, Homo sapiens
agtctattttagctgcatatgt

SEQ ID NO: 8377857 - DNA, 22 bp, Homo sapiens
agtctattttcagaagcagttt

SEQ ID NO: 8377858 - DNA, 22 bp, Homo sapiens
agtctattgcctaacagagagg

SEQ ID NO: 8377859 - DNA, 22 bp, Homo sapiens
agtctatattgtgaaagtaaaa

SEQ ID NO: 8377860 - DNA, 22 bp, Homo sapiens
ctcacatagtaagcagtcagta

SEQ ID NO: 8377861 - DNA, 22 bp, Homo sapiens
ctcaccagacatggaacctgtc

SEQ ID NO: 8377862 - DNA, 18 bp, Homo sapiens
agtcttctgatccatttt

SEQ ID NO: 8377863 - DNA, 22 bp, Homo sapiens
agtctttatacagaaatatatg

SEQ ID NO: 8377864 - DNA, 22 bp, Homo sapiens
agtctttatgattgtcaaagta

SEQ ID NO: 8377865 - DNA, 22 bp, Homo sapiens
agtctttattcactattgataa

SEQ ID NO: 8377866 - DNA, 22 bp, Homo sapiens
agtctttccttttggaagaaaa

SEQ ID NO: 8377867 - DNA, 22 bp, Homo sapiens
agtctttggttataagagacag

SEQ ID NO: 8377868 - DNA, 22 bp, Homo sapiens
agtctttattgtcgtcactaga

SEQ ID NO: 8377869 - DNA, 22 bp, Homo sapiens
agtctttatttagagttaggac

SEQ ID NO: 8377870 - DNA, 18 bp, Homo sapiens
agtctttatttctttcat

SEQ ID NO: 8377871 - DNA, 20 bp, Homo sapiens
actttctcggtttctcacct

SEQ ID NO: 8377872 - DNA, 22 bp, Homo sapiens
actttggacaatttattactgt

SEQ ID NO: 8377873 - DNA, 22 bp, Homo sapiens
actttggacgccatgctgtttg

SEQ ID NO: 8377874 - DNA, 22 bp, Homo sapiens
actttggcacagaacttccatt

SEQ ID NO: 8377875 - DNA, 22 bp, Homo sapiens
atagagtgatgtaaggtatgtg

SEQ ID NO: 8377876 - DNA, 22 bp, Homo sapiens
atagagttgagttcaaatatgt

SEQ ID NO: 8377877 - DNA, 23 bp, Homo sapiens
acttttcaattagctatgcttaa

SEQ ID NO: 8377878 - DNA, 20 bp, Homo sapiens
atagatatcatctttagaag

SEQ ID NO: 8377879 - DNA, 22 bp, Homo sapiens
atagatattagcaaaattttat

SEQ ID NO: 8377880 - DNA, 20 bp, Homo sapiens
atagatatcatctttagaag

SEQ ID NO: 8377881 - DNA, 22 bp, Homo sapiens
atagatattagcaaaattttat

SEQ ID NO: 8377882 - DNA, 22 bp, Homo sapiens
atacaaaaattagccgggagta

SEQ ID NO: 8377883 - DNA, 22 bp, Homo sapiens
ataatttttgtttgatgtccaa

SEQ ID NO: 8377884 - DNA, 22 bp, Homo sapiens
ataatttttgtttgatgtccaa

SEQ ID NO: 8377885 - DNA, 22 bp, Homo sapiens
ataatttttgtttgatgtccaa

SEQ ID NO: 8377886 - DNA, 22 bp, Homo sapiens
atacaaaaattagccgggagta

SEQ ID NO: 8377887 - DNA, 22 bp, Homo sapiens
ataatttttgtttgatgtccaa

SEQ ID NO: 8377888 - DNA, 22 bp, Homo sapiens
acttctctgctacctgcaaaga

SEQ ID NO: 8377889 - DNA, 22 bp, Homo sapiens
atacaaaatatatactggagac

SEQ ID NO: 8377890 - DNA, 22 bp, Homo sapiens
atacaaaatatatactggagac

SEQ ID NO: 8377891 - DNA, 22 bp, Homo sapiens
atacaaaatatatactggagac

SEQ ID NO: 8377892 - DNA, 22 bp, Homo sapiens
atacaaagacaaatctcaatct

SEQ ID NO: 8377893 - DNA, 22 bp, Homo sapiens
acttggttgcaaatgaattatt

SEQ ID NO: 8377894 - DNA, 22 bp, Homo sapiens
actttaaaactgatcatcagag

SEQ ID NO: 8377895 - DNA, 22 bp, Homo sapiens
atacatcacctatatattcaca

SEQ ID NO: 8377896 - DNA, 22 bp, Homo sapiens
actttacacatcttttctcatt

SEQ ID NO: 8377897 - DNA, 22 bp, Homo sapiens
atacatatccacaggagataaa

SEQ ID NO: 8377898 - DNA, 21 bp, Homo sapiens
actttacaatttacatagtga

SEQ ID NO: 8377899 - DNA, 21 bp, Homo sapiens
actttacaatttacatagtga

SEQ ID NO: 8377900 - DNA, 22 bp, Homo sapiens
actttaaagcagaatggctatg

SEQ ID NO: 8377901 - DNA, 22 bp, Homo sapiens
actttaactgttattactcacc

SEQ ID NO: 8377902 - DNA, 22 bp, Homo sapiens
actttacaatatcctgtgactt

SEQ ID NO: 8377903 - DNA, 22 bp, Homo sapiens
actttacaagcttatagcctag

SEQ ID NO: 8377904 - DNA, 22 bp, Homo sapiens
actttacaaactcctcactgtt

SEQ ID NO: 8377905 - DNA, 22 bp, Homo sapiens
agtttttcctgattttacagaa

SEQ ID NO: 8377906 - DNA, 21 bp, Homo sapiens
agtttttactcttaactgtgg

SEQ ID NO: 8377907 - DNA, 21 bp, Homo sapiens
agtttttactcttaactgtgg

SEQ ID NO: 8377908 - DNA, 22 bp, Homo sapiens
agttttatgtagacaattcatt

SEQ ID NO: 8377909 - DNA, 23 bp, Homo sapiens
agtttttaatggtcatagctgag

SEQ ID NO: 8377910 - DNA, 22 bp, Homo sapiens
agtttttctcccctggcttcat

SEQ ID NO: 8377911 - DNA, 22 bp, Homo sapiens
ataaaaactgacccatcctttg

SEQ ID NO: 8377912 - DNA, 22 bp, Homo sapiens
actgttatttgtaatccattat

SEQ ID NO: 8377913 - DNA, 22 bp, Homo sapiens
agttttatggctcaacctaata

SEQ ID NO: 8377914 - DNA, 21 bp, Homo sapiens
agttttatattataagctaaa

SEQ ID NO: 8377915 - DNA, 22 bp, Homo sapiens
agttttatctgtaagctgttca

SEQ ID NO: 8377916 - DNA, 21 bp, Homo sapiens
agttttatattataagctaaa

SEQ ID NO: 8377917 - DNA, 22 bp, Homo sapiens
actgggctagagtggaagctgg

SEQ ID NO: 8377918 - DNA, 22 bp, Homo sapiens
actgggctagagtggaagctgg

SEQ ID NO: 8377919 - DNA, 22 bp, Homo sapiens
actgggctccagatgtgatacg

SEQ ID NO: 8377920 - DNA, 22 bp, Homo sapiens
actgggctccaaggacctggag

SEQ ID NO: 8377921 - DNA, 21 bp, Homo sapiens
actgggctagcctgacttctg

SEQ ID NO: 8377922 - DNA, 22 bp, Homo sapiens
actgggctcataatgtcataga

SEQ ID NO: 8377923 - DNA, 22 bp, Homo sapiens
acttcctgttatgtgtgcctct

SEQ ID NO: 8377924 - DNA, 22 bp, Homo sapiens
acttccagcccctgtcagcaaa

SEQ ID NO: 8377925 - DNA, 21 bp, Homo sapiens
ataaagttttacaggaatgca

SEQ ID NO: 8377926 - DNA, 22 bp, Homo sapiens
actgttttctgtaaagggccag

SEQ ID NO: 8377927 - DNA, 22 bp, Homo sapiens
actgtttctcaaattatgtggt

SEQ ID NO: 8377928 - DNA, 22 bp, Homo sapiens
actgtttctgccacaatagccc

SEQ ID NO: 8377929 - DNA, 22 bp, Homo sapiens
actgttttctgtaaagggccag

SEQ ID NO: 8377930 - DNA, 22 bp, Homo sapiens
acttaaaaacagatccagcagg

SEQ ID NO: 8377931 - DNA, 22 bp, Homo sapiens
acttaaaaagaatcttttcacg

SEQ ID NO: 8377932 - DNA, 22 bp, Homo sapiens
acttaaaaacagatccagcagg

SEQ ID NO: 8377933 - DNA, 22 bp, Homo sapiens
ataaagtctaccgtattaaaga

SEQ ID NO: 8377934 - DNA, 18 bp, Homo sapiens
ataaagtgctaataatgg

SEQ ID NO: 8377935 - DNA, 22 bp, Homo sapiens
acttaaaaccagacagcgtcat

SEQ ID NO: 8377936 - DNA, 22 bp, Homo sapiens
acttaaaaagaatcttttcacg

SEQ ID NO: 8377937 - DNA, 22 bp, Homo sapiens
acttaaaaagaatcttttcacg

SEQ ID NO: 8377938 - DNA, 22 bp, Homo sapiens
acttaaaaagaatcttttcacg

SEQ ID NO: 8377939 - DNA, 22 bp, Homo sapiens
agaaaaagtcaaggaattggac

SEQ ID NO: 8377940 - DNA, 21 bp, Homo sapiens
atatttctcataaggttatgg

SEQ ID NO: 8377941 - DNA, 22 bp, Homo sapiens
atattttggggtgatgtgcatc

SEQ ID NO: 8377942 - DNA, 22 bp, Homo sapiens
atattttggggtgatgtgcatc

SEQ ID NO: 8377943 - DNA, 22 bp, Homo sapiens
agaaaaagaaagtggatttgtc

SEQ ID NO: 8377944 - DNA, 21 bp, Homo sapiens
agaaaaaccagcatgttttca

SEQ ID NO: 8377945 - DNA, 21 bp, Homo sapiens
agaaaaaccagcatgttttca

SEQ ID NO: 8377946 - DNA, 22 bp, Homo sapiens
atattttgtaacttggaatagg

SEQ ID NO: 8377947 - DNA, 22 bp, Homo sapiens
atatttttccatgtgggactct

SEQ ID NO: 8377948 - DNA, 22 bp, Homo sapiens
atattttgtaacttggaatagg

SEQ ID NO: 8377949 - DNA, 22 bp, Homo sapiens
atattttgtaacttggaatagg

SEQ ID NO: 8377950 - DNA, 21 bp, Homo sapiens
atatttttgtttggactgtca

SEQ ID NO: 8377951 - DNA, 22 bp, Homo sapiens
actttttacagggtgtatacca

SEQ ID NO: 8377952 - DNA, 22 bp, Homo sapiens
acttttcccttggtagagttgc

SEQ ID NO: 8377953 - DNA, 22 bp, Homo sapiens
acttttctccctcctgccttca

SEQ ID NO: 8377954 - DNA, 22 bp, Homo sapiens
acttttctccctcctgccttca

SEQ ID NO: 8377955 - DNA, 21 bp, Homo sapiens
agaaaaacacgatataagccc

SEQ ID NO: 8377956 - DNA, 21 bp, Homo sapiens
agaaaaacacgatataagccc

SEQ ID NO: 8377957 - DNA, 23 bp, Homo sapiens
agaaaaacaggattgtgttccta

SEQ ID NO: 8377958 - DNA, 22 bp, Homo sapiens
actttttctcagaaggattggt

SEQ ID NO: 8377959 - DNA, 22 bp, Homo sapiens
acttttttataaggaagaagat

SEQ ID NO: 8377960 - DNA, 22 bp, Homo sapiens
acttttttataaggaagaagat

SEQ ID NO: 8377961 - DNA, 22 bp, Homo sapiens
agaaagcacagcgggtccattt

SEQ ID NO: 8377962 - DNA, 22 bp, Homo sapiens
agaaagatccttctggctgcct

SEQ ID NO: 8377963 - DNA, 22 bp, Homo sapiens
agaaagcctgagcagacggagc

SEQ ID NO: 8377964 - DNA, 22 bp, Homo sapiens
agaaagcccacccagaagatgt

SEQ ID NO: 8377965 - DNA, 22 bp, Homo sapiens
agaaagcccaggagaacagatt

SEQ ID NO: 8377966 - DNA, 22 bp, Homo sapiens
agaaagcccacccagaagatgt

SEQ ID NO: 8377967 - DNA, 22 bp, Homo sapiens
atcagtgtgtcaaaagcacaaa

SEQ ID NO: 8377968 - DNA, 22 bp, Homo sapiens
atcagtgtattcatagggaata

SEQ ID NO: 8377969 - DNA, 22 bp, Homo sapiens
atcagtgttccttgagactgcc

SEQ ID NO: 8377970 - DNA, 22 bp, Homo sapiens
atcagtgttgttgattggatag

SEQ ID NO: 8377971 - DNA, 22 bp, Homo sapiens
atcagtggggacgagaagttta

SEQ ID NO: 8377972 - DNA, 22 bp, Homo sapiens
atcagtgtaccttatggatttt

SEQ ID NO: 8377973 - DNA, 22 bp, Homo sapiens
atcagtagtgtgaaaacagact

SEQ ID NO: 8377974 - DNA, 22 bp, Homo sapiens
atcagtaaatattcattgtgca

SEQ ID NO: 8377975 - DNA, 22 bp, Homo sapiens
agaaatcaggaacagtaaggag

SEQ ID NO: 8377976 - DNA, 22 bp, Homo sapiens
atcagtgtttcaaatgtaatct

SEQ ID NO: 8377977 - DNA, 22 bp, Homo sapiens
atcagtgtttgcatgggagctt

SEQ ID NO: 8377978 - DNA, 22 bp, Homo sapiens
agaaatcatgtcttatttctat

SEQ ID NO: 8377979 - DNA, 22 bp, Homo sapiens
agaaatcatgtcttatttctat

SEQ ID NO: 8377980 - DNA, 22 bp, Homo sapiens
agaaatcatgactaagagcagt

SEQ ID NO: 8377981 - DNA, 22 bp, Homo sapiens
agaaatcatgtcttatttctat

SEQ ID NO: 8377982 - DNA, 22 bp, Homo sapiens
atctctggccttccttttccaa

SEQ ID NO: 8377983 - DNA, 22 bp, Homo sapiens
atctcttagcagtctagtgacc

SEQ ID NO: 8377984 - DNA, 22 bp, Homo sapiens
atctcttatgtcacataaacca

SEQ ID NO: 8377985 - DNA, 22 bp, Homo sapiens
agaagccacaggaaagcagctt

SEQ ID NO: 8377986 - DNA, 22 bp, Homo sapiens
agaagccacaggaaagcagctt

SEQ ID NO: 8377987 - DNA, 22 bp, Homo sapiens
atctctttgatggctcctgtga

SEQ ID NO: 8377988 - DNA, 22 bp, Homo sapiens
agaagccaagaacagacagtgc

SEQ ID NO: 8377989 - DNA, 22 bp, Homo sapiens
agaagctgtggtatgaaatgtg

SEQ ID NO: 8377990 - DNA, 22 bp, Homo sapiens
agaagctgtggtatgaaatgtg

SEQ ID NO: 8377991 - DNA, 19 bp, Homo sapiens
agaagctgtgaaatgaagg

SEQ ID NO: 8377992 - DNA, 19 bp, Homo sapiens
agaagctgtgaaatgaagg

SEQ ID NO: 8377993 - DNA, 23 bp, Homo sapiens
agaagctgggagcctggggatgg

SEQ ID NO: 8377994 - DNA, 22 bp, Homo sapiens
agaagctgtggtatgaaatgtg

SEQ ID NO: 8377995 - DNA, 22 bp, Homo sapiens
atctcaggggttccttctagag

SEQ ID NO: 8377996 - DNA, 20 bp, Homo sapiens
agaacctaagttaaaacaca

SEQ ID NO: 8377997 - DNA, 22 bp, Homo sapiens
atcccagagaataatgatcagg

SEQ ID NO: 8377998 - DNA, 22 bp, Homo sapiens
atcccatgagaccacgttggct

SEQ ID NO: 8377999 - DNA, 22 bp, Homo sapiens
atccaggagtcgtggcgctcag

SEQ ID NO: 8378000 - DNA, 22 bp, Homo sapiens
agaaatctgactgctgtgcaca

SEQ ID NO: 8378001 - DNA, 22 bp, Homo sapiens
agaaatctatgttttggttaga

SEQ ID NO: 8378002 - DNA, 22 bp, Homo sapiens
agaaatctatgttttggttaga

SEQ ID NO: 8378003 - DNA, 22 bp, Homo sapiens
agaaatcattgaattatttgct

SEQ ID NO: 8378004 - DNA, 22 bp, Homo sapiens
agaaatcattttaggcttgatg

SEQ ID NO: 8378005 - DNA, 22 bp, Homo sapiens
aggtcaaaatcaggcagggaag

SEQ ID NO: 8378006 - DNA, 22 bp, Homo sapiens
aggtcaaaatgcttttcaggtc

SEQ ID NO: 8378007 - DNA, 19 bp, Homo sapiens
aggtagctcagactcaaag

SEQ ID NO: 8378008 - DNA, 22 bp, Homo sapiens
aggtatttcaaagcccacttcc

SEQ ID NO: 8378009 - DNA, 19 bp, Homo sapiens
acctttcctttctcagatg

SEQ ID NO: 8378010 - DNA, 22 bp, Homo sapiens
acctttcctggctgaccgagga

SEQ ID NO: 8378011 - DNA, 22 bp, Homo sapiens
acctttccaagtatcaggtggt

SEQ ID NO: 8378012 - DNA, 22 bp, Homo sapiens
acctttatgtttgattacaatt

SEQ ID NO: 8378013 - DNA, 22 bp, Homo sapiens
aggtccacagttcagctgccca

SEQ ID NO: 8378014 - DNA, 22 bp, Homo sapiens
aggtccagaggttgaacggtgg

SEQ ID NO: 8378015 - DNA, 22 bp, Homo sapiens
acgaggtgcttccaccatttca

SEQ ID NO: 8378016 - DNA, 22 bp, Homo sapiens
acgagaggtccttagaatctgt

SEQ ID NO: 8378017 - DNA, 22 bp, Homo sapiens
accttttcatctgaaactttta

SEQ ID NO: 8378018 - DNA, 22 bp, Homo sapiens
aggtgacatcccggcagcagag

SEQ ID NO: 8378019 - DNA, 22 bp, Homo sapiens
aggtgacaggacaggagctggt

SEQ ID NO: 8378020 - DNA, 22 bp, Homo sapiens
aggtgaagttgaggaggcagaa

SEQ ID NO: 8378021 - DNA, 22 bp, Homo sapiens
aggtgaagttaaaaaccagtct

SEQ ID NO: 8378022 - DNA, 22 bp, Homo sapiens
aggtgaagttgaggaggcagaa

SEQ ID NO: 8378023 - DNA, 21 bp, Homo sapiens
actacatcatggtcacctact

SEQ ID NO: 8378024 - DNA, 22 bp, Homo sapiens
actacagtccctcatatgttgg

SEQ ID NO: 8378025 - DNA, 23 bp, Homo sapiens
agtacatttgacccaaataagct

SEQ ID NO: 8378026 - DNA, 22 bp, Homo sapiens
agtacatttattaatggtaaaa

SEQ ID NO: 8378027 - DNA, 22 bp, Homo sapiens
agtactttacttcttacagttt

SEQ ID NO: 8378028 - DNA, 22 bp, Homo sapiens
agtagtcagcagataatatagg

SEQ ID NO: 8378029 - DNA, 22 bp, Homo sapiens
agtagaaagaaggcactgggcc

SEQ ID NO: 8378030 - DNA, 22 bp, Homo sapiens
agtatacaaataaatgtgtaat

SEQ ID NO: 8378031 - DNA, 22 bp, Homo sapiens
agtatacaaataaatgtgtaat

SEQ ID NO: 8378032 - DNA, 22 bp, Homo sapiens
agtatacatatattagccttcg

SEQ ID NO: 8378033 - DNA, 22 bp, Homo sapiens
agtataaagtggttttcagcac

SEQ ID NO: 8378034 - DNA, 21 bp, Homo sapiens
agtagtttagcacagggtttg

SEQ ID NO: 8378035 - DNA, 22 bp, Homo sapiens
agtcacttaacatttgctgcag

SEQ ID NO: 8378036 - DNA, 22 bp, Homo sapiens
agtcacttcatggtttcttgga

SEQ ID NO: 8378037 - DNA, 22 bp, Homo sapiens
agtcacttaataggttcatctg

SEQ ID NO: 8378038 - DNA, 22 bp, Homo sapiens
agtcacttaataggttcatctg

SEQ ID NO: 8378039 - DNA, 22 bp, Homo sapiens
agtcactgtcaaagccacacac

SEQ ID NO: 8378040 - DNA, 22 bp, Homo sapiens
actctcccttggagcctcaggc

SEQ ID NO: 8378041 - DNA, 22 bp, Homo sapiens
actcctacatattagcattaac

SEQ ID NO: 8378042 - DNA, 22 bp, Homo sapiens
actcctgccacacagatgctgt

SEQ ID NO: 8378043 - DNA, 22 bp, Homo sapiens
actcctgctgtcactgcagttc

SEQ ID NO: 8378044 - DNA, 22 bp, Homo sapiens
actcctgcttcttccctgagga

SEQ ID NO: 8378045 - DNA, 22 bp, Homo sapiens
actccagggtgactctgtctga

SEQ ID NO: 8378046 - DNA, 22 bp, Homo sapiens
agtcacccaggtgtgatggatg

SEQ ID NO: 8378047 - DNA, 22 bp, Homo sapiens
actcctgggtgctgaccagcgt

SEQ ID NO: 8378048 - DNA, 22 bp, Homo sapiens
actcctgggtgcatttctgatt

SEQ ID NO: 8378049 - DNA, 22 bp, Homo sapiens
actcctggggctgccatcacag

SEQ ID NO: 8378050 - DNA, 22 bp, Homo sapiens
actcctggggatccattccttt

SEQ ID NO: 8378051 - DNA, 22 bp, Homo sapiens
actcctggaaaagaacgcaggg

SEQ ID NO: 8378052 - DNA, 22 bp, Homo sapiens
agtgaactgtggcccgtgaact

SEQ ID NO: 8378053 - DNA, 22 bp, Homo sapiens
actgagctctaggttttgaacc

SEQ ID NO: 8378054 - DNA, 22 bp, Homo sapiens
actgagctccctgagggcaggc

SEQ ID NO: 8378055 - DNA, 22 bp, Homo sapiens
actgagctccaagcctggaatc

SEQ ID NO: 8378056 - DNA, 22 bp, Homo sapiens
actgagcatggctcacagagag

SEQ ID NO: 8378057 - DNA, 23 bp, Homo sapiens
actgagcattagtatttttataa

SEQ ID NO: 8378058 - DNA, 22 bp, Homo sapiens
actgagcaagtgctgctcacgt

SEQ ID NO: 8378059 - DNA, 23 bp, Homo sapiens
actgagcaatgtttacatacttg

SEQ ID NO: 8378060 - DNA, 22 bp, Homo sapiens
actgagcaggagaatcacttta

SEQ ID NO: 8378061 - DNA, 22 bp, Homo sapiens
actgagcagaagagatctgtga

SEQ ID NO: 8378062 - DNA, 22 bp, Homo sapiens
actgagcactcacttttgttat

SEQ ID NO: 8378063 - DNA, 22 bp, Homo sapiens
actgagaggtgatagtgacatt

SEQ ID NO: 8378064 - DNA, 22 bp, Homo sapiens
actctgacatttaaaaagcaat

SEQ ID NO: 8378065 - DNA, 18 bp, Homo sapiens
actctgcggaggccccag

SEQ ID NO: 8378066 - DNA, 18 bp, Homo sapiens
actctgcggaggccccag

SEQ ID NO: 8378067 - DNA, 22 bp, Homo sapiens
agtgaagatatactgttgtcct

SEQ ID NO: 8378068 - DNA, 22 bp, Homo sapiens
agtgaagatatactgttgtcct

SEQ ID NO: 8378069 - DNA, 22 bp, Homo sapiens
agtgaaggaagtttgtcttggg

SEQ ID NO: 8378070 - DNA, 22 bp, Homo sapiens
agtgaaggtttacagggcccct

SEQ ID NO: 8378071 - DNA, 22 bp, Homo sapiens
agtgaaggaaacaattggttga

SEQ ID NO: 8378072 - DNA, 22 bp, Homo sapiens
agtgaagtgatagtttgcctag

SEQ ID NO: 8378073 - DNA, 22 bp, Homo sapiens
actgcacatagtgggctggcct

SEQ ID NO: 8378074 - DNA, 22 bp, Homo sapiens
actgcactccagcctgggtgat

SEQ ID NO: 8378075 - DNA, 22 bp, Homo sapiens
actgcactcctgcctgggtaac

SEQ ID NO: 8378076 - DNA, 22 bp, Homo sapiens
actgcactcctgcctgggtaac

SEQ ID NO: 8378077 - DNA, 22 bp, Homo sapiens
agtgctcatgcacatttatagt

SEQ ID NO: 8378078 - DNA, 22 bp, Homo sapiens
actgcacttcaccctgggtgac

SEQ ID NO: 8378079 - DNA, 22 bp, Homo sapiens
actgcagcctagggaccacagt

SEQ ID NO: 8378080 - DNA, 23 bp, Homo sapiens
actgcagcctccgcctgccgggt

SEQ ID NO: 8378081 - DNA, 22 bp, Homo sapiens
actgcagccccctattaggact

SEQ ID NO: 8378082 - DNA, 22 bp, Homo sapiens
actgcagcaggtaagagcattt

SEQ ID NO: 8378083 - DNA, 22 bp, Homo sapiens
actgggaggcaaagagcaagga

SEQ ID NO: 8378084 - DNA, 22 bp, Homo sapiens
actgggaggcaaagagcaagga

SEQ ID NO: 8378085 - DNA, 22 bp, Homo sapiens
actgcctggcctggcctcactg

SEQ ID NO: 8378086 - DNA, 21 bp, Homo sapiens
actgcctggggtgctggccaa

SEQ ID NO: 8378087 - DNA, 22 bp, Homo sapiens
actgcctggcagaggtttgcaa

SEQ ID NO: 8378088 - DNA, 22 bp, Homo sapiens
actgcctgcctctgattctgca

SEQ ID NO: 8378089 - DNA, 23 bp, Homo sapiens
actgcctgctactatgcccacgg

SEQ ID NO: 8378090 - DNA, 19 bp, Homo sapiens
actgcctgaggctcacagg

SEQ ID NO: 8378091 - DNA, 22 bp, Homo sapiens
actgcccaggaatctcaaagaa

SEQ ID NO: 8378092 - DNA, 22 bp, Homo sapiens
actgcccattatggtagtcact

SEQ ID NO: 8378093 - DNA, 22 bp, Homo sapiens
actgccctccagcctgggtgac

SEQ ID NO: 8378094 - DNA, 22 bp, Homo sapiens
actgcccttgtcctggcacacc

SEQ ID NO: 8378095 - DNA, 22 bp, Homo sapiens
actgccattttgaataattact

SEQ ID NO: 8378096 - DNA, 22 bp, Homo sapiens
aggcttcagttgtaccttcttg

SEQ ID NO: 8378097 - DNA, 18 bp, Homo sapiens
aggcttcccaggcaggcc

SEQ ID NO: 8378098 - DNA, 22 bp, Homo sapiens
aggcttcagcagccctctcttg

SEQ ID NO: 8378099 - DNA, 22 bp, Homo sapiens
aggcttcaggaagtctcctggg

SEQ ID NO: 8378100 - DNA, 22 bp, Homo sapiens
aggctccagggctgtgtgggag

SEQ ID NO: 8378101 - DNA, 22 bp, Homo sapiens
acattgaagctgtgaaatcaaa

SEQ ID NO: 8378102 - DNA, 22 bp, Homo sapiens
acattgaattcaaaattactga

SEQ ID NO: 8378103 - DNA, 23 bp, Homo sapiens
aggctccactccctgggatgtgg

SEQ ID NO: 8378104 - DNA, 22 bp, Homo sapiens
acattcaagatgcattcactta

SEQ ID NO: 8378105 - DNA, 22 bp, Homo sapiens
aggccctgcattgtactgaggg

SEQ ID NO: 8378106 - DNA, 22 bp, Homo sapiens
acattcactatgtccaaactct

SEQ ID NO: 8378107 - DNA, 22 bp, Homo sapiens
acattcacgctctcaaagctga

SEQ ID NO: 8378108 - DNA, 22 bp, Homo sapiens
acattcatgggttttacattat

SEQ ID NO: 8378109 - DNA, 22 bp, Homo sapiens
acattcatgtcccacttctagc

SEQ ID NO: 8378110 - DNA, 22 bp, Homo sapiens
acattcatgtcccacttctagc

SEQ ID NO: 8378111 - DNA, 22 bp, Homo sapiens
acattcatgtcccacttctagc

SEQ ID NO: 8378112 - DNA, 22 bp, Homo sapiens
acattcattccaggtcagtcag

SEQ ID NO: 8378113 - DNA, 22 bp, Homo sapiens
acattcaaggccttctgacaca

SEQ ID NO: 8378114 - DNA, 22 bp, Homo sapiens
acattcaaggccttctgacaca

SEQ ID NO: 8378115 - DNA, 22 bp, Homo sapiens
acattcaaggcagcactgagtg

SEQ ID NO: 8378116 - DNA, 22 bp, Homo sapiens
acattcaaggcagcactgagtg

SEQ ID NO: 8378117 - DNA, 22 bp, Homo sapiens
acattcaagtttctgctcatgg

SEQ ID NO: 8378118 - DNA, 22 bp, Homo sapiens
acattcacaagcctacaaggtt

SEQ ID NO: 8378119 - DNA, 22 bp, Homo sapiens
acattcaagtttctgctcatgg

SEQ ID NO: 8378120 - DNA, 22 bp, Homo sapiens
acattcacaagcctacaaggtt

SEQ ID NO: 8378121 - DNA, 22 bp, Homo sapiens
acattcttgaagtgaagtttat

SEQ ID NO: 8378122 - DNA, 22 bp, Homo sapiens
acattctagatatgttatattt

SEQ ID NO: 8378123 - DNA, 22 bp, Homo sapiens
acattctaacattgtacagata

SEQ ID NO: 8378124 - DNA, 22 bp, Homo sapiens
acattccaaaaactagcagata

SEQ ID NO: 8378125 - DNA, 18 bp, Homo sapiens
aggccacactccagaaca

SEQ ID NO: 8378126 - DNA, 22 bp, Homo sapiens
aggcatgggtagaagagaagcc

SEQ ID NO: 8378127 - DNA, 17 bp, Homo sapiens
aggcatggtctggggtg

SEQ ID NO: 8378128 - DNA, 22 bp, Homo sapiens
aggccagcaccagagtcaagaa

SEQ ID NO: 8378129 - DNA, 22 bp, Homo sapiens
aggccagcaccagagtcaagaa

SEQ ID NO: 8378130 - DNA, 22 bp, Homo sapiens
aggccagcagacgtgggactga

SEQ ID NO: 8378131 - DNA, 22 bp, Homo sapiens
aggccacagtactttgcagacc

SEQ ID NO: 8378132 - DNA, 19 bp, Homo sapiens
aggcatgggaagagaagtc

SEQ ID NO: 8378133 - DNA, 20 bp, Homo sapiens
aggcatgggatgcccagatt

SEQ ID NO: 8378134 - DNA, 20 bp, Homo sapiens
aggcatgggatgcccagatt

SEQ ID NO: 8378135 - DNA, 22 bp, Homo sapiens
aggcatggggctgcagtcaggt

SEQ ID NO: 8378136 - DNA, 20 bp, Homo sapiens
aggcatgggatgcccagatt

SEQ ID NO: 8378137 - DNA, 22 bp, Homo sapiens
aggcatggggctgcagtcaggt

SEQ ID NO: 8378138 - DNA, 22 bp, Homo sapiens
acatacatgggattaaaaaatt

SEQ ID NO: 8378139 - DNA, 22 bp, Homo sapiens
acatacatggattcatggattc

SEQ ID NO: 8378140 - DNA, 22 bp, Homo sapiens
acatacatggtgctttcttggt

SEQ ID NO: 8378141 - DNA, 22 bp, Homo sapiens
aggccctgagaaaatccctgca

SEQ ID NO: 8378142 - DNA, 22 bp, Homo sapiens
aggccctgagcatccgagggca

SEQ ID NO: 8378143 - DNA, 23 bp, Homo sapiens
aggcccaggtatgtttgttttgg

SEQ ID NO: 8378144 - DNA, 22 bp, Homo sapiens
aggcccagggctgctctctgaa

SEQ ID NO: 8378145 - DNA, 21 bp, Homo sapiens
aggcccaggaatatgcatttt

SEQ ID NO: 8378146 - DNA, 21 bp, Homo sapiens
aggcccagctttcctcttgct

SEQ ID NO: 8378147 - DNA, 22 bp, Homo sapiens
aggcccagcttgaagtgggaag

SEQ ID NO: 8378148 - DNA, 22 bp, Homo sapiens
aggcccagctgggccaggaaca

SEQ ID NO: 8378149 - DNA, 20 bp, Homo sapiens
acatgaaaggaaacaggaaa

SEQ ID NO: 8378150 - DNA, 20 bp, Homo sapiens
acatgaaaggaaacaggaaa

SEQ ID NO: 8378151 - DNA, 20 bp, Homo sapiens
acatgaaaggaaacaggaaa

SEQ ID NO: 8378152 - DNA, 22 bp, Homo sapiens
aggccaggtggtcatgcttgct

SEQ ID NO: 8378153 - DNA, 22 bp, Homo sapiens
aggccagccctgggctgagaga

SEQ ID NO: 8378154 - DNA, 22 bp, Homo sapiens
aggccagccctcacctgtgttc

SEQ ID NO: 8378155 - DNA, 18 bp, Homo sapiens
aggccagccctgctactg

SEQ ID NO: 8378156 - DNA, 22 bp, Homo sapiens
aggccagcattctctctccagg

SEQ ID NO: 8378157 - DNA, 22 bp, Homo sapiens
aggccagcatgcagttctaagg

SEQ ID NO: 8378158 - DNA, 22 bp, Homo sapiens
aggccagcagacgtgggactga

SEQ ID NO: 8378159 - DNA, 22 bp, Homo sapiens
aggccagcctcaggcagggacc

SEQ ID NO: 8378160 - DNA, 22 bp, Homo sapiens
acatctttgctcttatagagct

SEQ ID NO: 8378161 - DNA, 22 bp, Homo sapiens
acatctttttggaaacggctga

SEQ ID NO: 8378162 - DNA, 22 bp, Homo sapiens
acatgaaaagactatctgatta

SEQ ID NO: 8378163 - DNA, 22 bp, Homo sapiens
acatgaaaagactatctgatta

SEQ ID NO: 8378164 - DNA, 22 bp, Homo sapiens
accctggcctggttcatgtgat

SEQ ID NO: 8378165 - DNA, 22 bp, Homo sapiens
accctggcccattgctgtgcct

SEQ ID NO: 8378166 - DNA, 22 bp, Homo sapiens
accctggcagccttctgtcctg

SEQ ID NO: 8378167 - DNA, 18 bp, Homo sapiens
accctggcatgctcttcc

SEQ ID NO: 8378168 - DNA, 22 bp, Homo sapiens
accctgtcttccctgggcatca

SEQ ID NO: 8378169 - DNA, 22 bp, Homo sapiens
accctgggttcccgcagcacca

SEQ ID NO: 8378170 - DNA, 22 bp, Homo sapiens
accctgggggtggccagtgcca

SEQ ID NO: 8378171 - DNA, 21 bp, Homo sapiens
accctgctttatgccgtcctc

SEQ ID NO: 8378172 - DNA, 22 bp, Homo sapiens
accctgctttatgccgtcctct

SEQ ID NO: 8378173 - DNA, 22 bp, Homo sapiens
accctgcttctggattaatcca

SEQ ID NO: 8378174 - DNA, 22 bp, Homo sapiens
accctgcttggccccacttcta

SEQ ID NO: 8378175 - DNA, 22 bp, Homo sapiens
accctgcctgacaacagaggat

SEQ ID NO: 8378176 - DNA, 22 bp, Homo sapiens
accctgctgacctgaaagaggg

SEQ ID NO: 8378177 - DNA, 22 bp, Homo sapiens
accctctgccttgagcagtgcc

SEQ ID NO: 8378178 - DNA, 22 bp, Homo sapiens
accccagcgcatatggtctgcg

SEQ ID NO: 8378179 - DNA, 23 bp, Homo sapiens
acccatctctcctgtcatgcaga

SEQ ID NO: 8378180 - DNA, 23 bp, Homo sapiens
acccatctctcctgtcatgcaga

SEQ ID NO: 8378181 - DNA, 22 bp, Homo sapiens
acccagagatgtcaatggcttt

SEQ ID NO: 8378182 - DNA, 22 bp, Homo sapiens
acccagagcactgggtgtgggc

SEQ ID NO: 8378183 - DNA, 22 bp, Homo sapiens
acccagagcacagatgcaacgt

SEQ ID NO: 8378184 - DNA, 22 bp, Homo sapiens
acccaccctactagcagtgtcc

SEQ ID NO: 8378185 - DNA, 22 bp, Homo sapiens
acccagagaactgaggcatgaa

SEQ ID NO: 8378186 - DNA, 22 bp, Homo sapiens
accaaatgcttggctgctgtga

SEQ ID NO: 8378187 - DNA, 22 bp, Homo sapiens
accaacatgtcctcacacagcc

SEQ ID NO: 8378188 - DNA, 22 bp, Homo sapiens
accaggaacaagccatggagga

SEQ ID NO: 8378189 - DNA, 22 bp, Homo sapiens
accagctgagtaggggagggcc

SEQ ID NO: 8378190 - DNA, 22 bp, Homo sapiens
accaatataagtataggtaagt

SEQ ID NO: 8378191 - DNA, 23 bp, Homo sapiens
accaggagaaaagctttgcggga

SEQ ID NO: 8378192 - DNA, 22 bp, Homo sapiens
accaggagagattttattgaga

SEQ ID NO: 8378193 - DNA, 19 bp, Homo sapiens
accaggagacagtgagctt

SEQ ID NO: 8378194 - DNA, 22 bp, Homo sapiens
accaggagcattttttattagt

SEQ ID NO: 8378195 - DNA, 22 bp, Homo sapiens
accaggaggaagtgttaatgat

SEQ ID NO: 8378196 - DNA, 22 bp, Homo sapiens
accaggaggcctggagcacaaa

SEQ ID NO: 8378197 - DNA, 22 bp, Homo sapiens
accaggaggccttggttctgag

SEQ ID NO: 8378198 - DNA, 22 bp, Homo sapiens
accaggaggctacactgtccca

SEQ ID NO: 8378199 - DNA, 22 bp, Homo sapiens
accagtccgcggagctccgggg

SEQ ID NO: 8378200 - DNA, 22 bp, Homo sapiens
accagtaggagttggagaggaa

SEQ ID NO: 8378201 - DNA, 21 bp, Homo sapiens
accagtccctagtcttatcct

SEQ ID NO: 8378202 - DNA, 23 bp, Homo sapiens
agggcccaagcctggacagcagg

SEQ ID NO: 8378203 - DNA, 22 bp, Homo sapiens
accagtttgtaacctgttttca

SEQ ID NO: 8378204 - DNA, 21 bp, Homo sapiens
accagtttggggggcttcctg

SEQ ID NO: 8378205 - DNA, 22 bp, Homo sapiens
accagtttctgggggaggttgg

SEQ ID NO: 8378206 - DNA, 22 bp, Homo sapiens
accagtttatagcgatctgtca

SEQ ID NO: 8378207 - DNA, 22 bp, Homo sapiens
accagggcttacagcagtagct

SEQ ID NO: 8378208 - DNA, 22 bp, Homo sapiens
agcttttagtacgttaaaattg

SEQ ID NO: 8378209 - DNA, 22 bp, Homo sapiens
aggaaaaaagtctgtgattata

SEQ ID NO: 8378210 - DNA, 21 bp, Homo sapiens
agcttttctgttttatatcta

SEQ ID NO: 8378211 - DNA, 22 bp, Homo sapiens
aggaaaaacctgttaatggtag

SEQ ID NO: 8378212 - DNA, 22 bp, Homo sapiens
aggaaaaacctgttaatggtag

SEQ ID NO: 8378213 - DNA, 22 bp, Homo sapiens
aggaaaaaagtctgtgattata

SEQ ID NO: 8378214 - DNA, 22 bp, Homo sapiens
agctttggttgccatgatctga

SEQ ID NO: 8378215 - DNA, 22 bp, Homo sapiens
agcttcataattccttgactca

SEQ ID NO: 8378216 - DNA, 23 bp, Homo sapiens
aggaaactgaaggggccctctat

SEQ ID NO: 8378217 - DNA, 22 bp, Homo sapiens
aggaaagaaaggaggtgcattt

SEQ ID NO: 8378218 - DNA, 22 bp, Homo sapiens
aggaaagaaaggaggtgcattt

SEQ ID NO: 8378219 - DNA, 22 bp, Homo sapiens
aggaagccacgagtggcacggg

SEQ ID NO: 8378220 - DNA, 22 bp, Homo sapiens
aggaagccaagcctgacactca

SEQ ID NO: 8378221 - DNA, 22 bp, Homo sapiens
aggaagagcattcacatggtag

SEQ ID NO: 8378222 - DNA, 22 bp, Homo sapiens
aggaaagaaaggaggtgcattt

SEQ ID NO: 8378223 - DNA, 22 bp, Homo sapiens
aggaaagaaaggaggtgcattt

SEQ ID NO: 8378224 - DNA, 18 bp, Homo sapiens
aggaaagaaaggcaggtg

SEQ ID NO: 8378225 - DNA, 18 bp, Homo sapiens
aggaaagaaaggcaggtg

SEQ ID NO: 8378226 - DNA, 18 bp, Homo sapiens
aggaaagaaaggcaggtg

SEQ ID NO: 8378227 - DNA, 22 bp, Homo sapiens
agctgtggtcttcaagttgcct

SEQ ID NO: 8378228 - DNA, 22 bp, Homo sapiens
agctgtggtgttttcaagccct

SEQ ID NO: 8378229 - DNA, 22 bp, Homo sapiens
agctgtggttagatagagtcct

SEQ ID NO: 8378230 - DNA, 22 bp, Homo sapiens
agctgtggttagatagagtcct

SEQ ID NO: 8378231 - DNA, 22 bp, Homo sapiens
agctgtggggaggaggctagca

SEQ ID NO: 8378232 - DNA, 19 bp, Homo sapiens
agctgtggggcctagcacc

SEQ ID NO: 8378233 - DNA, 22 bp, Homo sapiens
agctgtggtacttgattcacaa

SEQ ID NO: 8378234 - DNA, 19 bp, Homo sapiens
agctgtggggcctagcacc

SEQ ID NO: 8378235 - DNA, 22 bp, Homo sapiens
agcttagaatgtgttaggaaag

SEQ ID NO: 8378236 - DNA, 22 bp, Homo sapiens
agctgtgtaggatcataacacg

SEQ ID NO: 8378237 - DNA, 22 bp, Homo sapiens
agcttatattctagtgatgcca

SEQ ID NO: 8378238 - DNA, 22 bp, Homo sapiens
agcttattaatttttctgcatg

SEQ ID NO: 8378239 - DNA, 22 bp, Homo sapiens
agcttcaaggttcaaggatgct

SEQ ID NO: 8378240 - DNA, 22 bp, Homo sapiens
agcttcaacttactaaaagata

SEQ ID NO: 8378241 - DNA, 22 bp, Homo sapiens
agctgggagctgaaggctgatt

SEQ ID NO: 8378242 - DNA, 22 bp, Homo sapiens
agctgggagctgaaggctgatt

SEQ ID NO: 8378243 - DNA, 22 bp, Homo sapiens
agctgggagctgaaggctgatt

SEQ ID NO: 8378244 - DNA, 22 bp, Homo sapiens
agctgggaggtgggcagtgaga

SEQ ID NO: 8378245 - DNA, 22 bp, Homo sapiens
agctggttcagtttctgggcct

SEQ ID NO: 8378246 - DNA, 22 bp, Homo sapiens
agctgtgggagaatctctgggt

SEQ ID NO: 8378247 - DNA, 22 bp, Homo sapiens
agctgggcaaaatgtgaggttg

SEQ ID NO: 8378248 - DNA, 22 bp, Homo sapiens
agctgggatgataacctcagtc

SEQ ID NO: 8378249 - DNA, 21 bp, Homo sapiens
agctggctctctctggagaga

SEQ ID NO: 8378250 - DNA, 22 bp, Homo sapiens
agctggctatgccctgtgaacc

SEQ ID NO: 8378251 - DNA, 22 bp, Homo sapiens
agctggctatgccctgtgaacc

SEQ ID NO: 8378252 - DNA, 22 bp, Homo sapiens
agctggctatacttgaaaagtc

SEQ ID NO: 8378253 - DNA, 20 bp, Homo sapiens
agctggcctgtcctaggcct

SEQ ID NO: 8378254 - DNA, 22 bp, Homo sapiens
acagcctgagagtggagctggc

SEQ ID NO: 8378255 - DNA, 22 bp, Homo sapiens
acagcctgacttttgttgtcac

SEQ ID NO: 8378256 - DNA, 22 bp, Homo sapiens
acagcctgagagtggagctggc

SEQ ID NO: 8378257 - DNA, 22 bp, Homo sapiens
acagcctgatttatggagcagt

SEQ ID NO: 8378258 - DNA, 22 bp, Homo sapiens
acagcctgatttatggagcagt

SEQ ID NO: 8378259 - DNA, 22 bp, Homo sapiens
acagcctgcagccccaggtcgc

SEQ ID NO: 8378260 - DNA, 22 bp, Homo sapiens
agctgctgtttggtgagtcttg

SEQ ID NO: 8378261 - DNA, 22 bp, Homo sapiens
agctgctgtttcttgcacgtat

SEQ ID NO: 8378262 - DNA, 22 bp, Homo sapiens
agctgctgtgtgctcaggcagg

SEQ ID NO: 8378263 - DNA, 22 bp, Homo sapiens
agctgctgtcctaggcactgta

SEQ ID NO: 8378264 - DNA, 23 bp, Homo sapiens
agctgctgggcctgccgtggcct

SEQ ID NO: 8378265 - DNA, 22 bp, Homo sapiens
agctgctggtttaagggatggg

SEQ ID NO: 8378266 - DNA, 22 bp, Homo sapiens
acagcccagctctttctctgca

SEQ ID NO: 8378267 - DNA, 22 bp, Homo sapiens
acagcccagaaagcctaagggg

SEQ ID NO: 8378268 - DNA, 22 bp, Homo sapiens
agctgcttgtacatgaccacat

SEQ ID NO: 8378269 - DNA, 22 bp, Homo sapiens
agctgcttagagtctcttctta

SEQ ID NO: 8378270 - DNA, 22 bp, Homo sapiens
agctgcagccctcctgcatggc

SEQ ID NO: 8378271 - DNA, 22 bp, Homo sapiens
acagcccaagtcacctgcagga

SEQ ID NO: 8378272 - DNA, 22 bp, Homo sapiens
agctgcagcgttcatttttcca

SEQ ID NO: 8378273 - DNA, 22 bp, Homo sapiens
agctgctcattactttctgttg

SEQ ID NO: 8378274 - DNA, 22 bp, Homo sapiens
acagccagtcatctcagcaggg

SEQ ID NO: 8378275 - DNA, 22 bp, Homo sapiens
acagccagtcatctcagcaggg

SEQ ID NO: 8378276 - DNA, 22 bp, Homo sapiens
acagccagtcatctcagcaggg

SEQ ID NO: 8378277 - DNA, 22 bp, Homo sapiens
agctcccagaaggccctgcgcc

SEQ ID NO: 8378278 - DNA, 20 bp, Homo sapiens
agctccatgaagtagtcact

SEQ ID NO: 8378279 - DNA, 18 bp, Homo sapiens
agctccatctgtcagcat

SEQ ID NO: 8378280 - DNA, 18 bp, Homo sapiens
agctccatctgtcagcat

SEQ ID NO: 8378281 - DNA, 22 bp, Homo sapiens
acagggtgactttgtgacagat

SEQ ID NO: 8378282 - DNA, 22 bp, Homo sapiens
aggagccattttccaagggcga

SEQ ID NO: 8378283 - DNA, 21 bp, Homo sapiens
aggagccatgtggtctgatgg

SEQ ID NO: 8378284 - DNA, 22 bp, Homo sapiens
aggagccatgagtgacatcaca

SEQ ID NO: 8378285 - DNA, 22 bp, Homo sapiens
aggagctgcagattctgccttg

SEQ ID NO: 8378286 - DNA, 22 bp, Homo sapiens
aggagccctgcgggaggcagag

SEQ ID NO: 8378287 - DNA, 23 bp, Homo sapiens
aggagcccctaattctgggcagc

SEQ ID NO: 8378288 - DNA, 22 bp, Homo sapiens
aggagcctgaatcagagggtga

SEQ ID NO: 8378289 - DNA, 17 bp, Homo sapiens
aggaagggcaagtttct

SEQ ID NO: 8378290 - DNA, 22 bp, Homo sapiens
acaggggctccgaaggtgaggg

SEQ ID NO: 8378291 - DNA, 22 bp, Homo sapiens
aggagacatctaactgtaggtt

SEQ ID NO: 8378292 - DNA, 22 bp, Homo sapiens
aggagacatggaatagtgaggc

SEQ ID NO: 8378293 - DNA, 23 bp, Homo sapiens
aggaaggaggtcctaacagtatc

SEQ ID NO: 8378294 - DNA, 23 bp, Homo sapiens
aggaaggaggtcctaacagtatc

SEQ ID NO: 8378295 - DNA, 23 bp, Homo sapiens
aggaaggaggtcctaacagtatc

SEQ ID NO: 8378296 - DNA, 17 bp, Homo sapiens
aggaagcgagctggcct

SEQ ID NO: 8378297 - DNA, 23 bp, Homo sapiens
acatacataagcaccacattttg

SEQ ID NO: 8378298 - DNA, 23 bp, Homo sapiens
acatacataagcaccacattttg

SEQ ID NO: 8378299 - DNA, 22 bp, Homo sapiens
acatacaaatagagctgtagta

SEQ ID NO: 8378300 - DNA, 22 bp, Homo sapiens
acatacatatgacaactttcct

SEQ ID NO: 8378301 - DNA, 23 bp, Homo sapiens
acatacatggagataaagtgatg

SEQ ID NO: 8378302 - DNA, 22 bp, Homo sapiens
aggcacagatttggggaaagca

SEQ ID NO: 8378303 - DNA, 18 bp, Homo sapiens
aggcacagagcatacata

SEQ ID NO: 8378304 - DNA, 22 bp, Homo sapiens
aggcacaagaaactgctcccca

SEQ ID NO: 8378305 - DNA, 22 bp, Homo sapiens
aggcacagaatggcattcagtg

SEQ ID NO: 8378306 - DNA, 22 bp, Homo sapiens
aggcacagaatggcattcagtg

SEQ ID NO: 8378307 - DNA, 22 bp, Homo sapiens
aggcaacaggaaaccacatgat

SEQ ID NO: 8378308 - DNA, 22 bp, Homo sapiens
aggcaacataacacgaaagtct

SEQ ID NO: 8378309 - DNA, 22 bp, Homo sapiens
aggaggctgtggagcactccat

SEQ ID NO: 8378310 - DNA, 22 bp, Homo sapiens
aggaggctgtggagcactccat

SEQ ID NO: 8378311 - DNA, 22 bp, Homo sapiens
aggaggccgctgatgggctccc

SEQ ID NO: 8378312 - DNA, 17 bp, Homo sapiens
aggagggaaatagcttg

SEQ ID NO: 8378313 - DNA, 17 bp, Homo sapiens
aggagggaaatagcttg

SEQ ID NO: 8378314 - DNA, 22 bp, Homo sapiens
aggagggaataagaaagagtca

SEQ ID NO: 8378315 - DNA, 22 bp, Homo sapiens
aggagggaataagaaagagtca

SEQ ID NO: 8378316 - DNA, 22 bp, Homo sapiens
aggagggacaccaatatatgtt

SEQ ID NO: 8378317 - DNA, 22 bp, Homo sapiens
aggagggagatgcccatcctgg

SEQ ID NO: 8378318 - DNA, 20 bp, Homo sapiens
aggagggacctggattggcg

SEQ ID NO: 8378319 - DNA, 22 bp, Homo sapiens
aggcaaagcgataccagagcta

SEQ ID NO: 8378320 - DNA, 22 bp, Homo sapiens
aggcaaagagccagcaaatctg

SEQ ID NO: 8378321 - DNA, 22 bp, Homo sapiens
aggcaaattattgtatgcagtt

SEQ ID NO: 8378322 - DNA, 22 bp, Homo sapiens
aggcaaattattgtatgcagtt

SEQ ID NO: 8378323 - DNA, 22 bp, Homo sapiens
aggcaaagaagttggtcaggag

SEQ ID NO: 8378324 - DNA, 22 bp, Homo sapiens
aggatggcgattcgagcacctc

SEQ ID NO: 8378325 - DNA, 22 bp, Homo sapiens
aggagggtacaatgggtggaaa

SEQ ID NO: 8378326 - DNA, 22 bp, Homo sapiens
aggagggtacaatgggtggaaa

SEQ ID NO: 8378327 - DNA, 22 bp, Homo sapiens
agagctggctggtagccctgat

SEQ ID NO: 8378328 - DNA, 21 bp, Homo sapiens
agagctggcctgccaggccct

SEQ ID NO: 8378329 - DNA, 22 bp, Homo sapiens
agagctggatggtcaagatggc

SEQ ID NO: 8378330 - DNA, 22 bp, Homo sapiens
agagccctgaagcagagctaaa

SEQ ID NO: 8378331 - DNA, 22 bp, Homo sapiens
agagccctgccaatggatgagg

SEQ ID NO: 8378332 - DNA, 22 bp, Homo sapiens
agagcctctgtcatggagagaa

SEQ ID NO: 8378333 - DNA, 22 bp, Homo sapiens
agagcagatttcaaatattggc

SEQ ID NO: 8378334 - DNA, 22 bp, Homo sapiens
agagcagatttcaaatattggc

SEQ ID NO: 8378335 - DNA, 22 bp, Homo sapiens
agagcagatggccagggggcct

SEQ ID NO: 8378336 - DNA, 22 bp, Homo sapiens
agagcagatggccagggggcct

SEQ ID NO: 8378337 - DNA, 22 bp, Homo sapiens
agagcagatggagctggaagag

SEQ ID NO: 8378338 - DNA, 22 bp, Homo sapiens
agagcagatggagctggaagag

SEQ ID NO: 8378339 - DNA, 22 bp, Homo sapiens
agagcagatggagctggaagag

SEQ ID NO: 8378340 - DNA, 22 bp, Homo sapiens
agagcagatggagctggaagag

SEQ ID NO: 8378341 - DNA, 22 bp, Homo sapiens
agagcccctggtggagtgagaa

SEQ ID NO: 8378342 - DNA, 22 bp, Homo sapiens
agagcccctcggtggaggggtc

SEQ ID NO: 8378343 - DNA, 22 bp, Homo sapiens
agagcccctggtggagtgagaa

SEQ ID NO: 8378344 - DNA, 22 bp, Homo sapiens
agagcccaggtcctggagaggg

SEQ ID NO: 8378345 - DNA, 22 bp, Homo sapiens
agagcccagtctttgtgtgaag

SEQ ID NO: 8378346 - DNA, 22 bp, Homo sapiens
agagcccagtctttgtgtgaag

SEQ ID NO: 8378347 - DNA, 22 bp, Homo sapiens
agagcccagaaagtatgtcata

SEQ ID NO: 8378348 - DNA, 22 bp, Homo sapiens
agagcccaggtcctggagaggg

SEQ ID NO: 8378349 - DNA, 22 bp, Homo sapiens
agagcccaggcaggcatccagg

SEQ ID NO: 8378350 - DNA, 22 bp, Homo sapiens
agagccaggccaggccggggca

SEQ ID NO: 8378351 - DNA, 22 bp, Homo sapiens
agagcacagggttttgtgccgg

SEQ ID NO: 8378352 - DNA, 22 bp, Homo sapiens
agagcacaggctctggagtcta

SEQ ID NO: 8378353 - DNA, 22 bp, Homo sapiens
agagcacagtgcaggatccccg

SEQ ID NO: 8378354 - DNA, 22 bp, Homo sapiens
agagcacagtatctgcacatca

SEQ ID NO: 8378355 - DNA, 22 bp, Homo sapiens
agagcacaggctctggagtcta

SEQ ID NO: 8378356 - DNA, 22 bp, Homo sapiens
agagattgctagctggctttaa

SEQ ID NO: 8378357 - DNA, 22 bp, Homo sapiens
agagcagaggcatggccgtggg

SEQ ID NO: 8378358 - DNA, 22 bp, Homo sapiens
agagcaccccgggaagagcaag

SEQ ID NO: 8378359 - DNA, 22 bp, Homo sapiens
agagcagagggctctgggacaa

SEQ ID NO: 8378360 - DNA, 22 bp, Homo sapiens
agagcagagtggctgtagcttg

SEQ ID NO: 8378361 - DNA, 22 bp, Homo sapiens
agacttatgcttcaaatagtaa

SEQ ID NO: 8378362 - DNA, 21 bp, Homo sapiens
agacttctagaagtgagatag

SEQ ID NO: 8378363 - DNA, 22 bp, Homo sapiens
agacttctctccttgacttgca

SEQ ID NO: 8378364 - DNA, 22 bp, Homo sapiens
agactttaatgtgcaaatgaaa

SEQ ID NO: 8378365 - DNA, 22 bp, Homo sapiens
agactttcttgacctagttaat

SEQ ID NO: 8378366 - DNA, 21 bp, Homo sapiens
agactttgcttgcagagagtc

SEQ ID NO: 8378367 - DNA, 22 bp, Homo sapiens
agactttataaatcttaatttc

SEQ ID NO: 8378368 - DNA, 22 bp, Homo sapiens
agactttagaatcagatagcct

SEQ ID NO: 8378369 - DNA, 22 bp, Homo sapiens
agagaatacaaagaagatatgt

SEQ ID NO: 8378370 - DNA, 22 bp, Homo sapiens
agagaaggtcactaaggaccca

SEQ ID NO: 8378371 - DNA, 22 bp, Homo sapiens
agagaaggtcactaaggaccca

SEQ ID NO: 8378372 - DNA, 22 bp, Homo sapiens
agagaaaagagttcaggctttg

SEQ ID NO: 8378373 - DNA, 19 bp, Homo sapiens
agagaaggatcctatggtt

SEQ ID NO: 8378374 - DNA, 22 bp, Homo sapiens
agagaaaagagttcaggctttg

SEQ ID NO: 8378375 - DNA, 22 bp, Homo sapiens
agagaaaactcattgaggtgtc

SEQ ID NO: 8378376 - DNA, 23 bp, Homo sapiens
agagaaaaatatctgggcacatt

SEQ ID NO: 8378377 - DNA, 19 bp, Homo sapiens
agagaggctgtgtgaggga

SEQ ID NO: 8378378 - DNA, 22 bp, Homo sapiens
agagaggctgggcgtagggctt

SEQ ID NO: 8378379 - DNA, 22 bp, Homo sapiens
agagagggaatatttggggtat

SEQ ID NO: 8378380 - DNA, 22 bp, Homo sapiens
agagaggtctcaggagaaacca

SEQ ID NO: 8378381 - DNA, 22 bp, Homo sapiens
agagagggcatagaaaaaggga

SEQ ID NO: 8378382 - DNA, 22 bp, Homo sapiens
agagagggcatagaaaaaggga

SEQ ID NO: 8378383 - DNA, 21 bp, Homo sapiens
agagagggagatgaaacatcc

SEQ ID NO: 8378384 - DNA, 22 bp, Homo sapiens
agagaggcattcggtgatccca

SEQ ID NO: 8378385 - DNA, 22 bp, Homo sapiens
agagaggctgctggactatatg

SEQ ID NO: 8378386 - DNA, 22 bp, Homo sapiens
agagaggcgagttacctgtgct

SEQ ID NO: 8378387 - DNA, 22 bp, Homo sapiens
agagagcagtggatcacctagc

SEQ ID NO: 8378388 - DNA, 21 bp, Homo sapiens
agagagaaggccatatggtcc

SEQ ID NO: 8378389 - DNA, 22 bp, Homo sapiens
agagagcccgggccagggcaca

SEQ ID NO: 8378390 - DNA, 21 bp, Homo sapiens
agagacagagaaagtaacatt

SEQ ID NO: 8378391 - DNA, 21 bp, Homo sapiens
agagacagagaaagtaacatt

SEQ ID NO: 8378392 - DNA, 22 bp, Homo sapiens
agagacaatgccaatgcacacg

SEQ ID NO: 8378393 - DNA, 22 bp, Homo sapiens
agagaattggagcagtgacagg

SEQ ID NO: 8378394 - DNA, 22 bp, Homo sapiens
atgaagcattacaggatgacag

SEQ ID NO: 8378395 - DNA, 19 bp, Homo sapiens
atgaagccccagggcccgt

SEQ ID NO: 8378396 - DNA, 22 bp, Homo sapiens
atgaagccatctcctccccttc

SEQ ID NO: 8378397 - DNA, 22 bp, Homo sapiens
atgaagccagaagaagactggc

SEQ ID NO: 8378398 - DNA, 22 bp, Homo sapiens
atctgcttgccctcttaggacc

SEQ ID NO: 8378399 - DNA, 22 bp, Homo sapiens
atctgcttgagtttgaagtcag

SEQ ID NO: 8378400 - DNA, 22 bp, Homo sapiens
atctgcttgaaacttcttatac

SEQ ID NO: 8378401 - DNA, 20 bp, Homo sapiens
atctgctgagaatgaaaggc

SEQ ID NO: 8378402 - DNA, 22 bp, Homo sapiens
atgaaggcagttttataagatt

SEQ ID NO: 8378403 - DNA, 22 bp, Homo sapiens
atgaaggcaagactgaggtgtg

SEQ ID NO: 8378404 - DNA, 19 bp, Homo sapiens
atgaaggcactgagtggga

SEQ ID NO: 8378405 - DNA, 22 bp, Homo sapiens
atgaagctgaggttctctttga

SEQ ID NO: 8378406 - DNA, 22 bp, Homo sapiens
atgaagctgtttattttagcag

SEQ ID NO: 8378407 - DNA, 22 bp, Homo sapiens
atgaagttctagtgagaaatgc

SEQ ID NO: 8378408 - DNA, 22 bp, Homo sapiens
agacaactgcagagcaaagaat

SEQ ID NO: 8378409 - DNA, 22 bp, Homo sapiens
agacaagaaactgggagtctct

SEQ ID NO: 8378410 - DNA, 22 bp, Homo sapiens
agacaacaccaaatgctagtgt

SEQ ID NO: 8378411 - DNA, 19 bp, Homo sapiens
agacaagtttccagaagcc

SEQ ID NO: 8378412 - DNA, 22 bp, Homo sapiens
agacaaggctggagtttaggca

SEQ ID NO: 8378413 - DNA, 22 bp, Homo sapiens
atgccttatagtccacagtgga

SEQ ID NO: 8378414 - DNA, 22 bp, Homo sapiens
atgcctttaagagatactgagg

SEQ ID NO: 8378415 - DNA, 22 bp, Homo sapiens
atgcctggtatgaagcaaggaa

SEQ ID NO: 8378416 - DNA, 22 bp, Homo sapiens
agacgagggcccccaggacagc

SEQ ID NO: 8378417 - DNA, 22 bp, Homo sapiens
agactgtaattgacatgtcagc

SEQ ID NO: 8378418 - DNA, 22 bp, Homo sapiens
agactggtttttaacttcacct

SEQ ID NO: 8378419 - DNA, 22 bp, Homo sapiens
agaccccatacctcagcaggta

SEQ ID NO: 8378420 - DNA, 22 bp, Homo sapiens
agacctggagtgaagagttccc

SEQ ID NO: 8378421 - DNA, 22 bp, Homo sapiens
atgccaattgcaggaagaaaac

SEQ ID NO: 8378422 - DNA, 22 bp, Homo sapiens
atgccaagtatgattcacatgt

SEQ ID NO: 8378423 - DNA, 22 bp, Homo sapiens
atgcatttttgagtatgaatga

SEQ ID NO: 8378424 - DNA, 22 bp, Homo sapiens
atgccaaaatgttacatttctt

SEQ ID NO: 8378425 - DNA, 22 bp, Homo sapiens
atgatacatcttgtttatttca

SEQ ID NO: 8378426 - DNA, 22 bp, Homo sapiens
atgatacatcttgtttatttca

SEQ ID NO: 8378427 - DNA, 22 bp, Homo sapiens
agacagaatttgtcagataaat

SEQ ID NO: 8378428 - DNA, 22 bp, Homo sapiens
agacagaacagaataattgttg

SEQ ID NO: 8378429 - DNA, 22 bp, Homo sapiens
atgatactctaggtgatttaca

SEQ ID NO: 8378430 - DNA, 22 bp, Homo sapiens
atgatatagagagtagattaaa

SEQ ID NO: 8378431 - DNA, 22 bp, Homo sapiens
agaggctgggaagggtccccgg

SEQ ID NO: 8378432 - DNA, 22 bp, Homo sapiens
agaggctgggcaggacccacag

SEQ ID NO: 8378433 - DNA, 22 bp, Homo sapiens
agaggctgggtacgggccacct

SEQ ID NO: 8378434 - DNA, 22 bp, Homo sapiens
agaggctgggtacgggccacct

SEQ ID NO: 8378435 - DNA, 22 bp, Homo sapiens
agaggctgtcccttgctattcc

SEQ ID NO: 8378436 - DNA, 22 bp, Homo sapiens
agaggctgggtacgggccacct

SEQ ID NO: 8378437 - DNA, 22 bp, Homo sapiens
agagggctttgattctcagttc

SEQ ID NO: 8378438 - DNA, 22 bp, Homo sapiens
agaggggaagtaatgaatgata

SEQ ID NO: 8378439 - DNA, 22 bp, Homo sapiens
agagggctttgattctcagttc

SEQ ID NO: 8378440 - DNA, 22 bp, Homo sapiens
agaggggaggcgaaccagagtc

SEQ ID NO: 8378441 - DNA, 22 bp, Homo sapiens
agaggggaggcgaaccagagtc

SEQ ID NO: 8378442 - DNA, 23 bp, Homo sapiens
agaggggagcatctgctggctga

SEQ ID NO: 8378443 - DNA, 22 bp, Homo sapiens
agaggggacagccacctgcccg

SEQ ID NO: 8378444 - DNA, 22 bp, Homo sapiens
agaggggagagctaagcaattc

SEQ ID NO: 8378445 - DNA, 22 bp, Homo sapiens
agaggggctcaagcagtggtct

SEQ ID NO: 8378446 - DNA, 20 bp, Homo sapiens
agagtgctggactgaggagc

SEQ ID NO: 8378447 - DNA, 22 bp, Homo sapiens
agagtgctagcctgagggaggt

SEQ ID NO: 8378448 - DNA, 22 bp, Homo sapiens
agagtgagggggcactgagacg

SEQ ID NO: 8378449 - DNA, 22 bp, Homo sapiens
agagtgagggggcactgagacg

SEQ ID NO: 8378450 - DNA, 18 bp, Homo sapiens
agagtccagggtgaggtg

SEQ ID NO: 8378451 - DNA, 22 bp, Homo sapiens
agagtccaggggcctggtgtgt

SEQ ID NO: 8378452 - DNA, 22 bp, Homo sapiens
agaggtggagctcttggcatca

SEQ ID NO: 8378453 - DNA, 22 bp, Homo sapiens
agagtcaccttttcctcaggat

SEQ ID NO: 8378454 - DNA, 22 bp, Homo sapiens
agagtcaagggtgcagaggaag

SEQ ID NO: 8378455 - DNA, 22 bp, Homo sapiens
agagtcaaggtggcatttagct

SEQ ID NO: 8378456 - DNA, 22 bp, Homo sapiens
agagtcagactaagccatggtg

SEQ ID NO: 8378457 - DNA, 22 bp, Homo sapiens
agagtcagactaagccatggtg

SEQ ID NO: 8378458 - DNA, 22 bp, Homo sapiens
agagtcagcttatgacacagtc

SEQ ID NO: 8378459 - DNA, 22 bp, Homo sapiens
agagtcagaaccaagatgaggc

SEQ ID NO: 8378460 - DNA, 22 bp, Homo sapiens
agagtcagaaagcagacagggg

SEQ ID NO: 8378461 - DNA, 22 bp, Homo sapiens
agagtccaaatgtgcagttatg

SEQ ID NO: 8378462 - DNA, 22 bp, Homo sapiens
agagtcagtaacatatatggta

SEQ ID NO: 8378463 - DNA, 22 bp, Homo sapiens
agagtcagttatgtcaagtgct

SEQ ID NO: 8378464 - DNA, 22 bp, Homo sapiens
agagtcagttagcgaatactta

SEQ ID NO: 8378465 - DNA, 23 bp, Homo sapiens
agaggccagcctttggagacacc

SEQ ID NO: 8378466 - DNA, 22 bp, Homo sapiens
agaggccagcactgcagggaag

SEQ ID NO: 8378467 - DNA, 22 bp, Homo sapiens
agaggccagatcatcatagatg

SEQ ID NO: 8378468 - DNA, 22 bp, Homo sapiens
agaggccaccagaggtggtgcc

SEQ ID NO: 8378469 - DNA, 22 bp, Homo sapiens
agaggctggattgagcatagac

SEQ ID NO: 8378470 - DNA, 18 bp, Homo sapiens
agaggctggacaggggat

SEQ ID NO: 8378471 - DNA, 18 bp, Homo sapiens
agaggctggacaggggat

SEQ ID NO: 8378472 - DNA, 18 bp, Homo sapiens
agaggctggacaggggat

SEQ ID NO: 8378473 - DNA, 22 bp, Homo sapiens
agaggctgcaggctggaaatca

SEQ ID NO: 8378474 - DNA, 22 bp, Homo sapiens
agaggctgcaggctggaaatca

SEQ ID NO: 8378475 - DNA, 23 bp, Homo sapiens
agaggctgcagggtattgagaat

SEQ ID NO: 8378476 - DNA, 18 bp, Homo sapiens
agaggctggacaggggat

SEQ ID NO: 8378477 - DNA, 22 bp, Homo sapiens
agaggctgcacttgctcatgat

SEQ ID NO: 8378478 - DNA, 22 bp, Homo sapiens
agaggctgcacttgctcatgat

SEQ ID NO: 8378479 - DNA, 22 bp, Homo sapiens
agagctggctgtgggtgacttt

SEQ ID NO: 8378480 - DNA, 22 bp, Homo sapiens
agaggcacaacagtcccattgt

SEQ ID NO: 8378481 - DNA, 22 bp, Homo sapiens
agaggcacaaactggaaaggac

SEQ ID NO: 8378482 - DNA, 22 bp, Homo sapiens
agaggcacatggagggtggaag

SEQ ID NO: 8378483 - DNA, 22 bp, Homo sapiens
agaggcaccatctggaacagcc

SEQ ID NO: 8378484 - DNA, 23 bp, Homo sapiens
agaggcacagcacttggctggcc

SEQ ID NO: 8378485 - DNA, 22 bp, Homo sapiens
attacactaatgtgacaacaat

SEQ ID NO: 8378486 - DNA, 22 bp, Homo sapiens
attacactagctattcttatgg

SEQ ID NO: 8378487 - DNA, 22 bp, Homo sapiens
agaggcacccagttaagctgca

SEQ ID NO: 8378488 - DNA, 22 bp, Homo sapiens
agaggcacccgcgcgcggccat

SEQ ID NO: 8378489 - DNA, 22 bp, Homo sapiens
agaggcacggaggctgcatgga

SEQ ID NO: 8378490 - DNA, 23 bp, Homo sapiens
agaggcacctaaagtcaagttgt

SEQ ID NO: 8378491 - DNA, 22 bp, Homo sapiens
agaggcactaagggaagagcag

SEQ ID NO: 8378492 - DNA, 22 bp, Homo sapiens
agaggcacggaggctgcatgga

SEQ ID NO: 8378493 - DNA, 22 bp, Homo sapiens
attacaatcgagagaaacaaat

SEQ ID NO: 8378494 - DNA, 23 bp, Homo sapiens
agaggcactaattattcagagat

SEQ ID NO: 8378495 - DNA, 22 bp, Homo sapiens
attacagaagatatgctcaaca

SEQ ID NO: 8378496 - DNA, 23 bp, Homo sapiens
agaggcaggagtggcttgcccgg

SEQ ID NO: 8378497 - DNA, 22 bp, Homo sapiens
attacagtaacagctacaatgc

SEQ ID NO: 8378498 - DNA, 22 bp, Homo sapiens
attacagtaacagctacaatgc

SEQ ID NO: 8378499 - DNA, 22 bp, Homo sapiens
agcaacagcaacgacatttctc

SEQ ID NO: 8378500 - DNA, 22 bp, Homo sapiens
agcaacagccctgtttcattag

SEQ ID NO: 8378501 - DNA, 22 bp, Homo sapiens
agcaaattcagaagcagaatgg

SEQ ID NO: 8378502 - DNA, 22 bp, Homo sapiens
agcaaattaggtcaaggagatg

SEQ ID NO: 8378503 - DNA, 22 bp, Homo sapiens
agcaaatgggtttatatttgac

SEQ ID NO: 8378504 - DNA, 22 bp, Homo sapiens
agatgtgggcaatggaatggag

SEQ ID NO: 8378505 - DNA, 22 bp, Homo sapiens
agatgttatcattcagagtagc

SEQ ID NO: 8378506 - DNA, 22 bp, Homo sapiens
agatgtggccggctagggagag

SEQ ID NO: 8378507 - DNA, 22 bp, Homo sapiens
attttcaccctgaatatattga

SEQ ID NO: 8378508 - DNA, 22 bp, Homo sapiens
attttcaccctgaatatattga

SEQ ID NO: 8378509 - DNA, 22 bp, Homo sapiens
attttcaagggagaggcctctg

SEQ ID NO: 8378510 - DNA, 22 bp, Homo sapiens
attttcaagggagaggcctctg

SEQ ID NO: 8378511 - DNA, 22 bp, Homo sapiens
attttatgacacgattcttcca

SEQ ID NO: 8378512 - DNA, 22 bp, Homo sapiens
attttatgacacgattcttcca

SEQ ID NO: 8378513 - DNA, 22 bp, Homo sapiens
attttcaaaacatctgctgtgt

SEQ ID NO: 8378514 - DNA, 22 bp, Homo sapiens
attttagcaaatgcaagatgga

SEQ ID NO: 8378515 - DNA, 23 bp, Homo sapiens
attttagctgaatgacttcttta

SEQ ID NO: 8378516 - DNA, 20 bp, Homo sapiens
agcaagaaggttgtgggagc

SEQ ID NO: 8378517 - DNA, 22 bp, Homo sapiens
agcaagaagggcaaggaagttt

SEQ ID NO: 8378518 - DNA, 22 bp, Homo sapiens
agcaagaagctttgctgtgata

SEQ ID NO: 8378519 - DNA, 20 bp, Homo sapiens
agcaagaacgttctgaggga

SEQ ID NO: 8378520 - DNA, 20 bp, Homo sapiens
agcaagaacgttctgaggga

SEQ ID NO: 8378521 - DNA, 22 bp, Homo sapiens
agcaactttgagatagacttag

SEQ ID NO: 8378522 - DNA, 22 bp, Homo sapiens
agcaagaaatcttcagtgttct

SEQ ID NO: 8378523 - DNA, 22 bp, Homo sapiens
agcaacccgtccttgggggact

SEQ ID NO: 8378524 - DNA, 22 bp, Homo sapiens
agcaacagggtggtcttcagaa

SEQ ID NO: 8378525 - DNA, 22 bp, Homo sapiens
agcaacaggcataatgtgttga

SEQ ID NO: 8378526 - DNA, 22 bp, Homo sapiens
caaacattttgagtggtttctg

SEQ ID NO: 8378527 - DNA, 22 bp, Homo sapiens
caaagcaaggctcagtttgaac

SEQ ID NO: 8378528 - DNA, 22 bp, Homo sapiens
caaagcaaggctcagtttgaac

SEQ ID NO: 8378529 - DNA, 22 bp, Homo sapiens
caaagcaagggctgaagactcc

SEQ ID NO: 8378530 - DNA, 17 bp, Homo sapiens
agatggcaggaggcaga

SEQ ID NO: 8378531 - DNA, 22 bp, Homo sapiens
agatggagtggagatgagtaaa

SEQ ID NO: 8378532 - DNA, 22 bp, Homo sapiens
agatggagaccttggatgaact

SEQ ID NO: 8378533 - DNA, 22 bp, Homo sapiens
agatggaaaatatagacagaga

SEQ ID NO: 8378534 - DNA, 22 bp, Homo sapiens
agatgctggatggaaaatgatc

SEQ ID NO: 8378535 - DNA, 21 bp, Homo sapiens
agatcattcttctgagcactt

SEQ ID NO: 8378536 - DNA, 22 bp, Homo sapiens
agatcattaaccacctgttctg

SEQ ID NO: 8378537 - DNA, 22 bp, Homo sapiens
agatgattatgatagcactgtt

SEQ ID NO: 8378538 - DNA, 22 bp, Homo sapiens
agatcagagtggattgtgctgc

SEQ ID NO: 8378539 - DNA, 23 bp, Homo sapiens
agatcacatgctgatggaaaatg

SEQ ID NO: 8378540 - DNA, 23 bp, Homo sapiens
agatcacatgctgatggaaaatg

SEQ ID NO: 8378541 - DNA, 22 bp, Homo sapiens
agatcacagtcaattgcaagtt

SEQ ID NO: 8378542 - DNA, 22 bp, Homo sapiens
agatattcaaccaaacactaat

SEQ ID NO: 8378543 - DNA, 22 bp, Homo sapiens
agatattaggaggattcataat

SEQ ID NO: 8378544 - DNA, 22 bp, Homo sapiens
agatattgtttgtttcaccaat

SEQ ID NO: 8378545 - DNA, 22 bp, Homo sapiens
agatatttaaatcagacaaaga

SEQ ID NO: 8378546 - DNA, 22 bp, Homo sapiens
attggtagttttgtatttctct

SEQ ID NO: 8378547 - DNA, 22 bp, Homo sapiens
attggtctggggaaatgaagag

SEQ ID NO: 8378548 - DNA, 22 bp, Homo sapiens
attggtctctagagtctattgt

SEQ ID NO: 8378549 - DNA, 22 bp, Homo sapiens
attggtctctgctaaagggagg

SEQ ID NO: 8378550 - DNA, 22 bp, Homo sapiens
attggtctaggctttaaaaaga

SEQ ID NO: 8378551 - DNA, 22 bp, Homo sapiens
attggtctccacttgttttaga

SEQ ID NO: 8378552 - DNA, 22 bp, Homo sapiens
attggtctaaagttaagaagat

SEQ ID NO: 8378553 - DNA, 22 bp, Homo sapiens
attggcttcgaaagttatatta

SEQ ID NO: 8378554 - DNA, 22 bp, Homo sapiens
agctaggaaattgaggctgaga

SEQ ID NO: 8378555 - DNA, 22 bp, Homo sapiens
agctagcttagcctgtgaggta

SEQ ID NO: 8378556 - DNA, 22 bp, Homo sapiens
agctagcctaggcagagtgcat

SEQ ID NO: 8378557 - DNA, 22 bp, Homo sapiens
agctagcaaatagcatgtagga

SEQ ID NO: 8378558 - DNA, 22 bp, Homo sapiens
agctccagcccatctgctcgtg

SEQ ID NO: 8378559 - DNA, 22 bp, Homo sapiens
agctccagccctagtacagctg

SEQ ID NO: 8378560 - DNA, 22 bp, Homo sapiens
agctccagggaaagagtggatc

SEQ ID NO: 8378561 - DNA, 20 bp, Homo sapiens
agctcctggactagagagtg

SEQ ID NO: 8378562 - DNA, 22 bp, Homo sapiens
agctcctggacgaacagggagt

SEQ ID NO: 8378563 - DNA, 22 bp, Homo sapiens
agctcctggacgaacagggagt

SEQ ID NO: 8378564 - DNA, 20 bp, Homo sapiens
agctcctggactagagagtg

SEQ ID NO: 8378565 - DNA, 22 bp, Homo sapiens
agctccaggatctgaaagttcg

SEQ ID NO: 8378566 - DNA, 22 bp, Homo sapiens
agctccaggataagacaggtgc

SEQ ID NO: 8378567 - DNA, 23 bp, Homo sapiens
agctccagctgacgtgggcagcc

SEQ ID NO: 8378568 - DNA, 22 bp, Homo sapiens
agctcctggctttcctctcacc

SEQ ID NO: 8378569 - DNA, 22 bp, Homo sapiens
agctcctggctttcctctcacc

SEQ ID NO: 8378570 - DNA, 22 bp, Homo sapiens
agctcctggcaaggtcatggtg

SEQ ID NO: 8378571 - DNA, 22 bp, Homo sapiens
agctcctggcaaggtcatggtg

SEQ ID NO: 8378572 - DNA, 22 bp, Homo sapiens
agctcctgggccaagcccatgc

SEQ ID NO: 8378573 - DNA, 19 bp, Homo sapiens
agctcctgggctctgggcc

SEQ ID NO: 8378574 - DNA, 22 bp, Homo sapiens
agctcctggtgcctcagccgaa

SEQ ID NO: 8378575 - DNA, 22 bp, Homo sapiens
agctcctggtctttgtccagag

SEQ ID NO: 8378576 - DNA, 22 bp, Homo sapiens
agctcctggtctttgtccagag

SEQ ID NO: 8378577 - DNA, 22 bp, Homo sapiens
agctcctgtctcaagggagcct

SEQ ID NO: 8378578 - DNA, 20 bp, Homo sapiens
agctcctggtataggtgcct

SEQ ID NO: 8378579 - DNA, 18 bp, Homo sapiens
agctcctggtctcaggga

SEQ ID NO: 8378580 - DNA, 18 bp, Homo sapiens
agctcctggtctcaggga

SEQ ID NO: 8378581 - DNA, 22 bp, Homo sapiens
agctcctgggggttccaagcag

SEQ ID NO: 8378582 - DNA, 22 bp, Homo sapiens
agctcctgggggttccaagcag

SEQ ID NO: 8378583 - DNA, 22 bp, Homo sapiens
agctctgttactgattttcctg

SEQ ID NO: 8378584 - DNA, 22 bp, Homo sapiens
agctcctgtggctgaaagagga

SEQ ID NO: 8378585 - DNA, 22 bp, Homo sapiens
agctcctgtgtgaagcctccct

SEQ ID NO: 8378586 - DNA, 22 bp, Homo sapiens
agctctgggattctcaggccac

SEQ ID NO: 8378587 - DNA, 20 bp, Homo sapiens
agctcttactttgcagcagc

SEQ ID NO: 8378588 - DNA, 22 bp, Homo sapiens
agctcttatctctaagcacagc

SEQ ID NO: 8378589 - DNA, 22 bp, Homo sapiens
agctcttccacctcatgatggg

SEQ ID NO: 8378590 - DNA, 22 bp, Homo sapiens
agctctttggaaggtgtgcact

SEQ ID NO: 8378591 - DNA, 22 bp, Homo sapiens
agctagaactacaggcatgtgc

SEQ ID NO: 8378592 - DNA, 22 bp, Homo sapiens
agctactggagaacacaaaacc

SEQ ID NO: 8378593 - DNA, 22 bp, Homo sapiens
agctagaatattgatctgaaat

SEQ ID NO: 8378594 - DNA, 22 bp, Homo sapiens
agctacagttgccctcagcagg

SEQ ID NO: 8378595 - DNA, 22 bp, Homo sapiens
agctacagttgccctcagcagg

SEQ ID NO: 8378596 - DNA, 22 bp, Homo sapiens
agctacagtcggaaggacagac

SEQ ID NO: 8378597 - DNA, 22 bp, Homo sapiens
agctacaagtcatcagctatca

SEQ ID NO: 8378598 - DNA, 22 bp, Homo sapiens
agctacaacttttccatgagca

SEQ ID NO: 8378599 - DNA, 22 bp, Homo sapiens
agctaattagaaatagattatt

SEQ ID NO: 8378600 - DNA, 20 bp, Homo sapiens
agctacaatgcgaagctggc

SEQ ID NO: 8378601 - DNA, 20 bp, Homo sapiens
agctacaatgcgaagctggc

SEQ ID NO: 8378602 - DNA, 22 bp, Homo sapiens
agctaatgatacatgctccaca

SEQ ID NO: 8378603 - DNA, 22 bp, Homo sapiens
agctaaggaactctgtaacacc

SEQ ID NO: 8378604 - DNA, 20 bp, Homo sapiens
agctaagaggaaaagtgaga

SEQ ID NO: 8378605 - DNA, 22 bp, Homo sapiens
agctaagctctcagatactaag

SEQ ID NO: 8378606 - DNA, 22 bp, Homo sapiens
agctaagatttattaaaggccc

SEQ ID NO: 8378607 - DNA, 22 bp, Homo sapiens
agctaagacttagtgacttagt

SEQ ID NO: 8378608 - DNA, 22 bp, Homo sapiens
agcctggccactcagggcctga

SEQ ID NO: 8378609 - DNA, 22 bp, Homo sapiens
cagcaagaatcagacaacctca

SEQ ID NO: 8378610 - DNA, 19 bp, Homo sapiens
agcctggctttgctctgct

SEQ ID NO: 8378611 - DNA, 22 bp, Homo sapiens
agcctgggaatttagagttcgg

SEQ ID NO: 8378612 - DNA, 21 bp, Homo sapiens
agcctgggaggcggaggttgc

SEQ ID NO: 8378613 - DNA, 22 bp, Homo sapiens
agcctgggcaacaacacagcga

SEQ ID NO: 8378614 - DNA, 20 bp, Homo sapiens
cagatgggacgtggaggagt

SEQ ID NO: 8378615 - DNA, 22 bp, Homo sapiens
cagatgtgcctccagggctttg

SEQ ID NO: 8378616 - DNA, 23 bp, Homo sapiens
cagatgtgcaactctaggcaatg

SEQ ID NO: 8378617 - DNA, 22 bp, Homo sapiens
cagatgtgcatgatgggaaggg

SEQ ID NO: 8378618 - DNA, 23 bp, Homo sapiens
cagatgtgcaactctaggcaatg

SEQ ID NO: 8378619 - DNA, 22 bp, Homo sapiens
cagatgtgagctggggagagtg

SEQ ID NO: 8378620 - DNA, 22 bp, Homo sapiens
cagcaacttggacagcagtctt

SEQ ID NO: 8378621 - DNA, 22 bp, Homo sapiens
cagatgtggaatgcagcaggct

SEQ ID NO: 8378622 - DNA, 22 bp, Homo sapiens
cagcaaatactactagttttta

SEQ ID NO: 8378623 - DNA, 22 bp, Homo sapiens
cagcaacctaaatccactaact

SEQ ID NO: 8378624 - DNA, 22 bp, Homo sapiens
cagcaacccgggggacctttct

SEQ ID NO: 8378625 - DNA, 22 bp, Homo sapiens
agccccaggatgggccgcagga

SEQ ID NO: 8378626 - DNA, 22 bp, Homo sapiens
agccccagtaagggagggcctg

SEQ ID NO: 8378627 - DNA, 22 bp, Homo sapiens
agccccacgttgtctagcacct

SEQ ID NO: 8378628 - DNA, 22 bp, Homo sapiens
agccccagcccctctctcacaa

SEQ ID NO: 8378629 - DNA, 22 bp, Homo sapiens
agccccaggatgggccgcagga

SEQ ID NO: 8378630 - DNA, 22 bp, Homo sapiens
agcccaggttgaggctgcagtg

SEQ ID NO: 8378631 - DNA, 22 bp, Homo sapiens
agcccaggttgaggctgcagtg

SEQ ID NO: 8378632 - DNA, 20 bp, Homo sapiens
agccccacccttgtcctggc

SEQ ID NO: 8378633 - DNA, 22 bp, Homo sapiens
agccccacactctctctgagaa

SEQ ID NO: 8378634 - DNA, 22 bp, Homo sapiens
agccccaaacaccaggattact

SEQ ID NO: 8378635 - DNA, 22 bp, Homo sapiens
cagagctctgacagctacagcc

SEQ ID NO: 8378636 - DNA, 22 bp, Homo sapiens
agccagtgcagctggaaattca

SEQ ID NO: 8378637 - DNA, 22 bp, Homo sapiens
agccagtgccagtcatgcctgc

SEQ ID NO: 8378638 - DNA, 22 bp, Homo sapiens
agcccaggttgaggctgcagtg

SEQ ID NO: 8378639 - DNA, 22 bp, Homo sapiens
agcccaggttgaggctgcagtg

SEQ ID NO: 8378640 - DNA, 22 bp, Homo sapiens
agcccaggttctaaagccaaac

SEQ ID NO: 8378641 - DNA, 22 bp, Homo sapiens
agcccaggttctaaagccaaac

SEQ ID NO: 8378642 - DNA, 22 bp, Homo sapiens
agcccaggttctaaagccaaac

SEQ ID NO: 8378643 - DNA, 22 bp, Homo sapiens
cagatgaagatcatagaatagt

SEQ ID NO: 8378644 - DNA, 22 bp, Homo sapiens
agccctgggcacctgtgagggg

SEQ ID NO: 8378645 - DNA, 22 bp, Homo sapiens
agccctggctcccagcagcgct

SEQ ID NO: 8378646 - DNA, 22 bp, Homo sapiens
agccctggagcaaaggtgtctt

SEQ ID NO: 8378647 - DNA, 22 bp, Homo sapiens
agccctgcttcaccatttactt

SEQ ID NO: 8378648 - DNA, 22 bp, Homo sapiens
agccctgagctggcctgggctt

SEQ ID NO: 8378649 - DNA, 22 bp, Homo sapiens
agccctgcgtgccaggggactg

SEQ ID NO: 8378650 - DNA, 23 bp, Homo sapiens
agccctgctgagacccagctccc

SEQ ID NO: 8378651 - DNA, 22 bp, Homo sapiens
agccccagtccgctgcgggcgg

SEQ ID NO: 8378652 - DNA, 22 bp, Homo sapiens
agcccccaaaagtgcttatgat

SEQ ID NO: 8378653 - DNA, 22 bp, Homo sapiens
agcccccacgtttcctgggtcc

SEQ ID NO: 8378654 - DNA, 17 bp, Homo sapiens
agcccccactcccaagt

SEQ ID NO: 8378655 - DNA, 22 bp, Homo sapiens
cactttctgtgttgtgcaaaaa

SEQ ID NO: 8378656 - DNA, 22 bp, Homo sapiens
cactttctcatgaatttggccc

SEQ ID NO: 8378657 - DNA, 22 bp, Homo sapiens
cactttctcatgaatttggccc

SEQ ID NO: 8378658 - DNA, 22 bp, Homo sapiens
cactttcaagtttcagaggata

SEQ ID NO: 8378659 - DNA, 22 bp, Homo sapiens
cactttataaaattggtgtgag

SEQ ID NO: 8378660 - DNA, 22 bp, Homo sapiens
cactttatgggaagcaaaaatt

SEQ ID NO: 8378661 - DNA, 21 bp, Homo sapiens
agccagcaacacagcatctcc

SEQ ID NO: 8378662 - DNA, 22 bp, Homo sapiens
agccagcacggatttcccagga

SEQ ID NO: 8378663 - DNA, 19 bp, Homo sapiens
agccagcagcgtagcatct

SEQ ID NO: 8378664 - DNA, 22 bp, Homo sapiens
agccagcaggaacgtctaggtt

SEQ ID NO: 8378665 - DNA, 19 bp, Homo sapiens
agccagcaggcctctgagc

SEQ ID NO: 8378666 - DNA, 22 bp, Homo sapiens
agccagctaccggggctcctgg

SEQ ID NO: 8378667 - DNA, 22 bp, Homo sapiens
agccagctaagggaagcatgat

SEQ ID NO: 8378668 - DNA, 22 bp, Homo sapiens
agccagcatgaagacagaggcc

SEQ ID NO: 8378669 - DNA, 22 bp, Homo sapiens
agccagcatcccttcagtctcc

SEQ ID NO: 8378670 - DNA, 22 bp, Homo sapiens
agccagccagttcactaggaaa

SEQ ID NO: 8378671 - DNA, 22 bp, Homo sapiens
agccagcatgaagacagaggcc

SEQ ID NO: 8378672 - DNA, 18 bp, Homo sapiens
cagagctcctggatgcag

SEQ ID NO: 8378673 - DNA, 18 bp, Homo sapiens
cagagctcctggatgcag

SEQ ID NO: 8378674 - DNA, 20 bp, Homo sapiens
cagagctatccctttattta

SEQ ID NO: 8378675 - DNA, 22 bp, Homo sapiens
cagagctcagagctgccaggca

SEQ ID NO: 8378676 - DNA, 22 bp, Homo sapiens
cagagcctttgtgtccacattt

SEQ ID NO: 8378677 - DNA, 22 bp, Homo sapiens
agccaggccttagggagaggca

SEQ ID NO: 8378678 - DNA, 22 bp, Homo sapiens
cagagacccttctcagtggcca

SEQ ID NO: 8378679 - DNA, 22 bp, Homo sapiens
cagagacccttctcagtggcca

SEQ ID NO: 8378680 - DNA, 22 bp, Homo sapiens
cagagacccttctcagtggcca

SEQ ID NO: 8378681 - DNA, 22 bp, Homo sapiens
cagagacctcaaattatttcct

SEQ ID NO: 8378682 - DNA, 22 bp, Homo sapiens
agccaggccagactcacaccct

SEQ ID NO: 8378683 - DNA, 20 bp, Homo sapiens
cagagacccaggcttcagct

SEQ ID NO: 8378684 - DNA, 20 bp, Homo sapiens
cagagacccaggcttcagct

SEQ ID NO: 8378685 - DNA, 20 bp, Homo sapiens
cagagaccaggccaggtgtc

SEQ ID NO: 8378686 - DNA, 22 bp, Homo sapiens
cagagaccccgctgcccttctg

SEQ ID NO: 8378687 - DNA, 22 bp, Homo sapiens
cagagacccctggcatggtggt

SEQ ID NO: 8378688 - DNA, 22 bp, Homo sapiens
cagagaccctaggcaggtgaca

SEQ ID NO: 8378689 - DNA, 22 bp, Homo sapiens
cagagaccctaggcaggtgaca

SEQ ID NO: 8378690 - DNA, 22 bp, Homo sapiens
cagagacatgtggcctgcacgt

SEQ ID NO: 8378691 - DNA, 21 bp, Homo sapiens
agccagctatcacacagcatt

SEQ ID NO: 8378692 - DNA, 22 bp, Homo sapiens
cagagaacaaagctgagggttt

SEQ ID NO: 8378693 - DNA, 22 bp, Homo sapiens
cagagaaagggtgaattccttc

SEQ ID NO: 8378694 - DNA, 22 bp, Homo sapiens
cagagacattaagtgccatgat

SEQ ID NO: 8378695 - DNA, 22 bp, Homo sapiens
cacagcagaacttaatttcaaa

SEQ ID NO: 8378696 - DNA, 22 bp, Homo sapiens
agcagggaggcccagggcactg

SEQ ID NO: 8378697 - DNA, 22 bp, Homo sapiens
agcaggcttactttctgattag

SEQ ID NO: 8378698 - DNA, 22 bp, Homo sapiens
agcagggaggtctagcacgtgg

SEQ ID NO: 8378699 - DNA, 22 bp, Homo sapiens
agcaggacaatatgggatcagg

SEQ ID NO: 8378700 - DNA, 22 bp, Homo sapiens
agcaggacacgatgcggcagga

SEQ ID NO: 8378701 - DNA, 22 bp, Homo sapiens
agcaggacacgatgcggcagga

SEQ ID NO: 8378702 - DNA, 22 bp, Homo sapiens
agcaggaccaagaaggggaaaa

SEQ ID NO: 8378703 - DNA, 22 bp, Homo sapiens
agcaggaccaagaaggggaaaa

SEQ ID NO: 8378704 - DNA, 17 bp, Homo sapiens
agcaggaccccagagca

SEQ ID NO: 8378705 - DNA, 22 bp, Homo sapiens
agcagcttctttcactcctgga

SEQ ID NO: 8378706 - DNA, 22 bp, Homo sapiens
agcagcttgagctggggctggc

SEQ ID NO: 8378707 - DNA, 22 bp, Homo sapiens
agcagcttgaggctggattcca

SEQ ID NO: 8378708 - DNA, 22 bp, Homo sapiens
agcagcttgaggctggattcca

SEQ ID NO: 8378709 - DNA, 22 bp, Homo sapiens
agcaggaaggtctgttagtcca

SEQ ID NO: 8378710 - DNA, 22 bp, Homo sapiens
agcaggaaggtctgtgtgagtc

SEQ ID NO: 8378711 - DNA, 22 bp, Homo sapiens
agcagggcactggaaggcactg

SEQ ID NO: 8378712 - DNA, 22 bp, Homo sapiens
agcagggcagctgatgcgcacg

SEQ ID NO: 8378713 - DNA, 22 bp, Homo sapiens
agcagggcaaagtcaggctaac

SEQ ID NO: 8378714 - DNA, 22 bp, Homo sapiens
agcagggcaggtaaggatcaga

SEQ ID NO: 8378715 - DNA, 22 bp, Homo sapiens
agcagggcagcttttttcagaa

SEQ ID NO: 8378716 - DNA, 22 bp, Homo sapiens
agcagggcagtgatcagaaagg

SEQ ID NO: 8378717 - DNA, 22 bp, Homo sapiens
agcagggctgcagtgtgtcttt

SEQ ID NO: 8378718 - DNA, 22 bp, Homo sapiens
agcagggctctgtggagggtgg

SEQ ID NO: 8378719 - DNA, 22 bp, Homo sapiens
agcagggctctgccatgggccc

SEQ ID NO: 8378720 - DNA, 20 bp, Homo sapiens
caccagcagcagctgccacc

SEQ ID NO: 8378721 - DNA, 20 bp, Homo sapiens
caccagcagcagctgccacc

SEQ ID NO: 8378722 - DNA, 23 bp, Homo sapiens
caccactttctccttctccttgg

SEQ ID NO: 8378723 - DNA, 23 bp, Homo sapiens
caccactttctccttctccttgg

SEQ ID NO: 8378724 - DNA, 22 bp, Homo sapiens
cactgttcacattttagtctat

SEQ ID NO: 8378725 - DNA, 22 bp, Homo sapiens
cactgttattactactatacat

SEQ ID NO: 8378726 - DNA, 22 bp, Homo sapiens
cactgttattactactatacat

SEQ ID NO: 8378727 - DNA, 22 bp, Homo sapiens
cacttaaaactcctggaattgt

SEQ ID NO: 8378728 - DNA, 22 bp, Homo sapiens
cactttactatctataaaataa

SEQ ID NO: 8378729 - DNA, 22 bp, Homo sapiens
cacttaaagtcttagcttacag

SEQ ID NO: 8378730 - DNA, 22 bp, Homo sapiens
cacttaaaactcctggaattgt

SEQ ID NO: 8378731 - DNA, 19 bp, Homo sapiens
agcatggcctacagtgtgc

SEQ ID NO: 8378732 - DNA, 22 bp, Homo sapiens
agcatggggcaatgcatgtgct

SEQ ID NO: 8378733 - DNA, 22 bp, Homo sapiens
agcatggctttggaggatagca

SEQ ID NO: 8378734 - DNA, 22 bp, Homo sapiens
agcatggggcaatgcatgtgct

SEQ ID NO: 8378735 - DNA, 22 bp, Homo sapiens
agcatgtaaagctcttagcacc

SEQ ID NO: 8378736 - DNA, 22 bp, Homo sapiens
agcatgcgcttgatcagctcca

SEQ ID NO: 8378737 - DNA, 18 bp, Homo sapiens
agcatggcacaggctccc

SEQ ID NO: 8378738 - DNA, 18 bp, Homo sapiens
agcatggcacaggctccc

SEQ ID NO: 8378739 - DNA, 22 bp, Homo sapiens
agcatggcactcaaggctcctg

SEQ ID NO: 8378740 - DNA, 22 bp, Homo sapiens
agcagtcaggcctcagagccgt

SEQ ID NO: 8378741 - DNA, 22 bp, Homo sapiens
agcagtcaggcctcagagccgt

SEQ ID NO: 8378742 - DNA, 22 bp, Homo sapiens
agcagtagtgatggcccctgag

SEQ ID NO: 8378743 - DNA, 18 bp, Homo sapiens
agcagtagcgccaggtgc

SEQ ID NO: 8378744 - DNA, 22 bp, Homo sapiens
agcagtcattttaggtcatgca

SEQ ID NO: 8378745 - DNA, 20 bp, Homo sapiens
agcagtccaaaagggcagac

SEQ ID NO: 8378746 - DNA, 22 bp, Homo sapiens
agcagtcattttaggtcatgca

SEQ ID NO: 8378747 - DNA, 22 bp, Homo sapiens
agcaggtttaaactctaatgca

SEQ ID NO: 8378748 - DNA, 22 bp, Homo sapiens
agcaggtttaaactctaatgca

SEQ ID NO: 8378749 - DNA, 18 bp, Homo sapiens
agcaggttctcacagcca

SEQ ID NO: 8378750 - DNA, 22 bp, Homo sapiens
agcagggctgcggccccaccac

SEQ ID NO: 8378751 - DNA, 22 bp, Homo sapiens
agcagggctggggcacgagcca

SEQ ID NO: 8378752 - DNA, 22 bp, Homo sapiens
agcatgaaagcataggacagtc

SEQ ID NO: 8378753 - DNA, 22 bp, Homo sapiens
agcatattcatgccagactact

SEQ ID NO: 8378754 - DNA, 22 bp, Homo sapiens
agcatataggaaatgttgaatc

SEQ ID NO: 8378755 - DNA, 22 bp, Homo sapiens
agcagtggagcgagatgtttaa

SEQ ID NO: 8378756 - DNA, 22 bp, Homo sapiens
agcagtgcccattctgccccct

SEQ ID NO: 8378757 - DNA, 22 bp, Homo sapiens
agcactgtagttatagctaaca

SEQ ID NO: 8378758 - DNA, 22 bp, Homo sapiens
agcactgtagttatagctaaca

SEQ ID NO: 8378759 - DNA, 22 bp, Homo sapiens
agcactgtccggtaagatgctc

SEQ ID NO: 8378760 - DNA, 22 bp, Homo sapiens
agcactctaagtgcaagacact

SEQ ID NO: 8378761 - DNA, 22 bp, Homo sapiens
agcactcctgtctttccccttt

SEQ ID NO: 8378762 - DNA, 22 bp, Homo sapiens
agcacctgtgccctgatggaga

SEQ ID NO: 8378763 - DNA, 20 bp, Homo sapiens
agcacctgtgtagaagcatc

SEQ ID NO: 8378764 - DNA, 22 bp, Homo sapiens
agcacctgtgtgagctagatgt

SEQ ID NO: 8378765 - DNA, 22 bp, Homo sapiens
agcacctgtgtggtagggaggt

SEQ ID NO: 8378766 - DNA, 22 bp, Homo sapiens
agcacctgtgttcatgcctcat

SEQ ID NO: 8378767 - DNA, 21 bp, Homo sapiens
agcaccttcaattctattgtc

SEQ ID NO: 8378768 - DNA, 22 bp, Homo sapiens
agcaccttgagatcaagcagtg

SEQ ID NO: 8378769 - DNA, 22 bp, Homo sapiens
agcaccttgatcttggacttcc

SEQ ID NO: 8378770 - DNA, 22 bp, Homo sapiens
agcactaagtaatctcacagga

SEQ ID NO: 8378771 - DNA, 22 bp, Homo sapiens
caaaggctttgctatgatgcat

SEQ ID NO: 8378772 - DNA, 22 bp, Homo sapiens
caaagggcatggcctgagcact

SEQ ID NO: 8378773 - DNA, 17 bp, Homo sapiens
caaagggagcccaccaa

SEQ ID NO: 8378774 - DNA, 17 bp, Homo sapiens
caaagggagcccaccaa

SEQ ID NO: 8378775 - DNA, 22 bp, Homo sapiens
caaagggaaaagccatgtgggc

SEQ ID NO: 8378776 - DNA, 22 bp, Homo sapiens
agcacctggtctcctggcgctg

SEQ ID NO: 8378777 - DNA, 22 bp, Homo sapiens
agcacctgtcaagtccaggctg

SEQ ID NO: 8378778 - DNA, 23 bp, Homo sapiens
agcacctgtgatttcctagctct

SEQ ID NO: 8378779 - DNA, 17 bp, Homo sapiens
agcacctgtccagtccc

SEQ ID NO: 8378780 - DNA, 19 bp, Homo sapiens
agcacctgtgagagcctgg

SEQ ID NO: 8378781 - DNA, 22 bp, Homo sapiens
agcacctgcttaatgtgcagtg

SEQ ID NO: 8378782 - DNA, 22 bp, Homo sapiens
agcacctggagggctgggacct

SEQ ID NO: 8378783 - DNA, 22 bp, Homo sapiens
agcactgtgatttataacattt

SEQ ID NO: 8378784 - DNA, 22 bp, Homo sapiens
agcactgtgatttataacattt

SEQ ID NO: 8378785 - DNA, 22 bp, Homo sapiens
agcagagcgcctgctcagaggg

SEQ ID NO: 8378786 - DNA, 22 bp, Homo sapiens
agcagagctattcttgtgcaat

SEQ ID NO: 8378787 - DNA, 22 bp, Homo sapiens
agcagagctgcagtggcctgct

SEQ ID NO: 8378788 - DNA, 22 bp, Homo sapiens
agcagagctttttggactcaga

SEQ ID NO: 8378789 - DNA, 22 bp, Homo sapiens
agcagaggaggatttagttagg

SEQ ID NO: 8378790 - DNA, 22 bp, Homo sapiens
agcagaggacagttcttaggaa

SEQ ID NO: 8378791 - DNA, 21 bp, Homo sapiens
agcagaggctgcctggtgact

SEQ ID NO: 8378792 - DNA, 20 bp, Homo sapiens
agcagagtgcccatcccgga

SEQ ID NO: 8378793 - DNA, 20 bp, Homo sapiens
agcagagtgcccatcccgga

SEQ ID NO: 8378794 - DNA, 22 bp, Homo sapiens
agcagaggtttgttggaaacct

SEQ ID NO: 8378795 - DNA, 21 bp, Homo sapiens
agcagaggggacatgtttgat

SEQ ID NO: 8378796 - DNA, 22 bp, Homo sapiens
caataatatcctgtgctgtttg

SEQ ID NO: 8378797 - DNA, 20 bp, Homo sapiens
caataatttacttccctatt

SEQ ID NO: 8378798 - DNA, 22 bp, Homo sapiens
caataatttacattggatacca

SEQ ID NO: 8378799 - DNA, 22 bp, Homo sapiens
caataattgctttccagagtta

SEQ ID NO: 8378800 - DNA, 19 bp, Homo sapiens
agcagcagaagtgtgcctt

SEQ ID NO: 8378801 - DNA, 22 bp, Homo sapiens
caatactgagtttacattcatc

SEQ ID NO: 8378802 - DNA, 18 bp, Homo sapiens
caatactgagaggtgggg

SEQ ID NO: 8378803 - DNA, 22 bp, Homo sapiens
caatacagcacacctgtatcag

SEQ ID NO: 8378804 - DNA, 22 bp, Homo sapiens
caatacatcaggtcaaaatgtg

SEQ ID NO: 8378805 - DNA, 22 bp, Homo sapiens
caatacaattaccagttaatca

SEQ ID NO: 8378806 - DNA, 21 bp, Homo sapiens
agcagcagatctggtgagggc

SEQ ID NO: 8378807 - DNA, 22 bp, Homo sapiens
agcagcagatcaaacaggcttg

SEQ ID NO: 8378808 - DNA, 22 bp, Homo sapiens
agcagcagaggtcagaaaggta

SEQ ID NO: 8378809 - DNA, 22 bp, Homo sapiens
agcagcagagctctggtctgca

SEQ ID NO: 8378810 - DNA, 22 bp, Homo sapiens
agcagcagagctctggtctgca

SEQ ID NO: 8378811 - DNA, 21 bp, Homo sapiens
agcagcagatctggtgagggc

SEQ ID NO: 8378812 - DNA, 20 bp, Homo sapiens
agcagcagatgttggaggtg

SEQ ID NO: 8378813 - DNA, 22 bp, Homo sapiens
agcagcccctcggcgggtgcgc

SEQ ID NO: 8378814 - DNA, 22 bp, Homo sapiens
agcagcctcccagggagcagcc

SEQ ID NO: 8378815 - DNA, 23 bp, Homo sapiens
agcagccctgggacctggcctgc

SEQ ID NO: 8378816 - DNA, 22 bp, Homo sapiens
agcagccttgcaggggtcgcac

SEQ ID NO: 8378817 - DNA, 22 bp, Homo sapiens
agcagccttaggtattgtgatt

SEQ ID NO: 8378818 - DNA, 22 bp, Homo sapiens
agcagcctggtctctcgccaat

SEQ ID NO: 8378819 - DNA, 22 bp, Homo sapiens
agcagcctctgtagaggtctcc

SEQ ID NO: 8378820 - DNA, 17 bp, Homo sapiens
agcagctggcacaggag

SEQ ID NO: 8378821 - DNA, 17 bp, Homo sapiens
agcagctggcacaggag

SEQ ID NO: 8378822 - DNA, 19 bp, Homo sapiens
agcagctggaggtggagtg

SEQ ID NO: 8378823 - DNA, 22 bp, Homo sapiens
cacagagcaactcaaatcagct

SEQ ID NO: 8378824 - DNA, 22 bp, Homo sapiens
cacagagatggccagggcacat

SEQ ID NO: 8378825 - DNA, 22 bp, Homo sapiens
agcagcctttgatcatctggga

SEQ ID NO: 8378826 - DNA, 22 bp, Homo sapiens
agcagctcaaagcctgcaagga

SEQ ID NO: 8378827 - DNA, 19 bp, Homo sapiens
agcagctcagggaggcacc

SEQ ID NO: 8378828 - DNA, 19 bp, Homo sapiens
agcagctcagggaggcacc

SEQ ID NO: 8378829 - DNA, 22 bp, Homo sapiens
agcagctcatggagtaggcact

SEQ ID NO: 8378830 - DNA, 22 bp, Homo sapiens
aaatggctacaagatgtgctct

SEQ ID NO: 8378831 - DNA, 22 bp, Homo sapiens
aaatggtaccctaatggccaga

SEQ ID NO: 8378832 - DNA, 23 bp, Homo sapiens
aaatgggtttctgttttgtggac

SEQ ID NO: 8378833 - DNA, 22 bp, Homo sapiens
aacaacagctgctaaagagttg

SEQ ID NO: 8378834 - DNA, 22 bp, Homo sapiens
aacaacagtgagtgctgggagg

SEQ ID NO: 8378835 - DNA, 22 bp, Homo sapiens
aacaaattagttgcaagactgg

SEQ ID NO: 8378836 - DNA, 22 bp, Homo sapiens
aacaaatgtgttttgtaattaa

SEQ ID NO: 8378837 - DNA, 22 bp, Homo sapiens
aacaaatgtgttttgtaattaa

SEQ ID NO: 8378838 - DNA, 22 bp, Homo sapiens
aaagcacagggtgctagagagt

SEQ ID NO: 8378839 - DNA, 22 bp, Homo sapiens
aaagcacagggtgctagagagt

SEQ ID NO: 8378840 - DNA, 22 bp, Homo sapiens
aaagcacattacaagctcagtc

SEQ ID NO: 8378841 - DNA, 22 bp, Homo sapiens
aacaattgacacttcattgtga

SEQ ID NO: 8378842 - DNA, 22 bp, Homo sapiens
aacaattgacacttcattgtga

SEQ ID NO: 8378843 - DNA, 22 bp, Homo sapiens
aacaattatcatatacattgca

SEQ ID NO: 8378844 - DNA, 22 bp, Homo sapiens
aacaattatcatatacattgca

SEQ ID NO: 8378845 - DNA, 22 bp, Homo sapiens
aacacaaaaattctcaggggca

SEQ ID NO: 8378846 - DNA, 23 bp, Homo sapiens
aacacaaagctgattccagtggc

SEQ ID NO: 8378847 - DNA, 22 bp, Homo sapiens
aacacaaagaagctgcaggatc

SEQ ID NO: 8378848 - DNA, 22 bp, Homo sapiens
aacacaaagaagctgcaggatc

SEQ ID NO: 8378849 - DNA, 22 bp, Homo sapiens
aacaatgtgattgaagctagaa

SEQ ID NO: 8378850 - DNA, 22 bp, Homo sapiens
aacaattactaccaaggcctgt

SEQ ID NO: 8378851 - DNA, 22 bp, Homo sapiens
aacaattagactgacggtatta

SEQ ID NO: 8378852 - DNA, 22 bp, Homo sapiens
aacaagaagggaaggcatgatt

SEQ ID NO: 8378853 - DNA, 22 bp, Homo sapiens
aacaagaataagtggtttctgg

SEQ ID NO: 8378854 - DNA, 22 bp, Homo sapiens
aacaagaacacctacagttcta

SEQ ID NO: 8378855 - DNA, 22 bp, Homo sapiens
aacagcagctgaggagctgggc

SEQ ID NO: 8378856 - DNA, 22 bp, Homo sapiens
aacagcagcatgacagctgggt

SEQ ID NO: 8378857 - DNA, 22 bp, Homo sapiens
aacagcagcatgacagctgggt

SEQ ID NO: 8378858 - DNA, 22 bp, Homo sapiens
aacagctttgagcagttctgta

SEQ ID NO: 8378859 - DNA, 22 bp, Homo sapiens
aacagctttgagcagttctgta

SEQ ID NO: 8378860 - DNA, 22 bp, Homo sapiens
aacacatgggtgtttattgtac

SEQ ID NO: 8378861 - DNA, 22 bp, Homo sapiens
aacacatgccttaagaataagt

SEQ ID NO: 8378862 - DNA, 22 bp, Homo sapiens
aacacatatttatatatgcaca

SEQ ID NO: 8378863 - DNA, 22 bp, Homo sapiens
aacagtactggacaaggagtca

SEQ ID NO: 8378864 - DNA, 22 bp, Homo sapiens
aacaggaatgaggagaaaaggt

SEQ ID NO: 8378865 - DNA, 22 bp, Homo sapiens
aacaggaactatttgtattcca

SEQ ID NO: 8378866 - DNA, 22 bp, Homo sapiens
aacaggaaaacagcacaatagc

SEQ ID NO: 8378867 - DNA, 22 bp, Homo sapiens
aacaggaaatacttatgaggta

SEQ ID NO: 8378868 - DNA, 22 bp, Homo sapiens
aacaggaaatacttatgaggta

SEQ ID NO: 8378869 - DNA, 22 bp, Homo sapiens
aacaggaaacaagttgttagga

SEQ ID NO: 8378870 - DNA, 22 bp, Homo sapiens
aacagtctgggagttccttata

SEQ ID NO: 8378871 - DNA, 22 bp, Homo sapiens
aacagtcttggaagtcttgtta

SEQ ID NO: 8378872 - DNA, 22 bp, Homo sapiens
aacattaattacagtcaaacat

SEQ ID NO: 8378873 - DNA, 22 bp, Homo sapiens
aacattcaagttctggtttatg

SEQ ID NO: 8378874 - DNA, 22 bp, Homo sapiens
aacattcaaaacccagttcagt

SEQ ID NO: 8378875 - DNA, 22 bp, Homo sapiens
aacattctatgtgcattcagaa

SEQ ID NO: 8378876 - DNA, 22 bp, Homo sapiens
aacattctactgtactgcattg

SEQ ID NO: 8378877 - DNA, 22 bp, Homo sapiens
aacattctatgtgcattcagaa

SEQ ID NO: 8378878 - DNA, 22 bp, Homo sapiens
aacattctactgtactgcattg

SEQ ID NO: 8378879 - DNA, 22 bp, Homo sapiens
aacattcacctctacctccttc

SEQ ID NO: 8378880 - DNA, 22 bp, Homo sapiens
aacatttcataacttgactttt

SEQ ID NO: 8378881 - DNA, 22 bp, Homo sapiens
aacatttcataacttgactttt

SEQ ID NO: 8378882 - DNA, 22 bp, Homo sapiens
aacatttcattggaagctatgt

SEQ ID NO: 8378883 - DNA, 22 bp, Homo sapiens
aacatttccggccttttgttct

SEQ ID NO: 8378884 - DNA, 22 bp, Homo sapiens
aacatttcattggaagctatgt

SEQ ID NO: 8378885 - DNA, 22 bp, Homo sapiens
aacatttcattggaagctatgt

SEQ ID NO: 8378886 - DNA, 22 bp, Homo sapiens
aacatttccggccttttgttct

SEQ ID NO: 8378887 - DNA, 22 bp, Homo sapiens
aacatttctgagaatatcagtt

SEQ ID NO: 8378888 - DNA, 22 bp, Homo sapiens
aactcaggagaatggagggtat

SEQ ID NO: 8378889 - DNA, 22 bp, Homo sapiens
aactcaggagaatggagggtat

SEQ ID NO: 8378890 - DNA, 22 bp, Homo sapiens
aactcaggagtttaaggctgca

SEQ ID NO: 8378891 - DNA, 22 bp, Homo sapiens
aactcaggagtttaaggctgca

SEQ ID NO: 8378892 - DNA, 22 bp, Homo sapiens
aactcagatatgatagcaggag

SEQ ID NO: 8378893 - DNA, 22 bp, Homo sapiens
aactgaaatcaatcagtgattc

SEQ ID NO: 8378894 - DNA, 22 bp, Homo sapiens
aactgagacacgaactatgatt

SEQ ID NO: 8378895 - DNA, 22 bp, Homo sapiens
aacttgaattctgccattcaga

SEQ ID NO: 8378896 - DNA, 22 bp, Homo sapiens
aacttgcttcaacttatttcac

SEQ ID NO: 8378897 - DNA, 22 bp, Homo sapiens
aactgattgttggatgatagtg

SEQ ID NO: 8378898 - DNA, 22 bp, Homo sapiens
aactgatttcaagttcagtttc

SEQ ID NO: 8378899 - DNA, 22 bp, Homo sapiens
aactgattgttggatgatagtg

SEQ ID NO: 8378900 - DNA, 22 bp, Homo sapiens
aactgaggtctccagtgcagaa

SEQ ID NO: 8378901 - DNA, 22 bp, Homo sapiens
aactgataatggacacataaaa

SEQ ID NO: 8378902 - DNA, 23 bp, Homo sapiens
aactgagataatgtatgtaaagc

SEQ ID NO: 8378903 - DNA, 22 bp, Homo sapiens
aactgagcccctgcacttgtga

SEQ ID NO: 8378904 - DNA, 22 bp, Homo sapiens
aactgagggccctgctgaagca

SEQ ID NO: 8378905 - DNA, 22 bp, Homo sapiens
aacatttcttctgaaactgagt

SEQ ID NO: 8378906 - DNA, 22 bp, Homo sapiens
aacatttgcagaggaaagctat

SEQ ID NO: 8378907 - DNA, 23 bp, Homo sapiens
aacatttgtaaggtgattttgtt

SEQ ID NO: 8378908 - DNA, 21 bp, Homo sapiens
aacatttggctggcttttgtg

SEQ ID NO: 8378909 - DNA, 22 bp, Homo sapiens
aacatttgtgaagtacttagat

SEQ ID NO: 8378910 - DNA, 22 bp, Homo sapiens
aactcactttgtggcttctgaa

SEQ ID NO: 8378911 - DNA, 22 bp, Homo sapiens
aactatgttaataagtttcatt

SEQ ID NO: 8378912 - DNA, 20 bp, Homo sapiens
aagagcatagtacaggaaga

SEQ ID NO: 8378913 - DNA, 22 bp, Homo sapiens
aagaggaagtctccatggagag

SEQ ID NO: 8378914 - DNA, 20 bp, Homo sapiens
aagagctacttagcctttcc

SEQ ID NO: 8378915 - DNA, 22 bp, Homo sapiens
aagaggaagtctccatggagag

SEQ ID NO: 8378916 - DNA, 22 bp, Homo sapiens
aagagcatatatgtatgtttgt

SEQ ID NO: 8378917 - DNA, 22 bp, Homo sapiens
aagacactgggttaggcacgtg

SEQ ID NO: 8378918 - DNA, 22 bp, Homo sapiens
aagaattatctgaaagctgtgt

SEQ ID NO: 8378919 - DNA, 22 bp, Homo sapiens
aagacactaagctttcaggata

SEQ ID NO: 8378920 - DNA, 22 bp, Homo sapiens
aagaatgttcttgtagtcatga

SEQ ID NO: 8378921 - DNA, 22 bp, Homo sapiens
aagaatgttagtttctgataca

SEQ ID NO: 8378922 - DNA, 22 bp, Homo sapiens
aagaatgttagtttctgataca

SEQ ID NO: 8378923 - DNA, 22 bp, Homo sapiens
aagaatgttcattaaactgttg

SEQ ID NO: 8378924 - DNA, 22 bp, Homo sapiens
aagaagttaggtgtaacaatat

SEQ ID NO: 8378925 - DNA, 22 bp, Homo sapiens
aagaaaggtgtgtttgcagatg

SEQ ID NO: 8378926 - DNA, 22 bp, Homo sapiens
aagaaaggtgtgtttgcagatg

SEQ ID NO: 8378927 - DNA, 22 bp, Homo sapiens
aagaaaggtctctgcccgctat

SEQ ID NO: 8378928 - DNA, 22 bp, Homo sapiens
aagaaagggctattgttctcca

SEQ ID NO: 8378929 - DNA, 22 bp, Homo sapiens
aagaatgagctcaaagatctta

SEQ ID NO: 8378930 - DNA, 22 bp, Homo sapiens
aagaatgattacaaagcaacga

SEQ ID NO: 8378931 - DNA, 22 bp, Homo sapiens
aagaaagctgaatattctgtgt

SEQ ID NO: 8378932 - DNA, 22 bp, Homo sapiens
aagaaagccaaagttcatacct

SEQ ID NO: 8378933 - DNA, 22 bp, Homo sapiens
aagaaagggctattgttctcca

SEQ ID NO: 8378934 - DNA, 22 bp, Homo sapiens
aagaaagggagaaggatggtgt

SEQ ID NO: 8378935 - DNA, 22 bp, Homo sapiens
aagaaaggatatatgggaggta

SEQ ID NO: 8378936 - DNA, 23 bp, Homo sapiens
aacttttagagtttaacagtgtt

SEQ ID NO: 8378937 - DNA, 22 bp, Homo sapiens
aacttttcattccaaaggtgct

SEQ ID NO: 8378938 - DNA, 22 bp, Homo sapiens
aactttctttcacagaagtatc

SEQ ID NO: 8378939 - DNA, 22 bp, Homo sapiens
aactttctttgcatctaagttt

SEQ ID NO: 8378940 - DNA, 22 bp, Homo sapiens
aactttctttgcatctaagttt

SEQ ID NO: 8378941 - DNA, 22 bp, Homo sapiens
aagcactggggccacagacacg

SEQ ID NO: 8378942 - DNA, 22 bp, Homo sapiens
aagcactggagatgccagagtg

SEQ ID NO: 8378943 - DNA, 20 bp, Homo sapiens
aagcactgtggtggcatgga

SEQ ID NO: 8378944 - DNA, 22 bp, Homo sapiens
aagcagaactgggaagtagtgg

SEQ ID NO: 8378945 - DNA, 22 bp, Homo sapiens
aagcagaaagaacaactgagtg

SEQ ID NO: 8378946 - DNA, 22 bp, Homo sapiens
aagcagaaagaacaactgagtg

SEQ ID NO: 8378947 - DNA, 22 bp, Homo sapiens
aagccacagatcgttctgtcac

SEQ ID NO: 8378948 - DNA, 22 bp, Homo sapiens
aagccacagatcgttctgtcac

SEQ ID NO: 8378949 - DNA, 22 bp, Homo sapiens
aagccacaatctgcatcagcat

SEQ ID NO: 8378950 - DNA, 22 bp, Homo sapiens
aagcatggtggatgatacagtg

SEQ ID NO: 8378951 - DNA, 22 bp, Homo sapiens
aagcagcacgctttgccaacaa

SEQ ID NO: 8378952 - DNA, 22 bp, Homo sapiens
aagcaaatatttctagagactg

SEQ ID NO: 8378953 - DNA, 22 bp, Homo sapiens
aagcaaattggatgtctgtgag

SEQ ID NO: 8378954 - DNA, 22 bp, Homo sapiens
aagcaaaggaaagctgactttt

SEQ ID NO: 8378955 - DNA, 22 bp, Homo sapiens
aagaggagacttcagcaacttg

SEQ ID NO: 8378956 - DNA, 22 bp, Homo sapiens
aagaggaggacggttcccagaa

SEQ ID NO: 8378957 - DNA, 18 bp, Homo sapiens
aagaggaggagcaggttg

SEQ ID NO: 8378958 - DNA, 22 bp, Homo sapiens
aaatatcatttataacttttaa

SEQ ID NO: 8378959 - DNA, 22 bp, Homo sapiens
aaacatttttcttcatcatcct

SEQ ID NO: 8378960 - DNA, 22 bp, Homo sapiens
aaacatttgcaactcggtttgg

SEQ ID NO: 8378961 - DNA, 22 bp, Homo sapiens
aaacatttgcaactcggtttgg

SEQ ID NO: 8378962 - DNA, 22 bp, Homo sapiens
aaaccacttatatcgtgatttg

SEQ ID NO: 8378963 - DNA, 22 bp, Homo sapiens
aaaccactcctgattcacttca

SEQ ID NO: 8378964 - DNA, 22 bp, Homo sapiens
aaacatttttcttcatcatcct

SEQ ID NO: 8378965 - DNA, 22 bp, Homo sapiens
aaaccattaggttttatctact

SEQ ID NO: 8378966 - DNA, 22 bp, Homo sapiens
aaacagtctgatgccatctgcc

SEQ ID NO: 8378967 - DNA, 22 bp, Homo sapiens
aaacagtcctctttatttagtc

SEQ ID NO: 8378968 - DNA, 20 bp, Homo sapiens
aaacacagcctctctttaca

SEQ ID NO: 8378969 - DNA, 22 bp, Homo sapiens
aaacacagatttctttgtccca

SEQ ID NO: 8378970 - DNA, 19 bp, Homo sapiens
aaacacagatttcttacca

SEQ ID NO: 8378971 - DNA, 22 bp, Homo sapiens
aaacatcttgctctgattggta

SEQ ID NO: 8378972 - DNA, 22 bp, Homo sapiens
aaacatgagcacttgcttcata

SEQ ID NO: 8378973 - DNA, 22 bp, Homo sapiens
aaacatgagcatctcttcaagc

SEQ ID NO: 8378974 - DNA, 22 bp, Homo sapiens
aaactttaaatttgtacctctg

SEQ ID NO: 8378975 - DNA, 22 bp, Homo sapiens
aaagaactacctgtatgatatt

SEQ ID NO: 8378976 - DNA, 22 bp, Homo sapiens
aaagaacttatcctagaatttg

SEQ ID NO: 8378977 - DNA, 22 bp, Homo sapiens
aaacttgacagtgagacagttt

SEQ ID NO: 8378978 - DNA, 22 bp, Homo sapiens
aaacttgaggcaatgaaggtgt

SEQ ID NO: 8378979 - DNA, 22 bp, Homo sapiens
aaagatggcccatgatctcttg

SEQ ID NO: 8378980 - DNA, 22 bp, Homo sapiens
aaagatctccccttcaaagagt

SEQ ID NO: 8378981 - DNA, 22 bp, Homo sapiens
aaagatctccccttcaaagagt

SEQ ID NO: 8378982 - DNA, 22 bp, Homo sapiens
aaagatctgacttagacacaga

SEQ ID NO: 8378983 - DNA, 22 bp, Homo sapiens
aaagagctttagaaatctcaga

SEQ ID NO: 8378984 - DNA, 22 bp, Homo sapiens
aaagagctttagaaatctcaga

SEQ ID NO: 8378985 - DNA, 22 bp, Homo sapiens
aaagaagagcaaatttgttgta

SEQ ID NO: 8378986 - DNA, 22 bp, Homo sapiens
aaagaagagctggaaggagtct

SEQ ID NO: 8378987 - DNA, 22 bp, Homo sapiens
aaagaagacagacatttctttc

SEQ ID NO: 8378988 - DNA, 22 bp, Homo sapiens
aaagaagatggagacctgacta

SEQ ID NO: 8378989 - DNA, 22 bp, Homo sapiens
aaagaagatggagacctgacta

SEQ ID NO: 8378990 - DNA, 22 bp, Homo sapiens
aaagaagcataggctagacttc

SEQ ID NO: 8378991 - DNA, 22 bp, Homo sapiens
aaagaaggatgggagaaatcct

SEQ ID NO: 8378992 - DNA, 22 bp, Homo sapiens
aaaagtctacaagcttcaacaa

SEQ ID NO: 8378993 - DNA, 22 bp, Homo sapiens
aaaagtctacaagcttcaacaa

SEQ ID NO: 8378994 - DNA, 22 bp, Homo sapiens
aaaagtattttggatctcagat

SEQ ID NO: 8378995 - DNA, 22 bp, Homo sapiens
aaaagtattttgagcactttat

SEQ ID NO: 8378996 - DNA, 19 bp, Homo sapiens
aaaagtctattcaattaca

SEQ ID NO: 8378997 - DNA, 22 bp, Homo sapiens
aaaagtctctctgagtaaaagt

SEQ ID NO: 8378998 - DNA, 22 bp, Homo sapiens
aaaagtctctctgagtaaaagt

SEQ ID NO: 8378999 - DNA, 22 bp, Homo sapiens
aaaagtctgctctcatttcaga

SEQ ID NO: 8379000 - DNA, 22 bp, Homo sapiens
aaaagtctgctttctattatca

SEQ ID NO: 8379001 - DNA, 22 bp, Homo sapiens
aaaagtctctctgagtaaaagt

SEQ ID NO: 8379002 - DNA, 22 bp, Homo sapiens
aaaaatgcttggacttaataaa

SEQ ID NO: 8379003 - DNA, 22 bp, Homo sapiens
aaaaatgtcattatggaactga

SEQ ID NO: 8379004 - DNA, 20 bp, Homo sapiens
aaaaagacaaaacgagttgg

SEQ ID NO: 8379005 - DNA, 19 bp, Homo sapiens
aaaaacttagtccagaaag

SEQ ID NO: 8379006 - DNA, 22 bp, Homo sapiens
aaaaagactagtcgagtgcagt

SEQ ID NO: 8379007 - DNA, 22 bp, Homo sapiens
aaaaagagaaatgctctagtcc

SEQ ID NO: 8379008 - DNA, 22 bp, Homo sapiens
aaaaagatagcattgtgctcct

SEQ ID NO: 8379009 - DNA, 22 bp, Homo sapiens
aaaaatgaattcttcagtggca

SEQ ID NO: 8379010 - DNA, 22 bp, Homo sapiens
aaaatagatgaaaggaagtctg

SEQ ID NO: 8379011 - DNA, 22 bp, Homo sapiens
aaaagtgatgggatggcacttc

SEQ ID NO: 8379012 - DNA, 22 bp, Homo sapiens
aaaatagctatggaatgtcact

SEQ ID NO: 8379013 - DNA, 22 bp, Homo sapiens
aaaatagctatggaatgtcact

SEQ ID NO: 8379014 - DNA, 22 bp, Homo sapiens
aaaatagcatattgctttcttt

SEQ ID NO: 8379015 - DNA, 20 bp, Homo sapiens
aaaatagccccaggctcatt

SEQ ID NO: 8379016 - DNA, 22 bp, Homo sapiens
aaaatagcatattgctttcttt

SEQ ID NO: 8379017 - DNA, 22 bp, Homo sapiens
aaaatagcaatcagggactctc

SEQ ID NO: 8379018 - DNA, 22 bp, Homo sapiens
aaaatagcagggatgtgggaaa

SEQ ID NO: 8379019 - DNA, 22 bp, Homo sapiens
aaaatagcctcacataattgct

SEQ ID NO: 8379020 - DNA, 22 bp, Homo sapiens
aaacaactcggcaactgctttt

SEQ ID NO: 8379021 - DNA, 22 bp, Homo sapiens
aaacaactcggcaactgctttt

SEQ ID NO: 8379022 - DNA, 22 bp, Homo sapiens
aaacaagagcttacatggctgc

SEQ ID NO: 8379023 - DNA, 22 bp, Homo sapiens
aaacacacagaaatgaatgagg

SEQ ID NO: 8379024 - DNA, 22 bp, Homo sapiens
aaacacacagaaatgaatgagg

SEQ ID NO: 8379025 - DNA, 22 bp, Homo sapiens
aaacacaatgtttctttgttct

SEQ ID NO: 8379026 - DNA, 22 bp, Homo sapiens
aaagatgtccaagtaaagttaa

SEQ ID NO: 8379027 - DNA, 22 bp, Homo sapiens
aaagatgtcatacacattaaga

SEQ ID NO: 8379028 - DNA, 23 bp, Homo sapiens
aaagatgtgagtattcatatggc

SEQ ID NO: 8379029 - DNA, 22 bp, Homo sapiens
aaagcaatgcttgtggaatgta

SEQ ID NO: 8379030 - DNA, 22 bp, Homo sapiens
aaagcaatgcccgttcattatc

SEQ ID NO: 8379031 - DNA, 22 bp, Homo sapiens
aaagcaatgcccgttcattatc

SEQ ID NO: 8379032 - DNA, 22 bp, Homo sapiens
aaagcaatggatgagaatctgt

SEQ ID NO: 8379033 - DNA, 22 bp, Homo sapiens
aaaggcatgggtgcctgcatgt

SEQ ID NO: 8379034 - DNA, 22 bp, Homo sapiens
aaaggccaataaagacaagctg

SEQ ID NO: 8379035 - DNA, 22 bp, Homo sapiens
aaaggccaataaagacaagctg

SEQ ID NO: 8379036 - DNA, 22 bp, Homo sapiens
aaaggccacacagagcagggag

SEQ ID NO: 8379037 - DNA, 22 bp, Homo sapiens
aaaggccttttccccacttctt

SEQ ID NO: 8379038 - DNA, 22 bp, Homo sapiens
aaaggccaccaacatgaagcat

SEQ ID NO: 8379039 - DNA, 22 bp, Homo sapiens
aaaggccactgcaagggaaggt

SEQ ID NO: 8379040 - DNA, 22 bp, Homo sapiens
aaaggccaggttggctggtatt

SEQ ID NO: 8379041 - DNA, 22 bp, Homo sapiens
aaacactgtacaatctgcaggg

SEQ ID NO: 8379042 - DNA, 22 bp, Homo sapiens
aaagtcatttagccttatctcc

SEQ ID NO: 8379043 - DNA, 22 bp, Homo sapiens
aaagtgcattgtttgtgttcct

SEQ ID NO: 8379044 - DNA, 22 bp, Homo sapiens
aaacagttttctcatttagtgt

SEQ ID NO: 8379045 - DNA, 22 bp, Homo sapiens
aaacagttttctcatttagtgt

SEQ ID NO: 8379046 - DNA, 22 bp, Homo sapiens
aaatacagattccagggtctta

SEQ ID NO: 8379047 - DNA, 22 bp, Homo sapiens
aaacatcataggcatgcatgat

SEQ ID NO: 8379048 - DNA, 22 bp, Homo sapiens
aaacagttttttaagtctctag

SEQ ID NO: 8379049 - DNA, 22 bp, Homo sapiens
aaacatagataatagatagatg

SEQ ID NO: 8379050 - DNA, 22 bp, Homo sapiens
aaacatcaccattttacctaat

SEQ ID NO: 8379051 - DNA, 22 bp, Homo sapiens
aaatgctagaacattttaaagg

SEQ ID NO: 8379052 - DNA, 22 bp, Homo sapiens
aaatgctacacaggaattctca

SEQ ID NO: 8379053 - DNA, 22 bp, Homo sapiens
aaatgctaaatgcagcaagtag

SEQ ID NO: 8379054 - DNA, 22 bp, Homo sapiens
aaatgcctatttgttccttcag

SEQ ID NO: 8379055 - DNA, 22 bp, Homo sapiens
aaatggcaggctctttgctagt

SEQ ID NO: 8379056 - DNA, 22 bp, Homo sapiens
aaatggcagtagaaaagaatcc

SEQ ID NO: 8379057 - DNA, 23 bp, Homo sapiens
aaatggccaaaaccaggtggtta

SEQ ID NO: 8379058 - DNA, 22 bp, Homo sapiens
aaatgctatttgggaacaacat

SEQ ID NO: 8379059 - DNA, 22 bp, Homo sapiens
aaatcatgtgcagagatcagga

SEQ ID NO: 8379060 - DNA, 22 bp, Homo sapiens
aaatcattatttacagttctga

SEQ ID NO: 8379061 - DNA, 22 bp, Homo sapiens
aaatcagttcacgttctgaggt

SEQ ID NO: 8379062 - DNA, 22 bp, Homo sapiens
aaactacactttgggaccagca

SEQ ID NO: 8379063 - DNA, 23 bp, Homo sapiens
aaactacatttatagtttttctc

SEQ ID NO: 8379064 - DNA, 22 bp, Homo sapiens
aaactactatgggaatgtactt

SEQ ID NO: 8379065 - DNA, 23 bp, Homo sapiens
aaatatgtctgagggcaaagaat

SEQ ID NO: 8379066 - DNA, 22 bp, Homo sapiens
aaatatgtgatcagtgaataaa

SEQ ID NO: 8379067 - DNA, 22 bp, Homo sapiens
aaatatgatactcccttttagt

SEQ ID NO: 8379068 - DNA, 22 bp, Homo sapiens
aaatatgtaaccaaggtgaagt

SEQ ID NO: 8379069 - DNA, 22 bp, Homo sapiens
aaatatgtaaccaaggtgaagt

SEQ ID NO: 8379070 - DNA, 22 bp, Homo sapiens
aaatagaattaactagctactg

SEQ ID NO: 8379071 - DNA, 22 bp, Homo sapiens
aaacggttgctcatagttacat

SEQ ID NO: 8379072 - DNA, 22 bp, Homo sapiens
aaatagaattggaagcagagtt

SEQ ID NO: 8379073 - DNA, 23 bp, Homo sapiens
aaaccttttgtagaacaattgct

SEQ ID NO: 8379074 - DNA, 22 bp, Homo sapiens
aaatactgttttattccatgat

SEQ ID NO: 8379075 - DNA, 22 bp, Homo sapiens
aaatactgttttattccatgat

SEQ ID NO: 8379076 - DNA, 22 bp, Homo sapiens
aaatactgttgaatgaagtaag

SEQ ID NO: 8379077 - DNA, 22 bp, Homo sapiens
aaatacagattctgactcagag

SEQ ID NO: 8379078 - DNA, 21 bp, Homo sapiens
aaatactgtcaaatggtgggt

SEQ ID NO: 8379079 - DNA, 22 bp, Homo sapiens
aaatactgtctctgagagagcc

SEQ ID NO: 8379080 - DNA, 22 bp, Homo sapiens
aaatactgtgaataaaggtttt

SEQ ID NO: 8379081 - DNA, 22 bp, Homo sapiens
aaatactgtgaataaaggtttt

SEQ ID NO: 8379082 - DNA, 22 bp, Homo sapiens
aaatactgtctctgagagagcc

SEQ ID NO: 8379083 - DNA, 22 bp, Homo sapiens
aaatactgtccaccatggagca

SEQ ID NO: 8379084 - DNA, 22 bp, Homo sapiens
aaatactgtccaccatggagca

SEQ ID NO: 8379085 - DNA, 22 bp, Homo sapiens
aacatttaggaaggacctcctc

SEQ ID NO: 8379086 - DNA, 22 bp, Homo sapiens
aacatttaggaaggacctcctc

SEQ ID NO: 8379087 - DNA, 22 bp, Homo sapiens
aacatttacaaatccttctgca

SEQ ID NO: 8379088 - DNA, 22 bp, Homo sapiens
aacatttatgattgaggtaaat

SEQ ID NO: 8379089 - DNA, 22 bp, Homo sapiens
aacatttatgattgaggtaaat

SEQ ID NO: 8379090 - DNA, 22 bp, Homo sapiens
aacatttatggtagtcattgca

SEQ ID NO: 8379091 - DNA, 22 bp, Homo sapiens
aatatttctgtagctatgttct

SEQ ID NO: 8379092 - DNA, 22 bp, Homo sapiens
aacatttcagcacctgattcct

SEQ ID NO: 8379093 - DNA, 22 bp, Homo sapiens
aacatttattgagcacctactg

SEQ ID NO: 8379094 - DNA, 22 bp, Homo sapiens
aatcacatgtgctcaattttaa

SEQ ID NO: 8379095 - DNA, 22 bp, Homo sapiens
aatatttgcatcattagctatt

SEQ ID NO: 8379096 - DNA, 22 bp, Homo sapiens
aacattctggttctaaaaacct

SEQ ID NO: 8379097 - DNA, 22 bp, Homo sapiens
aacattcttcaaatatcactct

SEQ ID NO: 8379098 - DNA, 22 bp, Homo sapiens
aacattctttagctcttcctgc

SEQ ID NO: 8379099 - DNA, 22 bp, Homo sapiens
aacagtttgtggatagcttgta

SEQ ID NO: 8379100 - DNA, 22 bp, Homo sapiens
aacagtttgggtaggtatgtag

SEQ ID NO: 8379101 - DNA, 22 bp, Homo sapiens
aacatgtttccagtgtaaggcc

SEQ ID NO: 8379102 - DNA, 22 bp, Homo sapiens
aacataaatttgaagtggcaaa

SEQ ID NO: 8379103 - DNA, 20 bp, Homo sapiens
aacattgaaagtctagaaga

SEQ ID NO: 8379104 - DNA, 22 bp, Homo sapiens
aacattgccatggttaatttta

SEQ ID NO: 8379105 - DNA, 20 bp, Homo sapiens
aacattgtttgtaaaagcag

SEQ ID NO: 8379106 - DNA, 22 bp, Homo sapiens
aacattgttttccctatatcca

SEQ ID NO: 8379107 - DNA, 22 bp, Homo sapiens
aacattgttttgcacaactctt

SEQ ID NO: 8379108 - DNA, 22 bp, Homo sapiens
aaccattagtcaatcagcaaga

SEQ ID NO: 8379109 - DNA, 22 bp, Homo sapiens
aaccaggagattaaagaaaggt

SEQ ID NO: 8379110 - DNA, 22 bp, Homo sapiens
aaccatgaatgggttctggtgt

SEQ ID NO: 8379111 - DNA, 22 bp, Homo sapiens
aaccagtcccagtgagatgaac

SEQ ID NO: 8379112 - DNA, 22 bp, Homo sapiens
aactcatctgggtgagtttgtc

SEQ ID NO: 8379113 - DNA, 22 bp, Homo sapiens
aactcatcccagtttgaccgga

SEQ ID NO: 8379114 - DNA, 22 bp, Homo sapiens
aactcatcttcgagtgaggctg

SEQ ID NO: 8379115 - DNA, 22 bp, Homo sapiens
aactcatttgcatttttcctgt

SEQ ID NO: 8379116 - DNA, 22 bp, Homo sapiens
aactccagcaggaaggtgagaa

SEQ ID NO: 8379117 - DNA, 22 bp, Homo sapiens
aactccagtgtcagctgcaatg

SEQ ID NO: 8379118 - DNA, 22 bp, Homo sapiens
aactccagggcattgtctcctg

SEQ ID NO: 8379119 - DNA, 22 bp, Homo sapiens
aatcacattacagcatatctgt

SEQ ID NO: 8379120 - DNA, 22 bp, Homo sapiens
aatcacattagtgaaacactga

SEQ ID NO: 8379121 - DNA, 22 bp, Homo sapiens
aatcacatttacattgctaatt

SEQ ID NO: 8379122 - DNA, 22 bp, Homo sapiens
aatcacatttgcccccatattc

SEQ ID NO: 8379123 - DNA, 22 bp, Homo sapiens
aatcagaaaattcagtggaatt

SEQ ID NO: 8379124 - DNA, 22 bp, Homo sapiens
aatcactttgcactcttatttg

SEQ ID NO: 8379125 - DNA, 19 bp, Homo sapiens
aaccaggacaaggggctgg

SEQ ID NO: 8379126 - DNA, 22 bp, Homo sapiens
aaccaggaattgcagggctgca

SEQ ID NO: 8379127 - DNA, 21 bp, Homo sapiens
aagtcaatacagataagtctt

SEQ ID NO: 8379128 - DNA, 22 bp, Homo sapiens
aagtcaaagctttcagaggaaa

SEQ ID NO: 8379129 - DNA, 22 bp, Homo sapiens
aacactggaagggacatcaagt

SEQ ID NO: 8379130 - DNA, 22 bp, Homo sapiens
aagttcttgagccctattctag

SEQ ID NO: 8379131 - DNA, 22 bp, Homo sapiens
aagttgagatgtcataggagac

SEQ ID NO: 8379132 - DNA, 20 bp, Homo sapiens
aagttacattgtattgtacc

SEQ ID NO: 8379133 - DNA, 22 bp, Homo sapiens
aagtttctgatattgttaaagc

SEQ ID NO: 8379134 - DNA, 22 bp, Homo sapiens
aagtttctgccatactgtggtg

SEQ ID NO: 8379135 - DNA, 22 bp, Homo sapiens
aagtttctgggcaagacaaggc

SEQ ID NO: 8379136 - DNA, 22 bp, Homo sapiens
aagtttctggaccttacctgct

SEQ ID NO: 8379137 - DNA, 22 bp, Homo sapiens
aagtttctgggcaagacaaggc

SEQ ID NO: 8379138 - DNA, 20 bp, Homo sapiens
aagtttctggtttatatctt

SEQ ID NO: 8379139 - DNA, 20 bp, Homo sapiens
aagtttctggtttatatctt

SEQ ID NO: 8379140 - DNA, 22 bp, Homo sapiens
aagtttctgttcatatctctga

SEQ ID NO: 8379141 - DNA, 22 bp, Homo sapiens
aagtttctgtatgctcttctgt

SEQ ID NO: 8379142 - DNA, 22 bp, Homo sapiens
aagtttctgttcgctttaataa

SEQ ID NO: 8379143 - DNA, 22 bp, Homo sapiens
aagtttctgttcatatctctga

SEQ ID NO: 8379144 - DNA, 22 bp, Homo sapiens
aagtttctttattagcttgtcc

SEQ ID NO: 8379145 - DNA, 22 bp, Homo sapiens
aataaaatggtcagttttctca

SEQ ID NO: 8379146 - DNA, 22 bp, Homo sapiens
aataaaatggtcagttttctca

SEQ ID NO: 8379147 - DNA, 22 bp, Homo sapiens
aataaaatggtcagttttctca

SEQ ID NO: 8379148 - DNA, 22 bp, Homo sapiens
aataaaatggtcagttttctca

SEQ ID NO: 8379149 - DNA, 22 bp, Homo sapiens
aacagtttgagctttgaatttc

SEQ ID NO: 8379150 - DNA, 22 bp, Homo sapiens
aacagtttgagctttgaatttc

SEQ ID NO: 8379151 - DNA, 22 bp, Homo sapiens
aacagtttgcctgaaatgtatt

SEQ ID NO: 8379152 - DNA, 22 bp, Homo sapiens
aacagtttgcctgaaatgtatt

SEQ ID NO: 8379153 - DNA, 22 bp, Homo sapiens
aacagtttgctttaagaggcac

SEQ ID NO: 8379154 - DNA, 22 bp, Homo sapiens
aacagtttatgtaaatgtccag

SEQ ID NO: 8379155 - DNA, 22 bp, Homo sapiens
aacagtttatgataaattctta

SEQ ID NO: 8379156 - DNA, 22 bp, Homo sapiens
aacagtttatgataaattctta

SEQ ID NO: 8379157 - DNA, 22 bp, Homo sapiens
aacagtttcagttactgatgag

SEQ ID NO: 8379158 - DNA, 18 bp, Homo sapiens
aacagtttccagattctc

SEQ ID NO: 8379159 - DNA, 22 bp, Homo sapiens
aataaacaaatctttcctgtgg

SEQ ID NO: 8379160 - DNA, 22 bp, Homo sapiens
aataaacaaatccttccttccc

SEQ ID NO: 8379161 - DNA, 22 bp, Homo sapiens
aataaacaaatccttccttccc

SEQ ID NO: 8379162 - DNA, 21 bp, Homo sapiens
aagcttttcctgagagttgtc

SEQ ID NO: 8379163 - DNA, 22 bp, Homo sapiens
aagctttttggatttgcttcag

SEQ ID NO: 8379164 - DNA, 22 bp, Homo sapiens
aagctttttggatttgcttcag

SEQ ID NO: 8379165 - DNA, 22 bp, Homo sapiens
aagcttttgacttggtagggaa

SEQ ID NO: 8379166 - DNA, 22 bp, Homo sapiens
aagcttttctctgtattacctg

SEQ ID NO: 8379167 - DNA, 19 bp, Homo sapiens
aagctttcccattaacccc

SEQ ID NO: 8379168 - DNA, 19 bp, Homo sapiens
aagctttcccattaacccc

SEQ ID NO: 8379169 - DNA, 22 bp, Homo sapiens
aagctttcagagcagaatgtga

SEQ ID NO: 8379170 - DNA, 22 bp, Homo sapiens
aagctgtcaggaggttaccttt

SEQ ID NO: 8379171 - DNA, 22 bp, Homo sapiens
aagctgtagaggcagtacattt

SEQ ID NO: 8379172 - DNA, 22 bp, Homo sapiens
aagcccagatgagatccctgga

SEQ ID NO: 8379173 - DNA, 22 bp, Homo sapiens
aagctggcctcaaactcctagc

SEQ ID NO: 8379174 - DNA, 22 bp, Homo sapiens
aagccagcattttcccattcct

SEQ ID NO: 8379175 - DNA, 22 bp, Homo sapiens
aagccattcatctaatgtcctg

SEQ ID NO: 8379176 - DNA, 22 bp, Homo sapiens
aagccattcatctaatgtcctg

SEQ ID NO: 8379177 - DNA, 22 bp, Homo sapiens
aagccattcccatagacttcag

SEQ ID NO: 8379178 - DNA, 22 bp, Homo sapiens
aaattgctagttgcttttttca

SEQ ID NO: 8379179 - DNA, 22 bp, Homo sapiens
aaatttaagaagtgtgtgcgtg

SEQ ID NO: 8379180 - DNA, 22 bp, Homo sapiens
aaatttaaggaggtgctcactt

SEQ ID NO: 8379181 - DNA, 22 bp, Homo sapiens
aaatttaaggaggtgctcactt

SEQ ID NO: 8379182 - DNA, 22 bp, Homo sapiens
aaatttaaaaagcagcattgca

SEQ ID NO: 8379183 - DNA, 22 bp, Homo sapiens
aaatttaaaaagcagcattgca

SEQ ID NO: 8379184 - DNA, 22 bp, Homo sapiens
aaatttaaaaagcagcattgca

SEQ ID NO: 8379185 - DNA, 22 bp, Homo sapiens
aaggagaaatggtagatgtgca

SEQ ID NO: 8379186 - DNA, 22 bp, Homo sapiens
aaggagaaggcatcattcaagt

SEQ ID NO: 8379187 - DNA, 22 bp, Homo sapiens
aaggagaaggcatcattcaagt

SEQ ID NO: 8379188 - DNA, 22 bp, Homo sapiens
aaggagaaggcatcattcaagt

SEQ ID NO: 8379189 - DNA, 22 bp, Homo sapiens
aaggactctccagctagcaaat

SEQ ID NO: 8379190 - DNA, 22 bp, Homo sapiens
aaggactgaataattctctttc

SEQ ID NO: 8379191 - DNA, 22 bp, Homo sapiens
aaatgttttgctcccatgtggt

SEQ ID NO: 8379192 - DNA, 22 bp, Homo sapiens
aaattataggtgccaccttgga

SEQ ID NO: 8379193 - DNA, 22 bp, Homo sapiens
aaattagtcatgttgtattact

SEQ ID NO: 8379194 - DNA, 22 bp, Homo sapiens
aaattattagttaagttgggca

SEQ ID NO: 8379195 - DNA, 22 bp, Homo sapiens
aaattattataggcagagctga

SEQ ID NO: 8379196 - DNA, 22 bp, Homo sapiens
aaattattacaagctagttggc

SEQ ID NO: 8379197 - DNA, 22 bp, Homo sapiens
aaattattaaacagtgggatgc

SEQ ID NO: 8379198 - DNA, 22 bp, Homo sapiens
aaattattataggcagagctga

SEQ ID NO: 8379199 - DNA, 22 bp, Homo sapiens
aaattattatgcccctctataa

SEQ ID NO: 8379200 - DNA, 22 bp, Homo sapiens
aaggacatttctgactaatgca

SEQ ID NO: 8379201 - DNA, 22 bp, Homo sapiens
aaggggcatgcttttgccagga

SEQ ID NO: 8379202 - DNA, 23 bp, Homo sapiens
aacaatagagataaagtgagatc

SEQ ID NO: 8379203 - DNA, 20 bp, Homo sapiens
aacaatctagaagctattct

SEQ ID NO: 8379204 - DNA, 22 bp, Homo sapiens
aacaatcaagtttctaaatgac

SEQ ID NO: 8379205 - DNA, 22 bp, Homo sapiens
aacaatcaagtttctaaatgac

SEQ ID NO: 8379206 - DNA, 22 bp, Homo sapiens
aacaatgaccacacaatgtact

SEQ ID NO: 8379207 - DNA, 22 bp, Homo sapiens
aacaatctgttcgatagaaaat

SEQ ID NO: 8379208 - DNA, 22 bp, Homo sapiens
aacaatgagtcctctgaggtta

SEQ ID NO: 8379209 - DNA, 22 bp, Homo sapiens
aacaatgaggatctgttctgag

SEQ ID NO: 8379210 - DNA, 22 bp, Homo sapiens
aagggagacagttgtgtgagga

SEQ ID NO: 8379211 - DNA, 22 bp, Homo sapiens
aacaagcagatgcaatgcactt

SEQ ID NO: 8379212 - DNA, 22 bp, Homo sapiens
aacaaggcacaagctggctgtt

SEQ ID NO: 8379213 - DNA, 22 bp, Homo sapiens
aacaagatagatatcacttagg

SEQ ID NO: 8379214 - DNA, 22 bp, Homo sapiens
aacaaatgtgttttgtaattaa

SEQ ID NO: 8379215 - DNA, 22 bp, Homo sapiens
aacaagatgggagaaggacctc

SEQ ID NO: 8379216 - DNA, 22 bp, Homo sapiens
aacaagtgagtcatttaaactc

SEQ ID NO: 8379217 - DNA, 22 bp, Homo sapiens
aacaagtgatgctcatgattca

SEQ ID NO: 8379218 - DNA, 22 bp, Homo sapiens
aacaagtaagtttatatatatt

SEQ ID NO: 8379219 - DNA, 22 bp, Homo sapiens
aacaaatgtaaaatgcagatgc

SEQ ID NO: 8379220 - DNA, 22 bp, Homo sapiens
aaggccacacttgctggccagc

SEQ ID NO: 8379221 - DNA, 22 bp, Homo sapiens
aaatttcaagcaaagtagctat

SEQ ID NO: 8379222 - DNA, 22 bp, Homo sapiens
aaatttcaagcaaagtagctat

SEQ ID NO: 8379223 - DNA, 22 bp, Homo sapiens
aaatttcagttacctttacgtt

SEQ ID NO: 8379224 - DNA, 22 bp, Homo sapiens
aaatttcagttggaatgagctc

SEQ ID NO: 8379225 - DNA, 22 bp, Homo sapiens
aaatttctaagcagccacttcc

SEQ ID NO: 8379226 - DNA, 22 bp, Homo sapiens
aagagtcatagagacattgatt

SEQ ID NO: 8379227 - DNA, 22 bp, Homo sapiens
aagagtcagcttctgtatgggt

SEQ ID NO: 8379228 - DNA, 22 bp, Homo sapiens
aagagtcctgttacacatgagt

SEQ ID NO: 8379229 - DNA, 22 bp, Homo sapiens
aagagtaaatgtctaattagga

SEQ ID NO: 8379230 - DNA, 22 bp, Homo sapiens
aagagtaaagcaaagcacttgt

SEQ ID NO: 8379231 - DNA, 22 bp, Homo sapiens
aagaggttgtctgtgatgagtt

SEQ ID NO: 8379232 - DNA, 22 bp, Homo sapiens
aagaggttgtctgtgatgagtt

SEQ ID NO: 8379233 - DNA, 22 bp, Homo sapiens
aagaggttgtctgtgatgagtt

SEQ ID NO: 8379234 - DNA, 22 bp, Homo sapiens
aagaggttgtctgtgatgagtt

SEQ ID NO: 8379235 - DNA, 22 bp, Homo sapiens
aagagttatacctatttctaac

SEQ ID NO: 8379236 - DNA, 22 bp, Homo sapiens
aagagtttaattttgtctagac

SEQ ID NO: 8379237 - DNA, 22 bp, Homo sapiens
aagagtttaattttgtctagac

SEQ ID NO: 8379238 - DNA, 22 bp, Homo sapiens
aagagtggagctggaaagtggg

SEQ ID NO: 8379239 - DNA, 22 bp, Homo sapiens
aagagtggagctggaaagtggg

SEQ ID NO: 8379240 - DNA, 22 bp, Homo sapiens
aagagtggagctggaaagtggg

SEQ ID NO: 8379241 - DNA, 23 bp, Homo sapiens
acacctgtgctgtagtcactaca

SEQ ID NO: 8379242 - DNA, 22 bp, Homo sapiens
acacatttctctttttgtaagt

SEQ ID NO: 8379243 - DNA, 22 bp, Homo sapiens
acacatttctctttttgtaagt

SEQ ID NO: 8379244 - DNA, 22 bp, Homo sapiens
acacatttctctttttgtaagt

SEQ ID NO: 8379245 - DNA, 22 bp, Homo sapiens
acacatttctcccagtctccat

SEQ ID NO: 8379246 - DNA, 22 bp, Homo sapiens
acacatttctcccagtctccat

SEQ ID NO: 8379247 - DNA, 22 bp, Homo sapiens
acacggaaaaggagacagaggg

SEQ ID NO: 8379248 - DNA, 22 bp, Homo sapiens
acacggcactttaggaaggggc

SEQ ID NO: 8379249 - DNA, 22 bp, Homo sapiens
acactagagagcaggcattccc

SEQ ID NO: 8379250 - DNA, 22 bp, Homo sapiens
aagaggagtagatgtggttggt

SEQ ID NO: 8379251 - DNA, 23 bp, Homo sapiens
aagaggaggccctgctcccgtcc

SEQ ID NO: 8379252 - DNA, 22 bp, Homo sapiens
aagaggcagcccgctgaggctg

SEQ ID NO: 8379253 - DNA, 22 bp, Homo sapiens
aagaggcataaaatttatatgg

SEQ ID NO: 8379254 - DNA, 22 bp, Homo sapiens
aagaggaggattgatgtgggag

SEQ ID NO: 8379255 - DNA, 22 bp, Homo sapiens
aagaggaagtctccatggagag

SEQ ID NO: 8379256 - DNA, 22 bp, Homo sapiens
aagaggaggattgatgtgggag

SEQ ID NO: 8379257 - DNA, 21 bp, Homo sapiens
aagaggaagcattatggcata

SEQ ID NO: 8379258 - DNA, 22 bp, Homo sapiens
aagacatttatttgaatcaatt

SEQ ID NO: 8379259 - DNA, 19 bp, Homo sapiens
aagagggaaagtgctatgc

SEQ ID NO: 8379260 - DNA, 20 bp, Homo sapiens
aagaggtgataacaggtgag

SEQ ID NO: 8379261 - DNA, 22 bp, Homo sapiens
aagaggtgggttggacagatac

SEQ ID NO: 8379262 - DNA, 22 bp, Homo sapiens
acacacaggtaaaggagcctgg

SEQ ID NO: 8379263 - DNA, 22 bp, Homo sapiens
acacacagcgcctaccatgtgc

SEQ ID NO: 8379264 - DNA, 22 bp, Homo sapiens
acacacagcgcctaccatgtgc

SEQ ID NO: 8379265 - DNA, 17 bp, Homo sapiens
acagagcacatcaagat

SEQ ID NO: 8379266 - DNA, 22 bp, Homo sapiens
acagaggaagcatatagcacaa

SEQ ID NO: 8379267 - DNA, 22 bp, Homo sapiens
acagaggaaggctgagctgccc

SEQ ID NO: 8379268 - DNA, 22 bp, Homo sapiens
acagaggacaactaggcgctca

SEQ ID NO: 8379269 - DNA, 22 bp, Homo sapiens
acagaggacaactaggcgctca

SEQ ID NO: 8379270 - DNA, 22 bp, Homo sapiens
aagcacagttcttagagttaca

SEQ ID NO: 8379271 - DNA, 22 bp, Homo sapiens
acagagtcattcactgatgaag

SEQ ID NO: 8379272 - DNA, 22 bp, Homo sapiens
acagatcacttgactaaaatga

SEQ ID NO: 8379273 - DNA, 22 bp, Homo sapiens
acagagtcatggtagtcaaagg

SEQ ID NO: 8379274 - DNA, 22 bp, Homo sapiens
acagagtcatggtagtcaaagg

SEQ ID NO: 8379275 - DNA, 22 bp, Homo sapiens
acagatgaattttaattgtgtt

SEQ ID NO: 8379276 - DNA, 22 bp, Homo sapiens
acagatgagactccaggacctt

SEQ ID NO: 8379277 - DNA, 22 bp, Homo sapiens
aagcacattatagctatctagg

SEQ ID NO: 8379278 - DNA, 22 bp, Homo sapiens
acagaagaccagagagctaact

SEQ ID NO: 8379279 - DNA, 22 bp, Homo sapiens
acagaagataactgggaccaga

SEQ ID NO: 8379280 - DNA, 22 bp, Homo sapiens
acagaagataatgctgccttgg

SEQ ID NO: 8379281 - DNA, 22 bp, Homo sapiens
acagaagagctggctctgtgct

SEQ ID NO: 8379282 - DNA, 22 bp, Homo sapiens
acagaagcaaagactcaggcaa

SEQ ID NO: 8379283 - DNA, 22 bp, Homo sapiens
acagaagataatgctgccttgg

SEQ ID NO: 8379284 - DNA, 22 bp, Homo sapiens
acagaagataatgctgccttgg

SEQ ID NO: 8379285 - DNA, 22 bp, Homo sapiens
acagaagcagcgcggctcttct

SEQ ID NO: 8379286 - DNA, 22 bp, Homo sapiens
acagaagcagccgtcacagata

SEQ ID NO: 8379287 - DNA, 22 bp, Homo sapiens
acagaagcagccgtcacagata

SEQ ID NO: 8379288 - DNA, 22 bp, Homo sapiens
aagcaaaaggttacacttctgg

SEQ ID NO: 8379289 - DNA, 19 bp, Homo sapiens
aagatttggtcattgataa

SEQ ID NO: 8379290 - DNA, 22 bp, Homo sapiens
aagatacatcattcaggagtga

SEQ ID NO: 8379291 - DNA, 22 bp, Homo sapiens
aagatacatgttaggagcaacc

SEQ ID NO: 8379292 - DNA, 22 bp, Homo sapiens
aagatagatgtcatcagcatat

SEQ ID NO: 8379293 - DNA, 22 bp, Homo sapiens
acagaagaagttcaaggtgaag

SEQ ID NO: 8379294 - DNA, 22 bp, Homo sapiens
acagaagaagttcaaggtgaag

SEQ ID NO: 8379295 - DNA, 22 bp, Homo sapiens
acagaagaaagggaggttttgc

SEQ ID NO: 8379296 - DNA, 22 bp, Homo sapiens
acagaagaccaagaaagcttcc

SEQ ID NO: 8379297 - DNA, 22 bp, Homo sapiens
acagaagaccaagaaagcttcc

SEQ ID NO: 8379298 - DNA, 22 bp, Homo sapiens
acagaagacagagtgttcatct

SEQ ID NO: 8379299 - DNA, 22 bp, Homo sapiens
aagacaattttgagtatgcaca

SEQ ID NO: 8379300 - DNA, 22 bp, Homo sapiens
aagacaatcctggacagtcagc

SEQ ID NO: 8379301 - DNA, 22 bp, Homo sapiens
aagacaatgcattactaagaag

SEQ ID NO: 8379302 - DNA, 22 bp, Homo sapiens
aagacacagcgaaatgttcctg

SEQ ID NO: 8379303 - DNA, 22 bp, Homo sapiens
acaacaaaatcactagtcttcc

SEQ ID NO: 8379304 - DNA, 22 bp, Homo sapiens
aagacacacacatatgctgagt

SEQ ID NO: 8379305 - DNA, 22 bp, Homo sapiens
aagacacacacatatgctgagt

SEQ ID NO: 8379306 - DNA, 22 bp, Homo sapiens
aagacacacacatatgctgagt

SEQ ID NO: 8379307 - DNA, 22 bp, Homo sapiens
aagacattcacaaatgttcact

SEQ ID NO: 8379308 - DNA, 22 bp, Homo sapiens
acaagaataaggataagagatt

SEQ ID NO: 8379309 - DNA, 22 bp, Homo sapiens
aagacattgctgcttttaattg

SEQ ID NO: 8379310 - DNA, 22 bp, Homo sapiens
aagacattgtcattttataatt

SEQ ID NO: 8379311 - DNA, 22 bp, Homo sapiens
acaagaaaggtaggattcaggt

SEQ ID NO: 8379312 - DNA, 22 bp, Homo sapiens
acaagaagtaaaggtcggatgc

SEQ ID NO: 8379313 - DNA, 23 bp, Homo sapiens
acaactttacagatacattttgt

SEQ ID NO: 8379314 - DNA, 22 bp, Homo sapiens
aattagaagctgttagcaaaat

SEQ ID NO: 8379315 - DNA, 22 bp, Homo sapiens
aattagagatcagttctttgac

SEQ ID NO: 8379316 - DNA, 22 bp, Homo sapiens
aattagaagggagttattgata

SEQ ID NO: 8379317 - DNA, 22 bp, Homo sapiens
aattcaatctaagaaatgatca

SEQ ID NO: 8379318 - DNA, 22 bp, Homo sapiens
aattcaatctaagaaatgatca

SEQ ID NO: 8379319 - DNA, 22 bp, Homo sapiens
aattcaatctgtagattgtgat

SEQ ID NO: 8379320 - DNA, 22 bp, Homo sapiens
aattcaatggtttttaggatat

SEQ ID NO: 8379321 - DNA, 22 bp, Homo sapiens
aattcaaagactagaattttgc

SEQ ID NO: 8379322 - DNA, 22 bp, Homo sapiens
aattcaaattacaatagttgtt

SEQ ID NO: 8379323 - DNA, 22 bp, Homo sapiens
aattcaaattacaatagttgtt

SEQ ID NO: 8379324 - DNA, 17 bp, Homo sapiens
aagacaagacaaatgca

SEQ ID NO: 8379325 - DNA, 22 bp, Homo sapiens
aagacaatcctggacagtcagc

SEQ ID NO: 8379326 - DNA, 22 bp, Homo sapiens
aagacaagccttgtttttctgc

SEQ ID NO: 8379327 - DNA, 17 bp, Homo sapiens
aagacaagacaaatgca

SEQ ID NO: 8379328 - DNA, 22 bp, Homo sapiens
aagacaacagagatgacagact

SEQ ID NO: 8379329 - DNA, 22 bp, Homo sapiens
aagaatttaaactaaccatatg

SEQ ID NO: 8379330 - DNA, 22 bp, Homo sapiens
aagaattatctgaaagctgtgt

SEQ ID NO: 8379331 - DNA, 22 bp, Homo sapiens
aattcacaaaagttagatccat

SEQ ID NO: 8379332 - DNA, 22 bp, Homo sapiens
aattcacaaaaccagattgctt

SEQ ID NO: 8379333 - DNA, 22 bp, Homo sapiens
aactctcttgggagtacctgga

SEQ ID NO: 8379334 - DNA, 22 bp, Homo sapiens
aactctggaagggtgaggctgt

SEQ ID NO: 8379335 - DNA, 22 bp, Homo sapiens
aactctggctgcttcccaggtc

SEQ ID NO: 8379336 - DNA, 22 bp, Homo sapiens
aactctatttaccctactaaac

SEQ ID NO: 8379337 - DNA, 22 bp, Homo sapiens
aatgtattctgggaaaatgtta

SEQ ID NO: 8379338 - DNA, 22 bp, Homo sapiens
aatgtacaataagacaaagagg

SEQ ID NO: 8379339 - DNA, 22 bp, Homo sapiens
aatgtattctctttataagata

SEQ ID NO: 8379340 - DNA, 22 bp, Homo sapiens
aactctttggtctcaggaaagg

SEQ ID NO: 8379341 - DNA, 22 bp, Homo sapiens
aactcttcttataatgcgtgat

SEQ ID NO: 8379342 - DNA, 22 bp, Homo sapiens
aactctgtgtaggaaccaggtc

SEQ ID NO: 8379343 - DNA, 22 bp, Homo sapiens
aactcttaattttcatgaaatg

SEQ ID NO: 8379344 - DNA, 22 bp, Homo sapiens
aatgtatttgatgtattagcct

SEQ ID NO: 8379345 - DNA, 22 bp, Homo sapiens
aatgtcaaaataattgatttgt

SEQ ID NO: 8379346 - DNA, 22 bp, Homo sapiens
aatgtcaacacaagagaaatgc

SEQ ID NO: 8379347 - DNA, 22 bp, Homo sapiens
aatgtcaacacaagagaaatgc

SEQ ID NO: 8379348 - DNA, 22 bp, Homo sapiens
aatgtcaaaggctatacattca

SEQ ID NO: 8379349 - DNA, 22 bp, Homo sapiens
aatgtctttctcataacagata

SEQ ID NO: 8379350 - DNA, 22 bp, Homo sapiens
aatgtctttctcataacagata

SEQ ID NO: 8379351 - DNA, 22 bp, Homo sapiens
aatgtctttctgttctatgaga

SEQ ID NO: 8379352 - DNA, 22 bp, Homo sapiens
aatgtctttacttttgtgggca

SEQ ID NO: 8379353 - DNA, 22 bp, Homo sapiens
aatgtctttaaagtgcaataga

SEQ ID NO: 8379354 - DNA, 22 bp, Homo sapiens
aatgtctttaaagtgcaataga

SEQ ID NO: 8379355 - DNA, 20 bp, Homo sapiens
aatgtcttgagacatttcag

SEQ ID NO: 8379356 - DNA, 22 bp, Homo sapiens
aatgtcaatctcagagaacaca

SEQ ID NO: 8379357 - DNA, 22 bp, Homo sapiens
aatgtcaagggaagcaggaaat

SEQ ID NO: 8379358 - DNA, 22 bp, Homo sapiens
aactttctagagatgagttcgg

SEQ ID NO: 8379359 - DNA, 22 bp, Homo sapiens
aactttcagaatcctatgcatt

SEQ ID NO: 8379360 - DNA, 22 bp, Homo sapiens
aactttccatcatttgaagccc

SEQ ID NO: 8379361 - DNA, 22 bp, Homo sapiens
aatgttattacacttgtgaaat

SEQ ID NO: 8379362 - DNA, 22 bp, Homo sapiens
aatgttattacacttgtgaaat

SEQ ID NO: 8379363 - DNA, 22 bp, Homo sapiens
aatgttatgtggttcaacttaa

SEQ ID NO: 8379364 - DNA, 22 bp, Homo sapiens
aatgttatgtggttcaacttaa

SEQ ID NO: 8379365 - DNA, 22 bp, Homo sapiens
aatgttttgtatgcctctgagc

SEQ ID NO: 8379366 - DNA, 22 bp, Homo sapiens
aatgttttttggtctgatgaat

SEQ ID NO: 8379367 - DNA, 22 bp, Homo sapiens
aattactgtaattttctacagc

SEQ ID NO: 8379368 - DNA, 22 bp, Homo sapiens
aattagaagctgttagcaaaat

SEQ ID NO: 8379369 - DNA, 22 bp, Homo sapiens
aatgttttgcattagttttcta

SEQ ID NO: 8379370 - DNA, 22 bp, Homo sapiens
aactttctgaaaagcttgatca

SEQ ID NO: 8379371 - DNA, 22 bp, Homo sapiens
aactttctgaaaagcttgatca

SEQ ID NO: 8379372 - DNA, 22 bp, Homo sapiens
aactttctctacggcatttgtt

SEQ ID NO: 8379373 - DNA, 22 bp, Homo sapiens
aatgttacacaggtataatcag

SEQ ID NO: 8379374 - DNA, 22 bp, Homo sapiens
aatgttacagttttaattctga

SEQ ID NO: 8379375 - DNA, 22 bp, Homo sapiens
aatgttatgtggttcaacttaa

SEQ ID NO: 8379376 - DNA, 22 bp, Homo sapiens
aatgttaattcacagccaaata

SEQ ID NO: 8379377 - DNA, 22 bp, Homo sapiens
aatgttaagtttagattataac

SEQ ID NO: 8379378 - DNA, 22 bp, Homo sapiens
aatgttaagtttagattataac

SEQ ID NO: 8379379 - DNA, 22 bp, Homo sapiens
aatgtcttttgatacaagttac

SEQ ID NO: 8379380 - DNA, 22 bp, Homo sapiens
aatgtcttttaacctctggact

SEQ ID NO: 8379381 - DNA, 22 bp, Homo sapiens
aatgtcttttaacctctggact

SEQ ID NO: 8379382 - DNA, 22 bp, Homo sapiens
aatgtctttcttggttctggtt

SEQ ID NO: 8379383 - DNA, 22 bp, Homo sapiens
aatgtctttctgttctatgaga

SEQ ID NO: 8379384 - DNA, 22 bp, Homo sapiens
aatgtcttttaaatgttgaggt

SEQ ID NO: 8379385 - DNA, 21 bp, Homo sapiens
aatgtctttgtccatgctctg

SEQ ID NO: 8379386 - DNA, 22 bp, Homo sapiens
aatgtgaaaccgcacagaataa

SEQ ID NO: 8379387 - DNA, 22 bp, Homo sapiens
agagcagctgacagcctgccat

SEQ ID NO: 8379388 - DNA, 22 bp, Homo sapiens
agagcagcgtttgtggaacact

SEQ ID NO: 8379389 - DNA, 22 bp, Homo sapiens
aattcactgaacttctctgaga

SEQ ID NO: 8379390 - DNA, 22 bp, Homo sapiens
aattcacatgttgaagtcctaa

SEQ ID NO: 8379391 - DNA, 22 bp, Homo sapiens
aattcactgaacttctctgaga

SEQ ID NO: 8379392 - DNA, 22 bp, Homo sapiens
aattcactgttccttctgcttt

SEQ ID NO: 8379393 - DNA, 22 bp, Homo sapiens
aattcacatgcatgtctgtgca

SEQ ID NO: 8379394 - DNA, 22 bp, Homo sapiens
aattcacatccgaccaggtcaa

SEQ ID NO: 8379395 - DNA, 22 bp, Homo sapiens
aattcacatgttgaagtcctaa

SEQ ID NO: 8379396 - DNA, 22 bp, Homo sapiens
aattcacaggaggtatttgtcc

SEQ ID NO: 8379397 - DNA, 22 bp, Homo sapiens
aattcacaggatcacaggagag

SEQ ID NO: 8379398 - DNA, 22 bp, Homo sapiens
aattcacagcatttgcccatct

SEQ ID NO: 8379399 - DNA, 22 bp, Homo sapiens
aattcacatatacattattcct

SEQ ID NO: 8379400 - DNA, 22 bp, Homo sapiens
aattcacagttctgcaccttac

SEQ ID NO: 8379401 - DNA, 22 bp, Homo sapiens
agagcagctgtgacatggacag

SEQ ID NO: 8379402 - DNA, 22 bp, Homo sapiens
agagcagctggctgcatctaga

SEQ ID NO: 8379403 - DNA, 22 bp, Homo sapiens
agagcaggcataaagctttgaa

SEQ ID NO: 8379404 - DNA, 19 bp, Homo sapiens
agaggcagtctccaacagg

SEQ ID NO: 8379405 - DNA, 19 bp, Homo sapiens
agaggcagtctccaacagg

SEQ ID NO: 8379406 - DNA, 22 bp, Homo sapiens
agaggcagtatacaatccgagc

SEQ ID NO: 8379407 - DNA, 22 bp, Homo sapiens
agaggcagtatacaatccgagc

SEQ ID NO: 8379408 - DNA, 21 bp, Homo sapiens
agaggcaggcattaagtacac

SEQ ID NO: 8379409 - DNA, 22 bp, Homo sapiens
agaggccaagccagactgtgca

SEQ ID NO: 8379410 - DNA, 22 bp, Homo sapiens
aattttctggtgtgtaatgaag

SEQ ID NO: 8379411 - DNA, 21 bp, Homo sapiens
aattttgaaggaagattaagg

SEQ ID NO: 8379412 - DNA, 21 bp, Homo sapiens
aattttgaaggaagattaagg

SEQ ID NO: 8379413 - DNA, 21 bp, Homo sapiens
aattttgaaggaagattaagg

SEQ ID NO: 8379414 - DNA, 22 bp, Homo sapiens
aattttgtgtgggatcaaagga

SEQ ID NO: 8379415 - DNA, 22 bp, Homo sapiens
aattttgtgtgggatcaaagga

SEQ ID NO: 8379416 - DNA, 17 bp, Homo sapiens
agagggctcaaggcatc

SEQ ID NO: 8379417 - DNA, 22 bp, Homo sapiens
agagggctgcctcagtcagcta

SEQ ID NO: 8379418 - DNA, 22 bp, Homo sapiens
agagggctgctgcacagtgctc

SEQ ID NO: 8379419 - DNA, 22 bp, Homo sapiens
agagggctgctgcacagtgctc

SEQ ID NO: 8379420 - DNA, 22 bp, Homo sapiens
agaggccaatagtaggtggcat

SEQ ID NO: 8379421 - DNA, 22 bp, Homo sapiens
aatttatatgtaattaggcaca

SEQ ID NO: 8379422 - DNA, 22 bp, Homo sapiens
aatttatatgtaattaggcaca

SEQ ID NO: 8379423 - DNA, 20 bp, Homo sapiens
agaggctttcttgtagtcag

SEQ ID NO: 8379424 - DNA, 22 bp, Homo sapiens
agagggcataaaatagagcacg

SEQ ID NO: 8379425 - DNA, 22 bp, Homo sapiens
aatttatttcctgccagtacac

SEQ ID NO: 8379426 - DNA, 22 bp, Homo sapiens
agaggtggccatgggcgctgga

SEQ ID NO: 8379427 - DNA, 22 bp, Homo sapiens
agaggtgtcttgcttattgtta

SEQ ID NO: 8379428 - DNA, 23 bp, Homo sapiens
agaggtgtagtgtctcatctact

SEQ ID NO: 8379429 - DNA, 22 bp, Homo sapiens
agaggtgtcttgcttattgtta

SEQ ID NO: 8379430 - DNA, 22 bp, Homo sapiens
agagtaaataggagatgacagc

SEQ ID NO: 8379431 - DNA, 22 bp, Homo sapiens
agaggtgtggccaggactcaag

SEQ ID NO: 8379432 - DNA, 22 bp, Homo sapiens
acaaaaagctccattactgtcc

SEQ ID NO: 8379433 - DNA, 22 bp, Homo sapiens
agagggtaacaagaggcctgga

SEQ ID NO: 8379434 - DNA, 22 bp, Homo sapiens
agaggtggccatgggcgctgga

SEQ ID NO: 8379435 - DNA, 22 bp, Homo sapiens
acaaaaaccgtggattcagcat

SEQ ID NO: 8379436 - DNA, 22 bp, Homo sapiens
acaaaaaccgtggattcagcat

SEQ ID NO: 8379437 - DNA, 22 bp, Homo sapiens
agagtctgtgctttcatcagga

SEQ ID NO: 8379438 - DNA, 22 bp, Homo sapiens
agataatgttctgatccatttc

SEQ ID NO: 8379439 - DNA, 22 bp, Homo sapiens
agattcagaaatgaggagggcc

SEQ ID NO: 8379440 - DNA, 19 bp, Homo sapiens
agattattgcacattcatg

SEQ ID NO: 8379441 - DNA, 19 bp, Homo sapiens
agattattgcacattcatg

SEQ ID NO: 8379442 - DNA, 22 bp, Homo sapiens
agatgttttgtgtatttcatca

SEQ ID NO: 8379443 - DNA, 22 bp, Homo sapiens
agatgttttctaattctatatt

SEQ ID NO: 8379444 - DNA, 22 bp, Homo sapiens
agatgttttgtgtatttcatca

SEQ ID NO: 8379445 - DNA, 22 bp, Homo sapiens
agatgttttctaattctatatt

SEQ ID NO: 8379446 - DNA, 22 bp, Homo sapiens
agatatgttactgcatcatggg

SEQ ID NO: 8379447 - DNA, 21 bp, Homo sapiens
agatatgaatactgcaggcct

SEQ ID NO: 8379448 - DNA, 22 bp, Homo sapiens
agatatgatctatgattttgac

SEQ ID NO: 8379449 - DNA, 22 bp, Homo sapiens
agatatgagaatatagaggccc

SEQ ID NO: 8379450 - DNA, 22 bp, Homo sapiens
agatatcaccagttttacatac

SEQ ID NO: 8379451 - DNA, 22 bp, Homo sapiens
agagaaagtcctgatctctcta

SEQ ID NO: 8379452 - DNA, 22 bp, Homo sapiens
agagaaagtaaagattctacct

SEQ ID NO: 8379453 - DNA, 22 bp, Homo sapiens
agagaaagtaaagattctacct

SEQ ID NO: 8379454 - DNA, 21 bp, Homo sapiens
agagaaagtcatggctgtggc

SEQ ID NO: 8379455 - DNA, 22 bp, Homo sapiens
agagacagggttttgccatgtt

SEQ ID NO: 8379456 - DNA, 21 bp, Homo sapiens
agagagaaggccatatggtcc

SEQ ID NO: 8379457 - DNA, 22 bp, Homo sapiens
agagagaggcagcagtgctcac

SEQ ID NO: 8379458 - DNA, 23 bp, Homo sapiens
agagagagtttgtgtcaggtacc

SEQ ID NO: 8379459 - DNA, 20 bp, Homo sapiens
agagagcacaggcaggaaag

SEQ ID NO: 8379460 - DNA, 22 bp, Homo sapiens
agagagcagtctggaagaaaca

SEQ ID NO: 8379461 - DNA, 22 bp, Homo sapiens
aattcacacctccggtttttct

SEQ ID NO: 8379462 - DNA, 22 bp, Homo sapiens
aattcacagaaccatggtgctc

SEQ ID NO: 8379463 - DNA, 22 bp, Homo sapiens
agagatctctgaagctgctgct

SEQ ID NO: 8379464 - DNA, 22 bp, Homo sapiens
agagatcaaagcttgccaagta

SEQ ID NO: 8379465 - DNA, 22 bp, Homo sapiens
agacactgatgttcagctcaat

SEQ ID NO: 8379466 - DNA, 17 bp, Homo sapiens
agacactgagccaagta

SEQ ID NO: 8379467 - DNA, 22 bp, Homo sapiens
agacactggtgaagaaatcagg

SEQ ID NO: 8379468 - DNA, 22 bp, Homo sapiens
agacctgaagagtatcttcaga

SEQ ID NO: 8379469 - DNA, 19 bp, Homo sapiens
agagaaagaattgagtcta

SEQ ID NO: 8379470 - DNA, 18 bp, Homo sapiens
agagaaagaccaaagcat

SEQ ID NO: 8379471 - DNA, 22 bp, Homo sapiens
agagaaagtaaagattctacct

SEQ ID NO: 8379472 - DNA, 23 bp, Homo sapiens
agagaaagggataacacgttgaa

SEQ ID NO: 8379473 - DNA, 22 bp, Homo sapiens
agagaaacaggtcagctgggag

SEQ ID NO: 8379474 - DNA, 22 bp, Homo sapiens
agactgaataacaagcaaataa

SEQ ID NO: 8379475 - DNA, 22 bp, Homo sapiens
agactgaagtaagaatgcagct

SEQ ID NO: 8379476 - DNA, 22 bp, Homo sapiens
agactgaaatagtgcacaccaa

SEQ ID NO: 8379477 - DNA, 22 bp, Homo sapiens
agaataaaatagtctgaagatg

SEQ ID NO: 8379478 - DNA, 22 bp, Homo sapiens
agaatcattagagagaaaactt

SEQ ID NO: 8379479 - DNA, 22 bp, Homo sapiens
agaatcattatatttattaagc

SEQ ID NO: 8379480 - DNA, 22 bp, Homo sapiens
agaatcattatatttattaagc

SEQ ID NO: 8379481 - DNA, 22 bp, Homo sapiens
agaataatcactgaagttcaaa

SEQ ID NO: 8379482 - DNA, 22 bp, Homo sapiens
agaatcaggacctgtggctgtc

SEQ ID NO: 8379483 - DNA, 19 bp, Homo sapiens
aatggacaggcaatagtct

SEQ ID NO: 8379484 - DNA, 22 bp, Homo sapiens
aatggaatacctaggtggccca

SEQ ID NO: 8379485 - DNA, 22 bp, Homo sapiens
aatgcttttgctgtcattgctt

SEQ ID NO: 8379486 - DNA, 22 bp, Homo sapiens
aatgctttgtctgctccagact

SEQ ID NO: 8379487 - DNA, 22 bp, Homo sapiens
aatgctttttgcgaaatgtgca

SEQ ID NO: 8379488 - DNA, 22 bp, Homo sapiens
aatgctttgattgattaaaaca

SEQ ID NO: 8379489 - DNA, 22 bp, Homo sapiens
aatgctttgattgattaaaaca

SEQ ID NO: 8379490 - DNA, 22 bp, Homo sapiens
aatgtacaggctggctatgggg

SEQ ID NO: 8379491 - DNA, 22 bp, Homo sapiens
aatgtagatgagatattttttg

SEQ ID NO: 8379492 - DNA, 22 bp, Homo sapiens
aatgtataaagtgttaataact

SEQ ID NO: 8379493 - DNA, 22 bp, Homo sapiens
aatgtataaagtgttaataact

SEQ ID NO: 8379494 - DNA, 22 bp, Homo sapiens
aatgtataaagtgttaataact

SEQ ID NO: 8379495 - DNA, 22 bp, Homo sapiens
aatgtacactgaaagcctatca

SEQ ID NO: 8379496 - DNA, 22 bp, Homo sapiens
agaatttttgattatctactcg

SEQ ID NO: 8379497 - DNA, 23 bp, Homo sapiens
agaatttctaactctagctctgt

SEQ ID NO: 8379498 - DNA, 22 bp, Homo sapiens
agaattttatctaaagggagta

SEQ ID NO: 8379499 - DNA, 22 bp, Homo sapiens
agaatttttgcagtttagccat

SEQ ID NO: 8379500 - DNA, 22 bp, Homo sapiens
agaatctaagtacacagacaga

SEQ ID NO: 8379501 - DNA, 23 bp, Homo sapiens
agaatttcaaagtccagcacatt

SEQ ID NO: 8379502 - DNA, 22 bp, Homo sapiens
agaatttcaaaaggaagccagc

SEQ ID NO: 8379503 - DNA, 22 bp, Homo sapiens
agccctggtagcctgctgccat

SEQ ID NO: 8379504 - DNA, 21 bp, Homo sapiens
agcctggcccagggggaggct

SEQ ID NO: 8379505 - DNA, 22 bp, Homo sapiens
acagacatgggccgctcttgag

SEQ ID NO: 8379506 - DNA, 22 bp, Homo sapiens
agccctggggctggtgcttacc

SEQ ID NO: 8379507 - DNA, 22 bp, Homo sapiens
agctcaagctacacacagagtc

SEQ ID NO: 8379508 - DNA, 22 bp, Homo sapiens
agctcaggccggagctacaggc

SEQ ID NO: 8379509 - DNA, 22 bp, Homo sapiens
agctcagggctccaggaccgct

SEQ ID NO: 8379510 - DNA, 22 bp, Homo sapiens
agctcaggctctgcagggacta

SEQ ID NO: 8379511 - DNA, 22 bp, Homo sapiens
agctcaggctctgcagggacta

SEQ ID NO: 8379512 - DNA, 22 bp, Homo sapiens
agctcaggtcattccagggatg

SEQ ID NO: 8379513 - DNA, 22 bp, Homo sapiens
agctccaaggttgaggagtgag

SEQ ID NO: 8379514 - DNA, 22 bp, Homo sapiens
agctccaggtcagtgcacccct

SEQ ID NO: 8379515 - DNA, 22 bp, Homo sapiens
agctccaggtagtgccttatcg

SEQ ID NO: 8379516 - DNA, 22 bp, Homo sapiens
agcctgttcagtccactctcca

SEQ ID NO: 8379517 - DNA, 22 bp, Homo sapiens
agcctgtgtgctttggacaggg

SEQ ID NO: 8379518 - DNA, 22 bp, Homo sapiens
agcctgttctggtactccaggt

SEQ ID NO: 8379519 - DNA, 22 bp, Homo sapiens
agcctgtgacattgactatgaa

SEQ ID NO: 8379520 - DNA, 22 bp, Homo sapiens
agcctggcttaatcctcctttt

SEQ ID NO: 8379521 - DNA, 22 bp, Homo sapiens
agcctggctgggaagagcctct

SEQ ID NO: 8379522 - DNA, 22 bp, Homo sapiens
agcctggctgtaacctcatggt

SEQ ID NO: 8379523 - DNA, 22 bp, Homo sapiens
agcctggctgggaagagcctct

SEQ ID NO: 8379524 - DNA, 22 bp, Homo sapiens
acagacagtaaatagtgtggct

SEQ ID NO: 8379525 - DNA, 22 bp, Homo sapiens
acagacagtatggtggggctga

SEQ ID NO: 8379526 - DNA, 22 bp, Homo sapiens
acagacagtatggtggggctga

SEQ ID NO: 8379527 - DNA, 22 bp, Homo sapiens
agcccaggtctggcccagcctg

SEQ ID NO: 8379528 - DNA, 22 bp, Homo sapiens
agcccaggtctcaaagtacagg

SEQ ID NO: 8379529 - DNA, 22 bp, Homo sapiens
agcccaggtctcaaagtacagg

SEQ ID NO: 8379530 - DNA, 22 bp, Homo sapiens
agcccaggtctcaaagtacagg

SEQ ID NO: 8379531 - DNA, 22 bp, Homo sapiens
agcccaggtctggcccagcctg

SEQ ID NO: 8379532 - DNA, 22 bp, Homo sapiens
acagaacatattgcttctctca

SEQ ID NO: 8379533 - DNA, 22 bp, Homo sapiens
acagaacaggctgagaaaaaca

SEQ ID NO: 8379534 - DNA, 22 bp, Homo sapiens
acagaactgcaggaggaaaagc

SEQ ID NO: 8379535 - DNA, 22 bp, Homo sapiens
acagaactgggggcacagatag

SEQ ID NO: 8379536 - DNA, 22 bp, Homo sapiens
acagaactgggggcacagatag

SEQ ID NO: 8379537 - DNA, 21 bp, Homo sapiens
acagaactgtatagtgataaa

SEQ ID NO: 8379538 - DNA, 22 bp, Homo sapiens
agcccagctttgaaccatatca

SEQ ID NO: 8379539 - DNA, 22 bp, Homo sapiens
agcccagggctaataggaacca

SEQ ID NO: 8379540 - DNA, 22 bp, Homo sapiens
agcccagggctaataggaacca

SEQ ID NO: 8379541 - DNA, 22 bp, Homo sapiens
agcccaggtccagttcactgca

SEQ ID NO: 8379542 - DNA, 22 bp, Homo sapiens
agccaggaatgcatgctctgct

SEQ ID NO: 8379543 - DNA, 22 bp, Homo sapiens
agcatttaatcctacatagatc

SEQ ID NO: 8379544 - DNA, 22 bp, Homo sapiens
agcattggtggccagagtgcct

SEQ ID NO: 8379545 - DNA, 22 bp, Homo sapiens
agccaggctaaatgagccatga

SEQ ID NO: 8379546 - DNA, 22 bp, Homo sapiens
agccaggcggggcaggtttcct

SEQ ID NO: 8379547 - DNA, 20 bp, Homo sapiens
agccaggctcaagctccccc

SEQ ID NO: 8379548 - DNA, 22 bp, Homo sapiens
agccaggctactccttgctgac

SEQ ID NO: 8379549 - DNA, 22 bp, Homo sapiens
agcattcattgctagaatgtaa

SEQ ID NO: 8379550 - DNA, 22 bp, Homo sapiens
agcatctggcagaaagtcagaa

SEQ ID NO: 8379551 - DNA, 22 bp, Homo sapiens
agcatctggtcatgagtgagaa

SEQ ID NO: 8379552 - DNA, 22 bp, Homo sapiens
agcatctggcctggttactttt

SEQ ID NO: 8379553 - DNA, 22 bp, Homo sapiens
agcatcctgcttgctgtctgtg

SEQ ID NO: 8379554 - DNA, 22 bp, Homo sapiens
agcatctgcatattgggagacc

SEQ ID NO: 8379555 - DNA, 21 bp, Homo sapiens
agcagcagcagtggggcttct

SEQ ID NO: 8379556 - DNA, 21 bp, Homo sapiens
agcagcagcagtggggcttct

SEQ ID NO: 8379557 - DNA, 22 bp, Homo sapiens
agcagcagctcagttctcagct

SEQ ID NO: 8379558 - DNA, 22 bp, Homo sapiens
agcagcaactgctagagtggca

SEQ ID NO: 8379559 - DNA, 22 bp, Homo sapiens
agcagcaaagtattgggcaaga

SEQ ID NO: 8379560 - DNA, 22 bp, Homo sapiens
agcagaacattatctaggtctt

SEQ ID NO: 8379561 - DNA, 22 bp, Homo sapiens
agcagaaatgatggtatgggac

SEQ ID NO: 8379562 - DNA, 22 bp, Homo sapiens
agcagcagattatggtctacat

SEQ ID NO: 8379563 - DNA, 22 bp, Homo sapiens
agcagcagattcagcaggaatg

SEQ ID NO: 8379564 - DNA, 22 bp, Homo sapiens
agcagccagagtctgaacatta

SEQ ID NO: 8379565 - DNA, 23 bp, Homo sapiens
acacagaagaagacccaaggaag

SEQ ID NO: 8379566 - DNA, 22 bp, Homo sapiens
agcacttgtcaggcagctctat

SEQ ID NO: 8379567 - DNA, 22 bp, Homo sapiens
agcagaaaactttcatgctctg

SEQ ID NO: 8379568 - DNA, 22 bp, Homo sapiens
agcagaaaactttcatgctctg

SEQ ID NO: 8379569 - DNA, 22 bp, Homo sapiens
agcagaaacagccagtctggac

SEQ ID NO: 8379570 - DNA, 22 bp, Homo sapiens
agcagaaatagaagtcaatgat

SEQ ID NO: 8379571 - DNA, 22 bp, Homo sapiens
agcagaaatgatggtatgggac

SEQ ID NO: 8379572 - DNA, 22 bp, Homo sapiens
agcagaaacagccagtctggac

SEQ ID NO: 8379573 - DNA, 22 bp, Homo sapiens
agcagaaatagaagtcaatgat

SEQ ID NO: 8379574 - DNA, 20 bp, Homo sapiens
agcacttgctgtgtgccata

SEQ ID NO: 8379575 - DNA, 22 bp, Homo sapiens
acacactgagtgccataggacc

SEQ ID NO: 8379576 - DNA, 22 bp, Homo sapiens
agatttctgtcaccttctatgc

SEQ ID NO: 8379577 - DNA, 22 bp, Homo sapiens
agatttccgttctctcttcagt

SEQ ID NO: 8379578 - DNA, 22 bp, Homo sapiens
agcaggtgagcacagccaggct

SEQ ID NO: 8379579 - DNA, 22 bp, Homo sapiens
agcatccagatgcctgatgtca

SEQ ID NO: 8379580 - DNA, 22 bp, Homo sapiens
agcatccagaaaactctcagaa

SEQ ID NO: 8379581 - DNA, 22 bp, Homo sapiens
agcatcagtactaatctggcca

SEQ ID NO: 8379582 - DNA, 22 bp, Homo sapiens
agcatcagcctctgtcctggag

SEQ ID NO: 8379583 - DNA, 22 bp, Homo sapiens
agcaggtgacccaagcaggctg

SEQ ID NO: 8379584 - DNA, 22 bp, Homo sapiens
agcaggtgacccaagcaggctg

SEQ ID NO: 8379585 - DNA, 22 bp, Homo sapiens
agcaggtgacagggctgtggtg

SEQ ID NO: 8379586 - DNA, 22 bp, Homo sapiens
agcagggctgtgctccttccga

SEQ ID NO: 8379587 - DNA, 22 bp, Homo sapiens
agcagggctgtgctccttccga

SEQ ID NO: 8379588 - DNA, 22 bp, Homo sapiens
agcagggctgtgtaggtaatga

SEQ ID NO: 8379589 - DNA, 22 bp, Homo sapiens
agcagggcttctgtgcctgtgc

SEQ ID NO: 8379590 - DNA, 22 bp, Homo sapiens
agcagggcttgccgcttgtcct

SEQ ID NO: 8379591 - DNA, 22 bp, Homo sapiens
agcagggctttgcagacttggg

SEQ ID NO: 8379592 - DNA, 23 bp, Homo sapiens
agcaggcatctgtggcacaaggc

SEQ ID NO: 8379593 - DNA, 23 bp, Homo sapiens
agcaggcatctgtggcacaaggc

SEQ ID NO: 8379594 - DNA, 19 bp, Homo sapiens
agcaggcaggtggcccagg

SEQ ID NO: 8379595 - DNA, 22 bp, Homo sapiens
agcaggcatagagtagcactca

SEQ ID NO: 8379596 - DNA, 22 bp, Homo sapiens
agcagctctggcactgtagcat

SEQ ID NO: 8379597 - DNA, 22 bp, Homo sapiens
agcagctctggcactgtagcat

SEQ ID NO: 8379598 - DNA, 23 bp, Homo sapiens
agcagccatagggaagcaataca

SEQ ID NO: 8379599 - DNA, 22 bp, Homo sapiens
agcagcccaaacagactaagac

SEQ ID NO: 8379600 - DNA, 22 bp, Homo sapiens
agcagctcctctaggaacggat

SEQ ID NO: 8379601 - DNA, 22 bp, Homo sapiens
agcagctgagccccagctgtga

SEQ ID NO: 8379602 - DNA, 22 bp, Homo sapiens
agcaggagctgtgggaagatgg

SEQ ID NO: 8379603 - DNA, 22 bp, Homo sapiens
agcaggagctgtgggaagatgg

SEQ ID NO: 8379604 - DNA, 22 bp, Homo sapiens
agcaggaggagagcctggcggt

SEQ ID NO: 8379605 - DNA, 22 bp, Homo sapiens
agcaggagtgtcccctggctgt

SEQ ID NO: 8379606 - DNA, 22 bp, Homo sapiens
agcaggagggttttgtagagtc

SEQ ID NO: 8379607 - DNA, 22 bp, Homo sapiens
agcaggcaggctgccagtgaat

SEQ ID NO: 8379608 - DNA, 22 bp, Homo sapiens
agcaggagggttttgtagagtc

SEQ ID NO: 8379609 - DNA, 22 bp, Homo sapiens
agcaggagggttttgtagagtc

SEQ ID NO: 8379610 - DNA, 22 bp, Homo sapiens
acagtgtaatatgggagtcagt

SEQ ID NO: 8379611 - DNA, 22 bp, Homo sapiens
acagtggtgagtgactgatagg

SEQ ID NO: 8379612 - DNA, 22 bp, Homo sapiens
acagtggtaggataactgtttt

SEQ ID NO: 8379613 - DNA, 22 bp, Homo sapiens
acagtggtaggataactgtttt

SEQ ID NO: 8379614 - DNA, 22 bp, Homo sapiens
acagtgctgtcaaatatgtttt

SEQ ID NO: 8379615 - DNA, 22 bp, Homo sapiens
acagtgctcatgtgacatggtg

SEQ ID NO: 8379616 - DNA, 22 bp, Homo sapiens
acagtgtagcatggtagcaatg

SEQ ID NO: 8379617 - DNA, 22 bp, Homo sapiens
acagtgtatgatatttcacagt

SEQ ID NO: 8379618 - DNA, 22 bp, Homo sapiens
acagtttacagggatttgagct

SEQ ID NO: 8379619 - DNA, 22 bp, Homo sapiens
acagtttacagggatttgagct

SEQ ID NO: 8379620 - DNA, 22 bp, Homo sapiens
acagtttactggccttgccgtt

SEQ ID NO: 8379621 - DNA, 22 bp, Homo sapiens
acagtgtccccagctctgtgag

SEQ ID NO: 8379622 - DNA, 22 bp, Homo sapiens
acagtgtccttgtggtccctgt

SEQ ID NO: 8379623 - DNA, 22 bp, Homo sapiens
acagtgtccccagctctgtgag

SEQ ID NO: 8379624 - DNA, 22 bp, Homo sapiens
acagtgtcatgtcgtgttcccc

SEQ ID NO: 8379625 - DNA, 22 bp, Homo sapiens
acagtgtcatcagtttctcaac

SEQ ID NO: 8379626 - DNA, 22 bp, Homo sapiens
acagtgcgggctgcggtgggtc

SEQ ID NO: 8379627 - DNA, 22 bp, Homo sapiens
acagtgcattattgctgaatgc

SEQ ID NO: 8379628 - DNA, 20 bp, Homo sapiens
acagtgcatggggggacagc

SEQ ID NO: 8379629 - DNA, 19 bp, Homo sapiens
acagtgcatgggacctggt

SEQ ID NO: 8379630 - DNA, 22 bp, Homo sapiens
acagtgcagtgtgatgagtatt

SEQ ID NO: 8379631 - DNA, 22 bp, Homo sapiens
acagtgcataaaaacaactttt

SEQ ID NO: 8379632 - DNA, 22 bp, Homo sapiens
acagtctttctacattctgtgc

SEQ ID NO: 8379633 - DNA, 22 bp, Homo sapiens
acagtgcaggtctcaacaatta

SEQ ID NO: 8379634 - DNA, 22 bp, Homo sapiens
acaggtgtagcaggagcatcaa

SEQ ID NO: 8379635 - DNA, 22 bp, Homo sapiens
acaggtgtagcaggagcatcaa

SEQ ID NO: 8379636 - DNA, 22 bp, Homo sapiens
acaggtgtctaaggcagacagc

SEQ ID NO: 8379637 - DNA, 22 bp, Homo sapiens
acaggtagatacatacttctaa

SEQ ID NO: 8379638 - DNA, 22 bp, Homo sapiens
acaggtaggttaaaatgtgtca

SEQ ID NO: 8379639 - DNA, 23 bp, Homo sapiens
acagggaaaagtcatcagtgtga

SEQ ID NO: 8379640 - DNA, 22 bp, Homo sapiens
acaggcttttttgctctcgaat

SEQ ID NO: 8379641 - DNA, 22 bp, Homo sapiens
acaggctttggcgaggcccatc

SEQ ID NO: 8379642 - DNA, 22 bp, Homo sapiens
acaggtccttataagagcactc

SEQ ID NO: 8379643 - DNA, 22 bp, Homo sapiens
acaggtcaacgagagcaggcaa

SEQ ID NO: 8379644 - DNA, 22 bp, Homo sapiens
acaggtcagataaaggctggtg

SEQ ID NO: 8379645 - DNA, 22 bp, Homo sapiens
acaggcttactgtttcataggg

SEQ ID NO: 8379646 - DNA, 22 bp, Homo sapiens
acaggcttacaggctgcaagta

SEQ ID NO: 8379647 - DNA, 22 bp, Homo sapiens
acaggcagagtcaggttgggtt

SEQ ID NO: 8379648 - DNA, 22 bp, Homo sapiens
acaggcagagtcaggttgggtt

SEQ ID NO: 8379649 - DNA, 22 bp, Homo sapiens
acaggcagagagtggcggactc

SEQ ID NO: 8379650 - DNA, 22 bp, Homo sapiens
acaggcagagagtggcggactc

SEQ ID NO: 8379651 - DNA, 22 bp, Homo sapiens
acaggcagagagtggcggactc

SEQ ID NO: 8379652 - DNA, 22 bp, Homo sapiens
aagccctgactatgaagacata

SEQ ID NO: 8379653 - DNA, 22 bp, Homo sapiens
aagccctgagcactgcagagaa

SEQ ID NO: 8379654 - DNA, 22 bp, Homo sapiens
aagccctgataggaaaatgctg

SEQ ID NO: 8379655 - DNA, 22 bp, Homo sapiens
aagccctgcagtctctgccaca

SEQ ID NO: 8379656 - DNA, 22 bp, Homo sapiens
aagccctgccacccattcactg

SEQ ID NO: 8379657 - DNA, 22 bp, Homo sapiens
aagccctgcagtctctgccaca

SEQ ID NO: 8379658 - DNA, 22 bp, Homo sapiens
aagccctggcaatgtcagatga

SEQ ID NO: 8379659 - DNA, 22 bp, Homo sapiens
aagccctggattaaagatgcca

SEQ ID NO: 8379660 - DNA, 22 bp, Homo sapiens
aagccctggacggcccttcccc

SEQ ID NO: 8379661 - DNA, 22 bp, Homo sapiens
aagccctggatagagagaactg

SEQ ID NO: 8379662 - DNA, 22 bp, Homo sapiens
aagccctggaactttcctagcc

SEQ ID NO: 8379663 - DNA, 22 bp, Homo sapiens
aagccctggctcagctcaccag

SEQ ID NO: 8379664 - DNA, 22 bp, Homo sapiens
aagccctggcgggtggagggcc

SEQ ID NO: 8379665 - DNA, 22 bp, Homo sapiens
aagccctggcccaaccttgatt

SEQ ID NO: 8379666 - DNA, 19 bp, Homo sapiens
acaggcagaattgggtgtg

SEQ ID NO: 8379667 - DNA, 22 bp, Homo sapiens
acaggcagagaactcagccaga

SEQ ID NO: 8379668 - DNA, 22 bp, Homo sapiens
acaggcagagaactcagccaga

SEQ ID NO: 8379669 - DNA, 22 bp, Homo sapiens
acaggcactttgacatgccatc

SEQ ID NO: 8379670 - DNA, 22 bp, Homo sapiens
acaggcactgtcaagtcatgaa

SEQ ID NO: 8379671 - DNA, 22 bp, Homo sapiens
acaggcactgtcaagtcatgaa

SEQ ID NO: 8379672 - DNA, 22 bp, Homo sapiens
acaggagctctagggacagcac

SEQ ID NO: 8379673 - DNA, 22 bp, Homo sapiens
acaggaggagcagctgtgtgcc

SEQ ID NO: 8379674 - DNA, 22 bp, Homo sapiens
acaggaggagctgtttcaggga

SEQ ID NO: 8379675 - DNA, 22 bp, Homo sapiens
acaggaaattggcatatcagtt

SEQ ID NO: 8379676 - DNA, 22 bp, Homo sapiens
acaggaaattggcatatcagtt

SEQ ID NO: 8379677 - DNA, 22 bp, Homo sapiens
acaggaaccaggcaggtcgatt

SEQ ID NO: 8379678 - DNA, 22 bp, Homo sapiens
acaggaacagcttgatggcatc

SEQ ID NO: 8379679 - DNA, 21 bp, Homo sapiens
acaggagaccgcctggcagtc

SEQ ID NO: 8379680 - DNA, 22 bp, Homo sapiens
acaggaaagagctaggcatagg

SEQ ID NO: 8379681 - DNA, 22 bp, Homo sapiens
acaggaaagagctaggcatagg

SEQ ID NO: 8379682 - DNA, 22 bp, Homo sapiens
acagcttttgaaaaattactgg

SEQ ID NO: 8379683 - DNA, 22 bp, Homo sapiens
acagcttttatgggaccagcca

SEQ ID NO: 8379684 - DNA, 22 bp, Homo sapiens
acagatgaggaagagtcagcca

SEQ ID NO: 8379685 - DNA, 22 bp, Homo sapiens
acattttgcccttatttgctga

SEQ ID NO: 8379686 - DNA, 22 bp, Homo sapiens
acattttgcccttatttgctga

SEQ ID NO: 8379687 - DNA, 20 bp, Homo sapiens
acattttggcatactctcaa

SEQ ID NO: 8379688 - DNA, 22 bp, Homo sapiens
acattcttaacagttaaaaact

SEQ ID NO: 8379689 - DNA, 22 bp, Homo sapiens
acattcttaacagttaaaaact

SEQ ID NO: 8379690 - DNA, 22 bp, Homo sapiens
accacccacctcacagcatagt

SEQ ID NO: 8379691 - DNA, 22 bp, Homo sapiens
accaccccagaatttttcaagg

SEQ ID NO: 8379692 - DNA, 22 bp, Homo sapiens
accacccccttgggtgtggaag

SEQ ID NO: 8379693 - DNA, 18 bp, Homo sapiens
accacatgatatcttgcc

SEQ ID NO: 8379694 - DNA, 22 bp, Homo sapiens
aagggcagctgacagatgctta

SEQ ID NO: 8379695 - DNA, 22 bp, Homo sapiens
aagggcagctgacagatgctta

SEQ ID NO: 8379696 - DNA, 22 bp, Homo sapiens
aagggcagcctgactcacggtc

SEQ ID NO: 8379697 - DNA, 22 bp, Homo sapiens
aagggcagctattatcgtcatc

SEQ ID NO: 8379698 - DNA, 22 bp, Homo sapiens
aagggcagcctgactcacggtc

SEQ ID NO: 8379699 - DNA, 22 bp, Homo sapiens
aagggcagcttaaattggtagc

SEQ ID NO: 8379700 - DNA, 22 bp, Homo sapiens
aagggcagcttaaattggtagc

SEQ ID NO: 8379701 - DNA, 22 bp, Homo sapiens
accagctgccaagggctacact

SEQ ID NO: 8379702 - DNA, 22 bp, Homo sapiens
accagcagagttgaggaggaca

SEQ ID NO: 8379703 - DNA, 22 bp, Homo sapiens
accagcagagttgaggaggaca

SEQ ID NO: 8379704 - DNA, 22 bp, Homo sapiens
aaggtttctccgaggctatttt

SEQ ID NO: 8379705 - DNA, 22 bp, Homo sapiens
aaggtttccagtgatattgtgg

SEQ ID NO: 8379706 - DNA, 22 bp, Homo sapiens
aagtaaaagctttaccatgcgc

SEQ ID NO: 8379707 - DNA, 22 bp, Homo sapiens
aagtaaaattcaatcttcactg

SEQ ID NO: 8379708 - DNA, 22 bp, Homo sapiens
aagtaaaatgtttcctttatta

SEQ ID NO: 8379709 - DNA, 22 bp, Homo sapiens
aagtaaaatgtttcctttatta

SEQ ID NO: 8379710 - DNA, 22 bp, Homo sapiens
accaggcatgatgtggagcaca

SEQ ID NO: 8379711 - DNA, 22 bp, Homo sapiens
aaggtttccagtgatattgtgg

SEQ ID NO: 8379712 - DNA, 22 bp, Homo sapiens
accagctgtgtcctggctgcag

SEQ ID NO: 8379713 - DNA, 22 bp, Homo sapiens
accagctggtcacctgggcact

SEQ ID NO: 8379714 - DNA, 22 bp, Homo sapiens
accagctgttaggcttggtgct

SEQ ID NO: 8379715 - DNA, 22 bp, Homo sapiens
accagctgtgtgacctgaggca

SEQ ID NO: 8379716 - DNA, 22 bp, Homo sapiens
accaggcactcttgtggcagtg

SEQ ID NO: 8379717 - DNA, 22 bp, Homo sapiens
acatggtgagcggcaggcctat

SEQ ID NO: 8379718 - DNA, 22 bp, Homo sapiens
acatgtaaaaattaaggtaaga

SEQ ID NO: 8379719 - DNA, 22 bp, Homo sapiens
aaggccagcttgtagggctggt

SEQ ID NO: 8379720 - DNA, 22 bp, Homo sapiens
aaggccagcttgtagggctggt

SEQ ID NO: 8379721 - DNA, 22 bp, Homo sapiens
aaggccagcttgtagggctggt

SEQ ID NO: 8379722 - DNA, 22 bp, Homo sapiens
aaggccagggatgccagctcgg

SEQ ID NO: 8379723 - DNA, 22 bp, Homo sapiens
aaggccaggcctagcacggagg

SEQ ID NO: 8379724 - DNA, 22 bp, Homo sapiens
aaggccaggcagggagctgtga

SEQ ID NO: 8379725 - DNA, 22 bp, Homo sapiens
aaggccaggccagatgacagtc

SEQ ID NO: 8379726 - DNA, 22 bp, Homo sapiens
acattcaaccaatgtttgctat

SEQ ID NO: 8379727 - DNA, 22 bp, Homo sapiens
acattcaacatggctggtctag

SEQ ID NO: 8379728 - DNA, 22 bp, Homo sapiens
acattcaaaattaggttagttg

SEQ ID NO: 8379729 - DNA, 22 bp, Homo sapiens
acattcaaaattgtggtttaga

SEQ ID NO: 8379730 - DNA, 22 bp, Homo sapiens
acattcaaaattaggttagttg

SEQ ID NO: 8379731 - DNA, 22 bp, Homo sapiens
acattcaaaattgtggtttaga

SEQ ID NO: 8379732 - DNA, 22 bp, Homo sapiens
acattcaaaatatttctgatgt

SEQ ID NO: 8379733 - DNA, 22 bp, Homo sapiens
acattcaacatggctggtctag

SEQ ID NO: 8379734 - DNA, 22 bp, Homo sapiens
acattctcttcctaaatatact

SEQ ID NO: 8379735 - DNA, 22 bp, Homo sapiens
acattcaaaaagcatctgtcac

SEQ ID NO: 8379736 - DNA, 22 bp, Homo sapiens
acattcaaaaagcatctgtcac

SEQ ID NO: 8379737 - DNA, 22 bp, Homo sapiens
acattacttaccttgggttcta

SEQ ID NO: 8379738 - DNA, 22 bp, Homo sapiens
acattagaacattaatattggg

SEQ ID NO: 8379739 - DNA, 22 bp, Homo sapiens
acatagaaatttatttcttaca

SEQ ID NO: 8379740 - DNA, 22 bp, Homo sapiens
acatgccaagatcctcgtcttt

SEQ ID NO: 8379741 - DNA, 22 bp, Homo sapiens
acatgccaagatcctcgtcttt

SEQ ID NO: 8379742 - DNA, 22 bp, Homo sapiens
acatactttgtccttaacgtac

SEQ ID NO: 8379743 - DNA, 21 bp, Homo sapiens
acatgggacctgcgaaaggaa

SEQ ID NO: 8379744 - DNA, 22 bp, Homo sapiens
acataacactcttctctagtga

SEQ ID NO: 8379745 - DNA, 22 bp, Homo sapiens
acataataaaaataacagctca

SEQ ID NO: 8379746 - DNA, 22 bp, Homo sapiens
acatacattgcctcattggtaa

SEQ ID NO: 8379747 - DNA, 22 bp, Homo sapiens
acatacttaacattaaagtcat

SEQ ID NO: 8379748 - DNA, 22 bp, Homo sapiens
acatacattgcctcattggtaa

SEQ ID NO: 8379749 - DNA, 22 bp, Homo sapiens
aatcttggttgcagtatatccg

SEQ ID NO: 8379750 - DNA, 22 bp, Homo sapiens
aatcttacttatgatttttcgg

SEQ ID NO: 8379751 - DNA, 22 bp, Homo sapiens
aatcttaagctgaattctctcc

SEQ ID NO: 8379752 - DNA, 22 bp, Homo sapiens
aatcttaagctgaattctctcc

SEQ ID NO: 8379753 - DNA, 22 bp, Homo sapiens
aatcttaaagaatattctacca

SEQ ID NO: 8379754 - DNA, 22 bp, Homo sapiens
aatcttaaagaatattctacca

SEQ ID NO: 8379755 - DNA, 22 bp, Homo sapiens
aatcttaaagaatattctacca

SEQ ID NO: 8379756 - DNA, 22 bp, Homo sapiens
aatctgtgctccctgcatttgt

SEQ ID NO: 8379757 - DNA, 22 bp, Homo sapiens
agaaactaagtcataactcttt

SEQ ID NO: 8379758 - DNA, 22 bp, Homo sapiens
agaaactattatggtaaacaaa

SEQ ID NO: 8379759 - DNA, 22 bp, Homo sapiens
agaaactcatcctggagatgac

SEQ ID NO: 8379760 - DNA, 22 bp, Homo sapiens
agaaactcatcctggagatgac

SEQ ID NO: 8379761 - DNA, 22 bp, Homo sapiens
agaaactgaacacaagagtcgg

SEQ ID NO: 8379762 - DNA, 22 bp, Homo sapiens
aatctatatgcttttcacatac

SEQ ID NO: 8379763 - DNA, 22 bp, Homo sapiens
aatattcatttgcagaagaagt

SEQ ID NO: 8379764 - DNA, 22 bp, Homo sapiens
aatattcatttgcagaagaagt

SEQ ID NO: 8379765 - DNA, 22 bp, Homo sapiens
agaaaataatttcttggctggt

SEQ ID NO: 8379766 - DNA, 21 bp, Homo sapiens
agaaaatggcgttttagattt

SEQ ID NO: 8379767 - DNA, 21 bp, Homo sapiens
agaaaatggcgttttagattt

SEQ ID NO: 8379768 - DNA, 22 bp, Homo sapiens
agaaaattactccagagacaag

SEQ ID NO: 8379769 - DNA, 22 bp, Homo sapiens
aatatgcagcttatcttctagg

SEQ ID NO: 8379770 - DNA, 22 bp, Homo sapiens
aatatgcaaagcgtgttatctg

SEQ ID NO: 8379771 - DNA, 22 bp, Homo sapiens
aatatgcagcttatcttctagg

SEQ ID NO: 8379772 - DNA, 22 bp, Homo sapiens
aatatgttccacttaaagctgg

SEQ ID NO: 8379773 - DNA, 22 bp, Homo sapiens
aatattatcaaaagctttttca

SEQ ID NO: 8379774 - DNA, 22 bp, Homo sapiens
aatattatcaaaagctttttca

SEQ ID NO: 8379775 - DNA, 22 bp, Homo sapiens
aatattatcaaaagctttttca

SEQ ID NO: 8379776 - DNA, 22 bp, Homo sapiens
aatattcaagttattctttctt

SEQ ID NO: 8379777 - DNA, 22 bp, Homo sapiens
aatagaaaggaggggctcttgt

SEQ ID NO: 8379778 - DNA, 22 bp, Homo sapiens
aatactttgccaagttcgaaga

SEQ ID NO: 8379779 - DNA, 22 bp, Homo sapiens
aatactttgccaagttcgaaga

SEQ ID NO: 8379780 - DNA, 22 bp, Homo sapiens
aatacttgtcagatgaataaga

SEQ ID NO: 8379781 - DNA, 22 bp, Homo sapiens
aatacttgaatttcatgtcagg

SEQ ID NO: 8379782 - DNA, 22 bp, Homo sapiens
aatacttgaatttcatgtcagg

SEQ ID NO: 8379783 - DNA, 17 bp, Homo sapiens
aatacttccaactagtg

SEQ ID NO: 8379784 - DNA, 22 bp, Homo sapiens
aatactgtctttcacagatatt

SEQ ID NO: 8379785 - DNA, 22 bp, Homo sapiens
aatactgtatgagctatggtag

SEQ ID NO: 8379786 - DNA, 22 bp, Homo sapiens
aatactgctgcctgcaaattat

SEQ ID NO: 8379787 - DNA, 22 bp, Homo sapiens
aatactgctgctgctgaaatca

SEQ ID NO: 8379788 - DNA, 22 bp, Homo sapiens
aatactggactctcactattta

SEQ ID NO: 8379789 - DNA, 22 bp, Homo sapiens
actgtgggaaccactgaatcag

SEQ ID NO: 8379790 - DNA, 22 bp, Homo sapiens
actgtggataagtcagagatgt

SEQ ID NO: 8379791 - DNA, 22 bp, Homo sapiens
actgtggcaaagaagcaggctc

SEQ ID NO: 8379792 - DNA, 22 bp, Homo sapiens
actgtgctgctctccgcagccc

SEQ ID NO: 8379793 - DNA, 22 bp, Homo sapiens
acttcccactgcagtgactgag

SEQ ID NO: 8379794 - DNA, 22 bp, Homo sapiens
aatatcagctctgtcacttact

SEQ ID NO: 8379795 - DNA, 22 bp, Homo sapiens
aatatcagcacttttgtggtat

SEQ ID NO: 8379796 - DNA, 22 bp, Homo sapiens
aatatcttctaaggatagaact

SEQ ID NO: 8379797 - DNA, 22 bp, Homo sapiens
acttatctgcaattagtacata

SEQ ID NO: 8379798 - DNA, 22 bp, Homo sapiens
acttatctgcaattagtacata

SEQ ID NO: 8379799 - DNA, 22 bp, Homo sapiens
acttatgaggagaaaatatata

SEQ ID NO: 8379800 - DNA, 22 bp, Homo sapiens
acttatcttagttcatttgtat

SEQ ID NO: 8379801 - DNA, 22 bp, Homo sapiens
acttatttattcattcagctca

SEQ ID NO: 8379802 - DNA, 22 bp, Homo sapiens
acttagaattagtgtagaatga

SEQ ID NO: 8379803 - DNA, 22 bp, Homo sapiens
aagtgacataaaatctcccagg

SEQ ID NO: 8379804 - DNA, 22 bp, Homo sapiens
aagtgaatctcctttctttatt

SEQ ID NO: 8379805 - DNA, 22 bp, Homo sapiens
aagtgaaattgccattcttata

SEQ ID NO: 8379806 - DNA, 22 bp, Homo sapiens
aagtgaaattgccattcttata

SEQ ID NO: 8379807 - DNA, 23 bp, Homo sapiens
aagtgaacaggagctagatggtc

SEQ ID NO: 8379808 - DNA, 22 bp, Homo sapiens
aagtgaagaaatacatgagaat

SEQ ID NO: 8379809 - DNA, 22 bp, Homo sapiens
aagtgaagaaatacatgagaat

SEQ ID NO: 8379810 - DNA, 22 bp, Homo sapiens
accttgtgaggttacataatgt

SEQ ID NO: 8379811 - DNA, 20 bp, Homo sapiens
accttgggtgagtgacggtc

SEQ ID NO: 8379812 - DNA, 20 bp, Homo sapiens
accttgggtgagtgacggtc

SEQ ID NO: 8379813 - DNA, 22 bp, Homo sapiens
accttgttgtaggtacaaaaga

SEQ ID NO: 8379814 - DNA, 22 bp, Homo sapiens
acctttatcgccatcattgtgc

SEQ ID NO: 8379815 - DNA, 22 bp, Homo sapiens
acctttatatgaaagatgacat

SEQ ID NO: 8379816 - DNA, 22 bp, Homo sapiens
acctttatagcaacctggtgaa

SEQ ID NO: 8379817 - DNA, 22 bp, Homo sapiens
aagtgatttagtcttataaagg

SEQ ID NO: 8379818 - DNA, 22 bp, Homo sapiens
aagtgcaaatttaagaaggcat

SEQ ID NO: 8379819 - DNA, 18 bp, Homo sapiens
aagtgactggcaggccaa

SEQ ID NO: 8379820 - DNA, 22 bp, Homo sapiens
aagtgaggcctaggcactgggt

SEQ ID NO: 8379821 - DNA, 19 bp, Homo sapiens
accttctgggaaacattcc

SEQ ID NO: 8379822 - DNA, 22 bp, Homo sapiens
acctgggatggggccaggttta

SEQ ID NO: 8379823 - DNA, 18 bp, Homo sapiens
aagtaacagaagagcaca

SEQ ID NO: 8379824 - DNA, 18 bp, Homo sapiens
acctgcctgttcttctct

SEQ ID NO: 8379825 - DNA, 22 bp, Homo sapiens
aagtaaaccacagagaagccac

SEQ ID NO: 8379826 - DNA, 22 bp, Homo sapiens
aagtaaaatgtttcctttatta

SEQ ID NO: 8379827 - DNA, 22 bp, Homo sapiens
aataaatgttaagattgtctca

SEQ ID NO: 8379828 - DNA, 22 bp, Homo sapiens
aataacagagtcttcaagatag

SEQ ID NO: 8379829 - DNA, 22 bp, Homo sapiens
aataaaggcaccataaggcaaa

SEQ ID NO: 8379830 - DNA, 22 bp, Homo sapiens
aataaagtagcgtttaaggtgc

SEQ ID NO: 8379831 - DNA, 22 bp, Homo sapiens
actgagaagtcaggttctcttc

SEQ ID NO: 8379832 - DNA, 22 bp, Homo sapiens
actgagaagctcgcagtgatgc

SEQ ID NO: 8379833 - DNA, 22 bp, Homo sapiens
actgagaagctcgcagtgatgc

SEQ ID NO: 8379834 - DNA, 22 bp, Homo sapiens
actgagaagattctcactctta

SEQ ID NO: 8379835 - DNA, 22 bp, Homo sapiens
actgagaagattctcactctta

SEQ ID NO: 8379836 - DNA, 22 bp, Homo sapiens
actgactagacttacaacagag

SEQ ID NO: 8379837 - DNA, 22 bp, Homo sapiens
actgagaaatttccagacttgc

SEQ ID NO: 8379838 - DNA, 22 bp, Homo sapiens
actgagaaatttccagacttgc

SEQ ID NO: 8379839 - DNA, 22 bp, Homo sapiens
actgactttggaatatttctag

SEQ ID NO: 8379840 - DNA, 21 bp, Homo sapiens
aagttttatgttgccatttgt

SEQ ID NO: 8379841 - DNA, 22 bp, Homo sapiens
aagttttattggaacatagcca

SEQ ID NO: 8379842 - DNA, 22 bp, Homo sapiens
actgacactgactaagacagca

SEQ ID NO: 8379843 - DNA, 22 bp, Homo sapiens
aagttttattggctatagcact

SEQ ID NO: 8379844 - DNA, 22 bp, Homo sapiens
actcagagcagagcagcctgag

SEQ ID NO: 8379845 - DNA, 23 bp, Homo sapiens
actcatccttgatttgcagatgt

SEQ ID NO: 8379846 - DNA, 20 bp, Homo sapiens
actcatctactccagaccct

SEQ ID NO: 8379847 - DNA, 19 bp, Homo sapiens
actcatctgccacctctgt

SEQ ID NO: 8379848 - DNA, 22 bp, Homo sapiens
actcatctgactggtgggaatg

SEQ ID NO: 8379849 - DNA, 22 bp, Homo sapiens
actcatctgaaaaatgaggaga

SEQ ID NO: 8379850 - DNA, 22 bp, Homo sapiens
actcatctattagatatctgtt

SEQ ID NO: 8379851 - DNA, 18 bp, Homo sapiens
aagtggcacaggagtgca

SEQ ID NO: 8379852 - DNA, 22 bp, Homo sapiens
aagtggcacgctttttggagtt

SEQ ID NO: 8379853 - DNA, 22 bp, Homo sapiens
aagtggcagaatagtggcagga

SEQ ID NO: 8379854 - DNA, 22 bp, Homo sapiens
aagtggagctataggctcagat

SEQ ID NO: 8379855 - DNA, 22 bp, Homo sapiens
actcatgtaagcggaatgtagt

SEQ ID NO: 8379856 - DNA, 22 bp, Homo sapiens
actcatgtcctaggagtaaagc

SEQ ID NO: 8379857 - DNA, 23 bp, Homo sapiens
actcatcttctggtatccacagt

SEQ ID NO: 8379858 - DNA, 22 bp, Homo sapiens
actcatcttccctcctggaggg

SEQ ID NO: 8379859 - DNA, 22 bp, Homo sapiens
actcatctgccattcctgtacc

SEQ ID NO: 8379860 - DNA, 19 bp, Homo sapiens
actcatctttccagaatat

SEQ ID NO: 8379861 - DNA, 22 bp, Homo sapiens
actcatctttgaattttcagta

SEQ ID NO: 8379862 - DNA, 21 bp, Homo sapiens
actcatctttttggagaccag

SEQ ID NO: 8379863 - DNA, 21 bp, Homo sapiens
aagtttgttcttgtatagtct

SEQ ID NO: 8379864 - DNA, 22 bp, Homo sapiens
aagtttgttgtacatgttagta

SEQ ID NO: 8379865 - DNA, 22 bp, Homo sapiens
aagttttaacaagtacttacta

SEQ ID NO: 8379866 - DNA, 22 bp, Homo sapiens
aagtttgtctcatttgatcttc

SEQ ID NO: 8379867 - DNA, 22 bp, Homo sapiens
aagtttgtcgaaattatcagca

SEQ ID NO: 8379868 - DNA, 22 bp, Homo sapiens
aagtttgtggtcatttattata

SEQ ID NO: 8379869 - DNA, 22 bp, Homo sapiens
aagtttgtggtcatttattata

SEQ ID NO: 8379870 - DNA, 22 bp, Homo sapiens
aagtttgttcattcattcatcc

SEQ ID NO: 8379871 - DNA, 22 bp, Homo sapiens
aagtggcatgtataagaaagaa

SEQ ID NO: 8379872 - DNA, 22 bp, Homo sapiens
aagtggcagttcaggaagcaga

SEQ ID NO: 8379873 - DNA, 22 bp, Homo sapiens
aagtggcagccttagaaggaga

SEQ ID NO: 8379874 - DNA, 22 bp, Homo sapiens
aagtttctgaatttgaaaggat

SEQ ID NO: 8379875 - DNA, 21 bp, Homo sapiens
aagtttctccctaattgttgc

SEQ ID NO: 8379876 - DNA, 22 bp, Homo sapiens
aagtttctcagggttgattggg

SEQ ID NO: 8379877 - DNA, 22 bp, Homo sapiens
aagtttctcaatggcaactggg

SEQ ID NO: 8379878 - DNA, 22 bp, Homo sapiens
tccaggaggcagggctgtgccc

SEQ ID NO: 8379879 - DNA, 22 bp, Homo sapiens
tccaggccagggtaagaggaga

SEQ ID NO: 8379880 - DNA, 22 bp, Homo sapiens
tccaggccctgggatgggagca

SEQ ID NO: 8379881 - DNA, 21 bp, Homo sapiens
tccaggcctcaggaagggatg

SEQ ID NO: 8379882 - DNA, 22 bp, Homo sapiens
tccagggacctccctgagagct

SEQ ID NO: 8379883 - DNA, 22 bp, Homo sapiens
tccagggagagccgctgctcca

SEQ ID NO: 8379884 - DNA, 22 bp, Homo sapiens
tccagggagagccgctgctcca

SEQ ID NO: 8379885 - DNA, 22 bp, Homo sapiens
tccagggacctccctgagagct

SEQ ID NO: 8379886 - DNA, 22 bp, Homo sapiens
tccagggacctccctgagagct

SEQ ID NO: 8379887 - DNA, 22 bp, Homo sapiens
tccagggacagcgctggagcta

SEQ ID NO: 8379888 - DNA, 22 bp, Homo sapiens
tccagggacagtatagaggatc

SEQ ID NO: 8379889 - DNA, 22 bp, Homo sapiens
tccagggacagtatagaggatc

SEQ ID NO: 8379890 - DNA, 22 bp, Homo sapiens
tccagggagatactggctgcca

SEQ ID NO: 8379891 - DNA, 22 bp, Homo sapiens
tccagggagatactggctgcca

SEQ ID NO: 8379892 - DNA, 22 bp, Homo sapiens
tccagggagatggcagaggctg

SEQ ID NO: 8379893 - DNA, 22 bp, Homo sapiens
tccagggagatggcagaggctg

SEQ ID NO: 8379894 - DNA, 22 bp, Homo sapiens
tccagggagcaagtcaggccgg

SEQ ID NO: 8379895 - DNA, 22 bp, Homo sapiens
tccagggagcaagtcaggccgg

SEQ ID NO: 8379896 - DNA, 22 bp, Homo sapiens
tccagggagtcaaatgaactac

SEQ ID NO: 8379897 - DNA, 22 bp, Homo sapiens
tccagggagtcaaatgaactac

SEQ ID NO: 8379898 - DNA, 22 bp, Homo sapiens
tccagggatgccagccatgttg

SEQ ID NO: 8379899 - DNA, 22 bp, Homo sapiens
tccagggagttggctggatagt

SEQ ID NO: 8379900 - DNA, 22 bp, Homo sapiens
tccagggatctttagagtcttt

SEQ ID NO: 8379901 - DNA, 22 bp, Homo sapiens
tccagggatctttagagtcttt

SEQ ID NO: 8379902 - DNA, 22 bp, Homo sapiens
tccagggatgtcctgtagcact

SEQ ID NO: 8379903 - DNA, 22 bp, Homo sapiens
tccagggatgccagccatgttg

SEQ ID NO: 8379904 - DNA, 22 bp, Homo sapiens
tccagggatggtaatgagcagt

SEQ ID NO: 8379905 - DNA, 23 bp, Homo sapiens
tccagggattaatgaagtcagtc

SEQ ID NO: 8379906 - DNA, 22 bp, Homo sapiens
tccagggatgtcctgtagcact

SEQ ID NO: 8379907 - DNA, 22 bp, Homo sapiens
tccagtccatggcctcagtctt

SEQ ID NO: 8379908 - DNA, 22 bp, Homo sapiens
tcccacttaactgtgacttctc

SEQ ID NO: 8379909 - DNA, 22 bp, Homo sapiens
tcccactgtcttctcgtgctcg

SEQ ID NO: 8379910 - DNA, 22 bp, Homo sapiens
tcccactgtctgtcttgctgca

SEQ ID NO: 8379911 - DNA, 22 bp, Homo sapiens
tcccactgtgaatccaaggcct

SEQ ID NO: 8379912 - DNA, 22 bp, Homo sapiens
tcccactgtctgtcttgctgca

SEQ ID NO: 8379913 - DNA, 22 bp, Homo sapiens
tcccactggacgtctgtgctgg

SEQ ID NO: 8379914 - DNA, 22 bp, Homo sapiens
tcccactggacgtctgtgctgg

SEQ ID NO: 8379915 - DNA, 21 bp, Homo sapiens
tcccactgccacagcttcagg

SEQ ID NO: 8379916 - DNA, 22 bp, Homo sapiens
tcccactgctttgctctgctca

SEQ ID NO: 8379917 - DNA, 22 bp, Homo sapiens
tcccactgctttgctctgctca

SEQ ID NO: 8379918 - DNA, 22 bp, Homo sapiens
tcccactgagcccctgctggtg

SEQ ID NO: 8379919 - DNA, 22 bp, Homo sapiens
tcccactgagcccctgctggtg

SEQ ID NO: 8379920 - DNA, 19 bp, Homo sapiens
tccagtgtagctggtcatt

SEQ ID NO: 8379921 - DNA, 22 bp, Homo sapiens
tccagtgtacaaaagctatctt

SEQ ID NO: 8379922 - DNA, 22 bp, Homo sapiens
tccagtgtgtgtccagctgctg

SEQ ID NO: 8379923 - DNA, 22 bp, Homo sapiens
tccagtgtggtcaaaggggaat

SEQ ID NO: 8379924 - DNA, 23 bp, Homo sapiens
tccagtgtgtgcagattaagtgc

SEQ ID NO: 8379925 - DNA, 22 bp, Homo sapiens
tcccagagaaagtcaaggtctt

SEQ ID NO: 8379926 - DNA, 22 bp, Homo sapiens
tcccagagaaagtcaaggtctt

SEQ ID NO: 8379927 - DNA, 19 bp, Homo sapiens
tcccagagtctagaggttg

SEQ ID NO: 8379928 - DNA, 22 bp, Homo sapiens
tcccagagtgtgggcatcaagg

SEQ ID NO: 8379929 - DNA, 22 bp, Homo sapiens
tcccagagttcaatgggaaggt

SEQ ID NO: 8379930 - DNA, 22 bp, Homo sapiens
tcccagcagatgagctgaccta

SEQ ID NO: 8379931 - DNA, 22 bp, Homo sapiens
tcccagcagatgagctgaccta

SEQ ID NO: 8379932 - DNA, 22 bp, Homo sapiens
tcccagcctttcttttctgctg

SEQ ID NO: 8379933 - DNA, 22 bp, Homo sapiens
tcccagcagtcagagctatgtg

SEQ ID NO: 8379934 - DNA, 22 bp, Homo sapiens
tcccagagtttcctgtgtccca

SEQ ID NO: 8379935 - DNA, 22 bp, Homo sapiens
tcccagagttcaatgggaaggt

SEQ ID NO: 8379936 - DNA, 22 bp, Homo sapiens
tcccagcagatgagctgaccta

SEQ ID NO: 8379937 - DNA, 17 bp, Homo sapiens
tcccaggaacagggaat

SEQ ID NO: 8379938 - DNA, 22 bp, Homo sapiens
tcccaggatgtgcgtgccgccg

SEQ ID NO: 8379939 - DNA, 22 bp, Homo sapiens
tcccagcttagatttgctcatt

SEQ ID NO: 8379940 - DNA, 22 bp, Homo sapiens
tccacacttgctgtctgctgag

SEQ ID NO: 8379941 - DNA, 22 bp, Homo sapiens
tccacagaatgtaagatccaca

SEQ ID NO: 8379942 - DNA, 22 bp, Homo sapiens
tccacagaatggaattctccgc

SEQ ID NO: 8379943 - DNA, 22 bp, Homo sapiens
tccacagaatgtaagatccaca

SEQ ID NO: 8379944 - DNA, 22 bp, Homo sapiens
tccacagaccagtatctgcagc

SEQ ID NO: 8379945 - DNA, 22 bp, Homo sapiens
tccacagacgtgttattagttg

SEQ ID NO: 8379946 - DNA, 22 bp, Homo sapiens
tccacagactattaagtgatct

SEQ ID NO: 8379947 - DNA, 21 bp, Homo sapiens
tccacaatagggaaattcacc

SEQ ID NO: 8379948 - DNA, 22 bp, Homo sapiens
tcattaaatgtttgttgtgcca

SEQ ID NO: 8379949 - DNA, 22 bp, Homo sapiens
tccacagattaaaaacatactt

SEQ ID NO: 8379950 - DNA, 22 bp, Homo sapiens
tccacagatgcctttaggagta

SEQ ID NO: 8379951 - DNA, 22 bp, Homo sapiens
tccacagataaaaacagaggtt

SEQ ID NO: 8379952 - DNA, 22 bp, Homo sapiens
tccacagggatgcctgcggctt

SEQ ID NO: 8379953 - DNA, 22 bp, Homo sapiens
tccacagggatgcctgcggctt

SEQ ID NO: 8379954 - DNA, 22 bp, Homo sapiens
tcatgttttagtaaagtgaagg

SEQ ID NO: 8379955 - DNA, 22 bp, Homo sapiens
tcatgttttagctgcaaaatga

SEQ ID NO: 8379956 - DNA, 22 bp, Homo sapiens
tcatgtttgttggaaatgtggc

SEQ ID NO: 8379957 - DNA, 22 bp, Homo sapiens
tcatgtttctcttacagcagct

SEQ ID NO: 8379958 - DNA, 22 bp, Homo sapiens
tcatgttattgactcataatat

SEQ ID NO: 8379959 - DNA, 22 bp, Homo sapiens
tcatgtgtgtttcatgtatgga

SEQ ID NO: 8379960 - DNA, 22 bp, Homo sapiens
tcatgtgtgtttcatgtatgga

SEQ ID NO: 8379961 - DNA, 20 bp, Homo sapiens
tcatgtgtgtcctacagaga

SEQ ID NO: 8379962 - DNA, 18 bp, Homo sapiens
tcatggcttgcagatggt

SEQ ID NO: 8379963 - DNA, 22 bp, Homo sapiens
tcatggcttcaaggaagcaggc

SEQ ID NO: 8379964 - DNA, 18 bp, Homo sapiens
tcatggctttagtccctc

SEQ ID NO: 8379965 - DNA, 22 bp, Homo sapiens
tcatggctttttcactgttcgc

SEQ ID NO: 8379966 - DNA, 22 bp, Homo sapiens
tccacccagcacactgtggtag

SEQ ID NO: 8379967 - DNA, 19 bp, Homo sapiens
tccaccccagccagctctg

SEQ ID NO: 8379968 - DNA, 22 bp, Homo sapiens
tccacccccagacagctggtga

SEQ ID NO: 8379969 - DNA, 22 bp, Homo sapiens
tccaccacttcctgcagccatt

SEQ ID NO: 8379970 - DNA, 22 bp, Homo sapiens
tccaccagcagcctgtcagcct

SEQ ID NO: 8379971 - DNA, 22 bp, Homo sapiens
tccactctaattactaccttct

SEQ ID NO: 8379972 - DNA, 21 bp, Homo sapiens
tccagaaaagaggtcattagc

SEQ ID NO: 8379973 - DNA, 22 bp, Homo sapiens
tccacttttcttccatcatcat

SEQ ID NO: 8379974 - DNA, 22 bp, Homo sapiens
tccactggcccacctcctcagt

SEQ ID NO: 8379975 - DNA, 22 bp, Homo sapiens
tccactggaacaactctgaggc

SEQ ID NO: 8379976 - DNA, 22 bp, Homo sapiens
tccactgtgcagctctgctgat

SEQ ID NO: 8379977 - DNA, 22 bp, Homo sapiens
tccactgtggtcccttgctgcc

SEQ ID NO: 8379978 - DNA, 20 bp, Homo sapiens
tccacttactagctctgtga

SEQ ID NO: 8379979 - DNA, 22 bp, Homo sapiens
tccactggcctctgtctttcag

SEQ ID NO: 8379980 - DNA, 22 bp, Homo sapiens
tccagaaatgcaagccaggtgt

SEQ ID NO: 8379981 - DNA, 22 bp, Homo sapiens
tccagaaaattttacagtgcct

SEQ ID NO: 8379982 - DNA, 22 bp, Homo sapiens
tccagaaaattttacagtgcct

SEQ ID NO: 8379983 - DNA, 22 bp, Homo sapiens
tccagaaacttttccagtctca

SEQ ID NO: 8379984 - DNA, 22 bp, Homo sapiens
tccagaaactgctgagataaga

SEQ ID NO: 8379985 - DNA, 22 bp, Homo sapiens
tccaggaacagaatgttagtgc

SEQ ID NO: 8379986 - DNA, 21 bp, Homo sapiens
tccagcctttccctcacttcc

SEQ ID NO: 8379987 - DNA, 22 bp, Homo sapiens
tccaggaacgagaggctgggca

SEQ ID NO: 8379988 - DNA, 23 bp, Homo sapiens
tccagcctcttgctctcacatgc

SEQ ID NO: 8379989 - DNA, 19 bp, Homo sapiens
tccagcctgctgtttctct

SEQ ID NO: 8379990 - DNA, 22 bp, Homo sapiens
tccagcctggttgcgggcatcc

SEQ ID NO: 8379991 - DNA, 20 bp, Homo sapiens
tccaggaatggtagaggact

SEQ ID NO: 8379992 - DNA, 21 bp, Homo sapiens
tccaggaatgtctgttcatct

SEQ ID NO: 8379993 - DNA, 21 bp, Homo sapiens
tccaggaatgtctgttcatct

SEQ ID NO: 8379994 - DNA, 22 bp, Homo sapiens
tccaggaatgtgtgtgggctag

SEQ ID NO: 8379995 - DNA, 22 bp, Homo sapiens
tccaggacagagtagaagcagc

SEQ ID NO: 8379996 - DNA, 22 bp, Homo sapiens
tccaggaccaaagacacatgta

SEQ ID NO: 8379997 - DNA, 23 bp, Homo sapiens
tccaggagcatgctggctggcga

SEQ ID NO: 8379998 - DNA, 20 bp, Homo sapiens
tccaggagaactgggagccg

SEQ ID NO: 8379999 - DNA, 23 bp, Homo sapiens
tcctccctgacttctacagcaca

SEQ ID NO: 8380000 - DNA, 22 bp, Homo sapiens
tcctccctgagtggggacagct

SEQ ID NO: 8380001 - DNA, 22 bp, Homo sapiens
tcctccctgtaccattcctctg

SEQ ID NO: 8380002 - DNA, 22 bp, Homo sapiens
tcctccctgcactcagtgaagt

SEQ ID NO: 8380003 - DNA, 22 bp, Homo sapiens
tcctccagtgtctggggccttg

SEQ ID NO: 8380004 - DNA, 22 bp, Homo sapiens
tcctccaggtctagggtggctt

SEQ ID NO: 8380005 - DNA, 21 bp, Homo sapiens
tcctcctggccaggcggcccc

SEQ ID NO: 8380006 - DNA, 22 bp, Homo sapiens
tcctcctctatcagacagtgcc

SEQ ID NO: 8380007 - DNA, 22 bp, Homo sapiens
tcctcctctatcagacagtgcc

SEQ ID NO: 8380008 - DNA, 22 bp, Homo sapiens
tcctccacgatggcacacctgg

SEQ ID NO: 8380009 - DNA, 22 bp, Homo sapiens
tcctccacgtgagggcatacag

SEQ ID NO: 8380010 - DNA, 22 bp, Homo sapiens
tcctccactttgtctagcaaca

SEQ ID NO: 8380011 - DNA, 22 bp, Homo sapiens
tcctccacactctggactgttg

SEQ ID NO: 8380012 - DNA, 22 bp, Homo sapiens
tcctccaggcacctcactggct

SEQ ID NO: 8380013 - DNA, 22 bp, Homo sapiens
tccggcagcatctggagggatg

SEQ ID NO: 8380014 - DNA, 22 bp, Homo sapiens
tccggcagcagctctgaaggag

SEQ ID NO: 8380015 - DNA, 22 bp, Homo sapiens
tccgccaggactgagggcccat

SEQ ID NO: 8380016 - DNA, 22 bp, Homo sapiens
tccgccaggactgagggcccat

SEQ ID NO: 8380017 - DNA, 22 bp, Homo sapiens
tccctttcactactgtgttggt

SEQ ID NO: 8380018 - DNA, 22 bp, Homo sapiens
tccgggcaactgaagggaggtt

SEQ ID NO: 8380019 - DNA, 23 bp, Homo sapiens
tcctcagtatataaaggcagatg

SEQ ID NO: 8380020 - DNA, 22 bp, Homo sapiens
tcctcagtcacggtagcacatt

SEQ ID NO: 8380021 - DNA, 22 bp, Homo sapiens
tcctcagtgctagccaactgcc

SEQ ID NO: 8380022 - DNA, 19 bp, Homo sapiens
tcctcagtgacaacctcag

SEQ ID NO: 8380023 - DNA, 22 bp, Homo sapiens
tcctcagtggggcattcattat

SEQ ID NO: 8380024 - DNA, 22 bp, Homo sapiens
tcctcagttataaataggaaac

SEQ ID NO: 8380025 - DNA, 19 bp, Homo sapiens
tcccttctatagtaataaa

SEQ ID NO: 8380026 - DNA, 22 bp, Homo sapiens
tcccttcatcagtgagcaagcc

SEQ ID NO: 8380027 - DNA, 18 bp, Homo sapiens
tcccttctcccttgcctc

SEQ ID NO: 8380028 - DNA, 22 bp, Homo sapiens
tccctgtgtcttcctcttgccc

SEQ ID NO: 8380029 - DNA, 20 bp, Homo sapiens
tccctggggccctacttcct

SEQ ID NO: 8380030 - DNA, 22 bp, Homo sapiens
tccctgggcttctccagacttg

SEQ ID NO: 8380031 - DNA, 22 bp, Homo sapiens
tccctgggcggacattctccca

SEQ ID NO: 8380032 - DNA, 22 bp, Homo sapiens
tccctggggatgttggcctgcc

SEQ ID NO: 8380033 - DNA, 22 bp, Homo sapiens
tccctggggaagggcaagcaag

SEQ ID NO: 8380034 - DNA, 22 bp, Homo sapiens
tccctgaggaaggggtgtggtg

SEQ ID NO: 8380035 - DNA, 22 bp, Homo sapiens
tcccaggattttaggctctcag

SEQ ID NO: 8380036 - DNA, 22 bp, Homo sapiens
tcccaggattttaggctctcag

SEQ ID NO: 8380037 - DNA, 22 bp, Homo sapiens
tcccaggcaaaggcagctcatt

SEQ ID NO: 8380038 - DNA, 22 bp, Homo sapiens
tcccaggatgtttatggctggt

SEQ ID NO: 8380039 - DNA, 22 bp, Homo sapiens
tcccaggatgtttatggctggt

SEQ ID NO: 8380040 - DNA, 22 bp, Homo sapiens
tccctgccctcagtgcacccgg

SEQ ID NO: 8380041 - DNA, 22 bp, Homo sapiens
tccctgggccacagctgtgagc

SEQ ID NO: 8380042 - DNA, 20 bp, Homo sapiens
tcacatcctctcccaacatg

SEQ ID NO: 8380043 - DNA, 22 bp, Homo sapiens
tcacatctatacccaataattt

SEQ ID NO: 8380044 - DNA, 22 bp, Homo sapiens
tcacatctgaaaaaatattgag

SEQ ID NO: 8380045 - DNA, 23 bp, Homo sapiens
tcacatctgccgtagtgtattct

SEQ ID NO: 8380046 - DNA, 22 bp, Homo sapiens
tcacatcactagctggtaatga

SEQ ID NO: 8380047 - DNA, 22 bp, Homo sapiens
tcacatatttaagaaagttaaa

SEQ ID NO: 8380048 - DNA, 22 bp, Homo sapiens
tcacagctattctcatgtattt

SEQ ID NO: 8380049 - DNA, 23 bp, Homo sapiens
tcacatatgtagaagtggaattc

SEQ ID NO: 8380050 - DNA, 22 bp, Homo sapiens
tcacagcatttttagaaagatt

SEQ ID NO: 8380051 - DNA, 22 bp, Homo sapiens
tcacagcattgtcacaaggctg

SEQ ID NO: 8380052 - DNA, 22 bp, Homo sapiens
tcacagcattgtcacaaggctg

SEQ ID NO: 8380053 - DNA, 22 bp, Homo sapiens
tcacagcattgagtgtactaga

SEQ ID NO: 8380054 - DNA, 22 bp, Homo sapiens
tcacagcattgagtgtactaga

SEQ ID NO: 8380055 - DNA, 22 bp, Homo sapiens
tcacagcattcgcaatggacag

SEQ ID NO: 8380056 - DNA, 22 bp, Homo sapiens
tcacagcagtaaagaaaacact

SEQ ID NO: 8380057 - DNA, 22 bp, Homo sapiens
tcacagcagtaaagaaaacact

SEQ ID NO: 8380058 - DNA, 19 bp, Homo sapiens
tcacagcatctgtctgaac

SEQ ID NO: 8380059 - DNA, 19 bp, Homo sapiens
tcacagcatctgtctgaac

SEQ ID NO: 8380060 - DNA, 22 bp, Homo sapiens
tcacagcagggtaacaggaaga

SEQ ID NO: 8380061 - DNA, 22 bp, Homo sapiens
tcacagcaccaggatctctcca

SEQ ID NO: 8380062 - DNA, 22 bp, Homo sapiens
tcacagcaccaggatctctcca

SEQ ID NO: 8380063 - DNA, 22 bp, Homo sapiens
tcacagcacatggaccgagtcc

SEQ ID NO: 8380064 - DNA, 22 bp, Homo sapiens
tcacagcaaccctgaggcgagt

SEQ ID NO: 8380065 - DNA, 22 bp, Homo sapiens
tcacagcaacactggggcagac

SEQ ID NO: 8380066 - DNA, 22 bp, Homo sapiens
tcacagcagaatttaggaggca

SEQ ID NO: 8380067 - DNA, 22 bp, Homo sapiens
tcacagcaggcagatattgttg

SEQ ID NO: 8380068 - DNA, 22 bp, Homo sapiens
tcacagcaggcagatattgttg

SEQ ID NO: 8380069 - DNA, 22 bp, Homo sapiens
tcacagcaccctgaggtgctgg

SEQ ID NO: 8380070 - DNA, 22 bp, Homo sapiens
tcacagacactgggttattgca

SEQ ID NO: 8380071 - DNA, 22 bp, Homo sapiens
tcacagagagaatattgtgttt

SEQ ID NO: 8380072 - DNA, 22 bp, Homo sapiens
tcacagagcacacaagaattgc

SEQ ID NO: 8380073 - DNA, 22 bp, Homo sapiens
tcacagagttaaaagtttcttt

SEQ ID NO: 8380074 - DNA, 22 bp, Homo sapiens
tcacagagctcacagtttagca

SEQ ID NO: 8380075 - DNA, 22 bp, Homo sapiens
tcacagcaaaagtgtgcagagc

SEQ ID NO: 8380076 - DNA, 22 bp, Homo sapiens
tcacagcaaatgctgcttctca

SEQ ID NO: 8380077 - DNA, 22 bp, Homo sapiens
tcacagcaaatgctgcttctca

SEQ ID NO: 8380078 - DNA, 22 bp, Homo sapiens
tcacacataaaaagaagactag

SEQ ID NO: 8380079 - DNA, 22 bp, Homo sapiens
tcacacagggttctggtctcat

SEQ ID NO: 8380080 - DNA, 22 bp, Homo sapiens
tcacacaggtttgcaatgattt

SEQ ID NO: 8380081 - DNA, 22 bp, Homo sapiens
tcacacagtgagcggggctcag

SEQ ID NO: 8380082 - DNA, 22 bp, Homo sapiens
tcacacagtggtaaaaccctga

SEQ ID NO: 8380083 - DNA, 22 bp, Homo sapiens
tcacagaatttttgcttccagt

SEQ ID NO: 8380084 - DNA, 22 bp, Homo sapiens
tcacagaatgtcagagttgggg

SEQ ID NO: 8380085 - DNA, 22 bp, Homo sapiens
tcaatgattagagtttagtgtg

SEQ ID NO: 8380086 - DNA, 22 bp, Homo sapiens
tcaatagaaatgcagagtctca

SEQ ID NO: 8380087 - DNA, 22 bp, Homo sapiens
tcaatacttggcacactgcaca

SEQ ID NO: 8380088 - DNA, 22 bp, Homo sapiens
tcaatactaatcttgctggaag

SEQ ID NO: 8380089 - DNA, 22 bp, Homo sapiens
tcaaacatgaaagcttgatttt

SEQ ID NO: 8380090 - DNA, 22 bp, Homo sapiens
tcaaaccatataatcggttaca

SEQ ID NO: 8380091 - DNA, 22 bp, Homo sapiens
tcaaaccagccttgcatcccag

SEQ ID NO: 8380092 - DNA, 22 bp, Homo sapiens
tcaaaccaccttgttactgggg

SEQ ID NO: 8380093 - DNA, 22 bp, Homo sapiens
tcaaaaatggtctttgagctgc

SEQ ID NO: 8380094 - DNA, 22 bp, Homo sapiens
tcaaaagacacaggaggctagt

SEQ ID NO: 8380095 - DNA, 22 bp, Homo sapiens
tcaaaagacacaggaggctagt

SEQ ID NO: 8380096 - DNA, 20 bp, Homo sapiens
tcaaaataggtgtgggcgga

SEQ ID NO: 8380097 - DNA, 22 bp, Homo sapiens
tcaaaatgccgagtgcccaggt

SEQ ID NO: 8380098 - DNA, 18 bp, Homo sapiens
tcaaaatatttctgtgga

SEQ ID NO: 8380099 - DNA, 22 bp, Homo sapiens
tcacacagattggtagagctga

SEQ ID NO: 8380100 - DNA, 22 bp, Homo sapiens
tcacacagcttggagttatggt

SEQ ID NO: 8380101 - DNA, 22 bp, Homo sapiens
tcacacagggtcggaaagagtg

SEQ ID NO: 8380102 - DNA, 22 bp, Homo sapiens
tcacacagattggtagagctga

SEQ ID NO: 8380103 - DNA, 22 bp, Homo sapiens
tcacacacatggatagtatttt

SEQ ID NO: 8380104 - DNA, 22 bp, Homo sapiens
tcaatgtcagctggtaggaaat

SEQ ID NO: 8380105 - DNA, 22 bp, Homo sapiens
tcaatgtgaattaagaatactt

SEQ ID NO: 8380106 - DNA, 22 bp, Homo sapiens
tcaattatgccattgcaatatt

SEQ ID NO: 8380107 - DNA, 22 bp, Homo sapiens
tcaattcagtccaacagtaatt

SEQ ID NO: 8380108 - DNA, 22 bp, Homo sapiens
tcaattattttggctatgctaa

SEQ ID NO: 8380109 - DNA, 22 bp, Homo sapiens
tcaattatttgatatgaaaggg

SEQ ID NO: 8380110 - DNA, 22 bp, Homo sapiens
tcaattctgcctctaaatattt

SEQ ID NO: 8380111 - DNA, 22 bp, Homo sapiens
tcaattctgcatacatttcact

SEQ ID NO: 8380112 - DNA, 22 bp, Homo sapiens
tcagaagcatgtggggagcctg

SEQ ID NO: 8380113 - DNA, 22 bp, Homo sapiens
tcagaagcatgtggggagcctg

SEQ ID NO: 8380114 - DNA, 22 bp, Homo sapiens
tcagagaagtaaggtggggtgc

SEQ ID NO: 8380115 - DNA, 22 bp, Homo sapiens
tcagagaaggtaagtgacctgc

SEQ ID NO: 8380116 - DNA, 23 bp, Homo sapiens
tcagagaagttgtaggctgggga

SEQ ID NO: 8380117 - DNA, 23 bp, Homo sapiens
tcagagaataattctgatagact

SEQ ID NO: 8380118 - DNA, 23 bp, Homo sapiens
tcagagaagttgtaggctgggga

SEQ ID NO: 8380119 - DNA, 23 bp, Homo sapiens
tcagagaagttgtaggctgggga

SEQ ID NO: 8380120 - DNA, 22 bp, Homo sapiens
tcagagaattctcagatgactc

SEQ ID NO: 8380121 - DNA, 22 bp, Homo sapiens
tcagagacaccagagagctgtg

SEQ ID NO: 8380122 - DNA, 22 bp, Homo sapiens
tcagagacaccagagagctgtg

SEQ ID NO: 8380123 - DNA, 22 bp, Homo sapiens
tcagagaattctcagatgactc

SEQ ID NO: 8380124 - DNA, 22 bp, Homo sapiens
tcagagaatgtccttcttcatt

SEQ ID NO: 8380125 - DNA, 22 bp, Homo sapiens
tcagagaatctctccttagttt

SEQ ID NO: 8380126 - DNA, 22 bp, Homo sapiens
tcagagaatccgtaagtcacaa

SEQ ID NO: 8380127 - DNA, 22 bp, Homo sapiens
tcagagaatccgtaagtcacaa

SEQ ID NO: 8380128 - DNA, 22 bp, Homo sapiens
tcagagaatgtccttcttcatt

SEQ ID NO: 8380129 - DNA, 23 bp, Homo sapiens
tcagagaatggtatgcttttcct

SEQ ID NO: 8380130 - DNA, 21 bp, Homo sapiens
tcagagaatggcctactctca

SEQ ID NO: 8380131 - DNA, 22 bp, Homo sapiens
tcagaacattgacattcttatt

SEQ ID NO: 8380132 - DNA, 22 bp, Homo sapiens
tcagaacattgacattcttatt

SEQ ID NO: 8380133 - DNA, 21 bp, Homo sapiens
tcagaactggtgcagatgaat

SEQ ID NO: 8380134 - DNA, 22 bp, Homo sapiens
tcagaactggtatttatcaagg

SEQ ID NO: 8380135 - DNA, 22 bp, Homo sapiens
tcagaagaagagactccacagc

SEQ ID NO: 8380136 - DNA, 22 bp, Homo sapiens
tcagaagaaagatgttattact

SEQ ID NO: 8380137 - DNA, 22 bp, Homo sapiens
tcagaagaaaagacttttagag

SEQ ID NO: 8380138 - DNA, 22 bp, Homo sapiens
tcagaagataaagctttttgtt

SEQ ID NO: 8380139 - DNA, 22 bp, Homo sapiens
tcagaagagctggtgctgcctg

SEQ ID NO: 8380140 - DNA, 22 bp, Homo sapiens
tcagaagagctggtgctgcctg

SEQ ID NO: 8380141 - DNA, 22 bp, Homo sapiens
tcagaagagtaatagggtgaga

SEQ ID NO: 8380142 - DNA, 22 bp, Homo sapiens
tcagaagactactaggacacat

SEQ ID NO: 8380143 - DNA, 21 bp, Homo sapiens
tcagaagagctgcctcttggt

SEQ ID NO: 8380144 - DNA, 22 bp, Homo sapiens
tcagagacatcaggttgtagca

SEQ ID NO: 8380145 - DNA, 22 bp, Homo sapiens
tcagagacagttctggggcagg

SEQ ID NO: 8380146 - DNA, 22 bp, Homo sapiens
tcagagacaccattttctttct

SEQ ID NO: 8380147 - DNA, 22 bp, Homo sapiens
tcagagacaccattttctttct

SEQ ID NO: 8380148 - DNA, 22 bp, Homo sapiens
tcagagacagtattggctattg

SEQ ID NO: 8380149 - DNA, 22 bp, Homo sapiens
tcagagacagtattggctattg

SEQ ID NO: 8380150 - DNA, 22 bp, Homo sapiens
tcagagacctagcaagaaattg

SEQ ID NO: 8380151 - DNA, 22 bp, Homo sapiens
tcagagactggtctgcagatgc

SEQ ID NO: 8380152 - DNA, 22 bp, Homo sapiens
tcagagactgtaggagcagcct

SEQ ID NO: 8380153 - DNA, 22 bp, Homo sapiens
tcagagactggtctgcagatgc

SEQ ID NO: 8380154 - DNA, 22 bp, Homo sapiens
tcagagagcctcaggcactgcc

SEQ ID NO: 8380155 - DNA, 22 bp, Homo sapiens
tcagagagctggtgggcagagg

SEQ ID NO: 8380156 - DNA, 22 bp, Homo sapiens
tcagaggaccttactgagaacc

SEQ ID NO: 8380157 - DNA, 22 bp, Homo sapiens
tcagaggacaagctccctggtg

SEQ ID NO: 8380158 - DNA, 22 bp, Homo sapiens
tcagaggaatctgtacttgaaa

SEQ ID NO: 8380159 - DNA, 22 bp, Homo sapiens
tcagaggagaccaaggggaata

SEQ ID NO: 8380160 - DNA, 22 bp, Homo sapiens
tcagaggagaagttgggaaaat

SEQ ID NO: 8380161 - DNA, 22 bp, Homo sapiens
tcagaggacgcactagggttgt

SEQ ID NO: 8380162 - DNA, 22 bp, Homo sapiens
tcagaggattgcctcagcgagc

SEQ ID NO: 8380163 - DNA, 22 bp, Homo sapiens
tcactggatcctagctgagcct

SEQ ID NO: 8380164 - DNA, 23 bp, Homo sapiens
tcactaaagtgtttagtgcagat

SEQ ID NO: 8380165 - DNA, 22 bp, Homo sapiens
tcactaaagttggagaagagct

SEQ ID NO: 8380166 - DNA, 22 bp, Homo sapiens
tcactacaacctccgcctcctg

SEQ ID NO: 8380167 - DNA, 22 bp, Homo sapiens
tcactgctttgagccactgagc

SEQ ID NO: 8380168 - DNA, 22 bp, Homo sapiens
tcactggaaatgcacagctgta

SEQ ID NO: 8380169 - DNA, 22 bp, Homo sapiens
tcactggggcccacatcaacat

SEQ ID NO: 8380170 - DNA, 21 bp, Homo sapiens
tcactgtgcaaatgttgatgg

SEQ ID NO: 8380171 - DNA, 23 bp, Homo sapiens
tcagaacagttcttggtgcatag

SEQ ID NO: 8380172 - DNA, 22 bp, Homo sapiens
tcacatctgtgtgattgtcatt

SEQ ID NO: 8380173 - DNA, 22 bp, Homo sapiens
tcacatgaggttatgacaaagc

SEQ ID NO: 8380174 - DNA, 18 bp, Homo sapiens
tcacatgacagctgttgc

SEQ ID NO: 8380175 - DNA, 22 bp, Homo sapiens
tcacccagggactgtgatggaa

SEQ ID NO: 8380176 - DNA, 22 bp, Homo sapiens
tcacggacctaagaggaagatt

SEQ ID NO: 8380177 - DNA, 22 bp, Homo sapiens
tcacggacctaagaggaagatt

SEQ ID NO: 8380178 - DNA, 22 bp, Homo sapiens
tcacctcaccacccttatggtt

SEQ ID NO: 8380179 - DNA, 22 bp, Homo sapiens
tcaccgaggctggagtgcagtg

SEQ ID NO: 8380180 - DNA, 22 bp, Homo sapiens
tcaccggcagacgtggcctgat

SEQ ID NO: 8380181 - DNA, 22 bp, Homo sapiens
tcacccctacatttcccttgct

SEQ ID NO: 8380182 - DNA, 22 bp, Homo sapiens
tcacccctccattctctcatgt

SEQ ID NO: 8380183 - DNA, 22 bp, Homo sapiens
tcacccctaccaaggagcactg

SEQ ID NO: 8380184 - DNA, 22 bp, Homo sapiens
tcaccccttgtgaatgctgctc

SEQ ID NO: 8380185 - DNA, 22 bp, Homo sapiens
tcacccctggcccagtcttgga

SEQ ID NO: 8380186 - DNA, 22 bp, Homo sapiens
tcaggcctttgaacttggagtg

SEQ ID NO: 8380187 - DNA, 22 bp, Homo sapiens
tcaggcctttcttcagagcttc

SEQ ID NO: 8380188 - DNA, 22 bp, Homo sapiens
tcaggctctcagaccaacagca

SEQ ID NO: 8380189 - DNA, 22 bp, Homo sapiens
tcaggctctacacttgacacac

SEQ ID NO: 8380190 - DNA, 22 bp, Homo sapiens
tcaggctccctgctgggctctg

SEQ ID NO: 8380191 - DNA, 22 bp, Homo sapiens
tcaggctcaggttaggggccaa

SEQ ID NO: 8380192 - DNA, 22 bp, Homo sapiens
tcaggctccctgctgggctctg

SEQ ID NO: 8380193 - DNA, 22 bp, Homo sapiens
tcaggctctgagctgatgctaa

SEQ ID NO: 8380194 - DNA, 22 bp, Homo sapiens
tcaggctgaaaggactccagtt

SEQ ID NO: 8380195 - DNA, 22 bp, Homo sapiens
tcagggagaggtgagagcctgt

SEQ ID NO: 8380196 - DNA, 22 bp, Homo sapiens
tcagggcaaaagggaaaccatt

SEQ ID NO: 8380197 - DNA, 22 bp, Homo sapiens
tcagggactgcagagggaagct

SEQ ID NO: 8380198 - DNA, 22 bp, Homo sapiens
tcagggcacattctgcagtggc

SEQ ID NO: 8380199 - DNA, 22 bp, Homo sapiens
tcagggcaccaaaaaagatgcc

SEQ ID NO: 8380200 - DNA, 22 bp, Homo sapiens
tcagggcacaggcctgtgggtt

SEQ ID NO: 8380201 - DNA, 22 bp, Homo sapiens
tcagggcaagtctcagaaggtt

SEQ ID NO: 8380202 - DNA, 22 bp, Homo sapiens
tcagggcaagattggttaataa

SEQ ID NO: 8380203 - DNA, 22 bp, Homo sapiens
tcagggcaaagggcagagtttg

SEQ ID NO: 8380204 - DNA, 22 bp, Homo sapiens
tcagggcagcctaaggcacctc

SEQ ID NO: 8380205 - DNA, 22 bp, Homo sapiens
tcagggcacgtttctgcaatgc

SEQ ID NO: 8380206 - DNA, 22 bp, Homo sapiens
tcagggcagaatccaaagaatt

SEQ ID NO: 8380207 - DNA, 22 bp, Homo sapiens
tcagggcagaatccaaagaatt

SEQ ID NO: 8380208 - DNA, 22 bp, Homo sapiens
tcaggtcctctgggtcccagcc

SEQ ID NO: 8380209 - DNA, 22 bp, Homo sapiens
tcagtgcattaataatatcagt

SEQ ID NO: 8380210 - DNA, 22 bp, Homo sapiens
tcagtgcatggacagatttaga

SEQ ID NO: 8380211 - DNA, 22 bp, Homo sapiens
tcagggtatgttctagatctga

SEQ ID NO: 8380212 - DNA, 22 bp, Homo sapiens
tcaggtagtggttaagttctgt

SEQ ID NO: 8380213 - DNA, 22 bp, Homo sapiens
tcaggtcaggaaaataagattg

SEQ ID NO: 8380214 - DNA, 20 bp, Homo sapiens
tcaggtagatctttgaggtc

SEQ ID NO: 8380215 - DNA, 22 bp, Homo sapiens
tcatcccagaccacttattttc

SEQ ID NO: 8380216 - DNA, 22 bp, Homo sapiens
tcatcccagtgtccatgctcag

SEQ ID NO: 8380217 - DNA, 22 bp, Homo sapiens
tcatccagttgtggagagggaa

SEQ ID NO: 8380218 - DNA, 20 bp, Homo sapiens
tcatccagttggtttatggt

SEQ ID NO: 8380219 - DNA, 22 bp, Homo sapiens
tcatctaagagtcttacattta

SEQ ID NO: 8380220 - DNA, 22 bp, Homo sapiens
tcatcctgtctcactttttgct

SEQ ID NO: 8380221 - DNA, 22 bp, Homo sapiens
tcatctaagagtcttacattta

SEQ ID NO: 8380222 - DNA, 22 bp, Homo sapiens
tcatcgtgctgctctgtccata

SEQ ID NO: 8380223 - DNA, 20 bp, Homo sapiens
tcatccaggacaggagtggc

SEQ ID NO: 8380224 - DNA, 22 bp, Homo sapiens
tcatcaaaggattgcatgattt

SEQ ID NO: 8380225 - DNA, 20 bp, Homo sapiens
tcataaagaggaaataaata

SEQ ID NO: 8380226 - DNA, 21 bp, Homo sapiens
tcatatttctcttgctattgt

SEQ ID NO: 8380227 - DNA, 22 bp, Homo sapiens
tcataaagatactaagtgagtt

SEQ ID NO: 8380228 - DNA, 22 bp, Homo sapiens
tcataaaagtactcatgttcat

SEQ ID NO: 8380229 - DNA, 22 bp, Homo sapiens
tcataaaagtactcatgttcat

SEQ ID NO: 8380230 - DNA, 22 bp, Homo sapiens
tcataaaagtactcatgttcat

SEQ ID NO: 8380231 - DNA, 22 bp, Homo sapiens
tcataaaagtactcatgttcat

SEQ ID NO: 8380232 - DNA, 22 bp, Homo sapiens
tcataaaagtactcatgttcat

SEQ ID NO: 8380233 - DNA, 22 bp, Homo sapiens
tcataaaatgctcctgatattg

SEQ ID NO: 8380234 - DNA, 22 bp, Homo sapiens
tcagtggattgtagaaggctta

SEQ ID NO: 8380235 - DNA, 22 bp, Homo sapiens
tcagtggagctaagcatgagat

SEQ ID NO: 8380236 - DNA, 22 bp, Homo sapiens
tcagttactcaacagaggtgga

SEQ ID NO: 8380237 - DNA, 22 bp, Homo sapiens
tcagtggtaccaagggggctgg

SEQ ID NO: 8380238 - DNA, 22 bp, Homo sapiens
tcagttactcctttccttaggt

SEQ ID NO: 8380239 - DNA, 22 bp, Homo sapiens
tcagtggtatgcgtgggagctg

SEQ ID NO: 8380240 - DNA, 22 bp, Homo sapiens
tcagttagggcctcagaagaca

SEQ ID NO: 8380241 - DNA, 22 bp, Homo sapiens
tcagttactctgatgtcctgtg

SEQ ID NO: 8380242 - DNA, 21 bp, Homo sapiens
tcagttactgagagagaagtg

SEQ ID NO: 8380243 - DNA, 22 bp, Homo sapiens
tcagttacttgcttgtttgaaa

SEQ ID NO: 8380244 - DNA, 22 bp, Homo sapiens
tcagtgcttcctggaggaagcc

SEQ ID NO: 8380245 - DNA, 22 bp, Homo sapiens
tcagtttgaatgttagcacagt

SEQ ID NO: 8380246 - DNA, 22 bp, Homo sapiens
tcagtttgctcataggtgaggg

SEQ ID NO: 8380247 - DNA, 22 bp, Homo sapiens
tcagttttaaggtttgagaatt

SEQ ID NO: 8380248 - DNA, 22 bp, Homo sapiens
tcagttctaacagtttagaaca

SEQ ID NO: 8380249 - DNA, 22 bp, Homo sapiens
tcagttttgtatgttgtaagtc

SEQ ID NO: 8380250 - DNA, 22 bp, Homo sapiens
tcagttttgaaaacattgaatg

SEQ ID NO: 8380251 - DNA, 22 bp, Homo sapiens
tcataaaaatagactctaaagt

SEQ ID NO: 8380252 - DNA, 22 bp, Homo sapiens
tcataaaacacaccaggtagtt

SEQ ID NO: 8380253 - DNA, 21 bp, Homo sapiens
tcagagggccctggaggctca

SEQ ID NO: 8380254 - DNA, 22 bp, Homo sapiens
tcagagggtggctgggagcatc

SEQ ID NO: 8380255 - DNA, 22 bp, Homo sapiens
tcagaggtgcaagaagttctga

SEQ ID NO: 8380256 - DNA, 22 bp, Homo sapiens
tcagaggtcagcagcttgccca

SEQ ID NO: 8380257 - DNA, 22 bp, Homo sapiens
tcagagtgaccttacatggtct

SEQ ID NO: 8380258 - DNA, 22 bp, Homo sapiens
tcagagtcttggcaataggtta

SEQ ID NO: 8380259 - DNA, 22 bp, Homo sapiens
tcagagtcttaactattcagag

SEQ ID NO: 8380260 - DNA, 22 bp, Homo sapiens
tcagagtcctcaccctgaggat

SEQ ID NO: 8380261 - DNA, 22 bp, Homo sapiens
tcagagtccatggtacttaatt

SEQ ID NO: 8380262 - DNA, 22 bp, Homo sapiens
tcagaggttacccatgggacag

SEQ ID NO: 8380263 - DNA, 22 bp, Homo sapiens
tcagagtcattgcaagtagaag

SEQ ID NO: 8380264 - DNA, 22 bp, Homo sapiens
tcagccaggccaggcattcaca

SEQ ID NO: 8380265 - DNA, 22 bp, Homo sapiens
tcagctgtatcagaaatacaat

SEQ ID NO: 8380266 - DNA, 22 bp, Homo sapiens
tcagctttccttgctttagatt

SEQ ID NO: 8380267 - DNA, 22 bp, Homo sapiens
tcagccagttgccccagttagt

SEQ ID NO: 8380268 - DNA, 20 bp, Homo sapiens
tcagccattccttacctttc

SEQ ID NO: 8380269 - DNA, 22 bp, Homo sapiens
tcagcctccgaaagtgctggga

SEQ ID NO: 8380270 - DNA, 22 bp, Homo sapiens
tcagcccttcctggagctttta

SEQ ID NO: 8380271 - DNA, 22 bp, Homo sapiens
tcagcccttcctggagctttta

SEQ ID NO: 8380272 - DNA, 22 bp, Homo sapiens
tcagcctcattttctgctctgt

SEQ ID NO: 8380273 - DNA, 22 bp, Homo sapiens
tcaggcagctccaggaatggta

SEQ ID NO: 8380274 - DNA, 22 bp, Homo sapiens
tcaggcagctccaggaatggta

SEQ ID NO: 8380275 - DNA, 22 bp, Homo sapiens
tcaggcagatgcagggatggat

SEQ ID NO: 8380276 - DNA, 22 bp, Homo sapiens
tcaggaggtccgcccgggaggg

SEQ ID NO: 8380277 - DNA, 22 bp, Homo sapiens
tcaggcagtagaattgcttgaa

SEQ ID NO: 8380278 - DNA, 22 bp, Homo sapiens
tcaggccttgtcctgacctcct

SEQ ID NO: 8380279 - DNA, 22 bp, Homo sapiens
tcaggcaggttggctgcaggtc

SEQ ID NO: 8380280 - DNA, 22 bp, Homo sapiens
tcaggcaggttggctgcaggtc

SEQ ID NO: 8380281 - DNA, 22 bp, Homo sapiens
tcaggcaggctcagaggaaaac

SEQ ID NO: 8380282 - DNA, 22 bp, Homo sapiens
tcaggcaggctcagaggaaaac

SEQ ID NO: 8380283 - DNA, 22 bp, Homo sapiens
tcaggcaggctcagaggaaaac

SEQ ID NO: 8380284 - DNA, 22 bp, Homo sapiens
tcaggcaggcagagggcaaatg

SEQ ID NO: 8380285 - DNA, 22 bp, Homo sapiens
tcaggcaggcagagggcaaatg

SEQ ID NO: 8380286 - DNA, 21 bp, Homo sapiens
tcaggcaggcgcagagggaag

SEQ ID NO: 8380287 - DNA, 21 bp, Homo sapiens
tcaggcaggcgcagagggaag

SEQ ID NO: 8380288 - DNA, 21 bp, Homo sapiens
tcaggcaggcgcagagggaag

SEQ ID NO: 8380289 - DNA, 22 bp, Homo sapiens
tcaggcaggatcccagggaagg

SEQ ID NO: 8380290 - DNA, 22 bp, Homo sapiens
tcaggcaggaagggaggacttg

SEQ ID NO: 8380291 - DNA, 22 bp, Homo sapiens
tcaggcaggaagggaggacttg

SEQ ID NO: 8380292 - DNA, 22 bp, Homo sapiens
tcaggagcagggggaagctctg

SEQ ID NO: 8380293 - DNA, 22 bp, Homo sapiens
tcaggagcctgaaagaggtcta

SEQ ID NO: 8380294 - DNA, 22 bp, Homo sapiens
tcaggagctgtgaatacaaagg

SEQ ID NO: 8380295 - DNA, 22 bp, Homo sapiens
tcaggagctcaggctgatggaa

SEQ ID NO: 8380296 - DNA, 22 bp, Homo sapiens
tcaggagggagtgtggatagag

SEQ ID NO: 8380297 - DNA, 22 bp, Homo sapiens
tcaggagggtgacaggccctgg

SEQ ID NO: 8380298 - DNA, 22 bp, Homo sapiens
tcaggagggtgacaggccctgg

SEQ ID NO: 8380299 - DNA, 22 bp, Homo sapiens
tcaggaaagtgttctcagagga

SEQ ID NO: 8380300 - DNA, 22 bp, Homo sapiens
tcaggaaatggaattcttgtgt

SEQ ID NO: 8380301 - DNA, 22 bp, Homo sapiens
tcaggaaagcctagaagagaac

SEQ ID NO: 8380302 - DNA, 22 bp, Homo sapiens
tcaggaaaggcagagtgtctgt

SEQ ID NO: 8380303 - DNA, 22 bp, Homo sapiens
tcaggaaagagttagatgatta

SEQ ID NO: 8380304 - DNA, 22 bp, Homo sapiens
tcaggaaagagtaatgtataca

SEQ ID NO: 8380305 - DNA, 22 bp, Homo sapiens
tcagctttctcaaagaagctgg

SEQ ID NO: 8380306 - DNA, 22 bp, Homo sapiens
tcaggaaatggaattcttgtgt

SEQ ID NO: 8380307 - DNA, 22 bp, Homo sapiens
tcaggaaatggacatctttgct

SEQ ID NO: 8380308 - DNA, 22 bp, Homo sapiens
tcaggagatgtaaccttagctg

SEQ ID NO: 8380309 - DNA, 22 bp, Homo sapiens
tcaggagcagcatgggtgagag

SEQ ID NO: 8380310 - DNA, 22 bp, Homo sapiens
tcaggagcagccttggagagcg

SEQ ID NO: 8380311 - DNA, 22 bp, Homo sapiens
tacatgtttggtaaatgatggc

SEQ ID NO: 8380312 - DNA, 22 bp, Homo sapiens
tacattaaggatatggacatga

SEQ ID NO: 8380313 - DNA, 22 bp, Homo sapiens
tacatacagtggatgctttagg

SEQ ID NO: 8380314 - DNA, 22 bp, Homo sapiens
tacatacagtggatgctttagg

SEQ ID NO: 8380315 - DNA, 22 bp, Homo sapiens
tacatacaagcattcaatttta

SEQ ID NO: 8380316 - DNA, 22 bp, Homo sapiens
tacattcacttgttgaaggtgg

SEQ ID NO: 8380317 - DNA, 22 bp, Homo sapiens
tacattcagaagaatggacacg

SEQ ID NO: 8380318 - DNA, 22 bp, Homo sapiens
tacattcacagttgttcatctc

SEQ ID NO: 8380319 - DNA, 22 bp, Homo sapiens
tacattcacttgttgaaggtgg

SEQ ID NO: 8380320 - DNA, 22 bp, Homo sapiens
tacattcacagttgttcatctc

SEQ ID NO: 8380321 - DNA, 22 bp, Homo sapiens
tacattcagcaaaagaatggtt

SEQ ID NO: 8380322 - DNA, 22 bp, Homo sapiens
tacattcagagaaagtttccat

SEQ ID NO: 8380323 - DNA, 22 bp, Homo sapiens
tacattcagagaaagtttccat

SEQ ID NO: 8380324 - DNA, 22 bp, Homo sapiens
tacattcagaattgggaggcaa

SEQ ID NO: 8380325 - DNA, 22 bp, Homo sapiens
tacattcagaattgggaggcaa

SEQ ID NO: 8380326 - DNA, 22 bp, Homo sapiens
tacattcagaagaatggacacg

SEQ ID NO: 8380327 - DNA, 22 bp, Homo sapiens
tacattcatatgtgtgcataca

SEQ ID NO: 8380328 - DNA, 22 bp, Homo sapiens
tacattcagcaaaagaatggtt

SEQ ID NO: 8380329 - DNA, 22 bp, Homo sapiens
tacattcagcaaaagaatggtt

SEQ ID NO: 8380330 - DNA, 22 bp, Homo sapiens
tacattcatggtgacttgtatg

SEQ ID NO: 8380331 - DNA, 22 bp, Homo sapiens
tacattcatatgtgtgcataca

SEQ ID NO: 8380332 - DNA, 22 bp, Homo sapiens
tacattcatggtgacttgtatg

SEQ ID NO: 8380333 - DNA, 22 bp, Homo sapiens
tacattcatggtgacttgtatg

SEQ ID NO: 8380334 - DNA, 23 bp, Homo sapiens
tacattcatttgcacagccagta

SEQ ID NO: 8380335 - DNA, 23 bp, Homo sapiens
tacattcatttgcacagccagta

SEQ ID NO: 8380336 - DNA, 15 bp, Homo sapiens
tacattcatttccac

SEQ ID NO: 8380337 - DNA, 15 bp, Homo sapiens
tacattcatttccac

SEQ ID NO: 8380338 - DNA, 20 bp, Homo sapiens
tacattcaaaacaaactctg

SEQ ID NO: 8380339 - DNA, 20 bp, Homo sapiens
tacattcaaaacaaactctg

SEQ ID NO: 8380340 - DNA, 22 bp, Homo sapiens
tacattcaaacgatttattgat

SEQ ID NO: 8380341 - DNA, 22 bp, Homo sapiens
tacattcaaacgatttattgat

SEQ ID NO: 8380342 - DNA, 22 bp, Homo sapiens
tacattcaacatgtcactatgt

SEQ ID NO: 8380343 - DNA, 22 bp, Homo sapiens
tacattcaacatgtcactatgt

SEQ ID NO: 8380344 - DNA, 22 bp, Homo sapiens
tacattcaacatgtcactatgt

SEQ ID NO: 8380345 - DNA, 22 bp, Homo sapiens
tacattcaacatgtcactatgt

SEQ ID NO: 8380346 - DNA, 22 bp, Homo sapiens
tacattatttcatcagtcatct

SEQ ID NO: 8380347 - DNA, 22 bp, Homo sapiens
tacattatcttgttatctttca

SEQ ID NO: 8380348 - DNA, 20 bp, Homo sapiens
tacaggaatcaagactgcat

SEQ ID NO: 8380349 - DNA, 20 bp, Homo sapiens
tacaggaatcaagactgcat

SEQ ID NO: 8380350 - DNA, 22 bp, Homo sapiens
tacaggaagttacagactatga

SEQ ID NO: 8380351 - DNA, 22 bp, Homo sapiens
tacagttaaaaagttcaatggt

SEQ ID NO: 8380352 - DNA, 22 bp, Homo sapiens
tacagtttttattcatgacaag

SEQ ID NO: 8380353 - DNA, 22 bp, Homo sapiens
tacagtttttattcatgacaag

SEQ ID NO: 8380354 - DNA, 22 bp, Homo sapiens
tacataattaatctttaagttc

SEQ ID NO: 8380355 - DNA, 22 bp, Homo sapiens
tacatacaagatgtgtttaaaa

SEQ ID NO: 8380356 - DNA, 22 bp, Homo sapiens
tacataattaatctttaagttc

SEQ ID NO: 8380357 - DNA, 22 bp, Homo sapiens
tacataatgagctagttaagtt

SEQ ID NO: 8380358 - DNA, 22 bp, Homo sapiens
tacataatgagctagttaagtt

SEQ ID NO: 8380359 - DNA, 22 bp, Homo sapiens
tacagcagagtgggatgcatct

SEQ ID NO: 8380360 - DNA, 18 bp, Homo sapiens
tacaggaaaagtgttaca

SEQ ID NO: 8380361 - DNA, 22 bp, Homo sapiens
tacaggaaagaaatttgaactc

SEQ ID NO: 8380362 - DNA, 22 bp, Homo sapiens
tacaggaactgggcaggacatt

SEQ ID NO: 8380363 - DNA, 22 bp, Homo sapiens
tacaggaagcactcaagaaatg

SEQ ID NO: 8380364 - DNA, 22 bp, Homo sapiens
tacaggaactgggcaggacatt

SEQ ID NO: 8380365 - DNA, 22 bp, Homo sapiens
tacaggaaccagattgttcagc

SEQ ID NO: 8380366 - DNA, 22 bp, Homo sapiens
tacaggaagtaagtaatgaaat

SEQ ID NO: 8380367 - DNA, 22 bp, Homo sapiens
tacaggaagtctcagtacagta

SEQ ID NO: 8380368 - DNA, 22 bp, Homo sapiens
tacaggaagtctcagtacagta

SEQ ID NO: 8380369 - DNA, 22 bp, Homo sapiens
tacaggaagtctcagtacagta

SEQ ID NO: 8380370 - DNA, 22 bp, Homo sapiens
tacaggaaggagcacatcggga

SEQ ID NO: 8380371 - DNA, 22 bp, Homo sapiens
tacaggaaggctctggaggtgc

SEQ ID NO: 8380372 - DNA, 18 bp, Homo sapiens
tacaggaaggggttctcg

SEQ ID NO: 8380373 - DNA, 22 bp, Homo sapiens
tacttgagtatagtcgcttcac

SEQ ID NO: 8380374 - DNA, 20 bp, Homo sapiens
tacttctgaggcactctgaa

SEQ ID NO: 8380375 - DNA, 22 bp, Homo sapiens
tacttccatgtccttagagtcc

SEQ ID NO: 8380376 - DNA, 22 bp, Homo sapiens
tacttcattcaagttcgctata

SEQ ID NO: 8380377 - DNA, 22 bp, Homo sapiens
tacttcatgggacagagagctg

SEQ ID NO: 8380378 - DNA, 19 bp, Homo sapiens
tacttattagaaatatggg

SEQ ID NO: 8380379 - DNA, 22 bp, Homo sapiens
tacttattggttcagaagttta

SEQ ID NO: 8380380 - DNA, 19 bp, Homo sapiens
tacttattagaaatatggg

SEQ ID NO: 8380381 - DNA, 22 bp, Homo sapiens
tacttcatacctgctagaatgg

SEQ ID NO: 8380382 - DNA, 22 bp, Homo sapiens
tacttcatacctgctagaatgg

SEQ ID NO: 8380383 - DNA, 22 bp, Homo sapiens
tactgtaatgagattagcttcc

SEQ ID NO: 8380384 - DNA, 18 bp, Homo sapiens
tactgagcaacaggagaa

SEQ ID NO: 8380385 - DNA, 22 bp, Homo sapiens
tactgaggcaatagataacggc

SEQ ID NO: 8380386 - DNA, 22 bp, Homo sapiens
tactgaggctgaattcttagca

SEQ ID NO: 8380387 - DNA, 22 bp, Homo sapiens
tactgaggccatgagtctcata

SEQ ID NO: 8380388 - DNA, 22 bp, Homo sapiens
tactgagggcaaagagtgaagc

SEQ ID NO: 8380389 - DNA, 22 bp, Homo sapiens
tactgaggctggcagccccttg

SEQ ID NO: 8380390 - DNA, 22 bp, Homo sapiens
tactgaggctgggttaagcatc

SEQ ID NO: 8380391 - DNA, 22 bp, Homo sapiens
tactgaggttgagaagctgctc

SEQ ID NO: 8380392 - DNA, 22 bp, Homo sapiens
tactgaggtactttacttataa

SEQ ID NO: 8380393 - DNA, 20 bp, Homo sapiens
tactgaggttaggggatgga

SEQ ID NO: 8380394 - DNA, 22 bp, Homo sapiens
tactgagggtgaaaaataaagt

SEQ ID NO: 8380395 - DNA, 22 bp, Homo sapiens
tactgagggtatgaagccaagg

SEQ ID NO: 8380396 - DNA, 17 bp, Homo sapiens
tactgaggggtctggag

SEQ ID NO: 8380397 - DNA, 22 bp, Homo sapiens
tactgagggctgtgtatgtatt

SEQ ID NO: 8380398 - DNA, 22 bp, Homo sapiens
tactgcatagacactgggatat

SEQ ID NO: 8380399 - DNA, 22 bp, Homo sapiens
tactgcatagacactgggatat

SEQ ID NO: 8380400 - DNA, 22 bp, Homo sapiens
tactgcataactggcatgtggg

SEQ ID NO: 8380401 - DNA, 22 bp, Homo sapiens
tactgcatcgaaatgcttttat

SEQ ID NO: 8380402 - DNA, 20 bp, Homo sapiens
tactggagtgagcctgtagc

SEQ ID NO: 8380403 - DNA, 22 bp, Homo sapiens
tactgcatgggtgcatgctgct

SEQ ID NO: 8380404 - DNA, 22 bp, Homo sapiens
tactgcatgtgtttgatgatgg

SEQ ID NO: 8380405 - DNA, 22 bp, Homo sapiens
tactgcgccttcaccaagcggc

SEQ ID NO: 8380406 - DNA, 22 bp, Homo sapiens
tacccagagggagagcaactat

SEQ ID NO: 8380407 - DNA, 22 bp, Homo sapiens
tacccagcaatccctagaggtt

SEQ ID NO: 8380408 - DNA, 22 bp, Homo sapiens
tacccagcccatgcctacctca

SEQ ID NO: 8380409 - DNA, 23 bp, Homo sapiens
tacctgaagtaagcattcatcca

SEQ ID NO: 8380410 - DNA, 22 bp, Homo sapiens
tacctgaattaccaaaagcttt

SEQ ID NO: 8380411 - DNA, 22 bp, Homo sapiens
tactgaaagagtggtggactct

SEQ ID NO: 8380412 - DNA, 22 bp, Homo sapiens
tactgaaagactgaatatttag

SEQ ID NO: 8380413 - DNA, 22 bp, Homo sapiens
tactgaaatggcagatatataa

SEQ ID NO: 8380414 - DNA, 22 bp, Homo sapiens
tacgttcttgtttggaatgagg

SEQ ID NO: 8380415 - DNA, 21 bp, Homo sapiens
tacgtgtgtgcatgtttatat

SEQ ID NO: 8380416 - DNA, 22 bp, Homo sapiens
taattttaatagtatgtggcat

SEQ ID NO: 8380417 - DNA, 22 bp, Homo sapiens
taattttaactgtgctgtttgg

SEQ ID NO: 8380418 - DNA, 22 bp, Homo sapiens
taattttacttcctgagcacct

SEQ ID NO: 8380419 - DNA, 22 bp, Homo sapiens
taattttacttcctgagcacct

SEQ ID NO: 8380420 - DNA, 22 bp, Homo sapiens
taattttacttcctgagcacct

SEQ ID NO: 8380421 - DNA, 22 bp, Homo sapiens
taatttgaatctcgctatttta

SEQ ID NO: 8380422 - DNA, 22 bp, Homo sapiens
taattttatgacagtgtatttt

SEQ ID NO: 8380423 - DNA, 23 bp, Homo sapiens
taattttagccttacaggaccct

SEQ ID NO: 8380424 - DNA, 22 bp, Homo sapiens
taattttatgacagtgtatttt

SEQ ID NO: 8380425 - DNA, 22 bp, Homo sapiens
taattttatgacagtgtatttt

SEQ ID NO: 8380426 - DNA, 22 bp, Homo sapiens
taattttccactctgtttatct

SEQ ID NO: 8380427 - DNA, 22 bp, Homo sapiens
taattttccactctgtttatct

SEQ ID NO: 8380428 - DNA, 22 bp, Homo sapiens
taattttgtcacagtgacatgc

SEQ ID NO: 8380429 - DNA, 22 bp, Homo sapiens
taattttgtccccctgcacata

SEQ ID NO: 8380430 - DNA, 22 bp, Homo sapiens
tacaatcaggctctagcttctc

SEQ ID NO: 8380431 - DNA, 22 bp, Homo sapiens
tacaatatgtggccttttgtga

SEQ ID NO: 8380432 - DNA, 20 bp, Homo sapiens
tacaatattcccactttgct

SEQ ID NO: 8380433 - DNA, 20 bp, Homo sapiens
tacaatattcccactttgct

SEQ ID NO: 8380434 - DNA, 22 bp, Homo sapiens
taatttttccacgtacactggg

SEQ ID NO: 8380435 - DNA, 22 bp, Homo sapiens
taatttttccacgtacactggg

SEQ ID NO: 8380436 - DNA, 22 bp, Homo sapiens
taatttttccacgtacactggg

SEQ ID NO: 8380437 - DNA, 22 bp, Homo sapiens
tacacataggtctgaataaaaa

SEQ ID NO: 8380438 - DNA, 22 bp, Homo sapiens
tacacatccttctgaacaacct

SEQ ID NO: 8380439 - DNA, 22 bp, Homo sapiens
tacacatgacagtggactgaga

SEQ ID NO: 8380440 - DNA, 22 bp, Homo sapiens
tacaatttagtggtgtgtggtt

SEQ ID NO: 8380441 - DNA, 19 bp, Homo sapiens
tacaattggctttccattg

SEQ ID NO: 8380442 - DNA, 21 bp, Homo sapiens
tacacaaagcgtggtccagag

SEQ ID NO: 8380443 - DNA, 22 bp, Homo sapiens
tacacaaaggcactctgttgtt

SEQ ID NO: 8380444 - DNA, 22 bp, Homo sapiens
tacacaaaggcactctgttgtt

SEQ ID NO: 8380445 - DNA, 22 bp, Homo sapiens
tacacaaaggcactctgttgtt

SEQ ID NO: 8380446 - DNA, 22 bp, Homo sapiens
tacaattctttgtaaggtggtc

SEQ ID NO: 8380447 - DNA, 22 bp, Homo sapiens
tacaatgttaaggaaagagaga

SEQ ID NO: 8380448 - DNA, 22 bp, Homo sapiens
tacaccattcccaggtggattt

SEQ ID NO: 8380449 - DNA, 22 bp, Homo sapiens
tacacccacattgagcatggga

SEQ ID NO: 8380450 - DNA, 22 bp, Homo sapiens
tacacccacatgcctaggaggg

SEQ ID NO: 8380451 - DNA, 22 bp, Homo sapiens
tacaccagtatcttaagcatga

SEQ ID NO: 8380452 - DNA, 22 bp, Homo sapiens
tacacctgctgagcctgtcctc

SEQ ID NO: 8380453 - DNA, 22 bp, Homo sapiens
tacacattacataatactatct

SEQ ID NO: 8380454 - DNA, 22 bp, Homo sapiens
tacacattacataatactatct

SEQ ID NO: 8380455 - DNA, 22 bp, Homo sapiens
tacacatgctcagattcctgtg

SEQ ID NO: 8380456 - DNA, 22 bp, Homo sapiens
tacacatgtatttatgtgtaca

SEQ ID NO: 8380457 - DNA, 22 bp, Homo sapiens
tacacatgtccaaggtgtcacc

SEQ ID NO: 8380458 - DNA, 23 bp, Homo sapiens
taatgccagccctgcagttaagc

SEQ ID NO: 8380459 - DNA, 22 bp, Homo sapiens
taatgccacctacctgctttat

SEQ ID NO: 8380460 - DNA, 22 bp, Homo sapiens
taatgagatcatatcttctgag

SEQ ID NO: 8380461 - DNA, 22 bp, Homo sapiens
taatgccaggagggagttttta

SEQ ID NO: 8380462 - DNA, 20 bp, Homo sapiens
taatgcttaacacatcccct

SEQ ID NO: 8380463 - DNA, 22 bp, Homo sapiens
taatgcttaattttcacaagcc

SEQ ID NO: 8380464 - DNA, 22 bp, Homo sapiens
taatgcttcaatttccttgatt

SEQ ID NO: 8380465 - DNA, 22 bp, Homo sapiens
taatgcttatgttatgcaattt

SEQ ID NO: 8380466 - DNA, 22 bp, Homo sapiens
taatgcttatgttatgcaattt

SEQ ID NO: 8380467 - DNA, 22 bp, Homo sapiens
taatgctttgttttgatctaac

SEQ ID NO: 8380468 - DNA, 22 bp, Homo sapiens
taatgcttgcaaattatgggac

SEQ ID NO: 8380469 - DNA, 22 bp, Homo sapiens
taatgcttttccttcaaataag

SEQ ID NO: 8380470 - DNA, 22 bp, Homo sapiens
taatttcagtgggctctgggct

SEQ ID NO: 8380471 - DNA, 22 bp, Homo sapiens
taatttcactgatatgaagtca

SEQ ID NO: 8380472 - DNA, 22 bp, Homo sapiens
taatggagttggaattaataag

SEQ ID NO: 8380473 - DNA, 22 bp, Homo sapiens
taatttcacagttcaacgcaca

SEQ ID NO: 8380474 - DNA, 22 bp, Homo sapiens
taagcataagatacatgagaca

SEQ ID NO: 8380475 - DNA, 22 bp, Homo sapiens
taagcagatgctgtctgcacaa

SEQ ID NO: 8380476 - DNA, 22 bp, Homo sapiens
taagcaatgagataatcatggg

SEQ ID NO: 8380477 - DNA, 22 bp, Homo sapiens
taagcaatgctgtagttcagtc

SEQ ID NO: 8380478 - DNA, 22 bp, Homo sapiens
taagcatacattctctcctttc

SEQ ID NO: 8380479 - DNA, 22 bp, Homo sapiens
taagtgttggtaattacaatga

SEQ ID NO: 8380480 - DNA, 22 bp, Homo sapiens
taagttcaaatcatcccaactt

SEQ ID NO: 8380481 - DNA, 22 bp, Homo sapiens
taagttcattagactacagata

SEQ ID NO: 8380482 - DNA, 22 bp, Homo sapiens
taagtttccagattgtaagtcc

SEQ ID NO: 8380483 - DNA, 22 bp, Homo sapiens
taagtttaaatgtacatgaagc

SEQ ID NO: 8380484 - DNA, 22 bp, Homo sapiens
taataaatgaaagtgctggcat

SEQ ID NO: 8380485 - DNA, 22 bp, Homo sapiens
taataacaattgtaggacatga

SEQ ID NO: 8380486 - DNA, 22 bp, Homo sapiens
taacaattctcaaaagagggga

SEQ ID NO: 8380487 - DNA, 22 bp, Homo sapiens
taacaatttgcttcatttgttt

SEQ ID NO: 8380488 - DNA, 22 bp, Homo sapiens
taacaatttgcttcatttgttt

SEQ ID NO: 8380489 - DNA, 22 bp, Homo sapiens
taacaatttgcttcatttgttt

SEQ ID NO: 8380490 - DNA, 21 bp, Homo sapiens
taacaaagacttctggtcagg

SEQ ID NO: 8380491 - DNA, 22 bp, Homo sapiens
taaatttttgttaacagcctct

SEQ ID NO: 8380492 - DNA, 22 bp, Homo sapiens
taaatacttagttttgtgtcta

SEQ ID NO: 8380493 - DNA, 22 bp, Homo sapiens
taacacatggttctgtcaggaa

SEQ ID NO: 8380494 - DNA, 21 bp, Homo sapiens
taagcaaggaaagggcagccc

SEQ ID NO: 8380495 - DNA, 22 bp, Homo sapiens
taagatgaggtaggtaagactt

SEQ ID NO: 8380496 - DNA, 22 bp, Homo sapiens
taagagtaagtgattaagaaga

SEQ ID NO: 8380497 - DNA, 22 bp, Homo sapiens
taagataagtgggttgagatgg

SEQ ID NO: 8380498 - DNA, 22 bp, Homo sapiens
taagataataagtatgtctatg

SEQ ID NO: 8380499 - DNA, 22 bp, Homo sapiens
taagataataagtatgtctatg

SEQ ID NO: 8380500 - DNA, 22 bp, Homo sapiens
taagataatccattataatgtt

SEQ ID NO: 8380501 - DNA, 22 bp, Homo sapiens
taagaaacttaactgggaacta

SEQ ID NO: 8380502 - DNA, 22 bp, Homo sapiens
taagaaacttaactgggaacta

SEQ ID NO: 8380503 - DNA, 22 bp, Homo sapiens
taagaaatttagttatagaatg

SEQ ID NO: 8380504 - DNA, 22 bp, Homo sapiens
taagaaatttagttatagaatg

SEQ ID NO: 8380505 - DNA, 22 bp, Homo sapiens
taagaaactgtcacagtactat

SEQ ID NO: 8380506 - DNA, 22 bp, Homo sapiens
taagaaactgtcacagtactat

SEQ ID NO: 8380507 - DNA, 22 bp, Homo sapiens
taagaaactgtcacagtactat

SEQ ID NO: 8380508 - DNA, 22 bp, Homo sapiens
taagaaactattgtctctgaac

SEQ ID NO: 8380509 - DNA, 22 bp, Homo sapiens
taagaaactattgtctctgaac

SEQ ID NO: 8380510 - DNA, 22 bp, Homo sapiens
taagaaacccaggaatttctta

SEQ ID NO: 8380511 - DNA, 22 bp, Homo sapiens
taagaaactatggagaagaact

SEQ ID NO: 8380512 - DNA, 22 bp, Homo sapiens
taagaaactatggagaagaact

SEQ ID NO: 8380513 - DNA, 22 bp, Homo sapiens
taagaaactaatgcaataagag

SEQ ID NO: 8380514 - DNA, 22 bp, Homo sapiens
taagaaactaatgcaataagag

SEQ ID NO: 8380515 - DNA, 22 bp, Homo sapiens
taagaaacccaggaatttctta

SEQ ID NO: 8380516 - DNA, 23 bp, Homo sapiens
taacttacatcattctgcacaag

SEQ ID NO: 8380517 - DNA, 22 bp, Homo sapiens
taactgtttttgaaatatatct

SEQ ID NO: 8380518 - DNA, 22 bp, Homo sapiens
taacttagaagtttaattgtat

SEQ ID NO: 8380519 - DNA, 22 bp, Homo sapiens
taacttcactggactcagcagc

SEQ ID NO: 8380520 - DNA, 22 bp, Homo sapiens
gttttataattgcttcataaga

SEQ ID NO: 8380521 - DNA, 22 bp, Homo sapiens
gttttataggtgaaatattact

SEQ ID NO: 8380522 - DNA, 22 bp, Homo sapiens
gttttatttccatgagagaccg

SEQ ID NO: 8380523 - DNA, 22 bp, Homo sapiens
gttttatttccatgagagaccg

SEQ ID NO: 8380524 - DNA, 22 bp, Homo sapiens
gttttatttccatgagagaccg

SEQ ID NO: 8380525 - DNA, 22 bp, Homo sapiens
gttttatttccatgagagaccg

SEQ ID NO: 8380526 - DNA, 20 bp, Homo sapiens
gttttatgccagttctgtgt

SEQ ID NO: 8380527 - DNA, 22 bp, Homo sapiens
gttttattggaacacagccatg

SEQ ID NO: 8380528 - DNA, 22 bp, Homo sapiens
gttttattggaacacagccatg

SEQ ID NO: 8380529 - DNA, 22 bp, Homo sapiens
gttttattggaacacagccatg

SEQ ID NO: 8380530 - DNA, 22 bp, Homo sapiens
gttttcagccaggagcacattt

SEQ ID NO: 8380531 - DNA, 22 bp, Homo sapiens
taaacagagaagactttgagca

SEQ ID NO: 8380532 - DNA, 22 bp, Homo sapiens
gttttcaattataagatggctt

SEQ ID NO: 8380533 - DNA, 22 bp, Homo sapiens
taaacagagatgcctgggtctg

SEQ ID NO: 8380534 - DNA, 22 bp, Homo sapiens
taaacagcctaaaactttcttt

SEQ ID NO: 8380535 - DNA, 22 bp, Homo sapiens
taaacagcctcccctttcactc

SEQ ID NO: 8380536 - DNA, 22 bp, Homo sapiens
taaacagtgatacgttccagct

SEQ ID NO: 8380537 - DNA, 22 bp, Homo sapiens
taaacatctgaatcctgcttcc

SEQ ID NO: 8380538 - DNA, 22 bp, Homo sapiens
taaacatgcccagtgacaggga

SEQ ID NO: 8380539 - DNA, 22 bp, Homo sapiens
taaacatctgtagccttcagtc

SEQ ID NO: 8380540 - DNA, 22 bp, Homo sapiens
taaacatctgaatcctgcttcc

SEQ ID NO: 8380541 - DNA, 21 bp, Homo sapiens
taaagaagatgaatgtgatca

SEQ ID NO: 8380542 - DNA, 22 bp, Homo sapiens
taaagacaaacccactagggtt

SEQ ID NO: 8380543 - DNA, 22 bp, Homo sapiens
taaactgtagctctcgtaattc

SEQ ID NO: 8380544 - DNA, 22 bp, Homo sapiens
taaactgtggaatgttctcttt

SEQ ID NO: 8380545 - DNA, 22 bp, Homo sapiens
taaactgtgaaaggcttaacat

SEQ ID NO: 8380546 - DNA, 22 bp, Homo sapiens
taaagtgtggatatgattagta

SEQ ID NO: 8380547 - DNA, 22 bp, Homo sapiens
taaagtgtgtatatacatatgg

SEQ ID NO: 8380548 - DNA, 22 bp, Homo sapiens
taaagtgtttgtatgcagataa

SEQ ID NO: 8380549 - DNA, 22 bp, Homo sapiens
taaagtgttgtacaaatgtatg

SEQ ID NO: 8380550 - DNA, 22 bp, Homo sapiens
taaagtgtggacagtatctata

SEQ ID NO: 8380551 - DNA, 21 bp, Homo sapiens
taaataataagttgctgagat

SEQ ID NO: 8380552 - DNA, 22 bp, Homo sapiens
taaataagttcttcattgtttg

SEQ ID NO: 8380553 - DNA, 21 bp, Homo sapiens
taaataataagttgctgagat

SEQ ID NO: 8380554 - DNA, 17 bp, Homo sapiens
taaatacacaagggtat

SEQ ID NO: 8380555 - DNA, 22 bp, Homo sapiens
gttcctttgtttagcagagaca

SEQ ID NO: 8380556 - DNA, 22 bp, Homo sapiens
gttcctttcctatttggataag

SEQ ID NO: 8380557 - DNA, 22 bp, Homo sapiens
gttcctttcctatttggataag

SEQ ID NO: 8380558 - DNA, 22 bp, Homo sapiens
gttccagggaagggaaggcaga

SEQ ID NO: 8380559 - DNA, 22 bp, Homo sapiens
gttcctgggaggcatgggctgg

SEQ ID NO: 8380560 - DNA, 18 bp, Homo sapiens
gttcccagatggtgctga

SEQ ID NO: 8380561 - DNA, 22 bp, Homo sapiens
gtttactgctctaggttgcaca

SEQ ID NO: 8380562 - DNA, 22 bp, Homo sapiens
gtttactggagaagatgacctg

SEQ ID NO: 8380563 - DNA, 22 bp, Homo sapiens
gtttactgtcttgcacagtgca

SEQ ID NO: 8380564 - DNA, 22 bp, Homo sapiens
gtttactgttaaccaacgaatg

SEQ ID NO: 8380565 - DNA, 22 bp, Homo sapiens
gtttagaattctaactttaagg

SEQ ID NO: 8380566 - DNA, 22 bp, Homo sapiens
gtttagtgtttcaagactcttt

SEQ ID NO: 8380567 - DNA, 22 bp, Homo sapiens
gtttataaggcccaatatttct

SEQ ID NO: 8380568 - DNA, 20 bp, Homo sapiens
gtttagcatggcagtgaaag

SEQ ID NO: 8380569 - DNA, 20 bp, Homo sapiens
gtttagcatggcagtgaaag

SEQ ID NO: 8380570 - DNA, 23 bp, Homo sapiens
gttttacaggtgagaaaatggag

SEQ ID NO: 8380571 - DNA, 22 bp, Homo sapiens
gttttacacacctatgaaagac

SEQ ID NO: 8380572 - DNA, 22 bp, Homo sapiens
gttttacacacctatgaaagac

SEQ ID NO: 8380573 - DNA, 22 bp, Homo sapiens
gtttctcatcagtttctgatat

SEQ ID NO: 8380574 - DNA, 18 bp, Homo sapiens
gtttctcccaggcggggc

SEQ ID NO: 8380575 - DNA, 22 bp, Homo sapiens
gtttctctgtctgttacattgg

SEQ ID NO: 8380576 - DNA, 20 bp, Homo sapiens
gtttctgattcagtaggtct

SEQ ID NO: 8380577 - DNA, 22 bp, Homo sapiens
gtttctgattctagaggcaggc

SEQ ID NO: 8380578 - DNA, 22 bp, Homo sapiens
gtttctgctccagtgatgcaag

SEQ ID NO: 8380579 - DNA, 22 bp, Homo sapiens
gtttctatggtttatattactg

SEQ ID NO: 8380580 - DNA, 22 bp, Homo sapiens
gtttctcaacatgctttctaac

SEQ ID NO: 8380581 - DNA, 22 bp, Homo sapiens
gtttccttttggaattagagct

SEQ ID NO: 8380582 - DNA, 22 bp, Homo sapiens
gtttcctacactgtagtattat

SEQ ID NO: 8380583 - DNA, 22 bp, Homo sapiens
gtttcctagatcagtgttctta

SEQ ID NO: 8380584 - DNA, 22 bp, Homo sapiens
gtttcctaccagtggttccaga

SEQ ID NO: 8380585 - DNA, 22 bp, Homo sapiens
gtgttaatgaaaaacaactcat

SEQ ID NO: 8380586 - DNA, 22 bp, Homo sapiens
gtgttaatggtagaatctgagt

SEQ ID NO: 8380587 - DNA, 22 bp, Homo sapiens
gtgttaaatttctaatttgtga

SEQ ID NO: 8380588 - DNA, 22 bp, Homo sapiens
gtgttaaatgcaatcacatgca

SEQ ID NO: 8380589 - DNA, 22 bp, Homo sapiens
gtgttaaacatgttcacagcat

SEQ ID NO: 8380590 - DNA, 22 bp, Homo sapiens
gtgttaaaaatcccatgatatg

SEQ ID NO: 8380591 - DNA, 22 bp, Homo sapiens
gtgttaaaatgctttatagtag

SEQ ID NO: 8380592 - DNA, 22 bp, Homo sapiens
gtgtgtttcagaagccaggtgt

SEQ ID NO: 8380593 - DNA, 22 bp, Homo sapiens
gtgtgtttagcattagcagggg

SEQ ID NO: 8380594 - DNA, 22 bp, Homo sapiens
gtgtgtttagcattagcagggg

SEQ ID NO: 8380595 - DNA, 22 bp, Homo sapiens
gtgtgtttcaccctgacaccaa

SEQ ID NO: 8380596 - DNA, 22 bp, Homo sapiens
gtgtgttcagcaagaggtaagg

SEQ ID NO: 8380597 - DNA, 22 bp, Homo sapiens
gtgcttttaaaggcaattagta

SEQ ID NO: 8380598 - DNA, 22 bp, Homo sapiens
gtgcttttaacttttgaaagga

SEQ ID NO: 8380599 - DNA, 19 bp, Homo sapiens
gtgctttttaagagctcag

SEQ ID NO: 8380600 - DNA, 22 bp, Homo sapiens
gtgtgtccttgggcctctgcag

SEQ ID NO: 8380601 - DNA, 22 bp, Homo sapiens
gttcattttactgtaaatagca

SEQ ID NO: 8380602 - DNA, 22 bp, Homo sapiens
gttataaatacctaataggatt

SEQ ID NO: 8380603 - DNA, 22 bp, Homo sapiens
gttataaaggtgataatggtca

SEQ ID NO: 8380604 - DNA, 22 bp, Homo sapiens
gttataaaatgcacagttgttt

SEQ ID NO: 8380605 - DNA, 23 bp, Homo sapiens
gttcattttattgtctgattgct

SEQ ID NO: 8380606 - DNA, 22 bp, Homo sapiens
gttcatttttactttgatctac

SEQ ID NO: 8380607 - DNA, 22 bp, Homo sapiens
gttcatttttagaatgctagta

SEQ ID NO: 8380608 - DNA, 22 bp, Homo sapiens
gttcatttttccctaatgagta

SEQ ID NO: 8380609 - DNA, 22 bp, Homo sapiens
gttccaaagcaaaggaggtgag

SEQ ID NO: 8380610 - DNA, 22 bp, Homo sapiens
gttccaaacaagtcataaagta

SEQ ID NO: 8380611 - DNA, 22 bp, Homo sapiens
gttccaaagtctctgagctgag

SEQ ID NO: 8380612 - DNA, 19 bp, Homo sapiens
gttccaaaggccagacctt

SEQ ID NO: 8380613 - DNA, 19 bp, Homo sapiens
gttccaaaggccagacctt

SEQ ID NO: 8380614 - DNA, 22 bp, Homo sapiens
gttccaaagtctctgagctgag

SEQ ID NO: 8380615 - DNA, 22 bp, Homo sapiens
gttccaaagttagagtgtattg

SEQ ID NO: 8380616 - DNA, 22 bp, Homo sapiens
gttccaaatttggatctttagg

SEQ ID NO: 8380617 - DNA, 22 bp, Homo sapiens
gttagagggaaaaatcatttgc

SEQ ID NO: 8380618 - DNA, 22 bp, Homo sapiens
gttagagggctgccttttgttt

SEQ ID NO: 8380619 - DNA, 22 bp, Homo sapiens
gttagcaccagtgctcataaca

SEQ ID NO: 8380620 - DNA, 22 bp, Homo sapiens
gttagcacaaccaagaaatgcg

SEQ ID NO: 8380621 - DNA, 20 bp, Homo sapiens
gttaggaggttggacatgga

SEQ ID NO: 8380622 - DNA, 20 bp, Homo sapiens
gttaggaggttggacatgga

SEQ ID NO: 8380623 - DNA, 20 bp, Homo sapiens
gttaggaggttggacatgga

SEQ ID NO: 8380624 - DNA, 20 bp, Homo sapiens
gttaggaggttggacatgga

SEQ ID NO: 8380625 - DNA, 20 bp, Homo sapiens
gttaggaggttggacatgga

SEQ ID NO: 8380626 - DNA, 22 bp, Homo sapiens
gttacaaaggtcataaaagtgt

SEQ ID NO: 8380627 - DNA, 22 bp, Homo sapiens
gttactcttccccggggtctgg

SEQ ID NO: 8380628 - DNA, 22 bp, Homo sapiens
gttacaaaggtcataaaagtgt

SEQ ID NO: 8380629 - DNA, 22 bp, Homo sapiens
gttactcttgagaggctgaggt

SEQ ID NO: 8380630 - DNA, 22 bp, Homo sapiens
gttagaaacacattcttattga

SEQ ID NO: 8380631 - DNA, 22 bp, Homo sapiens
gttagaaacacattcttattga

SEQ ID NO: 8380632 - DNA, 22 bp, Homo sapiens
gttagaaacgcaggctctccgg

SEQ ID NO: 8380633 - DNA, 22 bp, Homo sapiens
gttagaaacacattcttattga

SEQ ID NO: 8380634 - DNA, 22 bp, Homo sapiens
gttagaaatgcagaaacttgac

SEQ ID NO: 8380635 - DNA, 22 bp, Homo sapiens
gttagaaagtgtctgcttgggt

SEQ ID NO: 8380636 - DNA, 22 bp, Homo sapiens
tattcacaaaatgaggtcctca

SEQ ID NO: 8380637 - DNA, 22 bp, Homo sapiens
tattcacaaaatgaggtcctca

SEQ ID NO: 8380638 - DNA, 22 bp, Homo sapiens
tattcacagctgccgcactcag

SEQ ID NO: 8380639 - DNA, 22 bp, Homo sapiens
tattcacaggcacgaaatattg

SEQ ID NO: 8380640 - DNA, 22 bp, Homo sapiens
tattcacaggcacgaaatattg

SEQ ID NO: 8380641 - DNA, 22 bp, Homo sapiens
tattcacaggcacgaaatattg

SEQ ID NO: 8380642 - DNA, 22 bp, Homo sapiens
tattcacagttgatttacagtt

SEQ ID NO: 8380643 - DNA, 22 bp, Homo sapiens
tattcacaggctggagtgatgt

SEQ ID NO: 8380644 - DNA, 22 bp, Homo sapiens
tattcacaggttctggggatca

SEQ ID NO: 8380645 - DNA, 22 bp, Homo sapiens
tattcacaggctggagtgatgt

SEQ ID NO: 8380646 - DNA, 22 bp, Homo sapiens
tattcacaggttccggagatta

SEQ ID NO: 8380647 - DNA, 22 bp, Homo sapiens
tattcacaggctggagtgatgt

SEQ ID NO: 8380648 - DNA, 22 bp, Homo sapiens
tattcacattaataagtcttca

SEQ ID NO: 8380649 - DNA, 22 bp, Homo sapiens
tattcacatgtacatatgctca

SEQ ID NO: 8380650 - DNA, 22 bp, Homo sapiens
tattcacatgtacatatgctca

SEQ ID NO: 8380651 - DNA, 22 bp, Homo sapiens
tattcacatgaaaacaaatttt

SEQ ID NO: 8380652 - DNA, 22 bp, Homo sapiens
tattcacatgaaaacaaatttt

SEQ ID NO: 8380653 - DNA, 22 bp, Homo sapiens
tattcatagtaaacaaaagtgg

SEQ ID NO: 8380654 - DNA, 22 bp, Homo sapiens
tattcacattctcaggcctggt

SEQ ID NO: 8380655 - DNA, 22 bp, Homo sapiens
tattcacattaataagtcttca

SEQ ID NO: 8380656 - DNA, 22 bp, Homo sapiens
tattcacattctcaggcctggt

SEQ ID NO: 8380657 - DNA, 22 bp, Homo sapiens
tattgagaccagtgcttgctta

SEQ ID NO: 8380658 - DNA, 22 bp, Homo sapiens
tattcatattgtaaaagaagtg

SEQ ID NO: 8380659 - DNA, 22 bp, Homo sapiens
tattcatgacattgcatatgca

SEQ ID NO: 8380660 - DNA, 22 bp, Homo sapiens
tattcatcttcatagtcacagt

SEQ ID NO: 8380661 - DNA, 22 bp, Homo sapiens
tatgttgtagctagtaataaat

SEQ ID NO: 8380662 - DNA, 22 bp, Homo sapiens
tatgttgagtgaaagaagctag

SEQ ID NO: 8380663 - DNA, 22 bp, Homo sapiens
tatgttctctgctctaggatgt

SEQ ID NO: 8380664 - DNA, 22 bp, Homo sapiens
tatgttctgactctacatggga

SEQ ID NO: 8380665 - DNA, 22 bp, Homo sapiens
tatgttattttcatacaacaga

SEQ ID NO: 8380666 - DNA, 22 bp, Homo sapiens
tatgttcagaagaagaatgggg

SEQ ID NO: 8380667 - DNA, 22 bp, Homo sapiens
tatgttcatagaaatcatgacc

SEQ ID NO: 8380668 - DNA, 22 bp, Homo sapiens
tatgttaagtgggataatcaaa

SEQ ID NO: 8380669 - DNA, 22 bp, Homo sapiens
tatgttactcacatgttcttgc

SEQ ID NO: 8380670 - DNA, 22 bp, Homo sapiens
tatgttacaaagtttttctaaa

SEQ ID NO: 8380671 - DNA, 22 bp, Homo sapiens
tatgtgtgtttcagtggaaatg

SEQ ID NO: 8380672 - DNA, 22 bp, Homo sapiens
tatgctttaacattaaacaaca

SEQ ID NO: 8380673 - DNA, 16 bp, Homo sapiens
tatgtgtgtgggagtg

SEQ ID NO: 8380674 - DNA, 22 bp, Homo sapiens
tatgctctgagacctttgtgca

SEQ ID NO: 8380675 - DNA, 22 bp, Homo sapiens
tatgcctggggtgctcaggcca

SEQ ID NO: 8380676 - DNA, 22 bp, Homo sapiens
tatgccagggactgtttcacca

SEQ ID NO: 8380677 - DNA, 22 bp, Homo sapiens
tatgccagcacttagatgagat

SEQ ID NO: 8380678 - DNA, 22 bp, Homo sapiens
tatgccagactgtgagcttctt

SEQ ID NO: 8380679 - DNA, 22 bp, Homo sapiens
tatttgtgtgggtatctatata

SEQ ID NO: 8380680 - DNA, 22 bp, Homo sapiens
tatttgtcactgcacttgaaat

SEQ ID NO: 8380681 - DNA, 22 bp, Homo sapiens
tatttgtatttcatgcagtaaa

SEQ ID NO: 8380682 - DNA, 22 bp, Homo sapiens
tattttcattctgtgtgactgt

SEQ ID NO: 8380683 - DNA, 22 bp, Homo sapiens
tattttcatcttgtccttggat

SEQ ID NO: 8380684 - DNA, 22 bp, Homo sapiens
tattttcaccttctctggatat

SEQ ID NO: 8380685 - DNA, 22 bp, Homo sapiens
tattttcaccttctctggatat

SEQ ID NO: 8380686 - DNA, 22 bp, Homo sapiens
tattttcaccatgtatccctgt

SEQ ID NO: 8380687 - DNA, 22 bp, Homo sapiens
tatttctaagagatatctgtac

SEQ ID NO: 8380688 - DNA, 22 bp, Homo sapiens
tatttccatgttagaactaagt

SEQ ID NO: 8380689 - DNA, 22 bp, Homo sapiens
tatttccatgttagaactaagt

SEQ ID NO: 8380690 - DNA, 22 bp, Homo sapiens
tatttccagcagtaagaagaca

SEQ ID NO: 8380691 - DNA, 22 bp, Homo sapiens
tatttccagcagtaagaagaca

SEQ ID NO: 8380692 - DNA, 22 bp, Homo sapiens
tatttcagggagaataaatttg

SEQ ID NO: 8380693 - DNA, 22 bp, Homo sapiens
tatttggagtgatggaaatgtt

SEQ ID NO: 8380694 - DNA, 22 bp, Homo sapiens
tatttctaagctgtaagtctga

SEQ ID NO: 8380695 - DNA, 22 bp, Homo sapiens
tatttggatacaatcatttgct

SEQ ID NO: 8380696 - DNA, 22 bp, Homo sapiens
tatttgtagaatggattaaggg

SEQ ID NO: 8380697 - DNA, 22 bp, Homo sapiens
tatttgtatgtgtgtacatata

SEQ ID NO: 8380698 - DNA, 22 bp, Homo sapiens
tatttgtagaatggattaaggg

SEQ ID NO: 8380699 - DNA, 22 bp, Homo sapiens
tattggtcttctgttccctatt

SEQ ID NO: 8380700 - DNA, 22 bp, Homo sapiens
tattggtctgcttaagtggatt

SEQ ID NO: 8380701 - DNA, 22 bp, Homo sapiens
tattggtcaatttcaccttgat

SEQ ID NO: 8380702 - DNA, 22 bp, Homo sapiens
tattggtcaagttgaggaccct

SEQ ID NO: 8380703 - DNA, 22 bp, Homo sapiens
tattggtcttggaaggttttgt

SEQ ID NO: 8380704 - DNA, 22 bp, Homo sapiens
tattgggtaaagatccagtttt

SEQ ID NO: 8380705 - DNA, 21 bp, Homo sapiens
tattgattcaatttcttgagt

SEQ ID NO: 8380706 - DNA, 23 bp, Homo sapiens
tattgcacacatagaaacataga

SEQ ID NO: 8380707 - DNA, 22 bp, Homo sapiens
tattgcatctcttcatatctgt

SEQ ID NO: 8380708 - DNA, 22 bp, Homo sapiens
tatttcacataccacagagtgt

SEQ ID NO: 8380709 - DNA, 22 bp, Homo sapiens
tatttcacagcagctcatttaa

SEQ ID NO: 8380710 - DNA, 22 bp, Homo sapiens
tattgtatcttaccacatgtat

SEQ ID NO: 8380711 - DNA, 22 bp, Homo sapiens
tatttcaagaacttctatccat

SEQ ID NO: 8380712 - DNA, 22 bp, Homo sapiens
tatttcaacgtatgaaaagctg

SEQ ID NO: 8380713 - DNA, 22 bp, Homo sapiens
tatttcagacactgatcttgca

SEQ ID NO: 8380714 - DNA, 22 bp, Homo sapiens
tatttcagcaagaagaatgtgg

SEQ ID NO: 8380715 - DNA, 22 bp, Homo sapiens
tatttcagctctttggattatc

SEQ ID NO: 8380716 - DNA, 22 bp, Homo sapiens
tatttcagcacatgggataggt

SEQ ID NO: 8380717 - DNA, 22 bp, Homo sapiens
tatttcaggctatatttcttgt

SEQ ID NO: 8380718 - DNA, 22 bp, Homo sapiens
tatttcagggagaataaatttg

SEQ ID NO: 8380719 - DNA, 22 bp, Homo sapiens
tatcttacagactgaatgttgg

SEQ ID NO: 8380720 - DNA, 22 bp, Homo sapiens
tatcttaaatgcatgatagaca

SEQ ID NO: 8380721 - DNA, 22 bp, Homo sapiens
tatctttaacttgcagtattta

SEQ ID NO: 8380722 - DNA, 19 bp, Homo sapiens
tatctttatgcagtggtgg

SEQ ID NO: 8380723 - DNA, 22 bp, Homo sapiens
tatgcattatacattaatttct

SEQ ID NO: 8380724 - DNA, 22 bp, Homo sapiens
tatgcagtgtatgcactgagat

SEQ ID NO: 8380725 - DNA, 22 bp, Homo sapiens
tatgcagtggtatcattttaaa

SEQ ID NO: 8380726 - DNA, 22 bp, Homo sapiens
tatgcataattggataagtaga

SEQ ID NO: 8380727 - DNA, 22 bp, Homo sapiens
tatgcatacaatgagatattcc

SEQ ID NO: 8380728 - DNA, 22 bp, Homo sapiens
tatgagttcagttatcttaagt

SEQ ID NO: 8380729 - DNA, 22 bp, Homo sapiens
tatgagtttaaggctaaaatag

SEQ ID NO: 8380730 - DNA, 22 bp, Homo sapiens
tatgcacattcacacaaaaatg

SEQ ID NO: 8380731 - DNA, 22 bp, Homo sapiens
tatgcactggtactattcgtgt

SEQ ID NO: 8380732 - DNA, 18 bp, Homo sapiens
tatatttcacacatattc

SEQ ID NO: 8380733 - DNA, 19 bp, Homo sapiens
tatatttgttgaataaaaa

SEQ ID NO: 8380734 - DNA, 22 bp, Homo sapiens
tatcaaaggctatgtgattttt

SEQ ID NO: 8380735 - DNA, 22 bp, Homo sapiens
tatcaaagttgtcctgtgaagt

SEQ ID NO: 8380736 - DNA, 22 bp, Homo sapiens
tatcaaattgaggcagctgggg

SEQ ID NO: 8380737 - DNA, 20 bp, Homo sapiens
tatattttctctttggcctt

SEQ ID NO: 8380738 - DNA, 20 bp, Homo sapiens
tatattttctctttggcctt

SEQ ID NO: 8380739 - DNA, 22 bp, Homo sapiens
tatctagcaagtaacatgctga

SEQ ID NO: 8380740 - DNA, 22 bp, Homo sapiens
tatctagatggattttagtgaa

SEQ ID NO: 8380741 - DNA, 17 bp, Homo sapiens
tatctgtgttcctggct

SEQ ID NO: 8380742 - DNA, 22 bp, Homo sapiens
tatctataatgttttacttcct

SEQ ID NO: 8380743 - DNA, 19 bp, Homo sapiens
tatcaatcacggcatcttt

SEQ ID NO: 8380744 - DNA, 22 bp, Homo sapiens
tatcaatatctcagtgtgcttc

SEQ ID NO: 8380745 - DNA, 22 bp, Homo sapiens
tatagcaactccaaagagactt

SEQ ID NO: 8380746 - DNA, 22 bp, Homo sapiens
tatatgtagtcagtcagagtaa

SEQ ID NO: 8380747 - DNA, 22 bp, Homo sapiens
tatattaaatgaccagttttaa

SEQ ID NO: 8380748 - DNA, 22 bp, Homo sapiens
tatattaaagtgctttgcagtg

SEQ ID NO: 8380749 - DNA, 22 bp, Homo sapiens
tatattataagccctttcagaa

SEQ ID NO: 8380750 - DNA, 22 bp, Homo sapiens
tatattatcataaaaccattca

SEQ ID NO: 8380751 - DNA, 22 bp, Homo sapiens
tatattaacttgtgatcctgga

SEQ ID NO: 8380752 - DNA, 22 bp, Homo sapiens
tatattaacttgtgatcctgga

SEQ ID NO: 8380753 - DNA, 22 bp, Homo sapiens
tatactattattgtcagtttat

SEQ ID NO: 8380754 - DNA, 21 bp, Homo sapiens
tatacatgtgtgcatacgtgt

SEQ ID NO: 8380755 - DNA, 22 bp, Homo sapiens
tatacatgttttacataagtga

SEQ ID NO: 8380756 - DNA, 22 bp, Homo sapiens
tatacatgttttacataagtga

SEQ ID NO: 8380757 - DNA, 22 bp, Homo sapiens
tatactctgagaaacgtgtcac

SEQ ID NO: 8380758 - DNA, 22 bp, Homo sapiens
tatactttcctgcaactttgat

SEQ ID NO: 8380759 - DNA, 22 bp, Homo sapiens
tagtgtcatttcagtggagttt

SEQ ID NO: 8380760 - DNA, 22 bp, Homo sapiens
tagtgtctagtgagtttgatgc

SEQ ID NO: 8380761 - DNA, 22 bp, Homo sapiens
tagtgtcatgaaaagtacacta

SEQ ID NO: 8380762 - DNA, 23 bp, Homo sapiens
tagtgtcaagagggagtgtaatt

SEQ ID NO: 8380763 - DNA, 22 bp, Homo sapiens
tagtgtcaaatagcctgagctt

SEQ ID NO: 8380764 - DNA, 22 bp, Homo sapiens
tagtgtcaaacagggattagaa

SEQ ID NO: 8380765 - DNA, 22 bp, Homo sapiens
tagtgtcagggagtgataaatg

SEQ ID NO: 8380766 - DNA, 22 bp, Homo sapiens
tagtgtcaggagggaaatgcaa

SEQ ID NO: 8380767 - DNA, 22 bp, Homo sapiens
tagtgtcatcgttgcagctgag

SEQ ID NO: 8380768 - DNA, 23 bp, Homo sapiens
tagtgtcatcctcagcttctgtt

SEQ ID NO: 8380769 - DNA, 22 bp, Homo sapiens
tagtgtcagcatctcattgagc

SEQ ID NO: 8380770 - DNA, 22 bp, Homo sapiens
tagtgtcagagaatcttggttt

SEQ ID NO: 8380771 - DNA, 19 bp, Homo sapiens
tagtgtcaaggaggagggt

SEQ ID NO: 8380772 - DNA, 22 bp, Homo sapiens
tagttaaagccctaaattgata

SEQ ID NO: 8380773 - DNA, 22 bp, Homo sapiens
tagttaatgctaattaacaaat

SEQ ID NO: 8380774 - DNA, 22 bp, Homo sapiens
tagttaaggccacttgcctaag

SEQ ID NO: 8380775 - DNA, 22 bp, Homo sapiens
taggctcacatagcactaagtg

SEQ ID NO: 8380776 - DNA, 22 bp, Homo sapiens
taggctcagaggcagaggctga

SEQ ID NO: 8380777 - DNA, 23 bp, Homo sapiens
taggctctgtaggtagagatggg

SEQ ID NO: 8380778 - DNA, 22 bp, Homo sapiens
taggacaggctaaaagggataa

SEQ ID NO: 8380779 - DNA, 22 bp, Homo sapiens
taggacaggatcatgatgctgg

SEQ ID NO: 8380780 - DNA, 22 bp, Homo sapiens
taggcctcaggaccccagggct

SEQ ID NO: 8380781 - DNA, 23 bp, Homo sapiens
taggcctccctggagcacccagc

SEQ ID NO: 8380782 - DNA, 22 bp, Homo sapiens
taggcctcaggaccccagggct

SEQ ID NO: 8380783 - DNA, 22 bp, Homo sapiens
taggcccagttccgcctcccgg

SEQ ID NO: 8380784 - DNA, 20 bp, Homo sapiens
taggacagggcctggcttct

SEQ ID NO: 8380785 - DNA, 22 bp, Homo sapiens
taggaagtagataggttgttct

SEQ ID NO: 8380786 - DNA, 22 bp, Homo sapiens
taggaatgtggcaggcagaaca

SEQ ID NO: 8380787 - DNA, 22 bp, Homo sapiens
taggaaatgctccattgcataa

SEQ ID NO: 8380788 - DNA, 22 bp, Homo sapiens
taggaaatgctccattgcataa

SEQ ID NO: 8380789 - DNA, 22 bp, Homo sapiens
taggaaatgctccattgcataa

SEQ ID NO: 8380790 - DNA, 22 bp, Homo sapiens
taggaaatgctccattgcataa

SEQ ID NO: 8380791 - DNA, 22 bp, Homo sapiens
taggaaatgccagccttcctcc

SEQ ID NO: 8380792 - DNA, 22 bp, Homo sapiens
taggaaatgccagccttcctcc

SEQ ID NO: 8380793 - DNA, 22 bp, Homo sapiens
taggaaatgaggccaacatgtg

SEQ ID NO: 8380794 - DNA, 22 bp, Homo sapiens
taggaaatgctgtcttattgta

SEQ ID NO: 8380795 - DNA, 22 bp, Homo sapiens
taggaaatgctgtcttattgta

SEQ ID NO: 8380796 - DNA, 22 bp, Homo sapiens
taggaaatgctgtcttattgta

SEQ ID NO: 8380797 - DNA, 22 bp, Homo sapiens
taggaaatgctgtcttattgta

SEQ ID NO: 8380798 - DNA, 22 bp, Homo sapiens
taggaaatggctcagttactgc

SEQ ID NO: 8380799 - DNA, 22 bp, Homo sapiens
taggaaatggctcagttactgc

SEQ ID NO: 8380800 - DNA, 22 bp, Homo sapiens
taggaaatggctcagttactgc

SEQ ID NO: 8380801 - DNA, 22 bp, Homo sapiens
taggaaatggctcagttactgc

SEQ ID NO: 8380802 - DNA, 22 bp, Homo sapiens
taggaagcctgctgtgcacagc

SEQ ID NO: 8380803 - DNA, 22 bp, Homo sapiens
taggaagatcaagtttatctca

SEQ ID NO: 8380804 - DNA, 22 bp, Homo sapiens
taggaagatgagtatcaacttg

SEQ ID NO: 8380805 - DNA, 22 bp, Homo sapiens
taggaagatgagtatcaacttg

SEQ ID NO: 8380806 - DNA, 22 bp, Homo sapiens
taggaaagaaatgagtagtgat

SEQ ID NO: 8380807 - DNA, 22 bp, Homo sapiens
taggaaagaaatgagtagtgat

SEQ ID NO: 8380808 - DNA, 22 bp, Homo sapiens
tagcccagatgattgaaccatg

SEQ ID NO: 8380809 - DNA, 19 bp, Homo sapiens
tagcccagagcctggctac

SEQ ID NO: 8380810 - DNA, 22 bp, Homo sapiens
tagccatgttgttaaaagacaa

SEQ ID NO: 8380811 - DNA, 22 bp, Homo sapiens
taggaaatattgatttcagtca

SEQ ID NO: 8380812 - DNA, 22 bp, Homo sapiens
taggaaatatttgaacatagga

SEQ ID NO: 8380813 - DNA, 22 bp, Homo sapiens
taggaaatatttgaacatagga

SEQ ID NO: 8380814 - DNA, 22 bp, Homo sapiens
taggaaatatttgaacatagga

SEQ ID NO: 8380815 - DNA, 22 bp, Homo sapiens
taggaaatcagagaaagaggtg

SEQ ID NO: 8380816 - DNA, 22 bp, Homo sapiens
taggaaatcagagaaagaggtg

SEQ ID NO: 8380817 - DNA, 20 bp, Homo sapiens
taggaaatcgaggcagggtg

SEQ ID NO: 8380818 - DNA, 20 bp, Homo sapiens
taggaaatcgaggcagggtg

SEQ ID NO: 8380819 - DNA, 22 bp, Homo sapiens
taggaaatgaatgcaggctccc

SEQ ID NO: 8380820 - DNA, 22 bp, Homo sapiens
taggaaataattcactctggct

SEQ ID NO: 8380821 - DNA, 22 bp, Homo sapiens
taggaaataattcactctggct

SEQ ID NO: 8380822 - DNA, 22 bp, Homo sapiens
taggaaataaatacttatggtt

SEQ ID NO: 8380823 - DNA, 22 bp, Homo sapiens
taggaaataaatacttatggtt

SEQ ID NO: 8380824 - DNA, 22 bp, Homo sapiens
taggaaagcagtagagccagga

SEQ ID NO: 8380825 - DNA, 22 bp, Homo sapiens
taggaaagcagtagagccagga

SEQ ID NO: 8380826 - DNA, 20 bp, Homo sapiens
taggaaatatgtttttaccc

SEQ ID NO: 8380827 - DNA, 20 bp, Homo sapiens
taggaaatatgtttttaccc

SEQ ID NO: 8380828 - DNA, 20 bp, Homo sapiens
taggaaatatgtttttaccc

SEQ ID NO: 8380829 - DNA, 20 bp, Homo sapiens
taggaaatatgtttttaccc

SEQ ID NO: 8380830 - DNA, 22 bp, Homo sapiens
taggaaatactgtaagtttggg

SEQ ID NO: 8380831 - DNA, 22 bp, Homo sapiens
taggaaatactgtaagtttggg

SEQ ID NO: 8380832 - DNA, 18 bp, Homo sapiens
taggaaatagggctgtga

SEQ ID NO: 8380833 - DNA, 22 bp, Homo sapiens
taggctggaggaagcagtgcct

SEQ ID NO: 8380834 - DNA, 22 bp, Homo sapiens
taggctggaacttaggcagagg

SEQ ID NO: 8380835 - DNA, 22 bp, Homo sapiens
taggctgagctaagagagctta

SEQ ID NO: 8380836 - DNA, 22 bp, Homo sapiens
taggctgcaagcatagaacaaa

SEQ ID NO: 8380837 - DNA, 22 bp, Homo sapiens
taggttcacacatcttccagat

SEQ ID NO: 8380838 - DNA, 22 bp, Homo sapiens
taggctgggaagaaagattctc

SEQ ID NO: 8380839 - DNA, 22 bp, Homo sapiens
taggctgggagcctgaggctag

SEQ ID NO: 8380840 - DNA, 22 bp, Homo sapiens
tagtatagattgaagcagatca

SEQ ID NO: 8380841 - DNA, 22 bp, Homo sapiens
tagtatagattgaagcagatca

SEQ ID NO: 8380842 - DNA, 22 bp, Homo sapiens
tagtagaatccaaaccaacagt

SEQ ID NO: 8380843 - DNA, 22 bp, Homo sapiens
tagtacagttttggcacatgga

SEQ ID NO: 8380844 - DNA, 22 bp, Homo sapiens
tagtacagtttactttcagcgc

SEQ ID NO: 8380845 - DNA, 19 bp, Homo sapiens
tagtagtagaaaacaatac

SEQ ID NO: 8380846 - DNA, 22 bp, Homo sapiens
taggtttactgaattagtggaa

SEQ ID NO: 8380847 - DNA, 22 bp, Homo sapiens
taggtttactgaattagtggaa

SEQ ID NO: 8380848 - DNA, 22 bp, Homo sapiens
taggtttaggagtgaaggtgaa

SEQ ID NO: 8380849 - DNA, 22 bp, Homo sapiens
taggtttaggagtgaaggtgaa

SEQ ID NO: 8380850 - DNA, 22 bp, Homo sapiens
tagtaaaagtttagttgaaagt

SEQ ID NO: 8380851 - DNA, 22 bp, Homo sapiens
tagtaaaagtttagttgaaagt

SEQ ID NO: 8380852 - DNA, 22 bp, Homo sapiens
tagtacagttccatcaaagcag

SEQ ID NO: 8380853 - DNA, 22 bp, Homo sapiens
tagtccagccttgggtgtagcc

SEQ ID NO: 8380854 - DNA, 22 bp, Homo sapiens
tagtccagtaaaacagctaacg

SEQ ID NO: 8380855 - DNA, 22 bp, Homo sapiens
tagtccaggtttccatctccac

SEQ ID NO: 8380856 - DNA, 22 bp, Homo sapiens
tagtctctaggaggggaaaaga

SEQ ID NO: 8380857 - DNA, 19 bp, Homo sapiens
tagtggagtgacaagttct

SEQ ID NO: 8380858 - DNA, 22 bp, Homo sapiens
tagtggcattgttgtgaggatt

SEQ ID NO: 8380859 - DNA, 22 bp, Homo sapiens
tagcacagcttcttgatgtcac

SEQ ID NO: 8380860 - DNA, 22 bp, Homo sapiens
tagcacacactgcatctacaaa

SEQ ID NO: 8380861 - DNA, 22 bp, Homo sapiens
tagcacactgcatatgaagatt

SEQ ID NO: 8380862 - DNA, 22 bp, Homo sapiens
tagatgtgttgcctggagttgt

SEQ ID NO: 8380863 - DNA, 20 bp, Homo sapiens
tagatgtttcctgtcataaa

SEQ ID NO: 8380864 - DNA, 22 bp, Homo sapiens
tagatgtttgagaagtttatgt

SEQ ID NO: 8380865 - DNA, 22 bp, Homo sapiens
tagattttgcatttctaacaag

SEQ ID NO: 8380866 - DNA, 22 bp, Homo sapiens
tagattttgcatttctaacaag

SEQ ID NO: 8380867 - DNA, 22 bp, Homo sapiens
tagcatttcactgatcttcact

SEQ ID NO: 8380868 - DNA, 22 bp, Homo sapiens
tagccacatgcagactttcatg

SEQ ID NO: 8380869 - DNA, 22 bp, Homo sapiens
tagccagctgaatgcactacag

SEQ ID NO: 8380870 - DNA, 22 bp, Homo sapiens
tagccagctggataatgtgggg

SEQ ID NO: 8380871 - DNA, 22 bp, Homo sapiens
tagccaggcaattatgggtgat

SEQ ID NO: 8380872 - DNA, 22 bp, Homo sapiens
tagccagtttctttaacagcaa

SEQ ID NO: 8380873 - DNA, 22 bp, Homo sapiens
tagccatcattctcacattctt

SEQ ID NO: 8380874 - DNA, 22 bp, Homo sapiens
tagccagttgcccagagtagaa

SEQ ID NO: 8380875 - DNA, 22 bp, Homo sapiens
tagccatgagcagatcactata

SEQ ID NO: 8380876 - DNA, 22 bp, Homo sapiens
tagcagggttttgaagagggtt

SEQ ID NO: 8380877 - DNA, 22 bp, Homo sapiens
tagcacccacctcgtggggttt

SEQ ID NO: 8380878 - DNA, 22 bp, Homo sapiens
tagcaccatttaaacatctctg

SEQ ID NO: 8380879 - DNA, 22 bp, Homo sapiens
tagcaccacaatcaagatacag

SEQ ID NO: 8380880 - DNA, 22 bp, Homo sapiens
tagcacccatggaatctgctgg

SEQ ID NO: 8380881 - DNA, 22 bp, Homo sapiens
tagcaccggatggcaagcaaca

SEQ ID NO: 8380882 - DNA, 22 bp, Homo sapiens
tagcacctgatacctagtatgt

SEQ ID NO: 8380883 - DNA, 22 bp, Homo sapiens
tagcacctagagtattttatca

SEQ ID NO: 8380884 - DNA, 22 bp, Homo sapiens
tagcacctgtgcacaccaggca

SEQ ID NO: 8380885 - DNA, 22 bp, Homo sapiens
tagcaccttaactctgctgcgt

SEQ ID NO: 8380886 - DNA, 22 bp, Homo sapiens
tagcacctggtcaattcagtca

SEQ ID NO: 8380887 - DNA, 22 bp, Homo sapiens
tagcacctgcaggatgtgcaca

SEQ ID NO: 8380888 - DNA, 22 bp, Homo sapiens
tagcacctgcaggatgtgcaca

SEQ ID NO: 8380889 - DNA, 22 bp, Homo sapiens
tagcacagttcactatgataca

SEQ ID NO: 8380890 - DNA, 22 bp, Homo sapiens
tagcacagttcactatgataca

SEQ ID NO: 8380891 - DNA, 22 bp, Homo sapiens
tagcaccaaacatatactcagt

SEQ ID NO: 8380892 - DNA, 22 bp, Homo sapiens
tagaatcatacctctaggaaca

SEQ ID NO: 8380893 - DNA, 22 bp, Homo sapiens
tagaataagttgatgatatatg

SEQ ID NO: 8380894 - DNA, 22 bp, Homo sapiens
tactttcatgtctatacatatt

SEQ ID NO: 8380895 - DNA, 22 bp, Homo sapiens
tactttctgtccttctgttaaa

SEQ ID NO: 8380896 - DNA, 22 bp, Homo sapiens
tactttctaagacatacaactt

SEQ ID NO: 8380897 - DNA, 22 bp, Homo sapiens
tactttattgtaaatgctgatg

SEQ ID NO: 8380898 - DNA, 22 bp, Homo sapiens
tactttctgtccttctgttaaa

SEQ ID NO: 8380899 - DNA, 22 bp, Homo sapiens
tactttcttgttcctttcataa

SEQ ID NO: 8380900 - DNA, 22 bp, Homo sapiens
tactttcttgttcctttcataa

SEQ ID NO: 8380901 - DNA, 22 bp, Homo sapiens
tactttctttctgatccttatg

SEQ ID NO: 8380902 - DNA, 22 bp, Homo sapiens
tactttctttcccaagaggtgg

SEQ ID NO: 8380903 - DNA, 23 bp, Homo sapiens
tagagcagccccgaggtgctgtc

SEQ ID NO: 8380904 - DNA, 22 bp, Homo sapiens
tagagcagaacttgttaacacc

SEQ ID NO: 8380905 - DNA, 22 bp, Homo sapiens
tagagcagttggcagctgtatt

SEQ ID NO: 8380906 - DNA, 23 bp, Homo sapiens
tagagcagggaaatctgtcagag

SEQ ID NO: 8380907 - DNA, 23 bp, Homo sapiens
tagagcagtagatcaccatggga

SEQ ID NO: 8380908 - DNA, 22 bp, Homo sapiens
tagagcagtgggtaccatggca

SEQ ID NO: 8380909 - DNA, 22 bp, Homo sapiens
tagaggagcggcgagctgagct

SEQ ID NO: 8380910 - DNA, 22 bp, Homo sapiens
tagaggagagttgctggatgga

SEQ ID NO: 8380911 - DNA, 22 bp, Homo sapiens
tagatgaccttgtgttaggcaa

SEQ ID NO: 8380912 - DNA, 22 bp, Homo sapiens
ggacagagccctggtggcctaa

SEQ ID NO: 8380913 - DNA, 21 bp, Homo sapiens
ggacaccagtcacactggatt

SEQ ID NO: 8380914 - DNA, 22 bp, Homo sapiens
ggacactgttcatggggagggg

SEQ ID NO: 8380915 - DNA, 23 bp, Homo sapiens
ggaccctgtggagggtgagagtc

SEQ ID NO: 8380916 - DNA, 23 bp, Homo sapiens
ggaccctgtggagggtgagagtc

SEQ ID NO: 8380917 - DNA, 22 bp, Homo sapiens
ggaccctggagacccactggga

SEQ ID NO: 8380918 - DNA, 22 bp, Homo sapiens
ggaccctgcagccacccgacat

SEQ ID NO: 8380919 - DNA, 22 bp, Homo sapiens
ggaccctgggcagctggctgct

SEQ ID NO: 8380920 - DNA, 22 bp, Homo sapiens
ggaccctgggcttgctcctggg

SEQ ID NO: 8380921 - DNA, 22 bp, Homo sapiens
ggacccagctctgagaccctgc

SEQ ID NO: 8380922 - DNA, 22 bp, Homo sapiens
ggacccaggtagggaggaagat

SEQ ID NO: 8380923 - DNA, 18 bp, Homo sapiens
ggacccagggcctcaccc

SEQ ID NO: 8380924 - DNA, 22 bp, Homo sapiens
ggacccaccaggccgggctcca

SEQ ID NO: 8380925 - DNA, 21 bp, Homo sapiens
ggacagaggagaaggcaccct

SEQ ID NO: 8380926 - DNA, 22 bp, Homo sapiens
ggacagagggcaggagcccaga

SEQ ID NO: 8380927 - DNA, 22 bp, Homo sapiens
ggacagagggcaggagcccaga

SEQ ID NO: 8380928 - DNA, 22 bp, Homo sapiens
ggactctgtagaggttctcatt

SEQ ID NO: 8380929 - DNA, 22 bp, Homo sapiens
ggactgaggacatgtgaggcat

SEQ ID NO: 8380930 - DNA, 22 bp, Homo sapiens
ggagagctggtagctggctcca

SEQ ID NO: 8380931 - DNA, 22 bp, Homo sapiens
ggagagctggtatatgaagaca

SEQ ID NO: 8380932 - DNA, 22 bp, Homo sapiens
ggagagctggtagctggctcca

SEQ ID NO: 8380933 - DNA, 22 bp, Homo sapiens
ggagaggagctattgggggctc

SEQ ID NO: 8380934 - DNA, 22 bp, Homo sapiens
ggagagctggtatatgaagaca

SEQ ID NO: 8380935 - DNA, 22 bp, Homo sapiens
ggagagcttggagtgcgatttt

SEQ ID NO: 8380936 - DNA, 22 bp, Homo sapiens
ggagaggaaatgccagcacttc

SEQ ID NO: 8380937 - DNA, 22 bp, Homo sapiens
ggagaggaaatgccagcacttc

SEQ ID NO: 8380938 - DNA, 22 bp, Homo sapiens
ggaaatctctactttgtcattt

SEQ ID NO: 8380939 - DNA, 22 bp, Homo sapiens
ggaaatctcttttgtggtgttt

SEQ ID NO: 8380940 - DNA, 21 bp, Homo sapiens
ggaacattgttaatagtctct

SEQ ID NO: 8380941 - DNA, 22 bp, Homo sapiens
ggaagccagagtgctgggcagg

SEQ ID NO: 8380942 - DNA, 18 bp, Homo sapiens
ggaaggaagaatgcattt

SEQ ID NO: 8380943 - DNA, 18 bp, Homo sapiens
ggaaggaagaatgcattt

SEQ ID NO: 8380944 - DNA, 18 bp, Homo sapiens
ggaaggaagaatgcattt

SEQ ID NO: 8380945 - DNA, 22 bp, Homo sapiens
ggaaggaaattggggcagttgt

SEQ ID NO: 8380946 - DNA, 22 bp, Homo sapiens
ggaaggaagtgaccaggatatc

SEQ ID NO: 8380947 - DNA, 22 bp, Homo sapiens
ggaaggaagtgaccaggatatc

SEQ ID NO: 8380948 - DNA, 22 bp, Homo sapiens
ggaaggaagtaaatgatgctat

SEQ ID NO: 8380949 - DNA, 22 bp, Homo sapiens
ggaagctgttgtgagtgcagca

SEQ ID NO: 8380950 - DNA, 22 bp, Homo sapiens
ggaagctgttgtgagtgcagca

SEQ ID NO: 8380951 - DNA, 21 bp, Homo sapiens
ggaagctgtgtccatgctcct

SEQ ID NO: 8380952 - DNA, 21 bp, Homo sapiens
ggaagctgtgtccatgctcct

SEQ ID NO: 8380953 - DNA, 19 bp, Homo sapiens
ggaagccaggtcagcccac

SEQ ID NO: 8380954 - DNA, 22 bp, Homo sapiens
ggaagccaggttactgttcaga

SEQ ID NO: 8380955 - DNA, 22 bp, Homo sapiens
ggaaaggagatattggagagtg

SEQ ID NO: 8380956 - DNA, 22 bp, Homo sapiens
ggaaaggagatattggagagtg

SEQ ID NO: 8380957 - DNA, 22 bp, Homo sapiens
ggaaagctttgttttcctcacc

SEQ ID NO: 8380958 - DNA, 22 bp, Homo sapiens
ggaaagctttgtacttgaaaac

SEQ ID NO: 8380959 - DNA, 22 bp, Homo sapiens
ggaaagctcagatcttgttgga

SEQ ID NO: 8380960 - DNA, 22 bp, Homo sapiens
ggaaaggcaggggccctgccca

SEQ ID NO: 8380961 - DNA, 22 bp, Homo sapiens
ggaaatctcagatctcccagat

SEQ ID NO: 8380962 - DNA, 22 bp, Homo sapiens
ggaaatattttgtctaatttgt

SEQ ID NO: 8380963 - DNA, 22 bp, Homo sapiens
ggaaatcaaggggacaaattgt

SEQ ID NO: 8380964 - DNA, 22 bp, Homo sapiens
ggaaagggcatggccttttcac

SEQ ID NO: 8380965 - DNA, 23 bp, Homo sapiens
gcttcccagacaatactgcttcc

SEQ ID NO: 8380966 - DNA, 22 bp, Homo sapiens
gcttcccagcagaggaaagact

SEQ ID NO: 8380967 - DNA, 22 bp, Homo sapiens
gcttcccaggcgcctgaccttt

SEQ ID NO: 8380968 - DNA, 20 bp, Homo sapiens
gcttcccaattcttgatctg

SEQ ID NO: 8380969 - DNA, 22 bp, Homo sapiens
gcttccggagccaaaaggcccc

SEQ ID NO: 8380970 - DNA, 22 bp, Homo sapiens
gcttcccattatggaaactctt

SEQ ID NO: 8380971 - DNA, 22 bp, Homo sapiens
gcttcccatagtggaattcggg

SEQ ID NO: 8380972 - DNA, 22 bp, Homo sapiens
gctgggagcaaagccatgcata

SEQ ID NO: 8380973 - DNA, 22 bp, Homo sapiens
gctgggaggatctctccctgtc

SEQ ID NO: 8380974 - DNA, 22 bp, Homo sapiens
gctgggagaggccctgaagtga

SEQ ID NO: 8380975 - DNA, 22 bp, Homo sapiens
gctgggacggctcagtaagaag

SEQ ID NO: 8380976 - DNA, 22 bp, Homo sapiens
gctgggactgagacagtgacct

SEQ ID NO: 8380977 - DNA, 22 bp, Homo sapiens
gctgggactgagacagtgacct

SEQ ID NO: 8380978 - DNA, 22 bp, Homo sapiens
gctgggaagtggcagagctgga

SEQ ID NO: 8380979 - DNA, 22 bp, Homo sapiens
gctgggaatgattttggagagg

SEQ ID NO: 8380980 - DNA, 22 bp, Homo sapiens
gctgggacaacaggtgagcacc

SEQ ID NO: 8380981 - DNA, 22 bp, Homo sapiens
gctgggaagagatgcacatgat

SEQ ID NO: 8380982 - DNA, 22 bp, Homo sapiens
gctgggaagtgcaagatcaagg

SEQ ID NO: 8380983 - DNA, 22 bp, Homo sapiens
gctgggaaccatgggaaggcag

SEQ ID NO: 8380984 - DNA, 22 bp, Homo sapiens
gctgggaagaacaggagagaat

SEQ ID NO: 8380985 - DNA, 22 bp, Homo sapiens
gctgggaaccatgggaaggcag

SEQ ID NO: 8380986 - DNA, 22 bp, Homo sapiens
gctggctcttcagtggagatag

SEQ ID NO: 8380987 - DNA, 22 bp, Homo sapiens
gctggctctgatgggctccagg

SEQ ID NO: 8380988 - DNA, 22 bp, Homo sapiens
gctggctgccaatttcagagct

SEQ ID NO: 8380989 - DNA, 22 bp, Homo sapiens
gctggctgccttactttgtgga

SEQ ID NO: 8380990 - DNA, 22 bp, Homo sapiens
gctggctgcacaggggctcact

SEQ ID NO: 8380991 - DNA, 22 bp, Homo sapiens
gctggctcaagaggtccagagg

SEQ ID NO: 8380992 - DNA, 22 bp, Homo sapiens
gctggcagggacagctgcgtgt

SEQ ID NO: 8380993 - DNA, 22 bp, Homo sapiens
gctggctcaagtgtgcttccca

SEQ ID NO: 8380994 - DNA, 22 bp, Homo sapiens
gctggcaggataacttctaagc

SEQ ID NO: 8380995 - DNA, 22 bp, Homo sapiens
gctggcaggatagaagtctaat

SEQ ID NO: 8380996 - DNA, 22 bp, Homo sapiens
gctggcaggatagaagtctaat

SEQ ID NO: 8380997 - DNA, 22 bp, Homo sapiens
gctggcagccaagtgaagaggg

SEQ ID NO: 8380998 - DNA, 22 bp, Homo sapiens
gctggcagagacaagaagacta

SEQ ID NO: 8380999 - DNA, 22 bp, Homo sapiens
gctggcagagacaagaagacta

SEQ ID NO: 8381000 - DNA, 22 bp, Homo sapiens
gctgcccaatggtagtgtcttt

SEQ ID NO: 8381001 - DNA, 22 bp, Homo sapiens
gctgccatgttgtgaggacact

SEQ ID NO: 8381002 - DNA, 22 bp, Homo sapiens
gctggcagactgggggcagaac

SEQ ID NO: 8381003 - DNA, 22 bp, Homo sapiens
gctggcagacttcctctggaac

SEQ ID NO: 8381004 - DNA, 22 bp, Homo sapiens
gctggcagacttcctctggaac

SEQ ID NO: 8381005 - DNA, 22 bp, Homo sapiens
gctggcagacttcctctggaac

SEQ ID NO: 8381006 - DNA, 22 bp, Homo sapiens
gctggcagaagagctggttcaa

SEQ ID NO: 8381007 - DNA, 22 bp, Homo sapiens
gctggcagaatttcttcttgct

SEQ ID NO: 8381008 - DNA, 22 bp, Homo sapiens
gctggcagaatttcttcttgct

SEQ ID NO: 8381009 - DNA, 22 bp, Homo sapiens
gctgtgcagccaagtgcctctg

SEQ ID NO: 8381010 - DNA, 22 bp, Homo sapiens
gctgtgcccagctccagctctg

SEQ ID NO: 8381011 - DNA, 22 bp, Homo sapiens
gcttccaatgcttctatcacat

SEQ ID NO: 8381012 - DNA, 22 bp, Homo sapiens
gcttccaagtcaatcaatgctg

SEQ ID NO: 8381013 - DNA, 22 bp, Homo sapiens
gcttccaagcggtagatagcat

SEQ ID NO: 8381014 - DNA, 22 bp, Homo sapiens
gcttccaaatctgttcaaaatg

SEQ ID NO: 8381015 - DNA, 21 bp, Homo sapiens
gcttccaagatggcaccttga

SEQ ID NO: 8381016 - DNA, 22 bp, Homo sapiens
gcttccaaacaaaattttgatg

SEQ ID NO: 8381017 - DNA, 22 bp, Homo sapiens
gcttcccaaacttgtggataga

SEQ ID NO: 8381018 - DNA, 22 bp, Homo sapiens
gcttccagtaagttgctgccat

SEQ ID NO: 8381019 - DNA, 22 bp, Homo sapiens
gcttccagtcctcagaggctgg

SEQ ID NO: 8381020 - DNA, 22 bp, Homo sapiens
gctgtctttcccctgctccaga

SEQ ID NO: 8381021 - DNA, 22 bp, Homo sapiens
gctgtcttgctcactcttgcag

SEQ ID NO: 8381022 - DNA, 22 bp, Homo sapiens
gctgtgagggcttctgaggcat

SEQ ID NO: 8381023 - DNA, 22 bp, Homo sapiens
gctgtgagggtctagtgaggtg

SEQ ID NO: 8381024 - DNA, 22 bp, Homo sapiens
gctgtgatccttgagagaaggt

SEQ ID NO: 8381025 - DNA, 22 bp, Homo sapiens
gctgtgataaatgcagatgtca

SEQ ID NO: 8381026 - DNA, 23 bp, Homo sapiens
gctgtgcacgagccactgcctgt

SEQ ID NO: 8381027 - DNA, 22 bp, Homo sapiens
gctgggttttcttccgggccta

SEQ ID NO: 8381028 - DNA, 22 bp, Homo sapiens
gctgggtctggatgctcaggtg

SEQ ID NO: 8381029 - DNA, 19 bp, Homo sapiens
gctgggtgaggtcgttgga

SEQ ID NO: 8381030 - DNA, 19 bp, Homo sapiens
gctgggtggggtccacagc

SEQ ID NO: 8381031 - DNA, 22 bp, Homo sapiens
gctggggtctgtgaggagggct

SEQ ID NO: 8381032 - DNA, 22 bp, Homo sapiens
gctggggtgtggtggataagct

SEQ ID NO: 8381033 - DNA, 16 bp, Homo sapiens
gctgggagggagaggt

SEQ ID NO: 8381034 - DNA, 22 bp, Homo sapiens
gctggggctgggctgaggaaga

SEQ ID NO: 8381035 - DNA, 22 bp, Homo sapiens
gcctcaggcctatagctgctgt

SEQ ID NO: 8381036 - DNA, 22 bp, Homo sapiens
gcctggctgccggccttggcaa

SEQ ID NO: 8381037 - DNA, 22 bp, Homo sapiens
gcctggcttcccttggagcatt

SEQ ID NO: 8381038 - DNA, 18 bp, Homo sapiens
gcctggcttcggagccgc

SEQ ID NO: 8381039 - DNA, 22 bp, Homo sapiens
gcctggctggtcactgcctggc

SEQ ID NO: 8381040 - DNA, 22 bp, Homo sapiens
gccttcagtagtatcctcatga

SEQ ID NO: 8381041 - DNA, 22 bp, Homo sapiens
gccttcagtagtgtcagctgta

SEQ ID NO: 8381042 - DNA, 22 bp, Homo sapiens
gccttcagcggccgctcgctgc

SEQ ID NO: 8381043 - DNA, 22 bp, Homo sapiens
gccttcaggaaatcagtccttg

SEQ ID NO: 8381044 - DNA, 22 bp, Homo sapiens
gccttcaggagggttccagaca

SEQ ID NO: 8381045 - DNA, 22 bp, Homo sapiens
gccttcagccctgactggccag

SEQ ID NO: 8381046 - DNA, 22 bp, Homo sapiens
gccttcagagtaccatgtcctc

SEQ ID NO: 8381047 - DNA, 22 bp, Homo sapiens
gccttcagagtaccatgtcctc

SEQ ID NO: 8381048 - DNA, 18 bp, Homo sapiens
gccttcagactgcatgct

SEQ ID NO: 8381049 - DNA, 22 bp, Homo sapiens
gcctggtctctggggttgggta

SEQ ID NO: 8381050 - DNA, 22 bp, Homo sapiens
gccttccacctaggcctctgct

SEQ ID NO: 8381051 - DNA, 22 bp, Homo sapiens
gccttccacctaggcctctgct

SEQ ID NO: 8381052 - DNA, 22 bp, Homo sapiens
gccttccacgtcaggggaaata

SEQ ID NO: 8381053 - DNA, 17 bp, Homo sapiens
gccttctctgccctcac

SEQ ID NO: 8381054 - DNA, 22 bp, Homo sapiens
gccttctctgtgagctcctagg

SEQ ID NO: 8381055 - DNA, 22 bp, Homo sapiens
gccttctgcgctcgtgtctccg

SEQ ID NO: 8381056 - DNA, 22 bp, Homo sapiens
gcgctgcgcctcctcttccgca

SEQ ID NO: 8381057 - DNA, 22 bp, Homo sapiens
gcggcagaggtgttgcgagcga

SEQ ID NO: 8381058 - DNA, 22 bp, Homo sapiens
gcggcggagacagcaggaagcc

SEQ ID NO: 8381059 - DNA, 22 bp, Homo sapiens
gcgggccaccttggagagcgct

SEQ ID NO: 8381060 - DNA, 18 bp, Homo sapiens
gctcaggccctagtcagt

SEQ ID NO: 8381061 - DNA, 22 bp, Homo sapiens
gctcaccactgctagagtctat

SEQ ID NO: 8381062 - DNA, 22 bp, Homo sapiens
gctcacatcatagtaagctcat

SEQ ID NO: 8381063 - DNA, 22 bp, Homo sapiens
gctcacagttctatttttcatg

SEQ ID NO: 8381064 - DNA, 22 bp, Homo sapiens
gctcacaggggcagacgagttg

SEQ ID NO: 8381065 - DNA, 22 bp, Homo sapiens
gctcaagccttctgcccacctc

SEQ ID NO: 8381066 - DNA, 22 bp, Homo sapiens
gctcaagccttctgcccacctc

SEQ ID NO: 8381067 - DNA, 22 bp, Homo sapiens
gctcaatgctcaatgctgcaaa

SEQ ID NO: 8381068 - DNA, 22 bp, Homo sapiens
gctcaagacccctctgtgactg

SEQ ID NO: 8381069 - DNA, 22 bp, Homo sapiens
gctcaagactgttagcctggca

SEQ ID NO: 8381070 - DNA, 22 bp, Homo sapiens
gcggggggaggaacatcttgca

SEQ ID NO: 8381071 - DNA, 22 bp, Homo sapiens
gcggggggaggaacatcttgca

SEQ ID NO: 8381072 - DNA, 22 bp, Homo sapiens
gctatgaacatgagaatgcaaa

SEQ ID NO: 8381073 - DNA, 21 bp, Homo sapiens
gctcaggctcttgacagagca

SEQ ID NO: 8381074 - DNA, 22 bp, Homo sapiens
gctcaggcctcggacacacaat

SEQ ID NO: 8381075 - DNA, 22 bp, Homo sapiens
gctcctggtctggagcttcaag

SEQ ID NO: 8381076 - DNA, 22 bp, Homo sapiens
gctcctggtgcaaagtttcttc

SEQ ID NO: 8381077 - DNA, 22 bp, Homo sapiens
gctcctggtgcaaagtttcttc

SEQ ID NO: 8381078 - DNA, 22 bp, Homo sapiens
gctctcactttaggttggaccg

SEQ ID NO: 8381079 - DNA, 22 bp, Homo sapiens
gctctcagaagtaacttgtcca

SEQ ID NO: 8381080 - DNA, 21 bp, Homo sapiens
gctctcagctgcctgctggtt

SEQ ID NO: 8381081 - DNA, 22 bp, Homo sapiens
gctcctggtgctgtagagattt

SEQ ID NO: 8381082 - DNA, 21 bp, Homo sapiens
gctcctggtgctgcgtggcgc

SEQ ID NO: 8381083 - DNA, 21 bp, Homo sapiens
gctcctggtgctgcgtggcgc

SEQ ID NO: 8381084 - DNA, 18 bp, Homo sapiens
gctcctggttggaaagaa

SEQ ID NO: 8381085 - DNA, 23 bp, Homo sapiens
gctctggcagcttgtgtcagcac

SEQ ID NO: 8381086 - DNA, 22 bp, Homo sapiens
gctctggcagctgatattagga

SEQ ID NO: 8381087 - DNA, 22 bp, Homo sapiens
gctctgctgcttactagatggt

SEQ ID NO: 8381088 - DNA, 22 bp, Homo sapiens
gctctgctgacagctgggacag

SEQ ID NO: 8381089 - DNA, 21 bp, Homo sapiens
gctctggcctactgttccctc

SEQ ID NO: 8381090 - DNA, 23 bp, Homo sapiens
gctctgctctgtttcatagacag

SEQ ID NO: 8381091 - DNA, 17 bp, Homo sapiens
gctctgcctctcccacc

SEQ ID NO: 8381092 - DNA, 22 bp, Homo sapiens
gctctgcccaggaccgtccttg

SEQ ID NO: 8381093 - DNA, 18 bp, Homo sapiens
gctctgcccaggctgccc

SEQ ID NO: 8381094 - DNA, 22 bp, Homo sapiens
gctctgcccagtgccctgagac

SEQ ID NO: 8381095 - DNA, 22 bp, Homo sapiens
gctctcagggtgatggcatact

SEQ ID NO: 8381096 - DNA, 22 bp, Homo sapiens
gctgcagctgtaggacacaatt

SEQ ID NO: 8381097 - DNA, 22 bp, Homo sapiens
gctgcagctcgccttccggcct

SEQ ID NO: 8381098 - DNA, 23 bp, Homo sapiens
gctgcagctgtggatgttctcag

SEQ ID NO: 8381099 - DNA, 22 bp, Homo sapiens
gctgcagctttaggatccagtg

SEQ ID NO: 8381100 - DNA, 22 bp, Homo sapiens
gctgcaggagctggagctgtgg

SEQ ID NO: 8381101 - DNA, 22 bp, Homo sapiens
gctgccactctgagcttgcttc

SEQ ID NO: 8381102 - DNA, 22 bp, Homo sapiens
gctgcaggatgaggctctgctc

SEQ ID NO: 8381103 - DNA, 22 bp, Homo sapiens
gctgccagctcactctcctgag

SEQ ID NO: 8381104 - DNA, 22 bp, Homo sapiens
gctgccaggggcagctgtctca

SEQ ID NO: 8381105 - DNA, 22 bp, Homo sapiens
gctgccatcccctgctgggctg

SEQ ID NO: 8381106 - DNA, 22 bp, Homo sapiens
gctgccatctcctgaggacagg

SEQ ID NO: 8381107 - DNA, 22 bp, Homo sapiens
gctgccagtgtggcatgatgca

SEQ ID NO: 8381108 - DNA, 22 bp, Homo sapiens
gctgaagataggcatttcagca

SEQ ID NO: 8381109 - DNA, 22 bp, Homo sapiens
gctgaagctgacacatagtgct

SEQ ID NO: 8381110 - DNA, 22 bp, Homo sapiens
gctgatataaaattacagagga

SEQ ID NO: 8381111 - DNA, 22 bp, Homo sapiens
gctgatatgattgataaaggta

SEQ ID NO: 8381112 - DNA, 22 bp, Homo sapiens
gctgatattttgaagggcaagg

SEQ ID NO: 8381113 - DNA, 23 bp, Homo sapiens
gctgatggagacttgtggcctcc

SEQ ID NO: 8381114 - DNA, 22 bp, Homo sapiens
gctgatggcttgctggctgaca

SEQ ID NO: 8381115 - DNA, 22 bp, Homo sapiens
gctgcactttgactgctggggt

SEQ ID NO: 8381116 - DNA, 22 bp, Homo sapiens
gctgcaccagctccaccagggc

SEQ ID NO: 8381117 - DNA, 19 bp, Homo sapiens
gctgcacacccagcaactg

SEQ ID NO: 8381118 - DNA, 22 bp, Homo sapiens
gctgcaagttagtatacattct

SEQ ID NO: 8381119 - DNA, 22 bp, Homo sapiens
gctgattctgaggtgctttcct

SEQ ID NO: 8381120 - DNA, 22 bp, Homo sapiens
gctgcaagcatgtcatcctcac

SEQ ID NO: 8381121 - DNA, 22 bp, Homo sapiens
gctgcaagtcacagaaacagtg

SEQ ID NO: 8381122 - DNA, 22 bp, Homo sapiens
gctgcaagtcatggcttttgca

SEQ ID NO: 8381123 - DNA, 22 bp, Homo sapiens
gctgcaagtccttccctctctt

SEQ ID NO: 8381124 - DNA, 22 bp, Homo sapiens
gcccagtttcagctctgccttt

SEQ ID NO: 8381125 - DNA, 22 bp, Homo sapiens
gcccagggcttcaaagagagaa

SEQ ID NO: 8381126 - DNA, 23 bp, Homo sapiens
gcccatgctgttgggcccgagca

SEQ ID NO: 8381127 - DNA, 22 bp, Homo sapiens
gcccaggctggagtgcagtggt

SEQ ID NO: 8381128 - DNA, 22 bp, Homo sapiens
gcccagggcgatggtcggggcc

SEQ ID NO: 8381129 - DNA, 22 bp, Homo sapiens
gcccaggctggagttcagtggt

SEQ ID NO: 8381130 - DNA, 22 bp, Homo sapiens
gccctgagccaccaatgccatt

SEQ ID NO: 8381131 - DNA, 22 bp, Homo sapiens
gccctgagcctatgagcctctc

SEQ ID NO: 8381132 - DNA, 22 bp, Homo sapiens
gcctcagctgttgcaggggccc

SEQ ID NO: 8381133 - DNA, 22 bp, Homo sapiens
gcctcagctcccagcccaggct

SEQ ID NO: 8381134 - DNA, 22 bp, Homo sapiens
gcctcagctcccagcccaggct

SEQ ID NO: 8381135 - DNA, 22 bp, Homo sapiens
gcctcagccggcggacgccagg

SEQ ID NO: 8381136 - DNA, 22 bp, Homo sapiens
gcctcagccggcggacgccagg

SEQ ID NO: 8381137 - DNA, 20 bp, Homo sapiens
gcctcagccaacccatgggg

SEQ ID NO: 8381138 - DNA, 20 bp, Homo sapiens
gcctcagccaacccatgggg

SEQ ID NO: 8381139 - DNA, 22 bp, Homo sapiens
gcctcagagggccctagggaca

SEQ ID NO: 8381140 - DNA, 22 bp, Homo sapiens
gccctgagggacctcaccccat

SEQ ID NO: 8381141 - DNA, 22 bp, Homo sapiens
gcctcagaaagtggcaggtagg

SEQ ID NO: 8381142 - DNA, 22 bp, Homo sapiens
gccaggtccagggtggagcgct

SEQ ID NO: 8381143 - DNA, 23 bp, Homo sapiens
gccaggcacatggtggacacgca

SEQ ID NO: 8381144 - DNA, 22 bp, Homo sapiens
gccaggcacagttctaggtgct

SEQ ID NO: 8381145 - DNA, 22 bp, Homo sapiens
gccaggagttcagatgcatgtt

SEQ ID NO: 8381146 - DNA, 22 bp, Homo sapiens
gccaggagttcagatgcatgtt

SEQ ID NO: 8381147 - DNA, 22 bp, Homo sapiens
gccaggtctgggtagcagagga

SEQ ID NO: 8381148 - DNA, 22 bp, Homo sapiens
gccaggacctcagatgcagggc

SEQ ID NO: 8381149 - DNA, 22 bp, Homo sapiens
gccaggaatggagaggtggcct

SEQ ID NO: 8381150 - DNA, 22 bp, Homo sapiens
gccaggactagagggaggtgag

SEQ ID NO: 8381151 - DNA, 22 bp, Homo sapiens
gccaggagaaaaggcgaatgat

SEQ ID NO: 8381152 - DNA, 22 bp, Homo sapiens
gccaggagaaaaggcgaatgat

SEQ ID NO: 8381153 - DNA, 22 bp, Homo sapiens
gccaggactgagaatgggagca

SEQ ID NO: 8381154 - DNA, 22 bp, Homo sapiens
gccaggactgagaatgggagca

SEQ ID NO: 8381155 - DNA, 22 bp, Homo sapiens
gccaggagagctccttcaggtt

SEQ ID NO: 8381156 - DNA, 22 bp, Homo sapiens
gccaggagagctccttcaggtt

SEQ ID NO: 8381157 - DNA, 22 bp, Homo sapiens
gccaggagaatgctagcagagg

SEQ ID NO: 8381158 - DNA, 22 bp, Homo sapiens
gccaggagaatgctagcagagg

SEQ ID NO: 8381159 - DNA, 22 bp, Homo sapiens
gccaggagccctgggcaagttc

SEQ ID NO: 8381160 - DNA, 22 bp, Homo sapiens
gccaggaggctgctgtgtaggc

SEQ ID NO: 8381161 - DNA, 18 bp, Homo sapiens
gcccagaggtctgggccc

SEQ ID NO: 8381162 - DNA, 23 bp, Homo sapiens
gcccagagaggctcaccaggaat

SEQ ID NO: 8381163 - DNA, 22 bp, Homo sapiens
gcccagaaagcatcattgtgga

SEQ ID NO: 8381164 - DNA, 22 bp, Homo sapiens
gcccagagagatgctgtagacc

SEQ ID NO: 8381165 - DNA, 22 bp, Homo sapiens
gcccacagtacgaggctcaggc

SEQ ID NO: 8381166 - DNA, 22 bp, Homo sapiens
gccagtggcttgccaggcagga

SEQ ID NO: 8381167 - DNA, 22 bp, Homo sapiens
gccagtggccctctggagaagg

SEQ ID NO: 8381168 - DNA, 22 bp, Homo sapiens
gccagtggagcacatggtgaag

SEQ ID NO: 8381169 - DNA, 22 bp, Homo sapiens
gccagtctgataggggagaagt

SEQ ID NO: 8381170 - DNA, 22 bp, Homo sapiens
gccagaggcccaaggacagctg

SEQ ID NO: 8381171 - DNA, 22 bp, Homo sapiens
gccagaggcccaaggacagctg

SEQ ID NO: 8381172 - DNA, 22 bp, Homo sapiens
gccagaggaacgctgcgcgccc

SEQ ID NO: 8381173 - DNA, 22 bp, Homo sapiens
gccagcaggtggagagatcaag

SEQ ID NO: 8381174 - DNA, 22 bp, Homo sapiens
gccagcagggcggagccatcta

SEQ ID NO: 8381175 - DNA, 22 bp, Homo sapiens
gccagcagggcccaaatgctgg

SEQ ID NO: 8381176 - DNA, 22 bp, Homo sapiens
gccagcaggttgtcaaggagct

SEQ ID NO: 8381177 - DNA, 22 bp, Homo sapiens
gccagcagtatgtcctggcagt

SEQ ID NO: 8381178 - DNA, 22 bp, Homo sapiens
gccagcagtatgtcctggcagt

SEQ ID NO: 8381179 - DNA, 22 bp, Homo sapiens
gccagcaggttgtcaaggagct

SEQ ID NO: 8381180 - DNA, 22 bp, Homo sapiens
gccagcccagctccaggggaaa

SEQ ID NO: 8381181 - DNA, 22 bp, Homo sapiens
gccagcagtcctgctgtgtgcc

SEQ ID NO: 8381182 - DNA, 22 bp, Homo sapiens
gccagcagtatgtcctggcagt

SEQ ID NO: 8381183 - DNA, 22 bp, Homo sapiens
gccagagagagtccctgggcct

SEQ ID NO: 8381184 - DNA, 22 bp, Homo sapiens
gccagagagactgatacatgct

SEQ ID NO: 8381185 - DNA, 22 bp, Homo sapiens
gccagagaggccttagaatcca

SEQ ID NO: 8381186 - DNA, 22 bp, Homo sapiens
gccagagaggccttagaatcca

SEQ ID NO: 8381187 - DNA, 22 bp, Homo sapiens
gccagagcacaggctggtagta

SEQ ID NO: 8381188 - DNA, 22 bp, Homo sapiens
gccagagcagaatagagtggcc

SEQ ID NO: 8381189 - DNA, 22 bp, Homo sapiens
gcattttaatgaggtttatgag

SEQ ID NO: 8381190 - DNA, 22 bp, Homo sapiens
gcattttaataagattcatagg

SEQ ID NO: 8381191 - DNA, 22 bp, Homo sapiens
gcatttgtgttcttcctagagc

SEQ ID NO: 8381192 - DNA, 22 bp, Homo sapiens
gcatttttctaatcattggcat

SEQ ID NO: 8381193 - DNA, 22 bp, Homo sapiens
gcattttagaatattggagcaa

SEQ ID NO: 8381194 - DNA, 22 bp, Homo sapiens
gccaagcctgtagacacaagct

SEQ ID NO: 8381195 - DNA, 22 bp, Homo sapiens
gccaagctgtttttcagagacg

SEQ ID NO: 8381196 - DNA, 22 bp, Homo sapiens
gccaagctggatgaagaggttg

SEQ ID NO: 8381197 - DNA, 22 bp, Homo sapiens
gccaaggaaggcttcctggaag

SEQ ID NO: 8381198 - DNA, 22 bp, Homo sapiens
gccaaggaaggcttcctggaag

SEQ ID NO: 8381199 - DNA, 21 bp, Homo sapiens
gccaaggaggctagagaacat

SEQ ID NO: 8381200 - DNA, 22 bp, Homo sapiens
gccaaggcctctgcaggatgag

SEQ ID NO: 8381201 - DNA, 22 bp, Homo sapiens
gcatgaaatgagcgaatataat

SEQ ID NO: 8381202 - DNA, 22 bp, Homo sapiens
gcatctgttagagtgtgcatgc

SEQ ID NO: 8381203 - DNA, 19 bp, Homo sapiens
gcatctgcatgatggggtt

SEQ ID NO: 8381204 - DNA, 22 bp, Homo sapiens
gcatgatgaaggaggaggagtc

SEQ ID NO: 8381205 - DNA, 22 bp, Homo sapiens
gcatgaggttcttggccagcat

SEQ ID NO: 8381206 - DNA, 19 bp, Homo sapiens
gcatttctctttacagcca

SEQ ID NO: 8381207 - DNA, 22 bp, Homo sapiens
gcatcggcgtctgttcaggttt

SEQ ID NO: 8381208 - DNA, 19 bp, Homo sapiens
gcatccatggaggccgctt

SEQ ID NO: 8381209 - DNA, 20 bp, Homo sapiens
gcatcctcccagcagagctg

SEQ ID NO: 8381210 - DNA, 22 bp, Homo sapiens
gcatcccaaatctgaaagtcca

SEQ ID NO: 8381211 - DNA, 22 bp, Homo sapiens
gcatcctggctctaggtgtcat

SEQ ID NO: 8381212 - DNA, 22 bp, Homo sapiens
gcatccagaggtagccactgtg

SEQ ID NO: 8381213 - DNA, 22 bp, Homo sapiens
gcagtcctctcattggcctcct

SEQ ID NO: 8381214 - DNA, 22 bp, Homo sapiens
gcagtcctcatcctttagcagt

SEQ ID NO: 8381215 - DNA, 22 bp, Homo sapiens
gcagtcatgggtagaactcaag

SEQ ID NO: 8381216 - DNA, 22 bp, Homo sapiens
gcagtcatttaacctctctgtg

SEQ ID NO: 8381217 - DNA, 22 bp, Homo sapiens
gcagtcatggaaaaatgtatac

SEQ ID NO: 8381218 - DNA, 22 bp, Homo sapiens
gcagtcatcagtcctttaatta

SEQ ID NO: 8381219 - DNA, 22 bp, Homo sapiens
gcagtcatccagcctttccact

SEQ ID NO: 8381220 - DNA, 21 bp, Homo sapiens
gcagtcatcatcaagctttgg

SEQ ID NO: 8381221 - DNA, 22 bp, Homo sapiens
gcagtcatctgagctaactact

SEQ ID NO: 8381222 - DNA, 22 bp, Homo sapiens
gcagtccgctcacccgcattgg

SEQ ID NO: 8381223 - DNA, 22 bp, Homo sapiens
gcagtccattgacagaggtctt

SEQ ID NO: 8381224 - DNA, 22 bp, Homo sapiens
gcagtatctatgtgatgggttg

SEQ ID NO: 8381225 - DNA, 22 bp, Homo sapiens
gcagtcaggttaaggccttccc

SEQ ID NO: 8381226 - DNA, 22 bp, Homo sapiens
gcagtcagtgttgactacatgc

SEQ ID NO: 8381227 - DNA, 22 bp, Homo sapiens
gcagtcataactaatattggtt

SEQ ID NO: 8381228 - DNA, 22 bp, Homo sapiens
gcagtcatcacggcttttaggc

SEQ ID NO: 8381229 - DNA, 22 bp, Homo sapiens
gcagtcatatcattccaacagg

SEQ ID NO: 8381230 - DNA, 22 bp, Homo sapiens
gcagtcagacaggaggagctcc

SEQ ID NO: 8381231 - DNA, 22 bp, Homo sapiens
gcagtcagacaggaggagctcc

SEQ ID NO: 8381232 - DNA, 22 bp, Homo sapiens
gcagggctccactgtggccaag

SEQ ID NO: 8381233 - DNA, 22 bp, Homo sapiens
gaggggctgtggagctctctgg

SEQ ID NO: 8381234 - DNA, 22 bp, Homo sapiens
gagggggcgaacagaagcaagg

SEQ ID NO: 8381235 - DNA, 22 bp, Homo sapiens
gaggggtcttttgttgtcaggg

SEQ ID NO: 8381236 - DNA, 22 bp, Homo sapiens
gagggggcgaacagaagcaagg

SEQ ID NO: 8381237 - DNA, 22 bp, Homo sapiens
gcaagcaaattatttataggca

SEQ ID NO: 8381238 - DNA, 22 bp, Homo sapiens
gcaagcaaaatgggagattccc

SEQ ID NO: 8381239 - DNA, 22 bp, Homo sapiens
gcaagcacagatagactcagcc

SEQ ID NO: 8381240 - DNA, 22 bp, Homo sapiens
gcaagcaagcaggtagagctga

SEQ ID NO: 8381241 - DNA, 22 bp, Homo sapiens
gcaagatggttataaaaaatgt

SEQ ID NO: 8381242 - DNA, 22 bp, Homo sapiens
gcaagagtttctggagcagagt

SEQ ID NO: 8381243 - DNA, 22 bp, Homo sapiens
gcaagagacttttatgtctgcc

SEQ ID NO: 8381244 - DNA, 22 bp, Homo sapiens
gcaagagacttttatgtctgcc

SEQ ID NO: 8381245 - DNA, 22 bp, Homo sapiens
gcaagaaaagagccttcagtgg

SEQ ID NO: 8381246 - DNA, 22 bp, Homo sapiens
gcacaggaggccgatgctcatg

SEQ ID NO: 8381247 - DNA, 22 bp, Homo sapiens
gcacaggaggccgatgctcatg

SEQ ID NO: 8381248 - DNA, 22 bp, Homo sapiens
gcacaggatgatgggttgaggg

SEQ ID NO: 8381249 - DNA, 22 bp, Homo sapiens
gcacaggatgatgggttgaggg

SEQ ID NO: 8381250 - DNA, 22 bp, Homo sapiens
gcacaggaaatgactcatgtta

SEQ ID NO: 8381251 - DNA, 22 bp, Homo sapiens
gcacagctggggtatgatgcca

SEQ ID NO: 8381252 - DNA, 22 bp, Homo sapiens
gcacagctcgagctcaggaggg

SEQ ID NO: 8381253 - DNA, 22 bp, Homo sapiens
gcacagctcagcatgggaggac

SEQ ID NO: 8381254 - DNA, 18 bp, Homo sapiens
gcacagctaggagggtcc

SEQ ID NO: 8381255 - DNA, 22 bp, Homo sapiens
gcaagctggctgttagaggatg

SEQ ID NO: 8381256 - DNA, 22 bp, Homo sapiens
gcaagctgctcttatgtggagg

SEQ ID NO: 8381257 - DNA, 22 bp, Homo sapiens
gcaagcagttgtggcttctgag

SEQ ID NO: 8381258 - DNA, 21 bp, Homo sapiens
gcaagccaccactgctgccac

SEQ ID NO: 8381259 - DNA, 22 bp, Homo sapiens
gcaagctgatgtgatagtgaaa

SEQ ID NO: 8381260 - DNA, 22 bp, Homo sapiens
gcaagcagcccagaacagctct

SEQ ID NO: 8381261 - DNA, 22 bp, Homo sapiens
gcaagcagttacccaggattcg

SEQ ID NO: 8381262 - DNA, 22 bp, Homo sapiens
gcaagcagacattcaggtaggt

SEQ ID NO: 8381263 - DNA, 22 bp, Homo sapiens
gcacagccactgagtgagaacc

SEQ ID NO: 8381264 - DNA, 22 bp, Homo sapiens
gcacagccagcatctgagggat

SEQ ID NO: 8381265 - DNA, 21 bp, Homo sapiens
gcacagcatgagtgttggcat

SEQ ID NO: 8381266 - DNA, 22 bp, Homo sapiens
gcacagcatgaagagaggaagc

SEQ ID NO: 8381267 - DNA, 22 bp, Homo sapiens
gcaaggaacaaatgctctgctt

SEQ ID NO: 8381268 - DNA, 22 bp, Homo sapiens
gcaagctgtccttttgcatggc

SEQ ID NO: 8381269 - DNA, 22 bp, Homo sapiens
gcaagctgtccttttgcatggc

SEQ ID NO: 8381270 - DNA, 22 bp, Homo sapiens
gcaagctgtgatttatgtgaat

SEQ ID NO: 8381271 - DNA, 22 bp, Homo sapiens
gcactctgccaggtctcctgat

SEQ ID NO: 8381272 - DNA, 22 bp, Homo sapiens
gcactctgccaggtctcctgat

SEQ ID NO: 8381273 - DNA, 21 bp, Homo sapiens
gcactcagtcactactcaaga

SEQ ID NO: 8381274 - DNA, 22 bp, Homo sapiens
gcactgagtctgtcatgctgca

SEQ ID NO: 8381275 - DNA, 22 bp, Homo sapiens
gcactgagcaccagccacagat

SEQ ID NO: 8381276 - DNA, 17 bp, Homo sapiens
gcactgagccacagttt

SEQ ID NO: 8381277 - DNA, 23 bp, Homo sapiens
gcactgccatgtgctctgcaggc

SEQ ID NO: 8381278 - DNA, 22 bp, Homo sapiens
gcactgcctgtgttcagggtaa

SEQ ID NO: 8381279 - DNA, 22 bp, Homo sapiens
gcactgagtctgtcatgctgca

SEQ ID NO: 8381280 - DNA, 22 bp, Homo sapiens
gcactgagtctgtcatgctgca

SEQ ID NO: 8381281 - DNA, 22 bp, Homo sapiens
gcactggagatggggttgtcgg

SEQ ID NO: 8381282 - DNA, 22 bp, Homo sapiens
gcactggagatacagagatgaa

SEQ ID NO: 8381283 - DNA, 22 bp, Homo sapiens
gcactggagaatggctgtattc

SEQ ID NO: 8381284 - DNA, 22 bp, Homo sapiens
gcactggaccccaggatatgga

SEQ ID NO: 8381285 - DNA, 23 bp, Homo sapiens
gcactggaaaaatgaagattact

SEQ ID NO: 8381286 - DNA, 22 bp, Homo sapiens
gcactggacaggagtgaaatta

SEQ ID NO: 8381287 - DNA, 22 bp, Homo sapiens
gcactggaaatacctagatgaa

SEQ ID NO: 8381288 - DNA, 22 bp, Homo sapiens
gcactggaaggagggaatctta

SEQ ID NO: 8381289 - DNA, 22 bp, Homo sapiens
gcactggatcttgggagacgtg

SEQ ID NO: 8381290 - DNA, 22 bp, Homo sapiens
gcactggagggtgtagttgctg

SEQ ID NO: 8381291 - DNA, 22 bp, Homo sapiens
gcactggattttgatctgcaag

SEQ ID NO: 8381292 - DNA, 22 bp, Homo sapiens
gcactggattttgatctgcaag

SEQ ID NO: 8381293 - DNA, 22 bp, Homo sapiens
gcactggccgcacgcgtagggc

SEQ ID NO: 8381294 - DNA, 22 bp, Homo sapiens
gcagaggagcaagctggacacc

SEQ ID NO: 8381295 - DNA, 22 bp, Homo sapiens
gcagaggagcaagctggacacc

SEQ ID NO: 8381296 - DNA, 22 bp, Homo sapiens
gcagaggagatgaagatacttt

SEQ ID NO: 8381297 - DNA, 22 bp, Homo sapiens
gcagaggactcaatcaaggtat

SEQ ID NO: 8381298 - DNA, 22 bp, Homo sapiens
gcagaggacagggatttagatt

SEQ ID NO: 8381299 - DNA, 21 bp, Homo sapiens
gcagaggaatggtatacataa

SEQ ID NO: 8381300 - DNA, 22 bp, Homo sapiens
gcagaggacacaggagggcaag

SEQ ID NO: 8381301 - DNA, 22 bp, Homo sapiens
gcagaggacacaggagggcaag

SEQ ID NO: 8381302 - DNA, 22 bp, Homo sapiens
gcagaggacacaggagggcaag

SEQ ID NO: 8381303 - DNA, 22 bp, Homo sapiens
gcagaggacacaggagggcaag

SEQ ID NO: 8381304 - DNA, 22 bp, Homo sapiens
gcagaggacacaggagggcaag

SEQ ID NO: 8381305 - DNA, 22 bp, Homo sapiens
gcagagctgcagcgaggcctgg

SEQ ID NO: 8381306 - DNA, 22 bp, Homo sapiens
gcacttgaaaagatcaggtgca

SEQ ID NO: 8381307 - DNA, 22 bp, Homo sapiens
gcacttgataaatgttaactga

SEQ ID NO: 8381308 - DNA, 22 bp, Homo sapiens
gcactgttctaggtgcagagct

SEQ ID NO: 8381309 - DNA, 22 bp, Homo sapiens
gcactgtgctagaagccagggg

SEQ ID NO: 8381310 - DNA, 22 bp, Homo sapiens
gcactgtgctaggtatcaggga

SEQ ID NO: 8381311 - DNA, 22 bp, Homo sapiens
gcactgttctaggtgcagagct

SEQ ID NO: 8381312 - DNA, 23 bp, Homo sapiens
gcactgggctctcagcaaggtgt

SEQ ID NO: 8381313 - DNA, 22 bp, Homo sapiens
gcactgtgctaaacatgtatca

SEQ ID NO: 8381314 - DNA, 22 bp, Homo sapiens
gcagaggaggacccaggaatta

SEQ ID NO: 8381315 - DNA, 22 bp, Homo sapiens
gcagcagcggggcccctgcgcg

SEQ ID NO: 8381316 - DNA, 22 bp, Homo sapiens
gcagaggaggacccaggaatta

SEQ ID NO: 8381317 - DNA, 22 bp, Homo sapiens
gcagaggaggacccaggaatta

SEQ ID NO: 8381318 - DNA, 22 bp, Homo sapiens
gcagaggaggacccaggaatta

SEQ ID NO: 8381319 - DNA, 22 bp, Homo sapiens
gcagaggagcaagttgctacag

SEQ ID NO: 8381320 - DNA, 23 bp, Homo sapiens
gcagaggagcaagctggacacca

SEQ ID NO: 8381321 - DNA, 22 bp, Homo sapiens
gcagcagctcagccgggcactg

SEQ ID NO: 8381322 - DNA, 22 bp, Homo sapiens
gcagcaggtgtgcttttaatga

SEQ ID NO: 8381323 - DNA, 22 bp, Homo sapiens
gcagcaggtctgtcaatgtcat

SEQ ID NO: 8381324 - DNA, 22 bp, Homo sapiens
gcagcaggtctgtcaatgtcat

SEQ ID NO: 8381325 - DNA, 22 bp, Homo sapiens
gcagcaggcacggtctcgacat

SEQ ID NO: 8381326 - DNA, 22 bp, Homo sapiens
gcagcaggcacggtctcgacat

SEQ ID NO: 8381327 - DNA, 22 bp, Homo sapiens
gcagcaggcacttaccgttgct

SEQ ID NO: 8381328 - DNA, 22 bp, Homo sapiens
gcagcaggtctgtcaatgtcat

SEQ ID NO: 8381329 - DNA, 22 bp, Homo sapiens
gcagcaggagagtttgtcctgc

SEQ ID NO: 8381330 - DNA, 22 bp, Homo sapiens
gcagcaggatggccaattgcca

SEQ ID NO: 8381331 - DNA, 22 bp, Homo sapiens
gcagcaggatggccaattgcca

SEQ ID NO: 8381332 - DNA, 22 bp, Homo sapiens
gcagcaggcacggtctcgacat

SEQ ID NO: 8381333 - DNA, 22 bp, Homo sapiens
gcagcaggcacggtctcgacat

SEQ ID NO: 8381334 - DNA, 22 bp, Homo sapiens
gcagcaggatggccaattgcca

SEQ ID NO: 8381335 - DNA, 22 bp, Homo sapiens
gcagcaggagagtttgtcctgc

SEQ ID NO: 8381336 - DNA, 22 bp, Homo sapiens
gcagcaggagagtttgtcctgc

SEQ ID NO: 8381337 - DNA, 22 bp, Homo sapiens
gcagcaggagagtaatagcggt

SEQ ID NO: 8381338 - DNA, 22 bp, Homo sapiens
gcagcaggagagtaatagcggt

SEQ ID NO: 8381339 - DNA, 22 bp, Homo sapiens
gcagcaggagagtaatagcggt

SEQ ID NO: 8381340 - DNA, 22 bp, Homo sapiens
gcagcaggactgccgttaaagt

SEQ ID NO: 8381341 - DNA, 22 bp, Homo sapiens
gcagcaggactgccgttaaagt

SEQ ID NO: 8381342 - DNA, 22 bp, Homo sapiens
gcagcaggaataggataagcaa

SEQ ID NO: 8381343 - DNA, 22 bp, Homo sapiens
gcagcaggaatttaaatttata

SEQ ID NO: 8381344 - DNA, 22 bp, Homo sapiens
gcagcaggaatttaaatttata

SEQ ID NO: 8381345 - DNA, 22 bp, Homo sapiens
gcagcaggaatttaaatttata

SEQ ID NO: 8381346 - DNA, 22 bp, Homo sapiens
gcagcaggaataggataagcaa

SEQ ID NO: 8381347 - DNA, 22 bp, Homo sapiens
gcagcaggaataggataagcaa

SEQ ID NO: 8381348 - DNA, 22 bp, Homo sapiens
gcagcaggaataggataagcaa

SEQ ID NO: 8381349 - DNA, 22 bp, Homo sapiens
gcagcaggaataggataagcaa

SEQ ID NO: 8381350 - DNA, 22 bp, Homo sapiens
gcagcaggaataggataagcaa

SEQ ID NO: 8381351 - DNA, 22 bp, Homo sapiens
gcagccacactgttacagaatg

SEQ ID NO: 8381352 - DNA, 22 bp, Homo sapiens
gcagctgcaagcacttctggca

SEQ ID NO: 8381353 - DNA, 22 bp, Homo sapiens
gcagcatttgtggaatgggccc

SEQ ID NO: 8381354 - DNA, 22 bp, Homo sapiens
gcagctgcagagaccgggtggg

SEQ ID NO: 8381355 - DNA, 22 bp, Homo sapiens
gcagctgcagaccctcagtgct

SEQ ID NO: 8381356 - DNA, 22 bp, Homo sapiens
gcagctgcagaccctcagtgct

SEQ ID NO: 8381357 - DNA, 22 bp, Homo sapiens
gcagctgcaataggcatcaagc

SEQ ID NO: 8381358 - DNA, 22 bp, Homo sapiens
gcagctgcacttctacctaatt

SEQ ID NO: 8381359 - DNA, 22 bp, Homo sapiens
gcagctgccagtccccttccag

SEQ ID NO: 8381360 - DNA, 18 bp, Homo sapiens
gcagctgcagttgtagct

SEQ ID NO: 8381361 - DNA, 22 bp, Homo sapiens
gcagctgcaggtggtcccatgc

SEQ ID NO: 8381362 - DNA, 22 bp, Homo sapiens
gcagctgcaggcaggcttgctg

SEQ ID NO: 8381363 - DNA, 22 bp, Homo sapiens
gcagctgcaggcaggcttgctg

SEQ ID NO: 8381364 - DNA, 22 bp, Homo sapiens
gcagctgccccgactgtgagtc

SEQ ID NO: 8381365 - DNA, 20 bp, Homo sapiens
gcagctgcccccagtccctg

SEQ ID NO: 8381366 - DNA, 22 bp, Homo sapiens
gcagctgccccgactgtgagtc

SEQ ID NO: 8381367 - DNA, 22 bp, Homo sapiens
gcagctgccgtgagctcacgcc

SEQ ID NO: 8381368 - DNA, 22 bp, Homo sapiens
gcagctgccgtgagctcacgcc

SEQ ID NO: 8381369 - DNA, 22 bp, Homo sapiens
gcagctgcctaaagtgctaaga

SEQ ID NO: 8381370 - DNA, 22 bp, Homo sapiens
gcagcagtgtgggctgaaccta

SEQ ID NO: 8381371 - DNA, 22 bp, Homo sapiens
gcagcagtggtctgtagaagga

SEQ ID NO: 8381372 - DNA, 22 bp, Homo sapiens
gcagcagtggctgcaggtccca

SEQ ID NO: 8381373 - DNA, 20 bp, Homo sapiens
gcagcagtgcaagtcctctt

SEQ ID NO: 8381374 - DNA, 22 bp, Homo sapiens
gcagcaggtgtgcttttaatga

SEQ ID NO: 8381375 - DNA, 22 bp, Homo sapiens
gcagcagtgcgggcagctacag

SEQ ID NO: 8381376 - DNA, 22 bp, Homo sapiens
gcagcattaccaagacatggca

SEQ ID NO: 8381377 - DNA, 22 bp, Homo sapiens
gcaggaggttgagccaggactg

SEQ ID NO: 8381378 - DNA, 22 bp, Homo sapiens
gcaggaggccaggtatgcttta

SEQ ID NO: 8381379 - DNA, 22 bp, Homo sapiens
gcaggaggttgagccaggactg

SEQ ID NO: 8381380 - DNA, 22 bp, Homo sapiens
gcaggaggttgagccaggactg

SEQ ID NO: 8381381 - DNA, 22 bp, Homo sapiens
gcaggagtatgcagctatggtt

SEQ ID NO: 8381382 - DNA, 22 bp, Homo sapiens
gcaggcctctgttgagggcctt

SEQ ID NO: 8381383 - DNA, 22 bp, Homo sapiens
gcaggcctctaattcaccgcag

SEQ ID NO: 8381384 - DNA, 22 bp, Homo sapiens
gcaggcctctgttgagggcctt

SEQ ID NO: 8381385 - DNA, 22 bp, Homo sapiens
gcaggaggagcattaactgagc

SEQ ID NO: 8381386 - DNA, 22 bp, Homo sapiens
gcaggaggatcacttgagccca

SEQ ID NO: 8381387 - DNA, 22 bp, Homo sapiens
gcaggagctggaaagtgatgtt

SEQ ID NO: 8381388 - DNA, 22 bp, Homo sapiens
gcagctggagaaataccaccct

SEQ ID NO: 8381389 - DNA, 22 bp, Homo sapiens
gcagctgcctattcagggcttg

SEQ ID NO: 8381390 - DNA, 22 bp, Homo sapiens
gcagctgcctaaagtgctaaga

SEQ ID NO: 8381391 - DNA, 22 bp, Homo sapiens
gcagctggatttcaagagggag

SEQ ID NO: 8381392 - DNA, 22 bp, Homo sapiens
gcagctggatttcaagagggag

SEQ ID NO: 8381393 - DNA, 22 bp, Homo sapiens
gcagctggatttcaagagggag

SEQ ID NO: 8381394 - DNA, 22 bp, Homo sapiens
gcagggcggcccagagcaggcc

SEQ ID NO: 8381395 - DNA, 22 bp, Homo sapiens
gcagggcgcgtttgagcgggct

SEQ ID NO: 8381396 - DNA, 22 bp, Homo sapiens
gcagggctagatatttgcaagt

SEQ ID NO: 8381397 - DNA, 22 bp, Homo sapiens
gcagggctaggtcttctagggc

SEQ ID NO: 8381398 - DNA, 22 bp, Homo sapiens
gcaggctgatagaggattccat

SEQ ID NO: 8381399 - DNA, 22 bp, Homo sapiens
gcaggctgaaactcggggtcta

SEQ ID NO: 8381400 - DNA, 22 bp, Homo sapiens
gcaggctgagttgggaaaccaa

SEQ ID NO: 8381401 - DNA, 19 bp, Homo sapiens
gcaggcctcttgggaatta

SEQ ID NO: 8381402 - DNA, 19 bp, Homo sapiens
gcaggcctcttgggaatta

SEQ ID NO: 8381403 - DNA, 22 bp, Homo sapiens
gcaggctccaaggcctgggaga

SEQ ID NO: 8381404 - DNA, 22 bp, Homo sapiens
gcaggctccaaggcctgggaga

SEQ ID NO: 8381405 - DNA, 22 bp, Homo sapiens
gcaggctcgttggaagtcccct

SEQ ID NO: 8381406 - DNA, 22 bp, Homo sapiens
gcaggctcccttgcagagcagg

SEQ ID NO: 8381407 - DNA, 22 bp, Homo sapiens
ggagcagagcatttcacagcct

SEQ ID NO: 8381408 - DNA, 22 bp, Homo sapiens
ggatctgttttgcctctgaggg

SEQ ID NO: 8381409 - DNA, 22 bp, Homo sapiens
ggagatgtagtgtcactggact

SEQ ID NO: 8381410 - DNA, 22 bp, Homo sapiens
ggagatggtggaagctggtgca

SEQ ID NO: 8381411 - DNA, 22 bp, Homo sapiens
ggagatggctggcaggtagatg

SEQ ID NO: 8381412 - DNA, 22 bp, Homo sapiens
ggagatggccacgtcactcagt

SEQ ID NO: 8381413 - DNA, 23 bp, Homo sapiens
ggatggacgtgatgccttagcca

SEQ ID NO: 8381414 - DNA, 18 bp, Homo sapiens
ggatgctgtgtgctcctt

SEQ ID NO: 8381415 - DNA, 22 bp, Homo sapiens
ggatgctgggagacagcaggca

SEQ ID NO: 8381416 - DNA, 22 bp, Homo sapiens
ggatgctgggagacagcaggca

SEQ ID NO: 8381417 - DNA, 22 bp, Homo sapiens
ggatgcaggagttgaagaagga

SEQ ID NO: 8381418 - DNA, 22 bp, Homo sapiens
ggatggaggttctcagatgctc

SEQ ID NO: 8381419 - DNA, 22 bp, Homo sapiens
ggatggaggttctcagatgctc

SEQ ID NO: 8381420 - DNA, 23 bp, Homo sapiens
ggatggagccactttgaaaccac

SEQ ID NO: 8381421 - DNA, 22 bp, Homo sapiens
ggatggcagtctgcatgagaaa

SEQ ID NO: 8381422 - DNA, 22 bp, Homo sapiens
ggatggcagtctgcatgagaaa

SEQ ID NO: 8381423 - DNA, 22 bp, Homo sapiens
ggatggcatgttgggctctgtt

SEQ ID NO: 8381424 - DNA, 22 bp, Homo sapiens
ggatggcttgcatttgaggact

SEQ ID NO: 8381425 - DNA, 22 bp, Homo sapiens
ggatggctgtaaaaggtgggaa

SEQ ID NO: 8381426 - DNA, 23 bp, Homo sapiens
ggcagcttatactttcatagaca

SEQ ID NO: 8381427 - DNA, 22 bp, Homo sapiens
ggcagcttcctgagccagcagc

SEQ ID NO: 8381428 - DNA, 22 bp, Homo sapiens
ggcagcttcctaggagagggca

SEQ ID NO: 8381429 - DNA, 22 bp, Homo sapiens
ggcagcttctcccaggctgttt

SEQ ID NO: 8381430 - DNA, 22 bp, Homo sapiens
ggcagcttcttaatatggagac

SEQ ID NO: 8381431 - DNA, 22 bp, Homo sapiens
ggcagcttcttaatatggagac

SEQ ID NO: 8381432 - DNA, 22 bp, Homo sapiens
ggcagcttgtccttcaggagag

SEQ ID NO: 8381433 - DNA, 22 bp, Homo sapiens
ggcagctttcaatagggttatg

SEQ ID NO: 8381434 - DNA, 22 bp, Homo sapiens
ggcagctttctcacccatgacc

SEQ ID NO: 8381435 - DNA, 22 bp, Homo sapiens
ggcagctgtttgtcctcctgtt

SEQ ID NO: 8381436 - DNA, 22 bp, Homo sapiens
ggcagctgttggctctctagga

SEQ ID NO: 8381437 - DNA, 22 bp, Homo sapiens
ggcagctgttggctctctagga

SEQ ID NO: 8381438 - DNA, 17 bp, Homo sapiens
ggcagctgtgtgcatgc

SEQ ID NO: 8381439 - DNA, 20 bp, Homo sapiens
ggcagcaggagtttcctctt

SEQ ID NO: 8381440 - DNA, 22 bp, Homo sapiens
ggcagcagggctgtctccctac

SEQ ID NO: 8381441 - DNA, 22 bp, Homo sapiens
ggcagcagggctgtctccctac

SEQ ID NO: 8381442 - DNA, 22 bp, Homo sapiens
ggcagcagtccatggcccaagg

SEQ ID NO: 8381443 - DNA, 20 bp, Homo sapiens
ggcagcaggagtttcctctt

SEQ ID NO: 8381444 - DNA, 19 bp, Homo sapiens
ggcagaaggtgtaggggga

SEQ ID NO: 8381445 - DNA, 22 bp, Homo sapiens
ggcagaagaaaggctaagtctc

SEQ ID NO: 8381446 - DNA, 22 bp, Homo sapiens
ggcagaagataggacagggaat

SEQ ID NO: 8381447 - DNA, 22 bp, Homo sapiens
ggcactgggtgagggtcactgg

SEQ ID NO: 8381448 - DNA, 22 bp, Homo sapiens
ggcactgggttgtaggaattaa

SEQ ID NO: 8381449 - DNA, 18 bp, Homo sapiens
ggcactggtgatgcagag

SEQ ID NO: 8381450 - DNA, 22 bp, Homo sapiens
ggcactgtttttgtattcagtt

SEQ ID NO: 8381451 - DNA, 22 bp, Homo sapiens
ggcactgtgtacacacagagac

SEQ ID NO: 8381452 - DNA, 22 bp, Homo sapiens
ggcactgtgtacacacagagac

SEQ ID NO: 8381453 - DNA, 18 bp, Homo sapiens
ggcactggtgatgcagag

SEQ ID NO: 8381454 - DNA, 19 bp, Homo sapiens
ggcactggggccaggacca

SEQ ID NO: 8381455 - DNA, 22 bp, Homo sapiens
ggcactgcaggtaagtgctgtc

SEQ ID NO: 8381456 - DNA, 22 bp, Homo sapiens
ggcaggggtgaggccactctga

SEQ ID NO: 8381457 - DNA, 22 bp, Homo sapiens
ggcaggggttcattttgtctta

SEQ ID NO: 8381458 - DNA, 22 bp, Homo sapiens
ggcaggggtggccttcctttgg

SEQ ID NO: 8381459 - DNA, 22 bp, Homo sapiens
ggcaggaggaagagttagcacc

SEQ ID NO: 8381460 - DNA, 22 bp, Homo sapiens
ggcaggaggaagagttagcacc

SEQ ID NO: 8381461 - DNA, 22 bp, Homo sapiens
ggcaggagaatggcgtgaactc

SEQ ID NO: 8381462 - DNA, 22 bp, Homo sapiens
ggcaggagaatggcgtgaactc

SEQ ID NO: 8381463 - DNA, 18 bp, Homo sapiens
ggcaggagcaagaatagg

SEQ ID NO: 8381464 - DNA, 18 bp, Homo sapiens
ggcaggagcaagaatagg

SEQ ID NO: 8381465 - DNA, 22 bp, Homo sapiens
ggcaggtgacggggatgagtat

SEQ ID NO: 8381466 - DNA, 22 bp, Homo sapiens
ggcaggtgacggggatgagtat

SEQ ID NO: 8381467 - DNA, 22 bp, Homo sapiens
ggcagggtgtggagttgggaca

SEQ ID NO: 8381468 - DNA, 22 bp, Homo sapiens
ggcaggtagcctagaggaggtt

SEQ ID NO: 8381469 - DNA, 17 bp, Homo sapiens
ggcagggtgctgggtat

SEQ ID NO: 8381470 - DNA, 22 bp, Homo sapiens
ggcatcgtcctgggcataggga

SEQ ID NO: 8381471 - DNA, 22 bp, Homo sapiens
ggcatcgtcctgggcataggga

SEQ ID NO: 8381472 - DNA, 22 bp, Homo sapiens
ggcatcggttgcttttcatatc

SEQ ID NO: 8381473 - DNA, 22 bp, Homo sapiens
ggcatcggaggctgaagtttcc

SEQ ID NO: 8381474 - DNA, 21 bp, Homo sapiens
ggcatcggcgcagtgatagag

SEQ ID NO: 8381475 - DNA, 22 bp, Homo sapiens
ggcatccagttctgatcaacaa

SEQ ID NO: 8381476 - DNA, 22 bp, Homo sapiens
ggcatccgcctggagggtgcta

SEQ ID NO: 8381477 - DNA, 22 bp, Homo sapiens
ggcagtggtgggaggctcgctc

SEQ ID NO: 8381478 - DNA, 22 bp, Homo sapiens
ggcatcagtatggccatagggt

SEQ ID NO: 8381479 - DNA, 22 bp, Homo sapiens
ggcatccaaataccaagatgta

SEQ ID NO: 8381480 - DNA, 22 bp, Homo sapiens
ggcatctggatctgcttctccc

SEQ ID NO: 8381481 - DNA, 22 bp, Homo sapiens
ggcatcttgttgctcaaatcta

SEQ ID NO: 8381482 - DNA, 20 bp, Homo sapiens
ggcatgagatgtgagggagg

SEQ ID NO: 8381483 - DNA, 21 bp, Homo sapiens
ggcatgagggcagtgagcaga

SEQ ID NO: 8381484 - DNA, 21 bp, Homo sapiens
ggcatgagggcagtgagcaga

SEQ ID NO: 8381485 - DNA, 22 bp, Homo sapiens
ggccagcttattagctcagagg

SEQ ID NO: 8381486 - DNA, 22 bp, Homo sapiens
ggccaggaacttttgggatggg

SEQ ID NO: 8381487 - DNA, 22 bp, Homo sapiens
ggccaggaacttttgggatggg

SEQ ID NO: 8381488 - DNA, 22 bp, Homo sapiens
ggcatgagtaacgtgagtgagg

SEQ ID NO: 8381489 - DNA, 22 bp, Homo sapiens
ggcatgagtaacgtgagtgagg

SEQ ID NO: 8381490 - DNA, 22 bp, Homo sapiens
ggcctgcctcacagtcagcacc

SEQ ID NO: 8381491 - DNA, 22 bp, Homo sapiens
ggcctgctaacctgaaacggag

SEQ ID NO: 8381492 - DNA, 22 bp, Homo sapiens
ggcctgctgcagtgtgacagtt

SEQ ID NO: 8381493 - DNA, 22 bp, Homo sapiens
ggcctgcttactgattgttgtt

SEQ ID NO: 8381494 - DNA, 22 bp, Homo sapiens
ggcctgctgggccccacagtcc

SEQ ID NO: 8381495 - DNA, 23 bp, Homo sapiens
ggcctggcccagggccctgatga

SEQ ID NO: 8381496 - DNA, 22 bp, Homo sapiens
ggcctggagtcagggaaagcaa

SEQ ID NO: 8381497 - DNA, 22 bp, Homo sapiens
ggcggtggcgtgaaggtggctg

SEQ ID NO: 8381498 - DNA, 22 bp, Homo sapiens
ggccctgggccctctagcttgt

SEQ ID NO: 8381499 - DNA, 22 bp, Homo sapiens
ggccctgggcagaggagtgggc

SEQ ID NO: 8381500 - DNA, 22 bp, Homo sapiens
ggccctgggatgctcagcagtg

SEQ ID NO: 8381501 - DNA, 22 bp, Homo sapiens
ggccaggaggcaggggctcaat

SEQ ID NO: 8381502 - DNA, 22 bp, Homo sapiens
ggccaggaggcaggggctcaat

SEQ ID NO: 8381503 - DNA, 22 bp, Homo sapiens
ggccaggagcaagccaggctct

SEQ ID NO: 8381504 - DNA, 22 bp, Homo sapiens
ggccaggagctgcacagggctc

SEQ ID NO: 8381505 - DNA, 22 bp, Homo sapiens
ggccaggagcaagccaggctct

SEQ ID NO: 8381506 - DNA, 22 bp, Homo sapiens
ggccaggagcaagccaggctct

SEQ ID NO: 8381507 - DNA, 22 bp, Homo sapiens
ggccaggaagggaagatcagca

SEQ ID NO: 8381508 - DNA, 22 bp, Homo sapiens
ggctcctgaggaccaggcacag

SEQ ID NO: 8381509 - DNA, 22 bp, Homo sapiens
ggctctgggttctgcaatgcgt

SEQ ID NO: 8381510 - DNA, 23 bp, Homo sapiens
ggctctgtgctgggcctgcagga

SEQ ID NO: 8381511 - DNA, 22 bp, Homo sapiens
ggctcttcacacagtgatgtca

SEQ ID NO: 8381512 - DNA, 22 bp, Homo sapiens
ggctcttccgccaccagccaca

SEQ ID NO: 8381513 - DNA, 22 bp, Homo sapiens
ggctcttccgccaccagccaca

SEQ ID NO: 8381514 - DNA, 22 bp, Homo sapiens
ggcggtggttgagaggacggcg

SEQ ID NO: 8381515 - DNA, 22 bp, Homo sapiens
ggcggtggttgagaggacggcg

SEQ ID NO: 8381516 - DNA, 19 bp, Homo sapiens
ggctaatgtctttgaaata

SEQ ID NO: 8381517 - DNA, 22 bp, Homo sapiens
ggctaggcctcaggcctgcctg

SEQ ID NO: 8381518 - DNA, 22 bp, Homo sapiens
ggctccagggagtggagagaag

SEQ ID NO: 8381519 - DNA, 22 bp, Homo sapiens
ggctccagtttgtgccttcagc

SEQ ID NO: 8381520 - DNA, 22 bp, Homo sapiens
ggctccagtttgtgccttcagc

SEQ ID NO: 8381521 - DNA, 22 bp, Homo sapiens
ggctccagtttgtgccttcagc

SEQ ID NO: 8381522 - DNA, 22 bp, Homo sapiens
ggctcccaggagggcctggagg

SEQ ID NO: 8381523 - DNA, 22 bp, Homo sapiens
ggctgagggttaagatcagaca

SEQ ID NO: 8381524 - DNA, 22 bp, Homo sapiens
ggctgagggtatagctgtccca

SEQ ID NO: 8381525 - DNA, 22 bp, Homo sapiens
ggctgagggtatagctgtccca

SEQ ID NO: 8381526 - DNA, 22 bp, Homo sapiens
ggctggacatagacatagccat

SEQ ID NO: 8381527 - DNA, 22 bp, Homo sapiens
ggctggacatagacatagccat

SEQ ID NO: 8381528 - DNA, 22 bp, Homo sapiens
ggctgctttgtagcttttgcca

SEQ ID NO: 8381529 - DNA, 22 bp, Homo sapiens
ggctgggtcccagctgggagga

SEQ ID NO: 8381530 - DNA, 21 bp, Homo sapiens
ggctgggtcatgcagctggcc

SEQ ID NO: 8381531 - DNA, 19 bp, Homo sapiens
ggctggagaaaggaatcag

SEQ ID NO: 8381532 - DNA, 19 bp, Homo sapiens
ggctggagaaaggaatcag

SEQ ID NO: 8381533 - DNA, 22 bp, Homo sapiens
ggctggaccatgctgccccttc

SEQ ID NO: 8381534 - DNA, 22 bp, Homo sapiens
ggctgtgcagggcagagtctca

SEQ ID NO: 8381535 - DNA, 22 bp, Homo sapiens
ggctgtgacccccacaggggtg

SEQ ID NO: 8381536 - DNA, 23 bp, Homo sapiens
ggctttgccacatattgaccatg

SEQ ID NO: 8381537 - DNA, 22 bp, Homo sapiens
ggctttctatgaactcaaaggc

SEQ ID NO: 8381538 - DNA, 22 bp, Homo sapiens
gggaagggacttgtttaaggtc

SEQ ID NO: 8381539 - DNA, 22 bp, Homo sapiens
gggaaggctgcctgagggatgg

SEQ ID NO: 8381540 - DNA, 22 bp, Homo sapiens
ggctgtgcctcaaggctactca

SEQ ID NO: 8381541 - DNA, 22 bp, Homo sapiens
ggctttatattgtttgagcaga

SEQ ID NO: 8381542 - DNA, 22 bp, Homo sapiens
gggagctgagctggaagagaat

SEQ ID NO: 8381543 - DNA, 22 bp, Homo sapiens
gggagctgagctctgagccacg

SEQ ID NO: 8381544 - DNA, 22 bp, Homo sapiens
gggaagtgagctggaatcaagg

SEQ ID NO: 8381545 - DNA, 22 bp, Homo sapiens
gggagctggatcgcgcgcccgg

SEQ ID NO: 8381546 - DNA, 22 bp, Homo sapiens
gggagggacacaaagagttccc

SEQ ID NO: 8381547 - DNA, 22 bp, Homo sapiens
gggagggaggtgatgcttggct

SEQ ID NO: 8381548 - DNA, 22 bp, Homo sapiens
gggcacaggagaaggatctggc

SEQ ID NO: 8381549 - DNA, 22 bp, Homo sapiens
gggcagtgttgtggttctctat

SEQ ID NO: 8381550 - DNA, 19 bp, Homo sapiens
gggcagtggcactagggag

SEQ ID NO: 8381551 - DNA, 22 bp, Homo sapiens
gggcagtgaatattggtgggaa

SEQ ID NO: 8381552 - DNA, 22 bp, Homo sapiens
gggcagtgacaaaggggatgaa

SEQ ID NO: 8381553 - DNA, 22 bp, Homo sapiens
gggcaggttattggagtaggga

SEQ ID NO: 8381554 - DNA, 22 bp, Homo sapiens
gggcactgagtggatgatgcag

SEQ ID NO: 8381555 - DNA, 22 bp, Homo sapiens
gggcactgaatgccaagctagg

SEQ ID NO: 8381556 - DNA, 22 bp, Homo sapiens
gggcaccagcggccgcactgcc

SEQ ID NO: 8381557 - DNA, 22 bp, Homo sapiens
gggcaccagcggccgcactgcc

SEQ ID NO: 8381558 - DNA, 23 bp, Homo sapiens
gggcaccaggagcaccggacagg

SEQ ID NO: 8381559 - DNA, 22 bp, Homo sapiens
gggcaccttgggtctcaggcaa

SEQ ID NO: 8381560 - DNA, 22 bp, Homo sapiens
gggcacctggctagtgacagtg

SEQ ID NO: 8381561 - DNA, 22 bp, Homo sapiens
gtcaccaggtctgatgcagcca

SEQ ID NO: 8381562 - DNA, 22 bp, Homo sapiens
gtcaccagtgctaagaggtgga

SEQ ID NO: 8381563 - DNA, 22 bp, Homo sapiens
gtcacaaaggtgagggacatga

SEQ ID NO: 8381564 - DNA, 22 bp, Homo sapiens
gtcattcttaacaactcagtag

SEQ ID NO: 8381565 - DNA, 22 bp, Homo sapiens
gtcattctctggtgtggttgtt

SEQ ID NO: 8381566 - DNA, 22 bp, Homo sapiens
gtcagtgtttaacaaccagctc

SEQ ID NO: 8381567 - DNA, 22 bp, Homo sapiens
gtcagtgttataagtttagcca

SEQ ID NO: 8381568 - DNA, 22 bp, Homo sapiens
gtcagtgtggttgctggcttgg

SEQ ID NO: 8381569 - DNA, 22 bp, Homo sapiens
gtcagtgtgagttgattccata

SEQ ID NO: 8381570 - DNA, 22 bp, Homo sapiens
gtcagtgtgagataatcttgga

SEQ ID NO: 8381571 - DNA, 20 bp, Homo sapiens
gtcagtgtcttcagtagtga

SEQ ID NO: 8381572 - DNA, 22 bp, Homo sapiens
gtcagtgtcttaacagagatta

SEQ ID NO: 8381573 - DNA, 22 bp, Homo sapiens
gtcagtgtaggttcatcagtgg

SEQ ID NO: 8381574 - DNA, 22 bp, Homo sapiens
gtcagtgtagcaggtgcaagcc

SEQ ID NO: 8381575 - DNA, 22 bp, Homo sapiens
gtcctctgagggggctgcacgc

SEQ ID NO: 8381576 - DNA, 22 bp, Homo sapiens
gtcctctgcccaggtcaaggtt

SEQ ID NO: 8381577 - DNA, 22 bp, Homo sapiens
gtctcccactttctggcctctt

SEQ ID NO: 8381578 - DNA, 22 bp, Homo sapiens
gtctcccatcgtttgtgaggaa

SEQ ID NO: 8381579 - DNA, 22 bp, Homo sapiens
gtctcctccagtaggaagtggc

SEQ ID NO: 8381580 - DNA, 22 bp, Homo sapiens
gtctcctccatggagatggtat

SEQ ID NO: 8381581 - DNA, 22 bp, Homo sapiens
gtctcctcttcatatacctgtt

SEQ ID NO: 8381582 - DNA, 20 bp, Homo sapiens
gtctcctctttgcattccta

SEQ ID NO: 8381583 - DNA, 22 bp, Homo sapiens
gtctcctccctttcattcacct

SEQ ID NO: 8381584 - DNA, 22 bp, Homo sapiens
gtctcctccctttcattcacct

SEQ ID NO: 8381585 - DNA, 22 bp, Homo sapiens
gtcatttatcttcagaatttct

SEQ ID NO: 8381586 - DNA, 22 bp, Homo sapiens
gtcattgcagtggcaaatcaca

SEQ ID NO: 8381587 - DNA, 22 bp, Homo sapiens
gtccctggagctgagcagtgct

SEQ ID NO: 8381588 - DNA, 22 bp, Homo sapiens
gtccctggatctgggacagctg

SEQ ID NO: 8381589 - DNA, 22 bp, Homo sapiens
gtcctattagcatattgaatac

SEQ ID NO: 8381590 - DNA, 22 bp, Homo sapiens
gtcctcaggcttgagtgtttat

SEQ ID NO: 8381591 - DNA, 23 bp, Homo sapiens
gtcctattttttgaaatactgag

SEQ ID NO: 8381592 - DNA, 22 bp, Homo sapiens
gtcctcagagtgggcaggtcct

SEQ ID NO: 8381593 - DNA, 22 bp, Homo sapiens
gtagcaccgcgagacttggggc

SEQ ID NO: 8381594 - DNA, 22 bp, Homo sapiens
gtagcacccactacttttcgct

SEQ ID NO: 8381595 - DNA, 22 bp, Homo sapiens
gtagcaccagtgctcttctcaa

SEQ ID NO: 8381596 - DNA, 22 bp, Homo sapiens
gtagcacatgattttgatatgt

SEQ ID NO: 8381597 - DNA, 22 bp, Homo sapiens
gtagcccacctggggagggcga

SEQ ID NO: 8381598 - DNA, 22 bp, Homo sapiens
gtagccagatctgctgtgtctg

SEQ ID NO: 8381599 - DNA, 22 bp, Homo sapiens
gtagacaggttataaatcagtg

SEQ ID NO: 8381600 - DNA, 22 bp, Homo sapiens
gtagctgatcctgaggacaggg

SEQ ID NO: 8381601 - DNA, 22 bp, Homo sapiens
gtagctgatattagcaatgagt

SEQ ID NO: 8381602 - DNA, 19 bp, Homo sapiens
gtcaataaaagttaggggt

SEQ ID NO: 8381603 - DNA, 22 bp, Homo sapiens
gtcaataagtttgtaactggat

SEQ ID NO: 8381604 - DNA, 22 bp, Homo sapiens
gtcaataagtttgtaactggat

SEQ ID NO: 8381605 - DNA, 22 bp, Homo sapiens
gtcaataattgatagatattgg

SEQ ID NO: 8381606 - DNA, 22 bp, Homo sapiens
gtcaataattttatggagagaa

SEQ ID NO: 8381607 - DNA, 21 bp, Homo sapiens
gtcaactggaagggcagggat

SEQ ID NO: 8381608 - DNA, 17 bp, Homo sapiens
gtaaggcttgcagatgc

SEQ ID NO: 8381609 - DNA, 22 bp, Homo sapiens
gtaacattattcatgagataca

SEQ ID NO: 8381610 - DNA, 22 bp, Homo sapiens
gtaataatactagtcagccttg

SEQ ID NO: 8381611 - DNA, 22 bp, Homo sapiens
ggtgggcaggcgaggcccaggt

SEQ ID NO: 8381612 - DNA, 22 bp, Homo sapiens
gtaaatgtgaatgtcatttagc

SEQ ID NO: 8381613 - DNA, 22 bp, Homo sapiens
gtaaatgtgcttcttttaactt

SEQ ID NO: 8381614 - DNA, 22 bp, Homo sapiens
gtaaatttcccgggccatttaa

SEQ ID NO: 8381615 - DNA, 22 bp, Homo sapiens
gtgaggcattgaagaccggaat

SEQ ID NO: 8381616 - DNA, 22 bp, Homo sapiens
gtgaggcagggaaagaggataa

SEQ ID NO: 8381617 - DNA, 22 bp, Homo sapiens
gtgaggtgggctggccagagac

SEQ ID NO: 8381618 - DNA, 22 bp, Homo sapiens
gtgaggtgggctgggctctatg

SEQ ID NO: 8381619 - DNA, 22 bp, Homo sapiens
gtcttcttttcagtctgcttgt

SEQ ID NO: 8381620 - DNA, 22 bp, Homo sapiens
gtgaggcagggaaagaggataa

SEQ ID NO: 8381621 - DNA, 22 bp, Homo sapiens
gtcttctgtctgtctggcatgt

SEQ ID NO: 8381622 - DNA, 22 bp, Homo sapiens
gtgagttactctggttctcatt

SEQ ID NO: 8381623 - DNA, 22 bp, Homo sapiens
gtgagtgtcagtcaaaggtttt

SEQ ID NO: 8381624 - DNA, 22 bp, Homo sapiens
gtgatgagagaaccaggacctt

SEQ ID NO: 8381625 - DNA, 22 bp, Homo sapiens
gtctctatcatagctgaaccct

SEQ ID NO: 8381626 - DNA, 23 bp, Homo sapiens
gtctctagagtgtggagcaaaga

SEQ ID NO: 8381627 - DNA, 22 bp, Homo sapiens
gtctctctgactggtccacacc

SEQ ID NO: 8381628 - DNA, 20 bp, Homo sapiens
gtcttatttaacacatgact

SEQ ID NO: 8381629 - DNA, 22 bp, Homo sapiens
gtcttcctaatttgctattagg

SEQ ID NO: 8381630 - DNA, 22 bp, Homo sapiens
gtcttctaagtatcaaagcaga

SEQ ID NO: 8381631 - DNA, 22 bp, Homo sapiens
gtcttagatttcaccgataatg

SEQ ID NO: 8381632 - DNA, 22 bp, Homo sapiens
gtctggtttatgaagatcccgt

SEQ ID NO: 8381633 - DNA, 22 bp, Homo sapiens
gtcttatagtacaatttgaagt

SEQ ID NO: 8381634 - DNA, 22 bp, Homo sapiens
gtgcttgcagtgagatgagatg

SEQ ID NO: 8381635 - DNA, 22 bp, Homo sapiens
gtgctgggtgctgcagacaggt

SEQ ID NO: 8381636 - DNA, 22 bp, Homo sapiens
gtgctgggccctgagaccaggg

SEQ ID NO: 8381637 - DNA, 22 bp, Homo sapiens
gtgctgggattacaggtgtgag

SEQ ID NO: 8381638 - DNA, 22 bp, Homo sapiens
gtgctgggggtttctgtaggtc

SEQ ID NO: 8381639 - DNA, 22 bp, Homo sapiens
gtgctggggagataggaagaga

SEQ ID NO: 8381640 - DNA, 22 bp, Homo sapiens
gtgcctctgagctctgctacag

SEQ ID NO: 8381641 - DNA, 23 bp, Homo sapiens
gtgccgacgctccagcaccatcc

SEQ ID NO: 8381642 - DNA, 23 bp, Homo sapiens
gtgccgacgctccagcaccatcc

SEQ ID NO: 8381643 - DNA, 22 bp, Homo sapiens
gtgcccttataatagagaccca

SEQ ID NO: 8381644 - DNA, 22 bp, Homo sapiens
gtgcccaggggccagctgccgg

SEQ ID NO: 8381645 - DNA, 22 bp, Homo sapiens
gtgcccaggggccagctgccgg

SEQ ID NO: 8381646 - DNA, 22 bp, Homo sapiens
gtgcccaggtgtccctgagaag

SEQ ID NO: 8381647 - DNA, 22 bp, Homo sapiens
gtgcaaatgtaattgtgatttt

SEQ ID NO: 8381648 - DNA, 22 bp, Homo sapiens
ggtggctctgttgtcaactgat

SEQ ID NO: 8381649 - DNA, 22 bp, Homo sapiens
ggtgcggagactccatgaggcc

SEQ ID NO: 8381650 - DNA, 22 bp, Homo sapiens
ggtgccagagtggcccaggggc

SEQ ID NO: 8381651 - DNA, 21 bp, Homo sapiens
ggtgggcacaggagagcagag

SEQ ID NO: 8381652 - DNA, 22 bp, Homo sapiens
ggtgggcaacatttggcctgag

SEQ ID NO: 8381653 - DNA, 22 bp, Homo sapiens
ggtgggagtggaacgtggaaga

SEQ ID NO: 8381654 - DNA, 22 bp, Homo sapiens
ggtgggagtggaacgtggaaga

SEQ ID NO: 8381655 - DNA, 16 bp, Homo sapiens
ggtgggaggtgaggtg

SEQ ID NO: 8381656 - DNA, 22 bp, Homo sapiens
ggtgggagagcttgctttgatg

SEQ ID NO: 8381657 - DNA, 22 bp, Homo sapiens
ggtgggaggcaggctgctccca

SEQ ID NO: 8381658 - DNA, 22 bp, Homo sapiens
ggtgggagccaacacccttctg

SEQ ID NO: 8381659 - DNA, 22 bp, Homo sapiens
ggtctggggcaggcatctgaca

SEQ ID NO: 8381660 - DNA, 22 bp, Homo sapiens
ggtcttttcacagtggtttgag

SEQ ID NO: 8381661 - DNA, 22 bp, Homo sapiens
ggtgcatgtgagaaagactggg

SEQ ID NO: 8381662 - DNA, 22 bp, Homo sapiens
ggtgcatgtgagaaagactggg

SEQ ID NO: 8381663 - DNA, 22 bp, Homo sapiens
ggtgcatggaaagagtaagtaa

SEQ ID NO: 8381664 - DNA, 20 bp, Homo sapiens
ggtgcaggtaacgctgtgct

SEQ ID NO: 8381665 - DNA, 22 bp, Homo sapiens
ggtgaaggtcagagcaggaaaa

SEQ ID NO: 8381666 - DNA, 22 bp, Homo sapiens
ggtgaagggccttaggagacag

SEQ ID NO: 8381667 - DNA, 22 bp, Homo sapiens
ggtagggatgggatttggaagt

SEQ ID NO: 8381668 - DNA, 22 bp, Homo sapiens
ggtcagccttggatttggtagc

SEQ ID NO: 8381669 - DNA, 21 bp, Homo sapiens
ggtcaggcatgtgccctgagc

SEQ ID NO: 8381670 - DNA, 20 bp, Homo sapiens
ggtagctgctgcagttggta

SEQ ID NO: 8381671 - DNA, 22 bp, Homo sapiens
ggtaggcagatcactgtctatg

SEQ ID NO: 8381672 - DNA, 22 bp, Homo sapiens
ggtaggaagatagagcaaagtt

SEQ ID NO: 8381673 - DNA, 22 bp, Homo sapiens
ggtaggagtattttgcagcagt

SEQ ID NO: 8381674 - DNA, 22 bp, Homo sapiens
ggtcagggggatctgtgaggta

SEQ ID NO: 8381675 - DNA, 22 bp, Homo sapiens
ggtccaggatcaaggcatcacc

SEQ ID NO: 8381676 - DNA, 22 bp, Homo sapiens
ggtccaggtatgtggtgtgaat

SEQ ID NO: 8381677 - DNA, 22 bp, Homo sapiens
ggtccaggtttgctctacttgt

SEQ ID NO: 8381678 - DNA, 22 bp, Homo sapiens
gggtccagacactccagaggaa

SEQ ID NO: 8381679 - DNA, 22 bp, Homo sapiens
gggtccagaatgagaatgggct

SEQ ID NO: 8381680 - DNA, 22 bp, Homo sapiens
gggtccagacactccagaggaa

SEQ ID NO: 8381681 - DNA, 22 bp, Homo sapiens
gggtccagagttgaagaggtta

SEQ ID NO: 8381682 - DNA, 22 bp, Homo sapiens
gggtccagagttgaagaggtta

SEQ ID NO: 8381683 - DNA, 23 bp, Homo sapiens
gggtccagagacaggcatgggtg

SEQ ID NO: 8381684 - DNA, 23 bp, Homo sapiens
gggtccagagaagccattagggc

SEQ ID NO: 8381685 - DNA, 23 bp, Homo sapiens
gggtccagagacaggcatgggtg

SEQ ID NO: 8381686 - DNA, 22 bp, Homo sapiens
gggtcaggcctcaaggtgggct

SEQ ID NO: 8381687 - DNA, 22 bp, Homo sapiens
gggtccagatggtgagagttaa

SEQ ID NO: 8381688 - DNA, 22 bp, Homo sapiens
ggtaccaccaattcagctgcca

SEQ ID NO: 8381689 - DNA, 22 bp, Homo sapiens
ggtaccaccaattcagctgcca

SEQ ID NO: 8381690 - DNA, 22 bp, Homo sapiens
gggctgggattgcttgctgtga

SEQ ID NO: 8381691 - DNA, 22 bp, Homo sapiens
gggctgggcatggtgttccctc

SEQ ID NO: 8381692 - DNA, 22 bp, Homo sapiens
gggctgggcatggtgttccctc

SEQ ID NO: 8381693 - DNA, 22 bp, Homo sapiens
gggctgggcatggtgttccctc

SEQ ID NO: 8381694 - DNA, 22 bp, Homo sapiens
gggctggggctcaataatttgt

SEQ ID NO: 8381695 - DNA, 22 bp, Homo sapiens
gggctgggaatggctaagtatg

SEQ ID NO: 8381696 - DNA, 22 bp, Homo sapiens
gggctgggaatggctaagtatg

SEQ ID NO: 8381697 - DNA, 22 bp, Homo sapiens
gggctggctgattttcctctct

SEQ ID NO: 8381698 - DNA, 22 bp, Homo sapiens
gggctggctctgtctagaaagg

SEQ ID NO: 8381699 - DNA, 22 bp, Homo sapiens
gggctgggatggcttgaagatt

SEQ ID NO: 8381700 - DNA, 22 bp, Homo sapiens
ggggatggaggcgtgtggtcct

SEQ ID NO: 8381701 - DNA, 22 bp, Homo sapiens
ggggatggaatgtagtagtgat

SEQ ID NO: 8381702 - DNA, 22 bp, Homo sapiens
ggggatggtgggaaggcaatct

SEQ ID NO: 8381703 - DNA, 22 bp, Homo sapiens
ggggcacctcctcttggcaatt

SEQ ID NO: 8381704 - DNA, 22 bp, Homo sapiens
ggggcacacttttggtagatat

SEQ ID NO: 8381705 - DNA, 22 bp, Homo sapiens
ggggcagaagtagtgcccctga

SEQ ID NO: 8381706 - DNA, 22 bp, Homo sapiens
ggggcagctaccggaagtaggg

SEQ ID NO: 8381707 - DNA, 22 bp, Homo sapiens
ggggcagaaagcccacagagtg

SEQ ID NO: 8381708 - DNA, 22 bp, Homo sapiens
ggggcagaaagcccacagagtg

SEQ ID NO: 8381709 - DNA, 22 bp, Homo sapiens
ggggcttttgcacgtgggaggc

SEQ ID NO: 8381710 - DNA, 18 bp, Homo sapiens
gggtatccagaactggtc

SEQ ID NO: 8381711 - DNA, 22 bp, Homo sapiens
gggggcagtaaggatatggaaa

SEQ ID NO: 8381712 - DNA, 21 bp, Homo sapiens
gggcctggctgcgcaggacgg

SEQ ID NO: 8381713 - DNA, 22 bp, Homo sapiens
gggcctctccggcctttgcatc

SEQ ID NO: 8381714 - DNA, 22 bp, Homo sapiens
gggcagtgttgtggttctctat

SEQ ID NO: 8381715 - DNA, 22 bp, Homo sapiens
gggcatctggtggagcctcagg

SEQ ID NO: 8381716 - DNA, 22 bp, Homo sapiens
gggcatgagagggcagctggca

SEQ ID NO: 8381717 - DNA, 22 bp, Homo sapiens
gggcatgacttttggagtggga

SEQ ID NO: 8381718 - DNA, 22 bp, Homo sapiens
gggcatgagaggcaggcaagtg

SEQ ID NO: 8381719 - DNA, 21 bp, Homo sapiens
gggctccagagatgtagcttc

SEQ ID NO: 8381720 - DNA, 22 bp, Homo sapiens
gggctccacagcagtgagtgga

SEQ ID NO: 8381721 - DNA, 22 bp, Homo sapiens
gggctccagccaggtgtcccca

SEQ ID NO: 8381722 - DNA, 22 bp, Homo sapiens
gggctccagccactggctgagg

SEQ ID NO: 8381723 - DNA, 22 bp, Homo sapiens
gggctccagccagctccttgtg

SEQ ID NO: 8381724 - DNA, 22 bp, Homo sapiens
gggctccagcagaggcagccgg

SEQ ID NO: 8381725 - DNA, 22 bp, Homo sapiens
gggctccagtttggccaggaag

SEQ ID NO: 8381726 - DNA, 22 bp, Homo sapiens
gggctccagctgtttgccatga

SEQ ID NO: 8381727 - DNA, 23 bp, Homo sapiens
gggctccagtctctgctcagttg

SEQ ID NO: 8381728 - DNA, 22 bp, Homo sapiens
gggctggctcccaggtgttgaa

SEQ ID NO: 8381729 - DNA, 22 bp, Homo sapiens
gggctggctcccaggtgttgaa

SEQ ID NO: 8381730 - DNA, 20 bp, Homo sapiens
gggctggctcaactggatcc

SEQ ID NO: 8381731 - DNA, 22 bp, Homo sapiens
gggctggctaagacttttctgt

SEQ ID NO: 8381732 - DNA, 22 bp, Homo sapiens
gggctggcgggaaaggcaattc

SEQ ID NO: 8381733 - DNA, 20 bp, Homo sapiens
gggctggcgcatggggaaag

SEQ ID NO: 8381734 - DNA, 21 bp, Homo sapiens
gggctctcctgaggccatgaa

SEQ ID NO: 8381735 - DNA, 22 bp, Homo sapiens
gggctctaggccaagagtcccg

SEQ ID NO: 8381736 - DNA, 22 bp, Homo sapiens
cctggggagccgcctgagcccc

SEQ ID NO: 8381737 - DNA, 22 bp, Homo sapiens
cctggggagccgcctgagcccc

SEQ ID NO: 8381738 - DNA, 23 bp, Homo sapiens
cctggggcacttgagtcctcatc

SEQ ID NO: 8381739 - DNA, 22 bp, Homo sapiens
cctggggattctgacacggagt

SEQ ID NO: 8381740 - DNA, 22 bp, Homo sapiens
tgtttctataacctctgaagca

SEQ ID NO: 8381741 - DNA, 22 bp, Homo sapiens
tgtttctatctggatcaataga

SEQ ID NO: 8381742 - DNA, 22 bp, Homo sapiens
tgtttctatctggatcaataga

SEQ ID NO: 8381743 - DNA, 20 bp, Homo sapiens
tgtttctgacggtaggagag

SEQ ID NO: 8381744 - DNA, 22 bp, Homo sapiens
tgtttctgggtgtgtctcacct

SEQ ID NO: 8381745 - DNA, 22 bp, Homo sapiens
tgttttcatttgatgtaacaaa

SEQ ID NO: 8381746 - DNA, 22 bp, Homo sapiens
tgttttcctcctggtttctgcc

SEQ ID NO: 8381747 - DNA, 19 bp, Homo sapiens
tgttgccaggtatcatgtt

SEQ ID NO: 8381748 - DNA, 19 bp, Homo sapiens
tgttggaggtgctgaatta

SEQ ID NO: 8381749 - DNA, 22 bp, Homo sapiens
tgttggagcccgagtcagggag

SEQ ID NO: 8381750 - DNA, 22 bp, Homo sapiens
tgttgattagtgtttagactta

SEQ ID NO: 8381751 - DNA, 22 bp, Homo sapiens
tgttcccacaccagcctcagcc

SEQ ID NO: 8381752 - DNA, 22 bp, Homo sapiens
tgttcccaagataagattatga

SEQ ID NO: 8381753 - DNA, 22 bp, Homo sapiens
tggttcatgctcatggtgatag

SEQ ID NO: 8381754 - DNA, 22 bp, Homo sapiens
tggttagatgaggctggtttca

SEQ ID NO: 8381755 - DNA, 22 bp, Homo sapiens
tggttagaggcttcttgcttgg

SEQ ID NO: 8381756 - DNA, 22 bp, Homo sapiens
tggttagactcaccttatagtt

SEQ ID NO: 8381757 - DNA, 22 bp, Homo sapiens
tggttcctcaagcgctggcggc

SEQ ID NO: 8381758 - DNA, 22 bp, Homo sapiens
ttaaaagggatgttatctgtaa

SEQ ID NO: 8381759 - DNA, 22 bp, Homo sapiens
ttaaaagggatgttatctgtaa

SEQ ID NO: 8381760 - DNA, 23 bp, Homo sapiens
ttaaaagtggagagagaagctgg

SEQ ID NO: 8381761 - DNA, 23 bp, Homo sapiens
ttaaaagtggagagagaagctgg

SEQ ID NO: 8381762 - DNA, 22 bp, Homo sapiens
ttaaaatagccagtgcccctct

SEQ ID NO: 8381763 - DNA, 22 bp, Homo sapiens
ttaaaagagcagcccagcatat

SEQ ID NO: 8381764 - DNA, 22 bp, Homo sapiens
ttaaaagagcagcccagcatat

SEQ ID NO: 8381765 - DNA, 22 bp, Homo sapiens
ttaaaagagcagcccagcatat

SEQ ID NO: 8381766 - DNA, 22 bp, Homo sapiens
ttaaaatgaatattgattagca

SEQ ID NO: 8381767 - DNA, 22 bp, Homo sapiens
ttaaaatgcagattatgactca

SEQ ID NO: 8381768 - DNA, 22 bp, Homo sapiens
ttaaaatcgctgttgcttctgt

SEQ ID NO: 8381769 - DNA, 22 bp, Homo sapiens
ttaaaatcacagtcacccagta

SEQ ID NO: 8381770 - DNA, 22 bp, Homo sapiens
ttaaaatagccagtgcccctct

SEQ ID NO: 8381771 - DNA, 22 bp, Homo sapiens
ttaatatgttgaaatttattag

SEQ ID NO: 8381772 - DNA, 22 bp, Homo sapiens
ttaatagatttgattttaaagg

SEQ ID NO: 8381773 - DNA, 22 bp, Homo sapiens
ttaatactataatttgaagtac

SEQ ID NO: 8381774 - DNA, 20 bp, Homo sapiens
ttaagcattattactcccag

SEQ ID NO: 8381775 - DNA, 22 bp, Homo sapiens
ttaaggaaacatttttccatag

SEQ ID NO: 8381776 - DNA, 22 bp, Homo sapiens
cctgtggcgggggccagtgcct

SEQ ID NO: 8381777 - DNA, 22 bp, Homo sapiens
ttacaaagcgttgagacaagta

SEQ ID NO: 8381778 - DNA, 22 bp, Homo sapiens
cctgtggctgccacttgggtga

SEQ ID NO: 8381779 - DNA, 22 bp, Homo sapiens
ttacaatcatctaggataaaga

SEQ ID NO: 8381780 - DNA, 22 bp, Homo sapiens
ttacaagtttctggcttcatcc

SEQ ID NO: 8381781 - DNA, 22 bp, Homo sapiens
ttacaagttttcatgaaattga

SEQ ID NO: 8381782 - DNA, 23 bp, Homo sapiens
ttacaagttctgaaatttccttc

SEQ ID NO: 8381783 - DNA, 22 bp, Homo sapiens
ttacaagttcagattttctcat

SEQ ID NO: 8381784 - DNA, 22 bp, Homo sapiens
ttaatgccaacaaagtgatttt

SEQ ID NO: 8381785 - DNA, 22 bp, Homo sapiens
ttaatgatacctatgttaattt

SEQ ID NO: 8381786 - DNA, 22 bp, Homo sapiens
ccttctggaagctctaagggag

SEQ ID NO: 8381787 - DNA, 22 bp, Homo sapiens
ccttctggagggtgtacgagag

SEQ ID NO: 8381788 - DNA, 22 bp, Homo sapiens
ccttcttaaacatcattttggc

SEQ ID NO: 8381789 - DNA, 22 bp, Homo sapiens
ccttctgggccaacttccagga

SEQ ID NO: 8381790 - DNA, 22 bp, Homo sapiens
ccttctggatgtgctaaggaag

SEQ ID NO: 8381791 - DNA, 22 bp, Homo sapiens
ttaccaatgtgcttttgctaca

SEQ ID NO: 8381792 - DNA, 22 bp, Homo sapiens
ttaccaattcagacatctcttc

SEQ ID NO: 8381793 - DNA, 22 bp, Homo sapiens
ttaccaaatgaaatagagattt

SEQ ID NO: 8381794 - DNA, 22 bp, Homo sapiens
ttaccatagtactatcagttta

SEQ ID NO: 8381795 - DNA, 22 bp, Homo sapiens
ttacccagtgaagccgaggcag

SEQ ID NO: 8381796 - DNA, 20 bp, Homo sapiens
ttacagaaatgatgttattt

SEQ ID NO: 8381797 - DNA, 21 bp, Homo sapiens
ccttctcttgcttcagcttca

SEQ ID NO: 8381798 - DNA, 22 bp, Homo sapiens
ttacagaactgtcttgaaattt

SEQ ID NO: 8381799 - DNA, 22 bp, Homo sapiens
ttacagaaggaacactactcag

SEQ ID NO: 8381800 - DNA, 22 bp, Homo sapiens
ttacagaagagtaacttggcaa

SEQ ID NO: 8381801 - DNA, 22 bp, Homo sapiens
ttacagaaggaacactactcag

SEQ ID NO: 8381802 - DNA, 22 bp, Homo sapiens
ccttggggaactggacgtgctg

SEQ ID NO: 8381803 - DNA, 22 bp, Homo sapiens
ccttgggatgcataagagccca

SEQ ID NO: 8381804 - DNA, 22 bp, Homo sapiens
ccttgggatttctcatgccaat

SEQ ID NO: 8381805 - DNA, 22 bp, Homo sapiens
ccttgggaccctgctggaggtt

SEQ ID NO: 8381806 - DNA, 22 bp, Homo sapiens
ccttgggagaaattgcagagtc

SEQ ID NO: 8381807 - DNA, 22 bp, Homo sapiens
ccttgggacagccagcttcaga

SEQ ID NO: 8381808 - DNA, 22 bp, Homo sapiens
ccttggcttgtgggctgcagcc

SEQ ID NO: 8381809 - DNA, 22 bp, Homo sapiens
ccttggcttgcacacggccacc

SEQ ID NO: 8381810 - DNA, 22 bp, Homo sapiens
ccttggcttaccttctgtgtgg

SEQ ID NO: 8381811 - DNA, 22 bp, Homo sapiens
ccttggcttccttccctctaga

SEQ ID NO: 8381812 - DNA, 22 bp, Homo sapiens
ccttggcttccttccctctaga

SEQ ID NO: 8381813 - DNA, 22 bp, Homo sapiens
ttacctgcaactcccatggtga

SEQ ID NO: 8381814 - DNA, 21 bp, Homo sapiens
ttactaaacaaaacatgcagg

SEQ ID NO: 8381815 - DNA, 22 bp, Homo sapiens
ttacgaatgttagattgcatct

SEQ ID NO: 8381816 - DNA, 19 bp, Homo sapiens
ccttgcctgtccctgcagc

SEQ ID NO: 8381817 - DNA, 19 bp, Homo sapiens
ccttgcctgtccctgcagc

SEQ ID NO: 8381818 - DNA, 22 bp, Homo sapiens
ccttggctggaattactctggg

SEQ ID NO: 8381819 - DNA, 22 bp, Homo sapiens
ccttggctgtgctgccctttgc

SEQ ID NO: 8381820 - DNA, 22 bp, Homo sapiens
ccttggctgtgttgcctgccct

SEQ ID NO: 8381821 - DNA, 22 bp, Homo sapiens
cctttaaatggatgttcaactg

SEQ ID NO: 8381822 - DNA, 22 bp, Homo sapiens
cctttaaatggatgttcaactg

SEQ ID NO: 8381823 - DNA, 21 bp, Homo sapiens
cctttacaattttgcattcct

SEQ ID NO: 8381824 - DNA, 22 bp, Homo sapiens
cctttacacatggaatgggtct

SEQ ID NO: 8381825 - DNA, 22 bp, Homo sapiens
ccttggggtgttggaggcagcc

SEQ ID NO: 8381826 - DNA, 22 bp, Homo sapiens
cctttaaagactgcataacttc

SEQ ID NO: 8381827 - DNA, 22 bp, Homo sapiens
ccttgtcttgcacagatgcagc

SEQ ID NO: 8381828 - DNA, 22 bp, Homo sapiens
ttatgtaagtggagtcatatag

SEQ ID NO: 8381829 - DNA, 22 bp, Homo sapiens
ttatgtaagtggagtcatatag

SEQ ID NO: 8381830 - DNA, 22 bp, Homo sapiens
ttatgtatgaatatagtagaag

SEQ ID NO: 8381831 - DNA, 22 bp, Homo sapiens
ttatgtatgaatatagtagaag

SEQ ID NO: 8381832 - DNA, 22 bp, Homo sapiens
cctttcttgctaagagtttatg

SEQ ID NO: 8381833 - DNA, 22 bp, Homo sapiens
cgcaactcagcaacttaactgc

SEQ ID NO: 8381834 - DNA, 22 bp, Homo sapiens
cgcaaagagctctaaatcagac

SEQ ID NO: 8381835 - DNA, 22 bp, Homo sapiens
cctttgggtgaattcctctctt

SEQ ID NO: 8381836 - DNA, 22 bp, Homo sapiens
cctttggccgctttatggagga

SEQ ID NO: 8381837 - DNA, 22 bp, Homo sapiens
cctttggctgcatagggaaggg

SEQ ID NO: 8381838 - DNA, 22 bp, Homo sapiens
cctttggcattttgaggatgcg

SEQ ID NO: 8381839 - DNA, 22 bp, Homo sapiens
cctttggccctgagagatgatt

SEQ ID NO: 8381840 - DNA, 22 bp, Homo sapiens
cgcagagggcaggcagtgctgg

SEQ ID NO: 8381841 - DNA, 22 bp, Homo sapiens
cgcagagggagccgcgggctgc

SEQ ID NO: 8381842 - DNA, 22 bp, Homo sapiens
cgcagcagccccgtggtaggtg

SEQ ID NO: 8381843 - DNA, 22 bp, Homo sapiens
ttcaaaacaatctgtttgcatt

SEQ ID NO: 8381844 - DNA, 22 bp, Homo sapiens
ttatttttaaaagttcacacag

SEQ ID NO: 8381845 - DNA, 17 bp, Homo sapiens
ttattttttgggctgag

SEQ ID NO: 8381846 - DNA, 22 bp, Homo sapiens
ttatttttaaaagttcacacag

SEQ ID NO: 8381847 - DNA, 22 bp, Homo sapiens
ttatttttaaaagttcacacag

SEQ ID NO: 8381848 - DNA, 22 bp, Homo sapiens
ttatttttaaaagttcacacag

SEQ ID NO: 8381849 - DNA, 22 bp, Homo sapiens
ttattcaccatttattatgtga

SEQ ID NO: 8381850 - DNA, 22 bp, Homo sapiens
ttattattgtggttgcattatc

SEQ ID NO: 8381851 - DNA, 22 bp, Homo sapiens
ttattattgtggttgcattatc

SEQ ID NO: 8381852 - DNA, 22 bp, Homo sapiens
ttattattgtggttgcattatc

SEQ ID NO: 8381853 - DNA, 22 bp, Homo sapiens
ttattattgtgacctgagaatg

SEQ ID NO: 8381854 - DNA, 22 bp, Homo sapiens
ttattattttgtgtacagcaaa

SEQ ID NO: 8381855 - DNA, 22 bp, Homo sapiens
ttattcaccagtgtaaaacact

SEQ ID NO: 8381856 - DNA, 22 bp, Homo sapiens
ttattattgtggttgcattatc

SEQ ID NO: 8381857 - DNA, 22 bp, Homo sapiens
ttattattttgtgtacagcaaa

SEQ ID NO: 8381858 - DNA, 22 bp, Homo sapiens
ctcagccaggagagtgttcaca

SEQ ID NO: 8381859 - DNA, 22 bp, Homo sapiens
ctcagcatggagggagaacaag

SEQ ID NO: 8381860 - DNA, 22 bp, Homo sapiens
ctcagccagacatgacccagtc

SEQ ID NO: 8381861 - DNA, 22 bp, Homo sapiens
ctcagccatggggtggatcagc

SEQ ID NO: 8381862 - DNA, 22 bp, Homo sapiens
ctcaggccattcctaccaaggg

SEQ ID NO: 8381863 - DNA, 22 bp, Homo sapiens
ctcaggccaggtttctcccaca

SEQ ID NO: 8381864 - DNA, 22 bp, Homo sapiens
ctcaggagttggaggctacagt

SEQ ID NO: 8381865 - DNA, 22 bp, Homo sapiens
ctcaggccattcttccagctgc

SEQ ID NO: 8381866 - DNA, 23 bp, Homo sapiens
ttgcaaaatgagtcttgagtgaa

SEQ ID NO: 8381867 - DNA, 22 bp, Homo sapiens
ttgcaaaagccgaggcactcca

SEQ ID NO: 8381868 - DNA, 22 bp, Homo sapiens
ttgatttttccagcttctagag

SEQ ID NO: 8381869 - DNA, 22 bp, Homo sapiens
ctcagaaagcaatctggtgagg

SEQ ID NO: 8381870 - DNA, 22 bp, Homo sapiens
ctcagaaacggagctgccattt

SEQ ID NO: 8381871 - DNA, 22 bp, Homo sapiens
ttgatttttttctactatgcgc

SEQ ID NO: 8381872 - DNA, 22 bp, Homo sapiens
ctcaggctaagaaggccaagtg

SEQ ID NO: 8381873 - DNA, 22 bp, Homo sapiens
ttgctgagctttggcaaggaag

SEQ ID NO: 8381874 - DNA, 22 bp, Homo sapiens
ttgctgctcccaagaggcagct

SEQ ID NO: 8381875 - DNA, 22 bp, Homo sapiens
ttgcacagatgcacatggttgc

SEQ ID NO: 8381876 - DNA, 23 bp, Homo sapiens
ttgcacagtgtatacacatattt

SEQ ID NO: 8381877 - DNA, 22 bp, Homo sapiens
ttcttaactggaaaatgtcaga

SEQ ID NO: 8381878 - DNA, 22 bp, Homo sapiens
ttcttaagagggttaagtgaag

SEQ ID NO: 8381879 - DNA, 22 bp, Homo sapiens
ttcttaagtcagtaagatgcaa

SEQ ID NO: 8381880 - DNA, 22 bp, Homo sapiens
ttcttaagtatgatcttaacgg

SEQ ID NO: 8381881 - DNA, 22 bp, Homo sapiens
ttcttaagcagtttggcatgtt

SEQ ID NO: 8381882 - DNA, 22 bp, Homo sapiens
ttcttaactcaaatatatatcc

SEQ ID NO: 8381883 - DNA, 22 bp, Homo sapiens
ttcttaaagaggcaaaacacag

SEQ ID NO: 8381884 - DNA, 20 bp, Homo sapiens
ttcttaaagacctcactttg

SEQ ID NO: 8381885 - DNA, 22 bp, Homo sapiens
ttcttacaagtatgacgtagca

SEQ ID NO: 8381886 - DNA, 23 bp, Homo sapiens
ttcttacaaggctggcccacttg

SEQ ID NO: 8381887 - DNA, 19 bp, Homo sapiens
ttcttacaacaccctggga

SEQ ID NO: 8381888 - DNA, 22 bp, Homo sapiens
ttcttacaaacaagatcattga

SEQ ID NO: 8381889 - DNA, 22 bp, Homo sapiens
ttcttacaaacaagatcattga

SEQ ID NO: 8381890 - DNA, 21 bp, Homo sapiens
ttcttcaggccaatgctcatt

SEQ ID NO: 8381891 - DNA, 21 bp, Homo sapiens
ttcttcaggccaatgctcatt

SEQ ID NO: 8381892 - DNA, 22 bp, Homo sapiens
ttcttacaagtattccaggtcc

SEQ ID NO: 8381893 - DNA, 22 bp, Homo sapiens
ttctgaaaccactgaccaacta

SEQ ID NO: 8381894 - DNA, 22 bp, Homo sapiens
ttctgaaaacacactttgcagc

SEQ ID NO: 8381895 - DNA, 22 bp, Homo sapiens
ttctgaaaattgggtcatactt

SEQ ID NO: 8381896 - DNA, 22 bp, Homo sapiens
ttctctttttgcatctcaacct

SEQ ID NO: 8381897 - DNA, 22 bp, Homo sapiens
ttctgtctctgtgtttacatta

SEQ ID NO: 8381898 - DNA, 22 bp, Homo sapiens
ttctgaaatttcaactttacta

SEQ ID NO: 8381899 - DNA, 22 bp, Homo sapiens
ttctgaaagtctttttaagtta

SEQ ID NO: 8381900 - DNA, 22 bp, Homo sapiens
ttctgaaagccaattcattgaa

SEQ ID NO: 8381901 - DNA, 22 bp, Homo sapiens
ttctgaaattcgactatccaat

SEQ ID NO: 8381902 - DNA, 22 bp, Homo sapiens
ttctgaaatgagatataaggta

SEQ ID NO: 8381903 - DNA, 22 bp, Homo sapiens
ttgaaatatcaagttattagtg

SEQ ID NO: 8381904 - DNA, 22 bp, Homo sapiens
ttcttcagtttggtaaatgtaa

SEQ ID NO: 8381905 - DNA, 22 bp, Homo sapiens
ttcttcccagccagcacagccc

SEQ ID NO: 8381906 - DNA, 21 bp, Homo sapiens
ttcttcatgatgattaatggc

SEQ ID NO: 8381907 - DNA, 22 bp, Homo sapiens
ctcactggcaagactacaggtg

SEQ ID NO: 8381908 - DNA, 22 bp, Homo sapiens
ctcagaaaacctctttcttgat

SEQ ID NO: 8381909 - DNA, 20 bp, Homo sapiens
ctcagaaaagctaaggagaa

SEQ ID NO: 8381910 - DNA, 22 bp, Homo sapiens
ctcagaaacggagctgccattt

SEQ ID NO: 8381911 - DNA, 22 bp, Homo sapiens
ttgaatctataatttcagtatt

SEQ ID NO: 8381912 - DNA, 22 bp, Homo sapiens
ttctcatgaaactcgcttcctc

SEQ ID NO: 8381913 - DNA, 22 bp, Homo sapiens
ttctcatgaaactcgcttcctc

SEQ ID NO: 8381914 - DNA, 22 bp, Homo sapiens
ttctcatgtaaatgccatcatc

SEQ ID NO: 8381915 - DNA, 22 bp, Homo sapiens
ttctcatgatgcaattcatccc

SEQ ID NO: 8381916 - DNA, 22 bp, Homo sapiens
ttctcctgcgcaggcccaggga

SEQ ID NO: 8381917 - DNA, 20 bp, Homo sapiens
ttctccaaaggagacactag

SEQ ID NO: 8381918 - DNA, 22 bp, Homo sapiens
ttctatttttgtggaactgtag

SEQ ID NO: 8381919 - DNA, 22 bp, Homo sapiens
ttctatttttgtggaactgtag

SEQ ID NO: 8381920 - DNA, 22 bp, Homo sapiens
ttctcaaaactcagggtatctg

SEQ ID NO: 8381921 - DNA, 22 bp, Homo sapiens
ctagtttctccgttttctaccc

SEQ ID NO: 8381922 - DNA, 22 bp, Homo sapiens
ctagtttaaagcagctgaaagg

SEQ ID NO: 8381923 - DNA, 22 bp, Homo sapiens
ctagttgaagaggctgtcatca

SEQ ID NO: 8381924 - DNA, 22 bp, Homo sapiens
ctagttgtttaatattgattga

SEQ ID NO: 8381925 - DNA, 22 bp, Homo sapiens
ctagttctagatccctgaggaa

SEQ ID NO: 8381926 - DNA, 22 bp, Homo sapiens
ctagttctagatccctgaggaa

SEQ ID NO: 8381927 - DNA, 22 bp, Homo sapiens
ctagtgtacaagtggtggagat

SEQ ID NO: 8381928 - DNA, 22 bp, Homo sapiens
ctagttctagatccctgaggaa

SEQ ID NO: 8381929 - DNA, 22 bp, Homo sapiens
ttctcctttgtaattctcatcc

SEQ ID NO: 8381930 - DNA, 21 bp, Homo sapiens
ttctcctgttttgcaccacag

SEQ ID NO: 8381931 - DNA, 22 bp, Homo sapiens
ttctacattgtgaagttcttta

SEQ ID NO: 8381932 - DNA, 22 bp, Homo sapiens
ttctacatgtgatgcgtgcctg

SEQ ID NO: 8381933 - DNA, 22 bp, Homo sapiens
ttctacatgagaaaatgtattt

SEQ ID NO: 8381934 - DNA, 22 bp, Homo sapiens
ttctacatttgaggagagtcag

SEQ ID NO: 8381935 - DNA, 22 bp, Homo sapiens
ctacagtgactgtgacagagca

SEQ ID NO: 8381936 - DNA, 22 bp, Homo sapiens
ctacagtgtcgtgtggtttctg

SEQ ID NO: 8381937 - DNA, 17 bp, Homo sapiens
ctacagtgtgtttcctg

SEQ ID NO: 8381938 - DNA, 22 bp, Homo sapiens
ctacataaatttatcacagact

SEQ ID NO: 8381939 - DNA, 22 bp, Homo sapiens
ctacataaatttatcacagact

SEQ ID NO: 8381940 - DNA, 22 bp, Homo sapiens
ctaaatgtcatggagttgtaga

SEQ ID NO: 8381941 - DNA, 22 bp, Homo sapiens
ctaacatttattgagcacttag

SEQ ID NO: 8381942 - DNA, 22 bp, Homo sapiens
ctaacatttattgagcacttag

SEQ ID NO: 8381943 - DNA, 22 bp, Homo sapiens
ctaacatttggaaggcttatga

SEQ ID NO: 8381944 - DNA, 22 bp, Homo sapiens
ctaacatttggaaggcttatga

SEQ ID NO: 8381945 - DNA, 22 bp, Homo sapiens
ttctacatagtctcttggagct

SEQ ID NO: 8381946 - DNA, 22 bp, Homo sapiens
ttctacagtgactgcagccata

SEQ ID NO: 8381947 - DNA, 22 bp, Homo sapiens
ttctacaggtactgaagtacat

SEQ ID NO: 8381948 - DNA, 22 bp, Homo sapiens
ttctacactgagttttttccct

SEQ ID NO: 8381949 - DNA, 22 bp, Homo sapiens
ttctacacttttcattagctag

SEQ ID NO: 8381950 - DNA, 22 bp, Homo sapiens
ttctacactcacccagctgtaa

SEQ ID NO: 8381951 - DNA, 22 bp, Homo sapiens
ttcctttttacataatcacatt

SEQ ID NO: 8381952 - DNA, 22 bp, Homo sapiens
ttcctttttacataatcacatt

SEQ ID NO: 8381953 - DNA, 22 bp, Homo sapiens
ttccactgaaggatctagggaa

SEQ ID NO: 8381954 - DNA, 22 bp, Homo sapiens
cgtctcctgtgttcgagccatt

SEQ ID NO: 8381955 - DNA, 19 bp, Homo sapiens
cgtgaacatgactgcatgg

SEQ ID NO: 8381956 - DNA, 17 bp, Homo sapiens
ttcctcctcaccatgtt

SEQ ID NO: 8381957 - DNA, 22 bp, Homo sapiens
ttcctccagcctggagcacttc

SEQ ID NO: 8381958 - DNA, 22 bp, Homo sapiens
ttcctccagtcagagctgtccc

SEQ ID NO: 8381959 - DNA, 22 bp, Homo sapiens
ttcctccatccttagggagagc

SEQ ID NO: 8381960 - DNA, 22 bp, Homo sapiens
ttcctctcctcccaccaggtga

SEQ ID NO: 8381961 - DNA, 22 bp, Homo sapiens
ttcctctctcttgccagaatgt

SEQ ID NO: 8381962 - DNA, 21 bp, Homo sapiens
ttcctctgcaactgatgctca

SEQ ID NO: 8381963 - DNA, 22 bp, Homo sapiens
ttcctctcctcccaccaggtga

SEQ ID NO: 8381964 - DNA, 22 bp, Homo sapiens
ttcagtttccacttacatttaa

SEQ ID NO: 8381965 - DNA, 22 bp, Homo sapiens
ttcagtttgaattctgtagaac

SEQ ID NO: 8381966 - DNA, 22 bp, Homo sapiens
ttcagtttcttccctgtgaaat

SEQ ID NO: 8381967 - DNA, 22 bp, Homo sapiens
ttcagtttccacttacatttaa

SEQ ID NO: 8381968 - DNA, 22 bp, Homo sapiens
cgcagctgcacggggctgagcc

SEQ ID NO: 8381969 - DNA, 22 bp, Homo sapiens
cggctggtgtcgggcacagcaa

SEQ ID NO: 8381970 - DNA, 22 bp, Homo sapiens
cggctggtgtcgggcacagcaa

SEQ ID NO: 8381971 - DNA, 21 bp, Homo sapiens
cggcttctgcattccagagct

SEQ ID NO: 8381972 - DNA, 22 bp, Homo sapiens
cggcttctcgggtcggattccg

SEQ ID NO: 8381973 - DNA, 22 bp, Homo sapiens
cgggaggaaaggcgaggctctg

SEQ ID NO: 8381974 - DNA, 22 bp, Homo sapiens
ttccaaatgttggacaactgta

SEQ ID NO: 8381975 - DNA, 22 bp, Homo sapiens
cggcttcttcatcaggtcagca

SEQ ID NO: 8381976 - DNA, 22 bp, Homo sapiens
cgggaaggtggaggttgcagtg

SEQ ID NO: 8381977 - DNA, 21 bp, Homo sapiens
cgggaaggaggttctgaccct

SEQ ID NO: 8381978 - DNA, 22 bp, Homo sapiens
ttccaccattcatgctaatatt

SEQ ID NO: 8381979 - DNA, 22 bp, Homo sapiens
tttttctagctcaaagattcta

SEQ ID NO: 8381980 - DNA, 22 bp, Homo sapiens
tttttctctaagtagtcccaaa

SEQ ID NO: 8381981 - DNA, 22 bp, Homo sapiens
tttttctagctcaaagattcta

SEQ ID NO: 8381982 - DNA, 19 bp, Homo sapiens
tttttacaagtaggtgtga

SEQ ID NO: 8381983 - DNA, 22 bp, Homo sapiens
ttttctctccaggtggggtgat

SEQ ID NO: 8381984 - DNA, 22 bp, Homo sapiens
tttttctcttctgtaaagtggt

SEQ ID NO: 8381985 - DNA, 22 bp, Homo sapiens
ttttctctatattgtctgtgaa

SEQ ID NO: 8381986 - DNA, 22 bp, Homo sapiens
ttttctctatattgtctgtgaa

SEQ ID NO: 8381987 - DNA, 22 bp, Homo sapiens
ttttctctacaaaataaccagc

SEQ ID NO: 8381988 - DNA, 22 bp, Homo sapiens
ttttctcctttctaggtcacat

SEQ ID NO: 8381989 - DNA, 22 bp, Homo sapiens
ttttctccagggaacaaggtga

SEQ ID NO: 8381990 - DNA, 22 bp, Homo sapiens
ttttctccccagagaccatcat

SEQ ID NO: 8381991 - DNA, 22 bp, Homo sapiens
ttttctcccgctggctgctctt

SEQ ID NO: 8381992 - DNA, 17 bp, Homo sapiens
ttttctcctgcccattc

SEQ ID NO: 8381993 - DNA, 22 bp, Homo sapiens
ttttctcctaagacccttcacc

SEQ ID NO: 8381994 - DNA, 22 bp, Homo sapiens
ttttctcaggtgcttatctaag

SEQ ID NO: 8381995 - DNA, 22 bp, Homo sapiens
ttttctcaggtgcttatctaag

SEQ ID NO: 8381996 - DNA, 22 bp, Homo sapiens
ctgaagattcgcctttgtttat

SEQ ID NO: 8381997 - DNA, 22 bp, Homo sapiens
ctgaagattataaacagacata

SEQ ID NO: 8381998 - DNA, 22 bp, Homo sapiens
ctgaagatttttggtaatcatg

SEQ ID NO: 8381999 - DNA, 22 bp, Homo sapiens
ctgaagatttggctgtaaagca

SEQ ID NO: 8382000 - DNA, 22 bp, Homo sapiens
ctgaagattcgcctttgtttat

SEQ ID NO: 8382001 - DNA, 22 bp, Homo sapiens
tttttcttaaatgtgggttggc

SEQ ID NO: 8382002 - DNA, 22 bp, Homo sapiens
tttttcttaaatgtgggttggc

SEQ ID NO: 8382003 - DNA, 22 bp, Homo sapiens
tttttcttgtgctggatctaat

SEQ ID NO: 8382004 - DNA, 20 bp, Homo sapiens
ctgaaagacgtaacagtgca

SEQ ID NO: 8382005 - DNA, 22 bp, Homo sapiens
ctgaaactccatgagaaattgc

SEQ ID NO: 8382006 - DNA, 22 bp, Homo sapiens
ctgaaactttagttctgcaaca

SEQ ID NO: 8382007 - DNA, 22 bp, Homo sapiens
ctgaaaatgttagtgatacgaa

SEQ ID NO: 8382008 - DNA, 22 bp, Homo sapiens
ctgagctggtggaagcatgcag

SEQ ID NO: 8382009 - DNA, 22 bp, Homo sapiens
ctgagctggtgtttcagggtca

SEQ ID NO: 8382010 - DNA, 22 bp, Homo sapiens
ctgagctgtggaataaacactg

SEQ ID NO: 8382011 - DNA, 22 bp, Homo sapiens
ctgagctgtggccaccaattta

SEQ ID NO: 8382012 - DNA, 22 bp, Homo sapiens
ctgagctgtgtggtcctgggca

SEQ ID NO: 8382013 - DNA, 22 bp, Homo sapiens
ctgagctgttactctgtcctcg

SEQ ID NO: 8382014 - DNA, 22 bp, Homo sapiens
ctgagctgtgctaagtgaaatg

SEQ ID NO: 8382015 - DNA, 22 bp, Homo sapiens
ctgagctgtcaggaatggaaag

SEQ ID NO: 8382016 - DNA, 22 bp, Homo sapiens
ctgagctggttctcttgtgaaa

SEQ ID NO: 8382017 - DNA, 22 bp, Homo sapiens
ctgaggaaagctgcagcggtac

SEQ ID NO: 8382018 - DNA, 22 bp, Homo sapiens
ctgaggaaagtattgcctggtg

SEQ ID NO: 8382019 - DNA, 22 bp, Homo sapiens
ctgaggaagacagcagctgtgt

SEQ ID NO: 8382020 - DNA, 22 bp, Homo sapiens
ctgaggacattgatgaggcaat

SEQ ID NO: 8382021 - DNA, 18 bp, Homo sapiens
ctgagggcagcccctggg

SEQ ID NO: 8382022 - DNA, 22 bp, Homo sapiens
ctgagggccctgaagcttggca

SEQ ID NO: 8382023 - DNA, 22 bp, Homo sapiens
ctgagggagttcctgagcccac

SEQ ID NO: 8382024 - DNA, 22 bp, Homo sapiens
ctgagggcaccgacagagtgga

SEQ ID NO: 8382025 - DNA, 18 bp, Homo sapiens
ctgagggcaacagaggct

SEQ ID NO: 8382026 - DNA, 18 bp, Homo sapiens
ctgagggcaacagaggct

SEQ ID NO: 8382027 - DNA, 22 bp, Homo sapiens
ctgaggctgggcatggggtcca

SEQ ID NO: 8382028 - DNA, 22 bp, Homo sapiens
ctgagggagagaatggggcaaa

SEQ ID NO: 8382029 - DNA, 22 bp, Homo sapiens
ctgagggagaagtgatctctac

SEQ ID NO: 8382030 - DNA, 22 bp, Homo sapiens
ctgagctgggagtagagactct

SEQ ID NO: 8382031 - DNA, 22 bp, Homo sapiens
ctgagctgggctctcttgaggg

SEQ ID NO: 8382032 - DNA, 22 bp, Homo sapiens
ctgagctgggagtggatagtgg

SEQ ID NO: 8382033 - DNA, 22 bp, Homo sapiens
ctgagatctttatacgaggcac

SEQ ID NO: 8382034 - DNA, 22 bp, Homo sapiens
ctgagataaatgcctccagtca

SEQ ID NO: 8382035 - DNA, 22 bp, Homo sapiens
ctgagaggggaccagggtgttt

SEQ ID NO: 8382036 - DNA, 22 bp, Homo sapiens
ctgagaggtaagcagcgcagtg

SEQ ID NO: 8382037 - DNA, 22 bp, Homo sapiens
ctgagaggtgacagcgtgctgg

SEQ ID NO: 8382038 - DNA, 22 bp, Homo sapiens
ctgctgctcttgtgcattagtg

SEQ ID NO: 8382039 - DNA, 17 bp, Homo sapiens
ctgctggctggggcttg

SEQ ID NO: 8382040 - DNA, 22 bp, Homo sapiens
ctgctggcaagcccagttggag

SEQ ID NO: 8382041 - DNA, 22 bp, Homo sapiens
ctgctggcaagcccagttggag

SEQ ID NO: 8382042 - DNA, 22 bp, Homo sapiens
ctgctggcaccgatgaaagaca

SEQ ID NO: 8382043 - DNA, 22 bp, Homo sapiens
ctgctggaggttggagcatgca

SEQ ID NO: 8382044 - DNA, 22 bp, Homo sapiens
ctgctggaagtttgctgtggat

SEQ ID NO: 8382045 - DNA, 22 bp, Homo sapiens
ctgctggactacaggaagagtt

SEQ ID NO: 8382046 - DNA, 22 bp, Homo sapiens
ctgctggagggagctgatagtg

SEQ ID NO: 8382047 - DNA, 22 bp, Homo sapiens
ctgctgagcctggtgcgggatg

SEQ ID NO: 8382048 - DNA, 22 bp, Homo sapiens
ctgctcctgtgggccagtggcc

SEQ ID NO: 8382049 - DNA, 22 bp, Homo sapiens
ctgctgagcatttgcagggaca

SEQ ID NO: 8382050 - DNA, 22 bp, Homo sapiens
ctgcgtgagcgtgcccgtcttg

SEQ ID NO: 8382051 - DNA, 22 bp, Homo sapiens
ctgcctgcactgcctggctcca

SEQ ID NO: 8382052 - DNA, 22 bp, Homo sapiens
ctgcctcttgacagatcgtggc

SEQ ID NO: 8382053 - DNA, 22 bp, Homo sapiens
ctgcctcttaagtggatggagt

SEQ ID NO: 8382054 - DNA, 22 bp, Homo sapiens
ctgcctcttgacagatcgtggc

SEQ ID NO: 8382055 - DNA, 22 bp, Homo sapiens
ctgcctcttgacagatcgtggc

SEQ ID NO: 8382056 - DNA, 22 bp, Homo sapiens
ctgcctctgttgggcatggtct

SEQ ID NO: 8382057 - DNA, 22 bp, Homo sapiens
ctgcctctgttgggcatggtct

SEQ ID NO: 8382058 - DNA, 22 bp, Homo sapiens
ctgcctcttaagtggatggagt

SEQ ID NO: 8382059 - DNA, 22 bp, Homo sapiens
ctgctccagtagccccatgtgg

SEQ ID NO: 8382060 - DNA, 22 bp, Homo sapiens
ctgctccccagcctgcgccttt

SEQ ID NO: 8382061 - DNA, 22 bp, Homo sapiens
ctgctccccagcctgcgccttt

SEQ ID NO: 8382062 - DNA, 19 bp, Homo sapiens
ctgctccctccttctggca

SEQ ID NO: 8382063 - DNA, 22 bp, Homo sapiens
ctgctcctgtccagcagggcca

SEQ ID NO: 8382064 - DNA, 22 bp, Homo sapiens
ctgctccaggaacagagctgct

SEQ ID NO: 8382065 - DNA, 22 bp, Homo sapiens
ctgcctctattcactgaggcag

SEQ ID NO: 8382066 - DNA, 22 bp, Homo sapiens
ctgcctctattcactgaggcag

SEQ ID NO: 8382067 - DNA, 22 bp, Homo sapiens
ctgcctctggcctcaggcccag

SEQ ID NO: 8382068 - DNA, 22 bp, Homo sapiens
ctgcctctggcctcaggcccag

SEQ ID NO: 8382069 - DNA, 22 bp, Homo sapiens
ctgcctctggttttggtccctg

SEQ ID NO: 8382070 - DNA, 22 bp, Homo sapiens
ctgcctctggttttggtccctg

SEQ ID NO: 8382071 - DNA, 22 bp, Homo sapiens
ctgcctctgttgggcatggtct

SEQ ID NO: 8382072 - DNA, 22 bp, Homo sapiens
ctgcctctgttgggcatggtct

SEQ ID NO: 8382073 - DNA, 22 bp, Homo sapiens
ctgccctgagtcatgccagatg

SEQ ID NO: 8382074 - DNA, 22 bp, Homo sapiens
ctgagggccgggacccagtttc

SEQ ID NO: 8382075 - DNA, 21 bp, Homo sapiens
ctgagggccgcagctgggctc

SEQ ID NO: 8382076 - DNA, 22 bp, Homo sapiens
ctgagggccttggctcctgccc

SEQ ID NO: 8382077 - DNA, 22 bp, Homo sapiens
ctgagggcctgaggacctagat

SEQ ID NO: 8382078 - DNA, 22 bp, Homo sapiens
ctgagggccttctatgctgagc

SEQ ID NO: 8382079 - DNA, 23 bp, Homo sapiens
ctgagggctggtctgaagtctgc

SEQ ID NO: 8382080 - DNA, 22 bp, Homo sapiens
ctgagggcttccttgtcccggg

SEQ ID NO: 8382081 - DNA, 22 bp, Homo sapiens
ctgagggctggagctgaggcct

SEQ ID NO: 8382082 - DNA, 22 bp, Homo sapiens
ctgagggctggagctgaggcct

SEQ ID NO: 8382083 - DNA, 21 bp, Homo sapiens
ctgagggctttgaatccagac

SEQ ID NO: 8382084 - DNA, 22 bp, Homo sapiens
ctgcaggttgagcagccaggtt

SEQ ID NO: 8382085 - DNA, 22 bp, Homo sapiens
ctgcccctgctcatggctgtcc

SEQ ID NO: 8382086 - DNA, 22 bp, Homo sapiens
ctgcatcactcttactggcttt

SEQ ID NO: 8382087 - DNA, 22 bp, Homo sapiens
ctgcatatcaaattactcctgg

SEQ ID NO: 8382088 - DNA, 22 bp, Homo sapiens
ctgcatatgatagatgccttgc

SEQ ID NO: 8382089 - DNA, 22 bp, Homo sapiens
ctgcagtgcaagcccagatgga

SEQ ID NO: 8382090 - DNA, 22 bp, Homo sapiens
tttcttcttgatttaaacaggg

SEQ ID NO: 8382091 - DNA, 22 bp, Homo sapiens
tttcttctgtttgtagttacac

SEQ ID NO: 8382092 - DNA, 22 bp, Homo sapiens
tttcttctgtttgtagttacac

SEQ ID NO: 8382093 - DNA, 22 bp, Homo sapiens
tttcttcttaatactggctgct

SEQ ID NO: 8382094 - DNA, 21 bp, Homo sapiens
tttcttaggctctaaaatgac

SEQ ID NO: 8382095 - DNA, 22 bp, Homo sapiens
tttcttatattctgtcattgtt

SEQ ID NO: 8382096 - DNA, 22 bp, Homo sapiens
tttcttatactatattgtcatc

SEQ ID NO: 8382097 - DNA, 22 bp, Homo sapiens
tttcttatactatattgtcatc

SEQ ID NO: 8382098 - DNA, 22 bp, Homo sapiens
tttcttgagcccaggaggtgga

SEQ ID NO: 8382099 - DNA, 22 bp, Homo sapiens
ctctgctgctttgccagtggaa

SEQ ID NO: 8382100 - DNA, 22 bp, Homo sapiens
ctctgctgctttgccagtggaa

SEQ ID NO: 8382101 - DNA, 22 bp, Homo sapiens
ctctgctgtgccgccagggcct

SEQ ID NO: 8382102 - DNA, 21 bp, Homo sapiens
ctctgctgtctaccagctgtt

SEQ ID NO: 8382103 - DNA, 22 bp, Homo sapiens
ctctgctgtctcagatgggcca

SEQ ID NO: 8382104 - DNA, 22 bp, Homo sapiens
ctctggagtcaggcagccctgg

SEQ ID NO: 8382105 - DNA, 19 bp, Homo sapiens
ctctggagtcattgctccc

SEQ ID NO: 8382106 - DNA, 22 bp, Homo sapiens
ctctggagtcaggcagccctgg

SEQ ID NO: 8382107 - DNA, 22 bp, Homo sapiens
ctctggaggtcaggtgtggtgg

SEQ ID NO: 8382108 - DNA, 22 bp, Homo sapiens
ctctggaggcagcaccagccag

SEQ ID NO: 8382109 - DNA, 19 bp, Homo sapiens
ctctggagggaccgccgtt

SEQ ID NO: 8382110 - DNA, 22 bp, Homo sapiens
ctctggagcatttcacctacat

SEQ ID NO: 8382111 - DNA, 22 bp, Homo sapiens
tttgaataaacggttaatgttc

SEQ ID NO: 8382112 - DNA, 22 bp, Homo sapiens
tttgaagggcacgacaatagtt

SEQ ID NO: 8382113 - DNA, 22 bp, Homo sapiens
ctctgagggtctaaggagtcac

SEQ ID NO: 8382114 - DNA, 22 bp, Homo sapiens
ctctgagggtctaaggagtcac

SEQ ID NO: 8382115 - DNA, 22 bp, Homo sapiens
ctctgagggctcgagggacgcg

SEQ ID NO: 8382116 - DNA, 22 bp, Homo sapiens
ctctgaggtcctacagtgaccc

SEQ ID NO: 8382117 - DNA, 22 bp, Homo sapiens
ctctgaggtcctacagtgaccc

SEQ ID NO: 8382118 - DNA, 22 bp, Homo sapiens
ctctgagggctcgagggacgcg

SEQ ID NO: 8382119 - DNA, 22 bp, Homo sapiens
ctctgaggctccatgcaggctt

SEQ ID NO: 8382120 - DNA, 22 bp, Homo sapiens
ctctgaggaagtcaagtagcca

SEQ ID NO: 8382121 - DNA, 22 bp, Homo sapiens
ctctgaggagaaagagcttggt

SEQ ID NO: 8382122 - DNA, 22 bp, Homo sapiens
ctctctggcacttcattgctgt

SEQ ID NO: 8382123 - DNA, 22 bp, Homo sapiens
ctctctggcacttcattgctgt

SEQ ID NO: 8382124 - DNA, 22 bp, Homo sapiens
ctctctggcacttcattgctgt

SEQ ID NO: 8382125 - DNA, 22 bp, Homo sapiens
tttctgatattcatttagaaga

SEQ ID NO: 8382126 - DNA, 22 bp, Homo sapiens
ctctgaggtccttcccagctct

SEQ ID NO: 8382127 - DNA, 22 bp, Homo sapiens
ctctgaggtctaggaccatggc

SEQ ID NO: 8382128 - DNA, 22 bp, Homo sapiens
tttctgcaaaatctaagttaga

SEQ ID NO: 8382129 - DNA, 22 bp, Homo sapiens
tttctgcaaaataaatagtgac

SEQ ID NO: 8382130 - DNA, 22 bp, Homo sapiens
tttctgcacatttctaaagttg

SEQ ID NO: 8382131 - DNA, 22 bp, Homo sapiens
tttctgcaagtgtagataccca

SEQ ID NO: 8382132 - DNA, 22 bp, Homo sapiens
ctctcaaagaaattgcctgtca

SEQ ID NO: 8382133 - DNA, 22 bp, Homo sapiens
ctctatttatggcatctttatg

SEQ ID NO: 8382134 - DNA, 22 bp, Homo sapiens
ctctatgttatgcagaattaag

SEQ ID NO: 8382135 - DNA, 22 bp, Homo sapiens
ctctcaaagtaaggtgtataca

SEQ ID NO: 8382136 - DNA, 22 bp, Homo sapiens
ctctcaaatgtcattcctctat

SEQ ID NO: 8382137 - DNA, 22 bp, Homo sapiens
ctctagcttttgataccagtgt

SEQ ID NO: 8382138 - DNA, 22 bp, Homo sapiens
ctctaccttcctgtccactgaa

SEQ ID NO: 8382139 - DNA, 22 bp, Homo sapiens
ctctactcttaacacagctagg

SEQ ID NO: 8382140 - DNA, 22 bp, Homo sapiens
ctctactgagagcagcagatat

SEQ ID NO: 8382141 - DNA, 22 bp, Homo sapiens
tttctctctatttagacaggta

SEQ ID NO: 8382142 - DNA, 19 bp, Homo sapiens
tttctctccctcatcccga

SEQ ID NO: 8382143 - DNA, 22 bp, Homo sapiens
tttctctctacagtactttcat

SEQ ID NO: 8382144 - DNA, 18 bp, Homo sapiens
tttatatggatagagacc

SEQ ID NO: 8382145 - DNA, 22 bp, Homo sapiens
tttatatgtgaaggtttgcaga

SEQ ID NO: 8382146 - DNA, 23 bp, Homo sapiens
ctcctggagggtccggccctgcc

SEQ ID NO: 8382147 - DNA, 22 bp, Homo sapiens
ctcctggaggctccaagggaga

SEQ ID NO: 8382148 - DNA, 22 bp, Homo sapiens
ctcctggagcagcaggcgcagg

SEQ ID NO: 8382149 - DNA, 22 bp, Homo sapiens
ctcctggaggatagtgactggg

SEQ ID NO: 8382150 - DNA, 22 bp, Homo sapiens
ctcctggacatggagcggagga

SEQ ID NO: 8382151 - DNA, 22 bp, Homo sapiens
ctcctggaagcccgccctgctg

SEQ ID NO: 8382152 - DNA, 22 bp, Homo sapiens
tttacacataaatgtgtagaca

SEQ ID NO: 8382153 - DNA, 22 bp, Homo sapiens
tttacacagaggacactgggct

SEQ ID NO: 8382154 - DNA, 22 bp, Homo sapiens
tttacacaaaagatagcacacc

SEQ ID NO: 8382155 - DNA, 22 bp, Homo sapiens
tttacacaaaagatagcacacc

SEQ ID NO: 8382156 - DNA, 22 bp, Homo sapiens
tttacacaaaatgttagtagat

SEQ ID NO: 8382157 - DNA, 22 bp, Homo sapiens
tttacacaaaatgttagtagat

SEQ ID NO: 8382158 - DNA, 22 bp, Homo sapiens
tttacaattggttttctctaat

SEQ ID NO: 8382159 - DNA, 22 bp, Homo sapiens
tttacaattctctaccagtgtt

SEQ ID NO: 8382160 - DNA, 22 bp, Homo sapiens
ctcctgggcttcgaaggctccc

SEQ ID NO: 8382161 - DNA, 22 bp, Homo sapiens
tttatatgtttgtacaattaag

SEQ ID NO: 8382162 - DNA, 22 bp, Homo sapiens
ctcctgtgattcatttaacata

SEQ ID NO: 8382163 - DNA, 22 bp, Homo sapiens
ctcctgtgcacctccagcggca

SEQ ID NO: 8382164 - DNA, 22 bp, Homo sapiens
ctcctgtcccggggaccgccga

SEQ ID NO: 8382165 - DNA, 22 bp, Homo sapiens
ctcctgtggtactcccagggcc

SEQ ID NO: 8382166 - DNA, 22 bp, Homo sapiens
tttcaaagtcaagaaggatact

SEQ ID NO: 8382167 - DNA, 22 bp, Homo sapiens
tttcaaatgcatgtctttcctc

SEQ ID NO: 8382168 - DNA, 22 bp, Homo sapiens
tttcaaataccataaacctaat

SEQ ID NO: 8382169 - DNA, 22 bp, Homo sapiens
tttcaaagtcaatatcattacc

SEQ ID NO: 8382170 - DNA, 22 bp, Homo sapiens
tttcaaagtcaatatcattacc

SEQ ID NO: 8382171 - DNA, 22 bp, Homo sapiens
ctccttcctggttagcacctta

SEQ ID NO: 8382172 - DNA, 21 bp, Homo sapiens
ctctacattcccagcaactct

SEQ ID NO: 8382173 - DNA, 22 bp, Homo sapiens
ctctaaaggcttgttattgcat

SEQ ID NO: 8382174 - DNA, 22 bp, Homo sapiens
ctctaaatccaaataagtgtcc

SEQ ID NO: 8382175 - DNA, 22 bp, Homo sapiens
ctctaaaggcttgttattgcat

SEQ ID NO: 8382176 - DNA, 22 bp, Homo sapiens
ctcctcaggaagtagcatgtgt

SEQ ID NO: 8382177 - DNA, 22 bp, Homo sapiens
ctcctcagtcaggtctagggtc

SEQ ID NO: 8382178 - DNA, 19 bp, Homo sapiens
ctcctcagtcccagaggtc

SEQ ID NO: 8382179 - DNA, 22 bp, Homo sapiens
ctcctcagctgggaggagtccc

SEQ ID NO: 8382180 - DNA, 22 bp, Homo sapiens
ctcctcagctgggaggagtccc

SEQ ID NO: 8382181 - DNA, 22 bp, Homo sapiens
ctcccttcaggagaggctcaca

SEQ ID NO: 8382182 - DNA, 22 bp, Homo sapiens
ctccctggtgtcccctccagga

SEQ ID NO: 8382183 - DNA, 22 bp, Homo sapiens
ctccctggtctttcccatcatt

SEQ ID NO: 8382184 - DNA, 22 bp, Homo sapiens
ctccctggtctttcccatcatt

SEQ ID NO: 8382185 - DNA, 22 bp, Homo sapiens
ctccctggcacagcgagaggtt

SEQ ID NO: 8382186 - DNA, 22 bp, Homo sapiens
ctccctggcagccgcactcctg

SEQ ID NO: 8382187 - DNA, 23 bp, Homo sapiens
ctccctggcccttgggagacctg

SEQ ID NO: 8382188 - DNA, 22 bp, Homo sapiens
ctccctgcttgtttcccttcag

SEQ ID NO: 8382189 - DNA, 22 bp, Homo sapiens
ctccctggaggcccagacctgg

SEQ ID NO: 8382190 - DNA, 22 bp, Homo sapiens
ctccccagcattctgacttcct

SEQ ID NO: 8382191 - DNA, 18 bp, Homo sapiens
ctccccagctgcccccag

SEQ ID NO: 8382192 - DNA, 23 bp, Homo sapiens
ttgtttaccgtaggacttttaac

SEQ ID NO: 8382193 - DNA, 22 bp, Homo sapiens
ttgtttatggattgtagaaact

SEQ ID NO: 8382194 - DNA, 22 bp, Homo sapiens
ttgtttcaaggaagaattagga

SEQ ID NO: 8382195 - DNA, 22 bp, Homo sapiens
ttgtttcagctgtatgctatgt

SEQ ID NO: 8382196 - DNA, 22 bp, Homo sapiens
ctcccatgctctctctgagaag

SEQ ID NO: 8382197 - DNA, 22 bp, Homo sapiens
ctccccacacactaggcctgat

SEQ ID NO: 8382198 - DNA, 22 bp, Homo sapiens
ctcccagggccatcgagtcact

SEQ ID NO: 8382199 - DNA, 22 bp, Homo sapiens
ctccccacatttctccctgtct

SEQ ID NO: 8382200 - DNA, 22 bp, Homo sapiens
ctccccaccttcgcggtccctg

SEQ ID NO: 8382201 - DNA, 22 bp, Homo sapiens
ctcaggctggtccttagtgaca

SEQ ID NO: 8382202 - DNA, 21 bp, Homo sapiens
ctcaggctggcagcaggctag

SEQ ID NO: 8382203 - DNA, 22 bp, Homo sapiens
ctcaggctctggccatccaagg

SEQ ID NO: 8382204 - DNA, 22 bp, Homo sapiens
gaagcatactttctatactgct

SEQ ID NO: 8382205 - DNA, 22 bp, Homo sapiens
gaagcagtcagcagcacctttg

SEQ ID NO: 8382206 - DNA, 20 bp, Homo sapiens
gaagcagcttcatgtagaca

SEQ ID NO: 8382207 - DNA, 22 bp, Homo sapiens
gaagcagccacggggagacaga

SEQ ID NO: 8382208 - DNA, 22 bp, Homo sapiens
gaagcagctaggatcttcattt

SEQ ID NO: 8382209 - DNA, 22 bp, Homo sapiens
gaagcaagtggcctgattcaga

SEQ ID NO: 8382210 - DNA, 22 bp, Homo sapiens
gaaaggagagggttaaggagct

SEQ ID NO: 8382211 - DNA, 22 bp, Homo sapiens
gaaaggagggaaacagagcggt

SEQ ID NO: 8382212 - DNA, 22 bp, Homo sapiens
gaaaggagggaaacagagcggt

SEQ ID NO: 8382213 - DNA, 17 bp, Homo sapiens
gaaaggaggcaacactg

SEQ ID NO: 8382214 - DNA, 17 bp, Homo sapiens
gaaaggaggcaacactg

SEQ ID NO: 8382215 - DNA, 22 bp, Homo sapiens
gaaaggagtgctttccaggtct

SEQ ID NO: 8382216 - DNA, 22 bp, Homo sapiens
gaaaggaagaaaggtcatttta

SEQ ID NO: 8382217 - DNA, 22 bp, Homo sapiens
gaaaggaacttgtgagtgggag

SEQ ID NO: 8382218 - DNA, 22 bp, Homo sapiens
gaaaggaaattgagggacgcat

SEQ ID NO: 8382219 - DNA, 22 bp, Homo sapiens
gaaaggaaatattctaagcact

SEQ ID NO: 8382220 - DNA, 22 bp, Homo sapiens
gaaaggaaatattctaagcact

SEQ ID NO: 8382221 - DNA, 22 bp, Homo sapiens
gaaagcttccattttgtacatt

SEQ ID NO: 8382222 - DNA, 22 bp, Homo sapiens
gaaagcttccattttgtacatt

SEQ ID NO: 8382223 - DNA, 22 bp, Homo sapiens
gaaagcttccattttgtacatt

SEQ ID NO: 8382224 - DNA, 22 bp, Homo sapiens
gaaaggaaatattctaagcact

SEQ ID NO: 8382225 - DNA, 22 bp, Homo sapiens
gaaagctgtgaaatagtgctct

SEQ ID NO: 8382226 - DNA, 22 bp, Homo sapiens
gaaagctgtgaaatagtgctct

SEQ ID NO: 8382227 - DNA, 22 bp, Homo sapiens
gaaagctgggaaataaatatta

SEQ ID NO: 8382228 - DNA, 22 bp, Homo sapiens
gaagccacgttaaattggctgt

SEQ ID NO: 8382229 - DNA, 22 bp, Homo sapiens
gaagccacagagattgtggggg

SEQ ID NO: 8382230 - DNA, 22 bp, Homo sapiens
gaaggagctaccaagactgaat

SEQ ID NO: 8382231 - DNA, 22 bp, Homo sapiens
gaaggagctaccaagactgaat

SEQ ID NO: 8382232 - DNA, 22 bp, Homo sapiens
gaaggagccgagctcttcccca

SEQ ID NO: 8382233 - DNA, 20 bp, Homo sapiens
gaagccagaggggaaaggag

SEQ ID NO: 8382234 - DNA, 22 bp, Homo sapiens
gaaggcagggaatgtggtgcta

SEQ ID NO: 8382235 - DNA, 22 bp, Homo sapiens
gaaggcaggcttctgattaggt

SEQ ID NO: 8382236 - DNA, 22 bp, Homo sapiens
gaaggcagggaatgtggtgcta

SEQ ID NO: 8382237 - DNA, 22 bp, Homo sapiens
gaaggcaggtttttcaaaactg

SEQ ID NO: 8382238 - DNA, 22 bp, Homo sapiens
gaaggccatttttaggtagaat

SEQ ID NO: 8382239 - DNA, 22 bp, Homo sapiens
gaagggaatttggagggtttca

SEQ ID NO: 8382240 - DNA, 22 bp, Homo sapiens
gaagggagaaggttgggtgacg

SEQ ID NO: 8382241 - DNA, 22 bp, Homo sapiens
gaaggcattctattctacatat

SEQ ID NO: 8382242 - DNA, 22 bp, Homo sapiens
gaaggcatttcagagatctctg

SEQ ID NO: 8382243 - DNA, 22 bp, Homo sapiens
gaaggcattttatgccttatag

SEQ ID NO: 8382244 - DNA, 22 bp, Homo sapiens
gaaggcatctctggacttattt

SEQ ID NO: 8382245 - DNA, 22 bp, Homo sapiens
gaaggcataaaaccaattttgt

SEQ ID NO: 8382246 - DNA, 22 bp, Homo sapiens
gaaggcagtaaatggctgtttt

SEQ ID NO: 8382247 - DNA, 22 bp, Homo sapiens
gaatatttgtaattactgttga

SEQ ID NO: 8382248 - DNA, 22 bp, Homo sapiens
gaatatttgtaattactgttga

SEQ ID NO: 8382249 - DNA, 22 bp, Homo sapiens
gaatattttcagtacagatggt

SEQ ID NO: 8382250 - DNA, 22 bp, Homo sapiens
gaatcatttatttttgacagca

SEQ ID NO: 8382251 - DNA, 17 bp, Homo sapiens
gaatccttctctgttct

SEQ ID NO: 8382252 - DNA, 22 bp, Homo sapiens
gaatccttggttttaagcaata

SEQ ID NO: 8382253 - DNA, 22 bp, Homo sapiens
gaatcttaaatcggaatcttaa

SEQ ID NO: 8382254 - DNA, 22 bp, Homo sapiens
gaatcttacctctctattgttg

SEQ ID NO: 8382255 - DNA, 20 bp, Homo sapiens
gaatcttactacattctctc

SEQ ID NO: 8382256 - DNA, 22 bp, Homo sapiens
gaatcttatttttaaatcttcc

SEQ ID NO: 8382257 - DNA, 22 bp, Homo sapiens
gaagggtgtgtgtgagggacac

SEQ ID NO: 8382258 - DNA, 22 bp, Homo sapiens
gaagggtgcatggagggaagtc

SEQ ID NO: 8382259 - DNA, 22 bp, Homo sapiens
gaaggggactggcagctgcaga

SEQ ID NO: 8382260 - DNA, 22 bp, Homo sapiens
gacagacaggagctcacaggca

SEQ ID NO: 8382261 - DNA, 22 bp, Homo sapiens
gacagacactgtgtcctcactt

SEQ ID NO: 8382262 - DNA, 22 bp, Homo sapiens
gacagacactgtgtcctcactt

SEQ ID NO: 8382263 - DNA, 22 bp, Homo sapiens
gacagacactgtgtcctcactt

SEQ ID NO: 8382264 - DNA, 22 bp, Homo sapiens
gacagacaggaggcattcaggg

SEQ ID NO: 8382265 - DNA, 22 bp, Homo sapiens
gacagacaggggttctcctgga

SEQ ID NO: 8382266 - DNA, 22 bp, Homo sapiens
gacagacaggtgtggtaggcac

SEQ ID NO: 8382267 - DNA, 22 bp, Homo sapiens
gacagacaggtgtggtaggcac

SEQ ID NO: 8382268 - DNA, 22 bp, Homo sapiens
gacagacacaattgatccatga

SEQ ID NO: 8382269 - DNA, 22 bp, Homo sapiens
gacagacaaatgtttttaactt

SEQ ID NO: 8382270 - DNA, 22 bp, Homo sapiens
gacagacacaattgatccatga

SEQ ID NO: 8382271 - DNA, 22 bp, Homo sapiens
gacagacacctggggggttgct

SEQ ID NO: 8382272 - DNA, 22 bp, Homo sapiens
gacagacactattggtatgcct

SEQ ID NO: 8382273 - DNA, 22 bp, Homo sapiens
gacagacacagggccatgattg

SEQ ID NO: 8382274 - DNA, 22 bp, Homo sapiens
gacagacacagggccatgattg

SEQ ID NO: 8382275 - DNA, 22 bp, Homo sapiens
gacagaaggcatctagggcacg

SEQ ID NO: 8382276 - DNA, 22 bp, Homo sapiens
gacagaaggcatctagggcacg

SEQ ID NO: 8382277 - DNA, 22 bp, Homo sapiens
gacactgtcccacagaattcga

SEQ ID NO: 8382278 - DNA, 22 bp, Homo sapiens
gacatttactgaatactgatta

SEQ ID NO: 8382279 - DNA, 22 bp, Homo sapiens
gacatttaaattgcaggcagcc

SEQ ID NO: 8382280 - DNA, 22 bp, Homo sapiens
gacagcagatgaagcctgcaga

SEQ ID NO: 8382281 - DNA, 22 bp, Homo sapiens
gacagcagcatgtttacaggcc

SEQ ID NO: 8382282 - DNA, 22 bp, Homo sapiens
gacagcagatgaagcctgcaga

SEQ ID NO: 8382283 - DNA, 22 bp, Homo sapiens
gacagcagatgaagcctgcaga

SEQ ID NO: 8382284 - DNA, 22 bp, Homo sapiens
gacagcagataagacctcatca

SEQ ID NO: 8382285 - DNA, 22 bp, Homo sapiens
gacagcagatactttcattgaa

SEQ ID NO: 8382286 - DNA, 22 bp, Homo sapiens
gacagacatttcctgatccaat

SEQ ID NO: 8382287 - DNA, 22 bp, Homo sapiens
gacagacatgggacttcatact

SEQ ID NO: 8382288 - DNA, 22 bp, Homo sapiens
gacagagaggctgagcagtaca

SEQ ID NO: 8382289 - DNA, 22 bp, Homo sapiens
gacagagaggctgagcagtaca

SEQ ID NO: 8382290 - DNA, 22 bp, Homo sapiens
gacagagattgaatcaggaaat

SEQ ID NO: 8382291 - DNA, 22 bp, Homo sapiens
gacagagattgaatcaggaaat

SEQ ID NO: 8382292 - DNA, 22 bp, Homo sapiens
gacagagctgctctagattctg

SEQ ID NO: 8382293 - DNA, 22 bp, Homo sapiens
gacagaggagaagatgctgtgg

SEQ ID NO: 8382294 - DNA, 22 bp, Homo sapiens
gacagcagacagaactacctgc

SEQ ID NO: 8382295 - DNA, 22 bp, Homo sapiens
gacagcagacagcctggcccct

SEQ ID NO: 8382296 - DNA, 22 bp, Homo sapiens
gacagcagacagcctggcccct

SEQ ID NO: 8382297 - DNA, 22 bp, Homo sapiens
gacagcagagcagactaatgga

SEQ ID NO: 8382298 - DNA, 22 bp, Homo sapiens
gacagcaatgacggggcagctg

SEQ ID NO: 8382299 - DNA, 22 bp, Homo sapiens
gacagcagaatccattcccagt

SEQ ID NO: 8382300 - DNA, 22 bp, Homo sapiens
gacagcagacaaaccatgtttt

SEQ ID NO: 8382301 - DNA, 22 bp, Homo sapiens
gactctgggcctttggtgactc

SEQ ID NO: 8382302 - DNA, 22 bp, Homo sapiens
gactctggcctcatccctgagg

SEQ ID NO: 8382303 - DNA, 22 bp, Homo sapiens
gactctcaagcacaagtccacc

SEQ ID NO: 8382304 - DNA, 22 bp, Homo sapiens
gactgagggacagggcagtgga

SEQ ID NO: 8382305 - DNA, 22 bp, Homo sapiens
gactgagaatcatagaaggcaa

SEQ ID NO: 8382306 - DNA, 22 bp, Homo sapiens
gacatttagctgttttgcattt

SEQ ID NO: 8382307 - DNA, 22 bp, Homo sapiens
gacatttagaagttagattcaa

SEQ ID NO: 8382308 - DNA, 22 bp, Homo sapiens
gaccagagaaaggcactggaag

SEQ ID NO: 8382309 - DNA, 22 bp, Homo sapiens
gaccagctctctgaagaaagag

SEQ ID NO: 8382310 - DNA, 22 bp, Homo sapiens
gaccaggctagttcagagcttc

SEQ ID NO: 8382311 - DNA, 22 bp, Homo sapiens
gagacccaggggtctgctgccc

SEQ ID NO: 8382312 - DNA, 22 bp, Homo sapiens
gagacgtggcctttgcctgagc

SEQ ID NO: 8382313 - DNA, 22 bp, Homo sapiens
gagactgatggggctcccagaa

SEQ ID NO: 8382314 - DNA, 22 bp, Homo sapiens
gagagaaaagggggaattgatt

SEQ ID NO: 8382315 - DNA, 22 bp, Homo sapiens
gagagaaagcccctgcatccct

SEQ ID NO: 8382316 - DNA, 22 bp, Homo sapiens
gagagaaagcccctgcatccct

SEQ ID NO: 8382317 - DNA, 22 bp, Homo sapiens
gagagaaaggataacagctcaa

SEQ ID NO: 8382318 - DNA, 22 bp, Homo sapiens
gagagaaaggataacagctcaa

SEQ ID NO: 8382319 - DNA, 22 bp, Homo sapiens
gagagaaaaatgagcttcattg

SEQ ID NO: 8382320 - DNA, 22 bp, Homo sapiens
gagagaaaaatgagcttcattg

SEQ ID NO: 8382321 - DNA, 22 bp, Homo sapiens
gagagaaaacaagttctccatt

SEQ ID NO: 8382322 - DNA, 22 bp, Homo sapiens
gagagaagaaagccatggtcct

SEQ ID NO: 8382323 - DNA, 18 bp, Homo sapiens
gagagggatccctcagga

SEQ ID NO: 8382324 - DNA, 22 bp, Homo sapiens
gagagaaatgtgcagtttgggc

SEQ ID NO: 8382325 - DNA, 22 bp, Homo sapiens
gagagaaaggcttgcaggctgt

SEQ ID NO: 8382326 - DNA, 22 bp, Homo sapiens
gagagaaaggcttgcaggctgt

SEQ ID NO: 8382327 - DNA, 22 bp, Homo sapiens
gagagaaattagttggtttgct

SEQ ID NO: 8382328 - DNA, 22 bp, Homo sapiens
gagagaaatgtgcagtttgggc

SEQ ID NO: 8382329 - DNA, 21 bp, Homo sapiens
gagagggcattataggaagtg

SEQ ID NO: 8382330 - DNA, 22 bp, Homo sapiens
gagagggcaaggtagatgctac

SEQ ID NO: 8382331 - DNA, 22 bp, Homo sapiens
gagagggccgggggccagctcc

SEQ ID NO: 8382332 - DNA, 19 bp, Homo sapiens
gagaaagcaggcacagcac

SEQ ID NO: 8382333 - DNA, 22 bp, Homo sapiens
gagaaagatgtaggctgggagg

SEQ ID NO: 8382334 - DNA, 22 bp, Homo sapiens
gagaaagatggaatcttacagg

SEQ ID NO: 8382335 - DNA, 22 bp, Homo sapiens
gagaaagattgtccttcagggg

SEQ ID NO: 8382336 - DNA, 20 bp, Homo sapiens
gagacagcaaaagcctctcc

SEQ ID NO: 8382337 - DNA, 19 bp, Homo sapiens
gagacatgtagatagaaga

SEQ ID NO: 8382338 - DNA, 22 bp, Homo sapiens
gagaaaggcattcctatgcaaa

SEQ ID NO: 8382339 - DNA, 22 bp, Homo sapiens
gagaaaggcattcctatgcaaa

SEQ ID NO: 8382340 - DNA, 22 bp, Homo sapiens
gagaaaggcattcctatgcaaa

SEQ ID NO: 8382341 - DNA, 22 bp, Homo sapiens
gagaaaggcatccttggcttca

SEQ ID NO: 8382342 - DNA, 22 bp, Homo sapiens
gagacagatgctgctggagcat

SEQ ID NO: 8382343 - DNA, 22 bp, Homo sapiens
gagaaactgaatatttaacggg

SEQ ID NO: 8382344 - DNA, 22 bp, Homo sapiens
gagaaactgaaacatagggcca

SEQ ID NO: 8382345 - DNA, 22 bp, Homo sapiens
gagaaacttggagttattctgg

SEQ ID NO: 8382346 - DNA, 22 bp, Homo sapiens
gagaaagaaagggaagtttgtt

SEQ ID NO: 8382347 - DNA, 22 bp, Homo sapiens
gagaaagacgtaggctgggagg

SEQ ID NO: 8382348 - DNA, 22 bp, Homo sapiens
gagaaacactgttagtttatta

SEQ ID NO: 8382349 - DNA, 22 bp, Homo sapiens
gagaaacactgttagtttatta

SEQ ID NO: 8382350 - DNA, 22 bp, Homo sapiens
gagaaaccgattctgcatgtca

SEQ ID NO: 8382351 - DNA, 18 bp, Homo sapiens
gagggagtagctgaggtt

SEQ ID NO: 8382352 - DNA, 22 bp, Homo sapiens
gaggggctgccctggtgtcagg

SEQ ID NO: 8382353 - DNA, 22 bp, Homo sapiens
gaggggctggcacgatggctgc

SEQ ID NO: 8382354 - DNA, 22 bp, Homo sapiens
gagggaggggagctccaccctc

SEQ ID NO: 8382355 - DNA, 22 bp, Homo sapiens
gagggagggactagcattctct

SEQ ID NO: 8382356 - DNA, 22 bp, Homo sapiens
gagggagagtgatggaccattg

SEQ ID NO: 8382357 - DNA, 22 bp, Homo sapiens
gagggagagtgatggaccattg

SEQ ID NO: 8382358 - DNA, 22 bp, Homo sapiens
gaggctgaggttgcagtgagcc

SEQ ID NO: 8382359 - DNA, 22 bp, Homo sapiens
gaggctgaggttgcagtgagcc

SEQ ID NO: 8382360 - DNA, 22 bp, Homo sapiens
gaggctgaggttgcagtgagct

SEQ ID NO: 8382361 - DNA, 22 bp, Homo sapiens
gaggctgaggttgcagtgagct

SEQ ID NO: 8382362 - DNA, 22 bp, Homo sapiens
gaggctgaggcggatggatcac

SEQ ID NO: 8382363 - DNA, 22 bp, Homo sapiens
gaggctgagggttagagagtca

SEQ ID NO: 8382364 - DNA, 22 bp, Homo sapiens
gaggctgagggttagagagtca

SEQ ID NO: 8382365 - DNA, 22 bp, Homo sapiens
gaggctgaggcaggaggatcac

SEQ ID NO: 8382366 - DNA, 22 bp, Homo sapiens
gaggctgaggcaggaggatcac

SEQ ID NO: 8382367 - DNA, 22 bp, Homo sapiens
gaggctgcactggctaaaggct

SEQ ID NO: 8382368 - DNA, 22 bp, Homo sapiens
gaggctgcccaactggagtgga

SEQ ID NO: 8382369 - DNA, 22 bp, Homo sapiens
gaggcagcttagggtactgact

SEQ ID NO: 8382370 - DNA, 22 bp, Homo sapiens
gaggcaggaggattgcttgagc

SEQ ID NO: 8382371 - DNA, 22 bp, Homo sapiens
gaggcagcttggggctgtgggt

SEQ ID NO: 8382372 - DNA, 22 bp, Homo sapiens
gaggcagcttggggctgtgggt

SEQ ID NO: 8382373 - DNA, 22 bp, Homo sapiens
gaggcaggcagattgcttgagg

SEQ ID NO: 8382374 - DNA, 22 bp, Homo sapiens
gaggcaggcagattgcttgagg

SEQ ID NO: 8382375 - DNA, 22 bp, Homo sapiens
gaggcaggccctgaatgagtca

SEQ ID NO: 8382376 - DNA, 22 bp, Homo sapiens
gaggcaggaggattgcttgagc

SEQ ID NO: 8382377 - DNA, 22 bp, Homo sapiens
gaggagagatggtagattgggt

SEQ ID NO: 8382378 - DNA, 22 bp, Homo sapiens
gaggagagatggtagattgggt

SEQ ID NO: 8382379 - DNA, 22 bp, Homo sapiens
gaggagagatggtagattgggt

SEQ ID NO: 8382380 - DNA, 22 bp, Homo sapiens
gaggagaggccatcgttgttat

SEQ ID NO: 8382381 - DNA, 22 bp, Homo sapiens
gaggagagcctgcactttgacc

SEQ ID NO: 8382382 - DNA, 22 bp, Homo sapiens
gaggagagcctgcactttgacc

SEQ ID NO: 8382383 - DNA, 22 bp, Homo sapiens
gaggagagggctgcgggcccac

SEQ ID NO: 8382384 - DNA, 22 bp, Homo sapiens
gaggagagggctgcgggcccac

SEQ ID NO: 8382385 - DNA, 22 bp, Homo sapiens
gaggagaggggctcccaagagc

SEQ ID NO: 8382386 - DNA, 22 bp, Homo sapiens
gaggagaggggctcccaagagc

SEQ ID NO: 8382387 - DNA, 22 bp, Homo sapiens
gaggagaggctggacgcggtga

SEQ ID NO: 8382388 - DNA, 22 bp, Homo sapiens
gaggagaggctggacgcggtga

SEQ ID NO: 8382389 - DNA, 22 bp, Homo sapiens
gaggagaggctggacgcggtga

SEQ ID NO: 8382390 - DNA, 22 bp, Homo sapiens
gaggagcatgggaaggctctgg

SEQ ID NO: 8382391 - DNA, 22 bp, Homo sapiens
gaggagcatgggaaggctctgg

SEQ ID NO: 8382392 - DNA, 22 bp, Homo sapiens
gaggagccaaggtatgtgtgtt

SEQ ID NO: 8382393 - DNA, 22 bp, Homo sapiens
gaggagcacatgaggctgaggg

SEQ ID NO: 8382394 - DNA, 22 bp, Homo sapiens
gaggagcacatgaggctgaggg

SEQ ID NO: 8382395 - DNA, 22 bp, Homo sapiens
gaggagaggggctcccaagagc

SEQ ID NO: 8382396 - DNA, 22 bp, Homo sapiens
gaggagaggggctcccaagagc

SEQ ID NO: 8382397 - DNA, 19 bp, Homo sapiens
gaggcagtagtcaaagctt

SEQ ID NO: 8382398 - DNA, 22 bp, Homo sapiens
gaggcagtatagtcattaagta

SEQ ID NO: 8382399 - DNA, 22 bp, Homo sapiens
gaggctgaagtgtacatgggtg

SEQ ID NO: 8382400 - DNA, 22 bp, Homo sapiens
gaggctgaatggccagaagcca

SEQ ID NO: 8382401 - DNA, 22 bp, Homo sapiens
gaggctgagagtttgttctact

SEQ ID NO: 8382402 - DNA, 22 bp, Homo sapiens
gaggctgagagtttgttctact

SEQ ID NO: 8382403 - DNA, 22 bp, Homo sapiens
gaggctcattgcattgtgcatt

SEQ ID NO: 8382404 - DNA, 22 bp, Homo sapiens
gagccctgtaggaatctctcaa

SEQ ID NO: 8382405 - DNA, 22 bp, Homo sapiens
gagccctgtgaggaaagagggt

SEQ ID NO: 8382406 - DNA, 22 bp, Homo sapiens
gagccctgtgattctgttgtgt

SEQ ID NO: 8382407 - DNA, 22 bp, Homo sapiens
gagctgagatcatgtacactag

SEQ ID NO: 8382408 - DNA, 22 bp, Homo sapiens
gagccctgttcaggcctcctca

SEQ ID NO: 8382409 - DNA, 18 bp, Homo sapiens
gagccctgggagatctct

SEQ ID NO: 8382410 - DNA, 22 bp, Homo sapiens
gagccctgtagcaagtcatgtc

SEQ ID NO: 8382411 - DNA, 22 bp, Homo sapiens
gagccctgcgtgtctgggggca

SEQ ID NO: 8382412 - DNA, 22 bp, Homo sapiens
gagccctgcgtgtctgggggca

SEQ ID NO: 8382413 - DNA, 22 bp, Homo sapiens
gagccctgctgggccttgtctc

SEQ ID NO: 8382414 - DNA, 22 bp, Homo sapiens
gagccctgcttccaagggggca

SEQ ID NO: 8382415 - DNA, 22 bp, Homo sapiens
gagccctggcagtctgggatgg

SEQ ID NO: 8382416 - DNA, 22 bp, Homo sapiens
gagccctggcagtctgggatgg

SEQ ID NO: 8382417 - DNA, 22 bp, Homo sapiens
gagccctgatttgcagcatttg

SEQ ID NO: 8382418 - DNA, 22 bp, Homo sapiens
gagccctgcccacttgtctgag

SEQ ID NO: 8382419 - DNA, 22 bp, Homo sapiens
gagccctgcggagccccgaggc

SEQ ID NO: 8382420 - DNA, 18 bp, Homo sapiens
gagccctgagtctgcaca

SEQ ID NO: 8382421 - DNA, 22 bp, Homo sapiens
gagctgagggtctaggagggtt

SEQ ID NO: 8382422 - DNA, 22 bp, Homo sapiens
gagctgagcagggagcctcact

SEQ ID NO: 8382423 - DNA, 22 bp, Homo sapiens
gaggaaatcattccagaaaagg

SEQ ID NO: 8382424 - DNA, 22 bp, Homo sapiens
gaggaaatcattccagaaaagg

SEQ ID NO: 8382425 - DNA, 22 bp, Homo sapiens
gaggaaatcttaggccccaacc

SEQ ID NO: 8382426 - DNA, 23 bp, Homo sapiens
gaggaaagaatatagatgcaatc

SEQ ID NO: 8382427 - DNA, 22 bp, Homo sapiens
gaggaaagagtcaaatctgaag

SEQ ID NO: 8382428 - DNA, 22 bp, Homo sapiens
gaggaaagaaccccagtcaata

SEQ ID NO: 8382429 - DNA, 22 bp, Homo sapiens
gaggaaagaaccccagtcaata

SEQ ID NO: 8382430 - DNA, 22 bp, Homo sapiens
gaggaaagaaccccagtcaata

SEQ ID NO: 8382431 - DNA, 22 bp, Homo sapiens
gaggaaaatgggacaggctgta

SEQ ID NO: 8382432 - DNA, 22 bp, Homo sapiens
gaggaaaatgggacaggctgta

SEQ ID NO: 8382433 - DNA, 22 bp, Homo sapiens
gagctgctggttgctggtgcct

SEQ ID NO: 8382434 - DNA, 22 bp, Homo sapiens
gagctgcctgttgcatagcaac

SEQ ID NO: 8382435 - DNA, 22 bp, Homo sapiens
gaggaaccactctgagaagcca

SEQ ID NO: 8382436 - DNA, 22 bp, Homo sapiens
gaggaaccaaatcagcttgcac

SEQ ID NO: 8382437 - DNA, 22 bp, Homo sapiens
gaggaacagcagccacatgtcc

SEQ ID NO: 8382438 - DNA, 22 bp, Homo sapiens
gaggaacagagggcaaggccag

SEQ ID NO: 8382439 - DNA, 22 bp, Homo sapiens
gaggaacaagctgctttatctt

SEQ ID NO: 8382440 - DNA, 21 bp, Homo sapiens
gaggaaatgctctggtgttca

SEQ ID NO: 8382441 - DNA, 22 bp, Homo sapiens
gaggaaatggttgttcaggtgg

SEQ ID NO: 8382442 - DNA, 22 bp, Homo sapiens
gaggaagaagcaaaccagctaa

SEQ ID NO: 8382443 - DNA, 22 bp, Homo sapiens
gaggaagaagcaaaccagctaa

SEQ ID NO: 8382444 - DNA, 22 bp, Homo sapiens
gaggaagaatcagggtggtgag

SEQ ID NO: 8382445 - DNA, 22 bp, Homo sapiens
gaggagagagggactgtctgca

SEQ ID NO: 8382446 - DNA, 22 bp, Homo sapiens
gaggagagagggactgtctgca

SEQ ID NO: 8382447 - DNA, 22 bp, Homo sapiens
gagccctgacactgagggagtt

SEQ ID NO: 8382448 - DNA, 22 bp, Homo sapiens
gagccctgacactgagggagtt

SEQ ID NO: 8382449 - DNA, 22 bp, Homo sapiens
gagccctgagagttgtgaggcc

SEQ ID NO: 8382450 - DNA, 22 bp, Homo sapiens
gagccctgaacaacagcaggaa

SEQ ID NO: 8382451 - DNA, 22 bp, Homo sapiens
gagccctgaacaacagcaggaa

SEQ ID NO: 8382452 - DNA, 22 bp, Homo sapiens
gagcccaggttctgcttccagc

SEQ ID NO: 8382453 - DNA, 22 bp, Homo sapiens
gagcccaggttctgcttccagc

SEQ ID NO: 8382454 - DNA, 22 bp, Homo sapiens
gagcccagggtgaaatagcagc

SEQ ID NO: 8382455 - DNA, 22 bp, Homo sapiens
gagcccagggcaggcaaggcag

SEQ ID NO: 8382456 - DNA, 22 bp, Homo sapiens
gagcccagcttgcacatggagc

SEQ ID NO: 8382457 - DNA, 22 bp, Homo sapiens
gagcccagctgtccttggcaaa

SEQ ID NO: 8382458 - DNA, 22 bp, Homo sapiens
gagcccaggaagtggaggctga

SEQ ID NO: 8382459 - DNA, 22 bp, Homo sapiens
gagcccagctctacctcagact

SEQ ID NO: 8382460 - DNA, 22 bp, Homo sapiens
gagcccagctctacctcagact

SEQ ID NO: 8382461 - DNA, 22 bp, Homo sapiens
gagcccagctgcggccctcagc

SEQ ID NO: 8382462 - DNA, 22 bp, Homo sapiens
gagcccagctgcggccctcagc

SEQ ID NO: 8382463 - DNA, 20 bp, Homo sapiens
gagcccaagtagggagaaat

SEQ ID NO: 8382464 - DNA, 22 bp, Homo sapiens
gagcaggcttgcagagaagggg

SEQ ID NO: 8382465 - DNA, 22 bp, Homo sapiens
gagaggggtttgccatcctatg

SEQ ID NO: 8382466 - DNA, 22 bp, Homo sapiens
gagaggggcccaagccacatag

SEQ ID NO: 8382467 - DNA, 22 bp, Homo sapiens
gagagggctgcctggtgtgagg

SEQ ID NO: 8382468 - DNA, 22 bp, Homo sapiens
gagaggggacctgtgtgtctag

SEQ ID NO: 8382469 - DNA, 18 bp, Homo sapiens
gagcatgggcagtgggga

SEQ ID NO: 8382470 - DNA, 19 bp, Homo sapiens
gagcatgactggccttgca

SEQ ID NO: 8382471 - DNA, 22 bp, Homo sapiens
gagcagttttatttcatgagac

SEQ ID NO: 8382472 - DNA, 22 bp, Homo sapiens
gagcagttgggctctaggaagt

SEQ ID NO: 8382473 - DNA, 22 bp, Homo sapiens
gagcagttctccttggtagggg

SEQ ID NO: 8382474 - DNA, 22 bp, Homo sapiens
gagcagttatttttagacatga

SEQ ID NO: 8382475 - DNA, 22 bp, Homo sapiens
gagcagtggtggtgtgttagag

SEQ ID NO: 8382476 - DNA, 22 bp, Homo sapiens
gagcagtggtcacagggaggga

SEQ ID NO: 8382477 - DNA, 22 bp, Homo sapiens
ctttgattccaggcacatgttt

SEQ ID NO: 8382478 - DNA, 22 bp, Homo sapiens
ctttgcaagggatttcatgtct

SEQ ID NO: 8382479 - DNA, 22 bp, Homo sapiens
cttttccactgagcctcacaaa

SEQ ID NO: 8382480 - DNA, 22 bp, Homo sapiens
cttttccaaagtccatctggtc

SEQ ID NO: 8382481 - DNA, 22 bp, Homo sapiens
cttttcattgtttgtacatgca

SEQ ID NO: 8382482 - DNA, 21 bp, Homo sapiens
cttttacattcagtcatgatg

SEQ ID NO: 8382483 - DNA, 22 bp, Homo sapiens
cttttacagtggacctgccatt

SEQ ID NO: 8382484 - DNA, 22 bp, Homo sapiens
cttttcttgtattggatgcccc

SEQ ID NO: 8382485 - DNA, 22 bp, Homo sapiens
cttttcttactcccgcaaggca

SEQ ID NO: 8382486 - DNA, 21 bp, Homo sapiens
cttttctagtcccagccccgc

SEQ ID NO: 8382487 - DNA, 21 bp, Homo sapiens
cttttctctccgcaggacatt

SEQ ID NO: 8382488 - DNA, 22 bp, Homo sapiens
cttttctactaatgagtagcta

SEQ ID NO: 8382489 - DNA, 22 bp, Homo sapiens
cttttcctcaggaggagacgcg

SEQ ID NO: 8382490 - DNA, 21 bp, Homo sapiens
cttttctagtcccagccccgc

SEQ ID NO: 8382491 - DNA, 22 bp, Homo sapiens
cttttcctattgattctgttac

SEQ ID NO: 8382492 - DNA, 22 bp, Homo sapiens
cttttctcttacattccactgg

SEQ ID NO: 8382493 - DNA, 22 bp, Homo sapiens
gaaaatgtttcctgttatttgc

SEQ ID NO: 8382494 - DNA, 22 bp, Homo sapiens
gaaaatgtttcctgttatttgc

SEQ ID NO: 8382495 - DNA, 22 bp, Homo sapiens
gaaaatgttagcttcatagtca

SEQ ID NO: 8382496 - DNA, 22 bp, Homo sapiens
gaaaattattgaaaatggctct

SEQ ID NO: 8382497 - DNA, 22 bp, Homo sapiens
gaaaatacttcagtgttctggc

SEQ ID NO: 8382498 - DNA, 22 bp, Homo sapiens
gaaaatacttcagtgttctggc

SEQ ID NO: 8382499 - DNA, 22 bp, Homo sapiens
cttttgcacccagagttatttg

SEQ ID NO: 8382500 - DNA, 22 bp, Homo sapiens
cttttgcaccttttaagtaatg

SEQ ID NO: 8382501 - DNA, 22 bp, Homo sapiens
gaaaatttaattctcttctgtg

SEQ ID NO: 8382502 - DNA, 22 bp, Homo sapiens
gaaaattattgaaaatggctct

SEQ ID NO: 8382503 - DNA, 22 bp, Homo sapiens
gaaaatttagaactgaacttct

SEQ ID NO: 8382504 - DNA, 22 bp, Homo sapiens
gaaaatttagaactgaacttct

SEQ ID NO: 8382505 - DNA, 22 bp, Homo sapiens
gaaaatttagaactgaacttct

SEQ ID NO: 8382506 - DNA, 22 bp, Homo sapiens
gaaaatttaattctcttctgtg

SEQ ID NO: 8382507 - DNA, 22 bp, Homo sapiens
gaaacaatacttgtcctcacta

SEQ ID NO: 8382508 - DNA, 22 bp, Homo sapiens
gaaacaatcatcatgtgatttg

SEQ ID NO: 8382509 - DNA, 22 bp, Homo sapiens
gaaacaatcatcatgtgatttg

SEQ ID NO: 8382510 - DNA, 22 bp, Homo sapiens
gaaacaatcatcatgtgatttg

SEQ ID NO: 8382511 - DNA, 22 bp, Homo sapiens
gaaaatttctgccacatgtgtg

SEQ ID NO: 8382512 - DNA, 22 bp, Homo sapiens
gaaacaactactattgatttct

SEQ ID NO: 8382513 - DNA, 22 bp, Homo sapiens
gaaacaactactattgatttct

SEQ ID NO: 8382514 - DNA, 22 bp, Homo sapiens
gaaacagattaacagcatattt

SEQ ID NO: 8382515 - DNA, 22 bp, Homo sapiens
gaaacaatttttgttgtctaag

SEQ ID NO: 8382516 - DNA, 22 bp, Homo sapiens
gaaacaatttttgttgtctaag

SEQ ID NO: 8382517 - DNA, 22 bp, Homo sapiens
gaaagccatctggctgctggga

SEQ ID NO: 8382518 - DNA, 22 bp, Homo sapiens
gaaagccagagagaaagggctc

SEQ ID NO: 8382519 - DNA, 22 bp, Homo sapiens
gaaagccagagagaaagggctc

SEQ ID NO: 8382520 - DNA, 18 bp, Homo sapiens
gaaagccatgcagcagtg

SEQ ID NO: 8382521 - DNA, 22 bp, Homo sapiens
gaaagatatttattggcaacag

SEQ ID NO: 8382522 - DNA, 22 bp, Homo sapiens
gaaagagaggggctgagatgca

SEQ ID NO: 8382523 - DNA, 22 bp, Homo sapiens
cttctgaagaggttatcataga

SEQ ID NO: 8382524 - DNA, 22 bp, Homo sapiens
cttctgaatggctgtgtatgct

SEQ ID NO: 8382525 - DNA, 22 bp, Homo sapiens
cttctgctgctgttcatggttg

SEQ ID NO: 8382526 - DNA, 22 bp, Homo sapiens
cttctgaagtgtttgatgattg

SEQ ID NO: 8382527 - DNA, 22 bp, Homo sapiens
cttctggagctcaccaacttcc

SEQ ID NO: 8382528 - DNA, 22 bp, Homo sapiens
cttctggaggacactggcccca

SEQ ID NO: 8382529 - DNA, 22 bp, Homo sapiens
cttctgggcatggcagagcctg

SEQ ID NO: 8382530 - DNA, 22 bp, Homo sapiens
cttctggggatggagcccagaa

SEQ ID NO: 8382531 - DNA, 22 bp, Homo sapiens
cttctgggatttttgaagactc

SEQ ID NO: 8382532 - DNA, 22 bp, Homo sapiens
cttctggcgttggaggtctgag

SEQ ID NO: 8382533 - DNA, 22 bp, Homo sapiens
cttctggttccagcttctgttg

SEQ ID NO: 8382534 - DNA, 22 bp, Homo sapiens
cttgtgcttttatgaatgcaga

SEQ ID NO: 8382535 - DNA, 22 bp, Homo sapiens
cttctgggtgtggagtgaggac

SEQ ID NO: 8382536 - DNA, 22 bp, Homo sapiens
cttctgggtattccagatacct

SEQ ID NO: 8382537 - DNA, 22 bp, Homo sapiens
cttgttttgaaagcagtggcca

SEQ ID NO: 8382538 - DNA, 21 bp, Homo sapiens
cttgttttgaaaggactggcc

SEQ ID NO: 8382539 - DNA, 22 bp, Homo sapiens
cttgttttcttctgcagtctat

SEQ ID NO: 8382540 - DNA, 22 bp, Homo sapiens
cttgttttctaaaacatcattt

SEQ ID NO: 8382541 - DNA, 22 bp, Homo sapiens
cttgttttggaacagagtgaat

SEQ ID NO: 8382542 - DNA, 22 bp, Homo sapiens
cttgttttggctagtatgatgt

SEQ ID NO: 8382543 - DNA, 22 bp, Homo sapiens
cttgtttttaagagatgtttac

SEQ ID NO: 8382544 - DNA, 22 bp, Homo sapiens
ctttaacagttccattcaattt

SEQ ID NO: 8382545 - DNA, 22 bp, Homo sapiens
ctttaaataatacaaggtccag

SEQ ID NO: 8382546 - DNA, 22 bp, Homo sapiens
ctttaattaggaagtataatga

SEQ ID NO: 8382547 - DNA, 22 bp, Homo sapiens
ctttacaaagcaattttgtctc

SEQ ID NO: 8382548 - DNA, 22 bp, Homo sapiens
ctttacaaagcaattttgtctc

SEQ ID NO: 8382549 - DNA, 22 bp, Homo sapiens
ctttacaaactataaagtgcgg

SEQ ID NO: 8382550 - DNA, 22 bp, Homo sapiens
ctttacaaactataaagtgcgg

SEQ ID NO: 8382551 - DNA, 22 bp, Homo sapiens
ctttctcttcactgtcatgatc

SEQ ID NO: 8382552 - DNA, 22 bp, Homo sapiens
ctttacaaatagggagggagtg

SEQ ID NO: 8382553 - DNA, 22 bp, Homo sapiens
ctttacaaagcaattttgtctc

SEQ ID NO: 8382554 - DNA, 22 bp, Homo sapiens
ctttgaaaacttaaataacagc

SEQ ID NO: 8382555 - DNA, 22 bp, Homo sapiens
ctttctcttcagcacccagccc

SEQ ID NO: 8382556 - DNA, 22 bp, Homo sapiens
ctttgactttgtcctcaggaaa

SEQ ID NO: 8382557 - DNA, 22 bp, Homo sapiens
ctttgattatcggtgtgaatgt

SEQ ID NO: 8382558 - DNA, 22 bp, Homo sapiens
ctttgatataagtatacatagt

SEQ ID NO: 8382559 - DNA, 22 bp, Homo sapiens
ctttgaaaatgtggttaagggt

SEQ ID NO: 8382560 - DNA, 22 bp, Homo sapiens
cttccagagatccatgaatacc

SEQ ID NO: 8382561 - DNA, 22 bp, Homo sapiens
cttccagagatagggcctcaag

SEQ ID NO: 8382562 - DNA, 22 bp, Homo sapiens
cttccaagcccaggagccattt

SEQ ID NO: 8382563 - DNA, 22 bp, Homo sapiens
cttccaagatgaacagcaagcg

SEQ ID NO: 8382564 - DNA, 22 bp, Homo sapiens
cttccaagttgctctgctgacc

SEQ ID NO: 8382565 - DNA, 22 bp, Homo sapiens
cttccagctgattacaggctat

SEQ ID NO: 8382566 - DNA, 22 bp, Homo sapiens
cttcctttccccaatcatatcg

SEQ ID NO: 8382567 - DNA, 22 bp, Homo sapiens
cttcctttccccaatcatatcg

SEQ ID NO: 8382568 - DNA, 22 bp, Homo sapiens
cttcctttgctgttcggaggtt

SEQ ID NO: 8382569 - DNA, 22 bp, Homo sapiens
cttcctttgctgttcggaggtt

SEQ ID NO: 8382570 - DNA, 22 bp, Homo sapiens
cttcctttggttggagcgccgt

SEQ ID NO: 8382571 - DNA, 22 bp, Homo sapiens
cttcctttggttggagcgccgt

SEQ ID NO: 8382572 - DNA, 20 bp, Homo sapiens
cttccttttccttcgtcaaa

SEQ ID NO: 8382573 - DNA, 20 bp, Homo sapiens
cttccttttccttcgtcaaa

SEQ ID NO: 8382574 - DNA, 22 bp, Homo sapiens
cttctaacatcctacaatgcaa

SEQ ID NO: 8382575 - DNA, 22 bp, Homo sapiens
cttctagagctggagcaaatgt

SEQ ID NO: 8382576 - DNA, 22 bp, Homo sapiens
cttctagggcatcatgacaaat

SEQ ID NO: 8382577 - DNA, 22 bp, Homo sapiens
cttctaggtcttgattgaatgt

SEQ ID NO: 8382578 - DNA, 22 bp, Homo sapiens
cttctacacatccctcttgctt

SEQ ID NO: 8382579 - DNA, 22 bp, Homo sapiens
cttctacacatccctcttgctt

SEQ ID NO: 8382580 - DNA, 22 bp, Homo sapiens
cttctacacgtggctgtgccaa

SEQ ID NO: 8382581 - DNA, 22 bp, Homo sapiens
cttctagaaccctctattcttt

SEQ ID NO: 8382582 - DNA, 22 bp, Homo sapiens
cttctcagcattttgtcagtct

SEQ ID NO: 8382583 - DNA, 22 bp, Homo sapiens
cttctcaaacctgaaaggacaa

SEQ ID NO: 8382584 - DNA, 22 bp, Homo sapiens
cttctattcactggtcacagtt

SEQ ID NO: 8382585 - DNA, 22 bp, Homo sapiens
cttagcttctctgcatctgtgt

SEQ ID NO: 8382586 - DNA, 22 bp, Homo sapiens
cttagctttaaaagtgagatct

SEQ ID NO: 8382587 - DNA, 22 bp, Homo sapiens
cttaggaagcttttgaggacaa

SEQ ID NO: 8382588 - DNA, 22 bp, Homo sapiens
cttagggaatcttagagctgga

SEQ ID NO: 8382589 - DNA, 22 bp, Homo sapiens
cttatacacgaacacaaggtgt

SEQ ID NO: 8382590 - DNA, 22 bp, Homo sapiens
cttatacaccctcttcccaggc

SEQ ID NO: 8382591 - DNA, 22 bp, Homo sapiens
cttataaagtccatctgaacaa

SEQ ID NO: 8382592 - DNA, 22 bp, Homo sapiens
cttcatttggcaggctggcctc

SEQ ID NO: 8382593 - DNA, 22 bp, Homo sapiens
cttcatttggagaactgtgctt

SEQ ID NO: 8382594 - DNA, 22 bp, Homo sapiens
cttcatttccatccaactggga

SEQ ID NO: 8382595 - DNA, 22 bp, Homo sapiens
cttcatttccatccaactggga

SEQ ID NO: 8382596 - DNA, 22 bp, Homo sapiens
cttcatttggagaactgtgctt

SEQ ID NO: 8382597 - DNA, 22 bp, Homo sapiens
cttcatttcaggctgaagaata

SEQ ID NO: 8382598 - DNA, 22 bp, Homo sapiens
cttcatttcaggctgaagaata

SEQ ID NO: 8382599 - DNA, 18 bp, Homo sapiens
cttcatttgtagagttcc

SEQ ID NO: 8382600 - DNA, 22 bp, Homo sapiens
cttccaaaatttatatgttgaa

SEQ ID NO: 8382601 - DNA, 22 bp, Homo sapiens
cttccaaacccagggtatgggc

SEQ ID NO: 8382602 - DNA, 22 bp, Homo sapiens
cttccaaagcactttatggacc

SEQ ID NO: 8382603 - DNA, 22 bp, Homo sapiens
cttccaaatgtaaataagtttc

SEQ ID NO: 8382604 - DNA, 22 bp, Homo sapiens
cttcagtgttggttcattacga

SEQ ID NO: 8382605 - DNA, 22 bp, Homo sapiens
cttatagatggcgatcttcttg

SEQ ID NO: 8382606 - DNA, 19 bp, Homo sapiens
cttatacagattttctcat

SEQ ID NO: 8382607 - DNA, 22 bp, Homo sapiens
cttcattacttgctcgtagcac

SEQ ID NO: 8382608 - DNA, 22 bp, Homo sapiens
cttcattacttgctcgtagcac

SEQ ID NO: 8382609 - DNA, 23 bp, Homo sapiens
cttcattgtagtgttggggagat

SEQ ID NO: 8382610 - DNA, 22 bp, Homo sapiens
cttcagttagagtttacaaagt

SEQ ID NO: 8382611 - DNA, 22 bp, Homo sapiens
ctgtttataaaccaccagttta

SEQ ID NO: 8382612 - DNA, 19 bp, Homo sapiens
ctgtttctgagcttgcttt

SEQ ID NO: 8382613 - DNA, 22 bp, Homo sapiens
ctgtttatcatgtacatttcca

SEQ ID NO: 8382614 - DNA, 22 bp, Homo sapiens
ctgtgcttgtgttcattgttaa

SEQ ID NO: 8382615 - DNA, 22 bp, Homo sapiens
ctgtgcttgacagtgggaagca

SEQ ID NO: 8382616 - DNA, 22 bp, Homo sapiens
ctgtgcttcgcaactccaaggt

SEQ ID NO: 8382617 - DNA, 22 bp, Homo sapiens
ctgtgcttccaggatggcagct

SEQ ID NO: 8382618 - DNA, 22 bp, Homo sapiens
ctgtggaacttagtgggagaca

SEQ ID NO: 8382619 - DNA, 22 bp, Homo sapiens
ctgtgctttcgagatgtgatct

SEQ ID NO: 8382620 - DNA, 22 bp, Homo sapiens
cttaaactgaaagctacaagat

SEQ ID NO: 8382621 - DNA, 22 bp, Homo sapiens
cttaaacaggaaagagccaggt

SEQ ID NO: 8382622 - DNA, 22 bp, Homo sapiens
cttaaactgaaagctacaagat

SEQ ID NO: 8382623 - DNA, 20 bp, Homo sapiens
cttaaacacagagatagatt

SEQ ID NO: 8382624 - DNA, 22 bp, Homo sapiens
cttaaaatctggcagttagcta

SEQ ID NO: 8382625 - DNA, 22 bp, Homo sapiens
cttaaaatctggcagttagcta

SEQ ID NO: 8382626 - DNA, 22 bp, Homo sapiens
cttaaaagttgcttccctaact

SEQ ID NO: 8382627 - DNA, 22 bp, Homo sapiens
cttacaaaggagaggagatagg

SEQ ID NO: 8382628 - DNA, 22 bp, Homo sapiens
cttaatttttgtagtagatgga

SEQ ID NO: 8382629 - DNA, 22 bp, Homo sapiens
cttaatttaaaatagttcaggc

SEQ ID NO: 8382630 - DNA, 22 bp, Homo sapiens
cttaatttaagcctagaatgca

SEQ ID NO: 8382631 - DNA, 22 bp, Homo sapiens
cttaatttcaaactgctagtga

SEQ ID NO: 8382632 - DNA, 22 bp, Homo sapiens
cttacaaaggagaggagatagg

SEQ ID NO: 8382633 - DNA, 22 bp, Homo sapiens
cttacaaatacacttaggagag

SEQ ID NO: 8382634 - DNA, 22 bp, Homo sapiens
cttaattacccaatgtggtagg

SEQ ID NO: 8382635 - DNA, 22 bp, Homo sapiens
cttaaattggatgagttaagtt

SEQ ID NO: 8382636 - DNA, 22 bp, Homo sapiens
cttaaattttcatctacaagaa

SEQ ID NO: 8382637 - DNA, 22 bp, Homo sapiens
cttaaattttcatctacaagaa

SEQ ID NO: 8382638 - DNA, 22 bp, Homo sapiens
cttaaaggaggttttgtttcca

SEQ ID NO: 8382639 - DNA, 22 bp, Homo sapiens
cttaaagtctatcctttctaga

SEQ ID NO: 8382640 - DNA, 22 bp, Homo sapiens
cttaaatccatcatttctaatc

SEQ ID NO: 8382641 - DNA, 22 bp, Homo sapiens
cttaaattcttaatgccctcat

SEQ ID NO: 8382642 - DNA, 22 bp, Homo sapiens
cttagaaatgcagattctcagg

SEQ ID NO: 8382643 - DNA, 22 bp, Homo sapiens
cttagaaatgcagattctcagg

SEQ ID NO: 8382644 - DNA, 22 bp, Homo sapiens
cttagaaatgcagattctcagg

SEQ ID NO: 8382645 - DNA, 22 bp, Homo sapiens
cttagaaatgcagattctcagg

SEQ ID NO: 8382646 - DNA, 20 bp, Homo sapiens
cttagcaccagcaggacagg

SEQ ID NO: 8382647 - DNA, 22 bp, Homo sapiens
cttagcacatatcagaaaatag

SEQ ID NO: 8382648 - DNA, 22 bp, Homo sapiens
cttagaaataatggtttcagtt

SEQ ID NO: 8382649 - DNA, 22 bp, Homo sapiens
cttagaaatcgaactcaggtta

SEQ ID NO: 8382650 - DNA, 22 bp, Homo sapiens
cttagaaatcgaactcaggtta

SEQ ID NO: 8382651 - DNA, 22 bp, Homo sapiens
cttagaaataatggtttcagtt

SEQ ID NO: 8382652 - DNA, 22 bp, Homo sapiens
cttagaaagagttttctcccct

SEQ ID NO: 8382653 - DNA, 22 bp, Homo sapiens
cttagaaataatggtttcagtt

SEQ ID NO: 8382654 - DNA, 22 bp, Homo sapiens
cttacatactgagaaaatatcc

SEQ ID NO: 8382655 - DNA, 22 bp, Homo sapiens
cttacatactgagaaaatatcc

SEQ ID NO: 8382656 - DNA, 22 bp, Homo sapiens
cttacaacttgtatgtgattgt

SEQ ID NO: 8382657 - DNA, 22 bp, Homo sapiens
cttacaaatacacttaggagag

SEQ ID NO: 8382658 - DNA, 22 bp, Homo sapiens
cttacaacttgtatgtgattgt

SEQ ID NO: 8382659 - DNA, 22 bp, Homo sapiens
cttacagagaagaaaatgtagt

SEQ ID NO: 8382660 - DNA, 22 bp, Homo sapiens
ctgtattttttaagaatatctc

SEQ ID NO: 8382661 - DNA, 22 bp, Homo sapiens
ctgtcaccatttgagccctgga

SEQ ID NO: 8382662 - DNA, 22 bp, Homo sapiens
ctgtatataatgtatgcatggg

SEQ ID NO: 8382663 - DNA, 22 bp, Homo sapiens
ctgtcaggggcgggtggagcgg

SEQ ID NO: 8382664 - DNA, 19 bp, Homo sapiens
ctgtcaggggctggatgtt

SEQ ID NO: 8382665 - DNA, 22 bp, Homo sapiens
ctgtcacctgccagcataccca

SEQ ID NO: 8382666 - DNA, 22 bp, Homo sapiens
ctgtcaggttggtctcagagct

SEQ ID NO: 8382667 - DNA, 22 bp, Homo sapiens
ctgtctctgttgcctgtaggtg

SEQ ID NO: 8382668 - DNA, 22 bp, Homo sapiens
ctgtctctgttgcctgtaggtg

SEQ ID NO: 8382669 - DNA, 18 bp, Homo sapiens
ctgtgccctgctcctact

SEQ ID NO: 8382670 - DNA, 22 bp, Homo sapiens
ctgtgctgaggatgcagtttct

SEQ ID NO: 8382671 - DNA, 22 bp, Homo sapiens
ctgtgctgattcagcacaggcc

SEQ ID NO: 8382672 - DNA, 22 bp, Homo sapiens
ctgtgctgagtgatgtgactta

SEQ ID NO: 8382673 - DNA, 22 bp, Homo sapiens
ctgtgctggtccagggagctgg

SEQ ID NO: 8382674 - DNA, 22 bp, Homo sapiens
ctgtgcttacctgcccaggtga

SEQ ID NO: 8382675 - DNA, 22 bp, Homo sapiens
ctgtgcttagccatcacattca

SEQ ID NO: 8382676 - DNA, 22 bp, Homo sapiens
ctgtgctgtcttgggagcctta

SEQ ID NO: 8382677 - DNA, 22 bp, Homo sapiens
ctgtgctggattctgaggctac

SEQ ID NO: 8382678 - DNA, 22 bp, Homo sapiens
ctgtgctggagatgggccagag

SEQ ID NO: 8382679 - DNA, 22 bp, Homo sapiens
ctgtgctgctagacctggattc

SEQ ID NO: 8382680 - DNA, 22 bp, Homo sapiens
ctgtctggtgtccctgtctaca

SEQ ID NO: 8382681 - DNA, 22 bp, Homo sapiens
ctgtctgggtctacatcctctg

SEQ ID NO: 8382682 - DNA, 19 bp, Homo sapiens
ctgtctgcggggcctgttc

SEQ ID NO: 8382683 - DNA, 19 bp, Homo sapiens
ctgtctgcggggcctgttc

SEQ ID NO: 8382684 - DNA, 22 bp, Homo sapiens
ctgtctgctagaacatctatac

SEQ ID NO: 8382685 - DNA, 22 bp, Homo sapiens
ctgtctgctatgcttgttgtca

SEQ ID NO: 8382686 - DNA, 22 bp, Homo sapiens
ctggggactttggttctccatg

SEQ ID NO: 8382687 - DNA, 22 bp, Homo sapiens
ctggggagacgatcgatgttct

SEQ ID NO: 8382688 - DNA, 20 bp, Homo sapiens
ctggggacagcaatggctgt

SEQ ID NO: 8382689 - DNA, 22 bp, Homo sapiens
ctggggacgtcgggcagtgttc

SEQ ID NO: 8382690 - DNA, 22 bp, Homo sapiens
ctggggaccgagcaagctctgg

SEQ ID NO: 8382691 - DNA, 22 bp, Homo sapiens
ctgggcttttgagtcacaaggg

SEQ ID NO: 8382692 - DNA, 22 bp, Homo sapiens
ctggtctgagggctcttgaggc

SEQ ID NO: 8382693 - DNA, 20 bp, Homo sapiens
ctggtctgccactcacagtt

SEQ ID NO: 8382694 - DNA, 20 bp, Homo sapiens
ctggggagcctcgcggtggc

SEQ ID NO: 8382695 - DNA, 22 bp, Homo sapiens
ctggtcagctgaagccccacac

SEQ ID NO: 8382696 - DNA, 22 bp, Homo sapiens
ctgtacaagtccttcatcaggg

SEQ ID NO: 8382697 - DNA, 22 bp, Homo sapiens
ctgtacaagtccttcatcaggg

SEQ ID NO: 8382698 - DNA, 22 bp, Homo sapiens
ctgtacaatgttacctatttat

SEQ ID NO: 8382699 - DNA, 19 bp, Homo sapiens
ctgtacaggttgcttctgg

SEQ ID NO: 8382700 - DNA, 22 bp, Homo sapiens
ctggtgcaaaagtaattgtggt

SEQ ID NO: 8382701 - DNA, 22 bp, Homo sapiens
ctggtgatcttgggcaagtcac

SEQ ID NO: 8382702 - DNA, 22 bp, Homo sapiens
ctggtgcacatgaaagagaagg

SEQ ID NO: 8382703 - DNA, 22 bp, Homo sapiens
ctggtgcacattcgctctcata

SEQ ID NO: 8382704 - DNA, 22 bp, Homo sapiens
ctggtgccctgtgtggcaggag

SEQ ID NO: 8382705 - DNA, 22 bp, Homo sapiens
ctggtgccctgtgtggcaggag

SEQ ID NO: 8382706 - DNA, 22 bp, Homo sapiens
ctgtacaaaagaaagttcctat

SEQ ID NO: 8382707 - DNA, 22 bp, Homo sapiens
ctgtacaaatggcagttgagtt

SEQ ID NO: 8382708 - DNA, 22 bp, Homo sapiens
ctgtacaaagtagctgctggga

SEQ ID NO: 8382709 - DNA, 21 bp, Homo sapiens
ctgcttcctctcttcatggca

SEQ ID NO: 8382710 - DNA, 21 bp, Homo sapiens
ctgcttcctctcttcatggca

SEQ ID NO: 8382711 - DNA, 22 bp, Homo sapiens
ctgcttcctccctgtaaaggca

SEQ ID NO: 8382712 - DNA, 22 bp, Homo sapiens
ctgcttcatatttcatagtgat

SEQ ID NO: 8382713 - DNA, 22 bp, Homo sapiens
ctgcttccaagaaagagatagg

SEQ ID NO: 8382714 - DNA, 22 bp, Homo sapiens
ctgggacacccaaggaaagagc

SEQ ID NO: 8382715 - DNA, 22 bp, Homo sapiens
ctgggacacccagagctgcaga

SEQ ID NO: 8382716 - DNA, 22 bp, Homo sapiens
ctgggacacgttctattccaaa

SEQ ID NO: 8382717 - DNA, 22 bp, Homo sapiens
ctgggacacccagagctgcaga

SEQ ID NO: 8382718 - DNA, 22 bp, Homo sapiens
ctgcttcctgctgggatactga

SEQ ID NO: 8382719 - DNA, 22 bp, Homo sapiens
ctgcttcctgctgggatactga

SEQ ID NO: 8382720 - DNA, 22 bp, Homo sapiens
ctgggaagaagtgggctacatt

SEQ ID NO: 8382721 - DNA, 22 bp, Homo sapiens
ctgcttatggagatgagtaaga

SEQ ID NO: 8382722 - DNA, 22 bp, Homo sapiens
ctgcttaaaatgcagattctgt

SEQ ID NO: 8382723 - DNA, 22 bp, Homo sapiens
ctgcttaatttaatagttgcaa

SEQ ID NO: 8382724 - DNA, 22 bp, Homo sapiens
ctgctgtgtttctgctagaaaa

SEQ ID NO: 8382725 - DNA, 22 bp, Homo sapiens
ctgctgtgttggcattggatag

SEQ ID NO: 8382726 - DNA, 20 bp, Homo sapiens
ctgctgtgttattgtagaac

SEQ ID NO: 8382727 - DNA, 22 bp, Homo sapiens
ctgctgtgtggattcaatggct

SEQ ID NO: 8382728 - DNA, 22 bp, Homo sapiens
ctgctgtgtggattcaatggct

SEQ ID NO: 8382729 - DNA, 23 bp, Homo sapiens
ctgggacatggtaggggcacaac

SEQ ID NO: 8382730 - DNA, 22 bp, Homo sapiens
ctgggacatgatagaaacagat

SEQ ID NO: 8382731 - DNA, 22 bp, Homo sapiens
ctgggacatgatagaaacagat

SEQ ID NO: 8382732 - DNA, 22 bp, Homo sapiens
ctgggacatgatagaaacagat

SEQ ID NO: 8382733 - DNA, 22 bp, Homo sapiens
ctgggacatggtgctgtcttta

SEQ ID NO: 8382734 - DNA, 22 bp, Homo sapiens
ctgggacattataagaaacatt

SEQ ID NO: 8382735 - DNA, 22 bp, Homo sapiens
ctgggacatattgctagtgttg

SEQ ID NO: 8382736 - DNA, 22 bp, Homo sapiens
ctgggacagagcagcagtgggg

SEQ ID NO: 8382737 - DNA, 22 bp, Homo sapiens
ctgggacagctgagacaggaga

SEQ ID NO: 8382738 - DNA, 22 bp, Homo sapiens
ctgggacagctgagacaggaga

SEQ ID NO: 8382739 - DNA, 22 bp, Homo sapiens
ctgggacctcctgaggtggagc

SEQ ID NO: 8382740 - DNA, 22 bp, Homo sapiens
ctgggacctcggggtgatcaaa

SEQ ID NO: 8382741 - DNA, 22 bp, Homo sapiens
ctgggaccctgccctgtggcct

SEQ ID NO: 8382742 - DNA, 22 bp, Homo sapiens
ctgggacctcctcactgttcta

SEQ ID NO: 8382743 - DNA, 22 bp, Homo sapiens
ctgggaccatctgtgtctactt

SEQ ID NO: 8382744 - DNA, 22 bp, Homo sapiens
ctgggaccagtgaagcaactca

SEQ ID NO: 8382745 - DNA, 22 bp, Homo sapiens
ctgggacccccactgcgtagct

SEQ ID NO: 8382746 - DNA, 22 bp, Homo sapiens
ctgggaccctgccctgtggcct

SEQ ID NO: 8382747 - DNA, 22 bp, Homo sapiens
ctgggacctgtgtgcctgggcc

SEQ ID NO: 8382748 - DNA, 22 bp, Homo sapiens
ctgggagatctgttgggactgg

SEQ ID NO: 8382749 - DNA, 22 bp, Homo sapiens
ctgggagatgactcagagcagg

SEQ ID NO: 8382750 - DNA, 22 bp, Homo sapiens
ctgggagattcaggtgaagttt

SEQ ID NO: 8382751 - DNA, 22 bp, Homo sapiens
ctgggagattgctagagatgca

SEQ ID NO: 8382752 - DNA, 22 bp, Homo sapiens
ctgggagatctcctgagggcag

SEQ ID NO: 8382753 - DNA, 22 bp, Homo sapiens
ctgggactgggtcctcaggaca

SEQ ID NO: 8382754 - DNA, 22 bp, Homo sapiens
ctgggactgggtcctcaggaca

SEQ ID NO: 8382755 - DNA, 22 bp, Homo sapiens
ctgggacttgcagagcaggagg

SEQ ID NO: 8382756 - DNA, 22 bp, Homo sapiens
ctgggacttgcagagcaggagg

SEQ ID NO: 8382757 - DNA, 22 bp, Homo sapiens
ctgggctagaaggaccaggatg

SEQ ID NO: 8382758 - DNA, 22 bp, Homo sapiens
ctgggctggcgcatccgacacg

SEQ ID NO: 8382759 - DNA, 22 bp, Homo sapiens
ctgggccttgatcacacaggtg

SEQ ID NO: 8382760 - DNA, 22 bp, Homo sapiens
ctgggagcctggcagttgctga

SEQ ID NO: 8382761 - DNA, 22 bp, Homo sapiens
ctgggagcgcagcaggcacaac

SEQ ID NO: 8382762 - DNA, 22 bp, Homo sapiens
ctgggagattgctagagatgca

SEQ ID NO: 8382763 - DNA, 22 bp, Homo sapiens
ctgggagcccgcgtcctggtgg

SEQ ID NO: 8382764 - DNA, 22 bp, Homo sapiens
ctgggagcaagtcaggaaaggt

SEQ ID NO: 8382765 - DNA, 17 bp, Homo sapiens
ctgggatgtggactctt

SEQ ID NO: 8382766 - DNA, 22 bp, Homo sapiens
ctgggagcggctgtcactggtt

SEQ ID NO: 8382767 - DNA, 22 bp, Homo sapiens
ctgggcagctccataccaccca

SEQ ID NO: 8382768 - DNA, 22 bp, Homo sapiens
ctgggcagctaccaccactgct

SEQ ID NO: 8382769 - DNA, 22 bp, Homo sapiens
ctgggcagctaccaccactgct

SEQ ID NO: 8382770 - DNA, 22 bp, Homo sapiens
ctgggcagcctcacacaatgtt

SEQ ID NO: 8382771 - DNA, 22 bp, Homo sapiens
ctgggcagctgtgcaaacaata

SEQ ID NO: 8382772 - DNA, 22 bp, Homo sapiens
ctgggcagctgtatcagggagt

SEQ ID NO: 8382773 - DNA, 22 bp, Homo sapiens
ctgggcagagtccggaagatgg

SEQ ID NO: 8382774 - DNA, 22 bp, Homo sapiens
ctgggcagagctaacacctgag

SEQ ID NO: 8382775 - DNA, 22 bp, Homo sapiens
ctgggcagagctaacacctgag

SEQ ID NO: 8382776 - DNA, 22 bp, Homo sapiens
ctgggcagaattttaggatggc

SEQ ID NO: 8382777 - DNA, 22 bp, Homo sapiens
tgctctggacgctgagtggttt

SEQ ID NO: 8382778 - DNA, 22 bp, Homo sapiens
tgctctgcacatccctcacaaa

SEQ ID NO: 8382779 - DNA, 22 bp, Homo sapiens
tgctgccttagcagccaggcaa

SEQ ID NO: 8382780 - DNA, 22 bp, Homo sapiens
tgctgcctgtgccaggagggtc

SEQ ID NO: 8382781 - DNA, 22 bp, Homo sapiens
tgctctgaggcacatgccatcg

SEQ ID NO: 8382782 - DNA, 22 bp, Homo sapiens
cccagtggcaaagcagcttaga

SEQ ID NO: 8382783 - DNA, 18 bp, Homo sapiens
cccagtgctcactgcctc

SEQ ID NO: 8382784 - DNA, 21 bp, Homo sapiens
tgctcagtaaatgctgagtga

SEQ ID NO: 8382785 - DNA, 22 bp, Homo sapiens
cccaggtctgtgccagctctga

SEQ ID NO: 8382786 - DNA, 22 bp, Homo sapiens
cccaggtctgtgccagctctga

SEQ ID NO: 8382787 - DNA, 22 bp, Homo sapiens
cccaggtctcctgcttcccagg

SEQ ID NO: 8382788 - DNA, 22 bp, Homo sapiens
cccaggtctgccagcctgtggg

SEQ ID NO: 8382789 - DNA, 22 bp, Homo sapiens
cccaggtctgccagcctgtggg

SEQ ID NO: 8382790 - DNA, 22 bp, Homo sapiens
cccaggtctcctgcttcccagg

SEQ ID NO: 8382791 - DNA, 19 bp, Homo sapiens
cccagtctaggtcctagga

SEQ ID NO: 8382792 - DNA, 19 bp, Homo sapiens
cccagtctaggtcctagga

SEQ ID NO: 8382793 - DNA, 19 bp, Homo sapiens
cccagtccttgtcctgggc

SEQ ID NO: 8382794 - DNA, 19 bp, Homo sapiens
cccagtccttgtcctgggc

SEQ ID NO: 8382795 - DNA, 22 bp, Homo sapiens
tgctcagggagcttcctggtgg

SEQ ID NO: 8382796 - DNA, 22 bp, Homo sapiens
tgctagaattaggttaaacaaa

SEQ ID NO: 8382797 - DNA, 22 bp, Homo sapiens
tgctagaatttgcagaagcata

SEQ ID NO: 8382798 - DNA, 22 bp, Homo sapiens
tgcaggtgccatcgctgctcat

SEQ ID NO: 8382799 - DNA, 22 bp, Homo sapiens
tgcaggtgcctcttgagcttgt

SEQ ID NO: 8382800 - DNA, 22 bp, Homo sapiens
tgcaggtgcgttttcaagcctc

SEQ ID NO: 8382801 - DNA, 22 bp, Homo sapiens
tgcaggtgctacaagaactcac

SEQ ID NO: 8382802 - DNA, 22 bp, Homo sapiens
tgcaggtgctccgggggtgccc

SEQ ID NO: 8382803 - DNA, 22 bp, Homo sapiens
tgcaggtgctccgggggtgccc

SEQ ID NO: 8382804 - DNA, 22 bp, Homo sapiens
tgcaggtgctgatacctactcc

SEQ ID NO: 8382805 - DNA, 22 bp, Homo sapiens
tgccttcttctccctggctcag

SEQ ID NO: 8382806 - DNA, 22 bp, Homo sapiens
tgccttctcccttggaccctga

SEQ ID NO: 8382807 - DNA, 22 bp, Homo sapiens
tgcttaaaaacagtatggtagt

SEQ ID NO: 8382808 - DNA, 22 bp, Homo sapiens
tgctgtttgagcttattttcag

SEQ ID NO: 8382809 - DNA, 22 bp, Homo sapiens
tgcttccctgctctgcacacct

SEQ ID NO: 8382810 - DNA, 22 bp, Homo sapiens
tgcttccctgctctgcacacct

SEQ ID NO: 8382811 - DNA, 22 bp, Homo sapiens
ccccaggagatttgggagcaca

SEQ ID NO: 8382812 - DNA, 22 bp, Homo sapiens
ccccaggagaaatcttaaacta

SEQ ID NO: 8382813 - DNA, 22 bp, Homo sapiens
ccccaggacacatggaccaagt

SEQ ID NO: 8382814 - DNA, 21 bp, Homo sapiens
tgcttccctgggccacactga

SEQ ID NO: 8382815 - DNA, 22 bp, Homo sapiens
tgcttcctatccacacaatgcc

SEQ ID NO: 8382816 - DNA, 22 bp, Homo sapiens
tgcttgggcggccagcatggcg

SEQ ID NO: 8382817 - DNA, 22 bp, Homo sapiens
ccctccctctgctgggtgtaga

SEQ ID NO: 8382818 - DNA, 22 bp, Homo sapiens
ccccagctcagtgcagggacat

SEQ ID NO: 8382819 - DNA, 22 bp, Homo sapiens
cccagtgtgatgaggttgctaa

SEQ ID NO: 8382820 - DNA, 22 bp, Homo sapiens
tgctgggcaccagtgcctgcag

SEQ ID NO: 8382821 - DNA, 22 bp, Homo sapiens
cccagtggtgctggcatctgtg

SEQ ID NO: 8382822 - DNA, 22 bp, Homo sapiens
tgctgctcacacacagtgaatg

SEQ ID NO: 8382823 - DNA, 22 bp, Homo sapiens
tggcagggagccaccggtcatg

SEQ ID NO: 8382824 - DNA, 19 bp, Homo sapiens
tggcagggagagtttgaag

SEQ ID NO: 8382825 - DNA, 22 bp, Homo sapiens
tggcagggaatacagatgttta

SEQ ID NO: 8382826 - DNA, 22 bp, Homo sapiens
tggcagggaatacagatgttta

SEQ ID NO: 8382827 - DNA, 22 bp, Homo sapiens
tggcagggaatacagatgttta

SEQ ID NO: 8382828 - DNA, 22 bp, Homo sapiens
cccttgggccccagctcagggc

SEQ ID NO: 8382829 - DNA, 22 bp, Homo sapiens
cccttgggccccagctcagggc

SEQ ID NO: 8382830 - DNA, 22 bp, Homo sapiens
cccttggggctctttgccaggc

SEQ ID NO: 8382831 - DNA, 22 bp, Homo sapiens
cccttggggtggaggttgcagt

SEQ ID NO: 8382832 - DNA, 22 bp, Homo sapiens
ccctttagcccctgcagagact

SEQ ID NO: 8382833 - DNA, 22 bp, Homo sapiens
ccctttaaggtctgattttcag

SEQ ID NO: 8382834 - DNA, 22 bp, Homo sapiens
ccctgggacccgctgcagaggc

SEQ ID NO: 8382835 - DNA, 22 bp, Homo sapiens
ccctgggagctgcctggctgac

SEQ ID NO: 8382836 - DNA, 22 bp, Homo sapiens
ccctgggaggcttccaggcaga

SEQ ID NO: 8382837 - DNA, 22 bp, Homo sapiens
ccctgggaagtattccagctat

SEQ ID NO: 8382838 - DNA, 22 bp, Homo sapiens
ccctggcttggcactctccact

SEQ ID NO: 8382839 - DNA, 22 bp, Homo sapiens
tggcaggaaaaacattggagat

SEQ ID NO: 8382840 - DNA, 22 bp, Homo sapiens
ccctggagtccggagctcacct

SEQ ID NO: 8382841 - DNA, 22 bp, Homo sapiens
ccctggaggtggaggttgcagg

SEQ ID NO: 8382842 - DNA, 22 bp, Homo sapiens
tggcacagtgctggatggtgct

SEQ ID NO: 8382843 - DNA, 22 bp, Homo sapiens
tggcagaagttcactagtagct

SEQ ID NO: 8382844 - DNA, 22 bp, Homo sapiens
tggcagaagtacacaagcatgc

SEQ ID NO: 8382845 - DNA, 22 bp, Homo sapiens
ccctggctgcgtgatggatgaa

SEQ ID NO: 8382846 - DNA, 22 bp, Homo sapiens
tggcagagaacacacatgattc

SEQ ID NO: 8382847 - DNA, 22 bp, Homo sapiens
ccctggctgctaccaggtagct

SEQ ID NO: 8382848 - DNA, 22 bp, Homo sapiens
ccctggctgctaccaggtagct

SEQ ID NO: 8382849 - DNA, 22 bp, Homo sapiens
tggcagaatttctagcagattc

SEQ ID NO: 8382850 - DNA, 22 bp, Homo sapiens
tggagatgggaaaaaggaggta

SEQ ID NO: 8382851 - DNA, 22 bp, Homo sapiens
tggagatgcctggagattaggg

SEQ ID NO: 8382852 - DNA, 22 bp, Homo sapiens
tggagatggcctcaggccctca

SEQ ID NO: 8382853 - DNA, 23 bp, Homo sapiens
tggagatgccccactccctgtct

SEQ ID NO: 8382854 - DNA, 19 bp, Homo sapiens
tggaggaagtatatttcat

SEQ ID NO: 8382855 - DNA, 22 bp, Homo sapiens
tggaggaagtggacagttgtgt

SEQ ID NO: 8382856 - DNA, 18 bp, Homo sapiens
tggaggaatcacaatggc

SEQ ID NO: 8382857 - DNA, 22 bp, Homo sapiens
tggaggcagtttaagtctgaga

SEQ ID NO: 8382858 - DNA, 22 bp, Homo sapiens
tggaggcagtttaagtctgaga

SEQ ID NO: 8382859 - DNA, 22 bp, Homo sapiens
tggaggccaaggcaggcggatc

SEQ ID NO: 8382860 - DNA, 22 bp, Homo sapiens
ccctggagggatttctcaatca

SEQ ID NO: 8382861 - DNA, 22 bp, Homo sapiens
tggaggcattgtgactgctgaa

SEQ ID NO: 8382862 - DNA, 22 bp, Homo sapiens
ccctccctttgcagcagtgcat

SEQ ID NO: 8382863 - DNA, 22 bp, Homo sapiens
ccctccctgaagaagttactct

SEQ ID NO: 8382864 - DNA, 22 bp, Homo sapiens
ccctccctgtgtgcctcatttg

SEQ ID NO: 8382865 - DNA, 22 bp, Homo sapiens
ccctcctcaactctggcttcca

SEQ ID NO: 8382866 - DNA, 22 bp, Homo sapiens
ccctcctcaactctggcttcca

SEQ ID NO: 8382867 - DNA, 22 bp, Homo sapiens
tggaaactatcctcacaactag

SEQ ID NO: 8382868 - DNA, 22 bp, Homo sapiens
tggaaagaaaaacaggccatga

SEQ ID NO: 8382869 - DNA, 22 bp, Homo sapiens
tggaaactctacctctctaaga

SEQ ID NO: 8382870 - DNA, 22 bp, Homo sapiens
tggagactgtgctaagggagtt

SEQ ID NO: 8382871 - DNA, 22 bp, Homo sapiens
tggagagtttagcctactggaa

SEQ ID NO: 8382872 - DNA, 22 bp, Homo sapiens
tggagagaaaaaagacagttct

SEQ ID NO: 8382873 - DNA, 22 bp, Homo sapiens
tggagataacagatgcaaacct

SEQ ID NO: 8382874 - DNA, 19 bp, Homo sapiens
tggagataagctgtcaata

SEQ ID NO: 8382875 - DNA, 22 bp, Homo sapiens
tggagataggctgaggcagggc

SEQ ID NO: 8382876 - DNA, 22 bp, Homo sapiens
tggagaatctggaaactgttga

SEQ ID NO: 8382877 - DNA, 22 bp, Homo sapiens
tggaaagaattcctatggttca

SEQ ID NO: 8382878 - DNA, 22 bp, Homo sapiens
tggaaagaaagtaaaggcgtat

SEQ ID NO: 8382879 - DNA, 22 bp, Homo sapiens
tggagaattctatgttgagggg

SEQ ID NO: 8382880 - DNA, 22 bp, Homo sapiens
tggagaattctatgttgagggg

SEQ ID NO: 8382881 - DNA, 20 bp, Homo sapiens
tggagacaattgcccttttt

SEQ ID NO: 8382882 - DNA, 18 bp, Homo sapiens
tggagacatagacaatgt

SEQ ID NO: 8382883 - DNA, 22 bp, Homo sapiens
tggagacacaggaccagactgc

SEQ ID NO: 8382884 - DNA, 17 bp, Homo sapiens
cctcccacaccgccctg

SEQ ID NO: 8382885 - DNA, 22 bp, Homo sapiens
cctcccacatcctagctctgct

SEQ ID NO: 8382886 - DNA, 22 bp, Homo sapiens
cctccaggtgttacatatgact

SEQ ID NO: 8382887 - DNA, 22 bp, Homo sapiens
cctcccacattgaggacatgct

SEQ ID NO: 8382888 - DNA, 23 bp, Homo sapiens
cctcccacctatttcactttctt

SEQ ID NO: 8382889 - DNA, 22 bp, Homo sapiens
cctcctctggtgctgccaaccc

SEQ ID NO: 8382890 - DNA, 22 bp, Homo sapiens
cctcctctggtgctgccaaccc

SEQ ID NO: 8382891 - DNA, 22 bp, Homo sapiens
cctcccacttcttgctgaggtc

SEQ ID NO: 8382892 - DNA, 22 bp, Homo sapiens
cctcctggcctgtgcagagccc

SEQ ID NO: 8382893 - DNA, 22 bp, Homo sapiens
cctcctggccctgggcctggaa

SEQ ID NO: 8382894 - DNA, 22 bp, Homo sapiens
cctcctgggacaggctggcaca

SEQ ID NO: 8382895 - DNA, 22 bp, Homo sapiens
cctcctggcttttcccattgaa

SEQ ID NO: 8382896 - DNA, 23 bp, Homo sapiens
cctcctgggcacaggcctgatgg

SEQ ID NO: 8382897 - DNA, 22 bp, Homo sapiens
cctcctgggactcattagcacc

SEQ ID NO: 8382898 - DNA, 22 bp, Homo sapiens
cctcctgggagagcacggaggg

SEQ ID NO: 8382899 - DNA, 22 bp, Homo sapiens
cctcctgggccttgctctgtga

SEQ ID NO: 8382900 - DNA, 22 bp, Homo sapiens
cctcctgggctcctgtctgcac

SEQ ID NO: 8382901 - DNA, 22 bp, Homo sapiens
cctccagggcccctctcactgg

SEQ ID NO: 8382902 - DNA, 22 bp, Homo sapiens
cctccaggctggttatcagctg

SEQ ID NO: 8382903 - DNA, 22 bp, Homo sapiens
cctccaggctggttatcagctg

SEQ ID NO: 8382904 - DNA, 22 bp, Homo sapiens
tggcatttggcttacttatgtt

SEQ ID NO: 8382905 - DNA, 22 bp, Homo sapiens
tggcattttgttcagtatatgg

SEQ ID NO: 8382906 - DNA, 23 bp, Homo sapiens
tggccaagataatctcagttttc

SEQ ID NO: 8382907 - DNA, 19 bp, Homo sapiens
tggcagtgtggcttccaga

SEQ ID NO: 8382908 - DNA, 22 bp, Homo sapiens
tgggacagattataagtctgca

SEQ ID NO: 8382909 - DNA, 22 bp, Homo sapiens
tgggacaggatgaccagaaggt

SEQ ID NO: 8382910 - DNA, 22 bp, Homo sapiens
tgggacaggaggcctctggaga

SEQ ID NO: 8382911 - DNA, 22 bp, Homo sapiens
tgggacaggaggcctctggaga

SEQ ID NO: 8382912 - DNA, 22 bp, Homo sapiens
tgggagagagaattcccagtgg

SEQ ID NO: 8382913 - DNA, 22 bp, Homo sapiens
tgggagagaattctggtgactg

SEQ ID NO: 8382914 - DNA, 22 bp, Homo sapiens
tgggacagggaatctgatcccc

SEQ ID NO: 8382915 - DNA, 22 bp, Homo sapiens
tgggcagaaggaagagccacct

SEQ ID NO: 8382916 - DNA, 22 bp, Homo sapiens
tgggcagaaatcagtatcagat

SEQ ID NO: 8382917 - DNA, 22 bp, Homo sapiens
tgggcagaatgtgggatccaga

SEQ ID NO: 8382918 - DNA, 22 bp, Homo sapiens
tgggcagaattgtggtagttaa

SEQ ID NO: 8382919 - DNA, 22 bp, Homo sapiens
tgggcagaatgtgggatccaga

SEQ ID NO: 8382920 - DNA, 22 bp, Homo sapiens
tgggcagacattgagtttgttc

SEQ ID NO: 8382921 - DNA, 22 bp, Homo sapiens
tgggcagacgctgttggaaggc

SEQ ID NO: 8382922 - DNA, 22 bp, Homo sapiens
tgggcagactaaggtcaaagct

SEQ ID NO: 8382923 - DNA, 22 bp, Homo sapiens
tgggcagacgggagcttgcctt

SEQ ID NO: 8382924 - DNA, 22 bp, Homo sapiens
tgggcagactaaggtcaaagct

SEQ ID NO: 8382925 - DNA, 22 bp, Homo sapiens
tgggataaggtatgtgaagtac

SEQ ID NO: 8382926 - DNA, 22 bp, Homo sapiens
tgggataataaatagaggcaga

SEQ ID NO: 8382927 - DNA, 20 bp, Homo sapiens
cctcctggtcaggtgtgcag

SEQ ID NO: 8382928 - DNA, 22 bp, Homo sapiens
cctcctggtaattagcgaaagg

SEQ ID NO: 8382929 - DNA, 22 bp, Homo sapiens
cctcctggggtgaaggatggga

SEQ ID NO: 8382930 - DNA, 22 bp, Homo sapiens
cctcctgggttcaagcgattct

SEQ ID NO: 8382931 - DNA, 22 bp, Homo sapiens
cctcctggtccagcatctcttt

SEQ ID NO: 8382932 - DNA, 22 bp, Homo sapiens
tggcttcttgtttggtttaaga

SEQ ID NO: 8382933 - DNA, 22 bp, Homo sapiens
tggcttctttccactgtcctgt

SEQ ID NO: 8382934 - DNA, 22 bp, Homo sapiens
tggcttggtaaggaccagcagg

SEQ ID NO: 8382935 - DNA, 22 bp, Homo sapiens
tggcttctttgtgacagctctt

SEQ ID NO: 8382936 - DNA, 22 bp, Homo sapiens
tggcttggactaaatggaccgt

SEQ ID NO: 8382937 - DNA, 19 bp, Homo sapiens
tggcttggctgcagatgct

SEQ ID NO: 8382938 - DNA, 22 bp, Homo sapiens
tggcttctttgtagaaattgaa

SEQ ID NO: 8382939 - DNA, 22 bp, Homo sapiens
tggcttctttccactgtcctgt

SEQ ID NO: 8382940 - DNA, 22 bp, Homo sapiens
tggcttctttctttccatgtgt

SEQ ID NO: 8382941 - DNA, 22 bp, Homo sapiens
cctctcccgggtgccgctgggc

SEQ ID NO: 8382942 - DNA, 22 bp, Homo sapiens
cctctcccgggtgccgctgggc

SEQ ID NO: 8382943 - DNA, 22 bp, Homo sapiens
tgggaaggcgtggaagtagaag

SEQ ID NO: 8382944 - DNA, 22 bp, Homo sapiens
tgggaaggcgtggaagtagaag

SEQ ID NO: 8382945 - DNA, 19 bp, Homo sapiens
cctctcccatgcttacctc

SEQ ID NO: 8382946 - DNA, 22 bp, Homo sapiens
cctctcccagggagagcctgag

SEQ ID NO: 8382947 - DNA, 22 bp, Homo sapiens
cctctcccctcccaaggcggga

SEQ ID NO: 8382948 - DNA, 19 bp, Homo sapiens
cctctcccatgcttacctc

SEQ ID NO: 8382949 - DNA, 22 bp, Homo sapiens
cctctcccaggcgcggcggcag

SEQ ID NO: 8382950 - DNA, 22 bp, Homo sapiens
cctctcccagggagagcctgag

SEQ ID NO: 8382951 - DNA, 22 bp, Homo sapiens
cctctcccacgtggcagaggct

SEQ ID NO: 8382952 - DNA, 22 bp, Homo sapiens
cctctccagcggcctcagggcc

SEQ ID NO: 8382953 - DNA, 23 bp, Homo sapiens
tggttacaggaacagggtttcgg

SEQ ID NO: 8382954 - DNA, 22 bp, Homo sapiens
tggttacataagaatagcactg

SEQ ID NO: 8382955 - DNA, 22 bp, Homo sapiens
tggtgggagtccgctgtgctgc

SEQ ID NO: 8382956 - DNA, 22 bp, Homo sapiens
tggttacagagatttttaagat

SEQ ID NO: 8382957 - DNA, 22 bp, Homo sapiens
tggttacagaacatgaatgttg

SEQ ID NO: 8382958 - DNA, 22 bp, Homo sapiens
tggttagacacatgcatgtcat

SEQ ID NO: 8382959 - DNA, 22 bp, Homo sapiens
tggttacatatcctttggagcc

SEQ ID NO: 8382960 - DNA, 23 bp, Homo sapiens
tggttacatagggcagatggcgc

SEQ ID NO: 8382961 - DNA, 22 bp, Homo sapiens
tggttacatcatcccattctga

SEQ ID NO: 8382962 - DNA, 22 bp, Homo sapiens
cctgcctgattccaggatggct

SEQ ID NO: 8382963 - DNA, 22 bp, Homo sapiens
cctgcctgcaaaatgggacaag

SEQ ID NO: 8382964 - DNA, 22 bp, Homo sapiens
cctgcctgcaccttctctgggg

SEQ ID NO: 8382965 - DNA, 22 bp, Homo sapiens
cctgcctcccagaggtcctcta

SEQ ID NO: 8382966 - DNA, 23 bp, Homo sapiens
cctgcctccccatcagttataca

SEQ ID NO: 8382967 - DNA, 22 bp, Homo sapiens
cctgcctgaaggtcagccaccc

SEQ ID NO: 8382968 - DNA, 17 bp, Homo sapiens
cctgcctgagccatagc

SEQ ID NO: 8382969 - DNA, 17 bp, Homo sapiens
cctgcctgagccatagc

SEQ ID NO: 8382970 - DNA, 22 bp, Homo sapiens
cctgcccttctttccccagcat

SEQ ID NO: 8382971 - DNA, 22 bp, Homo sapiens
cctgcccttctttccccagcat

SEQ ID NO: 8382972 - DNA, 22 bp, Homo sapiens
cctgccctgtgtttggggacta

SEQ ID NO: 8382973 - DNA, 22 bp, Homo sapiens
cctgcccttctttccccagcat

SEQ ID NO: 8382974 - DNA, 22 bp, Homo sapiens
cctgcccttctttccccagcat

SEQ ID NO: 8382975 - DNA, 22 bp, Homo sapiens
tggtagcaacatctcagtggct

SEQ ID NO: 8382976 - DNA, 22 bp, Homo sapiens
cctgccctgtcactggctaggg

SEQ ID NO: 8382977 - DNA, 22 bp, Homo sapiens
cctgcagggtgctgccacagat

SEQ ID NO: 8382978 - DNA, 22 bp, Homo sapiens
cctgccactgtaggtgacagtt

SEQ ID NO: 8382979 - DNA, 22 bp, Homo sapiens
tgggtggaataaatcagttctg

SEQ ID NO: 8382980 - DNA, 18 bp, Homo sapiens
tgggtggctagggagttt

SEQ ID NO: 8382981 - DNA, 21 bp, Homo sapiens
tgggcctcaagtgggtggcag

SEQ ID NO: 8382982 - DNA, 22 bp, Homo sapiens
tgggcctggagtttgtccagag

SEQ ID NO: 8382983 - DNA, 22 bp, Homo sapiens
tgggcaggcaagtgaatacctt

SEQ ID NO: 8382984 - DNA, 22 bp, Homo sapiens
tgggcaggataatatctcatgt

SEQ ID NO: 8382985 - DNA, 22 bp, Homo sapiens
tgggcaggagagaagctaaaga

SEQ ID NO: 8382986 - DNA, 22 bp, Homo sapiens
tgggctcagtgggagaaagggc

SEQ ID NO: 8382987 - DNA, 22 bp, Homo sapiens
tgggctcatgctggagatgaga

SEQ ID NO: 8382988 - DNA, 22 bp, Homo sapiens
tgggcctggccctgtggaggag

SEQ ID NO: 8382989 - DNA, 22 bp, Homo sapiens
tgggctccggcggcctcaggct

SEQ ID NO: 8382990 - DNA, 19 bp, Homo sapiens
tgggctcattcaggtggtt

SEQ ID NO: 8382991 - DNA, 22 bp, Homo sapiens
tgggctcatgtttatacatatc

SEQ ID NO: 8382992 - DNA, 22 bp, Homo sapiens
tgggctcatggcccagcactgg

SEQ ID NO: 8382993 - DNA, 22 bp, Homo sapiens
tgggctcatgtttctttgagga

SEQ ID NO: 8382994 - DNA, 22 bp, Homo sapiens
tgggctcatgtttctttgagga

SEQ ID NO: 8382995 - DNA, 22 bp, Homo sapiens
tggggagaagcaatagactcta

SEQ ID NO: 8382996 - DNA, 22 bp, Homo sapiens
cctgatatggtgtcatttaaac

SEQ ID NO: 8382997 - DNA, 22 bp, Homo sapiens
cctgatattaagaaggagtgag

SEQ ID NO: 8382998 - DNA, 22 bp, Homo sapiens
cctgataacacagatacaagat

SEQ ID NO: 8382999 - DNA, 17 bp, Homo sapiens
cctgatattcaagcagc

SEQ ID NO: 8383000 - DNA, 22 bp, Homo sapiens
cctgagtggtgctaagcagata

SEQ ID NO: 8383001 - DNA, 22 bp, Homo sapiens
tggggagagattgaggagtttt

SEQ ID NO: 8383002 - DNA, 23 bp, Homo sapiens
tggggagagttaccctggaagcg

SEQ ID NO: 8383003 - DNA, 22 bp, Homo sapiens
cctgcagaccacactcagtcct

SEQ ID NO: 8383004 - DNA, 22 bp, Homo sapiens
cctgcagctgtaggagaaggcg

SEQ ID NO: 8383005 - DNA, 22 bp, Homo sapiens
cctgcagctttgcctcctgaac

SEQ ID NO: 8383006 - DNA, 22 bp, Homo sapiens
cctgcaggctgcaggccagttc

SEQ ID NO: 8383007 - DNA, 22 bp, Homo sapiens
cctgcagggaatcgaggcagaa

SEQ ID NO: 8383008 - DNA, 22 bp, Homo sapiens
ccagtcccatctctgtcgctta

SEQ ID NO: 8383009 - DNA, 22 bp, Homo sapiens
ccagtcccagctctgccatgct

SEQ ID NO: 8383010 - DNA, 21 bp, Homo sapiens
ccagtgctacagctgcctgac

SEQ ID NO: 8383011 - DNA, 22 bp, Homo sapiens
tgaggcagtgtgagataataaa

SEQ ID NO: 8383012 - DNA, 22 bp, Homo sapiens
tgagcaggtcaggaagtacatt

SEQ ID NO: 8383013 - DNA, 21 bp, Homo sapiens
tgagcaggtgctgcttttatg

SEQ ID NO: 8383014 - DNA, 21 bp, Homo sapiens
tgagcaggtgcagggaagtgg

SEQ ID NO: 8383015 - DNA, 22 bp, Homo sapiens
tgagcagtaggtctgaatagtg

SEQ ID NO: 8383016 - DNA, 17 bp, Homo sapiens
tgagcagtagaagatgc

SEQ ID NO: 8383017 - DNA, 22 bp, Homo sapiens
tgagcagtaacagctcacaggg

SEQ ID NO: 8383018 - DNA, 22 bp, Homo sapiens
tgagcagtcagacaagcatcac

SEQ ID NO: 8383019 - DNA, 22 bp, Homo sapiens
tgagcagtcatccatttctcct

SEQ ID NO: 8383020 - DNA, 22 bp, Homo sapiens
ccagtcagtcagttgctggcat

SEQ ID NO: 8383021 - DNA, 22 bp, Homo sapiens
ccagtcagggcaggagcctggt

SEQ ID NO: 8383022 - DNA, 22 bp, Homo sapiens
ccagtcagggcaggagcctggt

SEQ ID NO: 8383023 - DNA, 22 bp, Homo sapiens
ccagtcagccaagctgcagcgg

SEQ ID NO: 8383024 - DNA, 22 bp, Homo sapiens
tgaggctgagatatcagggagg

SEQ ID NO: 8383025 - DNA, 22 bp, Homo sapiens
tgaggctgagatatcagggagg

SEQ ID NO: 8383026 - DNA, 22 bp, Homo sapiens
tgaggctgagatatcagggagg

SEQ ID NO: 8383027 - DNA, 18 bp, Homo sapiens
tgaggctgagggtagagg

SEQ ID NO: 8383028 - DNA, 22 bp, Homo sapiens
ccatacacacaccaaatttgta

SEQ ID NO: 8383029 - DNA, 22 bp, Homo sapiens
ccatccagaagggtttgaaaga

SEQ ID NO: 8383030 - DNA, 22 bp, Homo sapiens
ccatcagcatgggagcatgggc

SEQ ID NO: 8383031 - DNA, 22 bp, Homo sapiens
ccatcagattagcaaaatccag

SEQ ID NO: 8383032 - DNA, 22 bp, Homo sapiens
tgaggcccagccgccctgagag

SEQ ID NO: 8383033 - DNA, 22 bp, Homo sapiens
tgaggctgaaactggcgataga

SEQ ID NO: 8383034 - DNA, 22 bp, Homo sapiens
tgaggccccgaagctgaggttt

SEQ ID NO: 8383035 - DNA, 18 bp, Homo sapiens
tgaggctgaatatggggc

SEQ ID NO: 8383036 - DNA, 22 bp, Homo sapiens
tgaggctgacaaaagatgaggt

SEQ ID NO: 8383037 - DNA, 22 bp, Homo sapiens
tgaggctgacaaaagatgaggt

SEQ ID NO: 8383038 - DNA, 22 bp, Homo sapiens
tgaggccagtctcatcacaggc

SEQ ID NO: 8383039 - DNA, 22 bp, Homo sapiens
tgagtcctaaagctgtgccctt

SEQ ID NO: 8383040 - DNA, 22 bp, Homo sapiens
tgagtttaatgatatttatatg

SEQ ID NO: 8383041 - DNA, 19 bp, Homo sapiens
tgagttctgtggttctcaa

SEQ ID NO: 8383042 - DNA, 22 bp, Homo sapiens
tgagttttttcaacatatgaag

SEQ ID NO: 8383043 - DNA, 22 bp, Homo sapiens
ccatcctgcaggacctccatat

SEQ ID NO: 8383044 - DNA, 22 bp, Homo sapiens
tgagtccaaattctaccacctc

SEQ ID NO: 8383045 - DNA, 22 bp, Homo sapiens
tgagtcagtgacatgaacttgt

SEQ ID NO: 8383046 - DNA, 22 bp, Homo sapiens
tgagtccaataggggcctggaa

SEQ ID NO: 8383047 - DNA, 22 bp, Homo sapiens
ccatccatgtggcagggctggc

SEQ ID NO: 8383048 - DNA, 22 bp, Homo sapiens
ccatcctgaatggtctcagcca

SEQ ID NO: 8383049 - DNA, 22 bp, Homo sapiens
ccatcccttctctggccagcag

SEQ ID NO: 8383050 - DNA, 22 bp, Homo sapiens
ccatcccttctctggccagcag

SEQ ID NO: 8383051 - DNA, 22 bp, Homo sapiens
cccagagctccggtcctgccca

SEQ ID NO: 8383052 - DNA, 23 bp, Homo sapiens
cccagaggagcagggcgtgagat

SEQ ID NO: 8383053 - DNA, 23 bp, Homo sapiens
cccagaggagcagggcgtgagat

SEQ ID NO: 8383054 - DNA, 19 bp, Homo sapiens
cccagaggaatgcctggaa

SEQ ID NO: 8383055 - DNA, 19 bp, Homo sapiens
cccagaggaatgcctggaa

SEQ ID NO: 8383056 - DNA, 19 bp, Homo sapiens
cccagaggaatgcctggaa

SEQ ID NO: 8383057 - DNA, 18 bp, Homo sapiens
cccagaggaatgcctgga

SEQ ID NO: 8383058 - DNA, 18 bp, Homo sapiens
cccagaggaatgcctgga

SEQ ID NO: 8383059 - DNA, 18 bp, Homo sapiens
cccagaggaatgcctgga

SEQ ID NO: 8383060 - DNA, 22 bp, Homo sapiens
tgcactccaggctgggtgacag

SEQ ID NO: 8383061 - DNA, 22 bp, Homo sapiens
tgcactccaggctgggtgacag

SEQ ID NO: 8383062 - DNA, 22 bp, Homo sapiens
cccaaggccttcaagccagctc

SEQ ID NO: 8383063 - DNA, 23 bp, Homo sapiens
cccaagcctgtgccctctgactc

SEQ ID NO: 8383064 - DNA, 22 bp, Homo sapiens
cccaagcctttcaaaactcaga

SEQ ID NO: 8383065 - DNA, 22 bp, Homo sapiens
tgcaataacccatgagatagaa

SEQ ID NO: 8383066 - DNA, 22 bp, Homo sapiens
tgcaataaggagtaatagtaaa

SEQ ID NO: 8383067 - DNA, 22 bp, Homo sapiens
tgcaataactactttaatgttg

SEQ ID NO: 8383068 - DNA, 22 bp, Homo sapiens
tgcaataagtattgcttacatg

SEQ ID NO: 8383069 - DNA, 22 bp, Homo sapiens
tgcaataagttgtgttatcact

SEQ ID NO: 8383070 - DNA, 22 bp, Homo sapiens
tgcaataatgtatgtcactccc

SEQ ID NO: 8383071 - DNA, 22 bp, Homo sapiens
tgcaatcaggtaccatttgatt

SEQ ID NO: 8383072 - DNA, 22 bp, Homo sapiens
tgataatattttgaatcataag

SEQ ID NO: 8383073 - DNA, 22 bp, Homo sapiens
tgcaataacccagtatctgtga

SEQ ID NO: 8383074 - DNA, 22 bp, Homo sapiens
tgcaataaagtgctataaatcc

SEQ ID NO: 8383075 - DNA, 22 bp, Homo sapiens
cccagcagccttgtcccttctc

SEQ ID NO: 8383076 - DNA, 22 bp, Homo sapiens
cccagcagcctggatgttcttt

SEQ ID NO: 8383077 - DNA, 22 bp, Homo sapiens
cccagcagcctggatgttcttt

SEQ ID NO: 8383078 - DNA, 22 bp, Homo sapiens
cccagcagcttgcacagtgctg

SEQ ID NO: 8383079 - DNA, 22 bp, Homo sapiens
tgcaggccggccctaggcctca

SEQ ID NO: 8383080 - DNA, 21 bp, Homo sapiens
tgcaggcaggcagagatgctg

SEQ ID NO: 8383081 - DNA, 22 bp, Homo sapiens
tgcaggcaggggatgagcagcc

SEQ ID NO: 8383082 - DNA, 22 bp, Homo sapiens
tgcaggcaggggatgagcagcc

SEQ ID NO: 8383083 - DNA, 22 bp, Homo sapiens
tgcaggcataaccgatgttgat

SEQ ID NO: 8383084 - DNA, 22 bp, Homo sapiens
tgcaggcattggtgagagaagc

SEQ ID NO: 8383085 - DNA, 22 bp, Homo sapiens
cccagcaggtcggtgctgcctg

SEQ ID NO: 8383086 - DNA, 22 bp, Homo sapiens
cccagcaggtcggtgctgcctg

SEQ ID NO: 8383087 - DNA, 22 bp, Homo sapiens
cccagcaggtcggtgctgcctg

SEQ ID NO: 8383088 - DNA, 22 bp, Homo sapiens
tgcagggatcctagctgaagag

SEQ ID NO: 8383089 - DNA, 22 bp, Homo sapiens
cccagcagggtctctgtgtcta

SEQ ID NO: 8383090 - DNA, 22 bp, Homo sapiens
cccagcagggtctctgtgtcta

SEQ ID NO: 8383091 - DNA, 22 bp, Homo sapiens
cccagcagggtctctgtgtcta

SEQ ID NO: 8383092 - DNA, 22 bp, Homo sapiens
cccagcaggcatgttgggagga

SEQ ID NO: 8383093 - DNA, 22 bp, Homo sapiens
cccagcaggcatgttgggagga

SEQ ID NO: 8383094 - DNA, 22 bp, Homo sapiens
cccagcaggcatgttgggagga

SEQ ID NO: 8383095 - DNA, 22 bp, Homo sapiens
cccagcaggcatgttgggagga

SEQ ID NO: 8383096 - DNA, 22 bp, Homo sapiens
cccagcaggaggaggttgcagt

SEQ ID NO: 8383097 - DNA, 22 bp, Homo sapiens
cccagcaggaggaggttgcagt

SEQ ID NO: 8383098 - DNA, 22 bp, Homo sapiens
cccagcaggaggaggttgcagt

SEQ ID NO: 8383099 - DNA, 22 bp, Homo sapiens
tgcagctgattaaagggcagac

SEQ ID NO: 8383100 - DNA, 20 bp, Homo sapiens
tgcagctgcaggagggtggg

SEQ ID NO: 8383101 - DNA, 20 bp, Homo sapiens
tgcagctgcaggagggtggg

SEQ ID NO: 8383102 - DNA, 20 bp, Homo sapiens
tgcagctgcaggagggtggg

SEQ ID NO: 8383103 - DNA, 22 bp, Homo sapiens
cccagagggaagggaatgaggt

SEQ ID NO: 8383104 - DNA, 22 bp, Homo sapiens
cccagagggctgaggatatgaa

SEQ ID NO: 8383105 - DNA, 22 bp, Homo sapiens
cccagaggctgagttgggagca

SEQ ID NO: 8383106 - DNA, 22 bp, Homo sapiens
tgcagctgctcattctctcagt

SEQ ID NO: 8383107 - DNA, 22 bp, Homo sapiens
tgcagctgctcattctctcagt

SEQ ID NO: 8383108 - DNA, 22 bp, Homo sapiens
tgcagctgcctagggctggctt

SEQ ID NO: 8383109 - DNA, 22 bp, Homo sapiens
tgcagctgcaggagggtgggag

SEQ ID NO: 8383110 - DNA, 22 bp, Homo sapiens
tgcaggacattagttatgaatt

SEQ ID NO: 8383111 - DNA, 22 bp, Homo sapiens
tgcaggacagtttggaagagag

SEQ ID NO: 8383112 - DNA, 22 bp, Homo sapiens
tgcaggaccttgatcctggact

SEQ ID NO: 8383113 - DNA, 22 bp, Homo sapiens
tgcaggactcaagggtagcagg

SEQ ID NO: 8383114 - DNA, 22 bp, Homo sapiens
tgcaggacttcaggactctgag

SEQ ID NO: 8383115 - DNA, 22 bp, Homo sapiens
tgcaggactggggagcggaagg

SEQ ID NO: 8383116 - DNA, 22 bp, Homo sapiens
ccaggctgtggtttagatagag

SEQ ID NO: 8383117 - DNA, 22 bp, Homo sapiens
tgaaacaattagaatgtaatga

SEQ ID NO: 8383118 - DNA, 22 bp, Homo sapiens
tgaaacaattagaatgtaatga

SEQ ID NO: 8383119 - DNA, 22 bp, Homo sapiens
tcttttgtgattctttagttac

SEQ ID NO: 8383120 - DNA, 22 bp, Homo sapiens
tcttttgtggatgaagaaatgg

SEQ ID NO: 8383121 - DNA, 22 bp, Homo sapiens
tcttttgtgattcttcagttac

SEQ ID NO: 8383122 - DNA, 22 bp, Homo sapiens
tgaaacaaatttggaaaatcta

SEQ ID NO: 8383123 - DNA, 21 bp, Homo sapiens
tgaaacaatcagacagagtct

SEQ ID NO: 8383124 - DNA, 22 bp, Homo sapiens
tcttgcagttgcgcagtgcatg

SEQ ID NO: 8383125 - DNA, 22 bp, Homo sapiens
tcttgcaggcggctcagcaacc

SEQ ID NO: 8383126 - DNA, 22 bp, Homo sapiens
tctttggtttctgtctctgtaa

SEQ ID NO: 8383127 - DNA, 22 bp, Homo sapiens
tcttttgtagctaacacattca

SEQ ID NO: 8383128 - DNA, 22 bp, Homo sapiens
tcttttggaaatgatgtgcagg

SEQ ID NO: 8383129 - DNA, 22 bp, Homo sapiens
ccaggcctgattgggaatcttg

SEQ ID NO: 8383130 - DNA, 22 bp, Homo sapiens
tcttgatttgaattgcagttgt

SEQ ID NO: 8383131 - DNA, 23 bp, Homo sapiens
ccaggcctctcagagggtgtgcc

SEQ ID NO: 8383132 - DNA, 22 bp, Homo sapiens
ccaggcctctggctgcttagtc

SEQ ID NO: 8383133 - DNA, 19 bp, Homo sapiens
ccaggcctctggggcctgt

SEQ ID NO: 8383134 - DNA, 22 bp, Homo sapiens
tcttgcagaaataagtttaaat

SEQ ID NO: 8383135 - DNA, 22 bp, Homo sapiens
tcttgcagaagaagctgccaag

SEQ ID NO: 8383136 - DNA, 22 bp, Homo sapiens
tcttgcagaaaatagtatagat

SEQ ID NO: 8383137 - DNA, 22 bp, Homo sapiens
tcttgattttgtgaataagttg

SEQ ID NO: 8383138 - DNA, 21 bp, Homo sapiens
tcttgattttggacttcttcc

SEQ ID NO: 8383139 - DNA, 22 bp, Homo sapiens
tcttgatttgtaaaagaaggat

SEQ ID NO: 8383140 - DNA, 22 bp, Homo sapiens
tcttgcagactcacaaggtact

SEQ ID NO: 8383141 - DNA, 22 bp, Homo sapiens
tcttgcagacagcttccagcct

SEQ ID NO: 8383142 - DNA, 22 bp, Homo sapiens
tcttgcagagggcccttctgct

SEQ ID NO: 8383143 - DNA, 22 bp, Homo sapiens
tcttgcagagtggttcccctct

SEQ ID NO: 8383144 - DNA, 22 bp, Homo sapiens
tcttgcagaggcactgtgtcag

SEQ ID NO: 8383145 - DNA, 22 bp, Homo sapiens
tcttgcagcttcatctgcaatt

SEQ ID NO: 8383146 - DNA, 22 bp, Homo sapiens
tcttgcaggcatgaaaggactc

SEQ ID NO: 8383147 - DNA, 22 bp, Homo sapiens
tcttgcaggcaaactacctcta

SEQ ID NO: 8383148 - DNA, 20 bp, Homo sapiens
tcttgcagctcctgtaccat

SEQ ID NO: 8383149 - DNA, 19 bp, Homo sapiens
tcttgcagccccagcaggc

SEQ ID NO: 8383150 - DNA, 22 bp, Homo sapiens
ccagggcacgttgggacagtac

SEQ ID NO: 8383151 - DNA, 22 bp, Homo sapiens
ccagggcacgttgggacagtac

SEQ ID NO: 8383152 - DNA, 22 bp, Homo sapiens
ccagggcaggagaaagactcac

SEQ ID NO: 8383153 - DNA, 22 bp, Homo sapiens
ccagggcaaatgagatcatagc

SEQ ID NO: 8383154 - DNA, 22 bp, Homo sapiens
ccagggcaattatttggagggt

SEQ ID NO: 8383155 - DNA, 23 bp, Homo sapiens
ccagggagtgctactatcaagcc

SEQ ID NO: 8383156 - DNA, 22 bp, Homo sapiens
ccagggagggtcctgtggcttc

SEQ ID NO: 8383157 - DNA, 22 bp, Homo sapiens
tgaaatgagatagataatcagg

SEQ ID NO: 8383158 - DNA, 22 bp, Homo sapiens
ccagggaagattagaagccact

SEQ ID NO: 8383159 - DNA, 22 bp, Homo sapiens
ccagggaagctggtcacgcagg

SEQ ID NO: 8383160 - DNA, 22 bp, Homo sapiens
ccagggaagctggtcacgcagg

SEQ ID NO: 8383161 - DNA, 22 bp, Homo sapiens
ccagggaagctggtcacgcagg

SEQ ID NO: 8383162 - DNA, 23 bp, Homo sapiens
ccagggaaggccatcttcaactg

SEQ ID NO: 8383163 - DNA, 22 bp, Homo sapiens
ccagggaaggactctctttccc

SEQ ID NO: 8383164 - DNA, 23 bp, Homo sapiens
ccagggaaggccatcttcaactg

SEQ ID NO: 8383165 - DNA, 17 bp, Homo sapiens
ccagggaggggccgcgc

SEQ ID NO: 8383166 - DNA, 22 bp, Homo sapiens
tgaaggtggggcttaggaatct

SEQ ID NO: 8383167 - DNA, 22 bp, Homo sapiens
tgaaggtgtctttgtgaacatc

SEQ ID NO: 8383168 - DNA, 22 bp, Homo sapiens
tgaaggtgtatgctgtgggtca

SEQ ID NO: 8383169 - DNA, 22 bp, Homo sapiens
tgaagtaggcagcatgctgaga

SEQ ID NO: 8383170 - DNA, 22 bp, Homo sapiens
tgaagtggaccctggacagacc

SEQ ID NO: 8383171 - DNA, 22 bp, Homo sapiens
tgaagtgattagaaccacttga

SEQ ID NO: 8383172 - DNA, 22 bp, Homo sapiens
ccagggctccccagaagtaccc

SEQ ID NO: 8383173 - DNA, 22 bp, Homo sapiens
ccagggctctatgagggtggag

SEQ ID NO: 8383174 - DNA, 22 bp, Homo sapiens
ccagggctgagctgtgaccatg

SEQ ID NO: 8383175 - DNA, 22 bp, Homo sapiens
ccagggctctgcttctgccatg

SEQ ID NO: 8383176 - DNA, 22 bp, Homo sapiens
ccaggcagcaaattttctgaat

SEQ ID NO: 8383177 - DNA, 17 bp, Homo sapiens
tcttctcttccagtctt

SEQ ID NO: 8383178 - DNA, 17 bp, Homo sapiens
tcttctcttccagtctt

SEQ ID NO: 8383179 - DNA, 22 bp, Homo sapiens
tcttcctcatgaattctcgtat

SEQ ID NO: 8383180 - DNA, 22 bp, Homo sapiens
tcttcctcaatgtaacaacccc

SEQ ID NO: 8383181 - DNA, 22 bp, Homo sapiens
tcttagaaatgaagttctttct

SEQ ID NO: 8383182 - DNA, 22 bp, Homo sapiens
tcttagaaactgtatcgattag

SEQ ID NO: 8383183 - DNA, 22 bp, Homo sapiens
ccaggcccccgagcagaagaca

SEQ ID NO: 8383184 - DNA, 22 bp, Homo sapiens
ccaggcaggcgatggtgcagtg

SEQ ID NO: 8383185 - DNA, 22 bp, Homo sapiens
ccaggcaggcgatggtgcagtg

SEQ ID NO: 8383186 - DNA, 19 bp, Homo sapiens
ccaggcctcctgggaggtc

SEQ ID NO: 8383187 - DNA, 22 bp, Homo sapiens
ccaggcctcctgtgagtggacc

SEQ ID NO: 8383188 - DNA, 22 bp, Homo sapiens
ccaggcagcctgctccattctg

SEQ ID NO: 8383189 - DNA, 22 bp, Homo sapiens
ccaggcagccaagtgtgtgtgt

SEQ ID NO: 8383190 - DNA, 22 bp, Homo sapiens
ccaggcaggcagcgttctcagg

SEQ ID NO: 8383191 - DNA, 22 bp, Homo sapiens
ccaggcaggcagcgttctcagg

SEQ ID NO: 8383192 - DNA, 22 bp, Homo sapiens
ccaggcaggcgatggtgcagtg

SEQ ID NO: 8383193 - DNA, 21 bp, Homo sapiens
ccaggcagagctgtgagttct

SEQ ID NO: 8383194 - DNA, 22 bp, Homo sapiens
ccaggcagaatgaaacccctgt

SEQ ID NO: 8383195 - DNA, 22 bp, Homo sapiens
ccaggaggctcttgtccctggt

SEQ ID NO: 8383196 - DNA, 22 bp, Homo sapiens
ccaggaggcggaggttgcagtg

SEQ ID NO: 8383197 - DNA, 22 bp, Homo sapiens
ccaggaggcggaggttgcagtg

SEQ ID NO: 8383198 - DNA, 20 bp, Homo sapiens
tcttacaatcgttacatcca

SEQ ID NO: 8383199 - DNA, 22 bp, Homo sapiens
tcttacaagaaggaaaagggag

SEQ ID NO: 8383200 - DNA, 22 bp, Homo sapiens
tcttacaagtcacccgctttct

SEQ ID NO: 8383201 - DNA, 20 bp, Homo sapiens
tcttacaatcgttacatcca

SEQ ID NO: 8383202 - DNA, 22 bp, Homo sapiens
ccaggcagcaaattttctgaat

SEQ ID NO: 8383203 - DNA, 22 bp, Homo sapiens
tcttaattctgtgtcttcacta

SEQ ID NO: 8383204 - DNA, 22 bp, Homo sapiens
tcttaattgagaacagtgtagg

SEQ ID NO: 8383205 - DNA, 22 bp, Homo sapiens
tcttacaagaaataagccaatg

SEQ ID NO: 8383206 - DNA, 22 bp, Homo sapiens
tcttacaagaaggaaaagggag

SEQ ID NO: 8383207 - DNA, 22 bp, Homo sapiens
tcttacaagaaataagccaatg

SEQ ID NO: 8383208 - DNA, 22 bp, Homo sapiens
ccaggcagagtgctccagaaag

SEQ ID NO: 8383209 - DNA, 22 bp, Homo sapiens
ccaggcagagtgctccagaaag

SEQ ID NO: 8383210 - DNA, 22 bp, Homo sapiens
ccaggcagatgggccggcttca

SEQ ID NO: 8383211 - DNA, 22 bp, Homo sapiens
ccaggcagagggatccccatcc

SEQ ID NO: 8383212 - DNA, 22 bp, Homo sapiens
ccaggcagagggatccccatcc

SEQ ID NO: 8383213 - DNA, 22 bp, Homo sapiens
ccaggcagagggaatagcaagt

SEQ ID NO: 8383214 - DNA, 22 bp, Homo sapiens
ccagcactctgtcccagcttcc

SEQ ID NO: 8383215 - DNA, 22 bp, Homo sapiens
tctgggcctcacctgctgctca

SEQ ID NO: 8383216 - DNA, 22 bp, Homo sapiens
tctgggcctcagtttcttcatc

SEQ ID NO: 8383217 - DNA, 22 bp, Homo sapiens
tctgggcctgtctcagagctgg

SEQ ID NO: 8383218 - DNA, 22 bp, Homo sapiens
tctgggctcacgagtctggaca

SEQ ID NO: 8383219 - DNA, 22 bp, Homo sapiens
tctgggctctgggaattaggga

SEQ ID NO: 8383220 - DNA, 22 bp, Homo sapiens
ccaggagcaaagatcactggga

SEQ ID NO: 8383221 - DNA, 22 bp, Homo sapiens
tctggggagtcaaagagacctg

SEQ ID NO: 8383222 - DNA, 22 bp, Homo sapiens
tctggggataagacccaggtat

SEQ ID NO: 8383223 - DNA, 22 bp, Homo sapiens
tctggggagggagccacaggtc

SEQ ID NO: 8383224 - DNA, 22 bp, Homo sapiens
tctggggaccatggcatctaaa

SEQ ID NO: 8383225 - DNA, 22 bp, Homo sapiens
tctggggacggggcccagcaat

SEQ ID NO: 8383226 - DNA, 22 bp, Homo sapiens
tctggggaatgttcatttctga

SEQ ID NO: 8383227 - DNA, 22 bp, Homo sapiens
tctgttctaagcattctatgtg

SEQ ID NO: 8383228 - DNA, 22 bp, Homo sapiens
tctgttcatgtctttttaagtg

SEQ ID NO: 8383229 - DNA, 22 bp, Homo sapiens
tctgttcttgcttttctccaac

SEQ ID NO: 8383230 - DNA, 22 bp, Homo sapiens
tctgttcttaaagcattcttgc

SEQ ID NO: 8383231 - DNA, 22 bp, Homo sapiens
tctgttctattggtctatgtgt

SEQ ID NO: 8383232 - DNA, 22 bp, Homo sapiens
tctgttcagttgattagacaga

SEQ ID NO: 8383233 - DNA, 22 bp, Homo sapiens
tctgttcaggtttcagagaact

SEQ ID NO: 8383234 - DNA, 22 bp, Homo sapiens
tctgttcagctgcctcagggta

SEQ ID NO: 8383235 - DNA, 23 bp, Homo sapiens
tctgtggctccttcaggctgctg

SEQ ID NO: 8383236 - DNA, 20 bp, Homo sapiens
tctgttattgcatgtacata

SEQ ID NO: 8383237 - DNA, 22 bp, Homo sapiens
ccaggagccactcaggcccaca

SEQ ID NO: 8383238 - DNA, 22 bp, Homo sapiens
ccaggagcagggctggctgcac

SEQ ID NO: 8383239 - DNA, 22 bp, Homo sapiens
ccaggagcagagtaggtgttca

SEQ ID NO: 8383240 - DNA, 22 bp, Homo sapiens
ccaggagcaccaggcctgtgcc

SEQ ID NO: 8383241 - DNA, 22 bp, Homo sapiens
ccaggagcagatatggacataa

SEQ ID NO: 8383242 - DNA, 22 bp, Homo sapiens
ccaggagcaggagctgcagctg

SEQ ID NO: 8383243 - DNA, 22 bp, Homo sapiens
ccaggagcagccggcccacctg

SEQ ID NO: 8383244 - DNA, 22 bp, Homo sapiens
tatattccagttcatctcttga

SEQ ID NO: 8383245 - DNA, 22 bp, Homo sapiens
tatattcattttaaagccatct

SEQ ID NO: 8383246 - DNA, 22 bp, Homo sapiens
tatattctgattccatctgtgt

SEQ ID NO: 8383247 - DNA, 18 bp, Homo sapiens
tatattctgtgccctggt

SEQ ID NO: 8383248 - DNA, 22 bp, Homo sapiens
tatattgtagctgatgacaaat

SEQ ID NO: 8383249 - DNA, 22 bp, Homo sapiens
tatgaacacactttggaagtga

SEQ ID NO: 8383250 - DNA, 22 bp, Homo sapiens
tatgaagaaacctatcctctag

SEQ ID NO: 8383251 - DNA, 22 bp, Homo sapiens
tatgatattctaaattgacacc

SEQ ID NO: 8383252 - DNA, 22 bp, Homo sapiens
tatgaagacaatgatagcatga

SEQ ID NO: 8383253 - DNA, 22 bp, Homo sapiens
tatgcaaagtcctaagaaagaa

SEQ ID NO: 8383254 - DNA, 22 bp, Homo sapiens
tatgcacacatcgcagcaggaa

SEQ ID NO: 8383255 - DNA, 22 bp, Homo sapiens
tatgcacaacatgcaggtttgt

SEQ ID NO: 8383256 - DNA, 22 bp, Homo sapiens
cagtaaaagatggaaatagaat

SEQ ID NO: 8383257 - DNA, 22 bp, Homo sapiens
cagtaattccaagtgcttatac

SEQ ID NO: 8383258 - DNA, 22 bp, Homo sapiens
cagtactgcttgtgggagcaga

SEQ ID NO: 8383259 - DNA, 22 bp, Homo sapiens
tatgtacatcttgagcaatgaa

SEQ ID NO: 8383260 - DNA, 22 bp, Homo sapiens
tatgtacatgatttcatttgct

SEQ ID NO: 8383261 - DNA, 22 bp, Homo sapiens
tatgtacatgatttcatttgct

SEQ ID NO: 8383262 - DNA, 22 bp, Homo sapiens
tatgtacatggagagcaattga

SEQ ID NO: 8383263 - DNA, 22 bp, Homo sapiens
caggtggggcagctgtgggagc

SEQ ID NO: 8383264 - DNA, 22 bp, Homo sapiens
tatgtacatcgttgaattcaaa

SEQ ID NO: 8383265 - DNA, 22 bp, Homo sapiens
caggtggggggcttccgagcct

SEQ ID NO: 8383266 - DNA, 22 bp, Homo sapiens
caggtggggagagtgtggagca

SEQ ID NO: 8383267 - DNA, 22 bp, Homo sapiens
caggtggctgagctgacctttg

SEQ ID NO: 8383268 - DNA, 22 bp, Homo sapiens
caggtggcttagtcccatttta

SEQ ID NO: 8383269 - DNA, 22 bp, Homo sapiens
caggtggcttagtcccatttta

SEQ ID NO: 8383270 - DNA, 22 bp, Homo sapiens
tagtacagtggcattcaaactt

SEQ ID NO: 8383271 - DNA, 22 bp, Homo sapiens
cagggccaccgtgtttgctgct

SEQ ID NO: 8383272 - DNA, 22 bp, Homo sapiens
taggtagtttcctgttgttggg

SEQ ID NO: 8383273 - DNA, 21 bp, Homo sapiens
cagggccaatcctgacctcta

SEQ ID NO: 8383274 - DNA, 22 bp, Homo sapiens
cagggccaccctctgctgggtg

SEQ ID NO: 8383275 - DNA, 22 bp, Homo sapiens
tagtaaattaaaatattgactt

SEQ ID NO: 8383276 - DNA, 22 bp, Homo sapiens
tagtttcttcacctgtaaaatg

SEQ ID NO: 8383277 - DNA, 22 bp, Homo sapiens
tagtttcttgattagccacttt

SEQ ID NO: 8383278 - DNA, 22 bp, Homo sapiens
tagtttctggttcttgctctgg

SEQ ID NO: 8383279 - DNA, 22 bp, Homo sapiens
tagtttctggttcttgctctgg

SEQ ID NO: 8383280 - DNA, 22 bp, Homo sapiens
tagtttctgggttggcttctac

SEQ ID NO: 8383281 - DNA, 22 bp, Homo sapiens
tagtttctgcctcggaagctga

SEQ ID NO: 8383282 - DNA, 22 bp, Homo sapiens
tagtttctgaggattgaaagat

SEQ ID NO: 8383283 - DNA, 22 bp, Homo sapiens
tagtttctgcctcggaagctga

SEQ ID NO: 8383284 - DNA, 22 bp, Homo sapiens
tagtttctagtcaatcttcttt

SEQ ID NO: 8383285 - DNA, 22 bp, Homo sapiens
tagtttctcagggaggaaagaa

SEQ ID NO: 8383286 - DNA, 22 bp, Homo sapiens
tagtttctgaggattgaaagat

SEQ ID NO: 8383287 - DNA, 22 bp, Homo sapiens
tagttttacttgcgatgataat

SEQ ID NO: 8383288 - DNA, 22 bp, Homo sapiens
tagtttctttcacgtagtaata

SEQ ID NO: 8383289 - DNA, 22 bp, Homo sapiens
tagtttctagtaacaaacccat

SEQ ID NO: 8383290 - DNA, 22 bp, Homo sapiens
tagtttctagacagtaagaatt

SEQ ID NO: 8383291 - DNA, 21 bp, Homo sapiens
tagtttctacccagttaatgg

SEQ ID NO: 8383292 - DNA, 22 bp, Homo sapiens
tagtgtctgaatgcacctgttt

SEQ ID NO: 8383293 - DNA, 22 bp, Homo sapiens
tagttttagcagcaatgggatg

SEQ ID NO: 8383294 - DNA, 22 bp, Homo sapiens
tatatacaaggtaggtttaggt

SEQ ID NO: 8383295 - DNA, 22 bp, Homo sapiens
tatataatttgtaaaagcacct

SEQ ID NO: 8383296 - DNA, 22 bp, Homo sapiens
cagtctggaggtcagctggctt

SEQ ID NO: 8383297 - DNA, 22 bp, Homo sapiens
cagtctggaggtcagctggctt

SEQ ID NO: 8383298 - DNA, 22 bp, Homo sapiens
cagtctggaggtcagctggctt

SEQ ID NO: 8383299 - DNA, 22 bp, Homo sapiens
cagtctgggactgagctccacc

SEQ ID NO: 8383300 - DNA, 22 bp, Homo sapiens
cagtcttagccttccctcaccc

SEQ ID NO: 8383301 - DNA, 22 bp, Homo sapiens
cagtcccatctcccaggtggct

SEQ ID NO: 8383302 - DNA, 22 bp, Homo sapiens
cagtcccagtttgagactctgg

SEQ ID NO: 8383303 - DNA, 22 bp, Homo sapiens
tcaaatgtaatttattgtttta

SEQ ID NO: 8383304 - DNA, 22 bp, Homo sapiens
tcaaatgtaatttattgtttta

SEQ ID NO: 8383305 - DNA, 19 bp, Homo sapiens
tcaaattcctaagttctgg

SEQ ID NO: 8383306 - DNA, 22 bp, Homo sapiens
tcaaattcagtgtgacaacatt

SEQ ID NO: 8383307 - DNA, 22 bp, Homo sapiens
tcaaattctattctatactcag

SEQ ID NO: 8383308 - DNA, 22 bp, Homo sapiens
tcaacaaatacttaaagcagag

SEQ ID NO: 8383309 - DNA, 17 bp, Homo sapiens
cagtgaagagacattaa

SEQ ID NO: 8383310 - DNA, 22 bp, Homo sapiens
cagtgaaatcacaactttagtt

SEQ ID NO: 8383311 - DNA, 22 bp, Homo sapiens
cagtctttgacaagccctttca

SEQ ID NO: 8383312 - DNA, 22 bp, Homo sapiens
cagtcttttgtatattagcaga

SEQ ID NO: 8383313 - DNA, 22 bp, Homo sapiens
cagtctttgttcccattactga

SEQ ID NO: 8383314 - DNA, 22 bp, Homo sapiens
cagtctttgatgcatcctagcc

SEQ ID NO: 8383315 - DNA, 22 bp, Homo sapiens
tcaaaagaaacaccatgttcct

SEQ ID NO: 8383316 - DNA, 22 bp, Homo sapiens
tcaaaacctaggctctctgctt

SEQ ID NO: 8383317 - DNA, 22 bp, Homo sapiens
tattcctatttctaaacatatg

SEQ ID NO: 8383318 - DNA, 22 bp, Homo sapiens
tattcctatttctaaacatatg

SEQ ID NO: 8383319 - DNA, 22 bp, Homo sapiens
tcaaagcaatttcaccagtgcc

SEQ ID NO: 8383320 - DNA, 22 bp, Homo sapiens
tcaaagcaatttcaccagtgcc

SEQ ID NO: 8383321 - DNA, 21 bp, Homo sapiens
tcaaagcacatatttgcacat

SEQ ID NO: 8383322 - DNA, 20 bp, Homo sapiens
tcaaagcactgcctgtcatc

SEQ ID NO: 8383323 - DNA, 23 bp, Homo sapiens
tcaaaggaggcatcgttctgcag

SEQ ID NO: 8383324 - DNA, 22 bp, Homo sapiens
tcaaaggagtttaagttactgg

SEQ ID NO: 8383325 - DNA, 22 bp, Homo sapiens
cagtacttggggggttctaagt

SEQ ID NO: 8383326 - DNA, 22 bp, Homo sapiens
cagtacttttctggctttctac

SEQ ID NO: 8383327 - DNA, 22 bp, Homo sapiens
cagtagaattattataaaacat

SEQ ID NO: 8383328 - DNA, 22 bp, Homo sapiens
tattccaactgtcatagtcata

SEQ ID NO: 8383329 - DNA, 22 bp, Homo sapiens
cagtagcatgcttatcttttga

SEQ ID NO: 8383330 - DNA, 22 bp, Homo sapiens
tattccaagtgcctagaagagt

SEQ ID NO: 8383331 - DNA, 22 bp, Homo sapiens
tattccaacttcactattgtct

SEQ ID NO: 8383332 - DNA, 22 bp, Homo sapiens
tattccaccagagatgtgaatt

SEQ ID NO: 8383333 - DNA, 22 bp, Homo sapiens
tattccaattggttgtaaagaa

SEQ ID NO: 8383334 - DNA, 22 bp, Homo sapiens
tattccagatgaaatcattcag

SEQ ID NO: 8383335 - DNA, 22 bp, Homo sapiens
tcactgcaacctctgcctcccg

SEQ ID NO: 8383336 - DNA, 22 bp, Homo sapiens
tcactgcaagctcctcctcctg

SEQ ID NO: 8383337 - DNA, 22 bp, Homo sapiens
tcacatgtcaagaagataattt

SEQ ID NO: 8383338 - DNA, 22 bp, Homo sapiens
tcacatgtcaaaaactacataa

SEQ ID NO: 8383339 - DNA, 22 bp, Homo sapiens
tcacatgtcagtcttaaacaga

SEQ ID NO: 8383340 - DNA, 22 bp, Homo sapiens
tcacatgtgtggcagtgcaagt

SEQ ID NO: 8383341 - DNA, 18 bp, Homo sapiens
tcacattataatgtaaca

SEQ ID NO: 8383342 - DNA, 22 bp, Homo sapiens
tcacattaggaagtaatgttgt

SEQ ID NO: 8383343 - DNA, 22 bp, Homo sapiens
tcacatgtgttttctcaccaac

SEQ ID NO: 8383344 - DNA, 22 bp, Homo sapiens
tcacatgttaggtcgggcaagg

SEQ ID NO: 8383345 - DNA, 22 bp, Homo sapiens
tcacattctagaatgttatcgt

SEQ ID NO: 8383346 - DNA, 22 bp, Homo sapiens
cagtggcaggatttcagctcag

SEQ ID NO: 8383347 - DNA, 22 bp, Homo sapiens
cagtggcaggatttcagctcag

SEQ ID NO: 8383348 - DNA, 21 bp, Homo sapiens
cagtggtttataaacaacaga

SEQ ID NO: 8383349 - DNA, 22 bp, Homo sapiens
cagtggttggtagatacttgag

SEQ ID NO: 8383350 - DNA, 22 bp, Homo sapiens
cagtggtttaggtcaaggggag

SEQ ID NO: 8383351 - DNA, 22 bp, Homo sapiens
cagtggttgcttgcatggctcc

SEQ ID NO: 8383352 - DNA, 22 bp, Homo sapiens
cagtggttgtcagcaacaatat

SEQ ID NO: 8383353 - DNA, 22 bp, Homo sapiens
cagtggcacgatctcagctcac

SEQ ID NO: 8383354 - DNA, 21 bp, Homo sapiens
cagtggcacgatttcggctca

SEQ ID NO: 8383355 - DNA, 22 bp, Homo sapiens
cagtggcacgatctcagctcac

SEQ ID NO: 8383356 - DNA, 22 bp, Homo sapiens
cagtggcacccacgggctgggc

SEQ ID NO: 8383357 - DNA, 22 bp, Homo sapiens
tcactgcagcctctgcctcccg

SEQ ID NO: 8383358 - DNA, 22 bp, Homo sapiens
tcactgcagagacctctagtca

SEQ ID NO: 8383359 - DNA, 22 bp, Homo sapiens
tcactgcactccagcactcagg

SEQ ID NO: 8383360 - DNA, 22 bp, Homo sapiens
cagtggaggccttgggaccttt

SEQ ID NO: 8383361 - DNA, 22 bp, Homo sapiens
tcacatgtatatgcagcacagc

SEQ ID NO: 8383362 - DNA, 22 bp, Homo sapiens
cagtggcaagaacagtaataat

SEQ ID NO: 8383363 - DNA, 22 bp, Homo sapiens
cagtggcaaggacagtaataat

SEQ ID NO: 8383364 - DNA, 19 bp, Homo sapiens
cagtggagattggaggagg

SEQ ID NO: 8383365 - DNA, 19 bp, Homo sapiens
cagtggagattggaggagg

SEQ ID NO: 8383366 - DNA, 22 bp, Homo sapiens
cagtggagaggcatgcttggca

SEQ ID NO: 8383367 - DNA, 22 bp, Homo sapiens
tcacactaagacaaaataattt

SEQ ID NO: 8383368 - DNA, 22 bp, Homo sapiens
cagtgcaggtggcagaggacag

SEQ ID NO: 8383369 - DNA, 22 bp, Homo sapiens
cagtgcagaggtgcaagcatgt

SEQ ID NO: 8383370 - DNA, 22 bp, Homo sapiens
cagtgcaggtttagggctgggg

SEQ ID NO: 8383371 - DNA, 22 bp, Homo sapiens
cagtgcagtcaaggaagaacca

SEQ ID NO: 8383372 - DNA, 22 bp, Homo sapiens
cagtgcagttggtggcaggggt

SEQ ID NO: 8383373 - DNA, 22 bp, Homo sapiens
cagtgcagttggtggcaggggt

SEQ ID NO: 8383374 - DNA, 22 bp, Homo sapiens
cagtgcagtttcccagatgctg

SEQ ID NO: 8383375 - DNA, 22 bp, Homo sapiens
tacagttcctctcgtggaggtg

SEQ ID NO: 8383376 - DNA, 22 bp, Homo sapiens
tacagttccaggatcatagggt

SEQ ID NO: 8383377 - DNA, 22 bp, Homo sapiens
tacagtttaacactttggagaa

SEQ ID NO: 8383378 - DNA, 22 bp, Homo sapiens
tacagtttacatgagaggaagc

SEQ ID NO: 8383379 - DNA, 22 bp, Homo sapiens
caggctcccgaaatcacccatg

SEQ ID NO: 8383380 - DNA, 22 bp, Homo sapiens
tacagtttgtatggtcaggaat

SEQ ID NO: 8383381 - DNA, 22 bp, Homo sapiens
caggctccctgcaggccagtga

SEQ ID NO: 8383382 - DNA, 22 bp, Homo sapiens
caggctccctaagtcagcagcc

SEQ ID NO: 8383383 - DNA, 22 bp, Homo sapiens
caggctccctaagtcagcagcc

SEQ ID NO: 8383384 - DNA, 22 bp, Homo sapiens
caggctcctcactcatgctccc

SEQ ID NO: 8383385 - DNA, 22 bp, Homo sapiens
caggccttgaaggcctgcggga

SEQ ID NO: 8383386 - DNA, 22 bp, Homo sapiens
caggccttgagttttgggcttt

SEQ ID NO: 8383387 - DNA, 22 bp, Homo sapiens
tacagagagaggggttaccagg

SEQ ID NO: 8383388 - DNA, 22 bp, Homo sapiens
tacagagagataagtgtaaaag

SEQ ID NO: 8383389 - DNA, 22 bp, Homo sapiens
tacagagactttatggcacaaa

SEQ ID NO: 8383390 - DNA, 22 bp, Homo sapiens
tacagagacccacaagagactg

SEQ ID NO: 8383391 - DNA, 22 bp, Homo sapiens
tacagagacccacaagagactg

SEQ ID NO: 8383392 - DNA, 22 bp, Homo sapiens
tacagcatgtccttagcaaggc

SEQ ID NO: 8383393 - DNA, 22 bp, Homo sapiens
tacagcagggcgctgtgatgaa

SEQ ID NO: 8383394 - DNA, 22 bp, Homo sapiens
tacagagaggtgacccttgggc

SEQ ID NO: 8383395 - DNA, 22 bp, Homo sapiens
tacagcattttgtagagtacta

SEQ ID NO: 8383396 - DNA, 22 bp, Homo sapiens
tacagccatcatgtatgtatat

SEQ ID NO: 8383397 - DNA, 22 bp, Homo sapiens
tacagcatgtccttagcaaggc

SEQ ID NO: 8383398 - DNA, 22 bp, Homo sapiens
tacagcattaacaggctgttta

SEQ ID NO: 8383399 - DNA, 22 bp, Homo sapiens
tacagccatggttaatttacct

SEQ ID NO: 8383400 - DNA, 22 bp, Homo sapiens
tacagcccaagaagtttatacg

SEQ ID NO: 8383401 - DNA, 22 bp, Homo sapiens
tacagccttcatctttgccttg

SEQ ID NO: 8383402 - DNA, 22 bp, Homo sapiens
tacagcctgttacctatatttg

SEQ ID NO: 8383403 - DNA, 22 bp, Homo sapiens
tacagcctcgaactcctgcatt

SEQ ID NO: 8383404 - DNA, 22 bp, Homo sapiens
cagctctgccacttcctagcta

SEQ ID NO: 8383405 - DNA, 22 bp, Homo sapiens
cagctctgccatcatctgcctt

SEQ ID NO: 8383406 - DNA, 22 bp, Homo sapiens
tacacagaagccagaaggcctg

SEQ ID NO: 8383407 - DNA, 22 bp, Homo sapiens
tacaatagggcttttgtttatg

SEQ ID NO: 8383408 - DNA, 22 bp, Homo sapiens
caggccctcaggcaagggctct

SEQ ID NO: 8383409 - DNA, 22 bp, Homo sapiens
caggccctcgcccgcagcgacc

SEQ ID NO: 8383410 - DNA, 22 bp, Homo sapiens
caggccctcgtggtgagctggg

SEQ ID NO: 8383411 - DNA, 22 bp, Homo sapiens
caggccctgcacagtggtcctg

SEQ ID NO: 8383412 - DNA, 22 bp, Homo sapiens
caggccctgcactaggccctgg

SEQ ID NO: 8383413 - DNA, 22 bp, Homo sapiens
caggccacagctaaagaggatt

SEQ ID NO: 8383414 - DNA, 22 bp, Homo sapiens
tacagagaactcatagaaagaa

SEQ ID NO: 8383415 - DNA, 22 bp, Homo sapiens
tacagacattcaattttgaccc

SEQ ID NO: 8383416 - DNA, 22 bp, Homo sapiens
taccctctcccggtccagcttt

SEQ ID NO: 8383417 - DNA, 22 bp, Homo sapiens
caggctgcaagaaaggcattca

SEQ ID NO: 8383418 - DNA, 22 bp, Homo sapiens
caggctgcagaggcctttcatg

SEQ ID NO: 8383419 - DNA, 22 bp, Homo sapiens
tagaaacaagggagaggattct

SEQ ID NO: 8383420 - DNA, 22 bp, Homo sapiens
tagaaagacaatgggaagtgct

SEQ ID NO: 8383421 - DNA, 22 bp, Homo sapiens
tagaaagacaatgggaagtgct

SEQ ID NO: 8383422 - DNA, 22 bp, Homo sapiens
tagaaagaacttcatgtaaaac

SEQ ID NO: 8383423 - DNA, 22 bp, Homo sapiens
tacctcattacatctgcaatga

SEQ ID NO: 8383424 - DNA, 22 bp, Homo sapiens
tacctcatgctgtacagcacgt

SEQ ID NO: 8383425 - DNA, 22 bp, Homo sapiens
tagaaagagcatagtattataa

SEQ ID NO: 8383426 - DNA, 22 bp, Homo sapiens
tagaaagagcatagtattataa

SEQ ID NO: 8383427 - DNA, 22 bp, Homo sapiens
tagaaagacatgggccagcagc

SEQ ID NO: 8383428 - DNA, 19 bp, Homo sapiens
tagaaagatgatgggtggg

SEQ ID NO: 8383429 - DNA, 22 bp, Homo sapiens
tagaaagatctgtaggcaagag

SEQ ID NO: 8383430 - DNA, 22 bp, Homo sapiens
tagaaagatctgtaggcaagag

SEQ ID NO: 8383431 - DNA, 22 bp, Homo sapiens
tagacagtgagctatgagtggt

SEQ ID NO: 8383432 - DNA, 22 bp, Homo sapiens
tagacattatgtattaagttct

SEQ ID NO: 8383433 - DNA, 22 bp, Homo sapiens
tagacatttgaatgtgaaatga

SEQ ID NO: 8383434 - DNA, 22 bp, Homo sapiens
tagacatttctggttattgaca

SEQ ID NO: 8383435 - DNA, 22 bp, Homo sapiens
tagacatttggcatggttttca

SEQ ID NO: 8383436 - DNA, 22 bp, Homo sapiens
cagggagaggcatcatagggaa

SEQ ID NO: 8383437 - DNA, 22 bp, Homo sapiens
cagggagaggcatcatagggaa

SEQ ID NO: 8383438 - DNA, 22 bp, Homo sapiens
cagggagaggcctctgttgccc

SEQ ID NO: 8383439 - DNA, 22 bp, Homo sapiens
tagaaatgttagatgtattgag

SEQ ID NO: 8383440 - DNA, 22 bp, Homo sapiens
tagaaatgttagatgtattgag

SEQ ID NO: 8383441 - DNA, 22 bp, Homo sapiens
tagaaagcatgcaagtttgatg

SEQ ID NO: 8383442 - DNA, 22 bp, Homo sapiens
tagaaatgtgataatagcttaa

SEQ ID NO: 8383443 - DNA, 22 bp, Homo sapiens
tagaacaggctgtcagagcggg

SEQ ID NO: 8383444 - DNA, 22 bp, Homo sapiens
tagaacagagttccagtgatca

SEQ ID NO: 8383445 - DNA, 22 bp, Homo sapiens
cagggacagccttggggtggcg

SEQ ID NO: 8383446 - DNA, 22 bp, Homo sapiens
cagggacagcgggactctgaca

SEQ ID NO: 8383447 - DNA, 22 bp, Homo sapiens
cagggagaagtctggtcagtcc

SEQ ID NO: 8383448 - DNA, 22 bp, Homo sapiens
cagggatgagaaagctctctaa

SEQ ID NO: 8383449 - DNA, 22 bp, Homo sapiens
cagggagggacaattgtcacct

SEQ ID NO: 8383450 - DNA, 22 bp, Homo sapiens
cagggagggaggaaaatttgct

SEQ ID NO: 8383451 - DNA, 22 bp, Homo sapiens
cagggagcggagtcccatgcct

SEQ ID NO: 8383452 - DNA, 22 bp, Homo sapiens
cagggagcctgaatgttccagg

SEQ ID NO: 8383453 - DNA, 22 bp, Homo sapiens
tagacatttgtcaagaatgact

SEQ ID NO: 8383454 - DNA, 22 bp, Homo sapiens
cagggagctttgtcttctcatt

SEQ ID NO: 8383455 - DNA, 22 bp, Homo sapiens
cagggaggctgtcttatgcctg

SEQ ID NO: 8383456 - DNA, 22 bp, Homo sapiens
cagggatgagcagatggagcaa

SEQ ID NO: 8383457 - DNA, 22 bp, Homo sapiens
cagggatgctgcttaggcagtt

SEQ ID NO: 8383458 - DNA, 22 bp, Homo sapiens
cagggatggcctggcgggccac

SEQ ID NO: 8383459 - DNA, 21 bp, Homo sapiens
tagcaattatagatgtctaaa

SEQ ID NO: 8383460 - DNA, 22 bp, Homo sapiens
tagcagcaattcaggtgtgatg

SEQ ID NO: 8383461 - DNA, 22 bp, Homo sapiens
tagcagcaatttcagaagtttg

SEQ ID NO: 8383462 - DNA, 22 bp, Homo sapiens
tagcagcacagaaagcctggag

SEQ ID NO: 8383463 - DNA, 22 bp, Homo sapiens
cagggcagttttacttctctct

SEQ ID NO: 8383464 - DNA, 22 bp, Homo sapiens
cagggcataagatgaggctgta

SEQ ID NO: 8383465 - DNA, 22 bp, Homo sapiens
cagggcagtaccgccctctggc

SEQ ID NO: 8383466 - DNA, 22 bp, Homo sapiens
cagggcagtgaagaacacacgt

SEQ ID NO: 8383467 - DNA, 22 bp, Homo sapiens
cagggcagtgaagaacacacgt

SEQ ID NO: 8383468 - DNA, 22 bp, Homo sapiens
cagggcagtttgtgcctatgag

SEQ ID NO: 8383469 - DNA, 22 bp, Homo sapiens
cagggcagtttgtgcctatgag

SEQ ID NO: 8383470 - DNA, 22 bp, Homo sapiens
tagcagtgtctaggtaggccat

SEQ ID NO: 8383471 - DNA, 22 bp, Homo sapiens
tagcataacaggtaagagtgag

SEQ ID NO: 8383472 - DNA, 22 bp, Homo sapiens
tagcagtgtctaggtaggccat

SEQ ID NO: 8383473 - DNA, 22 bp, Homo sapiens
tagcagtgtctaggtaggccat

SEQ ID NO: 8383474 - DNA, 18 bp, Homo sapiens
tagcagcactggccgctt

SEQ ID NO: 8383475 - DNA, 22 bp, Homo sapiens
tagcagcactatttgttgtagt

SEQ ID NO: 8383476 - DNA, 22 bp, Homo sapiens
tagcatctttttctgtcttcta

SEQ ID NO: 8383477 - DNA, 22 bp, Homo sapiens
tagcattaaaggtaagacatta

SEQ ID NO: 8383478 - DNA, 22 bp, Homo sapiens
tagcattaaaggtaagacatta

SEQ ID NO: 8383479 - DNA, 22 bp, Homo sapiens
tagcattagtcagatatgtttt

SEQ ID NO: 8383480 - DNA, 22 bp, Homo sapiens
tagcatctgcatttgtaactag

SEQ ID NO: 8383481 - DNA, 22 bp, Homo sapiens
tagcatctggagaaacaagtcc

SEQ ID NO: 8383482 - DNA, 22 bp, Homo sapiens
ccacagctgacaatggatagac

SEQ ID NO: 8383483 - DNA, 22 bp, Homo sapiens
ccacaggctgctgcaggtcccg

SEQ ID NO: 8383484 - DNA, 22 bp, Homo sapiens
tcctggccttagcgaggcggtc

SEQ ID NO: 8383485 - DNA, 22 bp, Homo sapiens
tcctggccttatccccaaactg

SEQ ID NO: 8383486 - DNA, 22 bp, Homo sapiens
tcctggctccactgagcaggcc

SEQ ID NO: 8383487 - DNA, 22 bp, Homo sapiens
ccaccaggacagccctgagggg

SEQ ID NO: 8383488 - DNA, 22 bp, Homo sapiens
tcctgccttagagcaaggaaaa

SEQ ID NO: 8383489 - DNA, 22 bp, Homo sapiens
tcctgccttagagcaaggaaaa

SEQ ID NO: 8383490 - DNA, 21 bp, Homo sapiens
tcctgccttagtccagagcag

SEQ ID NO: 8383491 - DNA, 22 bp, Homo sapiens
tcctgccttcatactgctgtat

SEQ ID NO: 8383492 - DNA, 22 bp, Homo sapiens
tcctgccttgcctgggacatca

SEQ ID NO: 8383493 - DNA, 22 bp, Homo sapiens
ccaagagctacagatatgaaat

SEQ ID NO: 8383494 - DNA, 22 bp, Homo sapiens
tcctgaggtggattgagcagag

SEQ ID NO: 8383495 - DNA, 23 bp, Homo sapiens
tcctgagggtttcccagccttgg

SEQ ID NO: 8383496 - DNA, 22 bp, Homo sapiens
tcctgagggctgcagtcatagg

SEQ ID NO: 8383497 - DNA, 19 bp, Homo sapiens
cattttctcattgtgcccc

SEQ ID NO: 8383498 - DNA, 22 bp, Homo sapiens
cattttgtgctagacactatgg

SEQ ID NO: 8383499 - DNA, 22 bp, Homo sapiens
cattttcctctgctggtgttca

SEQ ID NO: 8383500 - DNA, 22 bp, Homo sapiens
cattttctcaatgaaccctctt

SEQ ID NO: 8383501 - DNA, 22 bp, Homo sapiens
tcctgagggactggttcctcgc

SEQ ID NO: 8383502 - DNA, 22 bp, Homo sapiens
tcctgagggctcggggctcatg

SEQ ID NO: 8383503 - DNA, 22 bp, Homo sapiens
tcctgagggctcggggctcatg

SEQ ID NO: 8383504 - DNA, 22 bp, Homo sapiens
tcctgagggcgattcagcaggt

SEQ ID NO: 8383505 - DNA, 22 bp, Homo sapiens
catttctagggatcataaagta

SEQ ID NO: 8383506 - DNA, 21 bp, Homo sapiens
catttctattgatgagaaaag

SEQ ID NO: 8383507 - DNA, 22 bp, Homo sapiens
cattttcagcacccatctgaaa

SEQ ID NO: 8383508 - DNA, 22 bp, Homo sapiens
cattttatgtttatggagtgct

SEQ ID NO: 8383509 - DNA, 21 bp, Homo sapiens
catttcatgattatagaaatg

SEQ ID NO: 8383510 - DNA, 22 bp, Homo sapiens
catttcattcctttgaaagtgg

SEQ ID NO: 8383511 - DNA, 22 bp, Homo sapiens
catttccactctgggagtcaga

SEQ ID NO: 8383512 - DNA, 20 bp, Homo sapiens
catttcattgtgtcttcact

SEQ ID NO: 8383513 - DNA, 22 bp, Homo sapiens
catttcactattcactaaaagg

SEQ ID NO: 8383514 - DNA, 22 bp, Homo sapiens
catttcatagttgtcacaataa

SEQ ID NO: 8383515 - DNA, 22 bp, Homo sapiens
catttccagctcctgcatcatg

SEQ ID NO: 8383516 - DNA, 22 bp, Homo sapiens
catttccttcctgctgctcctc

SEQ ID NO: 8383517 - DNA, 22 bp, Homo sapiens
catttcctgtctggaggtcaaa

SEQ ID NO: 8383518 - DNA, 22 bp, Homo sapiens
catttctagggatcataaagta

SEQ ID NO: 8383519 - DNA, 22 bp, Homo sapiens
tccatagtgaatgggtaatgca

SEQ ID NO: 8383520 - DNA, 22 bp, Homo sapiens
catttcacagtaaagtgatttc

SEQ ID NO: 8383521 - DNA, 22 bp, Homo sapiens
catttattggcatgtagtaggt

SEQ ID NO: 8383522 - DNA, 20 bp, Homo sapiens
tccagttttggagacattct

SEQ ID NO: 8383523 - DNA, 16 bp, Homo sapiens
tccagttttcagcact

SEQ ID NO: 8383524 - DNA, 19 bp, Homo sapiens
tccagtttggcaggaagac

SEQ ID NO: 8383525 - DNA, 22 bp, Homo sapiens
tccagtttgcactgtataatag

SEQ ID NO: 8383526 - DNA, 22 bp, Homo sapiens
tccaggtcctactggcccatag

SEQ ID NO: 8383527 - DNA, 22 bp, Homo sapiens
ccagaggctgggttcacctcag

SEQ ID NO: 8383528 - DNA, 22 bp, Homo sapiens
ccagagccggctccctcagctt

SEQ ID NO: 8383529 - DNA, 22 bp, Homo sapiens
ccagagcccgggacctggactt

SEQ ID NO: 8383530 - DNA, 22 bp, Homo sapiens
ccagagcagggcagcagggctc

SEQ ID NO: 8383531 - DNA, 22 bp, Homo sapiens
tctctgggataaactgggccag

SEQ ID NO: 8383532 - DNA, 22 bp, Homo sapiens
tctctgggataaactgggccag

SEQ ID NO: 8383533 - DNA, 22 bp, Homo sapiens
ccagaggtctcctgcacgggat

SEQ ID NO: 8383534 - DNA, 22 bp, Homo sapiens
ccagaggtcccctgccaggagg

SEQ ID NO: 8383535 - DNA, 22 bp, Homo sapiens
ccagaggtcccctgccaggagg

SEQ ID NO: 8383536 - DNA, 22 bp, Homo sapiens
ccagatgttcccctggaggcct

SEQ ID NO: 8383537 - DNA, 22 bp, Homo sapiens
ccagcaagtgcagatggccaag

SEQ ID NO: 8383538 - DNA, 22 bp, Homo sapiens
tctctgtaaggaagaattagat

SEQ ID NO: 8383539 - DNA, 22 bp, Homo sapiens
tctagaaagtttgtactgattt

SEQ ID NO: 8383540 - DNA, 22 bp, Homo sapiens
tctagaatagattctgctgatc

SEQ ID NO: 8383541 - DNA, 21 bp, Homo sapiens
tctagaatcctgtataagact

SEQ ID NO: 8383542 - DNA, 22 bp, Homo sapiens
tcctgttgttcgcctgcgatgg

SEQ ID NO: 8383543 - DNA, 22 bp, Homo sapiens
tcctgtgttacccttgcagtga

SEQ ID NO: 8383544 - DNA, 22 bp, Homo sapiens
ccaccctgccttgggccagtga

SEQ ID NO: 8383545 - DNA, 20 bp, Homo sapiens
ccaccctgctaagaatacac

SEQ ID NO: 8383546 - DNA, 20 bp, Homo sapiens
ccaccctgctaagaatacac

SEQ ID NO: 8383547 - DNA, 20 bp, Homo sapiens
tcctgtgtgtctcatcaacc

SEQ ID NO: 8383548 - DNA, 18 bp, Homo sapiens
ccacccagggggagagga

SEQ ID NO: 8383549 - DNA, 22 bp, Homo sapiens
ccaccaggcactcacagggaag

SEQ ID NO: 8383550 - DNA, 22 bp, Homo sapiens
ccacccctgggtgcagggagcg

SEQ ID NO: 8383551 - DNA, 22 bp, Homo sapiens
ccacccatgtgactacctcatg

SEQ ID NO: 8383552 - DNA, 19 bp, Homo sapiens
ccacccctttgctgggccc

SEQ ID NO: 8383553 - DNA, 19 bp, Homo sapiens
ccacccctttgctgggccc

SEQ ID NO: 8383554 - DNA, 22 bp, Homo sapiens
ccacccctgtagagggacagac

SEQ ID NO: 8383555 - DNA, 22 bp, Homo sapiens
ccacccctgtagagggacagac

SEQ ID NO: 8383556 - DNA, 22 bp, Homo sapiens
tctcaggagccacagcgggagt

SEQ ID NO: 8383557 - DNA, 17 bp, Homo sapiens
tctcaggcacgtgtggc

SEQ ID NO: 8383558 - DNA, 22 bp, Homo sapiens
tctcaggatctaatacatggta

SEQ ID NO: 8383559 - DNA, 22 bp, Homo sapiens
tctcaggatctaatacatggta

SEQ ID NO: 8383560 - DNA, 22 bp, Homo sapiens
tctcagtggatctcagaatttt

SEQ ID NO: 8383561 - DNA, 22 bp, Homo sapiens
tctcaggcattcccacatagaa

SEQ ID NO: 8383562 - DNA, 22 bp, Homo sapiens
tctcagtgggaagggcacagtt

SEQ ID NO: 8383563 - DNA, 22 bp, Homo sapiens
tctcagtgggaagggcacagtt

SEQ ID NO: 8383564 - DNA, 22 bp, Homo sapiens
tctcagtgtttaaaaagatttc

SEQ ID NO: 8383565 - DNA, 22 bp, Homo sapiens
tctataaatgcagatatgtgtg

SEQ ID NO: 8383566 - DNA, 22 bp, Homo sapiens
tctagaatttgcgtaggttaga

SEQ ID NO: 8383567 - DNA, 22 bp, Homo sapiens
tctataaatgcagatatgtgtg

SEQ ID NO: 8383568 - DNA, 22 bp, Homo sapiens
tctataaattatgcagtctcag

SEQ ID NO: 8383569 - DNA, 22 bp, Homo sapiens
tctataatcctatttcaactgc

SEQ ID NO: 8383570 - DNA, 21 bp, Homo sapiens
tctataatatgcaggtcatca

SEQ ID NO: 8383571 - DNA, 22 bp, Homo sapiens
tctataatcctatttcaactgc

SEQ ID NO: 8383572 - DNA, 22 bp, Homo sapiens
tctataatggaaagtggatgtg

SEQ ID NO: 8383573 - DNA, 22 bp, Homo sapiens
tctatacaagtttcactttgac

SEQ ID NO: 8383574 - DNA, 22 bp, Homo sapiens
tctcaggaatagagtggcagca

SEQ ID NO: 8383575 - DNA, 22 bp, Homo sapiens
tctcagagaagtgatgagcaat

SEQ ID NO: 8383576 - DNA, 22 bp, Homo sapiens
tctatagacttggacatatagt

SEQ ID NO: 8383577 - DNA, 22 bp, Homo sapiens
tctatacacacaaagaatgctt

SEQ ID NO: 8383578 - DNA, 23 bp, Homo sapiens
tctatacatactgcagcctctgg

SEQ ID NO: 8383579 - DNA, 22 bp, Homo sapiens
tctatacatgtgcacacacatc

SEQ ID NO: 8383580 - DNA, 22 bp, Homo sapiens
tcacttaaaaattctagttatg

SEQ ID NO: 8383581 - DNA, 22 bp, Homo sapiens
cagtgtcctcagccagcagcta

SEQ ID NO: 8383582 - DNA, 22 bp, Homo sapiens
cagtgtcaggatcagtatattt

SEQ ID NO: 8383583 - DNA, 22 bp, Homo sapiens
cagtgtacttggaatgtaacag

SEQ ID NO: 8383584 - DNA, 22 bp, Homo sapiens
cagtgtcaccaggcgagtctcc

SEQ ID NO: 8383585 - DNA, 22 bp, Homo sapiens
cagtgtataaactttaacatag

SEQ ID NO: 8383586 - DNA, 22 bp, Homo sapiens
cagtggttttgagattcagggt

SEQ ID NO: 8383587 - DNA, 22 bp, Homo sapiens
cagtggttttatatctaagctt

SEQ ID NO: 8383588 - DNA, 22 bp, Homo sapiens
cagtggttttcagctgggagtt

SEQ ID NO: 8383589 - DNA, 22 bp, Homo sapiens
cagtggtttccaaacttgttcc

SEQ ID NO: 8383590 - DNA, 22 bp, Homo sapiens
cagtggtttctgaacagtgtgc

SEQ ID NO: 8383591 - DNA, 22 bp, Homo sapiens
tcaggaggccggcaggatttga

SEQ ID NO: 8383592 - DNA, 22 bp, Homo sapiens
tcaggaggccaccaggacctgt

SEQ ID NO: 8383593 - DNA, 22 bp, Homo sapiens
tcaggaggcgtctcgctggggc

SEQ ID NO: 8383594 - DNA, 22 bp, Homo sapiens
tcaggcagaattatcaaaagat

SEQ ID NO: 8383595 - DNA, 22 bp, Homo sapiens
tcaggcagaattatcaaaagat

SEQ ID NO: 8383596 - DNA, 22 bp, Homo sapiens
tcaggcagaaaaatcactaatt

SEQ ID NO: 8383597 - DNA, 22 bp, Homo sapiens
tcaggagggagtgtggatagag

SEQ ID NO: 8383598 - DNA, 22 bp, Homo sapiens
catcaacagtgtcagatgatgc

SEQ ID NO: 8383599 - DNA, 22 bp, Homo sapiens
catcaatgtgcagagatgaacg

SEQ ID NO: 8383600 - DNA, 22 bp, Homo sapiens
tcaggctgcagctgtcagcagc

SEQ ID NO: 8383601 - DNA, 22 bp, Homo sapiens
tcaggctgcatctgtaagggtg

SEQ ID NO: 8383602 - DNA, 22 bp, Homo sapiens
tcaggctgcccgttcagggctc

SEQ ID NO: 8383603 - DNA, 18 bp, Homo sapiens
tcaggctgccctgtgtct

SEQ ID NO: 8383604 - DNA, 22 bp, Homo sapiens
catcacattagtctcaagagaa

SEQ ID NO: 8383605 - DNA, 22 bp, Homo sapiens
catcagagtcagagctctttct

SEQ ID NO: 8383606 - DNA, 22 bp, Homo sapiens
tcaggcagaccaccgtgggcag

SEQ ID NO: 8383607 - DNA, 22 bp, Homo sapiens
tcaggcagagctgtggagctct

SEQ ID NO: 8383608 - DNA, 22 bp, Homo sapiens
tcaggcagaccaccgtgggcag

SEQ ID NO: 8383609 - DNA, 22 bp, Homo sapiens
tcaggcagaccaccgtgggcag

SEQ ID NO: 8383610 - DNA, 22 bp, Homo sapiens
tcaggcagaggatggggagcgt

SEQ ID NO: 8383611 - DNA, 19 bp, Homo sapiens
catatttttgggctggcat

SEQ ID NO: 8383612 - DNA, 22 bp, Homo sapiens
catcaaataggaatatttggca

SEQ ID NO: 8383613 - DNA, 22 bp, Homo sapiens
catcaaatactacatgggttgg

SEQ ID NO: 8383614 - DNA, 22 bp, Homo sapiens
catcaaatctgacttttcttcc

SEQ ID NO: 8383615 - DNA, 22 bp, Homo sapiens
catcaaataaagaaattccttg

SEQ ID NO: 8383616 - DNA, 22 bp, Homo sapiens
catcaaagttggtatatttgca

SEQ ID NO: 8383617 - DNA, 22 bp, Homo sapiens
catcagcactatgattaaagta

SEQ ID NO: 8383618 - DNA, 22 bp, Homo sapiens
catcagctcttcattcttgatt

SEQ ID NO: 8383619 - DNA, 22 bp, Homo sapiens
catcagtaaggcaacatagctt

SEQ ID NO: 8383620 - DNA, 22 bp, Homo sapiens
catcaggaggagatgaagaaaa

SEQ ID NO: 8383621 - DNA, 22 bp, Homo sapiens
catcaggagaccaggtcctgct

SEQ ID NO: 8383622 - DNA, 22 bp, Homo sapiens
catcaggatctctctggaatgc

SEQ ID NO: 8383623 - DNA, 22 bp, Homo sapiens
catcaggataagttccaggtgg

SEQ ID NO: 8383624 - DNA, 22 bp, Homo sapiens
catcaggaaaaaactggagcca

SEQ ID NO: 8383625 - DNA, 22 bp, Homo sapiens
catcaggaaaaaactggagcca

SEQ ID NO: 8383626 - DNA, 22 bp, Homo sapiens
catcaggaaaggacgtctagcc

SEQ ID NO: 8383627 - DNA, 22 bp, Homo sapiens
catcaggaattatcctaattat

SEQ ID NO: 8383628 - DNA, 22 bp, Homo sapiens
catcaggaataaatgaggctgt

SEQ ID NO: 8383629 - DNA, 22 bp, Homo sapiens
catcaggacagcttcttttcac

SEQ ID NO: 8383630 - DNA, 20 bp, Homo sapiens
catcaggaccctcagttttt

SEQ ID NO: 8383631 - DNA, 22 bp, Homo sapiens
tcagtgtgtagtaaattgtagg

SEQ ID NO: 8383632 - DNA, 22 bp, Homo sapiens
tcagtgtgcacatggtagcagt

SEQ ID NO: 8383633 - DNA, 23 bp, Homo sapiens
tcagtgtgcaagaatggagaagc

SEQ ID NO: 8383634 - DNA, 22 bp, Homo sapiens
tcagtgtggcccagggaagcag

SEQ ID NO: 8383635 - DNA, 22 bp, Homo sapiens
tcagtgtcttgggcttgaatgc

SEQ ID NO: 8383636 - DNA, 22 bp, Homo sapiens
tcagtgtgaattcattttagat

SEQ ID NO: 8383637 - DNA, 22 bp, Homo sapiens
catcataataacccagacacag

SEQ ID NO: 8383638 - DNA, 22 bp, Homo sapiens
catcataaaattgagataactg

SEQ ID NO: 8383639 - DNA, 22 bp, Homo sapiens
tcagtgtcttgacctgggtgtg

SEQ ID NO: 8383640 - DNA, 22 bp, Homo sapiens
tcagtgtcttctctttcctacc

SEQ ID NO: 8383641 - DNA, 22 bp, Homo sapiens
tcagtgctgtaaacaaaaggaa

SEQ ID NO: 8383642 - DNA, 22 bp, Homo sapiens
tcagtgctgtgtaaatgtatta

SEQ ID NO: 8383643 - DNA, 22 bp, Homo sapiens
catctacactgattaggtgaac

SEQ ID NO: 8383644 - DNA, 22 bp, Homo sapiens
catctagaaaaaagacctgttg

SEQ ID NO: 8383645 - DNA, 22 bp, Homo sapiens
tcagtttcattatccataaaat

SEQ ID NO: 8383646 - DNA, 22 bp, Homo sapiens
tcagtgtgtagtaaattgtagg

SEQ ID NO: 8383647 - DNA, 22 bp, Homo sapiens
catccgcatgcaagtgctgtcc

SEQ ID NO: 8383648 - DNA, 22 bp, Homo sapiens
catccttcaaaggctacaatta

SEQ ID NO: 8383649 - DNA, 22 bp, Homo sapiens
catcgtgtctaggtgtgcagca

SEQ ID NO: 8383650 - DNA, 22 bp, Homo sapiens
catccttctcaaagagtgcatg

SEQ ID NO: 8383651 - DNA, 22 bp, Homo sapiens
tcatcagagctcccccaaacgt

SEQ ID NO: 8383652 - DNA, 22 bp, Homo sapiens
tcatcagagctcccccaaacgt

SEQ ID NO: 8383653 - DNA, 22 bp, Homo sapiens
tcatcactcattggacaacaga

SEQ ID NO: 8383654 - DNA, 22 bp, Homo sapiens
tcataatacaaagagttctgca

SEQ ID NO: 8383655 - DNA, 22 bp, Homo sapiens
tcataatgtagttcatggctgg

SEQ ID NO: 8383656 - DNA, 22 bp, Homo sapiens
tcataatgaccccagagtccgc

SEQ ID NO: 8383657 - DNA, 22 bp, Homo sapiens
tcataattgtatacatttatgg

SEQ ID NO: 8383658 - DNA, 22 bp, Homo sapiens
tcatacaactaagagtttcaga

SEQ ID NO: 8383659 - DNA, 22 bp, Homo sapiens
tcatacaactaagagtttcaga

SEQ ID NO: 8383660 - DNA, 22 bp, Homo sapiens
tcatacaagatcactttggcca

SEQ ID NO: 8383661 - DNA, 22 bp, Homo sapiens
tcatacaaggagggtgttcaaa

SEQ ID NO: 8383662 - DNA, 22 bp, Homo sapiens
tcatacaaggagggtgttcaaa

SEQ ID NO: 8383663 - DNA, 22 bp, Homo sapiens
tcatacaattcaatctctgatt

SEQ ID NO: 8383664 - DNA, 22 bp, Homo sapiens
tcatacaattcaatctctgatt

SEQ ID NO: 8383665 - DNA, 22 bp, Homo sapiens
catgctctagattctctctaat

SEQ ID NO: 8383666 - DNA, 22 bp, Homo sapiens
catgctctctggcaacttgtgt

SEQ ID NO: 8383667 - DNA, 22 bp, Homo sapiens
catgctatataggaagagcact

SEQ ID NO: 8383668 - DNA, 22 bp, Homo sapiens
catgctatttatacataagtct

SEQ ID NO: 8383669 - DNA, 22 bp, Homo sapiens
catgccacatggacttcaaacc

SEQ ID NO: 8383670 - DNA, 22 bp, Homo sapiens
tcatcaggaaacttatgcagtg

SEQ ID NO: 8383671 - DNA, 22 bp, Homo sapiens
catgcattttctattcactcag

SEQ ID NO: 8383672 - DNA, 22 bp, Homo sapiens
tcatcagtcagaacttaagctt

SEQ ID NO: 8383673 - DNA, 22 bp, Homo sapiens
catgctgggccttgggtgcact

SEQ ID NO: 8383674 - DNA, 22 bp, Homo sapiens
catgctggtcagccagtggatg

SEQ ID NO: 8383675 - DNA, 22 bp, Homo sapiens
tccaagaagcttacaatctaat

SEQ ID NO: 8383676 - DNA, 22 bp, Homo sapiens
tccaagaagtttcgttaaatgt

SEQ ID NO: 8383677 - DNA, 22 bp, Homo sapiens
tccaagagaatactggagagta

SEQ ID NO: 8383678 - DNA, 18 bp, Homo sapiens
tccagaggtgttggagcc

SEQ ID NO: 8383679 - DNA, 22 bp, Homo sapiens
tccagaggtgaacacccaggca

SEQ ID NO: 8383680 - DNA, 18 bp, Homo sapiens
tccagagagggagaagtg

SEQ ID NO: 8383681 - DNA, 22 bp, Homo sapiens
tccagcagaaccagagacctgg

SEQ ID NO: 8383682 - DNA, 22 bp, Homo sapiens
tccagcagaaccagagacctgg

SEQ ID NO: 8383683 - DNA, 22 bp, Homo sapiens
tccagcagaaaagaggtaggga

SEQ ID NO: 8383684 - DNA, 22 bp, Homo sapiens
tccagcacctggaggcgtcccc

SEQ ID NO: 8383685 - DNA, 22 bp, Homo sapiens
tccagcacctggaggcgtcccc

SEQ ID NO: 8383686 - DNA, 22 bp, Homo sapiens
tccagcactcgcccagggcttg

SEQ ID NO: 8383687 - DNA, 21 bp, Homo sapiens
tccagcacagatgacctcccc

SEQ ID NO: 8383688 - DNA, 22 bp, Homo sapiens
catgcttcatgcaaaattctga

SEQ ID NO: 8383689 - DNA, 22 bp, Homo sapiens
catgcttcctccaaactaccct

SEQ ID NO: 8383690 - DNA, 22 bp, Homo sapiens
catgcttcatgcaaaattctga

SEQ ID NO: 8383691 - DNA, 22 bp, Homo sapiens
catgcttttttctagtataaat

SEQ ID NO: 8383692 - DNA, 22 bp, Homo sapiens
catgcttttcaatctatcttaa

SEQ ID NO: 8383693 - DNA, 22 bp, Homo sapiens
catgctttgggtcagaaatgcc

SEQ ID NO: 8383694 - DNA, 22 bp, Homo sapiens
catgctttctgtccaaatgtta

SEQ ID NO: 8383695 - DNA, 22 bp, Homo sapiens
catgctttctgtccaaatgtta

SEQ ID NO: 8383696 - DNA, 22 bp, Homo sapiens
catgtacaaaaggcaaatgcct

SEQ ID NO: 8383697 - DNA, 22 bp, Homo sapiens
catgtaaaaaattaggtcatct

SEQ ID NO: 8383698 - DNA, 19 bp, Homo sapiens
catggtgaaaccccgtctc

SEQ ID NO: 8383699 - DNA, 23 bp, Homo sapiens
catggaaaactgaaagctgacct

SEQ ID NO: 8383700 - DNA, 22 bp, Homo sapiens
catgtgggacaatctcaggtat

SEQ ID NO: 8383701 - DNA, 22 bp, Homo sapiens
catgtgtaaggctcacaggcag

SEQ ID NO: 8383702 - DNA, 22 bp, Homo sapiens
catgtgggactcctgctgtttt

SEQ ID NO: 8383703 - DNA, 22 bp, Homo sapiens
catgtgggttattgggttctag

SEQ ID NO: 8383704 - DNA, 22 bp, Homo sapiens
catgttttctaggctttcacaa

SEQ ID NO: 8383705 - DNA, 22 bp, Homo sapiens
catgtggctttggcatgtgccc

SEQ ID NO: 8383706 - DNA, 22 bp, Homo sapiens
catgtacacacaaagggacaat

SEQ ID NO: 8383707 - DNA, 22 bp, Homo sapiens
catgtacaaggatgctcagagt

SEQ ID NO: 8383708 - DNA, 22 bp, Homo sapiens
catgtacaaggatgctcagagt

SEQ ID NO: 8383709 - DNA, 23 bp, Homo sapiens
catgtacacacagctgtacagtg

SEQ ID NO: 8383710 - DNA, 23 bp, Homo sapiens
catgtacacacagctgtacagtg

SEQ ID NO: 8383711 - DNA, 22 bp, Homo sapiens
catgtacactcatgtaactata

SEQ ID NO: 8383712 - DNA, 22 bp, Homo sapiens
catgtacactcatgtaactata

SEQ ID NO: 8383713 - DNA, 22 bp, Homo sapiens
catgtacagccagggttgagaa

SEQ ID NO: 8383714 - DNA, 23 bp, Homo sapiens
catgtacagagtttgataaagtg

SEQ ID NO: 8383715 - DNA, 22 bp, Homo sapiens
catgtacatgcatgggcactgt

SEQ ID NO: 8383716 - DNA, 22 bp, Homo sapiens
catgtacagtttttctgtcctg

SEQ ID NO: 8383717 - DNA, 22 bp, Homo sapiens
cattacaacaatctgccatggc

SEQ ID NO: 8383718 - DNA, 22 bp, Homo sapiens
cattacaaagttataaacagtt

SEQ ID NO: 8383719 - DNA, 19 bp, Homo sapiens
cattacaaatttgtaggga

SEQ ID NO: 8383720 - DNA, 22 bp, Homo sapiens
cattaattgtatttttcaaagt

SEQ ID NO: 8383721 - DNA, 22 bp, Homo sapiens
cattacaaacatgttaagattt

SEQ ID NO: 8383722 - DNA, 21 bp, Homo sapiens
cattacaagatttccaatttg

SEQ ID NO: 8383723 - DNA, 21 bp, Homo sapiens
cattacaagatttccaatttg

SEQ ID NO: 8383724 - DNA, 21 bp, Homo sapiens
ttttttcttgcgtgaggcctg

SEQ ID NO: 8383725 - DNA, 22 bp, Homo sapiens
ttttacttaattcttggtcatg

SEQ ID NO: 8383726 - DNA, 22 bp, Homo sapiens
ttttagaaggaatgctatggtg

SEQ ID NO: 8383727 - DNA, 22 bp, Homo sapiens
ttttagaaagatccctggcagg

SEQ ID NO: 8383728 - DNA, 22 bp, Homo sapiens
ttttactttggatacagtactt

SEQ ID NO: 8383729 - DNA, 22 bp, Homo sapiens
ttttcacaagggtccaactagt

SEQ ID NO: 8383730 - DNA, 22 bp, Homo sapiens
ttttattgtcaatgaagacaga

SEQ ID NO: 8383731 - DNA, 23 bp, Homo sapiens
ttttaatttggacataagaagat

SEQ ID NO: 8383732 - DNA, 22 bp, Homo sapiens
ttttacacctcagatgagcaga

SEQ ID NO: 8383733 - DNA, 22 bp, Homo sapiens
ttttacaagctgagtcgttaaa

SEQ ID NO: 8383734 - DNA, 22 bp, Homo sapiens
ttttacaagctgagtcgttaaa

SEQ ID NO: 8383735 - DNA, 22 bp, Homo sapiens
ttttacacttcggttgtgtgca

SEQ ID NO: 8383736 - DNA, 22 bp, Homo sapiens
ttttacagttccatgcaaagcg

SEQ ID NO: 8383737 - DNA, 22 bp, Homo sapiens
tttgtgctaatgctagattact

SEQ ID NO: 8383738 - DNA, 22 bp, Homo sapiens
tttgtgctaatgctagattact

SEQ ID NO: 8383739 - DNA, 22 bp, Homo sapiens
tttgtccttgaatcaattcaca

SEQ ID NO: 8383740 - DNA, 22 bp, Homo sapiens
tttgtcttatccaatctctcag

SEQ ID NO: 8383741 - DNA, 22 bp, Homo sapiens
tttgtcttcatccttcgagctg

SEQ ID NO: 8383742 - DNA, 22 bp, Homo sapiens
ttttggtagaatcaacaatgta

SEQ ID NO: 8383743 - DNA, 22 bp, Homo sapiens
ttttggtaattaagtagatatt

SEQ ID NO: 8383744 - DNA, 22 bp, Homo sapiens
ttttggtagccaacaaaatgtt

SEQ ID NO: 8383745 - DNA, 22 bp, Homo sapiens
ttttggttctgggatacagaga

SEQ ID NO: 8383746 - DNA, 22 bp, Homo sapiens
ttttccttctagagcagatttc

SEQ ID NO: 8383747 - DNA, 19 bp, Homo sapiens
ttttccttctatatgtttc

SEQ ID NO: 8383748 - DNA, 22 bp, Homo sapiens
ttttccttcacctcttgagcct

SEQ ID NO: 8383749 - DNA, 22 bp, Homo sapiens
ttttcctactgataaacagtta

SEQ ID NO: 8383750 - DNA, 22 bp, Homo sapiens
ttttcctactgataaacagtta

SEQ ID NO: 8383751 - DNA, 22 bp, Homo sapiens
ttttcccatctacaaagcaggg

SEQ ID NO: 8383752 - DNA, 22 bp, Homo sapiens
ttttcctcacctaactcaaggt

SEQ ID NO: 8383753 - DNA, 22 bp, Homo sapiens
ttttcctagtaggcctattaga

SEQ ID NO: 8383754 - DNA, 22 bp, Homo sapiens
ttttcctatatgcaaagaatgc

SEQ ID NO: 8383755 - DNA, 22 bp, Homo sapiens
ttttccagcataggtacatata

SEQ ID NO: 8383756 - DNA, 19 bp, Homo sapiens
ttttcccaccctttagaat

SEQ ID NO: 8383757 - DNA, 22 bp, Homo sapiens
ttttgtatagtcaaagacaaga

SEQ ID NO: 8383758 - DNA, 22 bp, Homo sapiens
tttttgtagtcattagaagagg

SEQ ID NO: 8383759 - DNA, 22 bp, Homo sapiens
tttttgtatagaaatgaactaa

SEQ ID NO: 8383760 - DNA, 22 bp, Homo sapiens
tttttgtagtcattagaagagg

SEQ ID NO: 8383761 - DNA, 22 bp, Homo sapiens
ttttttatatcaactgaagtct

SEQ ID NO: 8383762 - DNA, 22 bp, Homo sapiens
ttttttagttaggtcagaatgt

SEQ ID NO: 8383763 - DNA, 22 bp, Homo sapiens
ttttttatagcaatgaacccac

SEQ ID NO: 8383764 - DNA, 22 bp, Homo sapiens
ttttttatctatggtagtacca

SEQ ID NO: 8383765 - DNA, 22 bp, Homo sapiens
ttttttatctatggtagtacca

SEQ ID NO: 8383766 - DNA, 22 bp, Homo sapiens
ttttttcagcctgtctgtgcca

SEQ ID NO: 8383767 - DNA, 22 bp, Homo sapiens
tttttgttctgattatactggt

SEQ ID NO: 8383768 - DNA, 22 bp, Homo sapiens
tttttgttcccagagaatttgt

SEQ ID NO: 8383769 - DNA, 22 bp, Homo sapiens
tttttgtctagcgtctctagtt

SEQ ID NO: 8383770 - DNA, 22 bp, Homo sapiens
tttggggagacatggccagctg

SEQ ID NO: 8383771 - DNA, 22 bp, Homo sapiens
tttggggaggttatcggtgtgc

SEQ ID NO: 8383772 - DNA, 22 bp, Homo sapiens
tttggggaaccactgaggtagg

SEQ ID NO: 8383773 - DNA, 22 bp, Homo sapiens
tttggggactgttagagaaaat

SEQ ID NO: 8383774 - DNA, 22 bp, Homo sapiens
tttggggatgacaggttaggaa

SEQ ID NO: 8383775 - DNA, 22 bp, Homo sapiens
tttgggcatatagctgttccct

SEQ ID NO: 8383776 - DNA, 22 bp, Homo sapiens
tttgtcattctgtgtatttaaa

SEQ ID NO: 8383777 - DNA, 22 bp, Homo sapiens
tttgtcatttccctgattaaag

SEQ ID NO: 8383778 - DNA, 22 bp, Homo sapiens
tttgtcatttccctgattaaag

SEQ ID NO: 8383779 - DNA, 22 bp, Homo sapiens
tttgtcatcagttattaatatg

SEQ ID NO: 8383780 - DNA, 22 bp, Homo sapiens
tttggtaaatgcaggttcttct

SEQ ID NO: 8383781 - DNA, 18 bp, Homo sapiens
tttggccatgacctggct

SEQ ID NO: 8383782 - DNA, 22 bp, Homo sapiens
tttggcaggtggcagctctggg

SEQ ID NO: 8383783 - DNA, 17 bp, Homo sapiens
tttggcagtcttttaca

SEQ ID NO: 8383784 - DNA, 22 bp, Homo sapiens
tttggcagtgaagccctctcat

SEQ ID NO: 8383785 - DNA, 21 bp, Homo sapiens
tttggcagtttcccaggaaat

SEQ ID NO: 8383786 - DNA, 22 bp, Homo sapiens
tttggccaagaaagttctgtgg

SEQ ID NO: 8383787 - DNA, 22 bp, Homo sapiens
tttggccacttcatagatcatt

SEQ ID NO: 8383788 - DNA, 22 bp, Homo sapiens
tttggccacagatccttggggg

SEQ ID NO: 8383789 - DNA, 22 bp, Homo sapiens
tttggccacttgggagtccagg

SEQ ID NO: 8383790 - DNA, 22 bp, Homo sapiens
tttggcttaacttacatgatat

SEQ ID NO: 8383791 - DNA, 22 bp, Homo sapiens
tttggctttagtgccttctgat

SEQ ID NO: 8383792 - DNA, 22 bp, Homo sapiens
tttggcttgcactggcaccaac

SEQ ID NO: 8383793 - DNA, 20 bp, Homo sapiens
tttggcttcaagtgcattgc

SEQ ID NO: 8383794 - DNA, 21 bp, Homo sapiens
tttggcttctctgctgcagcc

SEQ ID NO: 8383795 - DNA, 22 bp, Homo sapiens
tttgcattctagaaaaatttct

SEQ ID NO: 8383796 - DNA, 22 bp, Homo sapiens
tttgctgaatagattgtaaact

SEQ ID NO: 8383797 - DNA, 22 bp, Homo sapiens
tttgctgaactaaaattctgaa

SEQ ID NO: 8383798 - DNA, 22 bp, Homo sapiens
tttgcttaactggtagaatgcg

SEQ ID NO: 8383799 - DNA, 22 bp, Homo sapiens
tttgcttaaaagcggagcaaga

SEQ ID NO: 8383800 - DNA, 22 bp, Homo sapiens
tttgctgtgcttacatatgtat

SEQ ID NO: 8383801 - DNA, 22 bp, Homo sapiens
tttgcatgggaggtagtaatca

SEQ ID NO: 8383802 - DNA, 22 bp, Homo sapiens
tttgcattatctcacttatata

SEQ ID NO: 8383803 - DNA, 22 bp, Homo sapiens
tttgcattatctcacttatata

SEQ ID NO: 8383804 - DNA, 22 bp, Homo sapiens
tttgcattatatttatagaaga

SEQ ID NO: 8383805 - DNA, 22 bp, Homo sapiens
tttgcagtgttcatcagtattt

SEQ ID NO: 8383806 - DNA, 22 bp, Homo sapiens
tttgagatggagtcttgctctg

SEQ ID NO: 8383807 - DNA, 22 bp, Homo sapiens
tttgagatggagtcttgctctg

SEQ ID NO: 8383808 - DNA, 19 bp, Homo sapiens
tttgagaagttattatcta

SEQ ID NO: 8383809 - DNA, 19 bp, Homo sapiens
tttgagaagttattatcta

SEQ ID NO: 8383810 - DNA, 22 bp, Homo sapiens
tttgagaatggtaagtggatcg

SEQ ID NO: 8383811 - DNA, 20 bp, Homo sapiens
tttgagaccagtctgcccaa

SEQ ID NO: 8383812 - DNA, 22 bp, Homo sapiens
tttgacattatcctgttactgg

SEQ ID NO: 8383813 - DNA, 22 bp, Homo sapiens
tttgacattgccaatttgctca

SEQ ID NO: 8383814 - DNA, 22 bp, Homo sapiens
tttgagaaggtgacaaattcta

SEQ ID NO: 8383815 - DNA, 22 bp, Homo sapiens
tttgacatctaagaattcttac

SEQ ID NO: 8383816 - DNA, 22 bp, Homo sapiens
tttgaagacatattgttacata

SEQ ID NO: 8383817 - DNA, 22 bp, Homo sapiens
tttgaacatgctgcatgataat

SEQ ID NO: 8383818 - DNA, 22 bp, Homo sapiens
tttgaacatgctgcatgataat

SEQ ID NO: 8383819 - DNA, 22 bp, Homo sapiens
tttgaaattggctcattggttt

SEQ ID NO: 8383820 - DNA, 22 bp, Homo sapiens
tttgaaattggctcattggttt

SEQ ID NO: 8383821 - DNA, 22 bp, Homo sapiens
tttgaacaggagtatctatagt

SEQ ID NO: 8383822 - DNA, 22 bp, Homo sapiens
tttgaacagggaatgttccaca

SEQ ID NO: 8383823 - DNA, 22 bp, Homo sapiens
tttgaaattaagatattgtcca

SEQ ID NO: 8383824 - DNA, 22 bp, Homo sapiens
tttgaaattaagatattgtcca

SEQ ID NO: 8383825 - DNA, 22 bp, Homo sapiens
tttgaaatgtatcagtataggt

SEQ ID NO: 8383826 - DNA, 22 bp, Homo sapiens
tttgaaatctaatcaaggaaca

SEQ ID NO: 8383827 - DNA, 22 bp, Homo sapiens
tttgaaatatgtgtcttttgaa

SEQ ID NO: 8383828 - DNA, 22 bp, Homo sapiens
tttgaaatctaatcaaggaaca

SEQ ID NO: 8383829 - DNA, 22 bp, Homo sapiens
tttgaaagttcttctgacacta

SEQ ID NO: 8383830 - DNA, 22 bp, Homo sapiens
tttgaaatatgtgatgagagag

SEQ ID NO: 8383831 - DNA, 22 bp, Homo sapiens
tttgaaatatgtgatgagagag

SEQ ID NO: 8383832 - DNA, 22 bp, Homo sapiens
tttgaaatatgtgatgagagag

SEQ ID NO: 8383833 - DNA, 22 bp, Homo sapiens
tttgaaatatgaggcattatga

SEQ ID NO: 8383834 - DNA, 22 bp, Homo sapiens
tttgaaatatgaggcattatga

SEQ ID NO: 8383835 - DNA, 22 bp, Homo sapiens
tttctattgatctaataaacat

SEQ ID NO: 8383836 - DNA, 22 bp, Homo sapiens
tttctattggcgtcactgttgt

SEQ ID NO: 8383837 - DNA, 21 bp, Homo sapiens
tttgaaagtgggtgattcttt

SEQ ID NO: 8383838 - DNA, 22 bp, Homo sapiens
tttctatatgaggagctaaagt

SEQ ID NO: 8383839 - DNA, 22 bp, Homo sapiens
tttctattgatctaataaacat

SEQ ID NO: 8383840 - DNA, 22 bp, Homo sapiens
tttctattctggatctgtggca

SEQ ID NO: 8383841 - DNA, 22 bp, Homo sapiens
tttctagagttcatcatggtaa

SEQ ID NO: 8383842 - DNA, 22 bp, Homo sapiens
tttctagacatttctatgtaca

SEQ ID NO: 8383843 - DNA, 22 bp, Homo sapiens
tttctagtcagccatatctagt

SEQ ID NO: 8383844 - DNA, 22 bp, Homo sapiens
tttctagtatataactagatct

SEQ ID NO: 8383845 - DNA, 22 bp, Homo sapiens
tttctagtaaaagctaattacc

SEQ ID NO: 8383846 - DNA, 22 bp, Homo sapiens
tttctagtaatcaatataaagt

SEQ ID NO: 8383847 - DNA, 22 bp, Homo sapiens
tttctatatcttacctattgta

SEQ ID NO: 8383848 - DNA, 22 bp, Homo sapiens
tttctataatctaccatgccag

SEQ ID NO: 8383849 - DNA, 22 bp, Homo sapiens
tttctatagctttcttgggagt

SEQ ID NO: 8383850 - DNA, 22 bp, Homo sapiens
tttctataactggactggattg

SEQ ID NO: 8383851 - DNA, 22 bp, Homo sapiens
tttctataaaaagtgctaggat

SEQ ID NO: 8383852 - DNA, 22 bp, Homo sapiens
tttcatcttatttgtctacatc

SEQ ID NO: 8383853 - DNA, 22 bp, Homo sapiens
tttccaaataaggtcacactca

SEQ ID NO: 8383854 - DNA, 22 bp, Homo sapiens
tttccaaataaggtcacactca

SEQ ID NO: 8383855 - DNA, 22 bp, Homo sapiens
tttccaaataaggtcacattct

SEQ ID NO: 8383856 - DNA, 22 bp, Homo sapiens
tttccaaataaggtcacattct

SEQ ID NO: 8383857 - DNA, 22 bp, Homo sapiens
tttccaaataaggtcacattct

SEQ ID NO: 8383858 - DNA, 22 bp, Homo sapiens
tttccagagctgagaaggcttg

SEQ ID NO: 8383859 - DNA, 22 bp, Homo sapiens
tttccagatgctaggttgaaag

SEQ ID NO: 8383860 - DNA, 22 bp, Homo sapiens
tttccagattaagataccactt

SEQ ID NO: 8383861 - DNA, 22 bp, Homo sapiens
tttccaggtgcatagaaaacag

SEQ ID NO: 8383862 - DNA, 22 bp, Homo sapiens
tttcatagtcaagtgtgtatga

SEQ ID NO: 8383863 - DNA, 22 bp, Homo sapiens
tttcataatgtcacagtcaaaa

SEQ ID NO: 8383864 - DNA, 22 bp, Homo sapiens
tttcataatatccagagatttt

SEQ ID NO: 8383865 - DNA, 22 bp, Homo sapiens
tttcataatactgtacatgaaa

SEQ ID NO: 8383866 - DNA, 22 bp, Homo sapiens
tttcataatagtgcagtttgtt

SEQ ID NO: 8383867 - DNA, 22 bp, Homo sapiens
tttcataatagtgcagtttgtt

SEQ ID NO: 8383868 - DNA, 22 bp, Homo sapiens
tttcataatagtgcagtttgtt

SEQ ID NO: 8383869 - DNA, 22 bp, Homo sapiens
tttcataaacagtagaagacta

SEQ ID NO: 8383870 - DNA, 22 bp, Homo sapiens
tttcataagggtttctagactt

SEQ ID NO: 8383871 - DNA, 22 bp, Homo sapiens
tttcccaagaccatagatggaa

SEQ ID NO: 8383872 - DNA, 22 bp, Homo sapiens
tttcccaagaaaaataattgga

SEQ ID NO: 8383873 - DNA, 22 bp, Homo sapiens
tttcccaaagcctggggtgagt

SEQ ID NO: 8383874 - DNA, 22 bp, Homo sapiens
tttcccaacagtctctctcaaa

SEQ ID NO: 8383875 - DNA, 22 bp, Homo sapiens
tttcccaagtgtaaacatggca

SEQ ID NO: 8383876 - DNA, 22 bp, Homo sapiens
tttcccaattgagaggttctgt

SEQ ID NO: 8383877 - DNA, 22 bp, Homo sapiens
tttcccaagtgaagtgaagcca

SEQ ID NO: 8383878 - DNA, 22 bp, Homo sapiens
tttcccaagtgtaaacatggca

SEQ ID NO: 8383879 - DNA, 22 bp, Homo sapiens
tttcccaatgagtccttgagca

SEQ ID NO: 8383880 - DNA, 22 bp, Homo sapiens
tttcctttgcccaatacatgtc

SEQ ID NO: 8383881 - DNA, 22 bp, Homo sapiens
tttcctttgcccaatacatgtc

SEQ ID NO: 8383882 - DNA, 22 bp, Homo sapiens
tttcctttgagggtcctacact

SEQ ID NO: 8383883 - DNA, 22 bp, Homo sapiens
tttcctttgggagcatgaattt

SEQ ID NO: 8383884 - DNA, 22 bp, Homo sapiens
tttcctttgggcacccgagctc

SEQ ID NO: 8383885 - DNA, 22 bp, Homo sapiens
tttcctttctggtttggtcata

SEQ ID NO: 8383886 - DNA, 22 bp, Homo sapiens
tttcctttgtgcaggccttggg

SEQ ID NO: 8383887 - DNA, 22 bp, Homo sapiens
tttcctttgtgcaggccttggg

SEQ ID NO: 8383888 - DNA, 22 bp, Homo sapiens
tttccttttaagcagtcggcct

SEQ ID NO: 8383889 - DNA, 22 bp, Homo sapiens
tttccttttataaggcttgagg

SEQ ID NO: 8383890 - DNA, 22 bp, Homo sapiens
tttccttttataaggcttgagg

SEQ ID NO: 8383891 - DNA, 22 bp, Homo sapiens
tttccttttggctaggtgtgaa

SEQ ID NO: 8383892 - DNA, 21 bp, Homo sapiens
tttcgcatgtgttaactgtga

SEQ ID NO: 8383893 - DNA, 22 bp, Homo sapiens
tttcggaataaatacgaacatc

SEQ ID NO: 8383894 - DNA, 22 bp, Homo sapiens
tttctaaactggattcagcctg

SEQ ID NO: 8383895 - DNA, 22 bp, Homo sapiens
tttctaaactggattcagcctg

SEQ ID NO: 8383896 - DNA, 22 bp, Homo sapiens
tttctaaaatagattttatggt

SEQ ID NO: 8383897 - DNA, 22 bp, Homo sapiens
tttctaacagcaaatgtttatc

SEQ ID NO: 8383898 - DNA, 22 bp, Homo sapiens
tttctaaatggtggctgcattg

SEQ ID NO: 8383899 - DNA, 22 bp, Homo sapiens
tttctaaatggtggctgcattg

SEQ ID NO: 8383900 - DNA, 22 bp, Homo sapiens
tttcacatgtggaatgccaggt

SEQ ID NO: 8383901 - DNA, 22 bp, Homo sapiens
tttcacatgtgctgttgtcaat

SEQ ID NO: 8383902 - DNA, 22 bp, Homo sapiens
tttcacatgtatataggcatta

SEQ ID NO: 8383903 - DNA, 22 bp, Homo sapiens
tttcacatgtatataggcatta

SEQ ID NO: 8383904 - DNA, 22 bp, Homo sapiens
tttcacatggtactgcctgttt

SEQ ID NO: 8383905 - DNA, 22 bp, Homo sapiens
tttcacatgtatataggcatta

SEQ ID NO: 8383906 - DNA, 22 bp, Homo sapiens
tttcacatcccgcgcgccctta

SEQ ID NO: 8383907 - DNA, 22 bp, Homo sapiens
tttcacatcatgggatggaagc

SEQ ID NO: 8383908 - DNA, 22 bp, Homo sapiens
tttcacatcatgggatggaagc

SEQ ID NO: 8383909 - DNA, 22 bp, Homo sapiens
tttcacatcatgggatggaagc

SEQ ID NO: 8383910 - DNA, 20 bp, Homo sapiens
tttcacatctgtccctttaa

SEQ ID NO: 8383911 - DNA, 22 bp, Homo sapiens
tttcacatcctgaagccccact

SEQ ID NO: 8383912 - DNA, 22 bp, Homo sapiens
tttcacatggactttttgttct

SEQ ID NO: 8383913 - DNA, 22 bp, Homo sapiens
tttcacatggaagctctcgaga

SEQ ID NO: 8383914 - DNA, 22 bp, Homo sapiens
tttcacatgcagcagggaagtg

SEQ ID NO: 8383915 - DNA, 22 bp, Homo sapiens
tttcacatgcagcagggaagtg

SEQ ID NO: 8383916 - DNA, 22 bp, Homo sapiens
tttcacatatggttgttgattg

SEQ ID NO: 8383917 - DNA, 22 bp, Homo sapiens
tttcacatatggttgttgattg

SEQ ID NO: 8383918 - DNA, 22 bp, Homo sapiens
tttcacatcagaggtagattag

SEQ ID NO: 8383919 - DNA, 22 bp, Homo sapiens
tttcacaggccttttgtagccc

SEQ ID NO: 8383920 - DNA, 22 bp, Homo sapiens
tttcacaatcaaatggtgaaat

SEQ ID NO: 8383921 - DNA, 22 bp, Homo sapiens
tttcagtgtatcttccaaaagc

SEQ ID NO: 8383922 - DNA, 22 bp, Homo sapiens
tttcacatttgttttaagaagt

SEQ ID NO: 8383923 - DNA, 22 bp, Homo sapiens
tttcacatttaggcgtgaattg

SEQ ID NO: 8383924 - DNA, 22 bp, Homo sapiens
tttcacatttaggcgtgaattg

SEQ ID NO: 8383925 - DNA, 22 bp, Homo sapiens
tttcagtttttgctcgatgtat

SEQ ID NO: 8383926 - DNA, 22 bp, Homo sapiens
tttcataaacagtagaagacta

SEQ ID NO: 8383927 - DNA, 22 bp, Homo sapiens
tttcataaacagtagaagacta

SEQ ID NO: 8383928 - DNA, 22 bp, Homo sapiens
tttcagtttgaaggaaaggcca

SEQ ID NO: 8383929 - DNA, 22 bp, Homo sapiens
tttcagtttccagctttgtcat

SEQ ID NO: 8383930 - DNA, 22 bp, Homo sapiens
tttcacattcagatatagactt

SEQ ID NO: 8383931 - DNA, 23 bp, Homo sapiens
tttcacattaatgtttagcagga

SEQ ID NO: 8383932 - DNA, 22 bp, Homo sapiens
tttcacattagatatgtcattt

SEQ ID NO: 8383933 - DNA, 23 bp, Homo sapiens
tttcacatttactgttagatggc

SEQ ID NO: 8383934 - DNA, 22 bp, Homo sapiens
tttcacattggcttctatttct

SEQ ID NO: 8383935 - DNA, 22 bp, Homo sapiens
tttcacattggcttctatttct

SEQ ID NO: 8383936 - DNA, 22 bp, Homo sapiens
tttcacattggcttctatttct

SEQ ID NO: 8383937 - DNA, 22 bp, Homo sapiens
tttcacattcttctgaatctac

SEQ ID NO: 8383938 - DNA, 22 bp, Homo sapiens
tttcacattcttctgaatctac

SEQ ID NO: 8383939 - DNA, 22 bp, Homo sapiens
tttcacattctctggttatcga

SEQ ID NO: 8383940 - DNA, 22 bp, Homo sapiens
tttcaaggccttctggttcagt

SEQ ID NO: 8383941 - DNA, 22 bp, Homo sapiens
tttatttataagccacttgctg

SEQ ID NO: 8383942 - DNA, 22 bp, Homo sapiens
tttatttataagccacttgctg

SEQ ID NO: 8383943 - DNA, 18 bp, Homo sapiens
tttcacaacctccagagg

SEQ ID NO: 8383944 - DNA, 22 bp, Homo sapiens
tttcacaacgttgtggtgagag

SEQ ID NO: 8383945 - DNA, 22 bp, Homo sapiens
tttcacaagacagctactgttg

SEQ ID NO: 8383946 - DNA, 22 bp, Homo sapiens
tttcacaagtttcaggattctg

SEQ ID NO: 8383947 - DNA, 22 bp, Homo sapiens
tttcacaactgcttatttgaga

SEQ ID NO: 8383948 - DNA, 22 bp, Homo sapiens
tttcacaactgcttatttgaga

SEQ ID NO: 8383949 - DNA, 22 bp, Homo sapiens
tttcaagttgtttatatccaga

SEQ ID NO: 8383950 - DNA, 22 bp, Homo sapiens
tttacacattattttcagtgtg

SEQ ID NO: 8383951 - DNA, 22 bp, Homo sapiens
tttacacattattttcagtgtg

SEQ ID NO: 8383952 - DNA, 22 bp, Homo sapiens
tttacactgcttgaacaatctc

SEQ ID NO: 8383953 - DNA, 22 bp, Homo sapiens
tttacactgacagcacataagg

SEQ ID NO: 8383954 - DNA, 22 bp, Homo sapiens
tttacactgacagcacataagg

SEQ ID NO: 8383955 - DNA, 22 bp, Homo sapiens
tttaagaagttatgttataaat

SEQ ID NO: 8383956 - DNA, 22 bp, Homo sapiens
tttacagatgaggatactgagg

SEQ ID NO: 8383957 - DNA, 22 bp, Homo sapiens
tttacagatgaggatactgagg

SEQ ID NO: 8383958 - DNA, 22 bp, Homo sapiens
tttacagatgaggatactgagg

SEQ ID NO: 8383959 - DNA, 22 bp, Homo sapiens
tttacagatgaggaaactgaga

SEQ ID NO: 8383960 - DNA, 22 bp, Homo sapiens
tttacagatgaggaaactgaga

SEQ ID NO: 8383961 - DNA, 22 bp, Homo sapiens
tttacagcattgctgaaagttc

SEQ ID NO: 8383962 - DNA, 22 bp, Homo sapiens
tttacagcaacagtgcagaggt

SEQ ID NO: 8383963 - DNA, 22 bp, Homo sapiens
tttacagacaacttaatagggg

SEQ ID NO: 8383964 - DNA, 22 bp, Homo sapiens
tttacagagagagaactggact

SEQ ID NO: 8383965 - DNA, 22 bp, Homo sapiens
tttacagagagagaactggact

SEQ ID NO: 8383966 - DNA, 22 bp, Homo sapiens
tttaacatgttcaagaaacata

SEQ ID NO: 8383967 - DNA, 22 bp, Homo sapiens
tttaacatgtgaattttggaag

SEQ ID NO: 8383968 - DNA, 22 bp, Homo sapiens
tttaacaggtaaagtaaatgtg

SEQ ID NO: 8383969 - DNA, 22 bp, Homo sapiens
tttaacatgtaattgctgcttt

SEQ ID NO: 8383970 - DNA, 22 bp, Homo sapiens
tttaacatgtaattgctgcttt

SEQ ID NO: 8383971 - DNA, 22 bp, Homo sapiens
tttaacagatgtgaaattttca

SEQ ID NO: 8383972 - DNA, 23 bp, Homo sapiens
tttaacatttgaacatgtggcca

SEQ ID NO: 8383973 - DNA, 22 bp, Homo sapiens
tttaacatgttcaagaaacata

SEQ ID NO: 8383974 - DNA, 22 bp, Homo sapiens
tttaacatgttcaagaaacata

SEQ ID NO: 8383975 - DNA, 22 bp, Homo sapiens
tttaaccagtttacaaagaatt

SEQ ID NO: 8383976 - DNA, 23 bp, Homo sapiens
tttaacatttgaacatgtggcca

SEQ ID NO: 8383977 - DNA, 22 bp, Homo sapiens
tttaagaagttatgttataaat

SEQ ID NO: 8383978 - DNA, 22 bp, Homo sapiens
ttgttgttataggtggtacaag

SEQ ID NO: 8383979 - DNA, 22 bp, Homo sapiens
ttgttgttggagccaatatgca

SEQ ID NO: 8383980 - DNA, 22 bp, Homo sapiens
ttgttgcataaagtaggaaata

SEQ ID NO: 8383981 - DNA, 22 bp, Homo sapiens
ttgttgcatttcaagtatgaga

SEQ ID NO: 8383982 - DNA, 22 bp, Homo sapiens
ttgttgtcattgtagaggattt

SEQ ID NO: 8383983 - DNA, 22 bp, Homo sapiens
ttgttcttttgcttagacagat

SEQ ID NO: 8383984 - DNA, 22 bp, Homo sapiens
ttgttcttttgcttagacagat

SEQ ID NO: 8383985 - DNA, 22 bp, Homo sapiens
ttgttctttttctccatgagat

SEQ ID NO: 8383986 - DNA, 22 bp, Homo sapiens
ttgttcttttgcttagacagat

SEQ ID NO: 8383987 - DNA, 22 bp, Homo sapiens
ttgttgcagagatgaatgacat

SEQ ID NO: 8383988 - DNA, 22 bp, Homo sapiens
ttgttcttacttaagagtgaat

SEQ ID NO: 8383989 - DNA, 22 bp, Homo sapiens
ttgttcttagtatgcattgttt

SEQ ID NO: 8383990 - DNA, 23 bp, Homo sapiens
ttgttcttggatcttcctgaagc

SEQ ID NO: 8383991 - DNA, 22 bp, Homo sapiens
ttgttcttggagcaggcagaga

SEQ ID NO: 8383992 - DNA, 22 bp, Homo sapiens
ttgttcttctctagagaagtgg

SEQ ID NO: 8383993 - DNA, 22 bp, Homo sapiens
tttatgtaatttcataggtgtg

SEQ ID NO: 8383994 - DNA, 22 bp, Homo sapiens
tttatgacttctaatctgaagc

SEQ ID NO: 8383995 - DNA, 22 bp, Homo sapiens
tttatgacttctaatctgaagc

SEQ ID NO: 8383996 - DNA, 22 bp, Homo sapiens
tttatgacattacaatatcaag

SEQ ID NO: 8383997 - DNA, 22 bp, Homo sapiens
tttatgacttctaatctgaagc

SEQ ID NO: 8383998 - DNA, 22 bp, Homo sapiens
tttatgaactacagatataact

SEQ ID NO: 8383999 - DNA, 22 bp, Homo sapiens
tttatgacaagcattactgatt

SEQ ID NO: 8384000 - DNA, 22 bp, Homo sapiens
tttatgaactacagatataact

SEQ ID NO: 8384001 - DNA, 22 bp, Homo sapiens
tttatgtttgcattttcaaaga

SEQ ID NO: 8384002 - DNA, 21 bp, Homo sapiens
tttatgtacttcatagagtag

SEQ ID NO: 8384003 - DNA, 21 bp, Homo sapiens
tttatgtacttcatagagtag

SEQ ID NO: 8384004 - DNA, 22 bp, Homo sapiens
tttatgttcctcttgagctttc

SEQ ID NO: 8384005 - DNA, 22 bp, Homo sapiens
tttatgtcactttgaaagagag

SEQ ID NO: 8384006 - DNA, 19 bp, Homo sapiens
tttatgtcattgaggtcat

SEQ ID NO: 8384007 - DNA, 22 bp, Homo sapiens
tttattggaacacagccatgac

SEQ ID NO: 8384008 - DNA, 22 bp, Homo sapiens
tttattggatggatggatggat

SEQ ID NO: 8384009 - DNA, 22 bp, Homo sapiens
tttattggatgggtcagctcta

SEQ ID NO: 8384010 - DNA, 22 bp, Homo sapiens
tttattggatatttacaagata

SEQ ID NO: 8384011 - DNA, 22 bp, Homo sapiens
tttattgggcctggaggatcta

SEQ ID NO: 8384012 - DNA, 20 bp, Homo sapiens
tttattggcctttcaggaac

SEQ ID NO: 8384013 - DNA, 22 bp, Homo sapiens
tttattgtcaatctattcccag

SEQ ID NO: 8384014 - DNA, 22 bp, Homo sapiens
tttattgggtgcagtgcccaca

SEQ ID NO: 8384015 - DNA, 22 bp, Homo sapiens
tttagcatgtgtgccatgtggc

SEQ ID NO: 8384016 - DNA, 22 bp, Homo sapiens
tttagcatgttcctttcataga

SEQ ID NO: 8384017 - DNA, 22 bp, Homo sapiens
tttagcatgttcctttcataga

SEQ ID NO: 8384018 - DNA, 22 bp, Homo sapiens
tttagcattactaaaatgaaaa

SEQ ID NO: 8384019 - DNA, 22 bp, Homo sapiens
tttagcattcctgggatgattt

SEQ ID NO: 8384020 - DNA, 22 bp, Homo sapiens
tttagcattaagcttttcaaat

SEQ ID NO: 8384021 - DNA, 22 bp, Homo sapiens
tttagcattaagcttttcaaat

SEQ ID NO: 8384022 - DNA, 22 bp, Homo sapiens
tttagcttgaatcttgtttaaa

SEQ ID NO: 8384023 - DNA, 23 bp, Homo sapiens
tttagcttataaatgcttttgaa

SEQ ID NO: 8384024 - DNA, 22 bp, Homo sapiens
tttagcgtagctgacagctaat

SEQ ID NO: 8384025 - DNA, 22 bp, Homo sapiens
tttagctaagacatagattctt

SEQ ID NO: 8384026 - DNA, 22 bp, Homo sapiens
tttaggaatagctgacaatctt

SEQ ID NO: 8384027 - DNA, 22 bp, Homo sapiens
tttaggaacttaggtttatgga

SEQ ID NO: 8384028 - DNA, 22 bp, Homo sapiens
tttatctgtatatctcaagtgt

SEQ ID NO: 8384029 - DNA, 22 bp, Homo sapiens
tttatctgtatatctcaagtgt

SEQ ID NO: 8384030 - DNA, 22 bp, Homo sapiens
tttatctgttgtacatttatgc

SEQ ID NO: 8384031 - DNA, 22 bp, Homo sapiens
tttatctgttgtacctgcattg

SEQ ID NO: 8384032 - DNA, 22 bp, Homo sapiens
tttatctttaggactttgcaga

SEQ ID NO: 8384033 - DNA, 22 bp, Homo sapiens
ttgtatttcctataacctttct

SEQ ID NO: 8384034 - DNA, 22 bp, Homo sapiens
ttgtatttatattgaatagctt

SEQ ID NO: 8384035 - DNA, 22 bp, Homo sapiens
ttgtattaattgaaatgaatgc

SEQ ID NO: 8384036 - DNA, 22 bp, Homo sapiens
ttgtattagtaagtcagctgct

SEQ ID NO: 8384037 - DNA, 22 bp, Homo sapiens
ttgtatcagtgcctataaaatg

SEQ ID NO: 8384038 - DNA, 22 bp, Homo sapiens
ttgtatgatcccatttagtgaa

SEQ ID NO: 8384039 - DNA, 22 bp, Homo sapiens
ttgtatatattcttaaagatgt

SEQ ID NO: 8384040 - DNA, 22 bp, Homo sapiens
ttgtatatattcttaaagatgt

SEQ ID NO: 8384041 - DNA, 22 bp, Homo sapiens
ttgtagaatcattatttctagt

SEQ ID NO: 8384042 - DNA, 22 bp, Homo sapiens
ttgtagaatcattatttctagt

SEQ ID NO: 8384043 - DNA, 22 bp, Homo sapiens
ttgtagaatttggatctcggca

SEQ ID NO: 8384044 - DNA, 22 bp, Homo sapiens
ttgtagaaaattctcttggata

SEQ ID NO: 8384045 - DNA, 22 bp, Homo sapiens
ttgtagaaaattagatgcatgg

SEQ ID NO: 8384046 - DNA, 22 bp, Homo sapiens
ttgggggaagaggatagacagt

SEQ ID NO: 8384047 - DNA, 22 bp, Homo sapiens
ttgggggcatattgagtagtgg

SEQ ID NO: 8384048 - DNA, 22 bp, Homo sapiens
ttgttctatggggtgaagtcta

SEQ ID NO: 8384049 - DNA, 22 bp, Homo sapiens
ttgttctatggtgaggcagcca

SEQ ID NO: 8384050 - DNA, 22 bp, Homo sapiens
ttgttcactatgaagaggttgg

SEQ ID NO: 8384051 - DNA, 22 bp, Homo sapiens
ttgttatttaggtctgggttag

SEQ ID NO: 8384052 - DNA, 22 bp, Homo sapiens
ttgttatttacaacaatcctat

SEQ ID NO: 8384053 - DNA, 23 bp, Homo sapiens
ttgtggagtggttgttttctagg

SEQ ID NO: 8384054 - DNA, 22 bp, Homo sapiens
ttgtggaagccctatgagagac

SEQ ID NO: 8384055 - DNA, 22 bp, Homo sapiens
ttgtgctctgtgttatttaagg

SEQ ID NO: 8384056 - DNA, 22 bp, Homo sapiens
ttgtgctctgtgttatttaagg

SEQ ID NO: 8384057 - DNA, 22 bp, Homo sapiens
ttgtgcagagttgcctttattt

SEQ ID NO: 8384058 - DNA, 22 bp, Homo sapiens
ttgtgctaagcaatttgcttaa

SEQ ID NO: 8384059 - DNA, 22 bp, Homo sapiens
ttgtgctaagtgctatgaaggc

SEQ ID NO: 8384060 - DNA, 22 bp, Homo sapiens
ttgtgagatgtctactgaagaa

SEQ ID NO: 8384061 - DNA, 22 bp, Homo sapiens
ttgtgagatgatttgaaagtgt

SEQ ID NO: 8384062 - DNA, 22 bp, Homo sapiens
ttgtgagagtttaccttgacca

SEQ ID NO: 8384063 - DNA, 22 bp, Homo sapiens
ttgtgagagaaaatgtgtatat

SEQ ID NO: 8384064 - DNA, 22 bp, Homo sapiens
ttgtgagagccaaacatgtaag

SEQ ID NO: 8384065 - DNA, 22 bp, Homo sapiens
ttgtgagacacaaatcaatgca

SEQ ID NO: 8384066 - DNA, 22 bp, Homo sapiens
ttgtatttcctataacctttct

SEQ ID NO: 8384067 - DNA, 22 bp, Homo sapiens
ttgtgagactcgtaagagaagg

SEQ ID NO: 8384068 - DNA, 23 bp, Homo sapiens
ttgtgagaccttggaagaagtat

SEQ ID NO: 8384069 - DNA, 22 bp, Homo sapiens
ttggggcacctccccagcattt

SEQ ID NO: 8384070 - DNA, 22 bp, Homo sapiens
ttggctttagacctgagactgt

SEQ ID NO: 8384071 - DNA, 22 bp, Homo sapiens
ttgggaaacagtatagctaaca

SEQ ID NO: 8384072 - DNA, 18 bp, Homo sapiens
ttggctttgagaactggt

SEQ ID NO: 8384073 - DNA, 22 bp, Homo sapiens
ttgggaaagaatgagaaggtga

SEQ ID NO: 8384074 - DNA, 22 bp, Homo sapiens
ttgggaaacagtatagctaaca

SEQ ID NO: 8384075 - DNA, 22 bp, Homo sapiens
ttgggaaagaatgagaaggtga

SEQ ID NO: 8384076 - DNA, 23 bp, Homo sapiens
ttgggaaatagttaagacatgag

SEQ ID NO: 8384077 - DNA, 22 bp, Homo sapiens
ttgggaaagggattatgagtag

SEQ ID NO: 8384078 - DNA, 22 bp, Homo sapiens
ttgggaaagccacaaattggag

SEQ ID NO: 8384079 - DNA, 22 bp, Homo sapiens
ttgggaaagccacaaattggag

SEQ ID NO: 8384080 - DNA, 22 bp, Homo sapiens
ttgggaactctaacattttgca

SEQ ID NO: 8384081 - DNA, 22 bp, Homo sapiens
ttgggaaattactctgctagga

SEQ ID NO: 8384082 - DNA, 22 bp, Homo sapiens
ttgggaaattactctgctagga

SEQ ID NO: 8384083 - DNA, 22 bp, Homo sapiens
ttgggaaatatggattgttatt

SEQ ID NO: 8384084 - DNA, 23 bp, Homo sapiens
ttgggaaatagttaagacatgag

SEQ ID NO: 8384085 - DNA, 22 bp, Homo sapiens
ttggcttctttagtcagtttgg

SEQ ID NO: 8384086 - DNA, 22 bp, Homo sapiens
ttggcttgatgactggcagtgt

SEQ ID NO: 8384087 - DNA, 22 bp, Homo sapiens
ttggcttgatgactggcagtgt

SEQ ID NO: 8384088 - DNA, 22 bp, Homo sapiens
ttggcttctgttttggctctgt

SEQ ID NO: 8384089 - DNA, 22 bp, Homo sapiens
ttggcttctgttttggctctgt

SEQ ID NO: 8384090 - DNA, 22 bp, Homo sapiens
ttggcttcaatgtcagagacag

SEQ ID NO: 8384091 - DNA, 22 bp, Homo sapiens
ttggcttcattgatctcacttt

SEQ ID NO: 8384092 - DNA, 22 bp, Homo sapiens
ttggcttctcttaaccctaaag

SEQ ID NO: 8384093 - DNA, 22 bp, Homo sapiens
ttggcttccaggatctcagcag

SEQ ID NO: 8384094 - DNA, 22 bp, Homo sapiens
ttggcctcatggacagctcatc

SEQ ID NO: 8384095 - DNA, 20 bp, Homo sapiens
ttggcagcagctcagccacc

SEQ ID NO: 8384096 - DNA, 22 bp, Homo sapiens
ttggcagatggattcaacatta

SEQ ID NO: 8384097 - DNA, 22 bp, Homo sapiens
ttggcccagcatgcgggtctgt

SEQ ID NO: 8384098 - DNA, 22 bp, Homo sapiens
ttggcccagactcggggactga

SEQ ID NO: 8384099 - DNA, 22 bp, Homo sapiens
ttggcccagggtcagcggcgct

SEQ ID NO: 8384100 - DNA, 22 bp, Homo sapiens
ttggctcaggacccctgtgact

SEQ ID NO: 8384101 - DNA, 22 bp, Homo sapiens
ttggctcaggctttcattgtaa

SEQ ID NO: 8384102 - DNA, 22 bp, Homo sapiens
ttggctcagctgggactgttga

SEQ ID NO: 8384103 - DNA, 22 bp, Homo sapiens
ttggctcagcatcttggtgcca

SEQ ID NO: 8384104 - DNA, 20 bp, Homo sapiens
ttggctcagatttttatggg

SEQ ID NO: 8384105 - DNA, 22 bp, Homo sapiens
ttggctcacctgtctacccaga

SEQ ID NO: 8384106 - DNA, 22 bp, Homo sapiens
ttggctcacatgattatggagg

SEQ ID NO: 8384107 - DNA, 22 bp, Homo sapiens
ttggctcacctggagcctgttg

SEQ ID NO: 8384108 - DNA, 22 bp, Homo sapiens
ttggctcaaaacttagattcca

SEQ ID NO: 8384109 - DNA, 22 bp, Homo sapiens
ttggctcacaaggacggttgct

SEQ ID NO: 8384110 - DNA, 20 bp, Homo sapiens
ttggctcatgcaacacctac

SEQ ID NO: 8384111 - DNA, 22 bp, Homo sapiens
ttggctcattaaagatgataat

SEQ ID NO: 8384112 - DNA, 22 bp, Homo sapiens
ttggctcatgctgttttgtgca

SEQ ID NO: 8384113 - DNA, 22 bp, Homo sapiens
ttggctcagtgtgagggagatg

SEQ ID NO: 8384114 - DNA, 22 bp, Homo sapiens
ttgcttctaagtataaatatga

SEQ ID NO: 8384115 - DNA, 22 bp, Homo sapiens
ttgcttctaagtataaatatga

SEQ ID NO: 8384116 - DNA, 22 bp, Homo sapiens
ttgcttctggaactttctgttc

SEQ ID NO: 8384117 - DNA, 22 bp, Homo sapiens
ttgcttcctttacagatgggca

SEQ ID NO: 8384118 - DNA, 23 bp, Homo sapiens
ttgcttctgtgcaattcagtact

SEQ ID NO: 8384119 - DNA, 23 bp, Homo sapiens
ttgcttctgtgcaattcagtact

SEQ ID NO: 8384120 - DNA, 23 bp, Homo sapiens
ttgcttctgtgcaattcagtact

SEQ ID NO: 8384121 - DNA, 23 bp, Homo sapiens
ttgcttctgtgcaattcagtact

SEQ ID NO: 8384122 - DNA, 18 bp, Homo sapiens
ttgcttcttttctctagg

SEQ ID NO: 8384123 - DNA, 18 bp, Homo sapiens
ttgcttcttttctctagg

SEQ ID NO: 8384124 - DNA, 22 bp, Homo sapiens
ttgcttcttagatattcctctc

SEQ ID NO: 8384125 - DNA, 22 bp, Homo sapiens
ttgcttcttagatattcctctc

SEQ ID NO: 8384126 - DNA, 22 bp, Homo sapiens
ttgcttcttagatattcctctc

SEQ ID NO: 8384127 - DNA, 22 bp, Homo sapiens
ttgcttgcagacttagcaaatt

SEQ ID NO: 8384128 - DNA, 22 bp, Homo sapiens
ttgctttagaatctgcttctgg

SEQ ID NO: 8384129 - DNA, 22 bp, Homo sapiens
ttgctttaaaatggctaagtct

SEQ ID NO: 8384130 - DNA, 22 bp, Homo sapiens
ttgcttgtcttccctttacctc

SEQ ID NO: 8384131 - DNA, 22 bp, Homo sapiens
ttggaacaggattcaattaaag

SEQ ID NO: 8384132 - DNA, 22 bp, Homo sapiens
ttggaacatgccggggtccagg

SEQ ID NO: 8384133 - DNA, 22 bp, Homo sapiens
ttggaagacagccgtctttatt

SEQ ID NO: 8384134 - DNA, 22 bp, Homo sapiens
ttggaagacaatgctgattctc

SEQ ID NO: 8384135 - DNA, 22 bp, Homo sapiens
ttggaagaaatatcaatagtgt

SEQ ID NO: 8384136 - DNA, 22 bp, Homo sapiens
ttggaacacagcagctgatttt

SEQ ID NO: 8384137 - DNA, 22 bp, Homo sapiens
ttggaatcctgagatgagaatt

SEQ ID NO: 8384138 - DNA, 22 bp, Homo sapiens
ttggaagagtagagttgaataa

SEQ ID NO: 8384139 - DNA, 22 bp, Homo sapiens
ttggaagagtagagttgaataa

SEQ ID NO: 8384140 - DNA, 22 bp, Homo sapiens
ttggaagacattaaagagagtg

SEQ ID NO: 8384141 - DNA, 22 bp, Homo sapiens
ttggaagacagtgaaacagcac

SEQ ID NO: 8384142 - DNA, 22 bp, Homo sapiens
ttggaagagagccacagttaat

SEQ ID NO: 8384143 - DNA, 22 bp, Homo sapiens
ttggaagagagccacagttaat

SEQ ID NO: 8384144 - DNA, 22 bp, Homo sapiens
ttggaggcaatgggaaggaggc

SEQ ID NO: 8384145 - DNA, 18 bp, Homo sapiens
ttggaggatgtccatgaa

SEQ ID NO: 8384146 - DNA, 22 bp, Homo sapiens
ttggagggacagatggctaggc

SEQ ID NO: 8384147 - DNA, 22 bp, Homo sapiens
ttggatgggcattaggaaagtc

SEQ ID NO: 8384148 - DNA, 22 bp, Homo sapiens
ttggatgggcattaggaaagtc

SEQ ID NO: 8384149 - DNA, 19 bp, Homo sapiens
ttggatgctaccaggtacc

SEQ ID NO: 8384150 - DNA, 22 bp, Homo sapiens
ttggaatgcacactgagcctgc

SEQ ID NO: 8384151 - DNA, 22 bp, Homo sapiens
ttggcactttgaatgagctcag

SEQ ID NO: 8384152 - DNA, 22 bp, Homo sapiens
ttggcactttctcagcagcctg

SEQ ID NO: 8384153 - DNA, 22 bp, Homo sapiens
ttggcactctccctgcactggt

SEQ ID NO: 8384154 - DNA, 22 bp, Homo sapiens
ttggcacctccctaggaagaag

SEQ ID NO: 8384155 - DNA, 22 bp, Homo sapiens
ttggcacacagtaagccctaag

SEQ ID NO: 8384156 - DNA, 22 bp, Homo sapiens
ttggcacagagctgcagcctgg

SEQ ID NO: 8384157 - DNA, 22 bp, Homo sapiens
ttgccttatagtgctctgcatt

SEQ ID NO: 8384158 - DNA, 22 bp, Homo sapiens
ttgccttgttattctctcagaa

SEQ ID NO: 8384159 - DNA, 22 bp, Homo sapiens
ttgcctggactctgctggtatt

SEQ ID NO: 8384160 - DNA, 22 bp, Homo sapiens
ttgcctggagggacatggagac

SEQ ID NO: 8384161 - DNA, 22 bp, Homo sapiens
ttgcctggagggacatggagac

SEQ ID NO: 8384162 - DNA, 22 bp, Homo sapiens
ttgcctggcttgtagatggggg

SEQ ID NO: 8384163 - DNA, 22 bp, Homo sapiens
ttgcctgggcaacatagaactc

SEQ ID NO: 8384164 - DNA, 22 bp, Homo sapiens
ttgcctggtcctgtgggtgctg

SEQ ID NO: 8384165 - DNA, 22 bp, Homo sapiens
ttgcccagagtcacccagctca

SEQ ID NO: 8384166 - DNA, 22 bp, Homo sapiens
ttgcccagagctgcctgttaca

SEQ ID NO: 8384167 - DNA, 22 bp, Homo sapiens
ttgcctgctacggtcttcactg

SEQ ID NO: 8384168 - DNA, 22 bp, Homo sapiens
ttgccattaaaacatgttatct

SEQ ID NO: 8384169 - DNA, 22 bp, Homo sapiens
ttgctcagtggcagggctggta

SEQ ID NO: 8384170 - DNA, 22 bp, Homo sapiens
ttgcttccagtccaagtctgtt

SEQ ID NO: 8384171 - DNA, 23 bp, Homo sapiens
ttgcttccactgtaagtggagaa

SEQ ID NO: 8384172 - DNA, 22 bp, Homo sapiens
ttgctaaaaatggaattatagg

SEQ ID NO: 8384173 - DNA, 22 bp, Homo sapiens
ttgctaaaaatggaattatagg

SEQ ID NO: 8384174 - DNA, 22 bp, Homo sapiens
ttgctaaaggattttgtattta

SEQ ID NO: 8384175 - DNA, 22 bp, Homo sapiens
ttgcatttgacaaattatttaa

SEQ ID NO: 8384176 - DNA, 22 bp, Homo sapiens
ttgcatttcactttcagtaggc

SEQ ID NO: 8384177 - DNA, 22 bp, Homo sapiens
ttgaggtcttgagtactgggga

SEQ ID NO: 8384178 - DNA, 22 bp, Homo sapiens
ttgaggtattgatattttatga

SEQ ID NO: 8384179 - DNA, 22 bp, Homo sapiens
ttgaggtccaggtgtgggcagg

SEQ ID NO: 8384180 - DNA, 22 bp, Homo sapiens
ttgaggtcttcattcttgggca

SEQ ID NO: 8384181 - DNA, 22 bp, Homo sapiens
ttgcatttttagatgcttctgt

SEQ ID NO: 8384182 - DNA, 22 bp, Homo sapiens
ttgcattttggttgtaaatatg

SEQ ID NO: 8384183 - DNA, 22 bp, Homo sapiens
ttgccacacaagtaaagaaaca

SEQ ID NO: 8384184 - DNA, 22 bp, Homo sapiens
ttgccactgaaccagtcttgca

SEQ ID NO: 8384185 - DNA, 22 bp, Homo sapiens
ttgcatttgtttgagtagaatg

SEQ ID NO: 8384186 - DNA, 22 bp, Homo sapiens
ttgcattttggttgtaaatatg

SEQ ID NO: 8384187 - DNA, 23 bp, Homo sapiens
ttcaagggttatttgttagcact

SEQ ID NO: 8384188 - DNA, 22 bp, Homo sapiens
ttcaagcaccaaattagtaggc

SEQ ID NO: 8384189 - DNA, 22 bp, Homo sapiens
ttattttctcctcagaaagtgg

SEQ ID NO: 8384190 - DNA, 22 bp, Homo sapiens
ttattttcagctaggaaagcca

SEQ ID NO: 8384191 - DNA, 22 bp, Homo sapiens
ttattttaccttcctctgagct

SEQ ID NO: 8384192 - DNA, 22 bp, Homo sapiens
ttattttaccttcctctgagct

SEQ ID NO: 8384193 - DNA, 22 bp, Homo sapiens
ttattttggtaaatgtttgcct

SEQ ID NO: 8384194 - DNA, 23 bp, Homo sapiens
ttcaaaactggaaaatcagatgc

SEQ ID NO: 8384195 - DNA, 21 bp, Homo sapiens
ttcaaaatggtgtgtttgtct

SEQ ID NO: 8384196 - DNA, 22 bp, Homo sapiens
ttcaaaagtaatcagtattaga

SEQ ID NO: 8384197 - DNA, 22 bp, Homo sapiens
ttatttagtctagatgaatttt

SEQ ID NO: 8384198 - DNA, 22 bp, Homo sapiens
ttatttaattttctcactcaga

SEQ ID NO: 8384199 - DNA, 22 bp, Homo sapiens
ttatttgttttctgagaagtat

SEQ ID NO: 8384200 - DNA, 22 bp, Homo sapiens
ttatttgtggcatatgagacga

SEQ ID NO: 8384201 - DNA, 22 bp, Homo sapiens
ttatttatggcactgttggtgg

SEQ ID NO: 8384202 - DNA, 22 bp, Homo sapiens
ttatttatatctctgcagttta

SEQ ID NO: 8384203 - DNA, 22 bp, Homo sapiens
ttatttatatctctgcagttta

SEQ ID NO: 8384204 - DNA, 22 bp, Homo sapiens
ttatgttttatggctatatcat

SEQ ID NO: 8384205 - DNA, 22 bp, Homo sapiens
ttatgttatgctatttcagata

SEQ ID NO: 8384206 - DNA, 22 bp, Homo sapiens
ttatgtttgagtatatgactca

SEQ ID NO: 8384207 - DNA, 22 bp, Homo sapiens
ttattgtttactagtttgcaga

SEQ ID NO: 8384208 - DNA, 22 bp, Homo sapiens
ttattgttagtgagactgtaga

SEQ ID NO: 8384209 - DNA, 22 bp, Homo sapiens
ttattaaaatgcggatttggct

SEQ ID NO: 8384210 - DNA, 22 bp, Homo sapiens
tcctctccagcaaactggctat

SEQ ID NO: 8384211 - DNA, 22 bp, Homo sapiens
tcctctgctcagcattcctcac

SEQ ID NO: 8384212 - DNA, 23 bp, Homo sapiens
tcctcgtgcctatgagcagtgcc

SEQ ID NO: 8384213 - DNA, 22 bp, Homo sapiens
tcctcctgtttctcaggcctgg

SEQ ID NO: 8384214 - DNA, 19 bp, Homo sapiens
tcctccttacttcctcttg

SEQ ID NO: 8384215 - DNA, 20 bp, Homo sapiens
tcctccttgcagagcccaga

SEQ ID NO: 8384216 - DNA, 21 bp, Homo sapiens
tcctcctgtagagggtcctgg

SEQ ID NO: 8384217 - DNA, 21 bp, Homo sapiens
tcctcctggccaggcggcccc

SEQ ID NO: 8384218 - DNA, 22 bp, Homo sapiens
tcctctggcccagctgcctctg

SEQ ID NO: 8384219 - DNA, 22 bp, Homo sapiens
tcctctggctctttccctagga

SEQ ID NO: 8384220 - DNA, 21 bp, Homo sapiens
tcctctgctctcataccacaa

SEQ ID NO: 8384221 - DNA, 22 bp, Homo sapiens
ttagtgtctttcaaaaggttta

SEQ ID NO: 8384222 - DNA, 22 bp, Homo sapiens
ttagtgtctggctatatttaaa

SEQ ID NO: 8384223 - DNA, 22 bp, Homo sapiens
ttagttaattgactatgttgca

SEQ ID NO: 8384224 - DNA, 22 bp, Homo sapiens
tcctctgggcctatttgttcac

SEQ ID NO: 8384225 - DNA, 22 bp, Homo sapiens
ttagtggagagttattatcagc

SEQ ID NO: 8384226 - DNA, 21 bp, Homo sapiens
ttatgtctctttggtgactgg

SEQ ID NO: 8384227 - DNA, 22 bp, Homo sapiens
ttatgcagatggcatgaggagg

SEQ ID NO: 8384228 - DNA, 22 bp, Homo sapiens
ttatgcatatagcagatacgag

SEQ ID NO: 8384229 - DNA, 22 bp, Homo sapiens
ttatgcctccgaaacctggagt

SEQ ID NO: 8384230 - DNA, 22 bp, Homo sapiens
ttatgctagttgaaataacaca

SEQ ID NO: 8384231 - DNA, 22 bp, Homo sapiens
ttatggaaaatacaattataag

SEQ ID NO: 8384232 - DNA, 23 bp, Homo sapiens
ttatgcaagcttcctggtctcag

SEQ ID NO: 8384233 - DNA, 20 bp, Homo sapiens
ttatgcaagcatcaatattg

SEQ ID NO: 8384234 - DNA, 22 bp, Homo sapiens
ttatacagggagtttccctgca

SEQ ID NO: 8384235 - DNA, 22 bp, Homo sapiens
ttatacaggagattccttactt

SEQ ID NO: 8384236 - DNA, 22 bp, Homo sapiens
ttatacagcattgctagtgatg

SEQ ID NO: 8384237 - DNA, 22 bp, Homo sapiens
ttatacacgtttatggagctac

SEQ ID NO: 8384238 - DNA, 22 bp, Homo sapiens
ttataagagtatatagtgtact

SEQ ID NO: 8384239 - DNA, 22 bp, Homo sapiens
ttagttagagccctatgttagg

SEQ ID NO: 8384240 - DNA, 22 bp, Homo sapiens
ttcaatatctctaagaatgagg

SEQ ID NO: 8384241 - DNA, 22 bp, Homo sapiens
ttcagaagtagctaagcagtca

SEQ ID NO: 8384242 - DNA, 22 bp, Homo sapiens
ttcagaaggattttaacacatg

SEQ ID NO: 8384243 - DNA, 23 bp, Homo sapiens
ttcagaagaaatgagtacaggag

SEQ ID NO: 8384244 - DNA, 22 bp, Homo sapiens
ttcagaataatgtgttagagaa

SEQ ID NO: 8384245 - DNA, 22 bp, Homo sapiens
ttcagaatatccgtttaagttt

SEQ ID NO: 8384246 - DNA, 22 bp, Homo sapiens
ttcagaatattattttaaaggc

SEQ ID NO: 8384247 - DNA, 22 bp, Homo sapiens
ttcagaatatttgttttacatg

SEQ ID NO: 8384248 - DNA, 22 bp, Homo sapiens
ttcagaataactttttattgaa

SEQ ID NO: 8384249 - DNA, 22 bp, Homo sapiens
ttcagaaatcgagtttcatgtc

SEQ ID NO: 8384250 - DNA, 22 bp, Homo sapiens
ttcactgtcctgcaactctaga

SEQ ID NO: 8384251 - DNA, 22 bp, Homo sapiens
ttcactgtgatggtgcagaggc

SEQ ID NO: 8384252 - DNA, 22 bp, Homo sapiens
ttcagaaatccctcttctaccc

SEQ ID NO: 8384253 - DNA, 22 bp, Homo sapiens
ttcagaatctatgtgccagctc

SEQ ID NO: 8384254 - DNA, 22 bp, Homo sapiens
ttcagaatgagaatggatgggt

SEQ ID NO: 8384255 - DNA, 22 bp, Homo sapiens
ttcagaatgacttatgtaaggc

SEQ ID NO: 8384256 - DNA, 22 bp, Homo sapiens
ttcagaatgattacattctggt

SEQ ID NO: 8384257 - DNA, 22 bp, Homo sapiens
ttcagaatgatttcagcgagca

SEQ ID NO: 8384258 - DNA, 22 bp, Homo sapiens
ttcagaatgctatttctgaaat

SEQ ID NO: 8384259 - DNA, 22 bp, Homo sapiens
ttcagaatgctatttctgaaat

SEQ ID NO: 8384260 - DNA, 22 bp, Homo sapiens
ttcagaatgctatttctgaaat

SEQ ID NO: 8384261 - DNA, 22 bp, Homo sapiens
ttcagaatgtactgatagaaca

SEQ ID NO: 8384262 - DNA, 22 bp, Homo sapiens
ttcagaatgtgaccttatttgg

SEQ ID NO: 8384263 - DNA, 16 bp, Homo sapiens
ttcagaatttgtagaa

SEQ ID NO: 8384264 - DNA, 19 bp, Homo sapiens
ttcagaattgggaggtgat

SEQ ID NO: 8384265 - DNA, 22 bp, Homo sapiens
ttcagaatgtgaccttatttgg

SEQ ID NO: 8384266 - DNA, 22 bp, Homo sapiens
ttcatacaatgggatattatga

SEQ ID NO: 8384267 - DNA, 22 bp, Homo sapiens
ttcatacatgtgtactgttcca

SEQ ID NO: 8384268 - DNA, 22 bp, Homo sapiens
ttcatataaatggaatcagaat

SEQ ID NO: 8384269 - DNA, 22 bp, Homo sapiens
ttcatagatctcaattttgagg

SEQ ID NO: 8384270 - DNA, 22 bp, Homo sapiens
ttcatagtaacagtaactatgg

SEQ ID NO: 8384271 - DNA, 22 bp, Homo sapiens
ttcatattatgatttgaaatgc

SEQ ID NO: 8384272 - DNA, 22 bp, Homo sapiens
ttcatattatgatttgaaatgc

SEQ ID NO: 8384273 - DNA, 22 bp, Homo sapiens
ttccatgttgatgtgggcccca

SEQ ID NO: 8384274 - DNA, 22 bp, Homo sapiens
ttccatttattcttgtccagat

SEQ ID NO: 8384275 - DNA, 22 bp, Homo sapiens
ttcccagacctgtaggatcaga

SEQ ID NO: 8384276 - DNA, 22 bp, Homo sapiens
ttcccagactccacactgaggc

SEQ ID NO: 8384277 - DNA, 22 bp, Homo sapiens
ttcccagaggagatttgcttat

SEQ ID NO: 8384278 - DNA, 19 bp, Homo sapiens
ttcccagagccatgagtga

SEQ ID NO: 8384279 - DNA, 22 bp, Homo sapiens
ttccatctgctaggtaaatgaa

SEQ ID NO: 8384280 - DNA, 22 bp, Homo sapiens
ttcccagtcccaagaaaagcca

SEQ ID NO: 8384281 - DNA, 22 bp, Homo sapiens
ttcccagtgattaaggcagtgg

SEQ ID NO: 8384282 - DNA, 22 bp, Homo sapiens
ttcccagtgattgaacatccct

SEQ ID NO: 8384283 - DNA, 22 bp, Homo sapiens
ttccccaggcggctttttcagc

SEQ ID NO: 8384284 - DNA, 22 bp, Homo sapiens
ttcccagttagtcatttttaca

SEQ ID NO: 8384285 - DNA, 22 bp, Homo sapiens
ttcccctctcagatctggccta

SEQ ID NO: 8384286 - DNA, 22 bp, Homo sapiens
ttccccaggctggagtgcagtg

SEQ ID NO: 8384287 - DNA, 22 bp, Homo sapiens
ttccccaggtgattctcatggc

SEQ ID NO: 8384288 - DNA, 19 bp, Homo sapiens
ttccaaaatcaggatttga

SEQ ID NO: 8384289 - DNA, 22 bp, Homo sapiens
ttccaagaagtcaacaggtagt

SEQ ID NO: 8384290 - DNA, 22 bp, Homo sapiens
ttccaaaacaatattctgtgaa

SEQ ID NO: 8384291 - DNA, 22 bp, Homo sapiens
ttccaaaacaatattctgtgaa

SEQ ID NO: 8384292 - DNA, 22 bp, Homo sapiens
ttcatcaggcatcatgctcaag

SEQ ID NO: 8384293 - DNA, 22 bp, Homo sapiens
ttccaaaacaatattctgtgaa

SEQ ID NO: 8384294 - DNA, 22 bp, Homo sapiens
ttccaagagtcagctgatccca

SEQ ID NO: 8384295 - DNA, 22 bp, Homo sapiens
ttccaagagcctttcttctaga

SEQ ID NO: 8384296 - DNA, 22 bp, Homo sapiens
ttccaatccaaacttcaccttt

SEQ ID NO: 8384297 - DNA, 22 bp, Homo sapiens
ttccataatcaccttattcttt

SEQ ID NO: 8384298 - DNA, 22 bp, Homo sapiens
ttccaagtgcccatatttcatc

SEQ ID NO: 8384299 - DNA, 22 bp, Homo sapiens
ttccaagtccagccaggccaaa

SEQ ID NO: 8384300 - DNA, 22 bp, Homo sapiens
ttcttctgattgccttctgcaa

SEQ ID NO: 8384301 - DNA, 22 bp, Homo sapiens
ttcttcttcaagtgctgcattc

SEQ ID NO: 8384302 - DNA, 22 bp, Homo sapiens
ttcttcttgaaactttaggttg

SEQ ID NO: 8384303 - DNA, 22 bp, Homo sapiens
ttctttctcaacatgaatgttt

SEQ ID NO: 8384304 - DNA, 22 bp, Homo sapiens
ttctttggggaatattctggtt

SEQ ID NO: 8384305 - DNA, 22 bp, Homo sapiens
ttctttgggctcagagagggag

SEQ ID NO: 8384306 - DNA, 22 bp, Homo sapiens
ttctttggggtctccagcatag

SEQ ID NO: 8384307 - DNA, 22 bp, Homo sapiens
ttctttggtgggagattgaggt

SEQ ID NO: 8384308 - DNA, 22 bp, Homo sapiens
ttctttggggaatattctggtt

SEQ ID NO: 8384309 - DNA, 22 bp, Homo sapiens
ttctttggggtctccagcatag

SEQ ID NO: 8384310 - DNA, 22 bp, Homo sapiens
ttctttggctgccagtctggag

SEQ ID NO: 8384311 - DNA, 22 bp, Homo sapiens
ttctttggctgccagtctggag

SEQ ID NO: 8384312 - DNA, 22 bp, Homo sapiens
ttctttggcttacgtctggcct

SEQ ID NO: 8384313 - DNA, 22 bp, Homo sapiens
ttctttggcttacgtctggcct

SEQ ID NO: 8384314 - DNA, 22 bp, Homo sapiens
ttctttgggcaattgctggccc

SEQ ID NO: 8384315 - DNA, 22 bp, Homo sapiens
ttctttgggcaattgctggccc

SEQ ID NO: 8384316 - DNA, 22 bp, Homo sapiens
ttctttgggattgtagctgtct

SEQ ID NO: 8384317 - DNA, 22 bp, Homo sapiens
ttctttgggattgtagctgtct

SEQ ID NO: 8384318 - DNA, 19 bp, Homo sapiens
ttctttgagttcttctgag

SEQ ID NO: 8384319 - DNA, 22 bp, Homo sapiens
ttctttgaccaaacagttttcc

SEQ ID NO: 8384320 - DNA, 22 bp, Homo sapiens
ttctttggaataagtcaagctg

SEQ ID NO: 8384321 - DNA, 22 bp, Homo sapiens
ttctttgcccatgtttcctaag

SEQ ID NO: 8384322 - DNA, 22 bp, Homo sapiens
ttctttggcatttcctgtatgt

SEQ ID NO: 8384323 - DNA, 23 bp, Homo sapiens
ttctttggaattgggctgcaagg

SEQ ID NO: 8384324 - DNA, 23 bp, Homo sapiens
ttctttggaattgggctgcaagg

SEQ ID NO: 8384325 - DNA, 22 bp, Homo sapiens
ttctggctttcttgtcaggatg

SEQ ID NO: 8384326 - DNA, 22 bp, Homo sapiens
ttctgggacattgcaggtattc

SEQ ID NO: 8384327 - DNA, 22 bp, Homo sapiens
ttctggcttttcatgttccagt

SEQ ID NO: 8384328 - DNA, 22 bp, Homo sapiens
ttctggcttttcatgttccagt

SEQ ID NO: 8384329 - DNA, 22 bp, Homo sapiens
ttctggctttgaccaagttcaa

SEQ ID NO: 8384330 - DNA, 22 bp, Homo sapiens
ttctggagtcccacagccaggg

SEQ ID NO: 8384331 - DNA, 22 bp, Homo sapiens
ttcttcagagagtagaagcaag

SEQ ID NO: 8384332 - DNA, 22 bp, Homo sapiens
ttctgggagattcatatgaaaa

SEQ ID NO: 8384333 - DNA, 22 bp, Homo sapiens
ttcttcctctgtaaaaggtgac

SEQ ID NO: 8384334 - DNA, 22 bp, Homo sapiens
ttgaggtacaatgggtcagtta

SEQ ID NO: 8384335 - DNA, 22 bp, Homo sapiens
ttgaggtaataaacagccattc

SEQ ID NO: 8384336 - DNA, 22 bp, Homo sapiens
ttgaggtagttctattgtgagt

SEQ ID NO: 8384337 - DNA, 22 bp, Homo sapiens
ttgaggtatattcacatatatc

SEQ ID NO: 8384338 - DNA, 22 bp, Homo sapiens
ttgagggagcctgggagccatg

SEQ ID NO: 8384339 - DNA, 22 bp, Homo sapiens
ttgagggattgcaccagaagag

SEQ ID NO: 8384340 - DNA, 22 bp, Homo sapiens
ttgagggatttacagaggtggg

SEQ ID NO: 8384341 - DNA, 22 bp, Homo sapiens
ttgagatagatctcatcttccc

SEQ ID NO: 8384342 - DNA, 22 bp, Homo sapiens
ttgagaggctgttgacattctg

SEQ ID NO: 8384343 - DNA, 22 bp, Homo sapiens
ttgagagaggaaacatagtctc

SEQ ID NO: 8384344 - DNA, 22 bp, Homo sapiens
ttgagagaggaaacatagtctc

SEQ ID NO: 8384345 - DNA, 22 bp, Homo sapiens
ttgaggcctgctggaaggtgtt

SEQ ID NO: 8384346 - DNA, 22 bp, Homo sapiens
ttgaggcccggcaggccgagcg

SEQ ID NO: 8384347 - DNA, 22 bp, Homo sapiens
ttgagggagaaagttggagtag

SEQ ID NO: 8384348 - DNA, 22 bp, Homo sapiens
ttgagaaaggtaagaacccaca

SEQ ID NO: 8384349 - DNA, 22 bp, Homo sapiens
ttgagaaaggggtcaatatctc

SEQ ID NO: 8384350 - DNA, 18 bp, Homo sapiens
ttgagaaataagcactaa

SEQ ID NO: 8384351 - DNA, 22 bp, Homo sapiens
ttgagaaataagcatgtctaga

SEQ ID NO: 8384352 - DNA, 22 bp, Homo sapiens
ttgagaaggtggtcatttgcaa

SEQ ID NO: 8384353 - DNA, 22 bp, Homo sapiens
ttgagaaggtggtcatttgcaa

SEQ ID NO: 8384354 - DNA, 22 bp, Homo sapiens
ttgagaagaaatagtttgcaat

SEQ ID NO: 8384355 - DNA, 22 bp, Homo sapiens
ttgagaaccactgagttagata

SEQ ID NO: 8384356 - DNA, 22 bp, Homo sapiens
ttgagagaaaaaatttattggt

SEQ ID NO: 8384357 - DNA, 22 bp, Homo sapiens
ttgagagaggaaacatagtctc

SEQ ID NO: 8384358 - DNA, 22 bp, Homo sapiens
ttgagacactttgggcatcact

SEQ ID NO: 8384359 - DNA, 22 bp, Homo sapiens
ttgagaatgatgagattcttcc

SEQ ID NO: 8384360 - DNA, 22 bp, Homo sapiens
ttgagacacaaggcacagtaag

SEQ ID NO: 8384361 - DNA, 22 bp, Homo sapiens
ttgaaaatatcacaggagcagc

SEQ ID NO: 8384362 - DNA, 22 bp, Homo sapiens
ttgaaaatatcacaggagcagc

SEQ ID NO: 8384363 - DNA, 22 bp, Homo sapiens
ttgaaaatatcacaggagcagc

SEQ ID NO: 8384364 - DNA, 22 bp, Homo sapiens
ttgaaacagacaagtaaatgtc

SEQ ID NO: 8384365 - DNA, 23 bp, Homo sapiens
ttgaaaaatatagtcccattgtc

SEQ ID NO: 8384366 - DNA, 22 bp, Homo sapiens
ttgaaaaaattggtagaggatg

SEQ ID NO: 8384367 - DNA, 22 bp, Homo sapiens
ttgaaaaaattggtagaggatg

SEQ ID NO: 8384368 - DNA, 22 bp, Homo sapiens
ttgaaactcatcttagtgatgt

SEQ ID NO: 8384369 - DNA, 22 bp, Homo sapiens
ttgaaacattctcctattgatt

SEQ ID NO: 8384370 - DNA, 22 bp, Homo sapiens
ttgaaactttagtaaactaagg

SEQ ID NO: 8384371 - DNA, 22 bp, Homo sapiens
ttgaaagatatgttaatctttc

SEQ ID NO: 8384372 - DNA, 19 bp, Homo sapiens
ttgaaagattagctttcta

SEQ ID NO: 8384373 - DNA, 22 bp, Homo sapiens
ttgaaagatatgttaatctttc

SEQ ID NO: 8384374 - DNA, 22 bp, Homo sapiens
ttgacatgtagtatagttgcat

SEQ ID NO: 8384375 - DNA, 22 bp, Homo sapiens
ttccctccctggctgccatttc

SEQ ID NO: 8384376 - DNA, 22 bp, Homo sapiens
ttccctcccccagcctggcagg

SEQ ID NO: 8384377 - DNA, 22 bp, Homo sapiens
ttccctctcctactcaggaaag

SEQ ID NO: 8384378 - DNA, 22 bp, Homo sapiens
ttccttgttgaaaatgtctgca

SEQ ID NO: 8384379 - DNA, 22 bp, Homo sapiens
ttcctttagtgtcatatacttt

SEQ ID NO: 8384380 - DNA, 21 bp, Homo sapiens
ttcctttttatggcttagtgg

SEQ ID NO: 8384381 - DNA, 22 bp, Homo sapiens
ttcctttagtgtcatatacttt

SEQ ID NO: 8384382 - DNA, 22 bp, Homo sapiens
ttctaaaaccaattctgcttct

SEQ ID NO: 8384383 - DNA, 22 bp, Homo sapiens
ttctaaaaccaattctgcttct

SEQ ID NO: 8384384 - DNA, 22 bp, Homo sapiens
ttcgttttctaggaccaacaga

SEQ ID NO: 8384385 - DNA, 22 bp, Homo sapiens
ttctaaactgaagtattttaaa

SEQ ID NO: 8384386 - DNA, 22 bp, Homo sapiens
ttctaaacggcttcacaggaat

SEQ ID NO: 8384387 - DNA, 22 bp, Homo sapiens
ttctaaagagaatgcgtttctg

SEQ ID NO: 8384388 - DNA, 22 bp, Homo sapiens
ttctaaacttcaattctaaatt

SEQ ID NO: 8384389 - DNA, 22 bp, Homo sapiens
ttctaaaataagtttatctggt

SEQ ID NO: 8384390 - DNA, 22 bp, Homo sapiens
ttctaaaataagtttatctggt

SEQ ID NO: 8384391 - DNA, 22 bp, Homo sapiens
ttctaaaataagtttatctggt

SEQ ID NO: 8384392 - DNA, 22 bp, Homo sapiens
ttctaaaataagtttatctggt

SEQ ID NO: 8384393 - DNA, 18 bp, Homo sapiens
ttctaaattctgttttta

SEQ ID NO: 8384394 - DNA, 22 bp, Homo sapiens
ttctaactccacttcccactcc

SEQ ID NO: 8384395 - DNA, 22 bp, Homo sapiens
ttctcacattcagaacttttat

SEQ ID NO: 8384396 - DNA, 22 bp, Homo sapiens
ttctcagaaaagcaagctttct

SEQ ID NO: 8384397 - DNA, 22 bp, Homo sapiens
ttctcagaattgactgggagca

SEQ ID NO: 8384398 - DNA, 22 bp, Homo sapiens
ttctcacaggatttcttttagt

SEQ ID NO: 8384399 - DNA, 22 bp, Homo sapiens
ttctcacaggatttcttttagt

SEQ ID NO: 8384400 - DNA, 22 bp, Homo sapiens
ttctcacaggctggaatgatga

SEQ ID NO: 8384401 - DNA, 22 bp, Homo sapiens
ttctcacaggaagtaggacttt

SEQ ID NO: 8384402 - DNA, 22 bp, Homo sapiens
ttctcaaggacaaaatgacatg

SEQ ID NO: 8384403 - DNA, 22 bp, Homo sapiens
ttctcaagtgagtggtaaatga

SEQ ID NO: 8384404 - DNA, 22 bp, Homo sapiens
ttctatgaaggtaagatgtacg

SEQ ID NO: 8384405 - DNA, 22 bp, Homo sapiens
ttctcaaagaaagctgtcatta

SEQ ID NO: 8384406 - DNA, 22 bp, Homo sapiens
ttctcaaagtgtgctccctgga

SEQ ID NO: 8384407 - DNA, 22 bp, Homo sapiens
ttctcaaagggtggtttgcaaa

SEQ ID NO: 8384408 - DNA, 22 bp, Homo sapiens
ttctatgattcatttagaagtt

SEQ ID NO: 8384409 - DNA, 22 bp, Homo sapiens
ttctcaaagaaagctgtcatta

SEQ ID NO: 8384410 - DNA, 22 bp, Homo sapiens
ttctccagaggtggctagagtt

SEQ ID NO: 8384411 - DNA, 22 bp, Homo sapiens
ttctcagatccatcagaagtcc

SEQ ID NO: 8384412 - DNA, 22 bp, Homo sapiens
ttctcagacttccagcaccagc

SEQ ID NO: 8384413 - DNA, 22 bp, Homo sapiens
ttctcagacttccagcaccagc

SEQ ID NO: 8384414 - DNA, 22 bp, Homo sapiens
ttctccaggcttgggccaggtc

SEQ ID NO: 8384415 - DNA, 19 bp, Homo sapiens
ttctccagggacttaggga

SEQ ID NO: 8384416 - DNA, 19 bp, Homo sapiens
ttctccaggctgcagaggg

SEQ ID NO: 8384417 - DNA, 22 bp, Homo sapiens
ttctccagcctattggcctatc

SEQ ID NO: 8384418 - DNA, 19 bp, Homo sapiens
ttctccagcctgacctgag

SEQ ID NO: 8384419 - DNA, 19 bp, Homo sapiens
ttctccagcctgacctgag

SEQ ID NO: 8384420 - DNA, 22 bp, Homo sapiens
ttctgcatttaaaatattacta

SEQ ID NO: 8384421 - DNA, 22 bp, Homo sapiens
ttctgcatttctaataagttcc

SEQ ID NO: 8384422 - DNA, 22 bp, Homo sapiens
ttctgcattgacttttatttcc

SEQ ID NO: 8384423 - DNA, 22 bp, Homo sapiens
ttctgcactaaatatcaaatat

SEQ ID NO: 8384424 - DNA, 22 bp, Homo sapiens
ttctgcattatacacaacctaa

SEQ ID NO: 8384425 - DNA, 21 bp, Homo sapiens
ttctgcattaaggtggagata

SEQ ID NO: 8384426 - DNA, 23 bp, Homo sapiens
ttctgcatgtttcagagctggga

SEQ ID NO: 8384427 - DNA, 20 bp, Homo sapiens
ttctggaggctacaagtctg

SEQ ID NO: 8384428 - DNA, 22 bp, Homo sapiens
ttctggaggacaactgttttca

SEQ ID NO: 8384429 - DNA, 22 bp, Homo sapiens
ttctgagtctcctgtcgacagt

SEQ ID NO: 8384430 - DNA, 22 bp, Homo sapiens
ttctgagggaaccttgttcttg

SEQ ID NO: 8384431 - DNA, 22 bp, Homo sapiens
ttctgagggctaatgtactgta

SEQ ID NO: 8384432 - DNA, 22 bp, Homo sapiens
ttctgattcatgatccagttct

SEQ ID NO: 8384433 - DNA, 22 bp, Homo sapiens
ttctgattgctgatgaggccca

SEQ ID NO: 8384434 - DNA, 22 bp, Homo sapiens
ttctgattgctgatgaggccca

SEQ ID NO: 8384435 - DNA, 22 bp, Homo sapiens
ttctgaggcatagaggatgaga

SEQ ID NO: 8384436 - DNA, 22 bp, Homo sapiens
ttctctttatgtatttagtggg

SEQ ID NO: 8384437 - DNA, 23 bp, Homo sapiens
ttctctttagatttacattactc

SEQ ID NO: 8384438 - DNA, 22 bp, Homo sapiens
ttctcttcatctcagtaaatgt

SEQ ID NO: 8384439 - DNA, 22 bp, Homo sapiens
ttctctgttttcccctcgatgt

SEQ ID NO: 8384440 - DNA, 22 bp, Homo sapiens
ttctctggtttgctgtttctga

SEQ ID NO: 8384441 - DNA, 22 bp, Homo sapiens
ttctctgtagttgcctggtgga

SEQ ID NO: 8384442 - DNA, 19 bp, Homo sapiens
ttctctgtgctagactctg

SEQ ID NO: 8384443 - DNA, 22 bp, Homo sapiens
ttctccgctaagttctctgcag

SEQ ID NO: 8384444 - DNA, 22 bp, Homo sapiens
ttctccctgccaaagctgcctc

SEQ ID NO: 8384445 - DNA, 21 bp, Homo sapiens
ttctcctccaagttgctcctg

SEQ ID NO: 8384446 - DNA, 17 bp, Homo sapiens
ttctcctctgtgtcctt

SEQ ID NO: 8384447 - DNA, 22 bp, Homo sapiens
ttctcctctgttaccttgcaaa

SEQ ID NO: 8384448 - DNA, 22 bp, Homo sapiens
ttctccagtcactgacttcgag

SEQ ID NO: 8384449 - DNA, 22 bp, Homo sapiens
ttctccatttaacttccttatg

SEQ ID NO: 8384450 - DNA, 21 bp, Homo sapiens
ttctccccagcgaatcctcgg

SEQ ID NO: 8384451 - DNA, 22 bp, Homo sapiens
ttctccctgccaaagctgcctc

SEQ ID NO: 8384452 - DNA, 22 bp, Homo sapiens
attctacaggactggcaatccc

SEQ ID NO: 8384453 - DNA, 22 bp, Homo sapiens
attctacagatgaaagcggctg

SEQ ID NO: 8384454 - DNA, 22 bp, Homo sapiens
attctacacctctctcatttag

SEQ ID NO: 8384455 - DNA, 22 bp, Homo sapiens
attctactcattgatctatata

SEQ ID NO: 8384456 - DNA, 22 bp, Homo sapiens
gcagcagggtgccagctttgca

SEQ ID NO: 8384457 - DNA, 22 bp, Homo sapiens
gcagcagggagcaggggtgtca

SEQ ID NO: 8384458 - DNA, 22 bp, Homo sapiens
gcagcagggagcaggggtgtca

SEQ ID NO: 8384459 - DNA, 22 bp, Homo sapiens
gcagcaggcttttcataccttg

SEQ ID NO: 8384460 - DNA, 22 bp, Homo sapiens
gcagcaggcttttcataccttg

SEQ ID NO: 8384461 - DNA, 22 bp, Homo sapiens
gcagcagggagcaggggtgtca

SEQ ID NO: 8384462 - DNA, 22 bp, Homo sapiens
gcagcagggtgccagctttgca

SEQ ID NO: 8384463 - DNA, 22 bp, Homo sapiens
gcagcaggtccgcatcatcatc

SEQ ID NO: 8384464 - DNA, 22 bp, Homo sapiens
gcagcaggcttttcataccttg

SEQ ID NO: 8384465 - DNA, 22 bp, Homo sapiens
gcagcaggcatggccgccctgg

SEQ ID NO: 8384466 - DNA, 22 bp, Homo sapiens
gcagcaggcacttaccgttgct

SEQ ID NO: 8384467 - DNA, 22 bp, Homo sapiens
gcagcaggcatggccgccctgg

SEQ ID NO: 8384468 - DNA, 22 bp, Homo sapiens
attccactttatgtctgtatga

SEQ ID NO: 8384469 - DNA, 16 bp, Homo sapiens
gcagaggaaaggggag

SEQ ID NO: 8384470 - DNA, 16 bp, Homo sapiens
gcagaggaaaggggag

SEQ ID NO: 8384471 - DNA, 20 bp, Homo sapiens
attcctcagccccagcctca

SEQ ID NO: 8384472 - DNA, 22 bp, Homo sapiens
attcagtgtttgcagcaacttt

SEQ ID NO: 8384473 - DNA, 22 bp, Homo sapiens
attcagttagccacagctattc

SEQ ID NO: 8384474 - DNA, 21 bp, Homo sapiens
gcagagctggaaccaggaccc

SEQ ID NO: 8384475 - DNA, 22 bp, Homo sapiens
gcagagctgcagcgaggcctgg

SEQ ID NO: 8384476 - DNA, 22 bp, Homo sapiens
attatttacagtgtgctcgaag

SEQ ID NO: 8384477 - DNA, 22 bp, Homo sapiens
attattgtactttcaataaggt

SEQ ID NO: 8384478 - DNA, 22 bp, Homo sapiens
attattgtactttcaataaggt

SEQ ID NO: 8384479 - DNA, 22 bp, Homo sapiens
attattgtcatcttaatcttaa

SEQ ID NO: 8384480 - DNA, 22 bp, Homo sapiens
attatttatcctcttggtctat

SEQ ID NO: 8384481 - DNA, 22 bp, Homo sapiens
attcagtgggtgctcagcacaa

SEQ ID NO: 8384482 - DNA, 22 bp, Homo sapiens
attcagtgccaaggagaacttg

SEQ ID NO: 8384483 - DNA, 22 bp, Homo sapiens
attgacatgtaggctacaagga

SEQ ID NO: 8384484 - DNA, 22 bp, Homo sapiens
attgacaggagagcttggagtg

SEQ ID NO: 8384485 - DNA, 22 bp, Homo sapiens
attgctggcccagatgctttag

SEQ ID NO: 8384486 - DNA, 22 bp, Homo sapiens
attgctggcatcagtgacaata

SEQ ID NO: 8384487 - DNA, 22 bp, Homo sapiens
attgacagagctttcaccatga

SEQ ID NO: 8384488 - DNA, 22 bp, Homo sapiens
attgaagagaagctaaatagag

SEQ ID NO: 8384489 - DNA, 22 bp, Homo sapiens
attgaagaaacccaaataatgg

SEQ ID NO: 8384490 - DNA, 22 bp, Homo sapiens
attgaagattaaatgcttcctt

SEQ ID NO: 8384491 - DNA, 22 bp, Homo sapiens
attgaatgtcctttagtaaaaa

SEQ ID NO: 8384492 - DNA, 22 bp, Homo sapiens
attgaatctgcactagtatttt

SEQ ID NO: 8384493 - DNA, 22 bp, Homo sapiens
attgaatagatgcattatacta

SEQ ID NO: 8384494 - DNA, 20 bp, Homo sapiens
attgaaatttttctgagatt

SEQ ID NO: 8384495 - DNA, 22 bp, Homo sapiens
attgaaaaatgactattgctta

SEQ ID NO: 8384496 - DNA, 22 bp, Homo sapiens
attctcagctttcaaatagaca

SEQ ID NO: 8384497 - DNA, 22 bp, Homo sapiens
attcttcacacctgttcctgtt

SEQ ID NO: 8384498 - DNA, 22 bp, Homo sapiens
attcttcaaagagtgtcaaagt

SEQ ID NO: 8384499 - DNA, 22 bp, Homo sapiens
attcttatttaaatagagtctg

SEQ ID NO: 8384500 - DNA, 22 bp, Homo sapiens
attcttaaatttaggtctgtga

SEQ ID NO: 8384501 - DNA, 22 bp, Homo sapiens
attcttattaaatagccagaag

SEQ ID NO: 8384502 - DNA, 22 bp, Homo sapiens
attcttattaaatagccagaag

SEQ ID NO: 8384503 - DNA, 22 bp, Homo sapiens
attcttattaaatagccagaag

SEQ ID NO: 8384504 - DNA, 22 bp, Homo sapiens
attcttattatagtaaaacagt

SEQ ID NO: 8384505 - DNA, 22 bp, Homo sapiens
attcttattatagtaaaacagt

SEQ ID NO: 8384506 - DNA, 22 bp, Homo sapiens
attcttattatagtaaaacagt

SEQ ID NO: 8384507 - DNA, 22 bp, Homo sapiens
attcttacaaatgaaactgcaa

SEQ ID NO: 8384508 - DNA, 22 bp, Homo sapiens
attcttactccatagaatgaat

SEQ ID NO: 8384509 - DNA, 22 bp, Homo sapiens
attcttacaaagcagagtctgt

SEQ ID NO: 8384510 - DNA, 22 bp, Homo sapiens
atgttttatgttccactcaagg

SEQ ID NO: 8384511 - DNA, 22 bp, Homo sapiens
atgttttattaccaacttgtac

SEQ ID NO: 8384512 - DNA, 22 bp, Homo sapiens
atgttttccccaaatgatcttc

SEQ ID NO: 8384513 - DNA, 22 bp, Homo sapiens
atgttttcaaagtaaacttgta

SEQ ID NO: 8384514 - DNA, 22 bp, Homo sapiens
atgttttctagagtttaaaatc

SEQ ID NO: 8384515 - DNA, 22 bp, Homo sapiens
atgttttatgcttcagatgagg

SEQ ID NO: 8384516 - DNA, 22 bp, Homo sapiens
atgttttatgttccactcaagg

SEQ ID NO: 8384517 - DNA, 22 bp, Homo sapiens
atgttttaccctttgcacaaac

SEQ ID NO: 8384518 - DNA, 22 bp, Homo sapiens
atgttttaccctttgcacaaac

SEQ ID NO: 8384519 - DNA, 20 bp, Homo sapiens
atgttttataaaagaacggg

SEQ ID NO: 8384520 - DNA, 22 bp, Homo sapiens
atgttaaaaaccagtacagttg

SEQ ID NO: 8384521 - DNA, 22 bp, Homo sapiens
atgtgtgtgtgcgcgcgcagga

SEQ ID NO: 8384522 - DNA, 22 bp, Homo sapiens
atgtgtgtgtatatacacacat

SEQ ID NO: 8384523 - DNA, 22 bp, Homo sapiens
atgtgttaatgtcaaccagaaa

SEQ ID NO: 8384524 - DNA, 22 bp, Homo sapiens
atgtgttaatgagcaatgacct

SEQ ID NO: 8384525 - DNA, 22 bp, Homo sapiens
atgtgttaatgagcaatgacct

SEQ ID NO: 8384526 - DNA, 22 bp, Homo sapiens
atgtttttaaatagacttacag

SEQ ID NO: 8384527 - DNA, 22 bp, Homo sapiens
atgtttttcataccagtgttgg

SEQ ID NO: 8384528 - DNA, 22 bp, Homo sapiens
attaaaactaaaatgcctgatt

SEQ ID NO: 8384529 - DNA, 22 bp, Homo sapiens
atgtttttggcttcaagtttct

SEQ ID NO: 8384530 - DNA, 22 bp, Homo sapiens
attaaatactgcaggctaagca

SEQ ID NO: 8384531 - DNA, 22 bp, Homo sapiens
attaaatgttccttaaattata

SEQ ID NO: 8384532 - DNA, 22 bp, Homo sapiens
attaaatggtggtcattcattt

SEQ ID NO: 8384533 - DNA, 22 bp, Homo sapiens
attaaaattccaaggtatgcca

SEQ ID NO: 8384534 - DNA, 22 bp, Homo sapiens
attaaaattccaaggtatgcca

SEQ ID NO: 8384535 - DNA, 22 bp, Homo sapiens
attaaatgttggcatattttgt

SEQ ID NO: 8384536 - DNA, 22 bp, Homo sapiens
attaaattaagtggctaattta

SEQ ID NO: 8384537 - DNA, 22 bp, Homo sapiens
attaaattagcaaactgtgaaa

SEQ ID NO: 8384538 - DNA, 22 bp, Homo sapiens
gatgaggcaagccagaggactg

SEQ ID NO: 8384539 - DNA, 22 bp, Homo sapiens
gatgaggctagagacatgtgta

SEQ ID NO: 8384540 - DNA, 22 bp, Homo sapiens
gatgaggcataaacacagtcac

SEQ ID NO: 8384541 - DNA, 22 bp, Homo sapiens
gatgaggctgtgtctgcacaag

SEQ ID NO: 8384542 - DNA, 18 bp, Homo sapiens
gatgaggctgtctgagaa

SEQ ID NO: 8384543 - DNA, 22 bp, Homo sapiens
gatgagttctttctattctatt

SEQ ID NO: 8384544 - DNA, 19 bp, Homo sapiens
gcaaggttcactcccagag

SEQ ID NO: 8384545 - DNA, 22 bp, Homo sapiens
gcaaggtgttttaacaggaaaa

SEQ ID NO: 8384546 - DNA, 21 bp, Homo sapiens
gcaagtgtttctgacagtggc

SEQ ID NO: 8384547 - DNA, 23 bp, Homo sapiens
gcaagtgaggcgtcagcagtcaa

SEQ ID NO: 8384548 - DNA, 22 bp, Homo sapiens
gcaaggctgttgctgctgcaag

SEQ ID NO: 8384549 - DNA, 22 bp, Homo sapiens
gcaaggctgtgcactttgcatt

SEQ ID NO: 8384550 - DNA, 22 bp, Homo sapiens
attagaatgcagggttcattgt

SEQ ID NO: 8384551 - DNA, 22 bp, Homo sapiens
attagaatgaagtataggattt

SEQ ID NO: 8384552 - DNA, 22 bp, Homo sapiens
attattcttatgtcatcatggc

SEQ ID NO: 8384553 - DNA, 22 bp, Homo sapiens
attattcttatgtcatcatggc

SEQ ID NO: 8384554 - DNA, 20 bp, Homo sapiens
attattcatacatgtgtgac

SEQ ID NO: 8384555 - DNA, 22 bp, Homo sapiens
attattcatggtcttccacaat

SEQ ID NO: 8384556 - DNA, 22 bp, Homo sapiens
attattcaatcatattaaaagt

SEQ ID NO: 8384557 - DNA, 22 bp, Homo sapiens
attattcaatgttatttcagtg

SEQ ID NO: 8384558 - DNA, 22 bp, Homo sapiens
attattcaatgttatttcagtg

SEQ ID NO: 8384559 - DNA, 22 bp, Homo sapiens
attattcaacacttgagaaatt

SEQ ID NO: 8384560 - DNA, 22 bp, Homo sapiens
attattcaacacttgagaaatt

SEQ ID NO: 8384561 - DNA, 22 bp, Homo sapiens
attattcaatcatattaaaagt

SEQ ID NO: 8384562 - DNA, 22 bp, Homo sapiens
attattaaagctacatcaagga

SEQ ID NO: 8384563 - DNA, 22 bp, Homo sapiens
attattaaagctacatcaagga

SEQ ID NO: 8384564 - DNA, 22 bp, Homo sapiens
attattaaagctacatcaagga

SEQ ID NO: 8384565 - DNA, 22 bp, Homo sapiens
attattaaaatgtgtttctctt

SEQ ID NO: 8384566 - DNA, 22 bp, Homo sapiens
attaatatacactgttagcatg

SEQ ID NO: 8384567 - DNA, 22 bp, Homo sapiens
attaagcattcagggctagaga

SEQ ID NO: 8384568 - DNA, 22 bp, Homo sapiens
gatgatcatctgtaaagttaga

SEQ ID NO: 8384569 - DNA, 22 bp, Homo sapiens
gatgatgacagtgattagactg

SEQ ID NO: 8384570 - DNA, 20 bp, Homo sapiens
attaatgaatacattttgat

SEQ ID NO: 8384571 - DNA, 18 bp, Homo sapiens
attaatcataaaatgctg

SEQ ID NO: 8384572 - DNA, 22 bp, Homo sapiens
attaatcatttctgcattatct

SEQ ID NO: 8384573 - DNA, 22 bp, Homo sapiens
attaattttacctttgtaaaca

SEQ ID NO: 8384574 - DNA, 22 bp, Homo sapiens
attaatttccaggcactgtgct

SEQ ID NO: 8384575 - DNA, 22 bp, Homo sapiens
attaatgtgtagccaacttaat

SEQ ID NO: 8384576 - DNA, 22 bp, Homo sapiens
attaatttttctgacagccaca

SEQ ID NO: 8384577 - DNA, 22 bp, Homo sapiens
attaatttttctgacagccaca

SEQ ID NO: 8384578 - DNA, 22 bp, Homo sapiens
attacaaaagaagggagaaggt

SEQ ID NO: 8384579 - DNA, 22 bp, Homo sapiens
attacaaaagaagggagaaggt

SEQ ID NO: 8384580 - DNA, 22 bp, Homo sapiens
attacaaaagaagggagaaggt

SEQ ID NO: 8384581 - DNA, 22 bp, Homo sapiens
attacaacaagaaaagggtaag

SEQ ID NO: 8384582 - DNA, 22 bp, Homo sapiens
attacaagtagactaactttca

SEQ ID NO: 8384583 - DNA, 22 bp, Homo sapiens
gcaaggctgagcacatttgcat

SEQ ID NO: 8384584 - DNA, 22 bp, Homo sapiens
gcaaggctgcccacttcaaaag

SEQ ID NO: 8384585 - DNA, 22 bp, Homo sapiens
gcaacttaggagttagagcatg

SEQ ID NO: 8384586 - DNA, 22 bp, Homo sapiens
attacaataatacatgctcatt

SEQ ID NO: 8384587 - DNA, 22 bp, Homo sapiens
attacaataaggtttatttgta

SEQ ID NO: 8384588 - DNA, 22 bp, Homo sapiens
atttccttgcaagtttctgtaa

SEQ ID NO: 8384589 - DNA, 22 bp, Homo sapiens
atttccttgcaagtttctgtaa

SEQ ID NO: 8384590 - DNA, 22 bp, Homo sapiens
atttccttcccagatttggttc

SEQ ID NO: 8384591 - DNA, 22 bp, Homo sapiens
atttcctagcctctcttgcagt

SEQ ID NO: 8384592 - DNA, 22 bp, Homo sapiens
atttcctagggtagatgtcaca

SEQ ID NO: 8384593 - DNA, 22 bp, Homo sapiens
atttctacagtacacatgcatt

SEQ ID NO: 8384594 - DNA, 22 bp, Homo sapiens
atttcagtgagaaagcaatcaa

SEQ ID NO: 8384595 - DNA, 22 bp, Homo sapiens
atttcagtattatacaactgct

SEQ ID NO: 8384596 - DNA, 22 bp, Homo sapiens
atttcagtagaaaatcttgatt

SEQ ID NO: 8384597 - DNA, 22 bp, Homo sapiens
atttcagtagaaaatcttgatt

SEQ ID NO: 8384598 - DNA, 20 bp, Homo sapiens
atttcaggttgtgttctgtt

SEQ ID NO: 8384599 - DNA, 22 bp, Homo sapiens
atttcaggagcagtttcagtgg

SEQ ID NO: 8384600 - DNA, 22 bp, Homo sapiens
atttcaggaatctgtatgaaag

SEQ ID NO: 8384601 - DNA, 22 bp, Homo sapiens
atttcaggatagcctagttttg

SEQ ID NO: 8384602 - DNA, 22 bp, Homo sapiens
atttcaggccaccagatgtctt

SEQ ID NO: 8384603 - DNA, 22 bp, Homo sapiens
atttcagggagtcatttacaca

SEQ ID NO: 8384604 - DNA, 22 bp, Homo sapiens
atttcagggtaaaaagtgttca

SEQ ID NO: 8384605 - DNA, 22 bp, Homo sapiens
atttcagattcagaaatgtagg

SEQ ID NO: 8384606 - DNA, 22 bp, Homo sapiens
gccaggcctgcaagtgctggtg

SEQ ID NO: 8384607 - DNA, 22 bp, Homo sapiens
gccaggcatttgttaggtgctg

SEQ ID NO: 8384608 - DNA, 22 bp, Homo sapiens
atttattatgggatttggcaca

SEQ ID NO: 8384609 - DNA, 22 bp, Homo sapiens
atttattatgggatttggctca

SEQ ID NO: 8384610 - DNA, 22 bp, Homo sapiens
atttaatttacatttgacagag

SEQ ID NO: 8384611 - DNA, 22 bp, Homo sapiens
atttaatttacatttgacagag

SEQ ID NO: 8384612 - DNA, 22 bp, Homo sapiens
atttaatgtcgagctattgtag

SEQ ID NO: 8384613 - DNA, 22 bp, Homo sapiens
atttaatgtcgagctattgtag

SEQ ID NO: 8384614 - DNA, 22 bp, Homo sapiens
atttaatttggagagagaaacc

SEQ ID NO: 8384615 - DNA, 22 bp, Homo sapiens
atttaatttggagagagaaacc

SEQ ID NO: 8384616 - DNA, 22 bp, Homo sapiens
atttaatttggagagagaaacc

SEQ ID NO: 8384617 - DNA, 22 bp, Homo sapiens
attggaaagttcttaagggata

SEQ ID NO: 8384618 - DNA, 22 bp, Homo sapiens
attggaaagtgtctagtgtggt

SEQ ID NO: 8384619 - DNA, 22 bp, Homo sapiens
attggaaatactgagagataaa

SEQ ID NO: 8384620 - DNA, 22 bp, Homo sapiens
attggaagtatttcatcaaaag

SEQ ID NO: 8384621 - DNA, 22 bp, Homo sapiens
attggaaatgctacaagttaga

SEQ ID NO: 8384622 - DNA, 22 bp, Homo sapiens
attggaaataggccttgtacag

SEQ ID NO: 8384623 - DNA, 22 bp, Homo sapiens
attggaaatgctacaagttaga

SEQ ID NO: 8384624 - DNA, 22 bp, Homo sapiens
attgcttttgagctagaatttt

SEQ ID NO: 8384625 - DNA, 18 bp, Homo sapiens
attgcttttgtaccaacc

SEQ ID NO: 8384626 - DNA, 18 bp, Homo sapiens
attgcttttgtaccaacc

SEQ ID NO: 8384627 - DNA, 22 bp, Homo sapiens
attgcttttccttaacacatgc

SEQ ID NO: 8384628 - DNA, 22 bp, Homo sapiens
attgcttttcagacaatgaggc

SEQ ID NO: 8384629 - DNA, 22 bp, Homo sapiens
attgcttttcagacaatgaggc

SEQ ID NO: 8384630 - DNA, 22 bp, Homo sapiens
attgctttagaaagaaaaatat

SEQ ID NO: 8384631 - DNA, 22 bp, Homo sapiens
attgcttttagtgaaattatat

SEQ ID NO: 8384632 - DNA, 22 bp, Homo sapiens
attgcttttaagcaccacctaa

SEQ ID NO: 8384633 - DNA, 22 bp, Homo sapiens
attgctttctttggggaactgt

SEQ ID NO: 8384634 - DNA, 22 bp, Homo sapiens
attgctttgtacatgcctagca

SEQ ID NO: 8384635 - DNA, 22 bp, Homo sapiens
gccaggaggggagagtgtgtca

SEQ ID NO: 8384636 - DNA, 19 bp, Homo sapiens
gccaggagggctctggctg

SEQ ID NO: 8384637 - DNA, 22 bp, Homo sapiens
atttacagaagcatgtaatagc

SEQ ID NO: 8384638 - DNA, 22 bp, Homo sapiens
gccaggaggcttaactggacag

SEQ ID NO: 8384639 - DNA, 22 bp, Homo sapiens
atttacacattcataagatttc

SEQ ID NO: 8384640 - DNA, 22 bp, Homo sapiens
atttacagaaacttaatcatag

SEQ ID NO: 8384641 - DNA, 22 bp, Homo sapiens
atttacagaaacttaatcatag

SEQ ID NO: 8384642 - DNA, 22 bp, Homo sapiens
atttacacttggtttactagag

SEQ ID NO: 8384643 - DNA, 22 bp, Homo sapiens
atttactgaggtaaataaactg

SEQ ID NO: 8384644 - DNA, 22 bp, Homo sapiens
gccaggaggggagagtgtgtca

SEQ ID NO: 8384645 - DNA, 20 bp, Homo sapiens
gccaggagggtgtgatgagc

SEQ ID NO: 8384646 - DNA, 22 bp, Homo sapiens
gccaggaggtcagcccctcaac

SEQ ID NO: 8384647 - DNA, 22 bp, Homo sapiens
gccaggaggtcagcccctcaac

SEQ ID NO: 8384648 - DNA, 23 bp, Homo sapiens
gcctgggagttgcgatctgcccg

SEQ ID NO: 8384649 - DNA, 22 bp, Homo sapiens
gcctgtccactaaacagccaag

SEQ ID NO: 8384650 - DNA, 22 bp, Homo sapiens
caaaaagcttaggtaacaagcc

SEQ ID NO: 8384651 - DNA, 22 bp, Homo sapiens
caaaacattcagagagctcact

SEQ ID NO: 8384652 - DNA, 22 bp, Homo sapiens
attttttagaacctggcctgat

SEQ ID NO: 8384653 - DNA, 22 bp, Homo sapiens
caaaaaacacagatgtctgtgt

SEQ ID NO: 8384654 - DNA, 22 bp, Homo sapiens
attttttagaacctggcctgat

SEQ ID NO: 8384655 - DNA, 22 bp, Homo sapiens
attttttagaacctggcctgat

SEQ ID NO: 8384656 - DNA, 22 bp, Homo sapiens
caaaaaacacctgtgtgagtat

SEQ ID NO: 8384657 - DNA, 22 bp, Homo sapiens
caaaaaacacagatgtctgtgt

SEQ ID NO: 8384658 - DNA, 22 bp, Homo sapiens
caaaacattctctgcagcaggg

SEQ ID NO: 8384659 - DNA, 22 bp, Homo sapiens
caaaaccaagaacattcatttc

SEQ ID NO: 8384660 - DNA, 22 bp, Homo sapiens
caaaactatcaggctcaaagct

SEQ ID NO: 8384661 - DNA, 22 bp, Homo sapiens
caaaaccaagaacattcatttc

SEQ ID NO: 8384662 - DNA, 22 bp, Homo sapiens
gcgagcctctggagtcctctgg

SEQ ID NO: 8384663 - DNA, 22 bp, Homo sapiens
gctcaggaaggctcaaccagga

SEQ ID NO: 8384664 - DNA, 22 bp, Homo sapiens
gctcaggaaacagcagggcttg

SEQ ID NO: 8384665 - DNA, 22 bp, Homo sapiens
caaactttcagttataacatga

SEQ ID NO: 8384666 - DNA, 22 bp, Homo sapiens
caaacttttcctggaaaagatt

SEQ ID NO: 8384667 - DNA, 22 bp, Homo sapiens
caaactttgcaaaacttacagt

SEQ ID NO: 8384668 - DNA, 22 bp, Homo sapiens
caaactttgcaaaacttacagt

SEQ ID NO: 8384669 - DNA, 22 bp, Homo sapiens
gcgcagctcagtgagggaactt

SEQ ID NO: 8384670 - DNA, 22 bp, Homo sapiens
gcgagggcacgcggttgaaggc

SEQ ID NO: 8384671 - DNA, 22 bp, Homo sapiens
gcgagtgccgagagggcagggc

SEQ ID NO: 8384672 - DNA, 22 bp, Homo sapiens
gcgagtgccgagagggcagggc

SEQ ID NO: 8384673 - DNA, 22 bp, Homo sapiens
caaactgagcatcagaaagttt

SEQ ID NO: 8384674 - DNA, 22 bp, Homo sapiens
caaaccggaaagtgtgaggaca

SEQ ID NO: 8384675 - DNA, 22 bp, Homo sapiens
caaaccttgtaaatgccaaact

SEQ ID NO: 8384676 - DNA, 22 bp, Homo sapiens
gcctgctggatcaagcttatgc

SEQ ID NO: 8384677 - DNA, 22 bp, Homo sapiens
gcctgctggatgtggccaggcc

SEQ ID NO: 8384678 - DNA, 22 bp, Homo sapiens
gcctgctggatgtggccaggcc

SEQ ID NO: 8384679 - DNA, 22 bp, Homo sapiens
gcctgctggacattggccggcc

SEQ ID NO: 8384680 - DNA, 22 bp, Homo sapiens
gcctgctggaggagcctcaggg

SEQ ID NO: 8384681 - DNA, 21 bp, Homo sapiens
gcctgctgcctgtggccggtc

SEQ ID NO: 8384682 - DNA, 22 bp, Homo sapiens
gcctgctgccaccctggctccg

SEQ ID NO: 8384683 - DNA, 22 bp, Homo sapiens
gcctgctgccaccctggctccg

SEQ ID NO: 8384684 - DNA, 22 bp, Homo sapiens
gcctgctgcatccaggctattg

SEQ ID NO: 8384685 - DNA, 22 bp, Homo sapiens
gcctgctctggaatccatgtaa

SEQ ID NO: 8384686 - DNA, 22 bp, Homo sapiens
gcctgctgagggaagttgggca

SEQ ID NO: 8384687 - DNA, 22 bp, Homo sapiens
gcctgctgagggaagttgggca

SEQ ID NO: 8384688 - DNA, 22 bp, Homo sapiens
gcctgctgaagccagagtgtgt

SEQ ID NO: 8384689 - DNA, 18 bp, Homo sapiens
gcctgcctagagcttgcc

SEQ ID NO: 8384690 - DNA, 22 bp, Homo sapiens
gcctgggagagggatagtgcag

SEQ ID NO: 8384691 - DNA, 22 bp, Homo sapiens
gcctggctgaggcctctgctaa

SEQ ID NO: 8384692 - DNA, 22 bp, Homo sapiens
gcctggagctcatgtgggcatt

SEQ ID NO: 8384693 - DNA, 21 bp, Homo sapiens
gcctccagccagatggcctcc

SEQ ID NO: 8384694 - DNA, 22 bp, Homo sapiens
gcctccacttttgctggcttct

SEQ ID NO: 8384695 - DNA, 21 bp, Homo sapiens
gcctcaccatgtcaagccagg

SEQ ID NO: 8384696 - DNA, 22 bp, Homo sapiens
atttctcagtgaaatgacaggc

SEQ ID NO: 8384697 - DNA, 21 bp, Homo sapiens
gcctcaccatgtcaagccagg

SEQ ID NO: 8384698 - DNA, 22 bp, Homo sapiens
atttctcagtgaaatgacaggc

SEQ ID NO: 8384699 - DNA, 22 bp, Homo sapiens
atttctcacaaagttgcttatc

SEQ ID NO: 8384700 - DNA, 22 bp, Homo sapiens
atttctcactcacagtccatgt

SEQ ID NO: 8384701 - DNA, 22 bp, Homo sapiens
atttctcactgagcagataaaa

SEQ ID NO: 8384702 - DNA, 22 bp, Homo sapiens
atttctcaaaggaatagagtga

SEQ ID NO: 8384703 - DNA, 22 bp, Homo sapiens
atttctcaaccaggtcaaaaag

SEQ ID NO: 8384704 - DNA, 22 bp, Homo sapiens
atttctcagaccagagaggtgt

SEQ ID NO: 8384705 - DNA, 22 bp, Homo sapiens
atttctcactgagcagataaaa

SEQ ID NO: 8384706 - DNA, 22 bp, Homo sapiens
gcctccagtttttttctgaact

SEQ ID NO: 8384707 - DNA, 22 bp, Homo sapiens
gcctccccaagcagcagggatt

SEQ ID NO: 8384708 - DNA, 22 bp, Homo sapiens
gcctccccaaagtgctgacagc

SEQ ID NO: 8384709 - DNA, 22 bp, Homo sapiens
gcctccccaaagtgctgacagc

SEQ ID NO: 8384710 - DNA, 22 bp, Homo sapiens
gcctccccaggggtgtcatgag

SEQ ID NO: 8384711 - DNA, 22 bp, Homo sapiens
gcctctcctggagaaggcaggg

SEQ ID NO: 8384712 - DNA, 21 bp, Homo sapiens
gcctctccaaatcctgccttc

SEQ ID NO: 8384713 - DNA, 22 bp, Homo sapiens
gcctctccgagccactgcctct

SEQ ID NO: 8384714 - DNA, 22 bp, Homo sapiens
cttgtaaatgcagattctgatt

SEQ ID NO: 8384715 - DNA, 22 bp, Homo sapiens
cttgtaaaatatccagttaagg

SEQ ID NO: 8384716 - DNA, 20 bp, Homo sapiens
atcttcttggccagcttgct

SEQ ID NO: 8384717 - DNA, 22 bp, Homo sapiens
atcttgaaggttctaccataca

SEQ ID NO: 8384718 - DNA, 22 bp, Homo sapiens
cttgtaaatgcagattctgatt

SEQ ID NO: 8384719 - DNA, 22 bp, Homo sapiens
atcttctatagatattctgaag

SEQ ID NO: 8384720 - DNA, 22 bp, Homo sapiens
cttggcagagggctgggctcag

SEQ ID NO: 8384721 - DNA, 22 bp, Homo sapiens
cttgctggggtaagtctgtgct

SEQ ID NO: 8384722 - DNA, 22 bp, Homo sapiens
cttggcccggagccccatgaag

SEQ ID NO: 8384723 - DNA, 22 bp, Homo sapiens
cttggcccagttgccaaggaaa

SEQ ID NO: 8384724 - DNA, 21 bp, Homo sapiens
cttggcctctagctagagctg

SEQ ID NO: 8384725 - DNA, 19 bp, Homo sapiens
cttggcatctgtgaagtga

SEQ ID NO: 8384726 - DNA, 22 bp, Homo sapiens
cttggcatgcagcaggcactca

SEQ ID NO: 8384727 - DNA, 22 bp, Homo sapiens
cttgggtgtgaccttggcattg

SEQ ID NO: 8384728 - DNA, 22 bp, Homo sapiens
cttggcctgggccgcagccact

SEQ ID NO: 8384729 - DNA, 22 bp, Homo sapiens
cttggcctcttctcagggtggg

SEQ ID NO: 8384730 - DNA, 22 bp, Homo sapiens
cttggcctgacatgtggcaggg

SEQ ID NO: 8384731 - DNA, 22 bp, Homo sapiens
cttggcctgcaggcagcagcgc

SEQ ID NO: 8384732 - DNA, 22 bp, Homo sapiens
cttggcctgcccagccagaagg

SEQ ID NO: 8384733 - DNA, 22 bp, Homo sapiens
cttgctggaaactctctctgcc

SEQ ID NO: 8384734 - DNA, 22 bp, Homo sapiens
cttgctggaaactctctctgcc

SEQ ID NO: 8384735 - DNA, 22 bp, Homo sapiens
cttgctctagatgttcagagct

SEQ ID NO: 8384736 - DNA, 22 bp, Homo sapiens
cttgctctgggaagaaaaagtc

SEQ ID NO: 8384737 - DNA, 22 bp, Homo sapiens
cttgcctttgtcttcaaaggct

SEQ ID NO: 8384738 - DNA, 22 bp, Homo sapiens
cttgccttcttttcctatagaa

SEQ ID NO: 8384739 - DNA, 22 bp, Homo sapiens
cttgcctttgtcttcaaaggct

SEQ ID NO: 8384740 - DNA, 22 bp, Homo sapiens
cttgccttctgttcctatagaa

SEQ ID NO: 8384741 - DNA, 22 bp, Homo sapiens
cttgccttcagtccatcagtca

SEQ ID NO: 8384742 - DNA, 19 bp, Homo sapiens
cttgcctgttcctacagct

SEQ ID NO: 8384743 - DNA, 22 bp, Homo sapiens
cttgcctgggactgaggcattt

SEQ ID NO: 8384744 - DNA, 22 bp, Homo sapiens
cttgcctgctggagcagggctc

SEQ ID NO: 8384745 - DNA, 23 bp, Homo sapiens
cttgcctggcctctctgcccaga

SEQ ID NO: 8384746 - DNA, 22 bp, Homo sapiens
atctacatgttgatttaaagaa

SEQ ID NO: 8384747 - DNA, 22 bp, Homo sapiens
atctacactataacagaatgct

SEQ ID NO: 8384748 - DNA, 22 bp, Homo sapiens
atctagattaggtataagagct

SEQ ID NO: 8384749 - DNA, 22 bp, Homo sapiens
atctaggatttgaatgcacagt

SEQ ID NO: 8384750 - DNA, 22 bp, Homo sapiens
atctagaagtcatggctttctt

SEQ ID NO: 8384751 - DNA, 22 bp, Homo sapiens
atctagaaagtgttgaagatca

SEQ ID NO: 8384752 - DNA, 22 bp, Homo sapiens
atctagaacaattattgtcaca

SEQ ID NO: 8384753 - DNA, 22 bp, Homo sapiens
atctagaaagccaggggcctgc

SEQ ID NO: 8384754 - DNA, 22 bp, Homo sapiens
atcttgcaatgacctatttagg

SEQ ID NO: 8384755 - DNA, 22 bp, Homo sapiens
atcttgcactcctttctcctag

SEQ ID NO: 8384756 - DNA, 22 bp, Homo sapiens
atcttgcatttgctaaaatgca

SEQ ID NO: 8384757 - DNA, 22 bp, Homo sapiens
atcttggattgactggctctgc

SEQ ID NO: 8384758 - DNA, 22 bp, Homo sapiens
atctttgggcaatgatgaggga

SEQ ID NO: 8384759 - DNA, 22 bp, Homo sapiens
atcttgcttgctgggcattttc

SEQ ID NO: 8384760 - DNA, 22 bp, Homo sapiens
atcttttatgagcgttctgaca

SEQ ID NO: 8384761 - DNA, 22 bp, Homo sapiens
atctttgggcaatgatgaggga

SEQ ID NO: 8384762 - DNA, 22 bp, Homo sapiens
atctttttatctgtttggaaca

SEQ ID NO: 8384763 - DNA, 22 bp, Homo sapiens
atcttttttgtcttggtcactg

SEQ ID NO: 8384764 - DNA, 22 bp, Homo sapiens
cttgttattggaaatgtcatgc

SEQ ID NO: 8384765 - DNA, 22 bp, Homo sapiens
atgaaaagcataaacgctgaag

SEQ ID NO: 8384766 - DNA, 22 bp, Homo sapiens
atgaaaagggagtgatatttgt

SEQ ID NO: 8384767 - DNA, 22 bp, Homo sapiens
cttgtggcccatggcttcctgc

SEQ ID NO: 8384768 - DNA, 22 bp, Homo sapiens
cttgtggcccatggcttcctgc

SEQ ID NO: 8384769 - DNA, 22 bp, Homo sapiens
cttgtggcaggtggatggtgcc

SEQ ID NO: 8384770 - DNA, 17 bp, Homo sapiens
cttgtggccagttttta

SEQ ID NO: 8384771 - DNA, 17 bp, Homo sapiens
cttgtggccagttttta

SEQ ID NO: 8384772 - DNA, 22 bp, Homo sapiens
cttgtggccaatgtttgttata

SEQ ID NO: 8384773 - DNA, 21 bp, Homo sapiens
cttgttccaagcatgtctgag

SEQ ID NO: 8384774 - DNA, 20 bp, Homo sapiens
cttgttgattctaggaatga

SEQ ID NO: 8384775 - DNA, 22 bp, Homo sapiens
atgaaatatcttgaagaaattc

SEQ ID NO: 8384776 - DNA, 22 bp, Homo sapiens
cttttattttgaattaagggct

SEQ ID NO: 8384777 - DNA, 22 bp, Homo sapiens
cttttacatttgttgaagagta

SEQ ID NO: 8384778 - DNA, 22 bp, Homo sapiens
atgaaatgtattcagatatgta

SEQ ID NO: 8384779 - DNA, 22 bp, Homo sapiens
atgaaatgtatgagtctgggtt

SEQ ID NO: 8384780 - DNA, 22 bp, Homo sapiens
atgaaatgtaagtagagagttt

SEQ ID NO: 8384781 - DNA, 22 bp, Homo sapiens
atgagtgcccttctcatgattt

SEQ ID NO: 8384782 - DNA, 22 bp, Homo sapiens
atgatttttcagcagaggatct

SEQ ID NO: 8384783 - DNA, 22 bp, Homo sapiens
atgattttttctaacacagtcg

SEQ ID NO: 8384784 - DNA, 22 bp, Homo sapiens
atgaggtggtcttcagtaggtc

SEQ ID NO: 8384785 - DNA, 22 bp, Homo sapiens
gaaagcagtaaatgggtcccat

SEQ ID NO: 8384786 - DNA, 19 bp, Homo sapiens
atgaggtagcagctggtgc

SEQ ID NO: 8384787 - DNA, 22 bp, Homo sapiens
atgaggaacagacttgctggat

SEQ ID NO: 8384788 - DNA, 19 bp, Homo sapiens
atgaggaactgaggctcag

SEQ ID NO: 8384789 - DNA, 22 bp, Homo sapiens
atgaggcagatgttgcatgagg

SEQ ID NO: 8384790 - DNA, 22 bp, Homo sapiens
atgaggcagcacatgggattgt

SEQ ID NO: 8384791 - DNA, 22 bp, Homo sapiens
atgaagatattcttgttttctg

SEQ ID NO: 8384792 - DNA, 21 bp, Homo sapiens
gaaagcacagaaaggactctt

SEQ ID NO: 8384793 - DNA, 22 bp, Homo sapiens
gaaagcacagttctgaccatgt

SEQ ID NO: 8384794 - DNA, 22 bp, Homo sapiens
gaaagcaatttgtgtaatctgt

SEQ ID NO: 8384795 - DNA, 22 bp, Homo sapiens
atgaggcagtacacacaaagcc

SEQ ID NO: 8384796 - DNA, 22 bp, Homo sapiens
atgaggcaggtggaggctgcca

SEQ ID NO: 8384797 - DNA, 22 bp, Homo sapiens
atgaggcaggagtgcagtggca

SEQ ID NO: 8384798 - DNA, 22 bp, Homo sapiens
atgaggcagctgctggagaacg

SEQ ID NO: 8384799 - DNA, 22 bp, Homo sapiens
atgaggcagctgacagctgttc

SEQ ID NO: 8384800 - DNA, 22 bp, Homo sapiens
atgcattcagcggaatgcttag

SEQ ID NO: 8384801 - DNA, 22 bp, Homo sapiens
atgcattatcaattgatgtagg

SEQ ID NO: 8384802 - DNA, 22 bp, Homo sapiens
atgcattcagcggaatgcttag

SEQ ID NO: 8384803 - DNA, 22 bp, Homo sapiens
atgcatgtttatagggtgcttc

SEQ ID NO: 8384804 - DNA, 22 bp, Homo sapiens
atgcatgtgtgagagcaagagg

SEQ ID NO: 8384805 - DNA, 21 bp, Homo sapiens
atgcatgttacagtatatgcc

SEQ ID NO: 8384806 - DNA, 22 bp, Homo sapiens
atgcatgtaacagtgttatgaa

SEQ ID NO: 8384807 - DNA, 22 bp, Homo sapiens
atgcatgtattatctagatgag

SEQ ID NO: 8384808 - DNA, 22 bp, Homo sapiens
atgcatgtattcatgtgtgaca

SEQ ID NO: 8384809 - DNA, 22 bp, Homo sapiens
atgcatttgacgggatatattt

SEQ ID NO: 8384810 - DNA, 22 bp, Homo sapiens
atgcatttatgtgtgtacattg

SEQ ID NO: 8384811 - DNA, 22 bp, Homo sapiens
atgcattgaggatgacatgagt

SEQ ID NO: 8384812 - DNA, 22 bp, Homo sapiens
atgcagctgctcttcctctatt

SEQ ID NO: 8384813 - DNA, 22 bp, Homo sapiens
atgcagctgagggtagtggagc

SEQ ID NO: 8384814 - DNA, 22 bp, Homo sapiens
atgcagctgacattttcatgtt

SEQ ID NO: 8384815 - DNA, 22 bp, Homo sapiens
atgcagctgacattttcatgtt

SEQ ID NO: 8384816 - DNA, 22 bp, Homo sapiens
atgcagctatttgagcatgtca

SEQ ID NO: 8384817 - DNA, 22 bp, Homo sapiens
atgcagctcatttgtttaaaag

SEQ ID NO: 8384818 - DNA, 19 bp, Homo sapiens
atgcagctcctgcctcctt

SEQ ID NO: 8384819 - DNA, 22 bp, Homo sapiens
atgcagctagattttccagtgt

SEQ ID NO: 8384820 - DNA, 22 bp, Homo sapiens
atgcagctgtgggcaagaaatg

SEQ ID NO: 8384821 - DNA, 22 bp, Homo sapiens
atgcagcttcaggattatgatg

SEQ ID NO: 8384822 - DNA, 22 bp, Homo sapiens
atgcagctgctgacagctttca

SEQ ID NO: 8384823 - DNA, 22 bp, Homo sapiens
atgcagctgtcagggagaacat

SEQ ID NO: 8384824 - DNA, 20 bp, Homo sapiens
atgcagctggagttggggtg

SEQ ID NO: 8384825 - DNA, 22 bp, Homo sapiens
atgcagcttccatattttgctg

SEQ ID NO: 8384826 - DNA, 21 bp, Homo sapiens
atgcatctatcttctactcca

SEQ ID NO: 8384827 - DNA, 19 bp, Homo sapiens
atgcatctgcattgacagg

SEQ ID NO: 8384828 - DNA, 22 bp, Homo sapiens
atgcatctatgacttagacatt

SEQ ID NO: 8384829 - DNA, 20 bp, Homo sapiens
atgcatctggtatctttcct

SEQ ID NO: 8384830 - DNA, 22 bp, Homo sapiens
atgcatgcattgtttatcatgg

SEQ ID NO: 8384831 - DNA, 22 bp, Homo sapiens
atgcatgcttcttatagtactt

SEQ ID NO: 8384832 - DNA, 22 bp, Homo sapiens
atgcatgcatgagtgtgtacct

SEQ ID NO: 8384833 - DNA, 22 bp, Homo sapiens
atgcagaacgtttgtgaaactt

SEQ ID NO: 8384834 - DNA, 22 bp, Homo sapiens
atgcagaatgagttcacgatct

SEQ ID NO: 8384835 - DNA, 22 bp, Homo sapiens
atgcagaaggagccatgcttgc

SEQ ID NO: 8384836 - DNA, 22 bp, Homo sapiens
atgcagatgttcctactgtgtt

SEQ ID NO: 8384837 - DNA, 22 bp, Homo sapiens
atgcagatggtggatggagaaa

SEQ ID NO: 8384838 - DNA, 22 bp, Homo sapiens
atgcaaataaagcaactataca

SEQ ID NO: 8384839 - DNA, 22 bp, Homo sapiens
atgcaaataaagcaactataca

SEQ ID NO: 8384840 - DNA, 22 bp, Homo sapiens
atgtctttgccatagttcatat

SEQ ID NO: 8384841 - DNA, 22 bp, Homo sapiens
atgtctttcttgtgtcccaaga

SEQ ID NO: 8384842 - DNA, 22 bp, Homo sapiens
atgtctttcttgtgtcccaaga

SEQ ID NO: 8384843 - DNA, 22 bp, Homo sapiens
atgtctttctagttaagagcta

SEQ ID NO: 8384844 - DNA, 22 bp, Homo sapiens
atgtctttggctttgacatggc

SEQ ID NO: 8384845 - DNA, 22 bp, Homo sapiens
atgtgaaaaatttcttattaca

SEQ ID NO: 8384846 - DNA, 22 bp, Homo sapiens
atgtctgctttccttttaatca

SEQ ID NO: 8384847 - DNA, 22 bp, Homo sapiens
atgtctggctaaaatccctggt

SEQ ID NO: 8384848 - DNA, 22 bp, Homo sapiens
gaggcctggctgggaggaggtg

SEQ ID NO: 8384849 - DNA, 22 bp, Homo sapiens
atgtgtcattatccagaataac

SEQ ID NO: 8384850 - DNA, 22 bp, Homo sapiens
atgtggctggtgactgccgtac

SEQ ID NO: 8384851 - DNA, 22 bp, Homo sapiens
atgtggctgtcacagcataatg

SEQ ID NO: 8384852 - DNA, 22 bp, Homo sapiens
gaggggagaggcttatggatca

SEQ ID NO: 8384853 - DNA, 22 bp, Homo sapiens
atgtagaaagttattgtcactg

SEQ ID NO: 8384854 - DNA, 18 bp, Homo sapiens
atgtacatgtactcacac

SEQ ID NO: 8384855 - DNA, 22 bp, Homo sapiens
gaggccagggatgcaatgagag

SEQ ID NO: 8384856 - DNA, 22 bp, Homo sapiens
gaggccagggtaccatcaacat

SEQ ID NO: 8384857 - DNA, 22 bp, Homo sapiens
atggctggcactggcctgggtt

SEQ ID NO: 8384858 - DNA, 22 bp, Homo sapiens
atggtaaaagatatactgtgca

SEQ ID NO: 8384859 - DNA, 22 bp, Homo sapiens
atggtacagataatacatgctg

SEQ ID NO: 8384860 - DNA, 22 bp, Homo sapiens
atggtattgcaacaactgtcat

SEQ ID NO: 8384861 - DNA, 22 bp, Homo sapiens
atggtactggggtcccggagtt

SEQ ID NO: 8384862 - DNA, 22 bp, Homo sapiens
atgtacaatctatcacaagaag

SEQ ID NO: 8384863 - DNA, 22 bp, Homo sapiens
atgtacatctttataacaagct

SEQ ID NO: 8384864 - DNA, 22 bp, Homo sapiens
atgtacaatttttgcttagggg

SEQ ID NO: 8384865 - DNA, 22 bp, Homo sapiens
atgtacaattctccttggtagg

SEQ ID NO: 8384866 - DNA, 22 bp, Homo sapiens
gagctggggcagcttaggagtg

SEQ ID NO: 8384867 - DNA, 17 bp, Homo sapiens
atggtctcactgagcaa

SEQ ID NO: 8384868 - DNA, 22 bp, Homo sapiens
gagctgggcctgcgagtgctgc

SEQ ID NO: 8384869 - DNA, 22 bp, Homo sapiens
gagctgggcctgcgagtgctgc

SEQ ID NO: 8384870 - DNA, 22 bp, Homo sapiens
atggaatgggaagagtgtgtga

SEQ ID NO: 8384871 - DNA, 22 bp, Homo sapiens
atggaagagtccccatggatga

SEQ ID NO: 8384872 - DNA, 22 bp, Homo sapiens
atggaaggctttatgactcaaa

SEQ ID NO: 8384873 - DNA, 23 bp, Homo sapiens
atggaagtcactgttttcttgtc

SEQ ID NO: 8384874 - DNA, 22 bp, Homo sapiens
atggaagtgcaacttgctcatc

SEQ ID NO: 8384875 - DNA, 22 bp, Homo sapiens
atggaagcagacaggtaattcc

SEQ ID NO: 8384876 - DNA, 20 bp, Homo sapiens
atggaggaagggcaagagaa

SEQ ID NO: 8384877 - DNA, 20 bp, Homo sapiens
atggaggaagggcaagagaa

SEQ ID NO: 8384878 - DNA, 22 bp, Homo sapiens
atggagagagaaggcttgctgt

SEQ ID NO: 8384879 - DNA, 22 bp, Homo sapiens
atggagagtgaaagtctctcta

SEQ ID NO: 8384880 - DNA, 22 bp, Homo sapiens
atggagagttcacttctaagtt

SEQ ID NO: 8384881 - DNA, 22 bp, Homo sapiens
atggagcaaatggggctgcagg

SEQ ID NO: 8384882 - DNA, 22 bp, Homo sapiens
gagaaaggtactattccctcca

SEQ ID NO: 8384883 - DNA, 22 bp, Homo sapiens
gagaaaggtactattccctcca

SEQ ID NO: 8384884 - DNA, 22 bp, Homo sapiens
gagaaagggataatttgaagag

SEQ ID NO: 8384885 - DNA, 22 bp, Homo sapiens
gagaaagggataatttgaagag

SEQ ID NO: 8384886 - DNA, 22 bp, Homo sapiens
gagaaatgcatgcatgtcatca

SEQ ID NO: 8384887 - DNA, 23 bp, Homo sapiens
gacagagtgagaccttgtcttac

SEQ ID NO: 8384888 - DNA, 22 bp, Homo sapiens
gacagaggcaagaccagaagcc

SEQ ID NO: 8384889 - DNA, 22 bp, Homo sapiens
gacagaggctggagcacctcct

SEQ ID NO: 8384890 - DNA, 23 bp, Homo sapiens
gacagagtgagaccttgtcttac

SEQ ID NO: 8384891 - DNA, 23 bp, Homo sapiens
gacagagtgagaccttgtcttac

SEQ ID NO: 8384892 - DNA, 22 bp, Homo sapiens
atgccactgcgctccagcctgg

SEQ ID NO: 8384893 - DNA, 22 bp, Homo sapiens
atgccactgcgctccagcctgg

SEQ ID NO: 8384894 - DNA, 22 bp, Homo sapiens
atgccactgcacttcagcttgg

SEQ ID NO: 8384895 - DNA, 22 bp, Homo sapiens
gacagatggtcagtgttgaagt

SEQ ID NO: 8384896 - DNA, 22 bp, Homo sapiens
atggaaatgatggaacattaaa

SEQ ID NO: 8384897 - DNA, 22 bp, Homo sapiens
atgccactgcgctctagcctgg

SEQ ID NO: 8384898 - DNA, 22 bp, Homo sapiens
atgccactgcgctctagcctgg

SEQ ID NO: 8384899 - DNA, 22 bp, Homo sapiens
atgccactgtactcaacaatag

SEQ ID NO: 8384900 - DNA, 22 bp, Homo sapiens
atgccactgcgctctagcctgg

SEQ ID NO: 8384901 - DNA, 22 bp, Homo sapiens
atggaacaagaactcagattta

SEQ ID NO: 8384902 - DNA, 22 bp, Homo sapiens
atggaaatgttccatatattga

SEQ ID NO: 8384903 - DNA, 22 bp, Homo sapiens
atggaaatggagtgtgcttgct

SEQ ID NO: 8384904 - DNA, 22 bp, Homo sapiens
gagccaggaagaaggccttact

SEQ ID NO: 8384905 - DNA, 22 bp, Homo sapiens
gagccagctacatggtctgcaa

SEQ ID NO: 8384906 - DNA, 22 bp, Homo sapiens
gagccagctacatggtctgcaa

SEQ ID NO: 8384907 - DNA, 22 bp, Homo sapiens
gagccagctatgtagcaagagg

SEQ ID NO: 8384908 - DNA, 22 bp, Homo sapiens
gagccagctgagctgcactgtc

SEQ ID NO: 8384909 - DNA, 22 bp, Homo sapiens
gagccagcgccttgcctctggg

SEQ ID NO: 8384910 - DNA, 22 bp, Homo sapiens
gagccagccttcttctgaggtc

SEQ ID NO: 8384911 - DNA, 22 bp, Homo sapiens
gagccagccttcttctgaggtc

SEQ ID NO: 8384912 - DNA, 22 bp, Homo sapiens
gagccagcctccgcctctctcc

SEQ ID NO: 8384913 - DNA, 22 bp, Homo sapiens
atggcccaaaacctcctccctc

SEQ ID NO: 8384914 - DNA, 22 bp, Homo sapiens
atggcccaagtgccctgacctg

SEQ ID NO: 8384915 - DNA, 22 bp, Homo sapiens
atggcccaaactgcaattactt

SEQ ID NO: 8384916 - DNA, 22 bp, Homo sapiens
atggcccaggcctcctgtggct

SEQ ID NO: 8384917 - DNA, 22 bp, Homo sapiens
atggcccaggccaggatccagc

SEQ ID NO: 8384918 - DNA, 22 bp, Homo sapiens
atggcccaggcaggctggtact

SEQ ID NO: 8384919 - DNA, 22 bp, Homo sapiens
atggcccagaagtttggaaagg

SEQ ID NO: 8384920 - DNA, 22 bp, Homo sapiens
atggcccactctggtcccggca

SEQ ID NO: 8384921 - DNA, 22 bp, Homo sapiens
atggcccagactcagactggtg

SEQ ID NO: 8384922 - DNA, 22 bp, Homo sapiens
atggccagtgttgagatcaggc

SEQ ID NO: 8384923 - DNA, 22 bp, Homo sapiens
atggccagtgtttccctcagtt

SEQ ID NO: 8384924 - DNA, 22 bp, Homo sapiens
gagaacagatttttctgctgtc

SEQ ID NO: 8384925 - DNA, 22 bp, Homo sapiens
gagaacagaagcattcctaatt

SEQ ID NO: 8384926 - DNA, 22 bp, Homo sapiens
gagaacagaagcattcctaatt

SEQ ID NO: 8384927 - DNA, 22 bp, Homo sapiens
gagaacactaatggtttcttaa

SEQ ID NO: 8384928 - DNA, 22 bp, Homo sapiens
atggcagcggagctggaaatga

SEQ ID NO: 8384929 - DNA, 22 bp, Homo sapiens
atggcagctggcttgggcacct

SEQ ID NO: 8384930 - DNA, 22 bp, Homo sapiens
atggcagctggcttgggcacct

SEQ ID NO: 8384931 - DNA, 22 bp, Homo sapiens
atggcagggcccttggctccca

SEQ ID NO: 8384932 - DNA, 22 bp, Homo sapiens
atggcagggactgtggcccttg

SEQ ID NO: 8384933 - DNA, 20 bp, Homo sapiens
atggcagtccgtgttcaggg

SEQ ID NO: 8384934 - DNA, 22 bp, Homo sapiens
atggcagtgtttcagtttttgg

SEQ ID NO: 8384935 - DNA, 22 bp, Homo sapiens
gagaggaactcccagtgcctgg

SEQ ID NO: 8384936 - DNA, 22 bp, Homo sapiens
gagaggaactcccagtgcctgg

SEQ ID NO: 8384937 - DNA, 22 bp, Homo sapiens
gagaggaaagatatatacttct

SEQ ID NO: 8384938 - DNA, 22 bp, Homo sapiens
gagaggaagccttctgtacttg

SEQ ID NO: 8384939 - DNA, 22 bp, Homo sapiens
cagccacagctgggtgcctgac

SEQ ID NO: 8384940 - DNA, 22 bp, Homo sapiens
cagccacagctgggtgcctgac

SEQ ID NO: 8384941 - DNA, 22 bp, Homo sapiens
cagccaatcctgggaaagtgca

SEQ ID NO: 8384942 - DNA, 22 bp, Homo sapiens
cagccactgaactcctggctat

SEQ ID NO: 8384943 - DNA, 22 bp, Homo sapiens
cagccactctcagacagtccca

SEQ ID NO: 8384944 - DNA, 22 bp, Homo sapiens
cagccactggtgccaggctgtt

SEQ ID NO: 8384945 - DNA, 22 bp, Homo sapiens
cagccactgtggtctagctgca

SEQ ID NO: 8384946 - DNA, 22 bp, Homo sapiens
cagccaggttcaagtccttata

SEQ ID NO: 8384947 - DNA, 22 bp, Homo sapiens
gtattttaagtgactactaggt

SEQ ID NO: 8384948 - DNA, 22 bp, Homo sapiens
cagcatttaatgcagtgcttcc

SEQ ID NO: 8384949 - DNA, 22 bp, Homo sapiens
cagcatttatcttgtagcagga

SEQ ID NO: 8384950 - DNA, 22 bp, Homo sapiens
cagcatttcaggaggctgaggt

SEQ ID NO: 8384951 - DNA, 22 bp, Homo sapiens
cagcatttggtgatcatcttaa

SEQ ID NO: 8384952 - DNA, 22 bp, Homo sapiens
cagcccagcagtcttagcctgc

SEQ ID NO: 8384953 - DNA, 22 bp, Homo sapiens
cagcccagcagggtctggccct

SEQ ID NO: 8384954 - DNA, 22 bp, Homo sapiens
cagcccagcactaagtagattt

SEQ ID NO: 8384955 - DNA, 22 bp, Homo sapiens
cagcaggcccaggtgctggtga

SEQ ID NO: 8384956 - DNA, 22 bp, Homo sapiens
cagcaggcggcccgcgggcccg

SEQ ID NO: 8384957 - DNA, 22 bp, Homo sapiens
cagcaggcggcccgcgggcccg

SEQ ID NO: 8384958 - DNA, 22 bp, Homo sapiens
gtatttctttccattatagtca

SEQ ID NO: 8384959 - DNA, 22 bp, Homo sapiens
gtatttctggttaaatgtgcta

SEQ ID NO: 8384960 - DNA, 22 bp, Homo sapiens
gtatttctggtaactgctgcta

SEQ ID NO: 8384961 - DNA, 22 bp, Homo sapiens
cagcaggaccattgaggcatca

SEQ ID NO: 8384962 - DNA, 22 bp, Homo sapiens
cagcaggatttgaaaggaagag

SEQ ID NO: 8384963 - DNA, 22 bp, Homo sapiens
cagcaggcaggtgggccaagtc

SEQ ID NO: 8384964 - DNA, 22 bp, Homo sapiens
cagcaggaccattgaggcatca

SEQ ID NO: 8384965 - DNA, 22 bp, Homo sapiens
cagcagctacttggagcagcag

SEQ ID NO: 8384966 - DNA, 22 bp, Homo sapiens
cagcagctacctgctcttgtgg

SEQ ID NO: 8384967 - DNA, 22 bp, Homo sapiens
gtatgaaggcgagagcccacta

SEQ ID NO: 8384968 - DNA, 22 bp, Homo sapiens
cagcagcctgccttgggagctt

SEQ ID NO: 8384969 - DNA, 22 bp, Homo sapiens
cagcagcctcttgtgcctgtgg

SEQ ID NO: 8384970 - DNA, 20 bp, Homo sapiens
gtatccccgcgtggggaagg

SEQ ID NO: 8384971 - DNA, 19 bp, Homo sapiens
gtatatttatatggctgta

SEQ ID NO: 8384972 - DNA, 22 bp, Homo sapiens
cagcagcaaggtgagggtggag

SEQ ID NO: 8384973 - DNA, 22 bp, Homo sapiens
cagcagcaaggtgagggtggag

SEQ ID NO: 8384974 - DNA, 22 bp, Homo sapiens
cagcagcacctattatagtgtt

SEQ ID NO: 8384975 - DNA, 22 bp, Homo sapiens
cagcagcactctgcgggtcccc

SEQ ID NO: 8384976 - DNA, 22 bp, Homo sapiens
cagcagcagacatttgatcttc

SEQ ID NO: 8384977 - DNA, 22 bp, Homo sapiens
cagcagcagagatactggtttc

SEQ ID NO: 8384978 - DNA, 22 bp, Homo sapiens
cagcagcagacatttgatcttc

SEQ ID NO: 8384979 - DNA, 22 bp, Homo sapiens
cagcagagtttggcttctaatg

SEQ ID NO: 8384980 - DNA, 22 bp, Homo sapiens
cagcagcaaatctagaagagga

SEQ ID NO: 8384981 - DNA, 22 bp, Homo sapiens
cagcagcaaatctagaagagga

SEQ ID NO: 8384982 - DNA, 22 bp, Homo sapiens
cagcagcaacaatagcggtcac

SEQ ID NO: 8384983 - DNA, 22 bp, Homo sapiens
cagcagcaacaacggaagcctt

SEQ ID NO: 8384984 - DNA, 22 bp, Homo sapiens
cagcagagctgtgtgggaaggg

SEQ ID NO: 8384985 - DNA, 22 bp, Homo sapiens
cagcagagtaattctcacctct

SEQ ID NO: 8384986 - DNA, 22 bp, Homo sapiens
cagcagagtaattctcacctct

SEQ ID NO: 8384987 - DNA, 21 bp, Homo sapiens
cagcagagtaatgcattcgta

SEQ ID NO: 8384988 - DNA, 22 bp, Homo sapiens
cagcagagtaattctcacctct

SEQ ID NO: 8384989 - DNA, 22 bp, Homo sapiens
cagcagagtatggcactcaact

SEQ ID NO: 8384990 - DNA, 22 bp, Homo sapiens
cagcagagtatggcactcaact

SEQ ID NO: 8384991 - DNA, 22 bp, Homo sapiens
cagcagagtatggcactcaact

SEQ ID NO: 8384992 - DNA, 22 bp, Homo sapiens
cagcagagtaggtgctacttct

SEQ ID NO: 8384993 - DNA, 22 bp, Homo sapiens
cagagtcagagcacctgggatt

SEQ ID NO: 8384994 - DNA, 22 bp, Homo sapiens
cagagtcagctagtcttgggat

SEQ ID NO: 8384995 - DNA, 22 bp, Homo sapiens
gggtgggaaggctaagggattg

SEQ ID NO: 8384996 - DNA, 22 bp, Homo sapiens
cagagtcagagctccatggagt

SEQ ID NO: 8384997 - DNA, 20 bp, Homo sapiens
gggtgggagagtctgagggt

SEQ ID NO: 8384998 - DNA, 22 bp, Homo sapiens
ggtgggtaaaactgctggcact

SEQ ID NO: 8384999 - DNA, 22 bp, Homo sapiens
ggtgggtgaaatctaggtgtgt

SEQ ID NO: 8385000 - DNA, 22 bp, Homo sapiens
cagcaaggccattggatgcagt

SEQ ID NO: 8385001 - DNA, 22 bp, Homo sapiens
cagcaaggccattggatgcagt

SEQ ID NO: 8385002 - DNA, 22 bp, Homo sapiens
cagcaatccaagctttctttaa

SEQ ID NO: 8385003 - DNA, 22 bp, Homo sapiens
ggtgtgctaagagcactttcaa

SEQ ID NO: 8385004 - DNA, 22 bp, Homo sapiens
cagcaagggttatatcaaagat

SEQ ID NO: 8385005 - DNA, 22 bp, Homo sapiens
ggttcctgtgcctctagctggc

SEQ ID NO: 8385006 - DNA, 22 bp, Homo sapiens
ggttctaggattaggaggccca

SEQ ID NO: 8385007 - DNA, 22 bp, Homo sapiens
ggttctaggtctggggataatg

SEQ ID NO: 8385008 - DNA, 22 bp, Homo sapiens
ggttctgagaaactctcaccat

SEQ ID NO: 8385009 - DNA, 23 bp, Homo sapiens
ggttctgccgcttactgctgtgc

SEQ ID NO: 8385010 - DNA, 22 bp, Homo sapiens
ggttcccggatctccgagtccc

SEQ ID NO: 8385011 - DNA, 22 bp, Homo sapiens
ggttctgctactctcttgctta

SEQ ID NO: 8385012 - DNA, 20 bp, Homo sapiens
gtaaaatatggtctttgggt

SEQ ID NO: 8385013 - DNA, 22 bp, Homo sapiens
gtaaacaacacaaatcatttga

SEQ ID NO: 8385014 - DNA, 22 bp, Homo sapiens
cagcagagctgtgtgggaaggg

SEQ ID NO: 8385015 - DNA, 22 bp, Homo sapiens
gtaaaattgcaattacttttgc

SEQ ID NO: 8385016 - DNA, 22 bp, Homo sapiens
gtaaaattgcaattacttttgc

SEQ ID NO: 8385017 - DNA, 22 bp, Homo sapiens
gtaaaattctagcatctgaaag

SEQ ID NO: 8385018 - DNA, 22 bp, Homo sapiens
gggcactgtgctgggtgcttta

SEQ ID NO: 8385019 - DNA, 22 bp, Homo sapiens
gggcactgtgttcagagtgcag

SEQ ID NO: 8385020 - DNA, 22 bp, Homo sapiens
gggcagactggttatacacggg

SEQ ID NO: 8385021 - DNA, 22 bp, Homo sapiens
gggcagagaaatggacagttgg

SEQ ID NO: 8385022 - DNA, 22 bp, Homo sapiens
gggcagaatttgtagatgacat

SEQ ID NO: 8385023 - DNA, 22 bp, Homo sapiens
cagagccctgggcacatggtag

SEQ ID NO: 8385024 - DNA, 22 bp, Homo sapiens
cagagctgagaatgttgatgct

SEQ ID NO: 8385025 - DNA, 22 bp, Homo sapiens
cagagctgacccaaggattgaa

SEQ ID NO: 8385026 - DNA, 22 bp, Homo sapiens
cagagctgcacattctatgatg

SEQ ID NO: 8385027 - DNA, 22 bp, Homo sapiens
cagagctgcacattctatgatg

SEQ ID NO: 8385028 - DNA, 23 bp, Homo sapiens
cagagctgattaaacttaatctc

SEQ ID NO: 8385029 - DNA, 22 bp, Homo sapiens
cagagctgagtcttcaaggttg

SEQ ID NO: 8385030 - DNA, 22 bp, Homo sapiens
cagagctgagtcttcaaggttg

SEQ ID NO: 8385031 - DNA, 22 bp, Homo sapiens
cagagctgctcatggtggccag

SEQ ID NO: 8385032 - DNA, 22 bp, Homo sapiens
gggctgtgtactatgaggaggg

SEQ ID NO: 8385033 - DNA, 19 bp, Homo sapiens
cagagctgctggcctcgtc

SEQ ID NO: 8385034 - DNA, 22 bp, Homo sapiens
ggggaaaggccatggcaagaac

SEQ ID NO: 8385035 - DNA, 22 bp, Homo sapiens
cagagctggtgttacaagtcca

SEQ ID NO: 8385036 - DNA, 22 bp, Homo sapiens
cagagctggtgttacaagtcca

SEQ ID NO: 8385037 - DNA, 22 bp, Homo sapiens
ggggaagaaatctgggttcttc

SEQ ID NO: 8385038 - DNA, 22 bp, Homo sapiens
ggggaagaaccgggattcccat

SEQ ID NO: 8385039 - DNA, 22 bp, Homo sapiens
ggggaagaatgctctctagaga

SEQ ID NO: 8385040 - DNA, 21 bp, Homo sapiens
cagaggcctatcacagactcc

SEQ ID NO: 8385041 - DNA, 22 bp, Homo sapiens
cagaggccccagaactagctct

SEQ ID NO: 8385042 - DNA, 19 bp, Homo sapiens
cagaggccagaagcacagg

SEQ ID NO: 8385043 - DNA, 22 bp, Homo sapiens
cagaggctgggacctcaggcat

SEQ ID NO: 8385044 - DNA, 22 bp, Homo sapiens
cagaggcttcaagtcattctcc

SEQ ID NO: 8385045 - DNA, 22 bp, Homo sapiens
cagaggtgttggtgaatggaga

SEQ ID NO: 8385046 - DNA, 22 bp, Homo sapiens
cagaggtgtacagagggaggcc

SEQ ID NO: 8385047 - DNA, 22 bp, Homo sapiens
gggtgcatggtgtatgactgga

SEQ ID NO: 8385048 - DNA, 22 bp, Homo sapiens
gggtgccacagagcttccactt

SEQ ID NO: 8385049 - DNA, 17 bp, Homo sapiens
cagacaggctgtcaccc

SEQ ID NO: 8385050 - DNA, 22 bp, Homo sapiens
cagacagggacctcgctccaga

SEQ ID NO: 8385051 - DNA, 22 bp, Homo sapiens
cagacagggacctcgctccaga

SEQ ID NO: 8385052 - DNA, 22 bp, Homo sapiens
gggcaaggcagaagagttggag

SEQ ID NO: 8385053 - DNA, 22 bp, Homo sapiens
gggcaatggatgtgatgactcc

SEQ ID NO: 8385054 - DNA, 22 bp, Homo sapiens
gggcaatgggcttttctgtaag

SEQ ID NO: 8385055 - DNA, 22 bp, Homo sapiens
cagacaggctagccagactcac

SEQ ID NO: 8385056 - DNA, 20 bp, Homo sapiens
gggaggccagcctcagagaa

SEQ ID NO: 8385057 - DNA, 22 bp, Homo sapiens
cagaagttgccacatgaccctt

SEQ ID NO: 8385058 - DNA, 22 bp, Homo sapiens
gggactgtaaattcatatggcc

SEQ ID NO: 8385059 - DNA, 22 bp, Homo sapiens
gggactgtcctacatggagagg

SEQ ID NO: 8385060 - DNA, 22 bp, Homo sapiens
gggactgtcctctgtgtctgtg

SEQ ID NO: 8385061 - DNA, 22 bp, Homo sapiens
gggactgtccggcagaaggtac

SEQ ID NO: 8385062 - DNA, 20 bp, Homo sapiens
gggactgtcccatcctcatc

SEQ ID NO: 8385063 - DNA, 22 bp, Homo sapiens
gggactgtgaggcctaactggg

SEQ ID NO: 8385064 - DNA, 22 bp, Homo sapiens
cagaagtgaatgtgataaacca

SEQ ID NO: 8385065 - DNA, 22 bp, Homo sapiens
gggagcagcctgcctcccacct

SEQ ID NO: 8385066 - DNA, 22 bp, Homo sapiens
gggagcaggacataatagcaat

SEQ ID NO: 8385067 - DNA, 22 bp, Homo sapiens
gggagcaggagcctgcctgcca

SEQ ID NO: 8385068 - DNA, 22 bp, Homo sapiens
cagacaggcaggtgctgctttg

SEQ ID NO: 8385069 - DNA, 22 bp, Homo sapiens
cagacaggagactggatcatgg

SEQ ID NO: 8385070 - DNA, 22 bp, Homo sapiens
cagacaggcaggtgagagctcc

SEQ ID NO: 8385071 - DNA, 23 bp, Homo sapiens
gggaagctccatggaggtgctgg

SEQ ID NO: 8385072 - DNA, 22 bp, Homo sapiens
gggaagctgaagctagagaaaa

SEQ ID NO: 8385073 - DNA, 18 bp, Homo sapiens
gggaagccgggaagccgg

SEQ ID NO: 8385074 - DNA, 22 bp, Homo sapiens
gggaaaggatcagtgggaggct

SEQ ID NO: 8385075 - DNA, 22 bp, Homo sapiens
gggaaggaaatcttgcttgtga

SEQ ID NO: 8385076 - DNA, 22 bp, Homo sapiens
gggaaggacacagccatgactg

SEQ ID NO: 8385077 - DNA, 22 bp, Homo sapiens
gggaaggaggtggcttgaagtg

SEQ ID NO: 8385078 - DNA, 22 bp, Homo sapiens
gggaaggaggtggacctgcccc

SEQ ID NO: 8385079 - DNA, 22 bp, Homo sapiens
gggacacaggtatctcaaatga

SEQ ID NO: 8385080 - DNA, 22 bp, Homo sapiens
gggacacagagaaactggagaa

SEQ ID NO: 8385081 - DNA, 22 bp, Homo sapiens
gggacagaggcaaactagcaga

SEQ ID NO: 8385082 - DNA, 22 bp, Homo sapiens
gggacagacccatgggccaggt

SEQ ID NO: 8385083 - DNA, 22 bp, Homo sapiens
gggaaagagaggtggacgcagg

SEQ ID NO: 8385084 - DNA, 22 bp, Homo sapiens
gggaaagagaggtggacgcagg

SEQ ID NO: 8385085 - DNA, 22 bp, Homo sapiens
gggaaagagtgcttgtccagag

SEQ ID NO: 8385086 - DNA, 22 bp, Homo sapiens
gggaaagagtgcttgtccagag

SEQ ID NO: 8385087 - DNA, 22 bp, Homo sapiens
gggaaagagaggtggacgcagg

SEQ ID NO: 8385088 - DNA, 22 bp, Homo sapiens
gggaaagacttattttgacttc

SEQ ID NO: 8385089 - DNA, 22 bp, Homo sapiens
gggaaagaccttcctggggtgt

SEQ ID NO: 8385090 - DNA, 22 bp, Homo sapiens
gggaaactgtccagttctcccc

SEQ ID NO: 8385091 - DNA, 22 bp, Homo sapiens
gggaaagaagaagagccatttt

SEQ ID NO: 8385092 - DNA, 22 bp, Homo sapiens
gggaaagaccctgagtcttatt

SEQ ID NO: 8385093 - DNA, 22 bp, Homo sapiens
gggaaagaagatctagatactg

SEQ ID NO: 8385094 - DNA, 22 bp, Homo sapiens
gggaaaatattaagcaggactt

SEQ ID NO: 8385095 - DNA, 22 bp, Homo sapiens
cagaaggtttgaaagatgtctt

SEQ ID NO: 8385096 - DNA, 22 bp, Homo sapiens
cactggcctaagcgcctcagcc

SEQ ID NO: 8385097 - DNA, 22 bp, Homo sapiens
cactggctgagcttctctaggg

SEQ ID NO: 8385098 - DNA, 22 bp, Homo sapiens
cactgggagagctggacttggg

SEQ ID NO: 8385099 - DNA, 22 bp, Homo sapiens
cagaaggcaaggcctgccacgc

SEQ ID NO: 8385100 - DNA, 22 bp, Homo sapiens
cagaagggacagggtttgtaga

SEQ ID NO: 8385101 - DNA, 22 bp, Homo sapiens
caacctgatgaattgaatttaa

SEQ ID NO: 8385102 - DNA, 22 bp, Homo sapiens
gctgcctgccttgcctggagga

SEQ ID NO: 8385103 - DNA, 22 bp, Homo sapiens
caagacaagatctaagcatgct

SEQ ID NO: 8385104 - DNA, 22 bp, Homo sapiens
caagagctgcaaatagcgtgac

SEQ ID NO: 8385105 - DNA, 22 bp, Homo sapiens
caagagctgaggctggagaggt

SEQ ID NO: 8385106 - DNA, 22 bp, Homo sapiens
gctgctggcactggagtgagcc

SEQ ID NO: 8385107 - DNA, 22 bp, Homo sapiens
gctgctggatgcgcttgatggt

SEQ ID NO: 8385108 - DNA, 22 bp, Homo sapiens
gctgctggagagcgagactgtt

SEQ ID NO: 8385109 - DNA, 22 bp, Homo sapiens
caaggacactgatgttcatcct

SEQ ID NO: 8385110 - DNA, 22 bp, Homo sapiens
caaggacagcgtcaggtgcaac

SEQ ID NO: 8385111 - DNA, 22 bp, Homo sapiens
caaggagaaaacggcttctgaa

SEQ ID NO: 8385112 - DNA, 22 bp, Homo sapiens
caaggaggcagtgggacttgaa

SEQ ID NO: 8385113 - DNA, 22 bp, Homo sapiens
caaggaggaagatgcaggggac

SEQ ID NO: 8385114 - DNA, 22 bp, Homo sapiens
caagctgcttattctctgctct

SEQ ID NO: 8385115 - DNA, 22 bp, Homo sapiens
caaggacaacttcatattgtgg

SEQ ID NO: 8385116 - DNA, 22 bp, Homo sapiens
caagctgccaccagaagagcat

SEQ ID NO: 8385117 - DNA, 22 bp, Homo sapiens
caagagctgggtggcaagctag

SEQ ID NO: 8385118 - DNA, 18 bp, Homo sapiens
gctcctggaccaggtcac

SEQ ID NO: 8385119 - DNA, 22 bp, Homo sapiens
gctcctgccctcttgcaattcc

SEQ ID NO: 8385120 - DNA, 22 bp, Homo sapiens
gctcctgaaggctctgcagggt

SEQ ID NO: 8385121 - DNA, 22 bp, Homo sapiens
caaagtatatttcatagtctca

SEQ ID NO: 8385122 - DNA, 22 bp, Homo sapiens
gctcctggagagattgagaaag

SEQ ID NO: 8385123 - DNA, 18 bp, Homo sapiens
gctcctggagtctgactc

SEQ ID NO: 8385124 - DNA, 19 bp, Homo sapiens
gctcctggatgacctgtgg

SEQ ID NO: 8385125 - DNA, 22 bp, Homo sapiens
gctgcagcccggcgcgcctgag

SEQ ID NO: 8385126 - DNA, 22 bp, Homo sapiens
gctgcagccaaattcattgtca

SEQ ID NO: 8385127 - DNA, 22 bp, Homo sapiens
gctgcagcagctgcagggttgt

SEQ ID NO: 8385128 - DNA, 19 bp, Homo sapiens
gctgcagcagagaaactgg

SEQ ID NO: 8385129 - DNA, 22 bp, Homo sapiens
gctgcagcaagccctccagggg

SEQ ID NO: 8385130 - DNA, 22 bp, Homo sapiens
gctgcagcagaagttctcagag

SEQ ID NO: 8385131 - DNA, 22 bp, Homo sapiens
caacatatgattttgtatataa

SEQ ID NO: 8385132 - DNA, 22 bp, Homo sapiens
caacatttgtgatgagcaaact

SEQ ID NO: 8385133 - DNA, 22 bp, Homo sapiens
caacatttgagtaaagaaatgg

SEQ ID NO: 8385134 - DNA, 22 bp, Homo sapiens
caacatttgagtaaagaaatgg

SEQ ID NO: 8385135 - DNA, 22 bp, Homo sapiens
caacatttcaaggtctttagga

SEQ ID NO: 8385136 - DNA, 22 bp, Homo sapiens
gctgcagccctgcggatcactt

SEQ ID NO: 8385137 - DNA, 22 bp, Homo sapiens
gctgcagcctttgggaaggaca

SEQ ID NO: 8385138 - DNA, 22 bp, Homo sapiens
gctgcagccttcttgccattaa

SEQ ID NO: 8385139 - DNA, 17 bp, Homo sapiens
gctgcagcggtaggcag

SEQ ID NO: 8385140 - DNA, 22 bp, Homo sapiens
gctgcaggtttgtctagtctgg

SEQ ID NO: 8385141 - DNA, 22 bp, Homo sapiens
gctgcagtgagccaagatcgtg

SEQ ID NO: 8385142 - DNA, 22 bp, Homo sapiens
gctgcatgacagacaggcctgg

SEQ ID NO: 8385143 - DNA, 22 bp, Homo sapiens
gctgcatggagggtgcccagga

SEQ ID NO: 8385144 - DNA, 21 bp, Homo sapiens
gctgccaccgcgtgctccagg

SEQ ID NO: 8385145 - DNA, 22 bp, Homo sapiens
caacactgattatggctgagct

SEQ ID NO: 8385146 - DNA, 22 bp, Homo sapiens
ggaaaagaattgcagtgaagta

SEQ ID NO: 8385147 - DNA, 22 bp, Homo sapiens
ggaaaagaattgcagtgaagta

SEQ ID NO: 8385148 - DNA, 22 bp, Homo sapiens
ggaaaagacagaattctagaat

SEQ ID NO: 8385149 - DNA, 22 bp, Homo sapiens
ggaaaagacagaattctagaat

SEQ ID NO: 8385150 - DNA, 22 bp, Homo sapiens
ggaaaagaaagggactgattgg

SEQ ID NO: 8385151 - DNA, 17 bp, Homo sapiens
ggaaaagaagagtagga

SEQ ID NO: 8385152 - DNA, 17 bp, Homo sapiens
ggaaaagaagagtagga

SEQ ID NO: 8385153 - DNA, 22 bp, Homo sapiens
ggaaaactgaggctctcagcag

SEQ ID NO: 8385154 - DNA, 21 bp, Homo sapiens
ggaaaactttccttgtctgaa

SEQ ID NO: 8385155 - DNA, 22 bp, Homo sapiens
ggaaaagaaagggactgattgg

SEQ ID NO: 8385156 - DNA, 22 bp, Homo sapiens
cacaaaatatcaagcactttta

SEQ ID NO: 8385157 - DNA, 22 bp, Homo sapiens
cacaaaatatcaagcactttta

SEQ ID NO: 8385158 - DNA, 23 bp, Homo sapiens
cacaaaggttccattctctcacc

SEQ ID NO: 8385159 - DNA, 18 bp, Homo sapiens
ggaaaaggagtgtctagc

SEQ ID NO: 8385160 - DNA, 22 bp, Homo sapiens
ggaaaaggccattgtttctctg

SEQ ID NO: 8385161 - DNA, 22 bp, Homo sapiens
ggaaaagtgttaaggtgttgat

SEQ ID NO: 8385162 - DNA, 22 bp, Homo sapiens
cacaactttaggaaccacattc

SEQ ID NO: 8385163 - DNA, 22 bp, Homo sapiens
cacaactttccttgactgtaag

SEQ ID NO: 8385164 - DNA, 22 bp, Homo sapiens
cacaataaatgtttgctgatga

SEQ ID NO: 8385165 - DNA, 22 bp, Homo sapiens
cacaatgcagcatgtaaatgca

SEQ ID NO: 8385166 - DNA, 22 bp, Homo sapiens
cacacccaaatttctctctcag

SEQ ID NO: 8385167 - DNA, 23 bp, Homo sapiens
cacacccatcactaagagctcct

SEQ ID NO: 8385168 - DNA, 19 bp, Homo sapiens
cacacccatgcttgccaag

SEQ ID NO: 8385169 - DNA, 22 bp, Homo sapiens
cacacctcacacctcgcatgct

SEQ ID NO: 8385170 - DNA, 22 bp, Homo sapiens
cacaccttaggcctgagcgctt

SEQ ID NO: 8385171 - DNA, 22 bp, Homo sapiens
cacacgtgtgagagctgtggca

SEQ ID NO: 8385172 - DNA, 21 bp, Homo sapiens
cacaccaggcatgtcttgagc

SEQ ID NO: 8385173 - DNA, 22 bp, Homo sapiens
cacaccagaggttacctgcaaa

SEQ ID NO: 8385174 - DNA, 22 bp, Homo sapiens
cacacattgaattcattcttgt

SEQ ID NO: 8385175 - DNA, 22 bp, Homo sapiens
cacacattggttttactccttt

SEQ ID NO: 8385176 - DNA, 19 bp, Homo sapiens
cacaattatgagacactta

SEQ ID NO: 8385177 - DNA, 22 bp, Homo sapiens
cacaattgtatcagaaaatagt

SEQ ID NO: 8385178 - DNA, 18 bp, Homo sapiens
cacaatttacagatgaca

SEQ ID NO: 8385179 - DNA, 22 bp, Homo sapiens
cacaatttcagttgcatgcaac

SEQ ID NO: 8385180 - DNA, 22 bp, Homo sapiens
cacacattaatatcaaaggctc

SEQ ID NO: 8385181 - DNA, 22 bp, Homo sapiens
cacaatttggtgctaaagaaag

SEQ ID NO: 8385182 - DNA, 22 bp, Homo sapiens
cacaatttccttgcttcacttt

SEQ ID NO: 8385183 - DNA, 22 bp, Homo sapiens
cacaatttggacttcactggtt

SEQ ID NO: 8385184 - DNA, 22 bp, Homo sapiens
gctgtgcttgcatgagtgtctg

SEQ ID NO: 8385185 - DNA, 22 bp, Homo sapiens
gctgtgcttgcatgagtgtctg

SEQ ID NO: 8385186 - DNA, 22 bp, Homo sapiens
gctgtgcttgggaagaatctct

SEQ ID NO: 8385187 - DNA, 22 bp, Homo sapiens
gctgtgcttttggtagatccca

SEQ ID NO: 8385188 - DNA, 22 bp, Homo sapiens
gctgtgctgcgggaggattccg

SEQ ID NO: 8385189 - DNA, 22 bp, Homo sapiens
gctgtgctgattcattccctgc

SEQ ID NO: 8385190 - DNA, 20 bp, Homo sapiens
gctgtggcaaagctttgtgt

SEQ ID NO: 8385191 - DNA, 20 bp, Homo sapiens
gctgtggcaaagctttgtgt

SEQ ID NO: 8385192 - DNA, 20 bp, Homo sapiens
gctgtggcaagtgctcactg

SEQ ID NO: 8385193 - DNA, 22 bp, Homo sapiens
gctgtggcccttggcatctgcg

SEQ ID NO: 8385194 - DNA, 19 bp, Homo sapiens
gctgtctgatgctgaggtc

SEQ ID NO: 8385195 - DNA, 22 bp, Homo sapiens
gctgtctgcatctctagagctt

SEQ ID NO: 8385196 - DNA, 21 bp, Homo sapiens
gctgtctctggctcctgggaa

SEQ ID NO: 8385197 - DNA, 22 bp, Homo sapiens
gctgtctcgcctgacactggct

SEQ ID NO: 8385198 - DNA, 22 bp, Homo sapiens
caaggcagctattgtctccata

SEQ ID NO: 8385199 - DNA, 22 bp, Homo sapiens
caaggcagctattgtctccata

SEQ ID NO: 8385200 - DNA, 22 bp, Homo sapiens
caaggcagcgttcctttctgga

SEQ ID NO: 8385201 - DNA, 22 bp, Homo sapiens
caaggcagctgtagggatttgg

SEQ ID NO: 8385202 - DNA, 22 bp, Homo sapiens
gctgtctccatagctgtgtgtc

SEQ ID NO: 8385203 - DNA, 21 bp, Homo sapiens
gctgtctcctccttgcaccag

SEQ ID NO: 8385204 - DNA, 22 bp, Homo sapiens
caaggcagaattcagactcagg

SEQ ID NO: 8385205 - DNA, 22 bp, Homo sapiens
caaggcagaattcagactcagg

SEQ ID NO: 8385206 - DNA, 22 bp, Homo sapiens
caaggcagaattcagactcagg

SEQ ID NO: 8385207 - DNA, 20 bp, Homo sapiens
caaggcagaccagagtgagt

SEQ ID NO: 8385208 - DNA, 22 bp, Homo sapiens
caaggcagaattcagactcagg

SEQ ID NO: 8385209 - DNA, 20 bp, Homo sapiens
caaggcagaccagagtgagt

SEQ ID NO: 8385210 - DNA, 20 bp, Homo sapiens
caaggcagaccagagtgagt

SEQ ID NO: 8385211 - DNA, 22 bp, Homo sapiens
caaggcagcccgctgaaccaca

SEQ ID NO: 8385212 - DNA, 22 bp, Homo sapiens
caaggcagcgttcctttctgga

SEQ ID NO: 8385213 - DNA, 22 bp, Homo sapiens
caaggcagcccgctgaaccaca

SEQ ID NO: 8385214 - DNA, 22 bp, Homo sapiens
gcttctcctcccgctcccaggc

SEQ ID NO: 8385215 - DNA, 22 bp, Homo sapiens
gcttctccagaccttcatcccc

SEQ ID NO: 8385216 - DNA, 20 bp, Homo sapiens
gctgtggccgtgccagactc

SEQ ID NO: 8385217 - DNA, 18 bp, Homo sapiens
gcttctcatttctaagca

SEQ ID NO: 8385218 - DNA, 22 bp, Homo sapiens
gcttctccagaccttcatcccc

SEQ ID NO: 8385219 - DNA, 22 bp, Homo sapiens
gcttctcatgtttatttttaca

SEQ ID NO: 8385220 - DNA, 20 bp, Homo sapiens
gcttctcagggcttctctga

SEQ ID NO: 8385221 - DNA, 22 bp, Homo sapiens
gcttggctcctggctcacaggt

SEQ ID NO: 8385222 - DNA, 22 bp, Homo sapiens
gcttctgaggaaggctcagcct

SEQ ID NO: 8385223 - DNA, 22 bp, Homo sapiens
gcttggcattggtttctctaag

SEQ ID NO: 8385224 - DNA, 22 bp, Homo sapiens
cacactgtcaggtaaataacac

SEQ ID NO: 8385225 - DNA, 22 bp, Homo sapiens
cacagctggtgcactagctctg

SEQ ID NO: 8385226 - DNA, 22 bp, Homo sapiens
ggaggcggacacaggtagtgtt

SEQ ID NO: 8385227 - DNA, 23 bp, Homo sapiens
ggatgggcaagcctagtgcctac

SEQ ID NO: 8385228 - DNA, 22 bp, Homo sapiens
ggatgggagcagaggacgacca

SEQ ID NO: 8385229 - DNA, 23 bp, Homo sapiens
cacagggagggaaactctttcag

SEQ ID NO: 8385230 - DNA, 22 bp, Homo sapiens
cacagggagttacagaagcact

SEQ ID NO: 8385231 - DNA, 22 bp, Homo sapiens
cacagggagttacagaagcact

SEQ ID NO: 8385232 - DNA, 22 bp, Homo sapiens
cacagggaggcggtcactggct

SEQ ID NO: 8385233 - DNA, 22 bp, Homo sapiens
cacagggcagagacctgggtgc

SEQ ID NO: 8385234 - DNA, 22 bp, Homo sapiens
cacagggagaggaacagcgcag

SEQ ID NO: 8385235 - DNA, 22 bp, Homo sapiens
cacagggaggcagccatgctcc

SEQ ID NO: 8385236 - DNA, 22 bp, Homo sapiens
cacagggaggacatcaacagtg

SEQ ID NO: 8385237 - DNA, 22 bp, Homo sapiens
ggatgggctgaaaggtagcccc

SEQ ID NO: 8385238 - DNA, 22 bp, Homo sapiens
ggatgggcccgggacggcgctg

SEQ ID NO: 8385239 - DNA, 22 bp, Homo sapiens
ggatgtcgaggatggggtagca

SEQ ID NO: 8385240 - DNA, 22 bp, Homo sapiens
cacagtgtagttaatgtgacat

SEQ ID NO: 8385241 - DNA, 22 bp, Homo sapiens
ggcagcagttacaaatgtgcag

SEQ ID NO: 8385242 - DNA, 22 bp, Homo sapiens
ggcagcagttacaaatgtgcag

SEQ ID NO: 8385243 - DNA, 22 bp, Homo sapiens
ggcagcagtggctgctattgtc

SEQ ID NO: 8385244 - DNA, 22 bp, Homo sapiens
ggcagcatctctggcagcagct

SEQ ID NO: 8385245 - DNA, 22 bp, Homo sapiens
ggcagcatatattcagtgggca

SEQ ID NO: 8385246 - DNA, 20 bp, Homo sapiens
ggcagccaatcagcgtgccg

SEQ ID NO: 8385247 - DNA, 22 bp, Homo sapiens
ggcagccaccctgggaggcaga

SEQ ID NO: 8385248 - DNA, 22 bp, Homo sapiens
cacagtgctttatgagagatct

SEQ ID NO: 8385249 - DNA, 22 bp, Homo sapiens
cacagtgctttatgagagatct

SEQ ID NO: 8385250 - DNA, 16 bp, Homo sapiens
cacagtgctgctgctc

SEQ ID NO: 8385251 - DNA, 22 bp, Homo sapiens
cacagtgctcgggttttatgtc

SEQ ID NO: 8385252 - DNA, 22 bp, Homo sapiens
cacagtgctcaaacacaagtgc

SEQ ID NO: 8385253 - DNA, 22 bp, Homo sapiens
cacagtgctcgggttttatgtc

SEQ ID NO: 8385254 - DNA, 22 bp, Homo sapiens
cacagtgctttacatgttttct

SEQ ID NO: 8385255 - DNA, 22 bp, Homo sapiens
cacagtgctgtttgtaaagaga

SEQ ID NO: 8385256 - DNA, 22 bp, Homo sapiens
cacagtgctgtttgtaaagaga

SEQ ID NO: 8385257 - DNA, 22 bp, Homo sapiens
ggcagagcttgcagtgagccga

SEQ ID NO: 8385258 - DNA, 22 bp, Homo sapiens
cacagtgcgaaagaaacccagc

SEQ ID NO: 8385259 - DNA, 22 bp, Homo sapiens
cacagtgctcaaacacaagtgc

SEQ ID NO: 8385260 - DNA, 21 bp, Homo sapiens
ggcagagctggggcctccagc

SEQ ID NO: 8385261 - DNA, 22 bp, Homo sapiens
ggcagagctagtggcttctctt

SEQ ID NO: 8385262 - DNA, 22 bp, Homo sapiens
ggcagagctctggactgagaac

SEQ ID NO: 8385263 - DNA, 22 bp, Homo sapiens
ggcagagcgcatgcgtcgcaga

SEQ ID NO: 8385264 - DNA, 22 bp, Homo sapiens
ggcacagggaggccctggtgtg

SEQ ID NO: 8385265 - DNA, 22 bp, Homo sapiens
ggcacagggagccgcagttgca

SEQ ID NO: 8385266 - DNA, 22 bp, Homo sapiens
ggcacagggggctgaggactag

SEQ ID NO: 8385267 - DNA, 22 bp, Homo sapiens
ggcacagggggctgaggactag

SEQ ID NO: 8385268 - DNA, 22 bp, Homo sapiens
ggcacagggggctgaggactag

SEQ ID NO: 8385269 - DNA, 22 bp, Homo sapiens
ggcacagggaggccctggtgtg

SEQ ID NO: 8385270 - DNA, 22 bp, Homo sapiens
ggcacagggggctgaggactag

SEQ ID NO: 8385271 - DNA, 22 bp, Homo sapiens
ggcacaggagtcacagcatttc

SEQ ID NO: 8385272 - DNA, 22 bp, Homo sapiens
ggcacaggagtcacagcatttc

SEQ ID NO: 8385273 - DNA, 22 bp, Homo sapiens
ggcacagggagaggcggatttt

SEQ ID NO: 8385274 - DNA, 22 bp, Homo sapiens
ggcacagggagccgcagttgca

SEQ ID NO: 8385275 - DNA, 22 bp, Homo sapiens
ggcacaaggtttaaataacatc

SEQ ID NO: 8385276 - DNA, 22 bp, Homo sapiens
ggcactggcaaagcaaagtctg

SEQ ID NO: 8385277 - DNA, 16 bp, Homo sapiens
ggcactggcaggtcct

SEQ ID NO: 8385278 - DNA, 22 bp, Homo sapiens
ggcactggcctggggccaagag

SEQ ID NO: 8385279 - DNA, 22 bp, Homo sapiens
ggcactggaagtcccattgtct

SEQ ID NO: 8385280 - DNA, 22 bp, Homo sapiens
ggcactggagactgttatgaga

SEQ ID NO: 8385281 - DNA, 22 bp, Homo sapiens
ggcactggaaggatcatgtgag

SEQ ID NO: 8385282 - DNA, 22 bp, Homo sapiens
ggcacatggagacttggcatca

SEQ ID NO: 8385283 - DNA, 20 bp, Homo sapiens
ggcactggaagcacacagga

SEQ ID NO: 8385284 - DNA, 22 bp, Homo sapiens
ggcagagcctcagccctccacc

SEQ ID NO: 8385285 - DNA, 22 bp, Homo sapiens
ggcagagagttctccacctctc

SEQ ID NO: 8385286 - DNA, 22 bp, Homo sapiens
ggcactgggaatgcagtgatga

SEQ ID NO: 8385287 - DNA, 22 bp, Homo sapiens
ggcactgggagaggtgagacgg

SEQ ID NO: 8385288 - DNA, 22 bp, Homo sapiens
ggcactgggcaccggctgaggg

SEQ ID NO: 8385289 - DNA, 22 bp, Homo sapiens
ggcactgggcaccggctgaggg

SEQ ID NO: 8385290 - DNA, 22 bp, Homo sapiens
cacccagagcagacactgtcca

SEQ ID NO: 8385291 - DNA, 22 bp, Homo sapiens
cacccagagcctgagagggata

SEQ ID NO: 8385292 - DNA, 22 bp, Homo sapiens
cacccagagcctgagagggata

SEQ ID NO: 8385293 - DNA, 22 bp, Homo sapiens
caccatgactggttgagagagg

SEQ ID NO: 8385294 - DNA, 22 bp, Homo sapiens
cacccacattcctctagtatgt

SEQ ID NO: 8385295 - DNA, 22 bp, Homo sapiens
ggcagctgagatcatgctgttg

SEQ ID NO: 8385296 - DNA, 22 bp, Homo sapiens
ggcagctgagatcatgctgttg

SEQ ID NO: 8385297 - DNA, 20 bp, Homo sapiens
caccagtcatgagtcaatac

SEQ ID NO: 8385298 - DNA, 22 bp, Homo sapiens
caccagtctttattttgttatt

SEQ ID NO: 8385299 - DNA, 16 bp, Homo sapiens
caccagtccttcctgc

SEQ ID NO: 8385300 - DNA, 22 bp, Homo sapiens
ggcagctgattagcatcaagga

SEQ ID NO: 8385301 - DNA, 22 bp, Homo sapiens
ggcagctgattagcatcaagga

SEQ ID NO: 8385302 - DNA, 18 bp, Homo sapiens
caccctccgcggctgccc

SEQ ID NO: 8385303 - DNA, 22 bp, Homo sapiens
caccctgctacaaagcctcctg

SEQ ID NO: 8385304 - DNA, 22 bp, Homo sapiens
caccctggaaagaaggtctggg

SEQ ID NO: 8385305 - DNA, 22 bp, Homo sapiens
cactctgagaaacactaaacca

SEQ ID NO: 8385306 - DNA, 22 bp, Homo sapiens
cactctgagaagtacaagctcc

SEQ ID NO: 8385307 - DNA, 20 bp, Homo sapiens
caccctcccagcacctatgc

SEQ ID NO: 8385308 - DNA, 22 bp, Homo sapiens
caccccttgtctttggggtcgt

SEQ ID NO: 8385309 - DNA, 22 bp, Homo sapiens
caccctcccgtcagcccctggg

SEQ ID NO: 8385310 - DNA, 20 bp, Homo sapiens
caccctcccagcacctatgc

SEQ ID NO: 8385311 - DNA, 18 bp, Homo sapiens
caccctccgcggctgccc

SEQ ID NO: 8385312 - DNA, 22 bp, Homo sapiens
cacccctgggctgggcacacag

SEQ ID NO: 8385313 - DNA, 22 bp, Homo sapiens
cacccctgtggagcatggtggc

SEQ ID NO: 8385314 - DNA, 22 bp, Homo sapiens
cacccctgtggagcatggtggc

SEQ ID NO: 8385315 - DNA, 22 bp, Homo sapiens
cacccctacctgagtcaggagt

SEQ ID NO: 8385316 - DNA, 22 bp, Homo sapiens
cacccccagcagggaaaggagg

SEQ ID NO: 8385317 - DNA, 22 bp, Homo sapiens
caccccagcttctcaggataga

SEQ ID NO: 8385318 - DNA, 22 bp, Homo sapiens
caccccaagttctgtccactgc

SEQ ID NO: 8385319 - DNA, 22 bp, Homo sapiens
caccccaagttctgtccactgc

SEQ ID NO: 8385320 - DNA, 22 bp, Homo sapiens
cacccagtaagcatgaggccct

SEQ ID NO: 8385321 - DNA, 22 bp, Homo sapiens
cacccaggttggagtgcagtgg

SEQ ID NO: 8385322 - DNA, 22 bp, Homo sapiens
cacccaggttggagtgcagtgg

SEQ ID NO: 8385323 - DNA, 22 bp, Homo sapiens
cacccaggctggaatgcagtgg

SEQ ID NO: 8385324 - DNA, 22 bp, Homo sapiens
cacccaggctagagtgcagtgg

SEQ ID NO: 8385325 - DNA, 22 bp, Homo sapiens
ggcatcagaggtgtgttctgct

SEQ ID NO: 8385326 - DNA, 22 bp, Homo sapiens
cactgagagatgtgtcacagca

SEQ ID NO: 8385327 - DNA, 21 bp, Homo sapiens
cactgaggaggaaaaggagct

SEQ ID NO: 8385328 - DNA, 19 bp, Homo sapiens
cactgagctctgttcacta

SEQ ID NO: 8385329 - DNA, 22 bp, Homo sapiens
cactgagctgatttcaggtgcc

SEQ ID NO: 8385330 - DNA, 22 bp, Homo sapiens
cactgagcaagtcagtacagca

SEQ ID NO: 8385331 - DNA, 22 bp, Homo sapiens
cactgagccttgccagcttggt

SEQ ID NO: 8385332 - DNA, 22 bp, Homo sapiens
cactgagcatgagtgggctgtg

SEQ ID NO: 8385333 - DNA, 22 bp, Homo sapiens
cactgaggctgggggagaaggt

SEQ ID NO: 8385334 - DNA, 21 bp, Homo sapiens
cactgaggaggaaaaggagct

SEQ ID NO: 8385335 - DNA, 22 bp, Homo sapiens
ggcctctctagcatccagcctg

SEQ ID NO: 8385336 - DNA, 22 bp, Homo sapiens
ggcctctcattctccctggtcc

SEQ ID NO: 8385337 - DNA, 22 bp, Homo sapiens
ggcctctcgaagcttcagtcca

SEQ ID NO: 8385338 - DNA, 22 bp, Homo sapiens
ggcctctctagcatccagcctg

SEQ ID NO: 8385339 - DNA, 22 bp, Homo sapiens
cactgcagcctcgctctcctga

SEQ ID NO: 8385340 - DNA, 22 bp, Homo sapiens
cactgcaggtctgagatggggg

SEQ ID NO: 8385341 - DNA, 20 bp, Homo sapiens
cactggaaagcaggcgactc

SEQ ID NO: 8385342 - DNA, 22 bp, Homo sapiens
cactggaagttcattctcagaa

SEQ ID NO: 8385343 - DNA, 22 bp, Homo sapiens
cactgctttttctcctcactgg

SEQ ID NO: 8385344 - DNA, 22 bp, Homo sapiens
cactgctttttctcctcactgg

SEQ ID NO: 8385345 - DNA, 22 bp, Homo sapiens
cactgcttttcagacagttatt

SEQ ID NO: 8385346 - DNA, 22 bp, Homo sapiens
cactggacagagtggggttccc

SEQ ID NO: 8385347 - DNA, 18 bp, Homo sapiens
cactggacctcatgagag

SEQ ID NO: 8385348 - DNA, 18 bp, Homo sapiens
cactggacctcatgagag

SEQ ID NO: 8385349 - DNA, 18 bp, Homo sapiens
cactggacctcatgagag

SEQ ID NO: 8385350 - DNA, 22 bp, Homo sapiens
cactggaggtcagtggagcact

SEQ ID NO: 8385351 - DNA, 22 bp, Homo sapiens
cactggcattagtcacgaggca

SEQ ID NO: 8385352 - DNA, 22 bp, Homo sapiens
cactgcatggatgatggctgta

SEQ ID NO: 8385353 - DNA, 22 bp, Homo sapiens
cactgcagtaactctaggactg

SEQ ID NO: 8385354 - DNA, 22 bp, Homo sapiens
cactgcagtcttcatcaaccaa

SEQ ID NO: 8385355 - DNA, 22 bp, Homo sapiens
ggctagggactcctcctcaggg

SEQ ID NO: 8385356 - DNA, 22 bp, Homo sapiens
ggctagggagacagagggcatg

SEQ ID NO: 8385357 - DNA, 22 bp, Homo sapiens
ggctaggggaataatctgtggt

SEQ ID NO: 8385358 - DNA, 22 bp, Homo sapiens
atcctaaagcagacagcaggtt

SEQ ID NO: 8385359 - DNA, 19 bp, Homo sapiens
atcctaaatccagtttcta

SEQ ID NO: 8385360 - DNA, 22 bp, Homo sapiens
atcctagaatcagcccttgctg

SEQ ID NO: 8385361 - DNA, 22 bp, Homo sapiens
atcctacaaagcagggctatgg

SEQ ID NO: 8385362 - DNA, 21 bp, Homo sapiens
atcctatttctgaaaacctgc

SEQ ID NO: 8385363 - DNA, 22 bp, Homo sapiens
atcctcagacctcagcaaagcc

SEQ ID NO: 8385364 - DNA, 23 bp, Homo sapiens
atcctctctccatcccactgtgc

SEQ ID NO: 8385365 - DNA, 22 bp, Homo sapiens
atcctctctcccataccagtct

SEQ ID NO: 8385366 - DNA, 22 bp, Homo sapiens
atcctctctgtgacagggaacg

SEQ ID NO: 8385367 - DNA, 22 bp, Homo sapiens
atcctcagtgtttctgacatct

SEQ ID NO: 8385368 - DNA, 22 bp, Homo sapiens
atcctcagtgtttctgacatct

SEQ ID NO: 8385369 - DNA, 22 bp, Homo sapiens
atcctttagtcctacaactcga

SEQ ID NO: 8385370 - DNA, 22 bp, Homo sapiens
atctacaatgtctggctgcact

SEQ ID NO: 8385371 - DNA, 22 bp, Homo sapiens
atccacaggtcatgtaatgtgg

SEQ ID NO: 8385372 - DNA, 22 bp, Homo sapiens
atccacatttaggtctctaaaa

SEQ ID NO: 8385373 - DNA, 17 bp, Homo sapiens
atccccagcatctagaa

SEQ ID NO: 8385374 - DNA, 22 bp, Homo sapiens
atccacatttaggtctctaaaa

SEQ ID NO: 8385375 - DNA, 22 bp, Homo sapiens
atccatttgtaaatgttagagt

SEQ ID NO: 8385376 - DNA, 22 bp, Homo sapiens
atccccttcacaccctctgcat

SEQ ID NO: 8385377 - DNA, 22 bp, Homo sapiens
atccctcagccacctttgagga

SEQ ID NO: 8385378 - DNA, 22 bp, Homo sapiens
atccctctctgcatgactgtgt

SEQ ID NO: 8385379 - DNA, 22 bp, Homo sapiens
atcattctagtccttatggtct

SEQ ID NO: 8385380 - DNA, 22 bp, Homo sapiens
atcattctagctgttgtgttga

SEQ ID NO: 8385381 - DNA, 22 bp, Homo sapiens
ctgtggagtgcttggctcagtg

SEQ ID NO: 8385382 - DNA, 22 bp, Homo sapiens
ctgtggagcagggcagggtcac

SEQ ID NO: 8385383 - DNA, 22 bp, Homo sapiens
atccaacaggacaaagaaagga

SEQ ID NO: 8385384 - DNA, 22 bp, Homo sapiens
atccaagcagaatcacgtgaga

SEQ ID NO: 8385385 - DNA, 22 bp, Homo sapiens
atccacaagaccccttttcact

SEQ ID NO: 8385386 - DNA, 22 bp, Homo sapiens
atccaattctaatattgtgttt

SEQ ID NO: 8385387 - DNA, 22 bp, Homo sapiens
atccaattacgttttttgtcat

SEQ ID NO: 8385388 - DNA, 22 bp, Homo sapiens
atccaaaggtgacacagaatac

SEQ ID NO: 8385389 - DNA, 22 bp, Homo sapiens
atcatttttaagagactcttct

SEQ ID NO: 8385390 - DNA, 22 bp, Homo sapiens
atcattttgtgacaatgcctgt

SEQ ID NO: 8385391 - DNA, 22 bp, Homo sapiens
atcattttatggctgagaggac

SEQ ID NO: 8385392 - DNA, 22 bp, Homo sapiens
atccaaaatttactgtagcatt

SEQ ID NO: 8385393 - DNA, 18 bp, Homo sapiens
atccaaaaagatggaagt

SEQ ID NO: 8385394 - DNA, 22 bp, Homo sapiens
ctgtccagtctttagcaagctg

SEQ ID NO: 8385395 - DNA, 22 bp, Homo sapiens
ctgtccagtgactttgggccat

SEQ ID NO: 8385396 - DNA, 22 bp, Homo sapiens
ctgtcccttcccaagcccagcc

SEQ ID NO: 8385397 - DNA, 22 bp, Homo sapiens
ctgggtctaaaaattctcagat

SEQ ID NO: 8385398 - DNA, 22 bp, Homo sapiens
atatttgtggtaaaggtaagaa

SEQ ID NO: 8385399 - DNA, 22 bp, Homo sapiens
atatttgtcaattcactgttca

SEQ ID NO: 8385400 - DNA, 22 bp, Homo sapiens
atatttgtcaattcactgttca

SEQ ID NO: 8385401 - DNA, 22 bp, Homo sapiens
ctgggtagaagattcctcagga

SEQ ID NO: 8385402 - DNA, 22 bp, Homo sapiens
ctgggtagggtgatatcccaca

SEQ ID NO: 8385403 - DNA, 22 bp, Homo sapiens
atcacatggaatgattttagac

SEQ ID NO: 8385404 - DNA, 22 bp, Homo sapiens
atcacatatatgcaccaagaca

SEQ ID NO: 8385405 - DNA, 22 bp, Homo sapiens
atcacagttttgtgccttgtgg

SEQ ID NO: 8385406 - DNA, 22 bp, Homo sapiens
atcacatatttaagaaacatgt

SEQ ID NO: 8385407 - DNA, 22 bp, Homo sapiens
atcacagttactcaaataatga

SEQ ID NO: 8385408 - DNA, 22 bp, Homo sapiens
atcacaggtggtaggaaaagaa

SEQ ID NO: 8385409 - DNA, 22 bp, Homo sapiens
atcacagtgccttcgtaaattt

SEQ ID NO: 8385410 - DNA, 22 bp, Homo sapiens
ctgtcctccagacgacagtccc

SEQ ID NO: 8385411 - DNA, 22 bp, Homo sapiens
ctgtcctcaccttggcaggggg

SEQ ID NO: 8385412 - DNA, 21 bp, Homo sapiens
ctgtcctcagatgtggacgag

SEQ ID NO: 8385413 - DNA, 22 bp, Homo sapiens
atcacatggaatgattttagac

SEQ ID NO: 8385414 - DNA, 19 bp, Homo sapiens
atcacatgtcaagagcagg

SEQ ID NO: 8385415 - DNA, 19 bp, Homo sapiens
atcacatgtcaagagcagg

SEQ ID NO: 8385416 - DNA, 22 bp, Homo sapiens
ctgtctttagtacaaaaaatgt

SEQ ID NO: 8385417 - DNA, 22 bp, Homo sapiens
ctgtcttctcctttgtttcagg

SEQ ID NO: 8385418 - DNA, 22 bp, Homo sapiens
ctgtcttctaccttcaacctcc

SEQ ID NO: 8385419 - DNA, 22 bp, Homo sapiens
ctgtcttttactatcatttact

SEQ ID NO: 8385420 - DNA, 22 bp, Homo sapiens
ctgtcttttcttctcattgatg

SEQ ID NO: 8385421 - DNA, 22 bp, Homo sapiens
ctgtctttttagagagtaggat

SEQ ID NO: 8385422 - DNA, 22 bp, Homo sapiens
ctgtgatatactcccaagagga

SEQ ID NO: 8385423 - DNA, 22 bp, Homo sapiens
ctgtgatatactcccaagagga

SEQ ID NO: 8385424 - DNA, 22 bp, Homo sapiens
ctgtgataggtcatactgtctc

SEQ ID NO: 8385425 - DNA, 22 bp, Homo sapiens
atcatggaaaggttcagcaagc

SEQ ID NO: 8385426 - DNA, 22 bp, Homo sapiens
ctgtgcagctggcttcctggaa

SEQ ID NO: 8385427 - DNA, 22 bp, Homo sapiens
ctgtgcagcttggcttcaggcc

SEQ ID NO: 8385428 - DNA, 18 bp, Homo sapiens
ctgtgcagcaaactgagc

SEQ ID NO: 8385429 - DNA, 22 bp, Homo sapiens
ctgtgatttctaaagagtagca

SEQ ID NO: 8385430 - DNA, 22 bp, Homo sapiens
atatttgtagtgggtaagaagt

SEQ ID NO: 8385431 - DNA, 22 bp, Homo sapiens
atatttctgggggtgtgtttct

SEQ ID NO: 8385432 - DNA, 22 bp, Homo sapiens
atatttctctcagacatggaag

SEQ ID NO: 8385433 - DNA, 22 bp, Homo sapiens
atatttctctcagacatggaag

SEQ ID NO: 8385434 - DNA, 22 bp, Homo sapiens
atatttagcaacatccttggcc

SEQ ID NO: 8385435 - DNA, 22 bp, Homo sapiens
atatttctctcagacatggaag

SEQ ID NO: 8385436 - DNA, 22 bp, Homo sapiens
atatgtttttggaaagaacaca

SEQ ID NO: 8385437 - DNA, 22 bp, Homo sapiens
atatgtttttcacaggtttaag

SEQ ID NO: 8385438 - DNA, 22 bp, Homo sapiens
atatgttttgtgcttcattggt

SEQ ID NO: 8385439 - DNA, 18 bp, Homo sapiens
atatgttaattaggtagg

SEQ ID NO: 8385440 - DNA, 22 bp, Homo sapiens
atatgttactctttcaagcaga

SEQ ID NO: 8385441 - DNA, 22 bp, Homo sapiens
atatgtttcagtattcaagtca

SEQ ID NO: 8385442 - DNA, 22 bp, Homo sapiens
atatgtgtgatgcatggactaa

SEQ ID NO: 8385443 - DNA, 22 bp, Homo sapiens
atatgtatgtacgcacatattc

SEQ ID NO: 8385444 - DNA, 22 bp, Homo sapiens
atatgggggggcgtgcagagga

SEQ ID NO: 8385445 - DNA, 20 bp, Homo sapiens
atatgcttaatctcactaca

SEQ ID NO: 8385446 - DNA, 22 bp, Homo sapiens
atatgattccactattgtatgg

SEQ ID NO: 8385447 - DNA, 22 bp, Homo sapiens
atatgattccactattgtatgg

SEQ ID NO: 8385448 - DNA, 22 bp, Homo sapiens
atatgagttgatttttagaata

SEQ ID NO: 8385449 - DNA, 22 bp, Homo sapiens
atatgagaattggaaaatatca

SEQ ID NO: 8385450 - DNA, 22 bp, Homo sapiens
atatatcatgagtaaaacttga

SEQ ID NO: 8385451 - DNA, 18 bp, Homo sapiens
atatccaataatgaacac

SEQ ID NO: 8385452 - DNA, 23 bp, Homo sapiens
ctggcttctggggcctctgtttc

SEQ ID NO: 8385453 - DNA, 22 bp, Homo sapiens
ctggcttctgggccagggcaga

SEQ ID NO: 8385454 - DNA, 22 bp, Homo sapiens
ctggcagctgtgtgaagaactg

SEQ ID NO: 8385455 - DNA, 22 bp, Homo sapiens
ctggcagcttagcactctggtt

SEQ ID NO: 8385456 - DNA, 22 bp, Homo sapiens
ctggcagcttagcactctggtt

SEQ ID NO: 8385457 - DNA, 22 bp, Homo sapiens
ctggcagcttagcactctggtt

SEQ ID NO: 8385458 - DNA, 22 bp, Homo sapiens
ctggcttctgggccagggcaga

SEQ ID NO: 8385459 - DNA, 22 bp, Homo sapiens
ctggcagctgcccgagatgccc

SEQ ID NO: 8385460 - DNA, 22 bp, Homo sapiens
ctggcagctggaggctagaggc

SEQ ID NO: 8385461 - DNA, 22 bp, Homo sapiens
ctgggaatgagcaggtggctcc

SEQ ID NO: 8385462 - DNA, 22 bp, Homo sapiens
ctgggaagggacgccagtgcct

SEQ ID NO: 8385463 - DNA, 22 bp, Homo sapiens
atataacatacatacagaaaag

SEQ ID NO: 8385464 - DNA, 19 bp, Homo sapiens
ctgggacaatgaaagcatc

SEQ ID NO: 8385465 - DNA, 22 bp, Homo sapiens
ctgggacacagccttacctggg

SEQ ID NO: 8385466 - DNA, 19 bp, Homo sapiens
ctgggacaatgaaagcatc

SEQ ID NO: 8385467 - DNA, 22 bp, Homo sapiens
atataagttagtggtcatgttt

SEQ ID NO: 8385468 - DNA, 22 bp, Homo sapiens
atatacttggagactatcattg

SEQ ID NO: 8385469 - DNA, 22 bp, Homo sapiens
atatacttttcactaatggcta

SEQ ID NO: 8385470 - DNA, 22 bp, Homo sapiens
atataatacaacctgctaagtg

SEQ ID NO: 8385471 - DNA, 22 bp, Homo sapiens
atatatatcgagttcatgtctc

SEQ ID NO: 8385472 - DNA, 22 bp, Homo sapiens
atatatacaactagattaaaag

SEQ ID NO: 8385473 - DNA, 22 bp, Homo sapiens
ctgggagacgcagctggggatc

SEQ ID NO: 8385474 - DNA, 22 bp, Homo sapiens
ctgggagacaagagagggctga

SEQ ID NO: 8385475 - DNA, 22 bp, Homo sapiens
ctgggagagaagcgaagctggg

SEQ ID NO: 8385476 - DNA, 22 bp, Homo sapiens
ctgggagagcctttcctgagtc

SEQ ID NO: 8385477 - DNA, 22 bp, Homo sapiens
atatatatcgagttcatgtctc

SEQ ID NO: 8385478 - DNA, 19 bp, Homo sapiens
ctgggaggtgttcagagaa

SEQ ID NO: 8385479 - DNA, 22 bp, Homo sapiens
ctgggcacacagtgactctgca

SEQ ID NO: 8385480 - DNA, 22 bp, Homo sapiens
atacttatgataaataattgct

SEQ ID NO: 8385481 - DNA, 22 bp, Homo sapiens
atacttcaacatatcagtcaga

SEQ ID NO: 8385482 - DNA, 22 bp, Homo sapiens
atacttcaacatatcagtcaga

SEQ ID NO: 8385483 - DNA, 22 bp, Homo sapiens
atactcagctgctagacagaag

SEQ ID NO: 8385484 - DNA, 22 bp, Homo sapiens
atactcaatttgttggaaagca

SEQ ID NO: 8385485 - DNA, 22 bp, Homo sapiens
ctggagtgaggtctgggagcct

SEQ ID NO: 8385486 - DNA, 22 bp, Homo sapiens
ctggagtgactttgttcctttt

SEQ ID NO: 8385487 - DNA, 22 bp, Homo sapiens
ctggagtgcaacctctgcctcc

SEQ ID NO: 8385488 - DNA, 22 bp, Homo sapiens
ctggagtgatactcagaatgtg

SEQ ID NO: 8385489 - DNA, 22 bp, Homo sapiens
ctggagtgcaatgaacaaggtc

SEQ ID NO: 8385490 - DNA, 22 bp, Homo sapiens
ctggagggctgcagcgaggctg

SEQ ID NO: 8385491 - DNA, 22 bp, Homo sapiens
ctggagggctgcagcgaggctg

SEQ ID NO: 8385492 - DNA, 22 bp, Homo sapiens
ctggagggctgcagcgaggctg

SEQ ID NO: 8385493 - DNA, 22 bp, Homo sapiens
ctggagtgaagtctggcagctt

SEQ ID NO: 8385494 - DNA, 22 bp, Homo sapiens
ctggagtgaagtctggcagctt

SEQ ID NO: 8385495 - DNA, 22 bp, Homo sapiens
ctggcagctctactcagagcct

SEQ ID NO: 8385496 - DNA, 22 bp, Homo sapiens
ctggcagcgtgtttatgaacat

SEQ ID NO: 8385497 - DNA, 22 bp, Homo sapiens
ctggcagcgtgagcagcatcca

SEQ ID NO: 8385498 - DNA, 22 bp, Homo sapiens
ctggcagcgcagcatgaagtcg

SEQ ID NO: 8385499 - DNA, 22 bp, Homo sapiens
ctggcagcggtttgcagcctgg

SEQ ID NO: 8385500 - DNA, 22 bp, Homo sapiens
atacttctttaagagtaagtct

SEQ ID NO: 8385501 - DNA, 22 bp, Homo sapiens
atacttcatgcttcatgtctgt

SEQ ID NO: 8385502 - DNA, 22 bp, Homo sapiens
atacttctagaaatactatgca

SEQ ID NO: 8385503 - DNA, 22 bp, Homo sapiens
atactttagagctagattgcct

SEQ ID NO: 8385504 - DNA, 22 bp, Homo sapiens
atactttagagctagattgcct

SEQ ID NO: 8385505 - DNA, 22 bp, Homo sapiens
atactttagagctagattgcct

SEQ ID NO: 8385506 - DNA, 22 bp, Homo sapiens
atacttgtcaacattttatcca

SEQ ID NO: 8385507 - DNA, 22 bp, Homo sapiens
ctggagggagttaggacccgga

SEQ ID NO: 8385508 - DNA, 22 bp, Homo sapiens
ctggagggaggaggctgctatt

SEQ ID NO: 8385509 - DNA, 22 bp, Homo sapiens
ctggagggatgtagggtgtatt

SEQ ID NO: 8385510 - DNA, 22 bp, Homo sapiens
atacagatgggtcagatttcat

SEQ ID NO: 8385511 - DNA, 22 bp, Homo sapiens
ctggagggagattcaaaggagg

SEQ ID NO: 8385512 - DNA, 22 bp, Homo sapiens
ctggaggaaaacaactgcagac

SEQ ID NO: 8385513 - DNA, 22 bp, Homo sapiens
atacagatcccacagcatgtga

SEQ ID NO: 8385514 - DNA, 18 bp, Homo sapiens
atacagagacctcaagga

SEQ ID NO: 8385515 - DNA, 22 bp, Homo sapiens
ctggagcatccatgcccagggt

SEQ ID NO: 8385516 - DNA, 22 bp, Homo sapiens
atacaagtggccacttgaattc

SEQ ID NO: 8385517 - DNA, 22 bp, Homo sapiens
ctggagagaccgaaagaggctg

SEQ ID NO: 8385518 - DNA, 22 bp, Homo sapiens
ctggagccccagacagggagag

SEQ ID NO: 8385519 - DNA, 22 bp, Homo sapiens
ctggagccccagacagggagag

SEQ ID NO: 8385520 - DNA, 19 bp, Homo sapiens
atacaagactagcatttac

SEQ ID NO: 8385521 - DNA, 22 bp, Homo sapiens
atacaaggtcatgaaggtttac

SEQ ID NO: 8385522 - DNA, 22 bp, Homo sapiens
atacaagtgatataattgtttc

SEQ ID NO: 8385523 - DNA, 22 bp, Homo sapiens
atacaaggtggagtcaggaaaa

SEQ ID NO: 8385524 - DNA, 22 bp, Homo sapiens
ataatatttgcattactgtgat

SEQ ID NO: 8385525 - DNA, 22 bp, Homo sapiens
ataatatcgctcctttttttga

SEQ ID NO: 8385526 - DNA, 22 bp, Homo sapiens
ctgctgtgtgaccatggacagg

SEQ ID NO: 8385527 - DNA, 22 bp, Homo sapiens
ataatcaaagtcctatgacatc

SEQ ID NO: 8385528 - DNA, 22 bp, Homo sapiens
ataatatttggataggacagta

SEQ ID NO: 8385529 - DNA, 22 bp, Homo sapiens
ataatcaaagtcctatgacatc

SEQ ID NO: 8385530 - DNA, 18 bp, Homo sapiens
ctgcttctgtctgccagt

SEQ ID NO: 8385531 - DNA, 22 bp, Homo sapiens
ctgctgtgtgcttacttgggtt

SEQ ID NO: 8385532 - DNA, 22 bp, Homo sapiens
ctgcccacttggccaccttcta

SEQ ID NO: 8385533 - DNA, 22 bp, Homo sapiens
ctgcccagaagccagatgggca

SEQ ID NO: 8385534 - DNA, 22 bp, Homo sapiens
ctgcccagaagcttagagctta

SEQ ID NO: 8385535 - DNA, 22 bp, Homo sapiens
ctgcccagaatcactcactcga

SEQ ID NO: 8385536 - DNA, 22 bp, Homo sapiens
ctgcccagaatcactcactcga

SEQ ID NO: 8385537 - DNA, 18 bp, Homo sapiens
ctgcccagagcacttgtg

SEQ ID NO: 8385538 - DNA, 22 bp, Homo sapiens
ctgctccaagccagccctgcag

SEQ ID NO: 8385539 - DNA, 22 bp, Homo sapiens
ataaatccaaggcggccatcat

SEQ ID NO: 8385540 - DNA, 22 bp, Homo sapiens
ctgcccacagttctctgccatg

SEQ ID NO: 8385541 - DNA, 22 bp, Homo sapiens
ctgctctgcagcttggactccc

SEQ ID NO: 8385542 - DNA, 22 bp, Homo sapiens
ctgctctgcagcttggactccc

SEQ ID NO: 8385543 - DNA, 22 bp, Homo sapiens
ctgctctggcgtactcggcatc

SEQ ID NO: 8385544 - DNA, 22 bp, Homo sapiens
ataatacatggttgatcttttc

SEQ ID NO: 8385545 - DNA, 22 bp, Homo sapiens
ataatacatggttgatcttttc

SEQ ID NO: 8385546 - DNA, 22 bp, Homo sapiens
ataatacatggttaacctcttt

SEQ ID NO: 8385547 - DNA, 22 bp, Homo sapiens
ctgctctgtatatgagcaggaa

SEQ ID NO: 8385548 - DNA, 22 bp, Homo sapiens
ctgctctggctgtgtacttcag

SEQ ID NO: 8385549 - DNA, 22 bp, Homo sapiens
ctgctctggcgtactcggcatc

SEQ ID NO: 8385550 - DNA, 21 bp, Homo sapiens
ctgctctggggaccggctgtg

SEQ ID NO: 8385551 - DNA, 22 bp, Homo sapiens
ctgaggcctctgttcaccagaa

SEQ ID NO: 8385552 - DNA, 22 bp, Homo sapiens
ctgaggctgggctgagggtata

SEQ ID NO: 8385553 - DNA, 18 bp, Homo sapiens
ctgaggcttagagaggtt

SEQ ID NO: 8385554 - DNA, 22 bp, Homo sapiens
ctgaggctggggaagggaagtg

SEQ ID NO: 8385555 - DNA, 22 bp, Homo sapiens
ctgaggctgggcttgccttctt

SEQ ID NO: 8385556 - DNA, 22 bp, Homo sapiens
ctgaggcttgtcctctcagctt

SEQ ID NO: 8385557 - DNA, 22 bp, Homo sapiens
ctgaggcttgtcctctcagctt

SEQ ID NO: 8385558 - DNA, 22 bp, Homo sapiens
ctgaggcttgtcctctcagctt

SEQ ID NO: 8385559 - DNA, 22 bp, Homo sapiens
ctgaggcttggaggggtctggt

SEQ ID NO: 8385560 - DNA, 22 bp, Homo sapiens
ctgaggcttctctagttcagct

SEQ ID NO: 8385561 - DNA, 22 bp, Homo sapiens
ctgaggcttctctagttcagct

SEQ ID NO: 8385562 - DNA, 22 bp, Homo sapiens
ctgagggtcaacttgattgtat

SEQ ID NO: 8385563 - DNA, 22 bp, Homo sapiens
ctgaggctttgtgtgcatgcct

SEQ ID NO: 8385564 - DNA, 22 bp, Homo sapiens
ctgaggtcaccccactggctgt

SEQ ID NO: 8385565 - DNA, 22 bp, Homo sapiens
agttgtcacctctattcaaatc

SEQ ID NO: 8385566 - DNA, 22 bp, Homo sapiens
agttgtaataacaataccaaaa

SEQ ID NO: 8385567 - DNA, 22 bp, Homo sapiens
agttggtgggtgtgagctggac

SEQ ID NO: 8385568 - DNA, 22 bp, Homo sapiens
agttggtgagcgtgtggtaatc

SEQ ID NO: 8385569 - DNA, 22 bp, Homo sapiens
agttgggtttgtgtcagttgca

SEQ ID NO: 8385570 - DNA, 22 bp, Homo sapiens
agttgtaagagacagatataaa

SEQ ID NO: 8385571 - DNA, 21 bp, Homo sapiens
ctgaggcagcacagctagtca

SEQ ID NO: 8385572 - DNA, 22 bp, Homo sapiens
agttgtaagaggcacaaggaag

SEQ ID NO: 8385573 - DNA, 21 bp, Homo sapiens
ctgaggcagcacagctagtca

SEQ ID NO: 8385574 - DNA, 22 bp, Homo sapiens
ctgaggcaggagaattgctgga

SEQ ID NO: 8385575 - DNA, 22 bp, Homo sapiens
ctgaggcaggggcagctggaga

SEQ ID NO: 8385576 - DNA, 22 bp, Homo sapiens
ctgaggcaggggcagctggaga

SEQ ID NO: 8385577 - DNA, 22 bp, Homo sapiens
ctgaggcaggatggcctggctg

SEQ ID NO: 8385578 - DNA, 22 bp, Homo sapiens
ctgaggcatcatggagaacagt

SEQ ID NO: 8385579 - DNA, 22 bp, Homo sapiens
agttggcaaggtctggccagcg

SEQ ID NO: 8385580 - DNA, 22 bp, Homo sapiens
ctctttggtgcaccttgcagtc

SEQ ID NO: 8385581 - DNA, 22 bp, Homo sapiens
agttctttctagacacgtagac

SEQ ID NO: 8385582 - DNA, 22 bp, Homo sapiens
agttctttctagacacgtagac

SEQ ID NO: 8385583 - DNA, 21 bp, Homo sapiens
ctctttgggatctttggaaag

SEQ ID NO: 8385584 - DNA, 21 bp, Homo sapiens
ctctttgggatctttggaaag

SEQ ID NO: 8385585 - DNA, 22 bp, Homo sapiens
ctctttgggatgggctctgctg

SEQ ID NO: 8385586 - DNA, 16 bp, Homo sapiens
ctctttgggcttccag

SEQ ID NO: 8385587 - DNA, 22 bp, Homo sapiens
ctctttggggctggaagcctag

SEQ ID NO: 8385588 - DNA, 22 bp, Homo sapiens
ctctttggggtgccccactggt

SEQ ID NO: 8385589 - DNA, 22 bp, Homo sapiens
ctctttggtcgcatcatccatt

SEQ ID NO: 8385590 - DNA, 22 bp, Homo sapiens
ctctttggtcgcatcatccatt

SEQ ID NO: 8385591 - DNA, 22 bp, Homo sapiens
agtttgaaggagttgaatcacc

SEQ ID NO: 8385592 - DNA, 22 bp, Homo sapiens
agtttgaaagtattgacagaag

SEQ ID NO: 8385593 - DNA, 22 bp, Homo sapiens
ctgcagctggctcatgggatat

SEQ ID NO: 8385594 - DNA, 22 bp, Homo sapiens
ctgcagctggagcatcttctca

SEQ ID NO: 8385595 - DNA, 22 bp, Homo sapiens
ctgcagctgctcatgttacttg

SEQ ID NO: 8385596 - DNA, 17 bp, Homo sapiens
ctgcagctggagggcca

SEQ ID NO: 8385597 - DNA, 22 bp, Homo sapiens
ctgcagctggagcatcttctca

SEQ ID NO: 8385598 - DNA, 22 bp, Homo sapiens
ctgcagctgcgggaccggagcg

SEQ ID NO: 8385599 - DNA, 22 bp, Homo sapiens
ctgcagctgccagtgatttcag

SEQ ID NO: 8385600 - DNA, 22 bp, Homo sapiens
ctgcagctgctcatgttacttg

SEQ ID NO: 8385601 - DNA, 22 bp, Homo sapiens
ctgcagctgccagtgatttcag

SEQ ID NO: 8385602 - DNA, 22 bp, Homo sapiens
ctgcagctgcagttctgagaga

SEQ ID NO: 8385603 - DNA, 22 bp, Homo sapiens
ctgcagctgcagttctgagaga

SEQ ID NO: 8385604 - DNA, 22 bp, Homo sapiens
ctgcagctgcagttctgagaga

SEQ ID NO: 8385605 - DNA, 19 bp, Homo sapiens
ctgcagctgcaccatccca

SEQ ID NO: 8385606 - DNA, 22 bp, Homo sapiens
agtttgctcagaaatttgaaat

SEQ ID NO: 8385607 - DNA, 22 bp, Homo sapiens
agtttgccccgtcaccctggtg

SEQ ID NO: 8385608 - DNA, 22 bp, Homo sapiens
agtttgctcagctgtcaaatgg

SEQ ID NO: 8385609 - DNA, 22 bp, Homo sapiens
agtttaatatccttcaactttc

SEQ ID NO: 8385610 - DNA, 22 bp, Homo sapiens
agttgtcagtcaaagacatttg

SEQ ID NO: 8385611 - DNA, 22 bp, Homo sapiens
ctgcagcctcctggggtacatg

SEQ ID NO: 8385612 - DNA, 22 bp, Homo sapiens
ctgcagctaaggaatgtggttg

SEQ ID NO: 8385613 - DNA, 22 bp, Homo sapiens
ctgcagctcccctgagatcaag

SEQ ID NO: 8385614 - DNA, 22 bp, Homo sapiens
ctgcagctcctctctgtgcccc

SEQ ID NO: 8385615 - DNA, 22 bp, Homo sapiens
ctgcagctatattttcccacag

SEQ ID NO: 8385616 - DNA, 22 bp, Homo sapiens
ctgcagctccttctggcatgtg

SEQ ID NO: 8385617 - DNA, 22 bp, Homo sapiens
ctgcagctctagcttttgacct

SEQ ID NO: 8385618 - DNA, 22 bp, Homo sapiens
ctgcagctcctgagctcagaga

SEQ ID NO: 8385619 - DNA, 22 bp, Homo sapiens
ctgcagctcctgagctcagaga

SEQ ID NO: 8385620 - DNA, 22 bp, Homo sapiens
ctgcagctcctctctgtgcccc

SEQ ID NO: 8385621 - DNA, 20 bp, Homo sapiens
ataaaataactgccacaaga

SEQ ID NO: 8385622 - DNA, 20 bp, Homo sapiens
ataaaataactgccacaaga

SEQ ID NO: 8385623 - DNA, 22 bp, Homo sapiens
ataaaagttcaagagagtacag

SEQ ID NO: 8385624 - DNA, 22 bp, Homo sapiens
ataaaagtttccaatcatgcct

SEQ ID NO: 8385625 - DNA, 22 bp, Homo sapiens
ataaaggataatccattagact

SEQ ID NO: 8385626 - DNA, 17 bp, Homo sapiens
ataaaggcaagtattat

SEQ ID NO: 8385627 - DNA, 21 bp, Homo sapiens
ctgccaggatagcatgcaggc

SEQ ID NO: 8385628 - DNA, 22 bp, Homo sapiens
ctgccaggcacgtgcagcatca

SEQ ID NO: 8385629 - DNA, 22 bp, Homo sapiens
ctgccaggattctgtgaacccc

SEQ ID NO: 8385630 - DNA, 22 bp, Homo sapiens
ctgccaggcactgggctctgca

SEQ ID NO: 8385631 - DNA, 22 bp, Homo sapiens
ctgccaggcagcagagggagaa

SEQ ID NO: 8385632 - DNA, 22 bp, Homo sapiens
ctgccaggcagggagatggctg

SEQ ID NO: 8385633 - DNA, 22 bp, Homo sapiens
ataaaagtaggaccaacttaca

SEQ ID NO: 8385634 - DNA, 22 bp, Homo sapiens
ataaaagtaggaccaacttaca

SEQ ID NO: 8385635 - DNA, 22 bp, Homo sapiens
ataaaagtctgcttatttgggc

SEQ ID NO: 8385636 - DNA, 22 bp, Homo sapiens
ataaaagtctgcttatttgggc

SEQ ID NO: 8385637 - DNA, 22 bp, Homo sapiens
aggtgccttccgcggagctcgc

SEQ ID NO: 8385638 - DNA, 22 bp, Homo sapiens
aggtgcctgtcgtctctggtta

SEQ ID NO: 8385639 - DNA, 22 bp, Homo sapiens
aggtgcctgtcgtctctggtta

SEQ ID NO: 8385640 - DNA, 22 bp, Homo sapiens
aggtgccctgctgtgcccttct

SEQ ID NO: 8385641 - DNA, 22 bp, Homo sapiens
aggtgcaggagctgtgcaggga

SEQ ID NO: 8385642 - DNA, 22 bp, Homo sapiens
aggtgccagtgctgtggtcccc

SEQ ID NO: 8385643 - DNA, 22 bp, Homo sapiens
aggtgccagctctcaggcagga

SEQ ID NO: 8385644 - DNA, 22 bp, Homo sapiens
cctgggagaactgctgggttgg

SEQ ID NO: 8385645 - DNA, 19 bp, Homo sapiens
cctgggacttaggctgggt

SEQ ID NO: 8385646 - DNA, 19 bp, Homo sapiens
cctgggacttaggctgggt

SEQ ID NO: 8385647 - DNA, 22 bp, Homo sapiens
cctgggactcggccaggacaga

SEQ ID NO: 8385648 - DNA, 21 bp, Homo sapiens
cctgggacactcaccagctcc

SEQ ID NO: 8385649 - DNA, 22 bp, Homo sapiens
cctgggaagttgtggctgcagt

SEQ ID NO: 8385650 - DNA, 22 bp, Homo sapiens
cctgggaagttgtggctgcagt

SEQ ID NO: 8385651 - DNA, 22 bp, Homo sapiens
cctgggaagtggaggttacagt

SEQ ID NO: 8385652 - DNA, 22 bp, Homo sapiens
cctgggacctcgcgggaagcgg

SEQ ID NO: 8385653 - DNA, 22 bp, Homo sapiens
cctgggacctcgcgggaagcgg

SEQ ID NO: 8385654 - DNA, 22 bp, Homo sapiens
aggtgctggcgccccaggagac

SEQ ID NO: 8385655 - DNA, 17 bp, Homo sapiens
aggtgctggagcatcag

SEQ ID NO: 8385656 - DNA, 22 bp, Homo sapiens
aggtggcatgagactgtaccag

SEQ ID NO: 8385657 - DNA, 22 bp, Homo sapiens
aggtggctctgacagctctggt

SEQ ID NO: 8385658 - DNA, 21 bp, Homo sapiens
aggtgggagaccatgtaggtc

SEQ ID NO: 8385659 - DNA, 22 bp, Homo sapiens
aggtggcttctggccaggtgtg

SEQ ID NO: 8385660 - DNA, 22 bp, Homo sapiens
aggtgggaacccagcagggccc

SEQ ID NO: 8385661 - DNA, 22 bp, Homo sapiens
aggtggctttactgtttcttac

SEQ ID NO: 8385662 - DNA, 22 bp, Homo sapiens
aggtggctggtccaggctgcag

SEQ ID NO: 8385663 - DNA, 17 bp, Homo sapiens
aggtggctgctgcgcct

SEQ ID NO: 8385664 - DNA, 22 bp, Homo sapiens
aggtggctgtattcagctgtaa

SEQ ID NO: 8385665 - DNA, 22 bp, Homo sapiens
aggtggctgtggcttcccttgt

SEQ ID NO: 8385666 - DNA, 22 bp, Homo sapiens
aggtggctgcctccccgcgcgg

SEQ ID NO: 8385667 - DNA, 21 bp, Homo sapiens
aggtggctgcatcctcagaag

SEQ ID NO: 8385668 - DNA, 21 bp, Homo sapiens
aggtggctgcatcctcagaag

SEQ ID NO: 8385669 - DNA, 22 bp, Homo sapiens
aggtggctgagctgtgcccctg

SEQ ID NO: 8385670 - DNA, 22 bp, Homo sapiens
aggtggctgaagagtgggtgag

SEQ ID NO: 8385671 - DNA, 19 bp, Homo sapiens
aggtggctgaaactacaga

SEQ ID NO: 8385672 - DNA, 20 bp, Homo sapiens
aggtggctcttcctgggctt

SEQ ID NO: 8385673 - DNA, 22 bp, Homo sapiens
ccttggcaaaccagggcagctg

SEQ ID NO: 8385674 - DNA, 22 bp, Homo sapiens
ccttggcaagacagtggagggt

SEQ ID NO: 8385675 - DNA, 22 bp, Homo sapiens
ccttggctaaactcaatccagc

SEQ ID NO: 8385676 - DNA, 22 bp, Homo sapiens
ccttggctgaggagggagctga

SEQ ID NO: 8385677 - DNA, 22 bp, Homo sapiens
ccttggctaggcagcggctgtc

SEQ ID NO: 8385678 - DNA, 22 bp, Homo sapiens
ccttgctcaagctagtgacggg

SEQ ID NO: 8385679 - DNA, 22 bp, Homo sapiens
ccttgctcaagctagtgacggg

SEQ ID NO: 8385680 - DNA, 22 bp, Homo sapiens
ccttgctcatcccccagtgcct

SEQ ID NO: 8385681 - DNA, 22 bp, Homo sapiens
ccttggagcggtcagcactggt

SEQ ID NO: 8385682 - DNA, 22 bp, Homo sapiens
agtagtcacttctattaatggc

SEQ ID NO: 8385683 - DNA, 22 bp, Homo sapiens
cggccttctccctgggcatcac

SEQ ID NO: 8385684 - DNA, 22 bp, Homo sapiens
cggccttctccctgggcatcac

SEQ ID NO: 8385685 - DNA, 22 bp, Homo sapiens
cggagcagagccactcgggccg

SEQ ID NO: 8385686 - DNA, 22 bp, Homo sapiens
cggagatatttaaggttctctc

SEQ ID NO: 8385687 - DNA, 22 bp, Homo sapiens
cggaggttgaggctgcagtgag

SEQ ID NO: 8385688 - DNA, 22 bp, Homo sapiens
aggtgggggctgtgtccttgac

SEQ ID NO: 8385689 - DNA, 22 bp, Homo sapiens
cctttgttctgtgtatctttgt

SEQ ID NO: 8385690 - DNA, 22 bp, Homo sapiens
cgaggcagacaaaagttggaag

SEQ ID NO: 8385691 - DNA, 18 bp, Homo sapiens
cgaggcaggcggatcacg

SEQ ID NO: 8385692 - DNA, 22 bp, Homo sapiens
cgaggcaggcaggcggaggata

SEQ ID NO: 8385693 - DNA, 22 bp, Homo sapiens
cgaggcagaggctgaaacggct

SEQ ID NO: 8385694 - DNA, 22 bp, Homo sapiens
cgaggccacacctgcttctggg

SEQ ID NO: 8385695 - DNA, 22 bp, Homo sapiens
cgaggcagggaagctgcaaaag

SEQ ID NO: 8385696 - DNA, 22 bp, Homo sapiens
cgagcatgatgacggctgtggc

SEQ ID NO: 8385697 - DNA, 22 bp, Homo sapiens
cgaggaggaaacgcggagaact

SEQ ID NO: 8385698 - DNA, 22 bp, Homo sapiens
cgaggaaaggcgatggctctcg

SEQ ID NO: 8385699 - DNA, 22 bp, Homo sapiens
cgaggaaatatttacaactgat

SEQ ID NO: 8385700 - DNA, 22 bp, Homo sapiens
ccttttatactcagtgatatca

SEQ ID NO: 8385701 - DNA, 19 bp, Homo sapiens
cctggctgctgtgggatgc

SEQ ID NO: 8385702 - DNA, 23 bp, Homo sapiens
cctggctggattctctgcattca

SEQ ID NO: 8385703 - DNA, 22 bp, Homo sapiens
cctgggaagtcagccaaggacg

SEQ ID NO: 8385704 - DNA, 20 bp, Homo sapiens
cctggccaatgagataggaa

SEQ ID NO: 8385705 - DNA, 22 bp, Homo sapiens
cctggccactcaggtgtggggc

SEQ ID NO: 8385706 - DNA, 21 bp, Homo sapiens
cctggccaatctgatagggtt

SEQ ID NO: 8385707 - DNA, 21 bp, Homo sapiens
cctggccaatctgatagggtt

SEQ ID NO: 8385708 - DNA, 22 bp, Homo sapiens
cctggccaatctagggctgtta

SEQ ID NO: 8385709 - DNA, 22 bp, Homo sapiens
cctggcagctgtttggcttggc

SEQ ID NO: 8385710 - DNA, 22 bp, Homo sapiens
cctggcagctgtttggcttggc

SEQ ID NO: 8385711 - DNA, 22 bp, Homo sapiens
cctggcagctccgtggccttcc

SEQ ID NO: 8385712 - DNA, 22 bp, Homo sapiens
cctggcagctccgtggccttcc

SEQ ID NO: 8385713 - DNA, 22 bp, Homo sapiens
cctggcagctcctccccggcgg

SEQ ID NO: 8385714 - DNA, 22 bp, Homo sapiens
cctggcagcccagagcgccgct

SEQ ID NO: 8385715 - DNA, 22 bp, Homo sapiens
cctggcagcccagagcgccgct

SEQ ID NO: 8385716 - DNA, 22 bp, Homo sapiens
cctggcacataatagtggctca

SEQ ID NO: 8385717 - DNA, 22 bp, Homo sapiens
cctggcagcgccgaagctggcc

SEQ ID NO: 8385718 - DNA, 22 bp, Homo sapiens
cctggcagcgccgaagctggcc

SEQ ID NO: 8385719 - DNA, 22 bp, Homo sapiens
cctggaaggtgatggtacagca

SEQ ID NO: 8385720 - DNA, 22 bp, Homo sapiens
cctggacagggccaggccatgc

SEQ ID NO: 8385721 - DNA, 22 bp, Homo sapiens
cctggacaatgagatgtcaggg

SEQ ID NO: 8385722 - DNA, 22 bp, Homo sapiens
cctgctctccatacactttcta

SEQ ID NO: 8385723 - DNA, 22 bp, Homo sapiens
cctgctctccatacactttcta

SEQ ID NO: 8385724 - DNA, 22 bp, Homo sapiens
cctgctctaaatctcatggaac

SEQ ID NO: 8385725 - DNA, 22 bp, Homo sapiens
cctgctctgccaagtcctcttt

SEQ ID NO: 8385726 - DNA, 19 bp, Homo sapiens
cctgctgaagtgatgcagc

SEQ ID NO: 8385727 - DNA, 22 bp, Homo sapiens
cctgctgagaccctgaggtggg

SEQ ID NO: 8385728 - DNA, 19 bp, Homo sapiens
cctgctgcaccacttgtta

SEQ ID NO: 8385729 - DNA, 20 bp, Homo sapiens
agggtcagagagcgtgagtg

SEQ ID NO: 8385730 - DNA, 22 bp, Homo sapiens
agggtctatctctctgcctttg

SEQ ID NO: 8385731 - DNA, 21 bp, Homo sapiens
agggtcctacagggctcagga

SEQ ID NO: 8385732 - DNA, 17 bp, Homo sapiens
agggtcaggtgaagttc

SEQ ID NO: 8385733 - DNA, 20 bp, Homo sapiens
agggtctgatgtggtggccc

SEQ ID NO: 8385734 - DNA, 22 bp, Homo sapiens
agggtctctgggagtagggcac

SEQ ID NO: 8385735 - DNA, 22 bp, Homo sapiens
agggtctctggagagctgagga

SEQ ID NO: 8385736 - DNA, 22 bp, Homo sapiens
agggtgaatctcacaactctta

SEQ ID NO: 8385737 - DNA, 22 bp, Homo sapiens
agggtctttatagaggtactta

SEQ ID NO: 8385738 - DNA, 22 bp, Homo sapiens
agggtctgtggatgcatctggg

SEQ ID NO: 8385739 - DNA, 22 bp, Homo sapiens
agggtctgttgtttgttctgga

SEQ ID NO: 8385740 - DNA, 22 bp, Homo sapiens
cctgccctatgaccagcttcac

SEQ ID NO: 8385741 - DNA, 22 bp, Homo sapiens
cctgcccccgtcagaggtgatg

SEQ ID NO: 8385742 - DNA, 22 bp, Homo sapiens
cctgcccctcaaggcctggtgc

SEQ ID NO: 8385743 - DNA, 23 bp, Homo sapiens
cctgcccaggaatccggcggcgt

SEQ ID NO: 8385744 - DNA, 19 bp, Homo sapiens
cctctgccagcccgcctct

SEQ ID NO: 8385745 - DNA, 22 bp, Homo sapiens
cctgccaggacattgcttgaag

SEQ ID NO: 8385746 - DNA, 22 bp, Homo sapiens
cctctctccttcctttgccaaa

SEQ ID NO: 8385747 - DNA, 22 bp, Homo sapiens
cctctctccttcctttgccaaa

SEQ ID NO: 8385748 - DNA, 22 bp, Homo sapiens
cctctctcttgtagtccctgcc

SEQ ID NO: 8385749 - DNA, 22 bp, Homo sapiens
cctctgcaccatagccttcagc

SEQ ID NO: 8385750 - DNA, 22 bp, Homo sapiens
cctctgccacctcccacgaggc

SEQ ID NO: 8385751 - DNA, 22 bp, Homo sapiens
cctctgcagcagagagccagag

SEQ ID NO: 8385752 - DNA, 22 bp, Homo sapiens
cctctgcagcagagagccagag

SEQ ID NO: 8385753 - DNA, 22 bp, Homo sapiens
cctctgcacttcaccttagctc

SEQ ID NO: 8385754 - DNA, 22 bp, Homo sapiens
ctccagagagaaaggaggccgc

SEQ ID NO: 8385755 - DNA, 22 bp, Homo sapiens
ctccagaactgggagagaataa

SEQ ID NO: 8385756 - DNA, 22 bp, Homo sapiens
agtgacaacaagttgactagaa

SEQ ID NO: 8385757 - DNA, 22 bp, Homo sapiens
agtgacacggagagacagcatg

SEQ ID NO: 8385758 - DNA, 22 bp, Homo sapiens
agtgacaaggtggtaatgaagc

SEQ ID NO: 8385759 - DNA, 22 bp, Homo sapiens
ctcagtgttaaagactttccag

SEQ ID NO: 8385760 - DNA, 22 bp, Homo sapiens
ctcagtgttaaatataaggtat

SEQ ID NO: 8385761 - DNA, 22 bp, Homo sapiens
ctcagtgtcacgttttgcctta

SEQ ID NO: 8385762 - DNA, 22 bp, Homo sapiens
ctcagtgtctggggccccaggg

SEQ ID NO: 8385763 - DNA, 20 bp, Homo sapiens
ctcagtgtattctgggtgct

SEQ ID NO: 8385764 - DNA, 22 bp, Homo sapiens
ctcagtgtgaatgctcagtaaa

SEQ ID NO: 8385765 - DNA, 22 bp, Homo sapiens
ctcagtgtcttatttgagttct

SEQ ID NO: 8385766 - DNA, 22 bp, Homo sapiens
ctcagtgtcttattgtacacat

SEQ ID NO: 8385767 - DNA, 23 bp, Homo sapiens
ctcagtgtgtgacccatggcctc

SEQ ID NO: 8385768 - DNA, 22 bp, Homo sapiens
ctcagtgtgagtgagaagtgca

SEQ ID NO: 8385769 - DNA, 20 bp, Homo sapiens
ctcagtgtggcctgagtgtt

SEQ ID NO: 8385770 - DNA, 22 bp, Homo sapiens
agtctccgctctcggagtcggc

SEQ ID NO: 8385771 - DNA, 22 bp, Homo sapiens
ctcagcacactcccatctaatt

SEQ ID NO: 8385772 - DNA, 22 bp, Homo sapiens
ctcagctctgacaggaggcatc

SEQ ID NO: 8385773 - DNA, 22 bp, Homo sapiens
ctcagctctttatactagctgt

SEQ ID NO: 8385774 - DNA, 20 bp, Homo sapiens
ctcagctcttcagggcaagt

SEQ ID NO: 8385775 - DNA, 22 bp, Homo sapiens
agtctcagagtacctgagggac

SEQ ID NO: 8385776 - DNA, 22 bp, Homo sapiens
agtctcagcaagcatggctagt

SEQ ID NO: 8385777 - DNA, 23 bp, Homo sapiens
ctcaaccctagtaagggagtagg

SEQ ID NO: 8385778 - DNA, 23 bp, Homo sapiens
ctcaaccctagtaagggagtagg

SEQ ID NO: 8385779 - DNA, 22 bp, Homo sapiens
agtcccaacagcttacaaggaa

SEQ ID NO: 8385780 - DNA, 22 bp, Homo sapiens
ctcaaatccccgttcctcattc

SEQ ID NO: 8385781 - DNA, 21 bp, Homo sapiens
ctcaaatgccagttttattta

SEQ ID NO: 8385782 - DNA, 22 bp, Homo sapiens
ctatttatctatttctgaatga

SEQ ID NO: 8385783 - DNA, 22 bp, Homo sapiens
cgggttcttaaacgactgggct

SEQ ID NO: 8385784 - DNA, 22 bp, Homo sapiens
ctatttatgtccaagtgtttta

SEQ ID NO: 8385785 - DNA, 22 bp, Homo sapiens
ctcaaatatgtggtcagaaagc

SEQ ID NO: 8385786 - DNA, 22 bp, Homo sapiens
cggggttcatccatgctgtggc

SEQ ID NO: 8385787 - DNA, 22 bp, Homo sapiens
cgggttcacgccattctcctgc

SEQ ID NO: 8385788 - DNA, 22 bp, Homo sapiens
cgggtcacctatcaattttgtg

SEQ ID NO: 8385789 - DNA, 22 bp, Homo sapiens
cgggttcacgccattctcctgc

SEQ ID NO: 8385790 - DNA, 22 bp, Homo sapiens
cgggggcacccacaaatgagga

SEQ ID NO: 8385791 - DNA, 18 bp, Homo sapiens
ctcagacatgcttctttt

SEQ ID NO: 8385792 - DNA, 22 bp, Homo sapiens
ctcagactaaaatgggaatgta

SEQ ID NO: 8385793 - DNA, 22 bp, Homo sapiens
ctcagacttttgttcaacgagt

SEQ ID NO: 8385794 - DNA, 22 bp, Homo sapiens
ctcagaggtcaagagcagagct

SEQ ID NO: 8385795 - DNA, 22 bp, Homo sapiens
ctcagagggttgaaggtgctct

SEQ ID NO: 8385796 - DNA, 22 bp, Homo sapiens
ctcagagttctcctgggaggtg

SEQ ID NO: 8385797 - DNA, 22 bp, Homo sapiens
ctcagagtccccacatctgggt

SEQ ID NO: 8385798 - DNA, 22 bp, Homo sapiens
ctcagcaagattaagcagcttg

SEQ ID NO: 8385799 - DNA, 22 bp, Homo sapiens
ctcagatcatcagaaacaatgt

SEQ ID NO: 8385800 - DNA, 22 bp, Homo sapiens
ctcagatctttcccattttccc

SEQ ID NO: 8385801 - DNA, 22 bp, Homo sapiens
agtcccagcctaggctgtgctg

SEQ ID NO: 8385802 - DNA, 22 bp, Homo sapiens
ctcaccagatgtcgggctgagt

SEQ ID NO: 8385803 - DNA, 22 bp, Homo sapiens
agtcccagatgacccagctact

SEQ ID NO: 8385804 - DNA, 22 bp, Homo sapiens
ctcagaagttcagcctagagta

SEQ ID NO: 8385805 - DNA, 22 bp, Homo sapiens
ctcagaagaacccagggtccca

SEQ ID NO: 8385806 - DNA, 22 bp, Homo sapiens
ctcagaaatcccactctgtgta

SEQ ID NO: 8385807 - DNA, 22 bp, Homo sapiens
ctcagaaagtgacaggggggtg

SEQ ID NO: 8385808 - DNA, 22 bp, Homo sapiens
ctcagaaatcccactctgtgta

SEQ ID NO: 8385809 - DNA, 23 bp, Homo sapiens
ctccttggtatgccatgcccagc

SEQ ID NO: 8385810 - DNA, 18 bp, Homo sapiens
ctccttggagaagaggcc

SEQ ID NO: 8385811 - DNA, 22 bp, Homo sapiens
ctcctgccaccgcggtgtcctg

SEQ ID NO: 8385812 - DNA, 22 bp, Homo sapiens
ctcctggtgctggggctgccgc

SEQ ID NO: 8385813 - DNA, 22 bp, Homo sapiens
ctcctgaggggacaggactcat

SEQ ID NO: 8385814 - DNA, 22 bp, Homo sapiens
ctccagagagtccagctctggg

SEQ ID NO: 8385815 - DNA, 22 bp, Homo sapiens
ctccagagagtccagctctggg

SEQ ID NO: 8385816 - DNA, 22 bp, Homo sapiens
agtgctatcgagttctaatgct

SEQ ID NO: 8385817 - DNA, 22 bp, Homo sapiens
agtgctggaaagggacggagga

SEQ ID NO: 8385818 - DNA, 22 bp, Homo sapiens
agtgctggagggaggcaggttc

SEQ ID NO: 8385819 - DNA, 22 bp, Homo sapiens
agtgctggattacaggcgtgag

SEQ ID NO: 8385820 - DNA, 22 bp, Homo sapiens
ctctccccacaccctctgcatg

SEQ ID NO: 8385821 - DNA, 22 bp, Homo sapiens
ctctccccacaccctctgcatg

SEQ ID NO: 8385822 - DNA, 22 bp, Homo sapiens
ctctccccacaccctctgcatg

SEQ ID NO: 8385823 - DNA, 22 bp, Homo sapiens
ctctcccagtcaggctcaggat

SEQ ID NO: 8385824 - DNA, 22 bp, Homo sapiens
ctctcccagtcaggctcaggat

SEQ ID NO: 8385825 - DNA, 20 bp, Homo sapiens
ctctcccagcacagcttcct

SEQ ID NO: 8385826 - DNA, 22 bp, Homo sapiens
ctctctagaggcccaccttgag

SEQ ID NO: 8385827 - DNA, 22 bp, Homo sapiens
ctcgggcaccctggttctggtg

SEQ ID NO: 8385828 - DNA, 22 bp, Homo sapiens
ctcgggcaccctggttctggtg

SEQ ID NO: 8385829 - DNA, 22 bp, Homo sapiens
agtgctggcccatagctgctgg

SEQ ID NO: 8385830 - DNA, 22 bp, Homo sapiens
agtgctggcccatagctgctgg

SEQ ID NO: 8385831 - DNA, 22 bp, Homo sapiens
agtgctgggattacaggcataa

SEQ ID NO: 8385832 - DNA, 22 bp, Homo sapiens
agtgctgggattacaggcataa

SEQ ID NO: 8385833 - DNA, 22 bp, Homo sapiens
agtgctgggattacaggcataa

SEQ ID NO: 8385834 - DNA, 22 bp, Homo sapiens
agtgctgggctatctactgcta

SEQ ID NO: 8385835 - DNA, 22 bp, Homo sapiens
ctctccaagttatcaagatgaa

SEQ ID NO: 8385836 - DNA, 22 bp, Homo sapiens
agtgctgggattgcaggcatga

SEQ ID NO: 8385837 - DNA, 22 bp, Homo sapiens
agtgctgggattgcaggcatga

SEQ ID NO: 8385838 - DNA, 22 bp, Homo sapiens
agtgctgggattgcaggcatga

SEQ ID NO: 8385839 - DNA, 22 bp, Homo sapiens
ctctccattccctacagttttc

SEQ ID NO: 8385840 - DNA, 22 bp, Homo sapiens
ctcttcttgtctctggttagaa

SEQ ID NO: 8385841 - DNA, 22 bp, Homo sapiens
ctcttgcattctatccctccag

SEQ ID NO: 8385842 - DNA, 22 bp, Homo sapiens
ctcttgatgactgttgctggtt

SEQ ID NO: 8385843 - DNA, 22 bp, Homo sapiens
ctcttgagtggcatgctctaac

SEQ ID NO: 8385844 - DNA, 22 bp, Homo sapiens
ctcttgcatctgttgtattggt

SEQ ID NO: 8385845 - DNA, 22 bp, Homo sapiens
ctcttgcatgagatccaggagt

SEQ ID NO: 8385846 - DNA, 22 bp, Homo sapiens
ctcttggccagacacagaggca

SEQ ID NO: 8385847 - DNA, 22 bp, Homo sapiens
ctctttggcgttggcagagcca

SEQ ID NO: 8385848 - DNA, 21 bp, Homo sapiens
ctcttgtctttgctcagtagc

SEQ ID NO: 8385849 - DNA, 22 bp, Homo sapiens
ctctttggcgttggcagagcca

SEQ ID NO: 8385850 - DNA, 22 bp, Homo sapiens
ctctttggcgttggcagagcca

SEQ ID NO: 8385851 - DNA, 16 bp, Homo sapiens
ctctttggcttccaag

SEQ ID NO: 8385852 - DNA, 22 bp, Homo sapiens
ctctttggctttgactcccatt

SEQ ID NO: 8385853 - DNA, 22 bp, Homo sapiens
ctcttggtaagacattagaggt

SEQ ID NO: 8385854 - DNA, 22 bp, Homo sapiens
agtggtgctaggtggaatatag

SEQ ID NO: 8385855 - DNA, 22 bp, Homo sapiens
agtggtgccattaaaatcattg

SEQ ID NO: 8385856 - DNA, 23 bp, Homo sapiens
ctctggagatcctctgcctgggt

SEQ ID NO: 8385857 - DNA, 22 bp, Homo sapiens
ctctggagatggttctcaattg

SEQ ID NO: 8385858 - DNA, 22 bp, Homo sapiens
ctctggagaactccttgtgtct

SEQ ID NO: 8385859 - DNA, 20 bp, Homo sapiens
ctctctccatctcagtggcc

SEQ ID NO: 8385860 - DNA, 22 bp, Homo sapiens
ctctctccttagctgcagacca

SEQ ID NO: 8385861 - DNA, 22 bp, Homo sapiens
ctctgctgcaggaaggcgtgca

SEQ ID NO: 8385862 - DNA, 22 bp, Homo sapiens
ctctgctgcaggaaggcgtgca

SEQ ID NO: 8385863 - DNA, 22 bp, Homo sapiens
ctctggacctcagctacagact

SEQ ID NO: 8385864 - DNA, 22 bp, Homo sapiens
ctctggggttagatctgatgct

SEQ ID NO: 8385865 - DNA, 22 bp, Homo sapiens
ctctggggttagatctgatgct

SEQ ID NO: 8385866 - DNA, 22 bp, Homo sapiens
agtggcttatctgggacagcta

SEQ ID NO: 8385867 - DNA, 22 bp, Homo sapiens
agtggcttcatttctgccagaa

SEQ ID NO: 8385868 - DNA, 22 bp, Homo sapiens
agtgggacagtgtagagcgtca

SEQ ID NO: 8385869 - DNA, 22 bp, Homo sapiens
agtggcttggctgcactacagg

SEQ ID NO: 8385870 - DNA, 22 bp, Homo sapiens
agtggcttgtccgtggtcacat

SEQ ID NO: 8385871 - DNA, 22 bp, Homo sapiens
ccccatggcaactgctgggggt

SEQ ID NO: 8385872 - DNA, 22 bp, Homo sapiens
agggaggaaggaactccttcta

SEQ ID NO: 8385873 - DNA, 21 bp, Homo sapiens
ccccatggagtacagttgggc

SEQ ID NO: 8385874 - DNA, 22 bp, Homo sapiens
ccccagggtcagtgtgtggagg

SEQ ID NO: 8385875 - DNA, 22 bp, Homo sapiens
agggagcagggctcctttgggt

SEQ ID NO: 8385876 - DNA, 18 bp, Homo sapiens
agggagcatctggttgcc

SEQ ID NO: 8385877 - DNA, 18 bp, Homo sapiens
agggagcatctggttgcc

SEQ ID NO: 8385878 - DNA, 22 bp, Homo sapiens
agggagagtttgatgtttcctc

SEQ ID NO: 8385879 - DNA, 22 bp, Homo sapiens
agggagcaaaggtttcagggtt

SEQ ID NO: 8385880 - DNA, 23 bp, Homo sapiens
agggagatgccacaaagatgccc

SEQ ID NO: 8385881 - DNA, 22 bp, Homo sapiens
ccccagcacttggagtggggag

SEQ ID NO: 8385882 - DNA, 22 bp, Homo sapiens
agggagcatgggtgaagcaggc

SEQ ID NO: 8385883 - DNA, 19 bp, Homo sapiens
agggaaggattctgtcatt

SEQ ID NO: 8385884 - DNA, 22 bp, Homo sapiens
agggaaggaggttagaacccac

SEQ ID NO: 8385885 - DNA, 22 bp, Homo sapiens
agggaaggaggccatgtgtccc

SEQ ID NO: 8385886 - DNA, 22 bp, Homo sapiens
agggaaggaggccatgtgtccc

SEQ ID NO: 8385887 - DNA, 19 bp, Homo sapiens
agggaaggattctgtcatt

SEQ ID NO: 8385888 - DNA, 22 bp, Homo sapiens
agggaaggcttttgacatttcc

SEQ ID NO: 8385889 - DNA, 22 bp, Homo sapiens
agggaagggaaaaacactcgtc

SEQ ID NO: 8385890 - DNA, 22 bp, Homo sapiens
agggaaggcttttgacatttcc

SEQ ID NO: 8385891 - DNA, 22 bp, Homo sapiens
agggaaggaaaagctgtcgctt

SEQ ID NO: 8385892 - DNA, 22 bp, Homo sapiens
agggaagcttgttactgagaag

SEQ ID NO: 8385893 - DNA, 22 bp, Homo sapiens
agggaaggaaaagctgtcgctt

SEQ ID NO: 8385894 - DNA, 22 bp, Homo sapiens
aggcttcaaggacctgagggaa

SEQ ID NO: 8385895 - DNA, 19 bp, Homo sapiens
agggaatccggctgaggga

SEQ ID NO: 8385896 - DNA, 22 bp, Homo sapiens
agggagaggctgaactatccta

SEQ ID NO: 8385897 - DNA, 22 bp, Homo sapiens
agggagaggttgaaacctcagt

SEQ ID NO: 8385898 - DNA, 22 bp, Homo sapiens
agggagaggttgaaacctcagt

SEQ ID NO: 8385899 - DNA, 22 bp, Homo sapiens
agggagagtagatatcaggtgt

SEQ ID NO: 8385900 - DNA, 22 bp, Homo sapiens
agggaagggcagggtctatgca

SEQ ID NO: 8385901 - DNA, 22 bp, Homo sapiens
agggaagggcagggtctatgca

SEQ ID NO: 8385902 - DNA, 22 bp, Homo sapiens
agggaagggcagggtctatgca

SEQ ID NO: 8385903 - DNA, 23 bp, Homo sapiens
agggaagggggcttattccacag

SEQ ID NO: 8385904 - DNA, 22 bp, Homo sapiens
agggaaggtagaggtcaccggc

SEQ ID NO: 8385905 - DNA, 19 bp, Homo sapiens
agggaatccggctgaggga

SEQ ID NO: 8385906 - DNA, 22 bp, Homo sapiens
aggctgttctaggagagtggga

SEQ ID NO: 8385907 - DNA, 22 bp, Homo sapiens
aggctgtgtttcccctggagct

SEQ ID NO: 8385908 - DNA, 22 bp, Homo sapiens
aggctgtgtttcccctggagct

SEQ ID NO: 8385909 - DNA, 22 bp, Homo sapiens
cccagctctgccatctacccac

SEQ ID NO: 8385910 - DNA, 22 bp, Homo sapiens
cccagctctcgcacttactagc

SEQ ID NO: 8385911 - DNA, 22 bp, Homo sapiens
cccagcctgatctcggccagct

SEQ ID NO: 8385912 - DNA, 22 bp, Homo sapiens
cccagcctctgtttgctcctct

SEQ ID NO: 8385913 - DNA, 22 bp, Homo sapiens
cccagcctctgggctcacccaa

SEQ ID NO: 8385914 - DNA, 18 bp, Homo sapiens
cccagcctctcctttcta

SEQ ID NO: 8385915 - DNA, 18 bp, Homo sapiens
cccagcctctcctttcta

SEQ ID NO: 8385916 - DNA, 22 bp, Homo sapiens
cccagcagtgacccagtgatac

SEQ ID NO: 8385917 - DNA, 22 bp, Homo sapiens
cccagcagtacccaagcccttg

SEQ ID NO: 8385918 - DNA, 22 bp, Homo sapiens
cccagcagtagagctcatatgg

SEQ ID NO: 8385919 - DNA, 22 bp, Homo sapiens
cccagcagtgacccagtgatac

SEQ ID NO: 8385920 - DNA, 22 bp, Homo sapiens
cccagcagtgacccagtgatac

SEQ ID NO: 8385921 - DNA, 22 bp, Homo sapiens
cccagcagtggttctcaaactt

SEQ ID NO: 8385922 - DNA, 22 bp, Homo sapiens
cccagcagtgacccagtgatac

SEQ ID NO: 8385923 - DNA, 22 bp, Homo sapiens
cccagcagtgacccagtgatac

SEQ ID NO: 8385924 - DNA, 22 bp, Homo sapiens
cccagcagtaaccagtggaaat

SEQ ID NO: 8385925 - DNA, 22 bp, Homo sapiens
cccagcagtacccaagcccttg

SEQ ID NO: 8385926 - DNA, 22 bp, Homo sapiens
cccagcagtacccaagcccttg

SEQ ID NO: 8385927 - DNA, 22 bp, Homo sapiens
cccagcagtacccaagcccttg

SEQ ID NO: 8385928 - DNA, 22 bp, Homo sapiens
cccagcagttgttggtgcacat

SEQ ID NO: 8385929 - DNA, 22 bp, Homo sapiens
cccagcagttgttggtgcacat

SEQ ID NO: 8385930 - DNA, 22 bp, Homo sapiens
cccagcagtttgcttagagtga

SEQ ID NO: 8385931 - DNA, 22 bp, Homo sapiens
cccagcagtttgcttagagtga

SEQ ID NO: 8385932 - DNA, 22 bp, Homo sapiens
ccatgaattcactccatgctag

SEQ ID NO: 8385933 - DNA, 22 bp, Homo sapiens
ccatcttgggtcactgcccccc

SEQ ID NO: 8385934 - DNA, 22 bp, Homo sapiens
ccatcttaattctaaagacaaa

SEQ ID NO: 8385935 - DNA, 22 bp, Homo sapiens
ccatctgtatctgacaaattct

SEQ ID NO: 8385936 - DNA, 22 bp, Homo sapiens
ccagtttcttaagtaggaagaa

SEQ ID NO: 8385937 - DNA, 22 bp, Homo sapiens
ccagtttgaggaagaagtagat

SEQ ID NO: 8385938 - DNA, 22 bp, Homo sapiens
ccatctccactgtccctgtcaa

SEQ ID NO: 8385939 - DNA, 22 bp, Homo sapiens
agggcagagggtgcctcacctg

SEQ ID NO: 8385940 - DNA, 22 bp, Homo sapiens
agggaggagaatggactccttc

SEQ ID NO: 8385941 - DNA, 22 bp, Homo sapiens
agggaggagaatggactccttc

SEQ ID NO: 8385942 - DNA, 22 bp, Homo sapiens
agggcagcccttctgggagggc

SEQ ID NO: 8385943 - DNA, 22 bp, Homo sapiens
agggcagcagctcctcctagct

SEQ ID NO: 8385944 - DNA, 22 bp, Homo sapiens
agggcagatggaacttccccga

SEQ ID NO: 8385945 - DNA, 22 bp, Homo sapiens
agggcagcagctcctcctagct

SEQ ID NO: 8385946 - DNA, 22 bp, Homo sapiens
agggcagcagctgtccctgaga

SEQ ID NO: 8385947 - DNA, 22 bp, Homo sapiens
agggcagcagctgtccctgaga

SEQ ID NO: 8385948 - DNA, 22 bp, Homo sapiens
agggcagcattgcctttctcca

SEQ ID NO: 8385949 - DNA, 22 bp, Homo sapiens
agggcagcattgcctttctcca

SEQ ID NO: 8385950 - DNA, 22 bp, Homo sapiens
agggccagccccaccctctctg

SEQ ID NO: 8385951 - DNA, 21 bp, Homo sapiens
agggccagatcaccaaggagc

SEQ ID NO: 8385952 - DNA, 22 bp, Homo sapiens
agggccagccgacttccagcct

SEQ ID NO: 8385953 - DNA, 22 bp, Homo sapiens
agggcagctgtgagccactgtg

SEQ ID NO: 8385954 - DNA, 22 bp, Homo sapiens
agggcagctctcacctctggcc

SEQ ID NO: 8385955 - DNA, 22 bp, Homo sapiens
agggcagctggaaggtggcttc

SEQ ID NO: 8385956 - DNA, 22 bp, Homo sapiens
agggcagctggaaggtggcttc

SEQ ID NO: 8385957 - DNA, 22 bp, Homo sapiens
agggcagctgtgagccactgtg

SEQ ID NO: 8385958 - DNA, 22 bp, Homo sapiens
agggcagcctctcagcctaggt

SEQ ID NO: 8385959 - DNA, 22 bp, Homo sapiens
agggcagcctgagtgctggccc

SEQ ID NO: 8385960 - DNA, 22 bp, Homo sapiens
agggcagcctgagtgctggccc

SEQ ID NO: 8385961 - DNA, 22 bp, Homo sapiens
agggcagcggtgcttgtgttat

SEQ ID NO: 8385962 - DNA, 22 bp, Homo sapiens
agggcagcctgagtgctggccc

SEQ ID NO: 8385963 - DNA, 22 bp, Homo sapiens
agggcagctaaggtgctgactg

SEQ ID NO: 8385964 - DNA, 22 bp, Homo sapiens
agggcagctctcacctctggcc

SEQ ID NO: 8385965 - DNA, 22 bp, Homo sapiens
agggcagctaaggtgctgactg

SEQ ID NO: 8385966 - DNA, 22 bp, Homo sapiens
ccctgggcaagccctattttcc

SEQ ID NO: 8385967 - DNA, 22 bp, Homo sapiens
ccctgggcaccaggcctggtaa

SEQ ID NO: 8385968 - DNA, 22 bp, Homo sapiens
ccctgggcagtctgcacttcag

SEQ ID NO: 8385969 - DNA, 22 bp, Homo sapiens
ccctgggcaccaggcctggtaa

SEQ ID NO: 8385970 - DNA, 22 bp, Homo sapiens
ccctgggctcagagcaggtagc

SEQ ID NO: 8385971 - DNA, 22 bp, Homo sapiens
ccctgggctcagagcaggtagc

SEQ ID NO: 8385972 - DNA, 22 bp, Homo sapiens
ccctgggctcagagcaggtagc

SEQ ID NO: 8385973 - DNA, 22 bp, Homo sapiens
agggccagggaagctgtatttt

SEQ ID NO: 8385974 - DNA, 22 bp, Homo sapiens
agggccaggctcccatgtcagg

SEQ ID NO: 8385975 - DNA, 22 bp, Homo sapiens
agggccagggaaacgatcagca

SEQ ID NO: 8385976 - DNA, 22 bp, Homo sapiens
agggccagccgacttccagcct

SEQ ID NO: 8385977 - DNA, 22 bp, Homo sapiens
agggccagccgacttccagcct

SEQ ID NO: 8385978 - DNA, 22 bp, Homo sapiens
agggccagctgatgagaatgag

SEQ ID NO: 8385979 - DNA, 22 bp, Homo sapiens
agggccagctgatgagaatgag

SEQ ID NO: 8385980 - DNA, 22 bp, Homo sapiens
agggccagctgatgagaatgag

SEQ ID NO: 8385981 - DNA, 22 bp, Homo sapiens
agggccaggaacacctgaaggg

SEQ ID NO: 8385982 - DNA, 22 bp, Homo sapiens
agggccaggatcacagccaaga

SEQ ID NO: 8385983 - DNA, 19 bp, Homo sapiens
agggccaggattctggaac

SEQ ID NO: 8385984 - DNA, 22 bp, Homo sapiens
cctcagagaaaggtatggctga

SEQ ID NO: 8385985 - DNA, 21 bp, Homo sapiens
cctcagagacagatacgggtg

SEQ ID NO: 8385986 - DNA, 22 bp, Homo sapiens
cctcagagcctccagaaggaat

SEQ ID NO: 8385987 - DNA, 22 bp, Homo sapiens
cctcagagcctccagaaggaat

SEQ ID NO: 8385988 - DNA, 22 bp, Homo sapiens
cctcagagcagcacccagatga

SEQ ID NO: 8385989 - DNA, 22 bp, Homo sapiens
cctcagagccatgcctgagttc

SEQ ID NO: 8385990 - DNA, 21 bp, Homo sapiens
cctcaagtgcctcctgctgct

SEQ ID NO: 8385991 - DNA, 22 bp, Homo sapiens
cctcaaattgtcaaataagaat

SEQ ID NO: 8385992 - DNA, 22 bp, Homo sapiens
ccctggggctgagggatggccg

SEQ ID NO: 8385993 - DNA, 17 bp, Homo sapiens
ccctgggtgagttctca

SEQ ID NO: 8385994 - DNA, 22 bp, Homo sapiens
ccctgtttatttttggagagaa

SEQ ID NO: 8385995 - DNA, 21 bp, Homo sapiens
ccctgtgttccacagcagaca

SEQ ID NO: 8385996 - DNA, 22 bp, Homo sapiens
cctagaatgtacttaatagatg

SEQ ID NO: 8385997 - DNA, 22 bp, Homo sapiens
cccttcagggttaagtagaggg

SEQ ID NO: 8385998 - DNA, 22 bp, Homo sapiens
cctagacattaagcttgggttt

SEQ ID NO: 8385999 - DNA, 23 bp, Homo sapiens
cccttcagcgagggcattaaggt

SEQ ID NO: 8386000 - DNA, 22 bp, Homo sapiens
cccttcagctgagtgggacagc

SEQ ID NO: 8386001 - DNA, 22 bp, Homo sapiens
cccttcagggttaagtagaggg

SEQ ID NO: 8386002 - DNA, 22 bp, Homo sapiens
cccttcagctgagtgggacagc

SEQ ID NO: 8386003 - DNA, 23 bp, Homo sapiens
cccttcagcgagggcattaaggt

SEQ ID NO: 8386004 - DNA, 20 bp, Homo sapiens
cctccaggcacacccatgtg

SEQ ID NO: 8386005 - DNA, 22 bp, Homo sapiens
cctccaggataagtcagggcct

SEQ ID NO: 8386006 - DNA, 22 bp, Homo sapiens
cctccaggctgaatatctagaa

SEQ ID NO: 8386007 - DNA, 21 bp, Homo sapiens
cctccaggagcagagccctga

SEQ ID NO: 8386008 - DNA, 22 bp, Homo sapiens
cctccaggaggaaatggaacac

SEQ ID NO: 8386009 - DNA, 22 bp, Homo sapiens
cctccccacagcccaggagact

SEQ ID NO: 8386010 - DNA, 22 bp, Homo sapiens
cctcccatccctgcaagagagc

SEQ ID NO: 8386011 - DNA, 22 bp, Homo sapiens
cctcgctgtgtgaccttgggtg

SEQ ID NO: 8386012 - DNA, 22 bp, Homo sapiens
cctccccacccacggctggtgg

SEQ ID NO: 8386013 - DNA, 22 bp, Homo sapiens
cctctcggcagcccatcttgtc

SEQ ID NO: 8386014 - DNA, 22 bp, Homo sapiens
cctctctccaattttcacctca

SEQ ID NO: 8386015 - DNA, 22 bp, Homo sapiens
aggctgagataggtggatcatt

SEQ ID NO: 8386016 - DNA, 22 bp, Homo sapiens
aggctctgccaattccttcctc

SEQ ID NO: 8386017 - DNA, 22 bp, Homo sapiens
aggctctgatgcaagcccaggg

SEQ ID NO: 8386018 - DNA, 22 bp, Homo sapiens
aggctctgcagaccccagctgt

SEQ ID NO: 8386019 - DNA, 22 bp, Homo sapiens
aggctctgcagaccccagctgt

SEQ ID NO: 8386020 - DNA, 22 bp, Homo sapiens
aggctctgcagtgctggaggac

SEQ ID NO: 8386021 - DNA, 19 bp, Homo sapiens
aggctctgagctcctggag

SEQ ID NO: 8386022 - DNA, 22 bp, Homo sapiens
ccagtgagaatgaagataaggc

SEQ ID NO: 8386023 - DNA, 22 bp, Homo sapiens
ccagtcactctgtgagagctac

SEQ ID NO: 8386024 - DNA, 22 bp, Homo sapiens
ccagttacaagtgattcttggt

SEQ ID NO: 8386025 - DNA, 22 bp, Homo sapiens
ccagttagttaaaggcgcagta

SEQ ID NO: 8386026 - DNA, 22 bp, Homo sapiens
ccagttactaacacctttggct

SEQ ID NO: 8386027 - DNA, 23 bp, Homo sapiens
ccagtttatctttagtgtagatc

SEQ ID NO: 8386028 - DNA, 22 bp, Homo sapiens
ccagtttaggtactaggctcta

SEQ ID NO: 8386029 - DNA, 22 bp, Homo sapiens
ccagttgtttgccttgaaatga

SEQ ID NO: 8386030 - DNA, 22 bp, Homo sapiens
ccagttctttctgtgtgcaaca

SEQ ID NO: 8386031 - DNA, 23 bp, Homo sapiens
ccagttctcctttgaacagtgac

SEQ ID NO: 8386032 - DNA, 22 bp, Homo sapiens
ccagttctgacacaagcacagt

SEQ ID NO: 8386033 - DNA, 22 bp, Homo sapiens
ccagttctgagatgaatatcca

SEQ ID NO: 8386034 - DNA, 22 bp, Homo sapiens
ccagttctaaacataaagctaa

SEQ ID NO: 8386035 - DNA, 22 bp, Homo sapiens
ccagttctaaacataaagctaa

SEQ ID NO: 8386036 - DNA, 22 bp, Homo sapiens
aggctgaggcaggtggatcact

SEQ ID NO: 8386037 - DNA, 22 bp, Homo sapiens
aggctgaggcaggtggatcatt

SEQ ID NO: 8386038 - DNA, 22 bp, Homo sapiens
aggctgaggcgggaggatcact

SEQ ID NO: 8386039 - DNA, 22 bp, Homo sapiens
ccaggcagtggaagctaaaatt

SEQ ID NO: 8386040 - DNA, 21 bp, Homo sapiens
ccaggcatgactgcagagagc

SEQ ID NO: 8386041 - DNA, 22 bp, Homo sapiens
aggcctcctggctccaggcctt

SEQ ID NO: 8386042 - DNA, 22 bp, Homo sapiens
aggcctctgagcagcactcatg

SEQ ID NO: 8386043 - DNA, 22 bp, Homo sapiens
ccaggcacttcatcattagggt

SEQ ID NO: 8386044 - DNA, 23 bp, Homo sapiens
ccaggcagtagctattgaagtga

SEQ ID NO: 8386045 - DNA, 22 bp, Homo sapiens
aggcctcacacaacagatgcat

SEQ ID NO: 8386046 - DNA, 22 bp, Homo sapiens
aggcctcagcctgccaggcctg

SEQ ID NO: 8386047 - DNA, 22 bp, Homo sapiens
aggcctcactctcagagcttct

SEQ ID NO: 8386048 - DNA, 22 bp, Homo sapiens
aggcctcacattgggcttcaag

SEQ ID NO: 8386049 - DNA, 22 bp, Homo sapiens
aggcctcagttcttgccaggtg

SEQ ID NO: 8386050 - DNA, 17 bp, Homo sapiens
aggcctcaggtgaaacc

SEQ ID NO: 8386051 - DNA, 22 bp, Homo sapiens
aggcctcatgtcaaagcagcaa

SEQ ID NO: 8386052 - DNA, 22 bp, Homo sapiens
aggcctcatgtcaaagcagcaa

SEQ ID NO: 8386053 - DNA, 22 bp, Homo sapiens
aggcctcatagtagacctgccc

SEQ ID NO: 8386054 - DNA, 22 bp, Homo sapiens
aggcctcatagtagacctgccc

SEQ ID NO: 8386055 - DNA, 22 bp, Homo sapiens
aggcctcctgcagggatgagtg

SEQ ID NO: 8386056 - DNA, 22 bp, Homo sapiens
ccaggcctagcccctgagggta

SEQ ID NO: 8386057 - DNA, 22 bp, Homo sapiens
ccaggcctagcccctgagggta

SEQ ID NO: 8386058 - DNA, 22 bp, Homo sapiens
ccaggcccgttcccttctccag

SEQ ID NO: 8386059 - DNA, 22 bp, Homo sapiens
ccaggccctgctcctcacacca

SEQ ID NO: 8386060 - DNA, 22 bp, Homo sapiens
ccaggcctcacctgcccaccta

SEQ ID NO: 8386061 - DNA, 22 bp, Homo sapiens
aggctccatgcaaaggctgttt

SEQ ID NO: 8386062 - DNA, 22 bp, Homo sapiens
ccaggctctgacatagatggga

SEQ ID NO: 8386063 - DNA, 22 bp, Homo sapiens
aggctccattttcctgcagctg

SEQ ID NO: 8386064 - DNA, 22 bp, Homo sapiens
aggcagtgagaaatagcaagat

SEQ ID NO: 8386065 - DNA, 22 bp, Homo sapiens
aggcagtgagcagggtgtcatg

SEQ ID NO: 8386066 - DNA, 22 bp, Homo sapiens
aggcagtgcagagtcctcttct

SEQ ID NO: 8386067 - DNA, 22 bp, Homo sapiens
aggcagtgcatgcaaaggtcgg

SEQ ID NO: 8386068 - DNA, 22 bp, Homo sapiens
aggcagtgcctggaccccagct

SEQ ID NO: 8386069 - DNA, 22 bp, Homo sapiens
aggcagtgcctggaccccagct

SEQ ID NO: 8386070 - DNA, 22 bp, Homo sapiens
aggcagtgctcaagacagcagc

SEQ ID NO: 8386071 - DNA, 22 bp, Homo sapiens
aggcagtgctcaagacagcagc

SEQ ID NO: 8386072 - DNA, 22 bp, Homo sapiens
aggcagtgctgtgccctgaacc

SEQ ID NO: 8386073 - DNA, 22 bp, Homo sapiens
aggcagtgctgtgccctgaacc

SEQ ID NO: 8386074 - DNA, 22 bp, Homo sapiens
aggcagtggaaggagaaagcaa

SEQ ID NO: 8386075 - DNA, 22 bp, Homo sapiens
aggcagtggaaggagaaagcaa

SEQ ID NO: 8386076 - DNA, 22 bp, Homo sapiens
aggcagtggaaggagaaagcaa

SEQ ID NO: 8386077 - DNA, 22 bp, Homo sapiens
aggcagtggagctggaataggc

SEQ ID NO: 8386078 - DNA, 22 bp, Homo sapiens
aggcagtggctgagaccagggg

SEQ ID NO: 8386079 - DNA, 22 bp, Homo sapiens
aggcagtggctgagaccagggg

SEQ ID NO: 8386080 - DNA, 22 bp, Homo sapiens
aggcagtggctgagaccagggg

SEQ ID NO: 8386081 - DNA, 22 bp, Homo sapiens
aggcagtggatgtcaggaatgg

SEQ ID NO: 8386082 - DNA, 22 bp, Homo sapiens
aggcagtggatgtcaggaatgg

SEQ ID NO: 8386083 - DNA, 22 bp, Homo sapiens
aggcagccctgtgctggatgct

SEQ ID NO: 8386084 - DNA, 22 bp, Homo sapiens
aggcagccctgtgctggatgct

SEQ ID NO: 8386085 - DNA, 22 bp, Homo sapiens
aggcagcccacaggacacagga

SEQ ID NO: 8386086 - DNA, 22 bp, Homo sapiens
aggcagcccacaggacacagga

SEQ ID NO: 8386087 - DNA, 22 bp, Homo sapiens
aggcagccatctgcaggaagga

SEQ ID NO: 8386088 - DNA, 22 bp, Homo sapiens
aggcagccattaccaagggcat

SEQ ID NO: 8386089 - DNA, 22 bp, Homo sapiens
aggcagcccacaggacacagga

SEQ ID NO: 8386090 - DNA, 22 bp, Homo sapiens
aggcagccatctgcaggaagga

SEQ ID NO: 8386091 - DNA, 22 bp, Homo sapiens
aggcagccatctgcaggaagga

SEQ ID NO: 8386092 - DNA, 23 bp, Homo sapiens
aggcaggtttgggctcttcttgt

SEQ ID NO: 8386093 - DNA, 22 bp, Homo sapiens
aggcagtctatctctggagcct

SEQ ID NO: 8386094 - DNA, 19 bp, Homo sapiens
aggcagtcattggaatata

SEQ ID NO: 8386095 - DNA, 22 bp, Homo sapiens
aggcagtctagtccccaggcaa

SEQ ID NO: 8386096 - DNA, 22 bp, Homo sapiens
aggcagtccccaggggtgttgc

SEQ ID NO: 8386097 - DNA, 22 bp, Homo sapiens
aggcagtcagccctgctagggt

SEQ ID NO: 8386098 - DNA, 22 bp, Homo sapiens
aggcagcctttagacagtctgc

SEQ ID NO: 8386099 - DNA, 22 bp, Homo sapiens
aggcagcctttttggaaacata

SEQ ID NO: 8386100 - DNA, 23 bp, Homo sapiens
ccactggagaaagtggcaggtgg

SEQ ID NO: 8386101 - DNA, 22 bp, Homo sapiens
ccactggaagatgctgaggtca

SEQ ID NO: 8386102 - DNA, 22 bp, Homo sapiens
ccactggctgtcagcaggactc

SEQ ID NO: 8386103 - DNA, 22 bp, Homo sapiens
ccactggagactggtctctgtg

SEQ ID NO: 8386104 - DNA, 22 bp, Homo sapiens
aggcatggcatggggcagatgt

SEQ ID NO: 8386105 - DNA, 22 bp, Homo sapiens
aggcatctgagtttgcaagctt

SEQ ID NO: 8386106 - DNA, 22 bp, Homo sapiens
aggcatgactttggctgaagaa

SEQ ID NO: 8386107 - DNA, 21 bp, Homo sapiens
aggcatgagccctgcatggac

SEQ ID NO: 8386108 - DNA, 22 bp, Homo sapiens
aggcatgatgtgcagtggcaaa

SEQ ID NO: 8386109 - DNA, 23 bp, Homo sapiens
aggcagtgggggccactttgctt

SEQ ID NO: 8386110 - DNA, 23 bp, Homo sapiens
aggcagtggtggtaacatgtcaa

SEQ ID NO: 8386111 - DNA, 22 bp, Homo sapiens
aggccaagtagctagcattgaa

SEQ ID NO: 8386112 - DNA, 22 bp, Homo sapiens
aggccaagtagccgctgtccta

SEQ ID NO: 8386113 - DNA, 21 bp, Homo sapiens
aggccaagttggatttcttca

SEQ ID NO: 8386114 - DNA, 22 bp, Homo sapiens
aggccaagtgctgggacaggtg

SEQ ID NO: 8386115 - DNA, 22 bp, Homo sapiens
aggccaagattttggatcagct

SEQ ID NO: 8386116 - DNA, 22 bp, Homo sapiens
aggcatttttgttaatctttgg

SEQ ID NO: 8386117 - DNA, 22 bp, Homo sapiens
aggccagctgccacccggtccg

SEQ ID NO: 8386118 - DNA, 22 bp, Homo sapiens
aggccagctgttactagagcca

SEQ ID NO: 8386119 - DNA, 22 bp, Homo sapiens
aggccagctgttactagagcca

SEQ ID NO: 8386120 - DNA, 22 bp, Homo sapiens
aggccagctgttactagagcca

SEQ ID NO: 8386121 - DNA, 22 bp, Homo sapiens
aggccagctctacccttggact

SEQ ID NO: 8386122 - DNA, 22 bp, Homo sapiens
aggccagctcaccctggctcct

SEQ ID NO: 8386123 - DNA, 22 bp, Homo sapiens
aggccagctcaccctggctcct

SEQ ID NO: 8386124 - DNA, 22 bp, Homo sapiens
aggccagccttgtaaatgcctc

SEQ ID NO: 8386125 - DNA, 22 bp, Homo sapiens
aggccagctatgactctgctcc

SEQ ID NO: 8386126 - DNA, 22 bp, Homo sapiens
aggccagcgctgctagctcccg

SEQ ID NO: 8386127 - DNA, 22 bp, Homo sapiens
aggccagcaagaaagagagtct

SEQ ID NO: 8386128 - DNA, 22 bp, Homo sapiens
aggccctaatccaacatgactg

SEQ ID NO: 8386129 - DNA, 22 bp, Homo sapiens
aggccctctcattccagaggca

SEQ ID NO: 8386130 - DNA, 22 bp, Homo sapiens
aggccggcgcttcccaggaggc

SEQ ID NO: 8386131 - DNA, 22 bp, Homo sapiens
aggcccagttatcctacttgtt

SEQ ID NO: 8386132 - DNA, 22 bp, Homo sapiens
aggcccagttatcctacttgtt

SEQ ID NO: 8386133 - DNA, 22 bp, Homo sapiens
aggcccagtgtggcttcctgga

SEQ ID NO: 8386134 - DNA, 20 bp, Homo sapiens
aggccccaggaaactctcag

SEQ ID NO: 8386135 - DNA, 22 bp, Homo sapiens
aggccccaaagcagtgcaagta

SEQ ID NO: 8386136 - DNA, 22 bp, Homo sapiens
aggccccatcaggaaggaggcc

SEQ ID NO: 8386137 - DNA, 20 bp, Homo sapiens
aggccccaggtggacactag

SEQ ID NO: 8386138 - DNA, 22 bp, Homo sapiens
aggcccgaggttcgtgtgcacc

SEQ ID NO: 8386139 - DNA, 22 bp, Homo sapiens
aggccccatcaggaaggaggcc

SEQ ID NO: 8386140 - DNA, 22 bp, Homo sapiens
aggcccccacaggcttgaggca

SEQ ID NO: 8386141 - DNA, 22 bp, Homo sapiens
aggcccagtgtggcttcctgga

SEQ ID NO: 8386142 - DNA, 22 bp, Homo sapiens
aggcccagtgccattagttttg

SEQ ID NO: 8386143 - DNA, 20 bp, Homo sapiens
aggcccagtgaatatattgc

SEQ ID NO: 8386144 - DNA, 22 bp, Homo sapiens
aggcccagtcctctgccgtctg

SEQ ID NO: 8386145 - DNA, 22 bp, Homo sapiens
aggcccagtcctctgccgtctg

SEQ ID NO: 8386146 - DNA, 22 bp, Homo sapiens
aggcccagtagtgctgccttta

SEQ ID NO: 8386147 - DNA, 22 bp, Homo sapiens
aggcccagtagtcgacggcgct

SEQ ID NO: 8386148 - DNA, 22 bp, Homo sapiens
aggcccagctgggccaggaaca

SEQ ID NO: 8386149 - DNA, 22 bp, Homo sapiens
aggccagcttctaccctctgtt

SEQ ID NO: 8386150 - DNA, 20 bp, Homo sapiens
aggccaggaaatgtagttct

SEQ ID NO: 8386151 - DNA, 22 bp, Homo sapiens
aggccaggaccattagcccaga

SEQ ID NO: 8386152 - DNA, 22 bp, Homo sapiens
aggccaggacacttaagtaaga

SEQ ID NO: 8386153 - DNA, 22 bp, Homo sapiens
cattcccatgactcctgctcag

SEQ ID NO: 8386154 - DNA, 22 bp, Homo sapiens
cattcccttggggagttcatgc

SEQ ID NO: 8386155 - DNA, 21 bp, Homo sapiens
cattcctcggctcatagagga

SEQ ID NO: 8386156 - DNA, 22 bp, Homo sapiens
aggcagcagaaaacaaatggtt

SEQ ID NO: 8386157 - DNA, 22 bp, Homo sapiens
cattccagatgaggccaggccc

SEQ ID NO: 8386158 - DNA, 22 bp, Homo sapiens
cattccaagtatatacatgata

SEQ ID NO: 8386159 - DNA, 22 bp, Homo sapiens
cattcaaaatgggctgacctgt

SEQ ID NO: 8386160 - DNA, 22 bp, Homo sapiens
cattcaaaagctccatgtttgt

SEQ ID NO: 8386161 - DNA, 22 bp, Homo sapiens
cattcaaaagctccatgtttgt

SEQ ID NO: 8386162 - DNA, 22 bp, Homo sapiens
cattcaaacattaatttattca

SEQ ID NO: 8386163 - DNA, 22 bp, Homo sapiens
cattcaaagcaggaaaggcctt

SEQ ID NO: 8386164 - DNA, 22 bp, Homo sapiens
cattattaattcagcacatgct

SEQ ID NO: 8386165 - DNA, 22 bp, Homo sapiens
cattatgtgagtgattaattca

SEQ ID NO: 8386166 - DNA, 22 bp, Homo sapiens
cattatgatggtaattttctct

SEQ ID NO: 8386167 - DNA, 22 bp, Homo sapiens
catggccccaaatcccatgcat

SEQ ID NO: 8386168 - DNA, 22 bp, Homo sapiens
cattaagatgcaaacctaacta

SEQ ID NO: 8386169 - DNA, 22 bp, Homo sapiens
catggcggtcaggatgtaggtg

SEQ ID NO: 8386170 - DNA, 22 bp, Homo sapiens
catggctcacaggatgggctag

SEQ ID NO: 8386171 - DNA, 22 bp, Homo sapiens
aggcagcatttgaatccaggtc

SEQ ID NO: 8386172 - DNA, 22 bp, Homo sapiens
aggcagccaaaaagaagtcctc

SEQ ID NO: 8386173 - DNA, 22 bp, Homo sapiens
aggcagccaatcagaggctgac

SEQ ID NO: 8386174 - DNA, 22 bp, Homo sapiens
aggcagccagttcaggtttctt

SEQ ID NO: 8386175 - DNA, 22 bp, Homo sapiens
aggcagcagtcatgaggaaaga

SEQ ID NO: 8386176 - DNA, 22 bp, Homo sapiens
aggcagcagtcatgaggaaaga

SEQ ID NO: 8386177 - DNA, 22 bp, Homo sapiens
catttacatttaaggttaatat

SEQ ID NO: 8386178 - DNA, 19 bp, Homo sapiens
aggcagcattctggggctt

SEQ ID NO: 8386179 - DNA, 22 bp, Homo sapiens
aggcagcatttctgcttatcca

SEQ ID NO: 8386180 - DNA, 22 bp, Homo sapiens
aggcagcagaggttgaggaaag

SEQ ID NO: 8386181 - DNA, 22 bp, Homo sapiens
aggcagcagaggttgaggaaag

SEQ ID NO: 8386182 - DNA, 22 bp, Homo sapiens
aggcagcagccacaaggcctga

SEQ ID NO: 8386183 - DNA, 22 bp, Homo sapiens
aggcagcagccacaaggcctga

SEQ ID NO: 8386184 - DNA, 22 bp, Homo sapiens
aggcagcagccacaaggcctga

SEQ ID NO: 8386185 - DNA, 18 bp, Homo sapiens
aggcagcagcatcttctc

SEQ ID NO: 8386186 - DNA, 22 bp, Homo sapiens
aggaggtgctagagaagatgtt

SEQ ID NO: 8386187 - DNA, 22 bp, Homo sapiens
aggaggtgctagagaagatgtt

SEQ ID NO: 8386188 - DNA, 22 bp, Homo sapiens
aggaggtggcaactgtcgacag

SEQ ID NO: 8386189 - DNA, 22 bp, Homo sapiens
aggaggtggcctgagcgtgccc

SEQ ID NO: 8386190 - DNA, 22 bp, Homo sapiens
aggaggtggctgaacttgaggg

SEQ ID NO: 8386191 - DNA, 22 bp, Homo sapiens
catgcacttacctgaaattcaa

SEQ ID NO: 8386192 - DNA, 22 bp, Homo sapiens
aggaggtgttgatagaaggttt

SEQ ID NO: 8386193 - DNA, 22 bp, Homo sapiens
aggaggtgttgatagaaggttt

SEQ ID NO: 8386194 - DNA, 22 bp, Homo sapiens
catgcacactgcaacaaggact

SEQ ID NO: 8386195 - DNA, 22 bp, Homo sapiens
catgcacagagcttggtcattg

SEQ ID NO: 8386196 - DNA, 22 bp, Homo sapiens
catgaaatgttagaattagaca

SEQ ID NO: 8386197 - DNA, 22 bp, Homo sapiens
catgaaatgttagaattagaca

SEQ ID NO: 8386198 - DNA, 22 bp, Homo sapiens
catgaaatgttagaattagaca

SEQ ID NO: 8386199 - DNA, 22 bp, Homo sapiens
catgaaatgtgttaatctcttg

SEQ ID NO: 8386200 - DNA, 22 bp, Homo sapiens
catgaaattcagcaggtgagta

SEQ ID NO: 8386201 - DNA, 22 bp, Homo sapiens
catgaaattcagcaggtgagta

SEQ ID NO: 8386202 - DNA, 22 bp, Homo sapiens
catgaaatctgagtatgtttcc

SEQ ID NO: 8386203 - DNA, 22 bp, Homo sapiens
catgaaatcacaagctgaggac

SEQ ID NO: 8386204 - DNA, 22 bp, Homo sapiens
catgaaatcacaagctgaggac

SEQ ID NO: 8386205 - DNA, 22 bp, Homo sapiens
catgaaatgatatttgggtggg

SEQ ID NO: 8386206 - DNA, 22 bp, Homo sapiens
catgaaatggccaaccttcggc

SEQ ID NO: 8386207 - DNA, 22 bp, Homo sapiens
aggaggcactcactctcagggt

SEQ ID NO: 8386208 - DNA, 22 bp, Homo sapiens
aggaggcactcactctcagggt

SEQ ID NO: 8386209 - DNA, 22 bp, Homo sapiens
catctttaaaatgggaacaaca

SEQ ID NO: 8386210 - DNA, 17 bp, Homo sapiens
catctttaaaatcctga

SEQ ID NO: 8386211 - DNA, 22 bp, Homo sapiens
catgaaatattagtaactgttt

SEQ ID NO: 8386212 - DNA, 22 bp, Homo sapiens
catgaaatatgctacctgtctt

SEQ ID NO: 8386213 - DNA, 22 bp, Homo sapiens
catgaaaatgtcaagttctgct

SEQ ID NO: 8386214 - DNA, 22 bp, Homo sapiens
aggcacagcctcccttcacatg

SEQ ID NO: 8386215 - DNA, 22 bp, Homo sapiens
aggcacagcctcccttcacatg

SEQ ID NO: 8386216 - DNA, 22 bp, Homo sapiens
aggcacaggaacaggaaaagag

SEQ ID NO: 8386217 - DNA, 22 bp, Homo sapiens
aggcacaggaggtggtaagaag

SEQ ID NO: 8386218 - DNA, 22 bp, Homo sapiens
aggcacaggaatgtcatccagt

SEQ ID NO: 8386219 - DNA, 22 bp, Homo sapiens
aggcacaggaatgtcatccagt

SEQ ID NO: 8386220 - DNA, 22 bp, Homo sapiens
aggcacaggaatgtcatccagt

SEQ ID NO: 8386221 - DNA, 22 bp, Homo sapiens
aggcacaggaatgtcatccagt

SEQ ID NO: 8386222 - DNA, 23 bp, Homo sapiens
catgccagtttgtgcaggcagat

SEQ ID NO: 8386223 - DNA, 22 bp, Homo sapiens
catgccatgtgtgaggagagga

SEQ ID NO: 8386224 - DNA, 22 bp, Homo sapiens
catgcaggaggaaaaagcagct

SEQ ID NO: 8386225 - DNA, 22 bp, Homo sapiens
catgcagagtttattaccatct

SEQ ID NO: 8386226 - DNA, 22 bp, Homo sapiens
cagtcctctggagtgagggtga

SEQ ID NO: 8386227 - DNA, 22 bp, Homo sapiens
cagtcctgaatactggacggtg

SEQ ID NO: 8386228 - DNA, 22 bp, Homo sapiens
cagtcctgaggaagagctgctg

SEQ ID NO: 8386229 - DNA, 22 bp, Homo sapiens
cagtcctgggcacagccctggg

SEQ ID NO: 8386230 - DNA, 22 bp, Homo sapiens
aggacagcagccattggcagtc

SEQ ID NO: 8386231 - DNA, 22 bp, Homo sapiens
cagtcctggagcccttcttggc

SEQ ID NO: 8386232 - DNA, 22 bp, Homo sapiens
aggaagctggtgtgaggatgaa

SEQ ID NO: 8386233 - DNA, 20 bp, Homo sapiens
aggaaggaagtttgcatgga

SEQ ID NO: 8386234 - DNA, 22 bp, Homo sapiens
aggaaggaagagacaccatttg

SEQ ID NO: 8386235 - DNA, 19 bp, Homo sapiens
aggaaggaacctgagtctg

SEQ ID NO: 8386236 - DNA, 19 bp, Homo sapiens
aggaaggaacctgagtctg

SEQ ID NO: 8386237 - DNA, 22 bp, Homo sapiens
aggacagcagttggtgaggttc

SEQ ID NO: 8386238 - DNA, 22 bp, Homo sapiens
aggacagcagtgctggcacttg

SEQ ID NO: 8386239 - DNA, 22 bp, Homo sapiens
aggacagcatatgggaaccagt

SEQ ID NO: 8386240 - DNA, 22 bp, Homo sapiens
aggacagcattttcagcatctc

SEQ ID NO: 8386241 - DNA, 22 bp, Homo sapiens
aggacagcattttcagcatctc

SEQ ID NO: 8386242 - DNA, 22 bp, Homo sapiens
aggacagcccccaacagcaaca

SEQ ID NO: 8386243 - DNA, 22 bp, Homo sapiens
aggacagcccttgagagcacat

SEQ ID NO: 8386244 - DNA, 22 bp, Homo sapiens
aggacagcccttgagagcacat

SEQ ID NO: 8386245 - DNA, 21 bp, Homo sapiens
aggacaggaactggctgaata

SEQ ID NO: 8386246 - DNA, 22 bp, Homo sapiens
aggagaaaacagtgttttgcct

SEQ ID NO: 8386247 - DNA, 21 bp, Homo sapiens
aggagaaacacaggtcagccc

SEQ ID NO: 8386248 - DNA, 21 bp, Homo sapiens
aggagaaacacaggtcagccc

SEQ ID NO: 8386249 - DNA, 22 bp, Homo sapiens
aggagaaagactggacagccaa

SEQ ID NO: 8386250 - DNA, 22 bp, Homo sapiens
aggagaaagactggacagccaa

SEQ ID NO: 8386251 - DNA, 18 bp, Homo sapiens
aggagaaagggaccaggg

SEQ ID NO: 8386252 - DNA, 22 bp, Homo sapiens
cagtctctggcagctgctggcc

SEQ ID NO: 8386253 - DNA, 22 bp, Homo sapiens
cagtctctgggaaagaggacag

SEQ ID NO: 8386254 - DNA, 22 bp, Homo sapiens
cagtctctgtcatctcatggga

SEQ ID NO: 8386255 - DNA, 22 bp, Homo sapiens
cagtctctttatccaccaagcc

SEQ ID NO: 8386256 - DNA, 22 bp, Homo sapiens
aggagaattaggaactcaagat

SEQ ID NO: 8386257 - DNA, 22 bp, Homo sapiens
cagtctcttttcagctccatcc

SEQ ID NO: 8386258 - DNA, 22 bp, Homo sapiens
cagtctctctccttgcaggcgt

SEQ ID NO: 8386259 - DNA, 22 bp, Homo sapiens
cagtctctctccttgcaggcgt

SEQ ID NO: 8386260 - DNA, 22 bp, Homo sapiens
cagtctctcttgtagtgcagct

SEQ ID NO: 8386261 - DNA, 23 bp, Homo sapiens
aggagaagagatttccacatgca

SEQ ID NO: 8386262 - DNA, 23 bp, Homo sapiens
aggagaagagatttccacatgca

SEQ ID NO: 8386263 - DNA, 23 bp, Homo sapiens
aggagaagagatttccacatgca

SEQ ID NO: 8386264 - DNA, 22 bp, Homo sapiens
aggagaagccaagttgtgagca

SEQ ID NO: 8386265 - DNA, 22 bp, Homo sapiens
aggagctcaaagatgccaggag

SEQ ID NO: 8386266 - DNA, 22 bp, Homo sapiens
aggagctcagcctgcagggagc

SEQ ID NO: 8386267 - DNA, 21 bp, Homo sapiens
aggagctctccaaggacaaag

SEQ ID NO: 8386268 - DNA, 22 bp, Homo sapiens
aggagctcccgtgaggagacca

SEQ ID NO: 8386269 - DNA, 22 bp, Homo sapiens
aggagctcccgtgaggagacca

SEQ ID NO: 8386270 - DNA, 22 bp, Homo sapiens
aggagctccagcccagggaagt

SEQ ID NO: 8386271 - DNA, 18 bp, Homo sapiens
aggagcctttgcactgga

SEQ ID NO: 8386272 - DNA, 19 bp, Homo sapiens
aggagccttgagcagtgag

SEQ ID NO: 8386273 - DNA, 22 bp, Homo sapiens
aggagagttcacactggtcaga

SEQ ID NO: 8386274 - DNA, 22 bp, Homo sapiens
aggagagggtggcattaagttt

SEQ ID NO: 8386275 - DNA, 22 bp, Homo sapiens
aggagccatgagcaggaggcaa

SEQ ID NO: 8386276 - DNA, 22 bp, Homo sapiens
aggagatagtcaaagcttcttg

SEQ ID NO: 8386277 - DNA, 22 bp, Homo sapiens
aggagataagaggctggtgtgg

SEQ ID NO: 8386278 - DNA, 22 bp, Homo sapiens
aggagataagaggctggtgtgg

SEQ ID NO: 8386279 - DNA, 22 bp, Homo sapiens
aggagcctggctggcccacagg

SEQ ID NO: 8386280 - DNA, 22 bp, Homo sapiens
aggagagaatgttccaggcttg

SEQ ID NO: 8386281 - DNA, 22 bp, Homo sapiens
aggagagaatgttccaggcttg

SEQ ID NO: 8386282 - DNA, 22 bp, Homo sapiens
aggagagaattactgggtgtca

SEQ ID NO: 8386283 - DNA, 22 bp, Homo sapiens
aggagagaattactgggtgtca

SEQ ID NO: 8386284 - DNA, 22 bp, Homo sapiens
aggagagaatgttccaggcttg

SEQ ID NO: 8386285 - DNA, 22 bp, Homo sapiens
aggagagaatgttccaggcttg

SEQ ID NO: 8386286 - DNA, 22 bp, Homo sapiens
aggagagagaacacttgggtcc

SEQ ID NO: 8386287 - DNA, 22 bp, Homo sapiens
aggagagagaacacttgggtcc

SEQ ID NO: 8386288 - DNA, 22 bp, Homo sapiens
aggagagagctgagctttgctg

SEQ ID NO: 8386289 - DNA, 22 bp, Homo sapiens
aggagaggctctaactctgtgt

SEQ ID NO: 8386290 - DNA, 22 bp, Homo sapiens
aggagaggcatcaagaaaatcg

SEQ ID NO: 8386291 - DNA, 22 bp, Homo sapiens
aggagaggcatcaagaaaatcg

SEQ ID NO: 8386292 - DNA, 22 bp, Homo sapiens
aggagagcaggccagccgtccc

SEQ ID NO: 8386293 - DNA, 22 bp, Homo sapiens
aggagagctggtgtctggaatc

SEQ ID NO: 8386294 - DNA, 22 bp, Homo sapiens
aggagctgagtcagcccgacag

SEQ ID NO: 8386295 - DNA, 20 bp, Homo sapiens
aggaggaagaaagcacactg

SEQ ID NO: 8386296 - DNA, 22 bp, Homo sapiens
aggagctcttgatgcttgaggg

SEQ ID NO: 8386297 - DNA, 20 bp, Homo sapiens
aggagctgaattagagggtt

SEQ ID NO: 8386298 - DNA, 22 bp, Homo sapiens
aggaggaggtgggacacagtga

SEQ ID NO: 8386299 - DNA, 22 bp, Homo sapiens
aggaggaggtaagaaaagcata

SEQ ID NO: 8386300 - DNA, 22 bp, Homo sapiens
aggaggaggtgggacacagtga

SEQ ID NO: 8386301 - DNA, 22 bp, Homo sapiens
aggaggaggtaagaaaagcata

SEQ ID NO: 8386302 - DNA, 17 bp, Homo sapiens
aggaggatcagagagta

SEQ ID NO: 8386303 - DNA, 22 bp, Homo sapiens
aggaggaggctggagtacaccc

SEQ ID NO: 8386304 - DNA, 22 bp, Homo sapiens
aggaggagcagctttttgtctc

SEQ ID NO: 8386305 - DNA, 21 bp, Homo sapiens
aggaggagagcttggcctacc

SEQ ID NO: 8386306 - DNA, 21 bp, Homo sapiens
aggaggagagcttggcctacc

SEQ ID NO: 8386307 - DNA, 22 bp, Homo sapiens
aggaggaattgacacagaagcc

SEQ ID NO: 8386308 - DNA, 22 bp, Homo sapiens
aggaggaattgacacagaagcc

SEQ ID NO: 8386309 - DNA, 22 bp, Homo sapiens
aggaggaatacaatccagcagc

SEQ ID NO: 8386310 - DNA, 22 bp, Homo sapiens
aggaggaatacaatccagcagc

SEQ ID NO: 8386311 - DNA, 22 bp, Homo sapiens
aggaggaatacaatccagcagc

SEQ ID NO: 8386312 - DNA, 22 bp, Homo sapiens
aggaaataggaccagacaaagc

SEQ ID NO: 8386313 - DNA, 22 bp, Homo sapiens
aggaaaggggtaggtgtggacg

SEQ ID NO: 8386314 - DNA, 22 bp, Homo sapiens
aggaaaggggtaggtgtggacg

SEQ ID NO: 8386315 - DNA, 22 bp, Homo sapiens
aggaaaggggtaggtgtggacg

SEQ ID NO: 8386316 - DNA, 22 bp, Homo sapiens
aggaacaactgattcagtcaac

SEQ ID NO: 8386317 - DNA, 22 bp, Homo sapiens
aggaaattttgaatcagtgtct

SEQ ID NO: 8386318 - DNA, 22 bp, Homo sapiens
aggaaatgtacaaatgaagatg

SEQ ID NO: 8386319 - DNA, 22 bp, Homo sapiens
aggaaatgtacaaatgaagatg

SEQ ID NO: 8386320 - DNA, 22 bp, Homo sapiens
aggaaattgagaatcagaataa

SEQ ID NO: 8386321 - DNA, 22 bp, Homo sapiens
aggaaattgagaatcagaataa

SEQ ID NO: 8386322 - DNA, 22 bp, Homo sapiens
aggaacccggtctgtcactgtg

SEQ ID NO: 8386323 - DNA, 22 bp, Homo sapiens
aggaacatctatcacataaacg

SEQ ID NO: 8386324 - DNA, 22 bp, Homo sapiens
cagggccagagagggctggctg

SEQ ID NO: 8386325 - DNA, 22 bp, Homo sapiens
cagggccagagagggctggctg

SEQ ID NO: 8386326 - DNA, 22 bp, Homo sapiens
cagggccagccgcagcatccac

SEQ ID NO: 8386327 - DNA, 22 bp, Homo sapiens
aggaaagccaatctctcttgac

SEQ ID NO: 8386328 - DNA, 23 bp, Homo sapiens
aggaaagcattcatttttaccat

SEQ ID NO: 8386329 - DNA, 22 bp, Homo sapiens
aggaaagcaatggctgagaaca

SEQ ID NO: 8386330 - DNA, 22 bp, Homo sapiens
aggaaagatggaaggaggataa

SEQ ID NO: 8386331 - DNA, 22 bp, Homo sapiens
aggaaagatggaaggaggataa

SEQ ID NO: 8386332 - DNA, 21 bp, Homo sapiens
aggaaaggaagtccccagggt

SEQ ID NO: 8386333 - DNA, 22 bp, Homo sapiens
cagggccactgtagatgaggag

SEQ ID NO: 8386334 - DNA, 22 bp, Homo sapiens
cagggccactgtagatgaggag

SEQ ID NO: 8386335 - DNA, 20 bp, Homo sapiens
aggaaagcctgtgtgagtct

SEQ ID NO: 8386336 - DNA, 22 bp, Homo sapiens
aggaaagcttggcaaactaaat

SEQ ID NO: 8386337 - DNA, 22 bp, Homo sapiens
agcttgttagggcagtggtcgc

SEQ ID NO: 8386338 - DNA, 22 bp, Homo sapiens
agcttgttataaatgcagaatg

SEQ ID NO: 8386339 - DNA, 22 bp, Homo sapiens
agcttgttcaaatgcagaatac

SEQ ID NO: 8386340 - DNA, 22 bp, Homo sapiens
agcttgttgttactgatgcatt

SEQ ID NO: 8386341 - DNA, 22 bp, Homo sapiens
agcttgtgctggaattacatgt

SEQ ID NO: 8386342 - DNA, 21 bp, Homo sapiens
agcttgtgtgtatcacagtgt

SEQ ID NO: 8386343 - DNA, 22 bp, Homo sapiens
agcttgttagaaatgtagactc

SEQ ID NO: 8386344 - DNA, 22 bp, Homo sapiens
agcttgttagaaatgtagactc

SEQ ID NO: 8386345 - DNA, 22 bp, Homo sapiens
agcttgtgtttttctaagtatc

SEQ ID NO: 8386346 - DNA, 22 bp, Homo sapiens
agctttaaagcatatttctaag

SEQ ID NO: 8386347 - DNA, 22 bp, Homo sapiens
agctttaaaaatccaatatcca

SEQ ID NO: 8386348 - DNA, 22 bp, Homo sapiens
aggaaagactggggccccagaa

SEQ ID NO: 8386349 - DNA, 18 bp, Homo sapiens
aggaaagacgaagagggc

SEQ ID NO: 8386350 - DNA, 18 bp, Homo sapiens
aggaaagacgaagagggc

SEQ ID NO: 8386351 - DNA, 22 bp, Homo sapiens
aggaaagaagtacattctcatg

SEQ ID NO: 8386352 - DNA, 17 bp, Homo sapiens
aggaaacattttctttc

SEQ ID NO: 8386353 - DNA, 22 bp, Homo sapiens
agcttgggtgtgcctgcgagct

SEQ ID NO: 8386354 - DNA, 23 bp, Homo sapiens
agcttggaacaatgcaaatacag

SEQ ID NO: 8386355 - DNA, 22 bp, Homo sapiens
agcttgatgaaagtgggtgctc

SEQ ID NO: 8386356 - DNA, 22 bp, Homo sapiens
agcttgatttctctgcagtgtg

SEQ ID NO: 8386357 - DNA, 22 bp, Homo sapiens
agcttaatggaacttgctcaaa

SEQ ID NO: 8386358 - DNA, 22 bp, Homo sapiens
agcttaaagtatttaaatttca

SEQ ID NO: 8386359 - DNA, 22 bp, Homo sapiens
agctgtttttccagtctctgga

SEQ ID NO: 8386360 - DNA, 22 bp, Homo sapiens
agcttctgttcatcttccaggc

SEQ ID NO: 8386361 - DNA, 22 bp, Homo sapiens
agcttgaagccttggcgagatt

SEQ ID NO: 8386362 - DNA, 22 bp, Homo sapiens
agcttgacagacagatggtagc

SEQ ID NO: 8386363 - DNA, 22 bp, Homo sapiens
agcttgacagacagatggtagc

SEQ ID NO: 8386364 - DNA, 21 bp, Homo sapiens
agctgtttgaagctatattgg

SEQ ID NO: 8386365 - DNA, 22 bp, Homo sapiens
agctgtttaaatgacttacttt

SEQ ID NO: 8386366 - DNA, 22 bp, Homo sapiens
agctgttccaggcctcattgct

SEQ ID NO: 8386367 - DNA, 22 bp, Homo sapiens
agctgttccaggcctcattgct

SEQ ID NO: 8386368 - DNA, 22 bp, Homo sapiens
agctgttagttattgaagatgt

SEQ ID NO: 8386369 - DNA, 22 bp, Homo sapiens
agctgttccctcactgcagtca

SEQ ID NO: 8386370 - DNA, 22 bp, Homo sapiens
agctgttgaaaatggtgtccta

SEQ ID NO: 8386371 - DNA, 22 bp, Homo sapiens
agctgttgctgggaggagagaa

SEQ ID NO: 8386372 - DNA, 22 bp, Homo sapiens
agctgtgtggtgtctgacagct

SEQ ID NO: 8386373 - DNA, 22 bp, Homo sapiens
agctgtgttaggatgttaataa

SEQ ID NO: 8386374 - DNA, 22 bp, Homo sapiens
agctgtgtggtttgggcaaatt

SEQ ID NO: 8386375 - DNA, 22 bp, Homo sapiens
agctgtgtgtgaatttggccta

SEQ ID NO: 8386376 - DNA, 22 bp, Homo sapiens
caggcctcccggtgcacactga

SEQ ID NO: 8386377 - DNA, 22 bp, Homo sapiens
agctgtggcagcagccgtggca

SEQ ID NO: 8386378 - DNA, 22 bp, Homo sapiens
agctgtgtcatcctggaaaatg

SEQ ID NO: 8386379 - DNA, 22 bp, Homo sapiens
agctgtgtgactctaagcaagt

SEQ ID NO: 8386380 - DNA, 22 bp, Homo sapiens
agctgtgtgacctagggcaagc

SEQ ID NO: 8386381 - DNA, 22 bp, Homo sapiens
caggcctcaccagcggagctgc

SEQ ID NO: 8386382 - DNA, 22 bp, Homo sapiens
caggcctcaggggctcaggctg

SEQ ID NO: 8386383 - DNA, 22 bp, Homo sapiens
caggcctcaggggctcaggctg

SEQ ID NO: 8386384 - DNA, 22 bp, Homo sapiens
caggcctccactccacgcagac

SEQ ID NO: 8386385 - DNA, 22 bp, Homo sapiens
agctgggaagactggaagacag

SEQ ID NO: 8386386 - DNA, 23 bp, Homo sapiens
agctgggaattttctgaagcttt

SEQ ID NO: 8386387 - DNA, 22 bp, Homo sapiens
agctctgccttgacaccttctc

SEQ ID NO: 8386388 - DNA, 22 bp, Homo sapiens
agctctgcaggcacagctgagg

SEQ ID NO: 8386389 - DNA, 23 bp, Homo sapiens
agctctgctcgggcatgccctgc

SEQ ID NO: 8386390 - DNA, 22 bp, Homo sapiens
agctctggaagccctggtagtt

SEQ ID NO: 8386391 - DNA, 22 bp, Homo sapiens
cagctctgaagaaaggtgtcta

SEQ ID NO: 8386392 - DNA, 23 bp, Homo sapiens
cagctcgcttttgttccctccct

SEQ ID NO: 8386393 - DNA, 22 bp, Homo sapiens
cagcttctttgggattctttat

SEQ ID NO: 8386394 - DNA, 21 bp, Homo sapiens
cagcttcttctgtgacctggt

SEQ ID NO: 8386395 - DNA, 22 bp, Homo sapiens
cagcttctggcgtggagcctga

SEQ ID NO: 8386396 - DNA, 22 bp, Homo sapiens
cagcttctggcgtggagcctga

SEQ ID NO: 8386397 - DNA, 22 bp, Homo sapiens
cagcttctgctcatggaggggt

SEQ ID NO: 8386398 - DNA, 22 bp, Homo sapiens
cagcttctgtttctagcccctg

SEQ ID NO: 8386399 - DNA, 23 bp, Homo sapiens
agctgaggctgtgggtgtcagag

SEQ ID NO: 8386400 - DNA, 22 bp, Homo sapiens
agctgaggcatgatgctatcag

SEQ ID NO: 8386401 - DNA, 22 bp, Homo sapiens
agctgaggccacgagtgaaggg

SEQ ID NO: 8386402 - DNA, 22 bp, Homo sapiens
agctgaggcatggacaggctgc

SEQ ID NO: 8386403 - DNA, 22 bp, Homo sapiens
caggaaaaatgccaggagtcag

SEQ ID NO: 8386404 - DNA, 22 bp, Homo sapiens
cagctttttagaatctagggca

SEQ ID NO: 8386405 - DNA, 22 bp, Homo sapiens
cagcttttaggactgtgagaaa

SEQ ID NO: 8386406 - DNA, 22 bp, Homo sapiens
cagctttgattctttctgccat

SEQ ID NO: 8386407 - DNA, 22 bp, Homo sapiens
cagctttggagtgtgagtgctg

SEQ ID NO: 8386408 - DNA, 22 bp, Homo sapiens
caggagtctctcttgagcccag

SEQ ID NO: 8386409 - DNA, 22 bp, Homo sapiens
caggagtctctcttgagcccag

SEQ ID NO: 8386410 - DNA, 22 bp, Homo sapiens
caggagtccctctggccagcat

SEQ ID NO: 8386411 - DNA, 22 bp, Homo sapiens
caggagtccctctggccagcat

SEQ ID NO: 8386412 - DNA, 22 bp, Homo sapiens
caggagtccatctggcctggtg

SEQ ID NO: 8386413 - DNA, 22 bp, Homo sapiens
caggagtccatctggcctggtg

SEQ ID NO: 8386414 - DNA, 22 bp, Homo sapiens
caggagtcccaggggtgggcca

SEQ ID NO: 8386415 - DNA, 22 bp, Homo sapiens
caggagtcccaggggtgggcca

SEQ ID NO: 8386416 - DNA, 22 bp, Homo sapiens
agctggctgccttctccttagg

SEQ ID NO: 8386417 - DNA, 22 bp, Homo sapiens
agctggctggccccttcctgcc

SEQ ID NO: 8386418 - DNA, 22 bp, Homo sapiens
agctggcttctctgcagacatt

SEQ ID NO: 8386419 - DNA, 22 bp, Homo sapiens
agctggctttgagctgggaggt

SEQ ID NO: 8386420 - DNA, 22 bp, Homo sapiens
agctggctttgagctgggaggt

SEQ ID NO: 8386421 - DNA, 22 bp, Homo sapiens
agctggccagcacctccaggtc

SEQ ID NO: 8386422 - DNA, 22 bp, Homo sapiens
caggaggttggtagcagtagat

SEQ ID NO: 8386423 - DNA, 22 bp, Homo sapiens
caggaggttgtaagagcaggcc

SEQ ID NO: 8386424 - DNA, 22 bp, Homo sapiens
caggaggttgtaagagcaggcc

SEQ ID NO: 8386425 - DNA, 22 bp, Homo sapiens
caggaggttgtaagagcaggcc

SEQ ID NO: 8386426 - DNA, 22 bp, Homo sapiens
caggagtccagagtgtcatttt

SEQ ID NO: 8386427 - DNA, 22 bp, Homo sapiens
caggaggtgccctctagtggca

SEQ ID NO: 8386428 - DNA, 22 bp, Homo sapiens
agctgctgagagtctgccgggc

SEQ ID NO: 8386429 - DNA, 22 bp, Homo sapiens
agctgctgagccaggctgatgt

SEQ ID NO: 8386430 - DNA, 22 bp, Homo sapiens
agctgctcttgggtgacttcaa

SEQ ID NO: 8386431 - DNA, 22 bp, Homo sapiens
agctgctcttgggtgacttcaa

SEQ ID NO: 8386432 - DNA, 22 bp, Homo sapiens
agctgctcttcatttcccccca

SEQ ID NO: 8386433 - DNA, 22 bp, Homo sapiens
agctgctctgagccctgattct

SEQ ID NO: 8386434 - DNA, 20 bp, Homo sapiens
agctgctctcatccagacct

SEQ ID NO: 8386435 - DNA, 22 bp, Homo sapiens
agctgctctcagcagttccagg

SEQ ID NO: 8386436 - DNA, 22 bp, Homo sapiens
agctgctcctttcctgcaggcg

SEQ ID NO: 8386437 - DNA, 22 bp, Homo sapiens
agctgctcgaagccggtggccc

SEQ ID NO: 8386438 - DNA, 22 bp, Homo sapiens
agctgctccctatcctttcctt

SEQ ID NO: 8386439 - DNA, 22 bp, Homo sapiens
agctgctccttggctgtggttc

SEQ ID NO: 8386440 - DNA, 22 bp, Homo sapiens
agctgctccaatttttaccatt

SEQ ID NO: 8386441 - DNA, 22 bp, Homo sapiens
agctgctccaatttttaccatt

SEQ ID NO: 8386442 - DNA, 22 bp, Homo sapiens
agctgctcattactttctgttg

SEQ ID NO: 8386443 - DNA, 22 bp, Homo sapiens
caggaaaaatgccaggagtcag

SEQ ID NO: 8386444 - DNA, 22 bp, Homo sapiens
agctgcctggagtcatttcctg

SEQ ID NO: 8386445 - DNA, 22 bp, Homo sapiens
caggaaaaggagactttagcac

SEQ ID NO: 8386446 - DNA, 22 bp, Homo sapiens
caggaaaaggagactttagcac

SEQ ID NO: 8386447 - DNA, 22 bp, Homo sapiens
caggacagaccaagatcgtgct

SEQ ID NO: 8386448 - DNA, 22 bp, Homo sapiens
caggacagaccaagatcgtgct

SEQ ID NO: 8386449 - DNA, 22 bp, Homo sapiens
caggacagacagaatgcctaac

SEQ ID NO: 8386450 - DNA, 22 bp, Homo sapiens
caggacagaaataaggaatata

SEQ ID NO: 8386451 - DNA, 22 bp, Homo sapiens
caggacagagcccagactgtgt

SEQ ID NO: 8386452 - DNA, 22 bp, Homo sapiens
agctggcaggtgaagatgattt

SEQ ID NO: 8386453 - DNA, 22 bp, Homo sapiens
caggacagagcccagactgtgt

SEQ ID NO: 8386454 - DNA, 22 bp, Homo sapiens
agctggcagtcggccttgatgc

SEQ ID NO: 8386455 - DNA, 22 bp, Homo sapiens
atgcttgcccatgtttctgaag

SEQ ID NO: 8386456 - DNA, 23 bp, Homo sapiens
atggaaatagcatgtgtcattta

SEQ ID NO: 8386457 - DNA, 22 bp, Homo sapiens
agactaagcggttcttttcaat

SEQ ID NO: 8386458 - DNA, 22 bp, Homo sapiens
agactacatatgccacatgaag

SEQ ID NO: 8386459 - DNA, 22 bp, Homo sapiens
agactccaaatgaaagaggggg

SEQ ID NO: 8386460 - DNA, 22 bp, Homo sapiens
atggacagtactgagtggacta

SEQ ID NO: 8386461 - DNA, 18 bp, Homo sapiens
atggctcaggaatggctt

SEQ ID NO: 8386462 - DNA, 22 bp, Homo sapiens
atggcagccagtgttggaggaa

SEQ ID NO: 8386463 - DNA, 22 bp, Homo sapiens
atggcagccagtgttggaggaa

SEQ ID NO: 8386464 - DNA, 22 bp, Homo sapiens
atggctcagcgcctttctgtgg

SEQ ID NO: 8386465 - DNA, 22 bp, Homo sapiens
atggcagcagctttagctgtgg

SEQ ID NO: 8386466 - DNA, 22 bp, Homo sapiens
atggcagcagtttggagtcttt

SEQ ID NO: 8386467 - DNA, 22 bp, Homo sapiens
atggcagcatagtggcaagtta

SEQ ID NO: 8386468 - DNA, 21 bp, Homo sapiens
atggctggtggctcagcctcc

SEQ ID NO: 8386469 - DNA, 21 bp, Homo sapiens
atggctggtggctcagcctcc

SEQ ID NO: 8386470 - DNA, 22 bp, Homo sapiens
atggctggtctcccatggaaaa

SEQ ID NO: 8386471 - DNA, 22 bp, Homo sapiens
atggctgggaggagagtatgat

SEQ ID NO: 8386472 - DNA, 22 bp, Homo sapiens
atggctgggatttcctttgcgt

SEQ ID NO: 8386473 - DNA, 22 bp, Homo sapiens
atggctgggatggggtagagaa

SEQ ID NO: 8386474 - DNA, 22 bp, Homo sapiens
atggacagtgtgaagcagatag

SEQ ID NO: 8386475 - DNA, 22 bp, Homo sapiens
atggagttctgccagcgctgct

SEQ ID NO: 8386476 - DNA, 22 bp, Homo sapiens
atggagtgctgttgatcaaggt

SEQ ID NO: 8386477 - DNA, 22 bp, Homo sapiens
atggcagcaaatgtctggctgg

SEQ ID NO: 8386478 - DNA, 22 bp, Homo sapiens
atgtacagccacttcacagtta

SEQ ID NO: 8386479 - DNA, 22 bp, Homo sapiens
atgtccagaggtgagtcagagc

SEQ ID NO: 8386480 - DNA, 22 bp, Homo sapiens
atgtccagaggtgagtcagagc

SEQ ID NO: 8386481 - DNA, 22 bp, Homo sapiens
atgtccagagtaaagcacattc

SEQ ID NO: 8386482 - DNA, 22 bp, Homo sapiens
atgtccagccaaccactggatt

SEQ ID NO: 8386483 - DNA, 22 bp, Homo sapiens
atgtccagaagggtcccctgtt

SEQ ID NO: 8386484 - DNA, 22 bp, Homo sapiens
atgtccagaagggtcccctgtt

SEQ ID NO: 8386485 - DNA, 22 bp, Homo sapiens
atgtctgttttcatatcagata

SEQ ID NO: 8386486 - DNA, 22 bp, Homo sapiens
atgtcttcatagcttatatcca

SEQ ID NO: 8386487 - DNA, 22 bp, Homo sapiens
atgtcttcatagcttatatcca

SEQ ID NO: 8386488 - DNA, 22 bp, Homo sapiens
atgtctgtggcaattgttgatg

SEQ ID NO: 8386489 - DNA, 22 bp, Homo sapiens
atgtctgtgtgatcttggataa

SEQ ID NO: 8386490 - DNA, 19 bp, Homo sapiens
atgtcccaccgcccctgag

SEQ ID NO: 8386491 - DNA, 22 bp, Homo sapiens
atgtccagtttctacacacata

SEQ ID NO: 8386492 - DNA, 20 bp, Homo sapiens
atgtccagtgactggaccat

SEQ ID NO: 8386493 - DNA, 22 bp, Homo sapiens
atgggaggatgctcgggtgctc

SEQ ID NO: 8386494 - DNA, 22 bp, Homo sapiens
atgggaggcaaagatcgcagaa

SEQ ID NO: 8386495 - DNA, 22 bp, Homo sapiens
atgggaggcagacactaagttc

SEQ ID NO: 8386496 - DNA, 22 bp, Homo sapiens
atgggaggatcacttgaggcca

SEQ ID NO: 8386497 - DNA, 22 bp, Homo sapiens
atgggaggaagagaagatgtct

SEQ ID NO: 8386498 - DNA, 22 bp, Homo sapiens
atggctgtgtgactgagttcta

SEQ ID NO: 8386499 - DNA, 23 bp, Homo sapiens
atgtaaacttcagagtcattgcc

SEQ ID NO: 8386500 - DNA, 22 bp, Homo sapiens
atgtaaaggcagactttaattt

SEQ ID NO: 8386501 - DNA, 22 bp, Homo sapiens
atgtacacacacatctttgcgt

SEQ ID NO: 8386502 - DNA, 22 bp, Homo sapiens
atgtaaaagattattttcctgt

SEQ ID NO: 8386503 - DNA, 20 bp, Homo sapiens
atgtaaaattataaggctga

SEQ ID NO: 8386504 - DNA, 20 bp, Homo sapiens
atgtaaaattataaggctga

SEQ ID NO: 8386505 - DNA, 22 bp, Homo sapiens
atggtttgtgtggcccagatga

SEQ ID NO: 8386506 - DNA, 20 bp, Homo sapiens
atgtaaaagacagggagtag

SEQ ID NO: 8386507 - DNA, 22 bp, Homo sapiens
atctttaccaccaaagaatgct

SEQ ID NO: 8386508 - DNA, 18 bp, Homo sapiens
atcttgtttttggattaa

SEQ ID NO: 8386509 - DNA, 19 bp, Homo sapiens
agaagcaccagtcattcct

SEQ ID NO: 8386510 - DNA, 22 bp, Homo sapiens
atcttattgctgttgccagata

SEQ ID NO: 8386511 - DNA, 22 bp, Homo sapiens
agaagcacacctgacctctagc

SEQ ID NO: 8386512 - DNA, 18 bp, Homo sapiens
agaagcacaagatgtctt

SEQ ID NO: 8386513 - DNA, 22 bp, Homo sapiens
agaagatttaggttgacgctat

SEQ ID NO: 8386514 - DNA, 22 bp, Homo sapiens
agaagcaaggtctgtcagtata

SEQ ID NO: 8386515 - DNA, 22 bp, Homo sapiens
agaagcaaggtctgtcagtata

SEQ ID NO: 8386516 - DNA, 20 bp, Homo sapiens
agaagaggatacaaccaggc

SEQ ID NO: 8386517 - DNA, 22 bp, Homo sapiens
agaagagagtcctaccccatac

SEQ ID NO: 8386518 - DNA, 22 bp, Homo sapiens
agaagagagtcctaccccatac

SEQ ID NO: 8386519 - DNA, 21 bp, Homo sapiens
agaagagaagcaggaccctct

SEQ ID NO: 8386520 - DNA, 22 bp, Homo sapiens
agaagagaactgccaaacactt

SEQ ID NO: 8386521 - DNA, 22 bp, Homo sapiens
agaagagtagtaacagaaatta

SEQ ID NO: 8386522 - DNA, 22 bp, Homo sapiens
agaagagtagtaacagaaatta

SEQ ID NO: 8386523 - DNA, 22 bp, Homo sapiens
agaagaggggtgtccctgtggc

SEQ ID NO: 8386524 - DNA, 22 bp, Homo sapiens
agaagatgtcactgcagacagc

SEQ ID NO: 8386525 - DNA, 22 bp, Homo sapiens
agaagaatacttgatgttcatg

SEQ ID NO: 8386526 - DNA, 22 bp, Homo sapiens
agaagaatacttgatgttcatg

SEQ ID NO: 8386527 - DNA, 22 bp, Homo sapiens
agaagaaatgtgaaggccactg

SEQ ID NO: 8386528 - DNA, 22 bp, Homo sapiens
agaagagaactgccaaacactt

SEQ ID NO: 8386529 - DNA, 22 bp, Homo sapiens
agaagagaaatagtgccactgt

SEQ ID NO: 8386530 - DNA, 22 bp, Homo sapiens
agaagagaactgccaaacactt

SEQ ID NO: 8386531 - DNA, 22 bp, Homo sapiens
agaagaatttctctcatgattt

SEQ ID NO: 8386532 - DNA, 22 bp, Homo sapiens
agaagagaaatagtgccactgt

SEQ ID NO: 8386533 - DNA, 22 bp, Homo sapiens
agaatacagtatgcaaaaagat

SEQ ID NO: 8386534 - DNA, 22 bp, Homo sapiens
agaatacagtatgcaaaaagat

SEQ ID NO: 8386535 - DNA, 22 bp, Homo sapiens
agaatacatcaatctattttct

SEQ ID NO: 8386536 - DNA, 22 bp, Homo sapiens
agaatacttgggaatgggttaa

SEQ ID NO: 8386537 - DNA, 22 bp, Homo sapiens
agaatactaggcttcagaaagg

SEQ ID NO: 8386538 - DNA, 22 bp, Homo sapiens
agaatactaggcttcagaaagg

SEQ ID NO: 8386539 - DNA, 22 bp, Homo sapiens
agaatacttgggaatgggttaa

SEQ ID NO: 8386540 - DNA, 22 bp, Homo sapiens
agaatcactggaattgtttttt

SEQ ID NO: 8386541 - DNA, 22 bp, Homo sapiens
atctttggtgcttggtgctccc

SEQ ID NO: 8386542 - DNA, 19 bp, Homo sapiens
atctttgggtcctgaaggg

SEQ ID NO: 8386543 - DNA, 19 bp, Homo sapiens
atctttgggtcctgaaggg

SEQ ID NO: 8386544 - DNA, 22 bp, Homo sapiens
atctttgggtacaaacttgcct

SEQ ID NO: 8386545 - DNA, 22 bp, Homo sapiens
atctttggggcatccaggaaaa

SEQ ID NO: 8386546 - DNA, 22 bp, Homo sapiens
atctttggtgcatgatactttg

SEQ ID NO: 8386547 - DNA, 22 bp, Homo sapiens
atctttggtcttgagtgcatct

SEQ ID NO: 8386548 - DNA, 22 bp, Homo sapiens
atctttggtactattcttatca

SEQ ID NO: 8386549 - DNA, 22 bp, Homo sapiens
agaatacaccacaggccgaaat

SEQ ID NO: 8386550 - DNA, 22 bp, Homo sapiens
agacacatcttaggttgtcagg

SEQ ID NO: 8386551 - DNA, 22 bp, Homo sapiens
agacacagtgctgggtgctgag

SEQ ID NO: 8386552 - DNA, 22 bp, Homo sapiens
agacacagtgctgggtgctgag

SEQ ID NO: 8386553 - DNA, 22 bp, Homo sapiens
agacacagtctgtctggaggag

SEQ ID NO: 8386554 - DNA, 22 bp, Homo sapiens
agacacagtttgggatgggttg

SEQ ID NO: 8386555 - DNA, 22 bp, Homo sapiens
agacacagtgttgaaggctagt

SEQ ID NO: 8386556 - DNA, 22 bp, Homo sapiens
agacacaggtgtaatttctgct

SEQ ID NO: 8386557 - DNA, 22 bp, Homo sapiens
agacacaggtgtaatttctgct

SEQ ID NO: 8386558 - DNA, 22 bp, Homo sapiens
agacacagtacttgccctcatg

SEQ ID NO: 8386559 - DNA, 22 bp, Homo sapiens
agacacagtataagcacaacaa

SEQ ID NO: 8386560 - DNA, 22 bp, Homo sapiens
agacacagtctgtctggaggag

SEQ ID NO: 8386561 - DNA, 22 bp, Homo sapiens
agacacagctgcaggaggtggg

SEQ ID NO: 8386562 - DNA, 22 bp, Homo sapiens
agacacaggattctgcatttct

SEQ ID NO: 8386563 - DNA, 21 bp, Homo sapiens
agacacaggggttgctggggt

SEQ ID NO: 8386564 - DNA, 22 bp, Homo sapiens
agacacagctaccataatacca

SEQ ID NO: 8386565 - DNA, 22 bp, Homo sapiens
agacacagctgcaggaggtggg

SEQ ID NO: 8386566 - DNA, 22 bp, Homo sapiens
agacagtgctatcccatctgtg

SEQ ID NO: 8386567 - DNA, 22 bp, Homo sapiens
atgcaggagttggaaaaaatga

SEQ ID NO: 8386568 - DNA, 22 bp, Homo sapiens
agacagtgcaagaagagcaggc

SEQ ID NO: 8386569 - DNA, 22 bp, Homo sapiens
agacagtgattcttcacatttc

SEQ ID NO: 8386570 - DNA, 22 bp, Homo sapiens
agacagtgaggcagagcttccg

SEQ ID NO: 8386571 - DNA, 17 bp, Homo sapiens
agacagtgagtgccttg

SEQ ID NO: 8386572 - DNA, 22 bp, Homo sapiens
agacagtgataccttgggatgt

SEQ ID NO: 8386573 - DNA, 22 bp, Homo sapiens
agacagtgatgtaagcaggagt

SEQ ID NO: 8386574 - DNA, 22 bp, Homo sapiens
agaatgcatctaaaagcagaga

SEQ ID NO: 8386575 - DNA, 22 bp, Homo sapiens
agaatgtgttattagagaagga

SEQ ID NO: 8386576 - DNA, 22 bp, Homo sapiens
agacacagaagttgctgttggg

SEQ ID NO: 8386577 - DNA, 22 bp, Homo sapiens
agacacagcaataactactgtt

SEQ ID NO: 8386578 - DNA, 22 bp, Homo sapiens
agacacagattttggaaaagat

SEQ ID NO: 8386579 - DNA, 19 bp, Homo sapiens
agacacacttgatatgtgt

SEQ ID NO: 8386580 - DNA, 22 bp, Homo sapiens
agacacagaacacaaaagcata

SEQ ID NO: 8386581 - DNA, 19 bp, Homo sapiens
agacacacttacgtggaat

SEQ ID NO: 8386582 - DNA, 22 bp, Homo sapiens
agacaatatataattttagttg

SEQ ID NO: 8386583 - DNA, 22 bp, Homo sapiens
agatggtgtttccccaggtgga

SEQ ID NO: 8386584 - DNA, 22 bp, Homo sapiens
agatggtggactatctgacttg

SEQ ID NO: 8386585 - DNA, 20 bp, Homo sapiens
agatggtgaaggccagggag

SEQ ID NO: 8386586 - DNA, 22 bp, Homo sapiens
agatggtgagggcagaagtaac

SEQ ID NO: 8386587 - DNA, 22 bp, Homo sapiens
agatggtgatagagctgggatt

SEQ ID NO: 8386588 - DNA, 22 bp, Homo sapiens
agatgggcgcgctgctctgatg

SEQ ID NO: 8386589 - DNA, 22 bp, Homo sapiens
atttccaatttcatccatgtcc

SEQ ID NO: 8386590 - DNA, 21 bp, Homo sapiens
atttccaagggtacctaagat

SEQ ID NO: 8386591 - DNA, 22 bp, Homo sapiens
atttccaagaaagctttaggat

SEQ ID NO: 8386592 - DNA, 22 bp, Homo sapiens
atttccaactacccctccattt

SEQ ID NO: 8386593 - DNA, 22 bp, Homo sapiens
agatgaaaatacgtgactttaa

SEQ ID NO: 8386594 - DNA, 22 bp, Homo sapiens
agatgaaaagataagcagcaat

SEQ ID NO: 8386595 - DNA, 22 bp, Homo sapiens
atttcattgaagttaattcttc

SEQ ID NO: 8386596 - DNA, 22 bp, Homo sapiens
agatgaagcctgtacttagtct

SEQ ID NO: 8386597 - DNA, 22 bp, Homo sapiens
agatgaagatgccactaagacc

SEQ ID NO: 8386598 - DNA, 22 bp, Homo sapiens
agatgaagactcaggagcaggt

SEQ ID NO: 8386599 - DNA, 22 bp, Homo sapiens
agatgaagatatctgcaggggc

SEQ ID NO: 8386600 - DNA, 19 bp, Homo sapiens
atttgctgcaatgcttcac

SEQ ID NO: 8386601 - DNA, 20 bp, Homo sapiens
atttgctgagctttttctcc

SEQ ID NO: 8386602 - DNA, 20 bp, Homo sapiens
atttgctgagctttttctcc

SEQ ID NO: 8386603 - DNA, 22 bp, Homo sapiens
atttgctggtgaatgtatagct

SEQ ID NO: 8386604 - DNA, 20 bp, Homo sapiens
atttgctgtcagtccctagg

SEQ ID NO: 8386605 - DNA, 22 bp, Homo sapiens
atttgcttgtgctatgaaagtt

SEQ ID NO: 8386606 - DNA, 22 bp, Homo sapiens
atttgcttctgtgaaatcaagt

SEQ ID NO: 8386607 - DNA, 22 bp, Homo sapiens
agcaaacagtgtgctaagaaat

SEQ ID NO: 8386608 - DNA, 22 bp, Homo sapiens
agcaaacattcagcagattggc

SEQ ID NO: 8386609 - DNA, 22 bp, Homo sapiens
agcaaacagtgtgctaagaaat

SEQ ID NO: 8386610 - DNA, 22 bp, Homo sapiens
agcaaaataaggtaatttattg

SEQ ID NO: 8386611 - DNA, 22 bp, Homo sapiens
atttgctttcaggtataaaagg

SEQ ID NO: 8386612 - DNA, 22 bp, Homo sapiens
atttgctttcagccttaaggat

SEQ ID NO: 8386613 - DNA, 22 bp, Homo sapiens
atttgctttaaggtataaaagg

SEQ ID NO: 8386614 - DNA, 22 bp, Homo sapiens
atttaatgggtagacattgtta

SEQ ID NO: 8386615 - DNA, 22 bp, Homo sapiens
atttaagattgcgtattcatgt

SEQ ID NO: 8386616 - DNA, 22 bp, Homo sapiens
atttaagactgacttcaccagt

SEQ ID NO: 8386617 - DNA, 22 bp, Homo sapiens
atttaagaggctgctagagtat

SEQ ID NO: 8386618 - DNA, 22 bp, Homo sapiens
atttaagattgcgtattcatgt

SEQ ID NO: 8386619 - DNA, 22 bp, Homo sapiens
attgttaataactattacattg

SEQ ID NO: 8386620 - DNA, 22 bp, Homo sapiens
attgttaataactattacattg

SEQ ID NO: 8386621 - DNA, 22 bp, Homo sapiens
attcttcatttactgttacttg

SEQ ID NO: 8386622 - DNA, 22 bp, Homo sapiens
attcttcatttactgttacttg

SEQ ID NO: 8386623 - DNA, 22 bp, Homo sapiens
attcttcctcatcaatctgtag

SEQ ID NO: 8386624 - DNA, 19 bp, Homo sapiens
attcttctcaaatatccat

SEQ ID NO: 8386625 - DNA, 22 bp, Homo sapiens
agagggtgggcacgtgatggat

SEQ ID NO: 8386626 - DNA, 22 bp, Homo sapiens
agagtgggacacgggcgctgtc

SEQ ID NO: 8386627 - DNA, 22 bp, Homo sapiens
agagtgggacacgggcgctgtc

SEQ ID NO: 8386628 - DNA, 22 bp, Homo sapiens
agagtgggacacgggcgctgtc

SEQ ID NO: 8386629 - DNA, 22 bp, Homo sapiens
agagtgggcctctgagtcccag

SEQ ID NO: 8386630 - DNA, 22 bp, Homo sapiens
agagtgggcctagctgtaaaag

SEQ ID NO: 8386631 - DNA, 22 bp, Homo sapiens
agagtggggaaggtgttgagaa

SEQ ID NO: 8386632 - DNA, 22 bp, Homo sapiens
atttagcaagagtacaaaataa

SEQ ID NO: 8386633 - DNA, 22 bp, Homo sapiens
atttagcaaaaaatgatgaagc

SEQ ID NO: 8386634 - DNA, 22 bp, Homo sapiens
atttattattgtggttacttct

SEQ ID NO: 8386635 - DNA, 22 bp, Homo sapiens
atttattatgggatttggctca

SEQ ID NO: 8386636 - DNA, 22 bp, Homo sapiens
atttagtagagaaattaagaaa

SEQ ID NO: 8386637 - DNA, 22 bp, Homo sapiens
atttagtaagtacttgttgaat

SEQ ID NO: 8386638 - DNA, 22 bp, Homo sapiens
atttagcacacggcctggtaca

SEQ ID NO: 8386639 - DNA, 22 bp, Homo sapiens
atttagcacctccatctcaaca

SEQ ID NO: 8386640 - DNA, 22 bp, Homo sapiens
atttagcacacggcctggtaca

SEQ ID NO: 8386641 - DNA, 22 bp, Homo sapiens
atttagcagtcctcctcacaat

SEQ ID NO: 8386642 - DNA, 22 bp, Homo sapiens
atttaggaatgttctgcacaaa

SEQ ID NO: 8386643 - DNA, 22 bp, Homo sapiens
atttattatgggatttggctca

SEQ ID NO: 8386644 - DNA, 22 bp, Homo sapiens
attagcaattgtttcattgatc

SEQ ID NO: 8386645 - DNA, 22 bp, Homo sapiens
attagcaatcacgcagtcattt

SEQ ID NO: 8386646 - DNA, 22 bp, Homo sapiens
attagcacataagaggtatagg

SEQ ID NO: 8386647 - DNA, 20 bp, Homo sapiens
attagctcaggtgaggtcat

SEQ ID NO: 8386648 - DNA, 20 bp, Homo sapiens
attagctcaggtgaggtcat

SEQ ID NO: 8386649 - DNA, 22 bp, Homo sapiens
attagcaacatggtgaatatgt

SEQ ID NO: 8386650 - DNA, 22 bp, Homo sapiens
attagcaaggttcatgagaaga

SEQ ID NO: 8386651 - DNA, 22 bp, Homo sapiens
attagcaactcttatgtaagca

SEQ ID NO: 8386652 - DNA, 22 bp, Homo sapiens
attagcaaggcagcatcaggca

SEQ ID NO: 8386653 - DNA, 22 bp, Homo sapiens
attacagtaacagctacaatgc

SEQ ID NO: 8386654 - DNA, 22 bp, Homo sapiens
atgtttgtgtttcccattcagg

SEQ ID NO: 8386655 - DNA, 22 bp, Homo sapiens
atgtttgttgaacatctactgc

SEQ ID NO: 8386656 - DNA, 22 bp, Homo sapiens
atgtttgtgttacactctgcag

SEQ ID NO: 8386657 - DNA, 22 bp, Homo sapiens
attaaagctatccagtcatgaa

SEQ ID NO: 8386658 - DNA, 22 bp, Homo sapiens
attaaacaatgtaaagttcttg

SEQ ID NO: 8386659 - DNA, 22 bp, Homo sapiens
attaaacaatgtaaagttcttg

SEQ ID NO: 8386660 - DNA, 22 bp, Homo sapiens
atgttaaataatcccttaaagc

SEQ ID NO: 8386661 - DNA, 22 bp, Homo sapiens
atgttaaataatcccttaaagc

SEQ ID NO: 8386662 - DNA, 22 bp, Homo sapiens
atgttaaagatggtgggaaatt

SEQ ID NO: 8386663 - DNA, 22 bp, Homo sapiens
atgtgtgtacacacgtgactct

SEQ ID NO: 8386664 - DNA, 22 bp, Homo sapiens
atgtgtggtttgtaaatgattt

SEQ ID NO: 8386665 - DNA, 23 bp, Homo sapiens
atgtgtgggaggtcagagagcca

SEQ ID NO: 8386666 - DNA, 22 bp, Homo sapiens
atgtgtgctacaggtgtgggaa

SEQ ID NO: 8386667 - DNA, 18 bp, Homo sapiens
atgtgtggcttggggtcc

SEQ ID NO: 8386668 - DNA, 22 bp, Homo sapiens
atgtgtgcatcaatgatagatc

SEQ ID NO: 8386669 - DNA, 22 bp, Homo sapiens
atgtgtgcctgagtgatggact

SEQ ID NO: 8386670 - DNA, 22 bp, Homo sapiens
atgtcttctaagctctaagctg

SEQ ID NO: 8386671 - DNA, 22 bp, Homo sapiens
atgtgtcttggagttttaatgt

SEQ ID NO: 8386672 - DNA, 22 bp, Homo sapiens
atgttacaatccaacaaaatta

SEQ ID NO: 8386673 - DNA, 22 bp, Homo sapiens
atgtttctgagtgtatatacat

SEQ ID NO: 8386674 - DNA, 20 bp, Homo sapiens
atgttaaatagcatttagag

SEQ ID NO: 8386675 - DNA, 20 bp, Homo sapiens
atgttaaatagcatttagag

SEQ ID NO: 8386676 - DNA, 20 bp, Homo sapiens
atgttaaatagcatttagag

SEQ ID NO: 8386677 - DNA, 22 bp, Homo sapiens
atgttaaatagccatttgtttg

SEQ ID NO: 8386678 - DNA, 22 bp, Homo sapiens
atgttaaatagccatttgtttg

SEQ ID NO: 8386679 - DNA, 22 bp, Homo sapiens
atgttaaatggtttattattaa

SEQ ID NO: 8386680 - DNA, 22 bp, Homo sapiens
atgttacaaatcctacaggtag

SEQ ID NO: 8386681 - DNA, 22 bp, Homo sapiens
atgttaaatggtttattattaa

SEQ ID NO: 8386682 - DNA, 22 bp, Homo sapiens
attcagcacaatttggccaata

SEQ ID NO: 8386683 - DNA, 22 bp, Homo sapiens
attcagcagttcctgcttcagt

SEQ ID NO: 8386684 - DNA, 22 bp, Homo sapiens
attcagcattcatttccaactt

SEQ ID NO: 8386685 - DNA, 22 bp, Homo sapiens
attcacactgtatacacaggat

SEQ ID NO: 8386686 - DNA, 22 bp, Homo sapiens
attcacacacatttagagcaga

SEQ ID NO: 8386687 - DNA, 22 bp, Homo sapiens
attcacagagtggttagtggta

SEQ ID NO: 8386688 - DNA, 22 bp, Homo sapiens
attcacaattagaagtagataa

SEQ ID NO: 8386689 - DNA, 22 bp, Homo sapiens
attcaaagatcatgatctctac

SEQ ID NO: 8386690 - DNA, 22 bp, Homo sapiens
attcaaagagctgccagaactg

SEQ ID NO: 8386691 - DNA, 22 bp, Homo sapiens
attcaaagcccagtaaacattg

SEQ ID NO: 8386692 - DNA, 22 bp, Homo sapiens
attatacattttgtgtagagat

SEQ ID NO: 8386693 - DNA, 22 bp, Homo sapiens
attataaagaacatgtgtgtgg

SEQ ID NO: 8386694 - DNA, 22 bp, Homo sapiens
attctgggaactttgtctctca

SEQ ID NO: 8386695 - DNA, 22 bp, Homo sapiens
attctctgtggtgatgctggtg

SEQ ID NO: 8386696 - DNA, 21 bp, Homo sapiens
agagggagagtggcccttcca

SEQ ID NO: 8386697 - DNA, 22 bp, Homo sapiens
agagggtgaatgagatagaaaa

SEQ ID NO: 8386698 - DNA, 22 bp, Homo sapiens
agagggtagaagacagggttgc

SEQ ID NO: 8386699 - DNA, 22 bp, Homo sapiens
agagggtgaatgagatagaaaa

SEQ ID NO: 8386700 - DNA, 22 bp, Homo sapiens
agagggtgggcacgtgatggat

SEQ ID NO: 8386701 - DNA, 22 bp, Homo sapiens
agagggtgggcacgtgatggat

SEQ ID NO: 8386702 - DNA, 22 bp, Homo sapiens
agagggtgagcaggtacacatg

SEQ ID NO: 8386703 - DNA, 22 bp, Homo sapiens
agagggcaagtgtagtccagta

SEQ ID NO: 8386704 - DNA, 22 bp, Homo sapiens
agagggatcaccctgtttctgg

SEQ ID NO: 8386705 - DNA, 22 bp, Homo sapiens
cagccctggctagggcgagggc

SEQ ID NO: 8386706 - DNA, 22 bp, Homo sapiens
cagccctgggagttggggccga

SEQ ID NO: 8386707 - DNA, 22 bp, Homo sapiens
cagccctgggtccctgccctgg

SEQ ID NO: 8386708 - DNA, 22 bp, Homo sapiens
cagccctgggatcttagtgcct

SEQ ID NO: 8386709 - DNA, 22 bp, Homo sapiens
cagccctgggatcttagtgcct

SEQ ID NO: 8386710 - DNA, 22 bp, Homo sapiens
agctcctgtgtgaagcctccct

SEQ ID NO: 8386711 - DNA, 22 bp, Homo sapiens
cagccctgggtccctgccctgg

SEQ ID NO: 8386712 - DNA, 22 bp, Homo sapiens
cagccctggcctcttcgctttc

SEQ ID NO: 8386713 - DNA, 22 bp, Homo sapiens
cagccctggcgcccccagatct

SEQ ID NO: 8386714 - DNA, 22 bp, Homo sapiens
agctcctactctatgccagaca

SEQ ID NO: 8386715 - DNA, 21 bp, Homo sapiens
agctccctgtttcctcactct

SEQ ID NO: 8386716 - DNA, 22 bp, Homo sapiens
cagccagctcaggaaggatttt

SEQ ID NO: 8386717 - DNA, 22 bp, Homo sapiens
agctcccagtctcctctccatg

SEQ ID NO: 8386718 - DNA, 22 bp, Homo sapiens
cagccagctggcactgtgagta

SEQ ID NO: 8386719 - DNA, 22 bp, Homo sapiens
agctcccaggcagtcatgagga

SEQ ID NO: 8386720 - DNA, 22 bp, Homo sapiens
cagcaggacgtccaagtgctat

SEQ ID NO: 8386721 - DNA, 22 bp, Homo sapiens
cagcaggaggcatggcttccct

SEQ ID NO: 8386722 - DNA, 22 bp, Homo sapiens
cagcaggagcagtcagactcct

SEQ ID NO: 8386723 - DNA, 23 bp, Homo sapiens
cagcaggagggtgcctgggctgc

SEQ ID NO: 8386724 - DNA, 23 bp, Homo sapiens
agccttggaggttgaggctgcag

SEQ ID NO: 8386725 - DNA, 23 bp, Homo sapiens
agccttggaggttgaggctgcag

SEQ ID NO: 8386726 - DNA, 22 bp, Homo sapiens
agccttggccgtaaggtatgct

SEQ ID NO: 8386727 - DNA, 22 bp, Homo sapiens
agccttggtcccgcgtcagcca

SEQ ID NO: 8386728 - DNA, 18 bp, Homo sapiens
agctcacagatctgtttt

SEQ ID NO: 8386729 - DNA, 22 bp, Homo sapiens
agctcacagaaatcctgcagga

SEQ ID NO: 8386730 - DNA, 22 bp, Homo sapiens
cagcaggaggtgagtagcaggt

SEQ ID NO: 8386731 - DNA, 22 bp, Homo sapiens
cagcaggaggtgagtagcaggt

SEQ ID NO: 8386732 - DNA, 22 bp, Homo sapiens
cagcaggaggtgagatgtgacc

SEQ ID NO: 8386733 - DNA, 22 bp, Homo sapiens
agctcacagcctagcactgtga

SEQ ID NO: 8386734 - DNA, 22 bp, Homo sapiens
agctcacagcctagcactgtga

SEQ ID NO: 8386735 - DNA, 21 bp, Homo sapiens
agctcacagttctgtcctgtc

SEQ ID NO: 8386736 - DNA, 22 bp, Homo sapiens
agctcacattctcatcagatgt

SEQ ID NO: 8386737 - DNA, 22 bp, Homo sapiens
agctcaccacaacctccgcctc

SEQ ID NO: 8386738 - DNA, 22 bp, Homo sapiens
agctcagaagcctatgcatagt

SEQ ID NO: 8386739 - DNA, 22 bp, Homo sapiens
agctcagaactgcagacatgtg

SEQ ID NO: 8386740 - DNA, 22 bp, Homo sapiens
agctcagaactgcagacatgtg

SEQ ID NO: 8386741 - DNA, 22 bp, Homo sapiens
agcctccatctcccatctgtga

SEQ ID NO: 8386742 - DNA, 22 bp, Homo sapiens
agcctccatcccatgcacaaag

SEQ ID NO: 8386743 - DNA, 22 bp, Homo sapiens
cagcagaggaaagcaaatctaa

SEQ ID NO: 8386744 - DNA, 22 bp, Homo sapiens
cagcagaggaaagcaaatctaa

SEQ ID NO: 8386745 - DNA, 22 bp, Homo sapiens
cagcagaggcacgtctgtgaat

SEQ ID NO: 8386746 - DNA, 22 bp, Homo sapiens
cagcagaggttggaacagttct

SEQ ID NO: 8386747 - DNA, 22 bp, Homo sapiens
cagcagaggtggttcacattgt

SEQ ID NO: 8386748 - DNA, 22 bp, Homo sapiens
cagcagcatgaattcgagccac

SEQ ID NO: 8386749 - DNA, 22 bp, Homo sapiens
cagcagcatcaggtctgtggtt

SEQ ID NO: 8386750 - DNA, 22 bp, Homo sapiens
cagcagcagtgttctagaatct

SEQ ID NO: 8386751 - DNA, 22 bp, Homo sapiens
cagcagaggttttgctccatga

SEQ ID NO: 8386752 - DNA, 22 bp, Homo sapiens
cagcagcagccccaggaaggtt

SEQ ID NO: 8386753 - DNA, 22 bp, Homo sapiens
cagcagcagtggctgcagaaca

SEQ ID NO: 8386754 - DNA, 22 bp, Homo sapiens
cagcagcagtggctgcagaaca

SEQ ID NO: 8386755 - DNA, 22 bp, Homo sapiens
cagcagcagcttagtggtcccc

SEQ ID NO: 8386756 - DNA, 22 bp, Homo sapiens
cagcagcaggcgcacggccgtc

SEQ ID NO: 8386757 - DNA, 20 bp, Homo sapiens
cagcacagagcttggctcta

SEQ ID NO: 8386758 - DNA, 19 bp, Homo sapiens
cagcaagaatgaaggcata

SEQ ID NO: 8386759 - DNA, 22 bp, Homo sapiens
cagaggctcagatggccctggc

SEQ ID NO: 8386760 - DNA, 22 bp, Homo sapiens
agccctccatctgtgctcaggc

SEQ ID NO: 8386761 - DNA, 23 bp, Homo sapiens
agcctcagccggtggcagaagtg

SEQ ID NO: 8386762 - DNA, 23 bp, Homo sapiens
agcctcagccggtggcagaagtg

SEQ ID NO: 8386763 - DNA, 22 bp, Homo sapiens
cagcacagggacaatagcagat

SEQ ID NO: 8386764 - DNA, 22 bp, Homo sapiens
cagagctggagcttgaatggag

SEQ ID NO: 8386765 - DNA, 22 bp, Homo sapiens
cagagctggagcttgaatggag

SEQ ID NO: 8386766 - DNA, 22 bp, Homo sapiens
cagagctgcttcccagtttgtg

SEQ ID NO: 8386767 - DNA, 22 bp, Homo sapiens
agcccagcctgattctacaccc

SEQ ID NO: 8386768 - DNA, 22 bp, Homo sapiens
agcccaggaggtggaggttgca

SEQ ID NO: 8386769 - DNA, 19 bp, Homo sapiens
agcccccagacagcaggcc

SEQ ID NO: 8386770 - DNA, 19 bp, Homo sapiens
agcccccagacagcaggcc

SEQ ID NO: 8386771 - DNA, 19 bp, Homo sapiens
agcccccagacagcaggcc

SEQ ID NO: 8386772 - DNA, 22 bp, Homo sapiens
agcccggcttccccggttgcta

SEQ ID NO: 8386773 - DNA, 22 bp, Homo sapiens
cagacagaggctgtatgagggc

SEQ ID NO: 8386774 - DNA, 22 bp, Homo sapiens
cagacagacctgcaagggcaca

SEQ ID NO: 8386775 - DNA, 22 bp, Homo sapiens
cagacagagtcttcccatcagt

SEQ ID NO: 8386776 - DNA, 17 bp, Homo sapiens
cagacagatatcctggg

SEQ ID NO: 8386777 - DNA, 22 bp, Homo sapiens
cagacagcaaatctgcttgcat

SEQ ID NO: 8386778 - DNA, 22 bp, Homo sapiens
agccaggggattcatcagggac

SEQ ID NO: 8386779 - DNA, 20 bp, Homo sapiens
agccagggttctggatgcac

SEQ ID NO: 8386780 - DNA, 22 bp, Homo sapiens
agccaggttaaaccacagtcaa

SEQ ID NO: 8386781 - DNA, 22 bp, Homo sapiens
agccaggtcagctcaccctgct

SEQ ID NO: 8386782 - DNA, 22 bp, Homo sapiens
agccaggtactcttgtgaccat

SEQ ID NO: 8386783 - DNA, 22 bp, Homo sapiens
cagagagggcggccctggcttc

SEQ ID NO: 8386784 - DNA, 22 bp, Homo sapiens
cagagagtggcagttactgaag

SEQ ID NO: 8386785 - DNA, 22 bp, Homo sapiens
cagagatgggtcgcagagatgg

SEQ ID NO: 8386786 - DNA, 22 bp, Homo sapiens
cagagcacagagcttgggacaa

SEQ ID NO: 8386787 - DNA, 22 bp, Homo sapiens
cagagagggagcagtagtctct

SEQ ID NO: 8386788 - DNA, 22 bp, Homo sapiens
cagagagggcggccctggcttc

SEQ ID NO: 8386789 - DNA, 22 bp, Homo sapiens
cagagagggagcagtagtctct

SEQ ID NO: 8386790 - DNA, 22 bp, Homo sapiens
cagagagggagcagtagtctct

SEQ ID NO: 8386791 - DNA, 22 bp, Homo sapiens
agccacacctgtcctgccagct

SEQ ID NO: 8386792 - DNA, 22 bp, Homo sapiens
agccaaggacacggagcctcct

SEQ ID NO: 8386793 - DNA, 22 bp, Homo sapiens
agccaatgcgtaaaaagatcta

SEQ ID NO: 8386794 - DNA, 22 bp, Homo sapiens
cactctgtgattgcagcattcc

SEQ ID NO: 8386795 - DNA, 22 bp, Homo sapiens
cactctgtgattgcagcattcc

SEQ ID NO: 8386796 - DNA, 22 bp, Homo sapiens
cactgaaaattagctttcctga

SEQ ID NO: 8386797 - DNA, 22 bp, Homo sapiens
cactgaaatattaatatcttat

SEQ ID NO: 8386798 - DNA, 19 bp, Homo sapiens
agccacagaacttgcagga

SEQ ID NO: 8386799 - DNA, 19 bp, Homo sapiens
agccacagaacttgcagga

SEQ ID NO: 8386800 - DNA, 19 bp, Homo sapiens
agccacagaacttgcagga

SEQ ID NO: 8386801 - DNA, 22 bp, Homo sapiens
agccacagagagggagctgcaa

SEQ ID NO: 8386802 - DNA, 19 bp, Homo sapiens
agccacagaacttgcagga

SEQ ID NO: 8386803 - DNA, 22 bp, Homo sapiens
agccacagagcaggagaccttt

SEQ ID NO: 8386804 - DNA, 22 bp, Homo sapiens
agccacagaggttgatgtggtt

SEQ ID NO: 8386805 - DNA, 22 bp, Homo sapiens
agccacagcaacaagtgcaatt

SEQ ID NO: 8386806 - DNA, 22 bp, Homo sapiens
agccacagcatgtgtgtatgta

SEQ ID NO: 8386807 - DNA, 23 bp, Homo sapiens
agccacagccagagctatctcca

SEQ ID NO: 8386808 - DNA, 22 bp, Homo sapiens
agccacagcctgacttaactgt

SEQ ID NO: 8386809 - DNA, 23 bp, Homo sapiens
cagaaatgacagtaagcaccctg

SEQ ID NO: 8386810 - DNA, 22 bp, Homo sapiens
cagaagctgaggagtgaggcaa

SEQ ID NO: 8386811 - DNA, 22 bp, Homo sapiens
cagaagcctaaatagtgcacca

SEQ ID NO: 8386812 - DNA, 22 bp, Homo sapiens
cagaagaatggtgtctgagctc

SEQ ID NO: 8386813 - DNA, 22 bp, Homo sapiens
cagaagagatgaaatagtatta

SEQ ID NO: 8386814 - DNA, 23 bp, Homo sapiens
cagaagacagtctcaagacaagg

SEQ ID NO: 8386815 - DNA, 22 bp, Homo sapiens
cagaagaaatcattatctggac

SEQ ID NO: 8386816 - DNA, 22 bp, Homo sapiens
cagaagaaagtggggagacaag

SEQ ID NO: 8386817 - DNA, 22 bp, Homo sapiens
agccaggacgttgctcagctcc

SEQ ID NO: 8386818 - DNA, 22 bp, Homo sapiens
agccaggacatctctagctgct

SEQ ID NO: 8386819 - DNA, 22 bp, Homo sapiens
agccaggatggtctcgatcggc

SEQ ID NO: 8386820 - DNA, 22 bp, Homo sapiens
agccaggatggtctcgatcggc

SEQ ID NO: 8386821 - DNA, 22 bp, Homo sapiens
agccaggatggtctcgatcggc

SEQ ID NO: 8386822 - DNA, 21 bp, Homo sapiens
agccagctatcacacagcatt

SEQ ID NO: 8386823 - DNA, 22 bp, Homo sapiens
agccagctccctcccctgcagg

SEQ ID NO: 8386824 - DNA, 22 bp, Homo sapiens
agccagctgcctttcacatctg

SEQ ID NO: 8386825 - DNA, 22 bp, Homo sapiens
agccagctctgagttgaagtac

SEQ ID NO: 8386826 - DNA, 17 bp, Homo sapiens
cagaaggaagcatggca

SEQ ID NO: 8386827 - DNA, 17 bp, Homo sapiens
cagaaggaagcatggca

SEQ ID NO: 8386828 - DNA, 22 bp, Homo sapiens
agccaggcagggctctcgctct

SEQ ID NO: 8386829 - DNA, 22 bp, Homo sapiens
cagacagaaggctccttgaggt

SEQ ID NO: 8386830 - DNA, 22 bp, Homo sapiens
agccaggattggctgagcctta

SEQ ID NO: 8386831 - DNA, 22 bp, Homo sapiens
agccaggattggctgagcctta

SEQ ID NO: 8386832 - DNA, 22 bp, Homo sapiens
agccaggattggctgagcctta

SEQ ID NO: 8386833 - DNA, 22 bp, Homo sapiens
agcacagagaagatttcaatta

SEQ ID NO: 8386834 - DNA, 22 bp, Homo sapiens
agcacagagttgcagagagcgt

SEQ ID NO: 8386835 - DNA, 22 bp, Homo sapiens
agcacagatggatgtattcatt

SEQ ID NO: 8386836 - DNA, 21 bp, Homo sapiens
agcaatttttcctcctctgca

SEQ ID NO: 8386837 - DNA, 23 bp, Homo sapiens
agcacagactagaaaggtctttc

SEQ ID NO: 8386838 - DNA, 22 bp, Homo sapiens
attttctatgttgtaattgtta

SEQ ID NO: 8386839 - DNA, 22 bp, Homo sapiens
attttctatgttgtaattgtta

SEQ ID NO: 8386840 - DNA, 22 bp, Homo sapiens
attttctatgttgtaattgtta

SEQ ID NO: 8386841 - DNA, 22 bp, Homo sapiens
attttctctttgtatatgctag

SEQ ID NO: 8386842 - DNA, 22 bp, Homo sapiens
attttctctttgtatatgctag

SEQ ID NO: 8386843 - DNA, 22 bp, Homo sapiens
attttctattctgctggtttag

SEQ ID NO: 8386844 - DNA, 22 bp, Homo sapiens
attttctctcaaaccttaaaat

SEQ ID NO: 8386845 - DNA, 22 bp, Homo sapiens
attttctcacaatgcagaagga

SEQ ID NO: 8386846 - DNA, 22 bp, Homo sapiens
agcagaagaggtcttgttgctg

SEQ ID NO: 8386847 - DNA, 17 bp, Homo sapiens
agcagaagtcagaggga

SEQ ID NO: 8386848 - DNA, 22 bp, Homo sapiens
agcactgtggtggaagcatcaa

SEQ ID NO: 8386849 - DNA, 22 bp, Homo sapiens
agcactgttatgggatgactta

SEQ ID NO: 8386850 - DNA, 22 bp, Homo sapiens
caaatgttttttagtataagta

SEQ ID NO: 8386851 - DNA, 22 bp, Homo sapiens
caaatgttaagacaggatcaag

SEQ ID NO: 8386852 - DNA, 22 bp, Homo sapiens
caaatgtttcttatctattgtt

SEQ ID NO: 8386853 - DNA, 22 bp, Homo sapiens
caaatgttgctgtaatgtttgt

SEQ ID NO: 8386854 - DNA, 22 bp, Homo sapiens
caaatgttaaatgtgttaagac

SEQ ID NO: 8386855 - DNA, 22 bp, Homo sapiens
agcacagctgttcaacaggaat

SEQ ID NO: 8386856 - DNA, 22 bp, Homo sapiens
caactgttataaatcaacagag

SEQ ID NO: 8386857 - DNA, 22 bp, Homo sapiens
caactcatttattcaattttct

SEQ ID NO: 8386858 - DNA, 21 bp, Homo sapiens
agcagacacttgtgaccttcc

SEQ ID NO: 8386859 - DNA, 22 bp, Homo sapiens
caactcatgtccaactttcttt

SEQ ID NO: 8386860 - DNA, 22 bp, Homo sapiens
caactcatgtccaactttcttt

SEQ ID NO: 8386861 - DNA, 22 bp, Homo sapiens
agcagaatctgggagcagcagt

SEQ ID NO: 8386862 - DNA, 22 bp, Homo sapiens
agcagaatgtgtgtgacaagta

SEQ ID NO: 8386863 - DNA, 22 bp, Homo sapiens
agcagacaacccagatgaccca

SEQ ID NO: 8386864 - DNA, 22 bp, Homo sapiens
agcagacaattgcctggatgga

SEQ ID NO: 8386865 - DNA, 22 bp, Homo sapiens
agcagcacctggctatctgatc

SEQ ID NO: 8386866 - DNA, 22 bp, Homo sapiens
agcagcacatggggctggcaac

SEQ ID NO: 8386867 - DNA, 22 bp, Homo sapiens
agcagcagaaagttgatggcag

SEQ ID NO: 8386868 - DNA, 22 bp, Homo sapiens
caaggcaggcagttcacttgag

SEQ ID NO: 8386869 - DNA, 22 bp, Homo sapiens
caaggcaggaagcctgtcttat

SEQ ID NO: 8386870 - DNA, 22 bp, Homo sapiens
agcagcaatggaaagcaacaca

SEQ ID NO: 8386871 - DNA, 22 bp, Homo sapiens
agcagcaattttcactgtcaat

SEQ ID NO: 8386872 - DNA, 18 bp, Homo sapiens
agcagcaatttgggatga

SEQ ID NO: 8386873 - DNA, 22 bp, Homo sapiens
agcagcaggtgacctcgatgcc

SEQ ID NO: 8386874 - DNA, 22 bp, Homo sapiens
agcagcagggtgtaattgggca

SEQ ID NO: 8386875 - DNA, 22 bp, Homo sapiens
caaggcatgtaacaatggcttt

SEQ ID NO: 8386876 - DNA, 22 bp, Homo sapiens
agcagcagggtgtaattgggca

SEQ ID NO: 8386877 - DNA, 22 bp, Homo sapiens
caaggcatgcaatgtcttcagg

SEQ ID NO: 8386878 - DNA, 22 bp, Homo sapiens
agcagcatattgtgtcttcata

SEQ ID NO: 8386879 - DNA, 22 bp, Homo sapiens
agcagcatattgtgtcttcata

SEQ ID NO: 8386880 - DNA, 22 bp, Homo sapiens
caaggcaggccagtttcaaggc

SEQ ID NO: 8386881 - DNA, 22 bp, Homo sapiens
caaggcaggccagtttcaaggc

SEQ ID NO: 8386882 - DNA, 22 bp, Homo sapiens
caaggcaggtctgaggaggttg

SEQ ID NO: 8386883 - DNA, 22 bp, Homo sapiens
caaggcagtccctactccctgc

SEQ ID NO: 8386884 - DNA, 22 bp, Homo sapiens
caaggcagtgggctaggaacct

SEQ ID NO: 8386885 - DNA, 22 bp, Homo sapiens
caaggcagtgggctaggaacct

SEQ ID NO: 8386886 - DNA, 22 bp, Homo sapiens
caaggcagttccccagagggct

SEQ ID NO: 8386887 - DNA, 22 bp, Homo sapiens
caatgaaagcaactgcctataa

SEQ ID NO: 8386888 - DNA, 22 bp, Homo sapiens
caatgaaattgagatccagaga

SEQ ID NO: 8386889 - DNA, 22 bp, Homo sapiens
caatgaaaatttaagttgcagc

SEQ ID NO: 8386890 - DNA, 22 bp, Homo sapiens
agcagcatgatgacagagtctc

SEQ ID NO: 8386891 - DNA, 22 bp, Homo sapiens
agcagcatgttcattacattat

SEQ ID NO: 8386892 - DNA, 22 bp, Homo sapiens
cacatctgacttccagtgcagg

SEQ ID NO: 8386893 - DNA, 22 bp, Homo sapiens
cacatctgacttccagtgcagg

SEQ ID NO: 8386894 - DNA, 22 bp, Homo sapiens
agcaggtcgccgaagatagctc

SEQ ID NO: 8386895 - DNA, 22 bp, Homo sapiens
cacatcttcttaactccaaagt

SEQ ID NO: 8386896 - DNA, 22 bp, Homo sapiens
cacatccgaggagggtgagatg

SEQ ID NO: 8386897 - DNA, 22 bp, Homo sapiens
cacatccttcagctgagcccag

SEQ ID NO: 8386898 - DNA, 22 bp, Homo sapiens
cacatccttcatactcagctct

SEQ ID NO: 8386899 - DNA, 22 bp, Homo sapiens
cacatccttcatactcagctct

SEQ ID NO: 8386900 - DNA, 22 bp, Homo sapiens
cacatctgaaaagatgcacaag

SEQ ID NO: 8386901 - DNA, 22 bp, Homo sapiens
cacatatttgatgaagctttgt

SEQ ID NO: 8386902 - DNA, 22 bp, Homo sapiens
cacatattgtagttcaccagga

SEQ ID NO: 8386903 - DNA, 22 bp, Homo sapiens
cacatcctatcagtcacggttt

SEQ ID NO: 8386904 - DNA, 22 bp, Homo sapiens
cacatccctggagttacccagt

SEQ ID NO: 8386905 - DNA, 16 bp, Homo sapiens
agcagggcgggaagga

SEQ ID NO: 8386906 - DNA, 22 bp, Homo sapiens
agcagggctccatttcactgcc

SEQ ID NO: 8386907 - DNA, 22 bp, Homo sapiens
agcagggctcctgaaagccgcg

SEQ ID NO: 8386908 - DNA, 22 bp, Homo sapiens
agcagggctcctgaaagccgcg

SEQ ID NO: 8386909 - DNA, 22 bp, Homo sapiens
agcagggctctgccatgggccc

SEQ ID NO: 8386910 - DNA, 22 bp, Homo sapiens
agcagggcctctggcactggtc

SEQ ID NO: 8386911 - DNA, 22 bp, Homo sapiens
agcagggcctctggcactggtc

SEQ ID NO: 8386912 - DNA, 22 bp, Homo sapiens
agcagggcagtgcttcagctct

SEQ ID NO: 8386913 - DNA, 22 bp, Homo sapiens
agcagggcagtgcttcagctct

SEQ ID NO: 8386914 - DNA, 22 bp, Homo sapiens
cacagtcaatgtagaaatatga

SEQ ID NO: 8386915 - DNA, 22 bp, Homo sapiens
cacagtatttgtttttctgagt

SEQ ID NO: 8386916 - DNA, 22 bp, Homo sapiens
cacagtcaatgtagaaatatga

SEQ ID NO: 8386917 - DNA, 22 bp, Homo sapiens
caccagggacaatgctaggggt

SEQ ID NO: 8386918 - DNA, 22 bp, Homo sapiens
agcaggtgcgttacttcactct

SEQ ID NO: 8386919 - DNA, 22 bp, Homo sapiens
agcaggtgcgttacttcactct

SEQ ID NO: 8386920 - DNA, 21 bp, Homo sapiens
agcaggtgctgttggaggaaa

SEQ ID NO: 8386921 - DNA, 22 bp, Homo sapiens
caccagggctctgagctctgaa

SEQ ID NO: 8386922 - DNA, 22 bp, Homo sapiens
agcagtggcctggggctctgtg

SEQ ID NO: 8386923 - DNA, 22 bp, Homo sapiens
agcagttgtagtcatggaaaat

SEQ ID NO: 8386924 - DNA, 22 bp, Homo sapiens
agcagttcataaacattttgag

SEQ ID NO: 8386925 - DNA, 22 bp, Homo sapiens
agcataaaggtcaacgttttag

SEQ ID NO: 8386926 - DNA, 22 bp, Homo sapiens
agcataagttggtacagccact

SEQ ID NO: 8386927 - DNA, 22 bp, Homo sapiens
cactctgggctcttgtttcaga

SEQ ID NO: 8386928 - DNA, 22 bp, Homo sapiens
agcagtttgaatcaatggccag

SEQ ID NO: 8386929 - DNA, 22 bp, Homo sapiens
agcagtttatcctcataatgga

SEQ ID NO: 8386930 - DNA, 22 bp, Homo sapiens
cacaggaggaggccagagcgta

SEQ ID NO: 8386931 - DNA, 22 bp, Homo sapiens
cacaggaagctgactgctggca

SEQ ID NO: 8386932 - DNA, 22 bp, Homo sapiens
agcagcttcctgctcttcgcct

SEQ ID NO: 8386933 - DNA, 22 bp, Homo sapiens
agcagcttcctgctcttcgcct

SEQ ID NO: 8386934 - DNA, 22 bp, Homo sapiens
agcagcttcctgtttgcaggca

SEQ ID NO: 8386935 - DNA, 22 bp, Homo sapiens
agcagcttatcttggagaggca

SEQ ID NO: 8386936 - DNA, 22 bp, Homo sapiens
agcagcttagggaattctccct

SEQ ID NO: 8386937 - DNA, 19 bp, Homo sapiens
agcagcttaattttgtagc

SEQ ID NO: 8386938 - DNA, 19 bp, Homo sapiens
agcagcttaattttgtagc

SEQ ID NO: 8386939 - DNA, 22 bp, Homo sapiens
caatgacatggataatcatatt

SEQ ID NO: 8386940 - DNA, 22 bp, Homo sapiens
agcagctgtactttcatctgtt

SEQ ID NO: 8386941 - DNA, 22 bp, Homo sapiens
caatgataatggctgtatttat

SEQ ID NO: 8386942 - DNA, 21 bp, Homo sapiens
agcagctgggcaacatggagg

SEQ ID NO: 8386943 - DNA, 22 bp, Homo sapiens
agcagctgtcccttaacatcag

SEQ ID NO: 8386944 - DNA, 22 bp, Homo sapiens
cacagggcctggggcagctgct

SEQ ID NO: 8386945 - DNA, 22 bp, Homo sapiens
cacagggcagtgctgcccactc

SEQ ID NO: 8386946 - DNA, 22 bp, Homo sapiens
cacagggcagtgctgcccactc

SEQ ID NO: 8386947 - DNA, 22 bp, Homo sapiens
cacagggcaggtactctcagag

SEQ ID NO: 8386948 - DNA, 22 bp, Homo sapiens
cacagtatgatctaaagtaagt

SEQ ID NO: 8386949 - DNA, 22 bp, Homo sapiens
cacagtatcttttgagtaagca

SEQ ID NO: 8386950 - DNA, 22 bp, Homo sapiens
cacagtatgatctaaagtaagt

SEQ ID NO: 8386951 - DNA, 22 bp, Homo sapiens
cacagggctaaatgaagggttg

SEQ ID NO: 8386952 - DNA, 22 bp, Homo sapiens
cacagggcttctcatggggtgc

SEQ ID NO: 8386953 - DNA, 22 bp, Homo sapiens
agcaggagagcagtgcgtggtc

SEQ ID NO: 8386954 - DNA, 22 bp, Homo sapiens
agcaggagatggggcgtgatgt

SEQ ID NO: 8386955 - DNA, 22 bp, Homo sapiens
agcaggagacatgggggtggtg

SEQ ID NO: 8386956 - DNA, 22 bp, Homo sapiens
agcaggagagcagtgcgtggtc

SEQ ID NO: 8386957 - DNA, 22 bp, Homo sapiens
agcaggagaacactgtggctct

SEQ ID NO: 8386958 - DNA, 22 bp, Homo sapiens
agcaggagaacactgtggctct

SEQ ID NO: 8386959 - DNA, 22 bp, Homo sapiens
cacaggagggagcgggcagcca

SEQ ID NO: 8386960 - DNA, 22 bp, Homo sapiens
cacaggaggaggtgcccgggcc

SEQ ID NO: 8386961 - DNA, 22 bp, Homo sapiens
actgtctttattagaatcttat

SEQ ID NO: 8386962 - DNA, 22 bp, Homo sapiens
actgtgaaagctaacatcttag

SEQ ID NO: 8386963 - DNA, 17 bp, Homo sapiens
actgtcttttacaccct

SEQ ID NO: 8386964 - DNA, 22 bp, Homo sapiens
actgtcttcaaatgaatatatt

SEQ ID NO: 8386965 - DNA, 22 bp, Homo sapiens
actgtaaagaggtgtatcttta

SEQ ID NO: 8386966 - DNA, 22 bp, Homo sapiens
actgtaaagaggtgtatcttta

SEQ ID NO: 8386967 - DNA, 22 bp, Homo sapiens
actgtcatcttgtaagcaatgt

SEQ ID NO: 8386968 - DNA, 22 bp, Homo sapiens
actgtaaattacataagaacag

SEQ ID NO: 8386969 - DNA, 22 bp, Homo sapiens
agtttcatttcttagtaccagt

SEQ ID NO: 8386970 - DNA, 22 bp, Homo sapiens
agtttcatgtagccatatttac

SEQ ID NO: 8386971 - DNA, 22 bp, Homo sapiens
actgtgactgagcattcacatg

SEQ ID NO: 8386972 - DNA, 22 bp, Homo sapiens
actgtgcctttcacttgcactt

SEQ ID NO: 8386973 - DNA, 22 bp, Homo sapiens
actgtgccttcttattgggtcc

SEQ ID NO: 8386974 - DNA, 22 bp, Homo sapiens
agtttctaacatatagcattgg

SEQ ID NO: 8386975 - DNA, 22 bp, Homo sapiens
actgtgccacaattcaccaggg

SEQ ID NO: 8386976 - DNA, 22 bp, Homo sapiens
agtttccttgggcatttgttta

SEQ ID NO: 8386977 - DNA, 22 bp, Homo sapiens
agtttcctgggagattcttaca

SEQ ID NO: 8386978 - DNA, 22 bp, Homo sapiens
actgtgggtcccagctgtgtct

SEQ ID NO: 8386979 - DNA, 22 bp, Homo sapiens
actgtgtattcctatatagtaa

SEQ ID NO: 8386980 - DNA, 22 bp, Homo sapiens
actgtgtaaatctgaaagtcta

SEQ ID NO: 8386981 - DNA, 22 bp, Homo sapiens
agttgctatcgtgaagcacgtg

SEQ ID NO: 8386982 - DNA, 22 bp, Homo sapiens
agttgctacctctctgtgctcc

SEQ ID NO: 8386983 - DNA, 22 bp, Homo sapiens
actggcagtggcagcagaaaga

SEQ ID NO: 8386984 - DNA, 22 bp, Homo sapiens
agtttacatcttcaatctcatt

SEQ ID NO: 8386985 - DNA, 22 bp, Homo sapiens
actggtttttccatatgagatg

SEQ ID NO: 8386986 - DNA, 17 bp, Homo sapiens
actggttttggcagcat

SEQ ID NO: 8386987 - DNA, 22 bp, Homo sapiens
actggtttttctcatgaaaatg

SEQ ID NO: 8386988 - DNA, 22 bp, Homo sapiens
actggttttccaggttacttct

SEQ ID NO: 8386989 - DNA, 22 bp, Homo sapiens
actggttttggaaatcagtaca

SEQ ID NO: 8386990 - DNA, 22 bp, Homo sapiens
actggtttgtctattgtcattc

SEQ ID NO: 8386991 - DNA, 22 bp, Homo sapiens
actggtttgggacaatttgtgc

SEQ ID NO: 8386992 - DNA, 22 bp, Homo sapiens
acttccaaaacacagcatggca

SEQ ID NO: 8386993 - DNA, 22 bp, Homo sapiens
acttccaaagaagtgattacag

SEQ ID NO: 8386994 - DNA, 22 bp, Homo sapiens
acttcagtgtggtataaaacgt

SEQ ID NO: 8386995 - DNA, 22 bp, Homo sapiens
acttgcaaggttgcagttagaa

SEQ ID NO: 8386996 - DNA, 22 bp, Homo sapiens
acttgcaggatcctctgcctga

SEQ ID NO: 8386997 - DNA, 22 bp, Homo sapiens
acttgatttttataataaatgg

SEQ ID NO: 8386998 - DNA, 22 bp, Homo sapiens
acttgatttttataataaatgg

SEQ ID NO: 8386999 - DNA, 22 bp, Homo sapiens
acttctttcacaatgtttctag

SEQ ID NO: 8387000 - DNA, 22 bp, Homo sapiens
acttccaagtttattcatgtga

SEQ ID NO: 8387001 - DNA, 17 bp, Homo sapiens
acttccaagcattgctg

SEQ ID NO: 8387002 - DNA, 22 bp, Homo sapiens
acttccaagtgacattcatatc

SEQ ID NO: 8387003 - DNA, 22 bp, Homo sapiens
acttccaacttcagtcctgagc

SEQ ID NO: 8387004 - DNA, 22 bp, Homo sapiens
acttccaaataccatcacattg

SEQ ID NO: 8387005 - DNA, 23 bp, Homo sapiens
acttggaagcagtgaacaacttt

SEQ ID NO: 8387006 - DNA, 22 bp, Homo sapiens
acttggccttatttccacagaa

SEQ ID NO: 8387007 - DNA, 21 bp, Homo sapiens
acttggccaggcccccacctg

SEQ ID NO: 8387008 - DNA, 22 bp, Homo sapiens
acttggatatgttcactagacc

SEQ ID NO: 8387009 - DNA, 22 bp, Homo sapiens
acttgccccagaattgctgctg

SEQ ID NO: 8387010 - DNA, 22 bp, Homo sapiens
acttgctcaatgcttgaagcca

SEQ ID NO: 8387011 - DNA, 20 bp, Homo sapiens
acttgcctctatgctacgtt

SEQ ID NO: 8387012 - DNA, 22 bp, Homo sapiens
acttgctggtggcatttacagt

SEQ ID NO: 8387013 - DNA, 22 bp, Homo sapiens
acttggaaaattcaaaatggca

SEQ ID NO: 8387014 - DNA, 22 bp, Homo sapiens
acttggaaagatgcaacacagt

SEQ ID NO: 8387015 - DNA, 20 bp, Homo sapiens
acttggaactcatttttctt

SEQ ID NO: 8387016 - DNA, 18 bp, Homo sapiens
actgttatctgataaggc

SEQ ID NO: 8387017 - DNA, 22 bp, Homo sapiens
actgttatgatttacacagtcc

SEQ ID NO: 8387018 - DNA, 22 bp, Homo sapiens
actgttatgttattacccatgt

SEQ ID NO: 8387019 - DNA, 22 bp, Homo sapiens
acttatttcatggatcataatg

SEQ ID NO: 8387020 - DNA, 19 bp, Homo sapiens
acttcaaatcttagagaaa

SEQ ID NO: 8387021 - DNA, 22 bp, Homo sapiens
acttcacaaagagatcatctaa

SEQ ID NO: 8387022 - DNA, 22 bp, Homo sapiens
actgttaaagtaattaattgtc

SEQ ID NO: 8387023 - DNA, 22 bp, Homo sapiens
actgttaaagtaattaattgtc

SEQ ID NO: 8387024 - DNA, 21 bp, Homo sapiens
actgttaagacgtagctgggg

SEQ ID NO: 8387025 - DNA, 22 bp, Homo sapiens
actgttaacggtatgatgctcg

SEQ ID NO: 8387026 - DNA, 22 bp, Homo sapiens
actgttaattcaatcaacaggt

SEQ ID NO: 8387027 - DNA, 22 bp, Homo sapiens
actgttacagagcaggaaattg

SEQ ID NO: 8387028 - DNA, 22 bp, Homo sapiens
actgttacagggcactgaacat

SEQ ID NO: 8387029 - DNA, 22 bp, Homo sapiens
actgtgttaaatacagagatgg

SEQ ID NO: 8387030 - DNA, 22 bp, Homo sapiens
actgtgtggaaatttgtgaggg

SEQ ID NO: 8387031 - DNA, 22 bp, Homo sapiens
atccactctcccattcatgcat

SEQ ID NO: 8387032 - DNA, 22 bp, Homo sapiens
atcatttaaaacaagtctctat

SEQ ID NO: 8387033 - DNA, 22 bp, Homo sapiens
atcattctgatggtcaatgcta

SEQ ID NO: 8387034 - DNA, 22 bp, Homo sapiens
atcattgaatataagtgctatt

SEQ ID NO: 8387035 - DNA, 22 bp, Homo sapiens
atcatttaaaacaagtctctat

SEQ ID NO: 8387036 - DNA, 22 bp, Homo sapiens
atcatttatgccccaattagat

SEQ ID NO: 8387037 - DNA, 22 bp, Homo sapiens
atcatttatgccccaattagat

SEQ ID NO: 8387038 - DNA, 23 bp, Homo sapiens
atcattctccaatctggagcagg

SEQ ID NO: 8387039 - DNA, 22 bp, Homo sapiens
atcattctattgttgagctgcc

SEQ ID NO: 8387040 - DNA, 22 bp, Homo sapiens
atcagcaagcatttattgagtg

SEQ ID NO: 8387041 - DNA, 22 bp, Homo sapiens
atcagcaagatgtaatttctat

SEQ ID NO: 8387042 - DNA, 22 bp, Homo sapiens
atcagagctgtgattcccactc

SEQ ID NO: 8387043 - DNA, 22 bp, Homo sapiens
atcagagctgcattttagagcc

SEQ ID NO: 8387044 - DNA, 22 bp, Homo sapiens
atcagagtcagaggctagagct

SEQ ID NO: 8387045 - DNA, 21 bp, Homo sapiens
atcagagtacgcatgcgctga

SEQ ID NO: 8387046 - DNA, 22 bp, Homo sapiens
atcagaggttatgtggagggga

SEQ ID NO: 8387047 - DNA, 20 bp, Homo sapiens
atcacctgtaggttctttgt

SEQ ID NO: 8387048 - DNA, 19 bp, Homo sapiens
atcacctggtgtttccttg

SEQ ID NO: 8387049 - DNA, 22 bp, Homo sapiens
atcacctggccattgggttaac

SEQ ID NO: 8387050 - DNA, 22 bp, Homo sapiens
atcacctgcacaaatgtgttcc

SEQ ID NO: 8387051 - DNA, 22 bp, Homo sapiens
agaaacatcattggaacacaag

SEQ ID NO: 8387052 - DNA, 22 bp, Homo sapiens
agaaacatcattgtttggtatt

SEQ ID NO: 8387053 - DNA, 22 bp, Homo sapiens
agaaacatcattggaacacaag

SEQ ID NO: 8387054 - DNA, 22 bp, Homo sapiens
agaaacatattcagtgagtaat

SEQ ID NO: 8387055 - DNA, 22 bp, Homo sapiens
agaaacagaagggaaagctttt

SEQ ID NO: 8387056 - DNA, 22 bp, Homo sapiens
agaaacagaagggaaagctttt

SEQ ID NO: 8387057 - DNA, 22 bp, Homo sapiens
agaaacatttagattatatgtc

SEQ ID NO: 8387058 - DNA, 21 bp, Homo sapiens
agaaacatgatcaaaggaacc

SEQ ID NO: 8387059 - DNA, 21 bp, Homo sapiens
agaaacatgatcaaaggaacc

SEQ ID NO: 8387060 - DNA, 22 bp, Homo sapiens
agaaacatcctgctttccattt

SEQ ID NO: 8387061 - DNA, 22 bp, Homo sapiens
agaaacatttagattatatgtc

SEQ ID NO: 8387062 - DNA, 22 bp, Homo sapiens
atcaattttgaggatacaagaa

SEQ ID NO: 8387063 - DNA, 22 bp, Homo sapiens
atatatttgagaatattcatga

SEQ ID NO: 8387064 - DNA, 22 bp, Homo sapiens
atatatttgagaatattcatga

SEQ ID NO: 8387065 - DNA, 22 bp, Homo sapiens
atatatttgagaatattcatga

SEQ ID NO: 8387066 - DNA, 22 bp, Homo sapiens
atatatttactctcctgttgca

SEQ ID NO: 8387067 - DNA, 22 bp, Homo sapiens
atatatttgagaatattcatga

SEQ ID NO: 8387068 - DNA, 22 bp, Homo sapiens
atatatttgagaatattcatga

SEQ ID NO: 8387069 - DNA, 22 bp, Homo sapiens
atatatttgagaatattcatga

SEQ ID NO: 8387070 - DNA, 22 bp, Homo sapiens
atatatttgagaatattcatga

SEQ ID NO: 8387071 - DNA, 22 bp, Homo sapiens
agaaaatttaaagagacacaca

SEQ ID NO: 8387072 - DNA, 22 bp, Homo sapiens
agaaacaacttgtttctcttgc

SEQ ID NO: 8387073 - DNA, 22 bp, Homo sapiens
agaaacagaaccaggtgtcatt

SEQ ID NO: 8387074 - DNA, 22 bp, Homo sapiens
agaaacaaggtgtaggttgacc

SEQ ID NO: 8387075 - DNA, 22 bp, Homo sapiens
agaaacagaaccaggtgtcatt

SEQ ID NO: 8387076 - DNA, 22 bp, Homo sapiens
agaaacagaaccaggtgtcatt

SEQ ID NO: 8387077 - DNA, 22 bp, Homo sapiens
agaaacaaggtgtaggttgacc

SEQ ID NO: 8387078 - DNA, 22 bp, Homo sapiens
agaaacaacttgtttctcttgc

SEQ ID NO: 8387079 - DNA, 22 bp, Homo sapiens
agaaaattagattttactgtgt

SEQ ID NO: 8387080 - DNA, 22 bp, Homo sapiens
atatataacctggataaggctt

SEQ ID NO: 8387081 - DNA, 22 bp, Homo sapiens
acttggtctaactagtgcttct

SEQ ID NO: 8387082 - DNA, 22 bp, Homo sapiens
acttgggatttcagatgctgtg

SEQ ID NO: 8387083 - DNA, 22 bp, Homo sapiens
acttgggaggctgaaggacatt

SEQ ID NO: 8387084 - DNA, 22 bp, Homo sapiens
atagtttacaaaaatgatgcat

SEQ ID NO: 8387085 - DNA, 22 bp, Homo sapiens
atagtttacaaaaatgatgcat

SEQ ID NO: 8387086 - DNA, 22 bp, Homo sapiens
atagtttaaggaactatgcgat

SEQ ID NO: 8387087 - DNA, 22 bp, Homo sapiens
acttggttctaactagtgtata

SEQ ID NO: 8387088 - DNA, 22 bp, Homo sapiens
atataattctcaggtttgacta

SEQ ID NO: 8387089 - DNA, 21 bp, Homo sapiens
actcatttgtctgcatctaat

SEQ ID NO: 8387090 - DNA, 22 bp, Homo sapiens
actccacatttgaacacagttc

SEQ ID NO: 8387091 - DNA, 22 bp, Homo sapiens
actccacaccacgggggccgcc

SEQ ID NO: 8387092 - DNA, 22 bp, Homo sapiens
actccagggctgaacgaggccc

SEQ ID NO: 8387093 - DNA, 22 bp, Homo sapiens
actccagggctccaccccagat

SEQ ID NO: 8387094 - DNA, 22 bp, Homo sapiens
agtctctctcctcgtggtaacc

SEQ ID NO: 8387095 - DNA, 22 bp, Homo sapiens
agtctcttaaagacagtgttga

SEQ ID NO: 8387096 - DNA, 22 bp, Homo sapiens
agtctgggtggctgagctacag

SEQ ID NO: 8387097 - DNA, 22 bp, Homo sapiens
agtctgggtgtgaatgaacttg

SEQ ID NO: 8387098 - DNA, 22 bp, Homo sapiens
agtctgggcatttaggatgttg

SEQ ID NO: 8387099 - DNA, 22 bp, Homo sapiens
agtctgggctgtctgcaggagt

SEQ ID NO: 8387100 - DNA, 22 bp, Homo sapiens
agtctcttgcacattgtattaa

SEQ ID NO: 8387101 - DNA, 22 bp, Homo sapiens
agtctcttcctcatgcatatgt

SEQ ID NO: 8387102 - DNA, 22 bp, Homo sapiens
agtctggctttttgatgagctt

SEQ ID NO: 8387103 - DNA, 22 bp, Homo sapiens
actgaagcttgggtggaactta

SEQ ID NO: 8387104 - DNA, 22 bp, Homo sapiens
actgaagcacatttgccatgaa

SEQ ID NO: 8387105 - DNA, 22 bp, Homo sapiens
actgaagagaagcattttctgc

SEQ ID NO: 8387106 - DNA, 22 bp, Homo sapiens
actgaagagcgtgctatgctca

SEQ ID NO: 8387107 - DNA, 22 bp, Homo sapiens
actgaacatatgcaagaccatt

SEQ ID NO: 8387108 - DNA, 22 bp, Homo sapiens
actgaacatatgcaagaccatt

SEQ ID NO: 8387109 - DNA, 22 bp, Homo sapiens
actgcaacacctcctgggttca

SEQ ID NO: 8387110 - DNA, 22 bp, Homo sapiens
actgcaacctccgcctgccagg

SEQ ID NO: 8387111 - DNA, 22 bp, Homo sapiens
actgcaacctccgcctgccagg

SEQ ID NO: 8387112 - DNA, 22 bp, Homo sapiens
actgcacagaattatggttggt

SEQ ID NO: 8387113 - DNA, 22 bp, Homo sapiens
actgcctgtagctcttcatctc

SEQ ID NO: 8387114 - DNA, 22 bp, Homo sapiens
actgagggtgcacaggcaggca

SEQ ID NO: 8387115 - DNA, 22 bp, Homo sapiens
actgagggtgcacaggcaggca

SEQ ID NO: 8387116 - DNA, 22 bp, Homo sapiens
actgagggttagtggaccgtgt

SEQ ID NO: 8387117 - DNA, 22 bp, Homo sapiens
actgaattcctctttcttatcc

SEQ ID NO: 8387118 - DNA, 22 bp, Homo sapiens
actgatgaagagtaccactgtt

SEQ ID NO: 8387119 - DNA, 23 bp, Homo sapiens
actgattaacatgtgtgatattc

SEQ ID NO: 8387120 - DNA, 22 bp, Homo sapiens
actgctttagacctagagctct

SEQ ID NO: 8387121 - DNA, 20 bp, Homo sapiens
actgcttctttctctgacct

SEQ ID NO: 8387122 - DNA, 20 bp, Homo sapiens
actgcttctttctctgacct

SEQ ID NO: 8387123 - DNA, 22 bp, Homo sapiens
actgcttacccggcctgacttc

SEQ ID NO: 8387124 - DNA, 22 bp, Homo sapiens
actgcttcactgcgtcttatct

SEQ ID NO: 8387125 - DNA, 22 bp, Homo sapiens
actgctattgatgtcacacttt

SEQ ID NO: 8387126 - DNA, 22 bp, Homo sapiens
actgctctctgcaagtagatgg

SEQ ID NO: 8387127 - DNA, 22 bp, Homo sapiens
actgctctctttgcaggggcta

SEQ ID NO: 8387128 - DNA, 22 bp, Homo sapiens
actgctctgttttcatatgttt

SEQ ID NO: 8387129 - DNA, 22 bp, Homo sapiens
actgctgactaaacagctccat

SEQ ID NO: 8387130 - DNA, 22 bp, Homo sapiens
agtggctgcttctggttgctcc

SEQ ID NO: 8387131 - DNA, 22 bp, Homo sapiens
actggatgaggggaaagagaca

SEQ ID NO: 8387132 - DNA, 22 bp, Homo sapiens
actggacagaggaaatatggag

SEQ ID NO: 8387133 - DNA, 22 bp, Homo sapiens
acctccctgcctcttggcgtca

SEQ ID NO: 8387134 - DNA, 22 bp, Homo sapiens
acctgccttctcaaggacatga

SEQ ID NO: 8387135 - DNA, 22 bp, Homo sapiens
acctgctgaggagggggaatta

SEQ ID NO: 8387136 - DNA, 22 bp, Homo sapiens
acctgctgtcttgggggaatgc

SEQ ID NO: 8387137 - DNA, 20 bp, Homo sapiens
acctggagacagcactctgg

SEQ ID NO: 8387138 - DNA, 22 bp, Homo sapiens
aggtagaaggaccagaatttat

SEQ ID NO: 8387139 - DNA, 22 bp, Homo sapiens
acctggttcctcctcactgctg

SEQ ID NO: 8387140 - DNA, 22 bp, Homo sapiens
acctgtgttttccctcagtttc

SEQ ID NO: 8387141 - DNA, 20 bp, Homo sapiens
agggtggggacgttctgact

SEQ ID NO: 8387142 - DNA, 22 bp, Homo sapiens
agggtgtcagccacggaatggg

SEQ ID NO: 8387143 - DNA, 22 bp, Homo sapiens
agggtgggctagactcttcccc

SEQ ID NO: 8387144 - DNA, 22 bp, Homo sapiens
agggctttcggcactctgaggg

SEQ ID NO: 8387145 - DNA, 22 bp, Homo sapiens
agggctttacttctcagttcta

SEQ ID NO: 8387146 - DNA, 22 bp, Homo sapiens
agggctttaatgattattttct

SEQ ID NO: 8387147 - DNA, 22 bp, Homo sapiens
agggctggtatgtccatgaaag

SEQ ID NO: 8387148 - DNA, 22 bp, Homo sapiens
agggctggtatgtccatgaaag

SEQ ID NO: 8387149 - DNA, 22 bp, Homo sapiens
accttatttggaaatataatta

SEQ ID NO: 8387150 - DNA, 19 bp, Homo sapiens
accttcagagtggcacaaa

SEQ ID NO: 8387151 - DNA, 22 bp, Homo sapiens
acgggcagacagagctactcgc

SEQ ID NO: 8387152 - DNA, 21 bp, Homo sapiens
accttcagtgttctcagctgc

SEQ ID NO: 8387153 - DNA, 22 bp, Homo sapiens
accttaaaggccgaagtaaaga

SEQ ID NO: 8387154 - DNA, 22 bp, Homo sapiens
accttaaaggccgaagtaaaga

SEQ ID NO: 8387155 - DNA, 22 bp, Homo sapiens
accttaaactttacagccaagt

SEQ ID NO: 8387156 - DNA, 22 bp, Homo sapiens
accttaaaactgacacatggag

SEQ ID NO: 8387157 - DNA, 22 bp, Homo sapiens
acgtgtgtttaacaaacctgca

SEQ ID NO: 8387158 - DNA, 20 bp, Homo sapiens
acgtgtgtgtgcacgcgcgc

SEQ ID NO: 8387159 - DNA, 22 bp, Homo sapiens
acgtgtgtatgagtgtacatat

SEQ ID NO: 8387160 - DNA, 22 bp, Homo sapiens
actaaagctcacagagttgaac

SEQ ID NO: 8387161 - DNA, 22 bp, Homo sapiens
actaaagctcacagagttgaac

SEQ ID NO: 8387162 - DNA, 22 bp, Homo sapiens
actaaagaacagttcgttcatg

SEQ ID NO: 8387163 - DNA, 22 bp, Homo sapiens
actatttactcaaatgaggttg

SEQ ID NO: 8387164 - DNA, 22 bp, Homo sapiens
actcaaatttgtcaactgaagc

SEQ ID NO: 8387165 - DNA, 22 bp, Homo sapiens
actcaacagggaacaagatcag

SEQ ID NO: 8387166 - DNA, 22 bp, Homo sapiens
actcaacagggaacaagatcag

SEQ ID NO: 8387167 - DNA, 22 bp, Homo sapiens
actcattgaaacttaagatcta

SEQ ID NO: 8387168 - DNA, 22 bp, Homo sapiens
actcattaaataggatgatttt

SEQ ID NO: 8387169 - DNA, 22 bp, Homo sapiens
actatataagattggcattttt

SEQ ID NO: 8387170 - DNA, 22 bp, Homo sapiens
actatcttccttatgcctatca

SEQ ID NO: 8387171 - DNA, 22 bp, Homo sapiens
actagtttatgctcagatgtct

SEQ ID NO: 8387172 - DNA, 22 bp, Homo sapiens
actagtttattacagttccact

SEQ ID NO: 8387173 - DNA, 22 bp, Homo sapiens
aggcaggcagctgtcaccactc

SEQ ID NO: 8387174 - DNA, 22 bp, Homo sapiens
aggcaggcagctgtcaccactc

SEQ ID NO: 8387175 - DNA, 17 bp, Homo sapiens
aggcaggcagagcggga

SEQ ID NO: 8387176 - DNA, 23 bp, Homo sapiens
aggcaggcagttcagctgttgtt

SEQ ID NO: 8387177 - DNA, 22 bp, Homo sapiens
aggcagggaccagttgttttct

SEQ ID NO: 8387178 - DNA, 22 bp, Homo sapiens
acatgaaatgcagcctgtaacc

SEQ ID NO: 8387179 - DNA, 22 bp, Homo sapiens
aggcaggggagctggaagggta

SEQ ID NO: 8387180 - DNA, 22 bp, Homo sapiens
aggcagggctcatttcttaggc

SEQ ID NO: 8387181 - DNA, 22 bp, Homo sapiens
aggcagggctgggattagactc

SEQ ID NO: 8387182 - DNA, 22 bp, Homo sapiens
acatgcacacgattcagtctgg

SEQ ID NO: 8387183 - DNA, 22 bp, Homo sapiens
acatgcacacctatatacatgt

SEQ ID NO: 8387184 - DNA, 22 bp, Homo sapiens
acatgatctgacttgcttttta

SEQ ID NO: 8387185 - DNA, 22 bp, Homo sapiens
acatgatcccacctgcctataa

SEQ ID NO: 8387186 - DNA, 23 bp, Homo sapiens
acatgatacacaattagcaaacc

SEQ ID NO: 8387187 - DNA, 22 bp, Homo sapiens
acatgatcttatgtagaagatc

SEQ ID NO: 8387188 - DNA, 22 bp, Homo sapiens
acatgattcttgataggcattg

SEQ ID NO: 8387189 - DNA, 22 bp, Homo sapiens
aggccctgtaaggtgtggagat

SEQ ID NO: 8387190 - DNA, 21 bp, Homo sapiens
acatggactgtgaatggggac

SEQ ID NO: 8387191 - DNA, 22 bp, Homo sapiens
acatggcacccagatctcaaaa

SEQ ID NO: 8387192 - DNA, 22 bp, Homo sapiens
acatggaagataaaaatactca

SEQ ID NO: 8387193 - DNA, 21 bp, Homo sapiens
acatggaagagaaattaacca

SEQ ID NO: 8387194 - DNA, 20 bp, Homo sapiens
acatggaaggtcaaactatc

SEQ ID NO: 8387195 - DNA, 22 bp, Homo sapiens
aggcccttaggacccctgcgtg

SEQ ID NO: 8387196 - DNA, 22 bp, Homo sapiens
aggcccttggagtagaggctga

SEQ ID NO: 8387197 - DNA, 22 bp, Homo sapiens
aggcccttggactcatgctcga

SEQ ID NO: 8387198 - DNA, 22 bp, Homo sapiens
acatttatataactcactagga

SEQ ID NO: 8387199 - DNA, 22 bp, Homo sapiens
acatttatataactcactagga

SEQ ID NO: 8387200 - DNA, 22 bp, Homo sapiens
acatttatataactcactagga

SEQ ID NO: 8387201 - DNA, 22 bp, Homo sapiens
acatttatatttagtggggaat

SEQ ID NO: 8387202 - DNA, 22 bp, Homo sapiens
acatttattactcaggttgttg

SEQ ID NO: 8387203 - DNA, 22 bp, Homo sapiens
acatttattttggcacggcaca

SEQ ID NO: 8387204 - DNA, 22 bp, Homo sapiens
acatttattttcagctgggaaa

SEQ ID NO: 8387205 - DNA, 22 bp, Homo sapiens
acatttaatgatcctactgtga

SEQ ID NO: 8387206 - DNA, 22 bp, Homo sapiens
acatttaatgatcctactgtga

SEQ ID NO: 8387207 - DNA, 20 bp, Homo sapiens
aggctgagttctatgcactt

SEQ ID NO: 8387208 - DNA, 22 bp, Homo sapiens
aggctaggaatcaagcctttct

SEQ ID NO: 8387209 - DNA, 22 bp, Homo sapiens
aggctagggccatggctggtga

SEQ ID NO: 8387210 - DNA, 22 bp, Homo sapiens
aggctaggctgatgcctcttcc

SEQ ID NO: 8387211 - DNA, 22 bp, Homo sapiens
aggctatttccactcttctcat

SEQ ID NO: 8387212 - DNA, 22 bp, Homo sapiens
acattgtatacagacttagtca

SEQ ID NO: 8387213 - DNA, 22 bp, Homo sapiens
aggctaggggcagtgccagcat

SEQ ID NO: 8387214 - DNA, 22 bp, Homo sapiens
acatttaaccctcaggtttctg

SEQ ID NO: 8387215 - DNA, 22 bp, Homo sapiens
acatttaaccaaactgtttaat

SEQ ID NO: 8387216 - DNA, 22 bp, Homo sapiens
acatttaaccaaactgtttaat

SEQ ID NO: 8387217 - DNA, 19 bp, Homo sapiens
acatttaaattcagatctc

SEQ ID NO: 8387218 - DNA, 22 bp, Homo sapiens
aggcctgcctggatcacacaga

SEQ ID NO: 8387219 - DNA, 22 bp, Homo sapiens
aggccttcctcggagacaggga

SEQ ID NO: 8387220 - DNA, 22 bp, Homo sapiens
aggccttaccatagctgtagca

SEQ ID NO: 8387221 - DNA, 22 bp, Homo sapiens
aggctagctaatgagtactgtg

SEQ ID NO: 8387222 - DNA, 22 bp, Homo sapiens
aggctagcaatgggagatgagt

SEQ ID NO: 8387223 - DNA, 22 bp, Homo sapiens
aggctagctgattgccttagaa

SEQ ID NO: 8387224 - DNA, 22 bp, Homo sapiens
acccgatgttggtgctctagta

SEQ ID NO: 8387225 - DNA, 22 bp, Homo sapiens
accccttttatagaagaacaga

SEQ ID NO: 8387226 - DNA, 22 bp, Homo sapiens
accccaggaagtggaggtcatg

SEQ ID NO: 8387227 - DNA, 17 bp, Homo sapiens
accctcaatctcctgca

SEQ ID NO: 8387228 - DNA, 22 bp, Homo sapiens
accctcaacaaattcactctat

SEQ ID NO: 8387229 - DNA, 22 bp, Homo sapiens
acccgtggttttatactacttc

SEQ ID NO: 8387230 - DNA, 22 bp, Homo sapiens
acccgcttccggagctgcagtg

SEQ ID NO: 8387231 - DNA, 22 bp, Homo sapiens
acccggagtcggaggttgcagt

SEQ ID NO: 8387232 - DNA, 22 bp, Homo sapiens
acccggcggagcctgcagtgag

SEQ ID NO: 8387233 - DNA, 22 bp, Homo sapiens
acccaggctgcttctcagtggc

SEQ ID NO: 8387234 - DNA, 22 bp, Homo sapiens
acccaggctggagtgcagtagc

SEQ ID NO: 8387235 - DNA, 22 bp, Homo sapiens
acccaggcctgagagacaggag

SEQ ID NO: 8387236 - DNA, 22 bp, Homo sapiens
acccaggcgggagtgcagtgtc

SEQ ID NO: 8387237 - DNA, 22 bp, Homo sapiens
acccaggctagagtgcagtggt

SEQ ID NO: 8387238 - DNA, 22 bp, Homo sapiens
acccaggctagaagtgaattat

SEQ ID NO: 8387239 - DNA, 18 bp, Homo sapiens
acccaggctcatggtcct

SEQ ID NO: 8387240 - DNA, 18 bp, Homo sapiens
acccaggctcatggtcct

SEQ ID NO: 8387241 - DNA, 22 bp, Homo sapiens
acccaggctagggtgcagtggc

SEQ ID NO: 8387242 - DNA, 22 bp, Homo sapiens
acccaagttttccatgcctgtt

SEQ ID NO: 8387243 - DNA, 22 bp, Homo sapiens
acccacacatctctaattcagt

SEQ ID NO: 8387244 - DNA, 22 bp, Homo sapiens
acccacacctccgtatatcact

SEQ ID NO: 8387245 - DNA, 22 bp, Homo sapiens
agggagctcagttggaagcggt

SEQ ID NO: 8387246 - DNA, 22 bp, Homo sapiens
agggagctctaagtagagggac

SEQ ID NO: 8387247 - DNA, 22 bp, Homo sapiens
agggagctctaagtagagggac

SEQ ID NO: 8387248 - DNA, 22 bp, Homo sapiens
accatcagtactggatgctgac

SEQ ID NO: 8387249 - DNA, 22 bp, Homo sapiens
accattctgtctctttacaaat

SEQ ID NO: 8387250 - DNA, 22 bp, Homo sapiens
accatttaaggaaaatgtatca

SEQ ID NO: 8387251 - DNA, 22 bp, Homo sapiens
accatttaaggaaaatgtatca

SEQ ID NO: 8387252 - DNA, 22 bp, Homo sapiens
accatgtttagtgcagtgttca

SEQ ID NO: 8387253 - DNA, 22 bp, Homo sapiens
accaggcctagcaagtacatta

SEQ ID NO: 8387254 - DNA, 22 bp, Homo sapiens
agggacagtatccatctcacag

SEQ ID NO: 8387255 - DNA, 22 bp, Homo sapiens
agggacagtatccatctcacag

SEQ ID NO: 8387256 - DNA, 22 bp, Homo sapiens
agggacagtatccatctcacag

SEQ ID NO: 8387257 - DNA, 21 bp, Homo sapiens
agggacacacaggatggggct

SEQ ID NO: 8387258 - DNA, 22 bp, Homo sapiens
agggacagatgaatgactgagt

SEQ ID NO: 8387259 - DNA, 22 bp, Homo sapiens
agggacagatgaatgactgagt

SEQ ID NO: 8387260 - DNA, 22 bp, Homo sapiens
agggacagatgaatgactgagt

SEQ ID NO: 8387261 - DNA, 22 bp, Homo sapiens
agggacagatgaatgactgagt

SEQ ID NO: 8387262 - DNA, 22 bp, Homo sapiens
agggaagctgctgggtccacct

SEQ ID NO: 8387263 - DNA, 22 bp, Homo sapiens
agggaagccctggctgagaccc

SEQ ID NO: 8387264 - DNA, 22 bp, Homo sapiens
agggaagctgctgggtccacct

SEQ ID NO: 8387265 - DNA, 22 bp, Homo sapiens
agggaagccaagccttagagaa

SEQ ID NO: 8387266 - DNA, 22 bp, Homo sapiens
agggaagaggcaaggtttatgg

SEQ ID NO: 8387267 - DNA, 22 bp, Homo sapiens
agggaagcaggaatagctctga

SEQ ID NO: 8387268 - DNA, 22 bp, Homo sapiens
acattttttagagtcccacatt

SEQ ID NO: 8387269 - DNA, 22 bp, Homo sapiens
accaaaaattgtggggctgaat

SEQ ID NO: 8387270 - DNA, 22 bp, Homo sapiens
accaaaaagatatgttgaagcc

SEQ ID NO: 8387271 - DNA, 22 bp, Homo sapiens
acatttttgggttgatgtctga

SEQ ID NO: 8387272 - DNA, 21 bp, Homo sapiens
accaaaacctatactttctgt

SEQ ID NO: 8387273 - DNA, 22 bp, Homo sapiens
accaaaacctgctactaaagga

SEQ ID NO: 8387274 - DNA, 22 bp, Homo sapiens
acatttttcacatttgtagggt

SEQ ID NO: 8387275 - DNA, 22 bp, Homo sapiens
acatttttctaggaggcaaggt

SEQ ID NO: 8387276 - DNA, 22 bp, Homo sapiens
acatttgtcttctttcagatta

SEQ ID NO: 8387277 - DNA, 22 bp, Homo sapiens
acatttgtcttctttcagatta

SEQ ID NO: 8387278 - DNA, 22 bp, Homo sapiens
acatttttactgggcatctgca

SEQ ID NO: 8387279 - DNA, 22 bp, Homo sapiens
aggctggagtgtgcagtggcgc

SEQ ID NO: 8387280 - DNA, 22 bp, Homo sapiens
aggctggagtgtgcagtggcgc

SEQ ID NO: 8387281 - DNA, 22 bp, Homo sapiens
aggctggagtgtgcagtggcgc

SEQ ID NO: 8387282 - DNA, 19 bp, Homo sapiens
aggctggatgcccatctta

SEQ ID NO: 8387283 - DNA, 20 bp, Homo sapiens
aggctggcactcctggccag

SEQ ID NO: 8387284 - DNA, 22 bp, Homo sapiens
aggctggcaaggcagatgtgtg

SEQ ID NO: 8387285 - DNA, 22 bp, Homo sapiens
aggctggcagccacctcagcag

SEQ ID NO: 8387286 - DNA, 22 bp, Homo sapiens
aggctggcatacatttgttctt

SEQ ID NO: 8387287 - DNA, 22 bp, Homo sapiens
aggctggcagccacctcagcag

SEQ ID NO: 8387288 - DNA, 22 bp, Homo sapiens
agggaagaatcactgggatgtt

SEQ ID NO: 8387289 - DNA, 22 bp, Homo sapiens
agggaagaggaccagagtctct

SEQ ID NO: 8387290 - DNA, 22 bp, Homo sapiens
agggaagaggaccagagtctct

SEQ ID NO: 8387291 - DNA, 22 bp, Homo sapiens
agggaagagcttgcaagaaacc

SEQ ID NO: 8387292 - DNA, 22 bp, Homo sapiens
agggaagagcttgcaagaaacc

SEQ ID NO: 8387293 - DNA, 22 bp, Homo sapiens
agggaagagcttgcaagaaacc

SEQ ID NO: 8387294 - DNA, 22 bp, Homo sapiens
aggagtcaggaattatttatga

SEQ ID NO: 8387295 - DNA, 22 bp, Homo sapiens
acagtacaagcatgatacataa

SEQ ID NO: 8387296 - DNA, 22 bp, Homo sapiens
acagtacaccactgtgtacagt

SEQ ID NO: 8387297 - DNA, 22 bp, Homo sapiens
acagtacaaaacccaccagagg

SEQ ID NO: 8387298 - DNA, 17 bp, Homo sapiens
aggagtctcagatgagc

SEQ ID NO: 8387299 - DNA, 22 bp, Homo sapiens
aggagtctgttgaaatgtctat

SEQ ID NO: 8387300 - DNA, 22 bp, Homo sapiens
aggagtgagctttggggtcaga

SEQ ID NO: 8387301 - DNA, 22 bp, Homo sapiens
aggagtcattgagaggggtcct

SEQ ID NO: 8387302 - DNA, 22 bp, Homo sapiens
aggagtgctgcaagttgacaga

SEQ ID NO: 8387303 - DNA, 22 bp, Homo sapiens
aggagtgagtgtcctcagcaga

SEQ ID NO: 8387304 - DNA, 22 bp, Homo sapiens
aggagtgagtgtcctcagcaga

SEQ ID NO: 8387305 - DNA, 21 bp, Homo sapiens
acagtaaattccctgcaaaga

SEQ ID NO: 8387306 - DNA, 22 bp, Homo sapiens
aggaggaactcagaaagaaggt

SEQ ID NO: 8387307 - DNA, 20 bp, Homo sapiens
aggaggaagaaagcacactg

SEQ ID NO: 8387308 - DNA, 20 bp, Homo sapiens
aggaggaagaaagcacactg

SEQ ID NO: 8387309 - DNA, 22 bp, Homo sapiens
aggaggaaaaaggccacagcaa

SEQ ID NO: 8387310 - DNA, 22 bp, Homo sapiens
aggaggaaaaaggccacagcaa

SEQ ID NO: 8387311 - DNA, 22 bp, Homo sapiens
aggaggaaaaaggccacagcaa

SEQ ID NO: 8387312 - DNA, 22 bp, Homo sapiens
aggaggaaagaaggcccccagc

SEQ ID NO: 8387313 - DNA, 22 bp, Homo sapiens
acagggcaacctctgggagact

SEQ ID NO: 8387314 - DNA, 22 bp, Homo sapiens
acagggcaacctctgggagact

SEQ ID NO: 8387315 - DNA, 22 bp, Homo sapiens
acagggcaacctctgggagact

SEQ ID NO: 8387316 - DNA, 22 bp, Homo sapiens
acagggagtgcaattcatattg

SEQ ID NO: 8387317 - DNA, 22 bp, Homo sapiens
acagggagtctgaggggatagt

SEQ ID NO: 8387318 - DNA, 18 bp, Homo sapiens
acagggagggcgctgggg

SEQ ID NO: 8387319 - DNA, 18 bp, Homo sapiens
acagggagggcgctgggg

SEQ ID NO: 8387320 - DNA, 22 bp, Homo sapiens
acagggcacctgaggtaggaag

SEQ ID NO: 8387321 - DNA, 22 bp, Homo sapiens
acagggcacctgaggtaggaag

SEQ ID NO: 8387322 - DNA, 22 bp, Homo sapiens
acaggtggcataggcagtttga

SEQ ID NO: 8387323 - DNA, 22 bp, Homo sapiens
acaggtggcagaagcatttact

SEQ ID NO: 8387324 - DNA, 21 bp, Homo sapiens
aggagctgtgttagctggtcg

SEQ ID NO: 8387325 - DNA, 22 bp, Homo sapiens
acaggtggtctttgctcctttt

SEQ ID NO: 8387326 - DNA, 22 bp, Homo sapiens
aggagctggagtccaggcaagt

SEQ ID NO: 8387327 - DNA, 22 bp, Homo sapiens
acaggtggcttattggctgatt

SEQ ID NO: 8387328 - DNA, 22 bp, Homo sapiens
acagttattctttatgcaacca

SEQ ID NO: 8387329 - DNA, 22 bp, Homo sapiens
acagttcaagacatcagtatga

SEQ ID NO: 8387330 - DNA, 22 bp, Homo sapiens
acagttcaagcaagtttctgtt

SEQ ID NO: 8387331 - DNA, 22 bp, Homo sapiens
acagttattttcccagcattta

SEQ ID NO: 8387332 - DNA, 22 bp, Homo sapiens
acagttcactttttatatcaaa

SEQ ID NO: 8387333 - DNA, 22 bp, Homo sapiens
acagttcaagtcttagacaaca

SEQ ID NO: 8387334 - DNA, 22 bp, Homo sapiens
acagttcaagtcttagacaaca

SEQ ID NO: 8387335 - DNA, 22 bp, Homo sapiens
acagttaataagtagtaagtca

SEQ ID NO: 8387336 - DNA, 22 bp, Homo sapiens
acagttaagcagtatgatcaca

SEQ ID NO: 8387337 - DNA, 22 bp, Homo sapiens
acagttacatcacttactgaca

SEQ ID NO: 8387338 - DNA, 22 bp, Homo sapiens
acagttacattccagcaacatc

SEQ ID NO: 8387339 - DNA, 22 bp, Homo sapiens
acagttacatgattcttgtgag

SEQ ID NO: 8387340 - DNA, 22 bp, Homo sapiens
acagttacattaaacaaaagga

SEQ ID NO: 8387341 - DNA, 22 bp, Homo sapiens
acagttaccacttagcagttac

SEQ ID NO: 8387342 - DNA, 22 bp, Homo sapiens
acagttactcatagaagcactt

SEQ ID NO: 8387343 - DNA, 22 bp, Homo sapiens
acagttactcatagaagcactt

SEQ ID NO: 8387344 - DNA, 22 bp, Homo sapiens
acagtgcaaaccctcgggaaag

SEQ ID NO: 8387345 - DNA, 20 bp, Homo sapiens
acagtgtttttgagtagagc

SEQ ID NO: 8387346 - DNA, 22 bp, Homo sapiens
acagtgttttagaaaagcttga

SEQ ID NO: 8387347 - DNA, 22 bp, Homo sapiens
acagtgcacatcctgagtgatt

SEQ ID NO: 8387348 - DNA, 22 bp, Homo sapiens
acagtgcaaacttttgtctcct

SEQ ID NO: 8387349 - DNA, 22 bp, Homo sapiens
acagtgcaaataggactgtctt

SEQ ID NO: 8387350 - DNA, 19 bp, Homo sapiens
acagtttgggaaatgagca

SEQ ID NO: 8387351 - DNA, 22 bp, Homo sapiens
acagtttggcgtgattgatagt

SEQ ID NO: 8387352 - DNA, 22 bp, Homo sapiens
acagtttggcgtgattgatagt

SEQ ID NO: 8387353 - DNA, 22 bp, Homo sapiens
aggcagcattcaggggtgatga

SEQ ID NO: 8387354 - DNA, 22 bp, Homo sapiens
aggcagcatgggccccagctcc

SEQ ID NO: 8387355 - DNA, 22 bp, Homo sapiens
aggcagcatccagaggagaatg

SEQ ID NO: 8387356 - DNA, 19 bp, Homo sapiens
aggcagcacccagtccttg

SEQ ID NO: 8387357 - DNA, 22 bp, Homo sapiens
aggcagcatgctctgcttctac

SEQ ID NO: 8387358 - DNA, 22 bp, Homo sapiens
aggcagcatgctctgcttctac

SEQ ID NO: 8387359 - DNA, 22 bp, Homo sapiens
aggcagcatgggcccagagtcc

SEQ ID NO: 8387360 - DNA, 22 bp, Homo sapiens
aggcaggcaaccacctgggaag

SEQ ID NO: 8387361 - DNA, 22 bp, Homo sapiens
aggcaggcaaccacctgggaag

SEQ ID NO: 8387362 - DNA, 22 bp, Homo sapiens
aggcaggcaaccacctgggaag

SEQ ID NO: 8387363 - DNA, 22 bp, Homo sapiens
aggcaggattgctgacaacaat

SEQ ID NO: 8387364 - DNA, 22 bp, Homo sapiens
aggcaggattgctgacaacaat

SEQ ID NO: 8387365 - DNA, 22 bp, Homo sapiens
acagtttgtgttggccatgggc

SEQ ID NO: 8387366 - DNA, 21 bp, Homo sapiens
acagttttaaggagcacatgg

SEQ ID NO: 8387367 - DNA, 22 bp, Homo sapiens
acataaagtactgagagactct

SEQ ID NO: 8387368 - DNA, 22 bp, Homo sapiens
acagttttttcaacattggaat

SEQ ID NO: 8387369 - DNA, 22 bp, Homo sapiens
acataaatagattattgggagg

SEQ ID NO: 8387370 - DNA, 22 bp, Homo sapiens
aggcagctggcaaattctagag

SEQ ID NO: 8387371 - DNA, 22 bp, Homo sapiens
acaggcctagctaatgctttcc

SEQ ID NO: 8387372 - DNA, 22 bp, Homo sapiens
acaggcctacgaagtcaggtgc

SEQ ID NO: 8387373 - DNA, 22 bp, Homo sapiens
acaggcctatgttccattgcag

SEQ ID NO: 8387374 - DNA, 22 bp, Homo sapiens
acaggcctagggtcaatttcct

SEQ ID NO: 8387375 - DNA, 18 bp, Homo sapiens
acaggcctcagtcctgca

SEQ ID NO: 8387376 - DNA, 22 bp, Homo sapiens
acaggcctcaagacacccaggt

SEQ ID NO: 8387377 - DNA, 22 bp, Homo sapiens
acaggcctcaaatagggtgcct

SEQ ID NO: 8387378 - DNA, 22 bp, Homo sapiens
acaggcctgacacacagagggc

SEQ ID NO: 8387379 - DNA, 22 bp, Homo sapiens
acaggcctcccatccggagccc

SEQ ID NO: 8387380 - DNA, 22 bp, Homo sapiens
acaggcctgatgccttggctgg

SEQ ID NO: 8387381 - DNA, 22 bp, Homo sapiens
acaggcctgagattttgcattt

SEQ ID NO: 8387382 - DNA, 22 bp, Homo sapiens
acaggcctgatgttatcctatt

SEQ ID NO: 8387383 - DNA, 17 bp, Homo sapiens
acaggcctgcttgcact

SEQ ID NO: 8387384 - DNA, 22 bp, Homo sapiens
acaggcctgggttcaaatttgg

SEQ ID NO: 8387385 - DNA, 22 bp, Homo sapiens
acaggcctggaaaggaaggagt

SEQ ID NO: 8387386 - DNA, 22 bp, Homo sapiens
acaggcctggggtacaagttct

SEQ ID NO: 8387387 - DNA, 22 bp, Homo sapiens
acagcttagccagtcaagctct

SEQ ID NO: 8387388 - DNA, 22 bp, Homo sapiens
acagcttcacccattatccctg

SEQ ID NO: 8387389 - DNA, 22 bp, Homo sapiens
acagctgtggggactcttgccc

SEQ ID NO: 8387390 - DNA, 22 bp, Homo sapiens
acaggcccagctcttcaccaga

SEQ ID NO: 8387391 - DNA, 22 bp, Homo sapiens
acagctgtgggctctgcatata

SEQ ID NO: 8387392 - DNA, 22 bp, Homo sapiens
acagctgtgggctctgcatata

SEQ ID NO: 8387393 - DNA, 22 bp, Homo sapiens
acagctgtgacttagagaagtt

SEQ ID NO: 8387394 - DNA, 19 bp, Homo sapiens
aggaatggaattaattctg

SEQ ID NO: 8387395 - DNA, 22 bp, Homo sapiens
aggaatgtcatagaataatcat

SEQ ID NO: 8387396 - DNA, 22 bp, Homo sapiens
aggaagggctgtttctccaaga

SEQ ID NO: 8387397 - DNA, 22 bp, Homo sapiens
aggaatgacttgtagctctgag

SEQ ID NO: 8387398 - DNA, 22 bp, Homo sapiens
agctttatgggagcttagataa

SEQ ID NO: 8387399 - DNA, 22 bp, Homo sapiens
acaggctctggggcaggatggc

SEQ ID NO: 8387400 - DNA, 22 bp, Homo sapiens
acaggctgccacttgcatccaa

SEQ ID NO: 8387401 - DNA, 22 bp, Homo sapiens
acaggctgctgggctccgtgct

SEQ ID NO: 8387402 - DNA, 22 bp, Homo sapiens
agctgctcacagggattcatgc

SEQ ID NO: 8387403 - DNA, 22 bp, Homo sapiens
acagcctgcagccccaggtcgc

SEQ ID NO: 8387404 - DNA, 22 bp, Homo sapiens
acagcctgctgcctgcttcttg

SEQ ID NO: 8387405 - DNA, 22 bp, Homo sapiens
agctgccttttgagaaagctca

SEQ ID NO: 8387406 - DNA, 22 bp, Homo sapiens
agctgccttccctctcattagg

SEQ ID NO: 8387407 - DNA, 17 bp, Homo sapiens
agctgccttgcttgagc

SEQ ID NO: 8387408 - DNA, 20 bp, Homo sapiens
agctgccttcattttctaga

SEQ ID NO: 8387409 - DNA, 22 bp, Homo sapiens
agctgcccccagggctgtgctt

SEQ ID NO: 8387410 - DNA, 22 bp, Homo sapiens
agctgccatcagcctttggatg

SEQ ID NO: 8387411 - DNA, 22 bp, Homo sapiens
agctgccaggcccctgagaacc

SEQ ID NO: 8387412 - DNA, 17 bp, Homo sapiens
agctgccagggagtgtg

SEQ ID NO: 8387413 - DNA, 22 bp, Homo sapiens
agctgcaggcccatgctcagtc

SEQ ID NO: 8387414 - DNA, 22 bp, Homo sapiens
acagcagacagtcggcttcctg

SEQ ID NO: 8387415 - DNA, 22 bp, Homo sapiens
acagcactttacttctcagtga

SEQ ID NO: 8387416 - DNA, 22 bp, Homo sapiens
acagcactttacttctcagtga

SEQ ID NO: 8387417 - DNA, 22 bp, Homo sapiens
acagcacttattcagcacagtg

SEQ ID NO: 8387418 - DNA, 22 bp, Homo sapiens
acagctaatccccctagattct

SEQ ID NO: 8387419 - DNA, 22 bp, Homo sapiens
acagctaatccccctagattct

SEQ ID NO: 8387420 - DNA, 22 bp, Homo sapiens
acagctcactcacagggctagt

SEQ ID NO: 8387421 - DNA, 22 bp, Homo sapiens
acagctcagacatcactgctct

SEQ ID NO: 8387422 - DNA, 22 bp, Homo sapiens
acagctctgagatattactatt

SEQ ID NO: 8387423 - DNA, 23 bp, Homo sapiens
acagctgcacctggccgcctggc

SEQ ID NO: 8387424 - DNA, 22 bp, Homo sapiens
acagctgcacactgaacttggt

SEQ ID NO: 8387425 - DNA, 22 bp, Homo sapiens
aacatattcagatgccaagtcc

SEQ ID NO: 8387426 - DNA, 22 bp, Homo sapiens
aacatatcataggatgtcattg

SEQ ID NO: 8387427 - DNA, 22 bp, Homo sapiens
aacatcatcatgaacaactaat

SEQ ID NO: 8387428 - DNA, 19 bp, Homo sapiens
aacatcatggctctttcca

SEQ ID NO: 8387429 - DNA, 22 bp, Homo sapiens
aacatccccagcgtctcctagg

SEQ ID NO: 8387430 - DNA, 22 bp, Homo sapiens
aacatcagaagtagaagactca

SEQ ID NO: 8387431 - DNA, 22 bp, Homo sapiens
aacatcagaagtagaagactca

SEQ ID NO: 8387432 - DNA, 22 bp, Homo sapiens
aacatatttggctgatattccc

SEQ ID NO: 8387433 - DNA, 22 bp, Homo sapiens
aacatcagcacacaatagcaag

SEQ ID NO: 8387434 - DNA, 22 bp, Homo sapiens
aagtgtctagcacctggatgca

SEQ ID NO: 8387435 - DNA, 22 bp, Homo sapiens
aacagcgacgtcctccccaaca

SEQ ID NO: 8387436 - DNA, 22 bp, Homo sapiens
aacagcctgagagaacaatgat

SEQ ID NO: 8387437 - DNA, 22 bp, Homo sapiens
aagtgtcaatatttttgtaggt

SEQ ID NO: 8387438 - DNA, 22 bp, Homo sapiens
aacagctaccttctcactgtgc

SEQ ID NO: 8387439 - DNA, 22 bp, Homo sapiens
aacagctattagaacttcatgg

SEQ ID NO: 8387440 - DNA, 22 bp, Homo sapiens
aacagctagtggtctagacttt

SEQ ID NO: 8387441 - DNA, 20 bp, Homo sapiens
aacagctctcgacttatctt

SEQ ID NO: 8387442 - DNA, 22 bp, Homo sapiens
aacagctgcaaaaggttgcctg

SEQ ID NO: 8387443 - DNA, 20 bp, Homo sapiens
aacagctctcgacttatctt

SEQ ID NO: 8387444 - DNA, 22 bp, Homo sapiens
aatagacaattctagccaacat

SEQ ID NO: 8387445 - DNA, 19 bp, Homo sapiens
aatagattaattatcctct

SEQ ID NO: 8387446 - DNA, 19 bp, Homo sapiens
aatagattaattatcctct

SEQ ID NO: 8387447 - DNA, 22 bp, Homo sapiens
aatagagtcagttctacattct

SEQ ID NO: 8387448 - DNA, 22 bp, Homo sapiens
aacatgtaaccagcattcatct

SEQ ID NO: 8387449 - DNA, 22 bp, Homo sapiens
aacatgtacctacaatcagaat

SEQ ID NO: 8387450 - DNA, 22 bp, Homo sapiens
aacatgtcttactttgctttct

SEQ ID NO: 8387451 - DNA, 22 bp, Homo sapiens
aacatgtacctacaatcagaat

SEQ ID NO: 8387452 - DNA, 22 bp, Homo sapiens
aacatgtagcagaaacgactaa

SEQ ID NO: 8387453 - DNA, 22 bp, Homo sapiens
aacatcttgtccttagattaaa

SEQ ID NO: 8387454 - DNA, 22 bp, Homo sapiens
aacatcttgtctaatgtcagct

SEQ ID NO: 8387455 - DNA, 22 bp, Homo sapiens
aacatcttcagagaagctaagt

SEQ ID NO: 8387456 - DNA, 22 bp, Homo sapiens
aacatcttatctgcatgatccc

SEQ ID NO: 8387457 - DNA, 22 bp, Homo sapiens
aacatctttgccaaattgctat

SEQ ID NO: 8387458 - DNA, 22 bp, Homo sapiens
aacatctttgataaacttagtg

SEQ ID NO: 8387459 - DNA, 22 bp, Homo sapiens
aacatctttttgtttgctgaaa

SEQ ID NO: 8387460 - DNA, 22 bp, Homo sapiens
aatagacaagcaccctggtaaa

SEQ ID NO: 8387461 - DNA, 22 bp, Homo sapiens
aacctcatttccttctttgtaa

SEQ ID NO: 8387462 - DNA, 22 bp, Homo sapiens
aacctcataggacttgaacata

SEQ ID NO: 8387463 - DNA, 22 bp, Homo sapiens
aacctcaaactcttgggcttaa

SEQ ID NO: 8387464 - DNA, 22 bp, Homo sapiens
aacccgtgatcctgactcccct

SEQ ID NO: 8387465 - DNA, 22 bp, Homo sapiens
aaccctttgttcggtgttctgg

SEQ ID NO: 8387466 - DNA, 22 bp, Homo sapiens
aaccgttttaccatttgtaact

SEQ ID NO: 8387467 - DNA, 22 bp, Homo sapiens
aacatgttgagttgaaagtagc

SEQ ID NO: 8387468 - DNA, 22 bp, Homo sapiens
aacatgttgctttaataatatt

SEQ ID NO: 8387469 - DNA, 22 bp, Homo sapiens
aacccacaaaggatttcagctc

SEQ ID NO: 8387470 - DNA, 22 bp, Homo sapiens
aacccgtgatcctgactcccct

SEQ ID NO: 8387471 - DNA, 22 bp, Homo sapiens
aaccttttgcaagtgccttgac

SEQ ID NO: 8387472 - DNA, 22 bp, Homo sapiens
aatgaattcgagtgaaggaaag

SEQ ID NO: 8387473 - DNA, 23 bp, Homo sapiens
aacgacagctacaggcatcccac

SEQ ID NO: 8387474 - DNA, 23 bp, Homo sapiens
aacctgaactagggtcttgcata

SEQ ID NO: 8387475 - DNA, 22 bp, Homo sapiens
aacctgaatttaattgaaatga

SEQ ID NO: 8387476 - DNA, 22 bp, Homo sapiens
aacctgaattacttttgcacca

SEQ ID NO: 8387477 - DNA, 22 bp, Homo sapiens
aacctgaaagtagtaaaagctg

SEQ ID NO: 8387478 - DNA, 22 bp, Homo sapiens
aacctgaaactacattcttgat

SEQ ID NO: 8387479 - DNA, 22 bp, Homo sapiens
aacctgaagaaaatatttgctg

SEQ ID NO: 8387480 - DNA, 22 bp, Homo sapiens
aactagaaaacaagatgctgat

SEQ ID NO: 8387481 - DNA, 22 bp, Homo sapiens
aatgacagtgttgggccagatg

SEQ ID NO: 8387482 - DNA, 23 bp, Homo sapiens
aatgacaggcaatgtaattgtgt

SEQ ID NO: 8387483 - DNA, 22 bp, Homo sapiens
aatgacagccctctagtctggg

SEQ ID NO: 8387484 - DNA, 22 bp, Homo sapiens
aactaggagtttttcttgagaa

SEQ ID NO: 8387485 - DNA, 22 bp, Homo sapiens
aatgctttcttataaccactgc

SEQ ID NO: 8387486 - DNA, 22 bp, Homo sapiens
aatgctttcttataaccactgc

SEQ ID NO: 8387487 - DNA, 22 bp, Homo sapiens
aatggcttgcaaatgggtccat

SEQ ID NO: 8387488 - DNA, 22 bp, Homo sapiens
aatggcttctttttggtataat

SEQ ID NO: 8387489 - DNA, 22 bp, Homo sapiens
aatggcttctgaagcacacttt

SEQ ID NO: 8387490 - DNA, 22 bp, Homo sapiens
aatggctgggtttcattttgta

SEQ ID NO: 8387491 - DNA, 22 bp, Homo sapiens
aatggcttagctcagcgctcag

SEQ ID NO: 8387492 - DNA, 22 bp, Homo sapiens
aatggctctgatgttgttgtga

SEQ ID NO: 8387493 - DNA, 22 bp, Homo sapiens
aaggcagcaagaattccaggtt

SEQ ID NO: 8387494 - DNA, 22 bp, Homo sapiens
aaggcagccagatcctttgggt

SEQ ID NO: 8387495 - DNA, 22 bp, Homo sapiens
aaggcagcatgaatccctgtac

SEQ ID NO: 8387496 - DNA, 19 bp, Homo sapiens
aaggcagcagtagcatcca

SEQ ID NO: 8387497 - DNA, 22 bp, Homo sapiens
aaattattcaaaaagctgtgtt

SEQ ID NO: 8387498 - DNA, 22 bp, Homo sapiens
aaggcagccctggctcagcctg

SEQ ID NO: 8387499 - DNA, 22 bp, Homo sapiens
aaggcagccctggctcagcctg

SEQ ID NO: 8387500 - DNA, 19 bp, Homo sapiens
aaggctggtaccataggtt

SEQ ID NO: 8387501 - DNA, 22 bp, Homo sapiens
aaggctgggtttgggatgtgat

SEQ ID NO: 8387502 - DNA, 22 bp, Homo sapiens
aaggctggggtgcagacggcct

SEQ ID NO: 8387503 - DNA, 22 bp, Homo sapiens
aaggctgggtaacctgtccact

SEQ ID NO: 8387504 - DNA, 21 bp, Homo sapiens
aaattcacctagtaaaacttc

SEQ ID NO: 8387505 - DNA, 22 bp, Homo sapiens
aaattcacaagagcattgcctg

SEQ ID NO: 8387506 - DNA, 22 bp, Homo sapiens
aaattattctcatgtgtttctt

SEQ ID NO: 8387507 - DNA, 18 bp, Homo sapiens
aaattattcttccttttc

SEQ ID NO: 8387508 - DNA, 23 bp, Homo sapiens
aaattattgctcttcaattgcct

SEQ ID NO: 8387509 - DNA, 22 bp, Homo sapiens
aaattcaattaactttcatgct

SEQ ID NO: 8387510 - DNA, 22 bp, Homo sapiens
aaattattgggtcccaccccag

SEQ ID NO: 8387511 - DNA, 22 bp, Homo sapiens
aaattattttcagaatggagaa

SEQ ID NO: 8387512 - DNA, 22 bp, Homo sapiens
aaattattttcagaatggagaa

SEQ ID NO: 8387513 - DNA, 22 bp, Homo sapiens
aaggaaagacaggacggaattc

SEQ ID NO: 8387514 - DNA, 22 bp, Homo sapiens
aaggaagacacagatgaagtga

SEQ ID NO: 8387515 - DNA, 22 bp, Homo sapiens
aaggaagacacagatgaagtga

SEQ ID NO: 8387516 - DNA, 22 bp, Homo sapiens
aaggaagactcgcaggtctatg

SEQ ID NO: 8387517 - DNA, 22 bp, Homo sapiens
aaggaagactcgcaggtctatg

SEQ ID NO: 8387518 - DNA, 22 bp, Homo sapiens
aaggaagagcaaagaattatgt

SEQ ID NO: 8387519 - DNA, 22 bp, Homo sapiens
aaatgcattggtttctacttgt

SEQ ID NO: 8387520 - DNA, 22 bp, Homo sapiens
aaatgcatgtatgtaatatgct

SEQ ID NO: 8387521 - DNA, 22 bp, Homo sapiens
aaatgtcagaaaacatggagtg

SEQ ID NO: 8387522 - DNA, 22 bp, Homo sapiens
aaatgtcaaggtgatagatgca

SEQ ID NO: 8387523 - DNA, 22 bp, Homo sapiens
aaatgtcagaggaacatattga

SEQ ID NO: 8387524 - DNA, 22 bp, Homo sapiens
aaatgtctactcctgtgtttat

SEQ ID NO: 8387525 - DNA, 22 bp, Homo sapiens
aaatgtctactcctgtgtttat

SEQ ID NO: 8387526 - DNA, 22 bp, Homo sapiens
aaatgtcatatttaagtaggaa

SEQ ID NO: 8387527 - DNA, 22 bp, Homo sapiens
aacacagaagtgccaagagcca

SEQ ID NO: 8387528 - DNA, 22 bp, Homo sapiens
aacacagagtatttgaagcatt

SEQ ID NO: 8387529 - DNA, 22 bp, Homo sapiens
aaggctggtcagatgtggtgaa

SEQ ID NO: 8387530 - DNA, 22 bp, Homo sapiens
aaggctggtggattatgaggtc

SEQ ID NO: 8387531 - DNA, 22 bp, Homo sapiens
aaggctggttccatccctggtg

SEQ ID NO: 8387532 - DNA, 22 bp, Homo sapiens
aaatttctaagtcaagaagaac

SEQ ID NO: 8387533 - DNA, 22 bp, Homo sapiens
aaattttaaggctggaacttaa

SEQ ID NO: 8387534 - DNA, 22 bp, Homo sapiens
aacaatgtgaagtgctgttcag

SEQ ID NO: 8387535 - DNA, 22 bp, Homo sapiens
aacaatgtaatctactctgctc

SEQ ID NO: 8387536 - DNA, 22 bp, Homo sapiens
aaatttgataagccattgttac

SEQ ID NO: 8387537 - DNA, 22 bp, Homo sapiens
aaatttcttgaggctctctagc

SEQ ID NO: 8387538 - DNA, 22 bp, Homo sapiens
aaatttctgttgttttgagcca

SEQ ID NO: 8387539 - DNA, 22 bp, Homo sapiens
aacacagttagtaagggaaata

SEQ ID NO: 8387540 - DNA, 20 bp, Homo sapiens
aacacagggttaccatcaga

SEQ ID NO: 8387541 - DNA, 22 bp, Homo sapiens
aacacagtttctctatgagagt

SEQ ID NO: 8387542 - DNA, 22 bp, Homo sapiens
aacacagttttccaaaatagag

SEQ ID NO: 8387543 - DNA, 22 bp, Homo sapiens
aacactgtatcagtcttcaata

SEQ ID NO: 8387544 - DNA, 22 bp, Homo sapiens
aacactttttatatattgtatc

SEQ ID NO: 8387545 - DNA, 22 bp, Homo sapiens
aacactttcttccttgctcagg

SEQ ID NO: 8387546 - DNA, 22 bp, Homo sapiens
aacagagaggccacctcagcag

SEQ ID NO: 8387547 - DNA, 22 bp, Homo sapiens
aacagagaggccacctcagcag

SEQ ID NO: 8387548 - DNA, 22 bp, Homo sapiens
aacagacaactcctgtggctca

SEQ ID NO: 8387549 - DNA, 22 bp, Homo sapiens
aacagacaactcctgtggctca

SEQ ID NO: 8387550 - DNA, 22 bp, Homo sapiens
aacagacatatttttaatatgc

SEQ ID NO: 8387551 - DNA, 22 bp, Homo sapiens
aacagacagaaaaatgtgatct

SEQ ID NO: 8387552 - DNA, 22 bp, Homo sapiens
aagaaatgtgaatattgaatag

SEQ ID NO: 8387553 - DNA, 22 bp, Homo sapiens
aagaaattaatgtgccattact

SEQ ID NO: 8387554 - DNA, 22 bp, Homo sapiens
aagaaattaaggaatgcaacga

SEQ ID NO: 8387555 - DNA, 22 bp, Homo sapiens
aagaacaactgctttaaaagca

SEQ ID NO: 8387556 - DNA, 17 bp, Homo sapiens
aagaacactcaatagca

SEQ ID NO: 8387557 - DNA, 17 bp, Homo sapiens
aagaacactcaatagca

SEQ ID NO: 8387558 - DNA, 22 bp, Homo sapiens
aatttaaggaggccttcactct

SEQ ID NO: 8387559 - DNA, 22 bp, Homo sapiens
aattctctccagggtaacatca

SEQ ID NO: 8387560 - DNA, 20 bp, Homo sapiens
aagaaacttgaaagtacaag

SEQ ID NO: 8387561 - DNA, 22 bp, Homo sapiens
aagaaagagatcactcctccat

SEQ ID NO: 8387562 - DNA, 20 bp, Homo sapiens
aagaaacttgaaagtacaag

SEQ ID NO: 8387563 - DNA, 20 bp, Homo sapiens
aagaaacttgaaagtacaag

SEQ ID NO: 8387564 - DNA, 22 bp, Homo sapiens
aagaaagagatcactcctccat

SEQ ID NO: 8387565 - DNA, 22 bp, Homo sapiens
aagaaagataaggtttgcttgg

SEQ ID NO: 8387566 - DNA, 22 bp, Homo sapiens
aagaaagataaggtttgcttgg

SEQ ID NO: 8387567 - DNA, 22 bp, Homo sapiens
aattcccatttgcagaaaatca

SEQ ID NO: 8387568 - DNA, 22 bp, Homo sapiens
aattcacaatgtgtagtcatgc

SEQ ID NO: 8387569 - DNA, 22 bp, Homo sapiens
aattcacaattatgttgggaga

SEQ ID NO: 8387570 - DNA, 22 bp, Homo sapiens
aagaaaacaatgacttgccagc

SEQ ID NO: 8387571 - DNA, 22 bp, Homo sapiens
aagaaaacaatgacttgccagc

SEQ ID NO: 8387572 - DNA, 22 bp, Homo sapiens
aagaaaacatgatctaatttaa

SEQ ID NO: 8387573 - DNA, 20 bp, Homo sapiens
aagaaaacgtcttcagggga

SEQ ID NO: 8387574 - DNA, 22 bp, Homo sapiens
aagaaaacgttttgaggagttt

SEQ ID NO: 8387575 - DNA, 22 bp, Homo sapiens
aagaaaagaaacctgaggcttt

SEQ ID NO: 8387576 - DNA, 22 bp, Homo sapiens
aagaaaagaaacctgaggcttt

SEQ ID NO: 8387577 - DNA, 22 bp, Homo sapiens
aagaaaagatgtttggttttca

SEQ ID NO: 8387578 - DNA, 22 bp, Homo sapiens
aagaaaaggtaaccgcttatct

SEQ ID NO: 8387579 - DNA, 22 bp, Homo sapiens
aagaaaaggtaaccgcttatct

SEQ ID NO: 8387580 - DNA, 22 bp, Homo sapiens
aagaaaagatgtttggttttca

SEQ ID NO: 8387581 - DNA, 22 bp, Homo sapiens
aagaaaaggtaaccgcttatct

SEQ ID NO: 8387582 - DNA, 22 bp, Homo sapiens
aagaaactggaatatagagagc

SEQ ID NO: 8387583 - DNA, 22 bp, Homo sapiens
aagaaactgaaagtggcttcat

SEQ ID NO: 8387584 - DNA, 22 bp, Homo sapiens
aagaaacgtttgagctttgact

SEQ ID NO: 8387585 - DNA, 22 bp, Homo sapiens
aagaaactggaatatagagagc

SEQ ID NO: 8387586 - DNA, 22 bp, Homo sapiens
aagaaacaaccactgctctcct

SEQ ID NO: 8387587 - DNA, 22 bp, Homo sapiens
aagaaacaaccactgctctcct

SEQ ID NO: 8387588 - DNA, 22 bp, Homo sapiens
aagaaacaaccactgctctcct

SEQ ID NO: 8387589 - DNA, 22 bp, Homo sapiens
aagaaaatcagttctggtcagt

SEQ ID NO: 8387590 - DNA, 22 bp, Homo sapiens
aactggaaccttttattcagtc

SEQ ID NO: 8387591 - DNA, 22 bp, Homo sapiens
aactggaaccttttattcagtc

SEQ ID NO: 8387592 - DNA, 22 bp, Homo sapiens
aactggaaagatcagtaggaag

SEQ ID NO: 8387593 - DNA, 22 bp, Homo sapiens
aatggctttgacattttcaaat

SEQ ID NO: 8387594 - DNA, 22 bp, Homo sapiens
aatggctttggtctgggtccca

SEQ ID NO: 8387595 - DNA, 22 bp, Homo sapiens
aatggcttttgcacttaaatcg

SEQ ID NO: 8387596 - DNA, 22 bp, Homo sapiens
aatggcttttgcacttaaatcg

SEQ ID NO: 8387597 - DNA, 19 bp, Homo sapiens
aactggataatggccacat

SEQ ID NO: 8387598 - DNA, 22 bp, Homo sapiens
aactggacactggtctgtactg

SEQ ID NO: 8387599 - DNA, 22 bp, Homo sapiens
aactggaatgaaatttacgatg

SEQ ID NO: 8387600 - DNA, 22 bp, Homo sapiens
aagagacaatgtcttttggata

SEQ ID NO: 8387601 - DNA, 22 bp, Homo sapiens
aagagaatacaagcaggcagga

SEQ ID NO: 8387602 - DNA, 22 bp, Homo sapiens
aagagaatatcgatagcactct

SEQ ID NO: 8387603 - DNA, 22 bp, Homo sapiens
aagagaaggccctgacccaccc

SEQ ID NO: 8387604 - DNA, 21 bp, Homo sapiens
aagagacatttctcatcagca

SEQ ID NO: 8387605 - DNA, 22 bp, Homo sapiens
aagagcaacttggaaacactca

SEQ ID NO: 8387606 - DNA, 22 bp, Homo sapiens
aagagcagattcctagtggagc

SEQ ID NO: 8387607 - DNA, 22 bp, Homo sapiens
acacaaagttggatgacaaaat

SEQ ID NO: 8387608 - DNA, 22 bp, Homo sapiens
acacaaagttggatgacaaaat

SEQ ID NO: 8387609 - DNA, 22 bp, Homo sapiens
acacaaagttggatgacaaaat

SEQ ID NO: 8387610 - DNA, 22 bp, Homo sapiens
acacaaacagtctatagcacca

SEQ ID NO: 8387611 - DNA, 22 bp, Homo sapiens
acacaaacagtctatagcacca

SEQ ID NO: 8387612 - DNA, 22 bp, Homo sapiens
acacaaaatcaaagtcctaggc

SEQ ID NO: 8387613 - DNA, 21 bp, Homo sapiens
aatttcagacccattttgcct

SEQ ID NO: 8387614 - DNA, 21 bp, Homo sapiens
aatttcagacccattttgcct

SEQ ID NO: 8387615 - DNA, 22 bp, Homo sapiens
aatttcagatattaaagaatga

SEQ ID NO: 8387616 - DNA, 22 bp, Homo sapiens
aatttcagatattaaagaatga

SEQ ID NO: 8387617 - DNA, 22 bp, Homo sapiens
aatttcagaacccaaattagcg

SEQ ID NO: 8387618 - DNA, 22 bp, Homo sapiens
aatttcagaacccaaattagcg

SEQ ID NO: 8387619 - DNA, 22 bp, Homo sapiens
aatttcagaccatttgcaatta

SEQ ID NO: 8387620 - DNA, 22 bp, Homo sapiens
aatttcagtatgaagtttcaca

SEQ ID NO: 8387621 - DNA, 22 bp, Homo sapiens
aatttcagttgctaataagttc

SEQ ID NO: 8387622 - DNA, 22 bp, Homo sapiens
aatttcagatgtcataaatata

SEQ ID NO: 8387623 - DNA, 22 bp, Homo sapiens
aatttcagatgtcataaatata

SEQ ID NO: 8387624 - DNA, 22 bp, Homo sapiens
aattttaatcagtggtgctgag

SEQ ID NO: 8387625 - DNA, 22 bp, Homo sapiens
aattttaagcatatgactggtt

SEQ ID NO: 8387626 - DNA, 22 bp, Homo sapiens
aattttaatcagtggtgctgag

SEQ ID NO: 8387627 - DNA, 22 bp, Homo sapiens
aagagaaggattctgagcctgg

SEQ ID NO: 8387628 - DNA, 22 bp, Homo sapiens
aagagaaggattctgagcctgg

SEQ ID NO: 8387629 - DNA, 22 bp, Homo sapiens
aagagaagaaagtgtctacaca

SEQ ID NO: 8387630 - DNA, 22 bp, Homo sapiens
aagagaagaaagtgtctacaca

SEQ ID NO: 8387631 - DNA, 22 bp, Homo sapiens
aagactttctgtaaagctacag

SEQ ID NO: 8387632 - DNA, 22 bp, Homo sapiens
aagagaaagcagactttgtcat

SEQ ID NO: 8387633 - DNA, 22 bp, Homo sapiens
aagagaaagcagactttgtcat

SEQ ID NO: 8387634 - DNA, 22 bp, Homo sapiens
aagagaagaaagtgtctacaca

SEQ ID NO: 8387635 - DNA, 22 bp, Homo sapiens
aagagaacagtcaccatgcaca

SEQ ID NO: 8387636 - DNA, 22 bp, Homo sapiens
aagacttgaccaggttgaaggc

SEQ ID NO: 8387637 - DNA, 22 bp, Homo sapiens
aagaccatttaatggagaaaga

SEQ ID NO: 8387638 - DNA, 22 bp, Homo sapiens
aagaccatcacagagacacttg

SEQ ID NO: 8387639 - DNA, 22 bp, Homo sapiens
aattttatctctaagcaggctt

SEQ ID NO: 8387640 - DNA, 22 bp, Homo sapiens
aagaccataatgtaagatgaat

SEQ ID NO: 8387641 - DNA, 20 bp, Homo sapiens
aattttatctccatcctttg

SEQ ID NO: 8387642 - DNA, 20 bp, Homo sapiens
aattttatctccatcctttg

SEQ ID NO: 8387643 - DNA, 22 bp, Homo sapiens
acagcagagtggagatgagcac

SEQ ID NO: 8387644 - DNA, 22 bp, Homo sapiens
acagcagagtggagatgagcac

SEQ ID NO: 8387645 - DNA, 22 bp, Homo sapiens
acagcctggactggctctctgc

SEQ ID NO: 8387646 - DNA, 22 bp, Homo sapiens
acagcctggactggctctctgc

SEQ ID NO: 8387647 - DNA, 22 bp, Homo sapiens
acagcctgctgcctgcttcttg

SEQ ID NO: 8387648 - DNA, 22 bp, Homo sapiens
aagcagcttccccaaagtgcct

SEQ ID NO: 8387649 - DNA, 22 bp, Homo sapiens
acagcagaccccagtgccatgg

SEQ ID NO: 8387650 - DNA, 22 bp, Homo sapiens
aagcagaggccacagagtgggc

SEQ ID NO: 8387651 - DNA, 22 bp, Homo sapiens
aagcagagggtatggccaggtt

SEQ ID NO: 8387652 - DNA, 22 bp, Homo sapiens
aagcagaggaccgacggaggga

SEQ ID NO: 8387653 - DNA, 22 bp, Homo sapiens
aagcagaggccacagagtgggc

SEQ ID NO: 8387654 - DNA, 22 bp, Homo sapiens
aagcagagaatctgggagcgag

SEQ ID NO: 8387655 - DNA, 22 bp, Homo sapiens
aagcagactgggccataaggaa

SEQ ID NO: 8387656 - DNA, 19 bp, Homo sapiens
aagcagactctgagccagg

SEQ ID NO: 8387657 - DNA, 22 bp, Homo sapiens
aagcagagcctgagacagggat

SEQ ID NO: 8387658 - DNA, 22 bp, Homo sapiens
aagcagacatcccatacttttg

SEQ ID NO: 8387659 - DNA, 22 bp, Homo sapiens
aagcaattgtcctgtctctaca

SEQ ID NO: 8387660 - DNA, 22 bp, Homo sapiens
aagcacatttggaaaacatgga

SEQ ID NO: 8387661 - DNA, 22 bp, Homo sapiens
aagcacccaatttacagcagtt

SEQ ID NO: 8387662 - DNA, 20 bp, Homo sapiens
aagcaatatagtgcaaatgt

SEQ ID NO: 8387663 - DNA, 22 bp, Homo sapiens
aagcaatatactgatatgatta

SEQ ID NO: 8387664 - DNA, 19 bp, Homo sapiens
aagcaatgttgtgaatcta

SEQ ID NO: 8387665 - DNA, 22 bp, Homo sapiens
aagatgcatgctgaagctggct

SEQ ID NO: 8387666 - DNA, 22 bp, Homo sapiens
aagatgcggttgaccatggtgt

SEQ ID NO: 8387667 - DNA, 22 bp, Homo sapiens
aagatgataggacttgcttaag

SEQ ID NO: 8387668 - DNA, 23 bp, Homo sapiens
aagatgtatttttaccaaatgtc

SEQ ID NO: 8387669 - DNA, 22 bp, Homo sapiens
aagatgtgaaattgtctctggg

SEQ ID NO: 8387670 - DNA, 22 bp, Homo sapiens
aagatggctgcagcaattccaa

SEQ ID NO: 8387671 - DNA, 22 bp, Homo sapiens
aagcaataatcccaaagtgctg

SEQ ID NO: 8387672 - DNA, 22 bp, Homo sapiens
aagcaataaataatttttagta

SEQ ID NO: 8387673 - DNA, 22 bp, Homo sapiens
aagcaaggcaacctatgtccag

SEQ ID NO: 8387674 - DNA, 22 bp, Homo sapiens
aagcaaggcccagagcatcagc

SEQ ID NO: 8387675 - DNA, 22 bp, Homo sapiens
aagcaaagacagtttgagtgga

SEQ ID NO: 8387676 - DNA, 22 bp, Homo sapiens
aagcaagagttggagtgatgtt

SEQ ID NO: 8387677 - DNA, 22 bp, Homo sapiens
aagatgtgtgattaagctctga

SEQ ID NO: 8387678 - DNA, 22 bp, Homo sapiens
acacatgagaaacatcagttgt

SEQ ID NO: 8387679 - DNA, 19 bp, Homo sapiens
aagagcagggaaagaattg

SEQ ID NO: 8387680 - DNA, 22 bp, Homo sapiens
aagagcaggctgctgtggagta

SEQ ID NO: 8387681 - DNA, 17 bp, Homo sapiens
acacatcttggctttgc

SEQ ID NO: 8387682 - DNA, 22 bp, Homo sapiens
acacatcttagactgaaatatg

SEQ ID NO: 8387683 - DNA, 22 bp, Homo sapiens
acacatttaaaaaggaacatat

SEQ ID NO: 8387684 - DNA, 22 bp, Homo sapiens
acacatttacatgtttacgtat

SEQ ID NO: 8387685 - DNA, 22 bp, Homo sapiens
acacatttacatgtttacgtat

SEQ ID NO: 8387686 - DNA, 22 bp, Homo sapiens
acacatttacatgtttacgtat

SEQ ID NO: 8387687 - DNA, 22 bp, Homo sapiens
acacatttacatgtttacgtat

SEQ ID NO: 8387688 - DNA, 22 bp, Homo sapiens
acacattgcagacatctcatta

SEQ ID NO: 8387689 - DNA, 22 bp, Homo sapiens
acacatttattacatgcatgtg

SEQ ID NO: 8387690 - DNA, 22 bp, Homo sapiens
acacatttattacatgcatgtg

SEQ ID NO: 8387691 - DNA, 22 bp, Homo sapiens
acacatttctaaatttttaccg

SEQ ID NO: 8387692 - DNA, 22 bp, Homo sapiens
acacatttctaaatttttaccg

SEQ ID NO: 8387693 - DNA, 22 bp, Homo sapiens
acacatttctaaatttttaccg

SEQ ID NO: 8387694 - DNA, 22 bp, Homo sapiens
acacatttagcaccaggtttat

SEQ ID NO: 8387695 - DNA, 22 bp, Homo sapiens
acacatttagcaccaggtttat

SEQ ID NO: 8387696 - DNA, 22 bp, Homo sapiens
acacatttagcaccaggtttat

SEQ ID NO: 8387697 - DNA, 22 bp, Homo sapiens
acacatttattacatgcatgtg

SEQ ID NO: 8387698 - DNA, 22 bp, Homo sapiens
acacatttatggatcgcagaaa

SEQ ID NO: 8387699 - DNA, 22 bp, Homo sapiens
acacatttatggatcgcagaaa

SEQ ID NO: 8387700 - DNA, 22 bp, Homo sapiens
acacatttctaaatttttaccg

SEQ ID NO: 8387701 - DNA, 22 bp, Homo sapiens
aagatgaatcagtatgtgtcct

SEQ ID NO: 8387702 - DNA, 22 bp, Homo sapiens
aagatgaaaatttactgtgatg

SEQ ID NO: 8387703 - DNA, 22 bp, Homo sapiens
aaagagaacttttacccaagaa

SEQ ID NO: 8387704 - DNA, 22 bp, Homo sapiens
aaagagaacttttacccaagaa

SEQ ID NO: 8387705 - DNA, 20 bp, Homo sapiens
aaagagaagcctcaccttgt

SEQ ID NO: 8387706 - DNA, 20 bp, Homo sapiens
aaagagaagcctcaccttgt

SEQ ID NO: 8387707 - DNA, 20 bp, Homo sapiens
aaagagaagcctcaccttgt

SEQ ID NO: 8387708 - DNA, 22 bp, Homo sapiens
aaagagaaacttagaagcctga

SEQ ID NO: 8387709 - DNA, 22 bp, Homo sapiens
aaagagaaacttagaagcctga

SEQ ID NO: 8387710 - DNA, 22 bp, Homo sapiens
aaagagaaacttagaagcctga

SEQ ID NO: 8387711 - DNA, 22 bp, Homo sapiens
aaagagaaaatgatctgtacat

SEQ ID NO: 8387712 - DNA, 22 bp, Homo sapiens
aaagagaaaatgatctgtacat

SEQ ID NO: 8387713 - DNA, 22 bp, Homo sapiens
aaagagaaaaagatcccggctc

SEQ ID NO: 8387714 - DNA, 22 bp, Homo sapiens
aaagagaaaaagatcccggctc

SEQ ID NO: 8387715 - DNA, 22 bp, Homo sapiens
aaagagaaaatgatctgtacat

SEQ ID NO: 8387716 - DNA, 22 bp, Homo sapiens
aaagagaaaatgatctgtacat

SEQ ID NO: 8387717 - DNA, 22 bp, Homo sapiens
aaagagatgtgccaaatagcct

SEQ ID NO: 8387718 - DNA, 22 bp, Homo sapiens
aaagatcagtctgaagcaacat

SEQ ID NO: 8387719 - DNA, 22 bp, Homo sapiens
aaagatgttatgaaataactat

SEQ ID NO: 8387720 - DNA, 22 bp, Homo sapiens
aaagactacacgggaaagagct

SEQ ID NO: 8387721 - DNA, 22 bp, Homo sapiens
aaagactagcatttatatgtac

SEQ ID NO: 8387722 - DNA, 21 bp, Homo sapiens
aaagaacaggcagatgttctt

SEQ ID NO: 8387723 - DNA, 22 bp, Homo sapiens
aaagacatgacacattggagag

SEQ ID NO: 8387724 - DNA, 22 bp, Homo sapiens
aaactttttattctaatgtcta

SEQ ID NO: 8387725 - DNA, 22 bp, Homo sapiens
aaactttttattctaatgtcta

SEQ ID NO: 8387726 - DNA, 22 bp, Homo sapiens
aaactttttattctaatgtcta

SEQ ID NO: 8387727 - DNA, 22 bp, Homo sapiens
aaagaaacctatcagccacatg

SEQ ID NO: 8387728 - DNA, 22 bp, Homo sapiens
aaagaaacctatcagccacatg

SEQ ID NO: 8387729 - DNA, 22 bp, Homo sapiens
aaagaaatacctttctcagctt

SEQ ID NO: 8387730 - DNA, 16 bp, Homo sapiens
aaagaaacaggtgtcc

SEQ ID NO: 8387731 - DNA, 16 bp, Homo sapiens
aaagaaacaggtgtcc

SEQ ID NO: 8387732 - DNA, 22 bp, Homo sapiens
aaagaaacctatcagccacatg

SEQ ID NO: 8387733 - DNA, 22 bp, Homo sapiens
aaagaaatagatggcatttaaa

SEQ ID NO: 8387734 - DNA, 21 bp, Homo sapiens
aaagaaatctcccattggtag

SEQ ID NO: 8387735 - DNA, 21 bp, Homo sapiens
aaagaaatctcccattggtag

SEQ ID NO: 8387736 - DNA, 22 bp, Homo sapiens
aaatagtcctgggaatagtact

SEQ ID NO: 8387737 - DNA, 22 bp, Homo sapiens
aaatagttagccctgcatatat

SEQ ID NO: 8387738 - DNA, 22 bp, Homo sapiens
aaatagttcagcttgtaaaccc

SEQ ID NO: 8387739 - DNA, 22 bp, Homo sapiens
aaatagttgtttggatcaataa

SEQ ID NO: 8387740 - DNA, 22 bp, Homo sapiens
aaacttttcctgctcttgtcct

SEQ ID NO: 8387741 - DNA, 22 bp, Homo sapiens
aaactttaggaaggaatttaca

SEQ ID NO: 8387742 - DNA, 22 bp, Homo sapiens
aaacatgatgtcatatatgcca

SEQ ID NO: 8387743 - DNA, 22 bp, Homo sapiens
aaacagctggtctcaaatgttc

SEQ ID NO: 8387744 - DNA, 22 bp, Homo sapiens
aaacagctacttctgtataatg

SEQ ID NO: 8387745 - DNA, 22 bp, Homo sapiens
aaacagctccttagtttccatc

SEQ ID NO: 8387746 - DNA, 22 bp, Homo sapiens
aaacagctcaagaagttactct

SEQ ID NO: 8387747 - DNA, 22 bp, Homo sapiens
aaacagctaagtacattcaagg

SEQ ID NO: 8387748 - DNA, 22 bp, Homo sapiens
aaacagccatgtcagctttgca

SEQ ID NO: 8387749 - DNA, 22 bp, Homo sapiens
aaacagccatgtcagctttgca

SEQ ID NO: 8387750 - DNA, 22 bp, Homo sapiens
aaacagcaatggagaagccagg

SEQ ID NO: 8387751 - DNA, 22 bp, Homo sapiens
aaagccagctctgagctgcacc

SEQ ID NO: 8387752 - DNA, 22 bp, Homo sapiens
aaagccagctctgagctgcacc

SEQ ID NO: 8387753 - DNA, 22 bp, Homo sapiens
aaagccaggaggagggcgctcg

SEQ ID NO: 8387754 - DNA, 22 bp, Homo sapiens
aaagccaggcagccaagccagt

SEQ ID NO: 8387755 - DNA, 22 bp, Homo sapiens
aaagccaggctggcctggggtt

SEQ ID NO: 8387756 - DNA, 22 bp, Homo sapiens
aaagccaggctggcctggggtt

SEQ ID NO: 8387757 - DNA, 22 bp, Homo sapiens
aaacagataagggacaatttca

SEQ ID NO: 8387758 - DNA, 22 bp, Homo sapiens
aaacagataagggacaatttca

SEQ ID NO: 8387759 - DNA, 20 bp, Homo sapiens
aaagccactggcaagagact

SEQ ID NO: 8387760 - DNA, 22 bp, Homo sapiens
aaagccactgcatgtgtagtat

SEQ ID NO: 8387761 - DNA, 22 bp, Homo sapiens
aaagccagaattcgtccagcct

SEQ ID NO: 8387762 - DNA, 22 bp, Homo sapiens
aaagccagagtgtgttagagac

SEQ ID NO: 8387763 - DNA, 18 bp, Homo sapiens
aaactgtatttctttcta

SEQ ID NO: 8387764 - DNA, 22 bp, Homo sapiens
aaactgtcattggatgcatttg

SEQ ID NO: 8387765 - DNA, 22 bp, Homo sapiens
aaactgtatagggaaaagtaga

SEQ ID NO: 8387766 - DNA, 22 bp, Homo sapiens
aaactgtatagggaaaagtaga

SEQ ID NO: 8387767 - DNA, 22 bp, Homo sapiens
aaactgtaagagaataaactac

SEQ ID NO: 8387768 - DNA, 22 bp, Homo sapiens
aaacattccctaatgtgtccgt

SEQ ID NO: 8387769 - DNA, 22 bp, Homo sapiens
aaacattgagcacttgctattt

SEQ ID NO: 8387770 - DNA, 22 bp, Homo sapiens
aaacattgtaattttagcatgg

SEQ ID NO: 8387771 - DNA, 22 bp, Homo sapiens
aaacattgtaattttagcatgg

SEQ ID NO: 8387772 - DNA, 22 bp, Homo sapiens
aaacatgctggatttagaatat

SEQ ID NO: 8387773 - DNA, 22 bp, Homo sapiens
aaacatgcattcaagaaaatct

SEQ ID NO: 8387774 - DNA, 22 bp, Homo sapiens
aaacatgtaattctgcttaaga

SEQ ID NO: 8387775 - DNA, 22 bp, Homo sapiens
aaacattccatatataccttgt

SEQ ID NO: 8387776 - DNA, 22 bp, Homo sapiens
aaacattccatttctatgtaag

SEQ ID NO: 8387777 - DNA, 22 bp, Homo sapiens
aaacattccatttctatgtaag

SEQ ID NO: 8387778 - DNA, 20 bp, Homo sapiens
aaacattcatgtacaagtga

SEQ ID NO: 8387779 - DNA, 22 bp, Homo sapiens
aaacattcaaagcaggatgtgt

SEQ ID NO: 8387780 - DNA, 22 bp, Homo sapiens
aaacatgttttctgaatatttt

SEQ ID NO: 8387781 - DNA, 22 bp, Homo sapiens
aaactgcacacgatgtgcctga

SEQ ID NO: 8387782 - DNA, 22 bp, Homo sapiens
aaaatatgtataactcttctgc

SEQ ID NO: 8387783 - DNA, 20 bp, Homo sapiens
aaaatatgtataactcttct

SEQ ID NO: 8387784 - DNA, 21 bp, Homo sapiens
aaaatgtgagcgtgatgctta

SEQ ID NO: 8387785 - DNA, 22 bp, Homo sapiens
aaaatatgactgtgctccttaa

SEQ ID NO: 8387786 - DNA, 22 bp, Homo sapiens
aaaatatgaagttgtcagtatg

SEQ ID NO: 8387787 - DNA, 22 bp, Homo sapiens
aaaatatgaagttgtcagtatg

SEQ ID NO: 8387788 - DNA, 20 bp, Homo sapiens
aaaatatgtataactcttct

SEQ ID NO: 8387789 - DNA, 22 bp, Homo sapiens
aaaatatgaagttgtcagtatg

SEQ ID NO: 8387790 - DNA, 22 bp, Homo sapiens
aaaatactgtggagtgttgaaa

SEQ ID NO: 8387791 - DNA, 22 bp, Homo sapiens
aaacagctttcagaatctctca

SEQ ID NO: 8387792 - DNA, 22 bp, Homo sapiens
aaacagtattatcaatatattt

SEQ ID NO: 8387793 - DNA, 22 bp, Homo sapiens
aaacagtaagttctagtattat

SEQ ID NO: 8387794 - DNA, 22 bp, Homo sapiens
aaacagtaagttctagtattat

SEQ ID NO: 8387795 - DNA, 22 bp, Homo sapiens
aaacactagcaggaagcactga

SEQ ID NO: 8387796 - DNA, 22 bp, Homo sapiens
aaacacattttaggaaaatcta

SEQ ID NO: 8387797 - DNA, 22 bp, Homo sapiens
aaacacattagccctgtggaaa

SEQ ID NO: 8387798 - DNA, 22 bp, Homo sapiens
aaacacattagccctgtggaaa

SEQ ID NO: 8387799 - DNA, 22 bp, Homo sapiens
aaagagcttcatttccatttat

SEQ ID NO: 8387800 - DNA, 22 bp, Homo sapiens
aaacacaagaggcagggtacag

SEQ ID NO: 8387801 - DNA, 22 bp, Homo sapiens
aaagagctgatagcatctgttt

SEQ ID NO: 8387802 - DNA, 22 bp, Homo sapiens
aaaattctcttgatcttgacag

SEQ ID NO: 8387803 - DNA, 22 bp, Homo sapiens
aaaatgtgatctacaaatgcaa

SEQ ID NO: 8387804 - DNA, 22 bp, Homo sapiens
aaaattcattcctcagactgcc

SEQ ID NO: 8387805 - DNA, 22 bp, Homo sapiens
aaaattcattcctcagactgcc

SEQ ID NO: 8387806 - DNA, 22 bp, Homo sapiens
aaaattctgtcattaaattgtg

SEQ ID NO: 8387807 - DNA, 17 bp, Homo sapiens
aaaattctgtaaagagg

SEQ ID NO: 8387808 - DNA, 22 bp, Homo sapiens
aaaattgaagtgatcaggaact

SEQ ID NO: 8387809 - DNA, 22 bp, Homo sapiens
aaaattctgtcattaaattgtg

SEQ ID NO: 8387810 - DNA, 22 bp, Homo sapiens
aaaattgagagtcttgtgcaag

SEQ ID NO: 8387811 - DNA, 22 bp, Homo sapiens
aaaattgagagtcttgtgcaag

SEQ ID NO: 8387812 - DNA, 22 bp, Homo sapiens
aaaattgagagttatagatggt

SEQ ID NO: 8387813 - DNA, 22 bp, Homo sapiens
aaaattgaggctcatgttaaat

SEQ ID NO: 8387814 - DNA, 22 bp, Homo sapiens
aaaaggtagattctccttctat

SEQ ID NO: 8387815 - DNA, 22 bp, Homo sapiens
aaaaggtagttgccaaataagg

SEQ ID NO: 8387816 - DNA, 22 bp, Homo sapiens
aaaattcatggcttgggaaaag

SEQ ID NO: 8387817 - DNA, 22 bp, Homo sapiens
aaaagtaattgcaattttgtag

SEQ ID NO: 8387818 - DNA, 22 bp, Homo sapiens
aaacagcttgtttcaggaaagt

SEQ ID NO: 8387819 - DNA, 22 bp, Homo sapiens
aaaagtaattgcaattttgtag

SEQ ID NO: 8387820 - DNA, 22 bp, Homo sapiens
aaaattcatagaactgtacgct

SEQ ID NO: 8387821 - DNA, 22 bp, Homo sapiens
aaaattatggagtatcccaaag

SEQ ID NO: 8387822 - DNA, 22 bp, Homo sapiens
aaaattattcatggcttttgga

SEQ ID NO: 8387823 - DNA, 22 bp, Homo sapiens
aaaattatagatctagtgcctg

SEQ ID NO: 8387824 - DNA, 22 bp, Homo sapiens
aaaattatggagtatcccaaag

SEQ ID NO: 8387825 - DNA, 22 bp, Homo sapiens
aaaattaagtgtctgggaagcc

SEQ ID NO: 8387826 - DNA, 21 bp, Homo sapiens
aaaatgtttccttgttggtta

SEQ ID NO: 8387827 - DNA, 21 bp, Homo sapiens
aaaatgtttccttgttggtta

SEQ ID NO: 8387828 - DNA, 22 bp, Homo sapiens
aaaagaacctagctcctcagtc

SEQ ID NO: 8387829 - DNA, 22 bp, Homo sapiens
aaaactgaaccttgagatcttt

SEQ ID NO: 8387830 - DNA, 22 bp, Homo sapiens
aaaaaggttgatccagattagg

SEQ ID NO: 8387831 - DNA, 22 bp, Homo sapiens
aaaaaggctaagcatcttgtgc

SEQ ID NO: 8387832 - DNA, 21 bp, Homo sapiens
aaaaagctggggcatgcatgc

SEQ ID NO: 8387833 - DNA, 22 bp, Homo sapiens
aaaaggcagtgcaagagagggt

SEQ ID NO: 8387834 - DNA, 22 bp, Homo sapiens
aaaaggcagtgcaagagagggt

SEQ ID NO: 8387835 - DNA, 22 bp, Homo sapiens
aaaactcctgaaattgtttccc

SEQ ID NO: 8387836 - DNA, 22 bp, Homo sapiens
aaaaccttctagactttatatt

SEQ ID NO: 8387837 - DNA, 22 bp, Homo sapiens
aaccccaggctggaggagtctc

SEQ ID NO: 8387838 - DNA, 22 bp, Homo sapiens
aaccccagtaccccaggatatg

SEQ ID NO: 8387839 - DNA, 22 bp, Homo sapiens
aacccgagggccccaggctcgg

SEQ ID NO: 8387840 - DNA, 22 bp, Homo sapiens
aaaggcagagttgttggaggca

SEQ ID NO: 8387841 - DNA, 22 bp, Homo sapiens
aaaggcagagttgttggaggca

SEQ ID NO: 8387842 - DNA, 18 bp, Homo sapiens
aaaggcagattactggga

SEQ ID NO: 8387843 - DNA, 18 bp, Homo sapiens
aaaggcagattactggga

SEQ ID NO: 8387844 - DNA, 22 bp, Homo sapiens
aaaggcaggactgcagcatagg

SEQ ID NO: 8387845 - DNA, 22 bp, Homo sapiens
aaaggcagtgggtatgtggatc

SEQ ID NO: 8387846 - DNA, 22 bp, Homo sapiens
aaaggcagtgggtatgtggatc

SEQ ID NO: 8387847 - DNA, 22 bp, Homo sapiens
aaaggcaggctttcacatctca

SEQ ID NO: 8387848 - DNA, 22 bp, Homo sapiens
aaaggcaggctttcacatctca

SEQ ID NO: 8387849 - DNA, 23 bp, Homo sapiens
aaaggcaggcctaggacatattg

SEQ ID NO: 8387850 - DNA, 23 bp, Homo sapiens
aaaggcaggcctaggacatattg

SEQ ID NO: 8387851 - DNA, 21 bp, Homo sapiens
aactgcaaatgatgctggaga

SEQ ID NO: 8387852 - DNA, 22 bp, Homo sapiens
aaaggcagtgtgatactgtggt

SEQ ID NO: 8387853 - DNA, 22 bp, Homo sapiens
aaaggcagtgtgatactgtggt

SEQ ID NO: 8387854 - DNA, 19 bp, Homo sapiens
aaaggcagtgggtggcgtg

SEQ ID NO: 8387855 - DNA, 22 bp, Homo sapiens
aacccaggaggtggaggttgtg

SEQ ID NO: 8387856 - DNA, 22 bp, Homo sapiens
aacccaggctggagtgcagtgg

SEQ ID NO: 8387857 - DNA, 22 bp, Homo sapiens
aacccaggagttggaggctgtg

SEQ ID NO: 8387858 - DNA, 22 bp, Homo sapiens
aacccaggaggcggaggttgtg

SEQ ID NO: 8387859 - DNA, 22 bp, Homo sapiens
aacccagggtggaggttgcagt

SEQ ID NO: 8387860 - DNA, 22 bp, Homo sapiens
aacccaggaggcagaggctgca

SEQ ID NO: 8387861 - DNA, 22 bp, Homo sapiens
aacccaggagatggaggttgtg

SEQ ID NO: 8387862 - DNA, 22 bp, Homo sapiens
aacccaggagccggaggttgtg

SEQ ID NO: 8387863 - DNA, 22 bp, Homo sapiens
aacccaggagacaggttgcagt

SEQ ID NO: 8387864 - DNA, 16 bp, Homo sapiens
aacccacagctcccga

SEQ ID NO: 8387865 - DNA, 22 bp, Homo sapiens
aacccagagctggaggagagta

SEQ ID NO: 8387866 - DNA, 22 bp, Homo sapiens
aaagcctcccaggttatgagta

SEQ ID NO: 8387867 - DNA, 22 bp, Homo sapiens
aacatttgtttggcttcaatta

SEQ ID NO: 8387868 - DNA, 22 bp, Homo sapiens
aacccacaagcagctgtagccc

SEQ ID NO: 8387869 - DNA, 22 bp, Homo sapiens
aacatttgtgtttgctaaaaat

SEQ ID NO: 8387870 - DNA, 22 bp, Homo sapiens
aacatttgtttggcttcaatta

SEQ ID NO: 8387871 - DNA, 22 bp, Homo sapiens
aagaacatgaagtcacaaatgc

SEQ ID NO: 8387872 - DNA, 22 bp, Homo sapiens
aagaacagttgggaggtgagcc

SEQ ID NO: 8387873 - DNA, 22 bp, Homo sapiens
aagaaataagacttctctgtcc

SEQ ID NO: 8387874 - DNA, 22 bp, Homo sapiens
aaagtaagaccaagtgatcatt

SEQ ID NO: 8387875 - DNA, 22 bp, Homo sapiens
aaagtaagatttgcatttcaga

SEQ ID NO: 8387876 - DNA, 22 bp, Homo sapiens
aaagtaagggttaatctacttt

SEQ ID NO: 8387877 - DNA, 22 bp, Homo sapiens
aaagtaattgcagtttctgcca

SEQ ID NO: 8387878 - DNA, 22 bp, Homo sapiens
aaaggtttttatttatcctgga

SEQ ID NO: 8387879 - DNA, 22 bp, Homo sapiens
aactgtacgataataaatttgt

SEQ ID NO: 8387880 - DNA, 22 bp, Homo sapiens
aaaggttttgccctgggtattc

SEQ ID NO: 8387881 - DNA, 22 bp, Homo sapiens
aaaggttttggtaaggctttaa

SEQ ID NO: 8387882 - DNA, 22 bp, Homo sapiens
aacacttcccgaccatatggct

SEQ ID NO: 8387883 - DNA, 22 bp, Homo sapiens
aacactgtcttatacttcaatg

SEQ ID NO: 8387884 - DNA, 22 bp, Homo sapiens
aacactgtgaggtaatgaccta

SEQ ID NO: 8387885 - DNA, 22 bp, Homo sapiens
aacactgtgaggtaatgaccta

SEQ ID NO: 8387886 - DNA, 22 bp, Homo sapiens
aaagcaagtctctacaaagtac

SEQ ID NO: 8387887 - DNA, 22 bp, Homo sapiens
aacactgtatcagtcttcaata

SEQ ID NO: 8387888 - DNA, 22 bp, Homo sapiens
aaagatttgaaattaggcatca

SEQ ID NO: 8387889 - DNA, 22 bp, Homo sapiens
aaagatttgagttctgcttata

SEQ ID NO: 8387890 - DNA, 22 bp, Homo sapiens
aaagatttgagttctgcttata

SEQ ID NO: 8387891 - DNA, 22 bp, Homo sapiens
aaagatttcagaagcctgtgcc

SEQ ID NO: 8387892 - DNA, 22 bp, Homo sapiens
aaagattatggcattgaaatac

SEQ ID NO: 8387893 - DNA, 22 bp, Homo sapiens
aaagatttaagaataatttgtg

SEQ ID NO: 8387894 - DNA, 22 bp, Homo sapiens
aaagattaaatcaaattggtca

SEQ ID NO: 8387895 - DNA, 22 bp, Homo sapiens
aaagatgttttataagttatgg

SEQ ID NO: 8387896 - DNA, 22 bp, Homo sapiens
aaagattatggcattgaaatac

SEQ ID NO: 8387897 - DNA, 22 bp, Homo sapiens
aaagattagataagatagattt

SEQ ID NO: 8387898 - DNA, 22 bp, Homo sapiens
aaagattaaggtattgttagct

SEQ ID NO: 8387899 - DNA, 22 bp, Homo sapiens
aaagcacttcaggagcagtttg

SEQ ID NO: 8387900 - DNA, 19 bp, Homo sapiens
aacagtgaggcccagcctg

SEQ ID NO: 8387901 - DNA, 22 bp, Homo sapiens
aaagcagcaaatacttttgcac

SEQ ID NO: 8387902 - DNA, 22 bp, Homo sapiens
aaagcagattctgatgcagtag

SEQ ID NO: 8387903 - DNA, 22 bp, Homo sapiens
aaagcagaggttgcagtgagct

SEQ ID NO: 8387904 - DNA, 22 bp, Homo sapiens
aaagcagaggttgcagtgagct

SEQ ID NO: 8387905 - DNA, 22 bp, Homo sapiens
aaagcagaggttgcagtgagct

SEQ ID NO: 8387906 - DNA, 22 bp, Homo sapiens
aacatagaattgttatattttc

SEQ ID NO: 8387907 - DNA, 22 bp, Homo sapiens
aacatacttgtactatgcatat

SEQ ID NO: 8387908 - DNA, 22 bp, Homo sapiens
aacatacatatttcagtgtcca

SEQ ID NO: 8387909 - DNA, 22 bp, Homo sapiens
aacatacatatttcagtgtcca

SEQ ID NO: 8387910 - DNA, 22 bp, Homo sapiens
aacataatgtggccaaagtcac

SEQ ID NO: 8387911 - DNA, 22 bp, Homo sapiens
aacatacagtgagcagtggact

SEQ ID NO: 8387912 - DNA, 22 bp, Homo sapiens
aacatataaactcttaagttca

SEQ ID NO: 8387913 - DNA, 22 bp, Homo sapiens
aacatataaactcttaagttca

SEQ ID NO: 8387914 - DNA, 22 bp, Homo sapiens
aaagccattgaactgtacttta

SEQ ID NO: 8387915 - DNA, 22 bp, Homo sapiens
aaagccattgcagagcaggatt

SEQ ID NO: 8387916 - DNA, 22 bp, Homo sapiens
aaagcccatgtggaagtacagg

SEQ ID NO: 8387917 - DNA, 22 bp, Homo sapiens
aaagcccatgtggaagtacagg

SEQ ID NO: 8387918 - DNA, 22 bp, Homo sapiens
aaagcccatgtggaagtacagg

SEQ ID NO: 8387919 - DNA, 22 bp, Homo sapiens
aagcaggagagcctgggtgagc

SEQ ID NO: 8387920 - DNA, 22 bp, Homo sapiens
aagcaggagatgcaggaatgta

SEQ ID NO: 8387921 - DNA, 22 bp, Homo sapiens
aagcaggagatgcaggaatgta

SEQ ID NO: 8387922 - DNA, 22 bp, Homo sapiens
aagcaggatggaggttgagtta

SEQ ID NO: 8387923 - DNA, 22 bp, Homo sapiens
aagcaggagatgcaggaatgta

SEQ ID NO: 8387924 - DNA, 22 bp, Homo sapiens
aagcaggcagggtggagagttt

SEQ ID NO: 8387925 - DNA, 22 bp, Homo sapiens
aagcaggcaaggttgtggggca

SEQ ID NO: 8387926 - DNA, 22 bp, Homo sapiens
aagcaggcatcttggaggtcaa

SEQ ID NO: 8387927 - DNA, 22 bp, Homo sapiens
aagattatggcagataacaatt

SEQ ID NO: 8387928 - DNA, 22 bp, Homo sapiens
aagattcacagagtgaatgaaa

SEQ ID NO: 8387929 - DNA, 20 bp, Homo sapiens
aagattcattgtaattaggg

SEQ ID NO: 8387930 - DNA, 22 bp, Homo sapiens
aagcaggagagcctgggcgagc

SEQ ID NO: 8387931 - DNA, 22 bp, Homo sapiens
aagcagcatatgacagcatcca

SEQ ID NO: 8387932 - DNA, 22 bp, Homo sapiens
aagatcaggcgtggaaaacact

SEQ ID NO: 8387933 - DNA, 22 bp, Homo sapiens
aagatgtttagatttatacaat

SEQ ID NO: 8387934 - DNA, 22 bp, Homo sapiens
aagatgtttagatttatacaat

SEQ ID NO: 8387935 - DNA, 22 bp, Homo sapiens
aagcccttttcaagatacaaca

SEQ ID NO: 8387936 - DNA, 22 bp, Homo sapiens
aagcccttggcagagttcccca

SEQ ID NO: 8387937 - DNA, 22 bp, Homo sapiens
aagccctgttaggcactgggga

SEQ ID NO: 8387938 - DNA, 22 bp, Homo sapiens
aagccctgttctttctctcacc

SEQ ID NO: 8387939 - DNA, 22 bp, Homo sapiens
aagccctgttctttctctcacc

SEQ ID NO: 8387940 - DNA, 22 bp, Homo sapiens
aagccctgtcaccctgacttca

SEQ ID NO: 8387941 - DNA, 22 bp, Homo sapiens
aagccctgtccggggggaagaa

SEQ ID NO: 8387942 - DNA, 22 bp, Homo sapiens
aagccctgtaaattgcccttaa

SEQ ID NO: 8387943 - DNA, 22 bp, Homo sapiens
aagcctccttattaaaggatat

SEQ ID NO: 8387944 - DNA, 22 bp, Homo sapiens
aagcctctggggcctcatctgt

SEQ ID NO: 8387945 - DNA, 22 bp, Homo sapiens
aaatgcatggctgttttaaagc

SEQ ID NO: 8387946 - DNA, 22 bp, Homo sapiens
aaatgcatggctgttttaaagc

SEQ ID NO: 8387947 - DNA, 22 bp, Homo sapiens
aaatgcatgtagaataatagag

SEQ ID NO: 8387948 - DNA, 22 bp, Homo sapiens
aaatctctgaacttaataatgc

SEQ ID NO: 8387949 - DNA, 22 bp, Homo sapiens
aaatctgaaatagtgtgaagta

SEQ ID NO: 8387950 - DNA, 22 bp, Homo sapiens
aaatcttcctgaaatttgttca

SEQ ID NO: 8387951 - DNA, 22 bp, Homo sapiens
aagcaggcgagggcctggagca

SEQ ID NO: 8387952 - DNA, 22 bp, Homo sapiens
aagcaggcattccagagacaat

SEQ ID NO: 8387953 - DNA, 22 bp, Homo sapiens
aagcaggccctgggccagggga

SEQ ID NO: 8387954 - DNA, 22 bp, Homo sapiens
aaatctcagtgttctaagcatt

SEQ ID NO: 8387955 - DNA, 22 bp, Homo sapiens
aaatctcactgtagtcaaagtg

SEQ ID NO: 8387956 - DNA, 19 bp, Homo sapiens
aaagtgaatgctgttttct

SEQ ID NO: 8387957 - DNA, 22 bp, Homo sapiens
aaagtgaatgtatcccgtaagt

SEQ ID NO: 8387958 - DNA, 22 bp, Homo sapiens
aaagtgatgccaggagtctggt

SEQ ID NO: 8387959 - DNA, 22 bp, Homo sapiens
aaagtgattatgctgtcaaaga

SEQ ID NO: 8387960 - DNA, 22 bp, Homo sapiens
aagaacatggtaggataacaaa

SEQ ID NO: 8387961 - DNA, 22 bp, Homo sapiens
aaagtgcagaactgttctcact

SEQ ID NO: 8387962 - DNA, 22 bp, Homo sapiens
aaagtgatttaagtacctcagg

SEQ ID NO: 8387963 - DNA, 22 bp, Homo sapiens
aagactataccatcttagttac

SEQ ID NO: 8387964 - DNA, 17 bp, Homo sapiens
aagaccctagtctaccc

SEQ ID NO: 8387965 - DNA, 22 bp, Homo sapiens
aagacagatgcaacctgctagc

SEQ ID NO: 8387966 - DNA, 22 bp, Homo sapiens
aagaccctatactcagtgaccc

SEQ ID NO: 8387967 - DNA, 22 bp, Homo sapiens
aagactctatctttagagatca

SEQ ID NO: 8387968 - DNA, 22 bp, Homo sapiens
aagactgtatattgagaaaaga

SEQ ID NO: 8387969 - DNA, 22 bp, Homo sapiens
aagactgtatgagacaatataa

SEQ ID NO: 8387970 - DNA, 22 bp, Homo sapiens
aagactgtatgagacaatataa

SEQ ID NO: 8387971 - DNA, 22 bp, Homo sapiens
aagaggggtggtctgtgaggat

SEQ ID NO: 8387972 - DNA, 23 bp, Homo sapiens
aaatacctgaattagatattatc

SEQ ID NO: 8387973 - DNA, 22 bp, Homo sapiens
aaatactggcaagtgctaattc

SEQ ID NO: 8387974 - DNA, 22 bp, Homo sapiens
aaatactggcaagtgctaattc

SEQ ID NO: 8387975 - DNA, 22 bp, Homo sapiens
aaatactgctgctattcctttt

SEQ ID NO: 8387976 - DNA, 22 bp, Homo sapiens
aaatactcatcccaggaactgg

SEQ ID NO: 8387977 - DNA, 19 bp, Homo sapiens
aaatactgaagttgttcat

SEQ ID NO: 8387978 - DNA, 22 bp, Homo sapiens
aagataaactcttgatttctga

SEQ ID NO: 8387979 - DNA, 22 bp, Homo sapiens
aaatactgggctcaaaagggtt

SEQ ID NO: 8387980 - DNA, 22 bp, Homo sapiens
aaatactgggctcaaaagggtt

SEQ ID NO: 8387981 - DNA, 21 bp, Homo sapiens
aaatactgggcagtgacttga

SEQ ID NO: 8387982 - DNA, 21 bp, Homo sapiens
aaatactgggcagtgacttga

SEQ ID NO: 8387983 - DNA, 22 bp, Homo sapiens
aaagtttccaagttacaccatt

SEQ ID NO: 8387984 - DNA, 22 bp, Homo sapiens
aaagttttagaactaggaagca

SEQ ID NO: 8387985 - DNA, 22 bp, Homo sapiens
aagagggaaattgttggctgct

SEQ ID NO: 8387986 - DNA, 22 bp, Homo sapiens
aagagggagggcaaaggcactg

SEQ ID NO: 8387987 - DNA, 22 bp, Homo sapiens
aagagggaagtcacctggaggt

SEQ ID NO: 8387988 - DNA, 22 bp, Homo sapiens
aagagggctgcaatcttattgc

SEQ ID NO: 8387989 - DNA, 22 bp, Homo sapiens
aagagggaggtgcgggtgcaga

SEQ ID NO: 8387990 - DNA, 22 bp, Homo sapiens
aatgtcttcagtgtatacatgg

SEQ ID NO: 8387991 - DNA, 22 bp, Homo sapiens
aatgtcttcagtgtatacatgg

SEQ ID NO: 8387992 - DNA, 22 bp, Homo sapiens
aatgtgaactttgtcatgtaac

SEQ ID NO: 8387993 - DNA, 22 bp, Homo sapiens
aatgtgaactttgtcatgtaac

SEQ ID NO: 8387994 - DNA, 22 bp, Homo sapiens
aatgtaaaatatcttgtacttg

SEQ ID NO: 8387995 - DNA, 22 bp, Homo sapiens
aatgtaaaatatcttgtacttg

SEQ ID NO: 8387996 - DNA, 22 bp, Homo sapiens
aatgtggattcacaagtgctca

SEQ ID NO: 8387997 - DNA, 22 bp, Homo sapiens
aatgtgaggccttggtagttat

SEQ ID NO: 8387998 - DNA, 22 bp, Homo sapiens
aatgtgagccaatgcccgtggg

SEQ ID NO: 8387999 - DNA, 22 bp, Homo sapiens
aatgtgagccaatgcccgtggg

SEQ ID NO: 8388000 - DNA, 22 bp, Homo sapiens
aatgggttgctttccacagcct

SEQ ID NO: 8388001 - DNA, 22 bp, Homo sapiens
aatgggtttctgtcccagctct

SEQ ID NO: 8388002 - DNA, 22 bp, Homo sapiens
aatggtttggactattcaatag

SEQ ID NO: 8388003 - DNA, 22 bp, Homo sapiens
agaagcagactctgaggcaagg

SEQ ID NO: 8388004 - DNA, 22 bp, Homo sapiens
agaagcagactctgaggcaagg

SEQ ID NO: 8388005 - DNA, 22 bp, Homo sapiens
agacaaacccagtggctgtttt

SEQ ID NO: 8388006 - DNA, 22 bp, Homo sapiens
agacaatatttcttgcctggtt

SEQ ID NO: 8388007 - DNA, 22 bp, Homo sapiens
agacaatgtcaaggtgatcatc

SEQ ID NO: 8388008 - DNA, 22 bp, Homo sapiens
agacaatttcaaagtaatatta

SEQ ID NO: 8388009 - DNA, 22 bp, Homo sapiens
aatgggaggtagtatgggaggt

SEQ ID NO: 8388010 - DNA, 22 bp, Homo sapiens
aatgggcatttggggttgagaa

SEQ ID NO: 8388011 - DNA, 20 bp, Homo sapiens
aatgggcagtgtgtgagata

SEQ ID NO: 8388012 - DNA, 22 bp, Homo sapiens
aatgggaagtcactactgttac

SEQ ID NO: 8388013 - DNA, 22 bp, Homo sapiens
aatggcagaatgggccagaagc

SEQ ID NO: 8388014 - DNA, 22 bp, Homo sapiens
aatggcactttataaatgttaa

SEQ ID NO: 8388015 - DNA, 22 bp, Homo sapiens
agaccctgcattttccagggtt

SEQ ID NO: 8388016 - DNA, 22 bp, Homo sapiens
agaccccctttaatggaagtgc

SEQ ID NO: 8388017 - DNA, 22 bp, Homo sapiens
aatgtgtaaaaggttttcttca

SEQ ID NO: 8388018 - DNA, 22 bp, Homo sapiens
aatgtttgtgcataaatatgtt

SEQ ID NO: 8388019 - DNA, 22 bp, Homo sapiens
aattaaaaaaggagagcttgct

SEQ ID NO: 8388020 - DNA, 22 bp, Homo sapiens
aattaaaaaaggagagcttgct

SEQ ID NO: 8388021 - DNA, 22 bp, Homo sapiens
agagacaggagttctgtttcca

SEQ ID NO: 8388022 - DNA, 22 bp, Homo sapiens
agagacaggaatggcattaaga

SEQ ID NO: 8388023 - DNA, 18 bp, Homo sapiens
agagacagcagcaaaaga

SEQ ID NO: 8388024 - DNA, 22 bp, Homo sapiens
agagacagatctgagggacctc

SEQ ID NO: 8388025 - DNA, 22 bp, Homo sapiens
aattaaatgacaggggaagatg

SEQ ID NO: 8388026 - DNA, 23 bp, Homo sapiens
aattaaattgctagatccagggc

SEQ ID NO: 8388027 - DNA, 22 bp, Homo sapiens
aattaaattggtttagagagga

SEQ ID NO: 8388028 - DNA, 22 bp, Homo sapiens
aattaaattggtttagagagga

SEQ ID NO: 8388029 - DNA, 22 bp, Homo sapiens
aattaaaaaaggagagcttgct

SEQ ID NO: 8388030 - DNA, 22 bp, Homo sapiens
agagccaggctcccatggggca

SEQ ID NO: 8388031 - DNA, 22 bp, Homo sapiens
agagccaggctcccatggggca

SEQ ID NO: 8388032 - DNA, 22 bp, Homo sapiens
agagccaggtgtagtctcggag

SEQ ID NO: 8388033 - DNA, 22 bp, Homo sapiens
agagccaggtgtagtctcggag

SEQ ID NO: 8388034 - DNA, 22 bp, Homo sapiens
agagccagttacaactgtggag

SEQ ID NO: 8388035 - DNA, 22 bp, Homo sapiens
agagccagttacaactgtggag

SEQ ID NO: 8388036 - DNA, 22 bp, Homo sapiens
agagacagggttttgccatgtt

SEQ ID NO: 8388037 - DNA, 22 bp, Homo sapiens
agagacaggatatctgctcatg

SEQ ID NO: 8388038 - DNA, 22 bp, Homo sapiens
agagacaggatatctgctcatg

SEQ ID NO: 8388039 - DNA, 22 bp, Homo sapiens
agagcctgcatcaggcttgggg

SEQ ID NO: 8388040 - DNA, 22 bp, Homo sapiens
agagcctggacctgggctctga

SEQ ID NO: 8388041 - DNA, 22 bp, Homo sapiens
acaacagagctggactgagagg

SEQ ID NO: 8388042 - DNA, 22 bp, Homo sapiens
agataaattcctaagatttcag

SEQ ID NO: 8388043 - DNA, 22 bp, Homo sapiens
acaacacatgtgtatatgtgtg

SEQ ID NO: 8388044 - DNA, 20 bp, Homo sapiens
acaacaaacttgcttaagga

SEQ ID NO: 8388045 - DNA, 22 bp, Homo sapiens
acaaattgcctagtctagcatc

SEQ ID NO: 8388046 - DNA, 22 bp, Homo sapiens
acaacaaagacacttgaaatga

SEQ ID NO: 8388047 - DNA, 22 bp, Homo sapiens
acaacaatctaccctagcttct

SEQ ID NO: 8388048 - DNA, 22 bp, Homo sapiens
acaagagcattgcaggtgtgtt

SEQ ID NO: 8388049 - DNA, 22 bp, Homo sapiens
acaagagccctttcagattgac

SEQ ID NO: 8388050 - DNA, 22 bp, Homo sapiens
acaagataaggtgtcagtgtgt

SEQ ID NO: 8388051 - DNA, 22 bp, Homo sapiens
agataagtactgttattattgc

SEQ ID NO: 8388052 - DNA, 22 bp, Homo sapiens
agataagatagtccagcacaat

SEQ ID NO: 8388053 - DNA, 19 bp, Homo sapiens
agataagagttgactgtgg

SEQ ID NO: 8388054 - DNA, 22 bp, Homo sapiens
acaactagcaggtattaatttt

SEQ ID NO: 8388055 - DNA, 22 bp, Homo sapiens
acaactagcaggtattaatttt

SEQ ID NO: 8388056 - DNA, 22 bp, Homo sapiens
acaacgtatgatctgaaagtat

SEQ ID NO: 8388057 - DNA, 22 bp, Homo sapiens
acaatcttattagtagtataga

SEQ ID NO: 8388058 - DNA, 22 bp, Homo sapiens
acaatcagcactgagtttatct

SEQ ID NO: 8388059 - DNA, 22 bp, Homo sapiens
acaatcattccgttcacaacag

SEQ ID NO: 8388060 - DNA, 22 bp, Homo sapiens
acaagcacttcactgtcctctg

SEQ ID NO: 8388061 - DNA, 23 bp, Homo sapiens
acaagatagggataaaaagataa

SEQ ID NO: 8388062 - DNA, 22 bp, Homo sapiens
acaagcatgtggtaaaaagacc

SEQ ID NO: 8388063 - DNA, 22 bp, Homo sapiens
acaagcgggccacagtgctggt

SEQ ID NO: 8388064 - DNA, 22 bp, Homo sapiens
agaggctgtgcccaccaggcaa

SEQ ID NO: 8388065 - DNA, 22 bp, Homo sapiens
agaggctgtgcccaccaggcaa

SEQ ID NO: 8388066 - DNA, 22 bp, Homo sapiens
agaggctgtgcccaccaggcaa

SEQ ID NO: 8388067 - DNA, 22 bp, Homo sapiens
agaggctgtgcagagggagtgc

SEQ ID NO: 8388068 - DNA, 22 bp, Homo sapiens
agaggctgtgcagagggagtgc

SEQ ID NO: 8388069 - DNA, 22 bp, Homo sapiens
agaggctgttacactcccagat

SEQ ID NO: 8388070 - DNA, 22 bp, Homo sapiens
agaggctgttacactcccagat

SEQ ID NO: 8388071 - DNA, 22 bp, Homo sapiens
agaggctgttacactcccagat

SEQ ID NO: 8388072 - DNA, 22 bp, Homo sapiens
agaggctgtgcccaccaggcaa

SEQ ID NO: 8388073 - DNA, 19 bp, Homo sapiens
acaaagctgtgagcagctt

SEQ ID NO: 8388074 - DNA, 18 bp, Homo sapiens
acaaaggatcatgaggga

SEQ ID NO: 8388075 - DNA, 22 bp, Homo sapiens
acaaagtaggcagtgggctgga

SEQ ID NO: 8388076 - DNA, 22 bp, Homo sapiens
acaaagtagtcaaagtagatga

SEQ ID NO: 8388077 - DNA, 22 bp, Homo sapiens
acaaaggtgcgtcccttcagct

SEQ ID NO: 8388078 - DNA, 22 bp, Homo sapiens
aattcttcaagtgctttggaga

SEQ ID NO: 8388079 - DNA, 22 bp, Homo sapiens
aattgacaaatcatacttgtat

SEQ ID NO: 8388080 - DNA, 22 bp, Homo sapiens
aattcttgttgttagtatattt

SEQ ID NO: 8388081 - DNA, 22 bp, Homo sapiens
aattgcatgttaatgactaagt

SEQ ID NO: 8388082 - DNA, 19 bp, Homo sapiens
aattgcctgtctctgccag

SEQ ID NO: 8388083 - DNA, 22 bp, Homo sapiens
aattgatgggcactgaaatatt

SEQ ID NO: 8388084 - DNA, 22 bp, Homo sapiens
aattgacagaaagtttacgagg

SEQ ID NO: 8388085 - DNA, 22 bp, Homo sapiens
aattgcttagttgcaactatgc

SEQ ID NO: 8388086 - DNA, 22 bp, Homo sapiens
aattgcttcattaacatttagg

SEQ ID NO: 8388087 - DNA, 22 bp, Homo sapiens
agaggctctttgagctgggaga

SEQ ID NO: 8388088 - DNA, 19 bp, Homo sapiens
agccagggtccagacatgt

SEQ ID NO: 8388089 - DNA, 22 bp, Homo sapiens
agccagggtaaggtacttagta

SEQ ID NO: 8388090 - DNA, 19 bp, Homo sapiens
agccagggtgagaaggagc

SEQ ID NO: 8388091 - DNA, 22 bp, Homo sapiens
acagagaaagtgggctgaagat

SEQ ID NO: 8388092 - DNA, 22 bp, Homo sapiens
acagagaaagtgggctgaagat

SEQ ID NO: 8388093 - DNA, 21 bp, Homo sapiens
acagagaaagagcagcctcct

SEQ ID NO: 8388094 - DNA, 21 bp, Homo sapiens
acagagaaagagcagcctcct

SEQ ID NO: 8388095 - DNA, 21 bp, Homo sapiens
acagagaaagagcagcctcct

SEQ ID NO: 8388096 - DNA, 23 bp, Homo sapiens
acagactgtattcaaagtaggac

SEQ ID NO: 8388097 - DNA, 22 bp, Homo sapiens
acagactgtgagtatgcatagt

SEQ ID NO: 8388098 - DNA, 21 bp, Homo sapiens
agccagggtggacactgtatg

SEQ ID NO: 8388099 - DNA, 22 bp, Homo sapiens
acagagacttggagcaggctga

SEQ ID NO: 8388100 - DNA, 22 bp, Homo sapiens
acagagactcatgaaagatgac

SEQ ID NO: 8388101 - DNA, 22 bp, Homo sapiens
acagagactgggagcaagaggc

SEQ ID NO: 8388102 - DNA, 23 bp, Homo sapiens
acagagactgccaagatattctc

SEQ ID NO: 8388103 - DNA, 22 bp, Homo sapiens
acagagagaattgggtttacag

SEQ ID NO: 8388104 - DNA, 22 bp, Homo sapiens
acagagagaggcccgaggctgc

SEQ ID NO: 8388105 - DNA, 22 bp, Homo sapiens
acagagagctgtgattgagtta

SEQ ID NO: 8388106 - DNA, 22 bp, Homo sapiens
acagagaaagttcctctcaggc

SEQ ID NO: 8388107 - DNA, 22 bp, Homo sapiens
acagagacaggcagacagtctt

SEQ ID NO: 8388108 - DNA, 22 bp, Homo sapiens
acagagaccagttacagcgtcc

SEQ ID NO: 8388109 - DNA, 22 bp, Homo sapiens
acagagaccagttacagcgtcc

SEQ ID NO: 8388110 - DNA, 22 bp, Homo sapiens
acagagactcatgaaagatgac

SEQ ID NO: 8388111 - DNA, 22 bp, Homo sapiens
acagaaagaaggtgtatttgag

SEQ ID NO: 8388112 - DNA, 22 bp, Homo sapiens
acagaaaatgccagaagggtgg

SEQ ID NO: 8388113 - DNA, 22 bp, Homo sapiens
acacttttgtttgaagtctcca

SEQ ID NO: 8388114 - DNA, 22 bp, Homo sapiens
acacttttgtgtatatccagtt

SEQ ID NO: 8388115 - DNA, 22 bp, Homo sapiens
acagaaaagtttacttttgctc

SEQ ID NO: 8388116 - DNA, 22 bp, Homo sapiens
acagaaaaatgagggagctgga

SEQ ID NO: 8388117 - DNA, 22 bp, Homo sapiens
acacttttatctctggaggctt

SEQ ID NO: 8388118 - DNA, 22 bp, Homo sapiens
acactttatcaatattcaaaaa

SEQ ID NO: 8388119 - DNA, 22 bp, Homo sapiens
acactttatgtctagatctggg

SEQ ID NO: 8388120 - DNA, 18 bp, Homo sapiens
acagacacttagtatgag

SEQ ID NO: 8388121 - DNA, 18 bp, Homo sapiens
acagacacttagtatgag

SEQ ID NO: 8388122 - DNA, 22 bp, Homo sapiens
acagacactgcactcccacctt

SEQ ID NO: 8388123 - DNA, 22 bp, Homo sapiens
acagacagaggctccatgagga

SEQ ID NO: 8388124 - DNA, 22 bp, Homo sapiens
acagacagacagagaactattc

SEQ ID NO: 8388125 - DNA, 22 bp, Homo sapiens
acagacagggcacctgcctcct

SEQ ID NO: 8388126 - DNA, 22 bp, Homo sapiens
agccagggggacgctttctggc

SEQ ID NO: 8388127 - DNA, 22 bp, Homo sapiens
acagacagaggctccatgagga

SEQ ID NO: 8388128 - DNA, 22 bp, Homo sapiens
acagaaagataggcacaaggtc

SEQ ID NO: 8388129 - DNA, 22 bp, Homo sapiens
acagaaagataggcacaaggtc

SEQ ID NO: 8388130 - DNA, 22 bp, Homo sapiens
acagaattaatgaaaattacaa

SEQ ID NO: 8388131 - DNA, 20 bp, Homo sapiens
acagaaagagagaatgtcag

SEQ ID NO: 8388132 - DNA, 22 bp, Homo sapiens
acagacacaggcgtggagtcgc

SEQ ID NO: 8388133 - DNA, 22 bp, Homo sapiens
acagacacaggcctgggctcct

SEQ ID NO: 8388134 - DNA, 22 bp, Homo sapiens
agctcctgcccaggaaggctct

SEQ ID NO: 8388135 - DNA, 22 bp, Homo sapiens
agctcctgcccaggaaggctct

SEQ ID NO: 8388136 - DNA, 17 bp, Homo sapiens
agctcctgcccatggct

SEQ ID NO: 8388137 - DNA, 22 bp, Homo sapiens
agctcctgcaccaggggcccct

SEQ ID NO: 8388138 - DNA, 22 bp, Homo sapiens
agctcctgcacccagccttgag

SEQ ID NO: 8388139 - DNA, 22 bp, Homo sapiens
agctcctgcagactcctgctca

SEQ ID NO: 8388140 - DNA, 22 bp, Homo sapiens
agctcctgcttgacagaagagg

SEQ ID NO: 8388141 - DNA, 22 bp, Homo sapiens
agctcctgcttgacagaagagg

SEQ ID NO: 8388142 - DNA, 22 bp, Homo sapiens
acagcaattttgtgcacaagtg

SEQ ID NO: 8388143 - DNA, 22 bp, Homo sapiens
agctcctgcgcacggtgcacac

SEQ ID NO: 8388144 - DNA, 22 bp, Homo sapiens
acagatgttagcaatgatgatg

SEQ ID NO: 8388145 - DNA, 22 bp, Homo sapiens
acagatgtggagtttgcatgat

SEQ ID NO: 8388146 - DNA, 21 bp, Homo sapiens
acagatgtgatatgcagtctt

SEQ ID NO: 8388147 - DNA, 22 bp, Homo sapiens
acagattcactgcactggccat

SEQ ID NO: 8388148 - DNA, 22 bp, Homo sapiens
agctcccagagctcgagagtaa

SEQ ID NO: 8388149 - DNA, 22 bp, Homo sapiens
acagatgtaatctattcacatt

SEQ ID NO: 8388150 - DNA, 22 bp, Homo sapiens
agcctctcactgtcaccctccc

SEQ ID NO: 8388151 - DNA, 22 bp, Homo sapiens
agcctctccagagcctggcaga

SEQ ID NO: 8388152 - DNA, 22 bp, Homo sapiens
agcctctcatgttctcccccag

SEQ ID NO: 8388153 - DNA, 22 bp, Homo sapiens
agcctctctgttagtcactggg

SEQ ID NO: 8388154 - DNA, 22 bp, Homo sapiens
agcctctcttatcccttcaaag

SEQ ID NO: 8388155 - DNA, 22 bp, Homo sapiens
agcctctgactgtcagcaaggt

SEQ ID NO: 8388156 - DNA, 22 bp, Homo sapiens
agcctctctttattcccagcta

SEQ ID NO: 8388157 - DNA, 22 bp, Homo sapiens
agcctctctttattcccagcta

SEQ ID NO: 8388158 - DNA, 22 bp, Homo sapiens
agcctctgatgatcacaggggg

SEQ ID NO: 8388159 - DNA, 22 bp, Homo sapiens
agcctctgatgatcacaggggg

SEQ ID NO: 8388160 - DNA, 22 bp, Homo sapiens
agcctctgatggctcccaagga

SEQ ID NO: 8388161 - DNA, 22 bp, Homo sapiens
agcctctgatggctcccaagga

SEQ ID NO: 8388162 - DNA, 22 bp, Homo sapiens
agcctctgatggctcccaagga

SEQ ID NO: 8388163 - DNA, 22 bp, Homo sapiens
acagagctgtacatgtgccatg

SEQ ID NO: 8388164 - DNA, 22 bp, Homo sapiens
acagagctaatgttgcataggc

SEQ ID NO: 8388165 - DNA, 19 bp, Homo sapiens
acagagctctctgcttctg

SEQ ID NO: 8388166 - DNA, 22 bp, Homo sapiens
acagagctaatgttgcataggc

SEQ ID NO: 8388167 - DNA, 22 bp, Homo sapiens
acagatgaggcccatcagtctg

SEQ ID NO: 8388168 - DNA, 22 bp, Homo sapiens
acagatgaggctggcgagggca

SEQ ID NO: 8388169 - DNA, 22 bp, Homo sapiens
acagatgagttaaagcagagtg

SEQ ID NO: 8388170 - DNA, 22 bp, Homo sapiens
acacagggcagagagctggctc

SEQ ID NO: 8388171 - DNA, 22 bp, Homo sapiens
acacagggcggaaagcatgaga

SEQ ID NO: 8388172 - DNA, 19 bp, Homo sapiens
acacagggatcagagggtt

SEQ ID NO: 8388173 - DNA, 22 bp, Homo sapiens
acacatctccagccagcaggag

SEQ ID NO: 8388174 - DNA, 22 bp, Homo sapiens
acacatcttagactgaaatatg

SEQ ID NO: 8388175 - DNA, 22 bp, Homo sapiens
acacagggaggaggtgctgtgc

SEQ ID NO: 8388176 - DNA, 22 bp, Homo sapiens
acacagggatatttcaggtggt

SEQ ID NO: 8388177 - DNA, 17 bp, Homo sapiens
acacagggagagggagc

SEQ ID NO: 8388178 - DNA, 17 bp, Homo sapiens
acacagggagagggagc

SEQ ID NO: 8388179 - DNA, 22 bp, Homo sapiens
agcagctggttcccgagggcgt

SEQ ID NO: 8388180 - DNA, 22 bp, Homo sapiens
acacatgtatggcacttacatt

SEQ ID NO: 8388181 - DNA, 20 bp, Homo sapiens
acacatgtcaagctaaaggc

SEQ ID NO: 8388182 - DNA, 22 bp, Homo sapiens
acacatgtgattctaagacagc

SEQ ID NO: 8388183 - DNA, 22 bp, Homo sapiens
acacatgtgattctaagacagc

SEQ ID NO: 8388184 - DNA, 20 bp, Homo sapiens
acacatgtgcgtgttcagta

SEQ ID NO: 8388185 - DNA, 22 bp, Homo sapiens
acacatgtgtctgcatgcagtg

SEQ ID NO: 8388186 - DNA, 22 bp, Homo sapiens
acacatgtttacagtcttcagt

SEQ ID NO: 8388187 - DNA, 22 bp, Homo sapiens
acacatgtttccaaaagcaccc

SEQ ID NO: 8388188 - DNA, 22 bp, Homo sapiens
acacatgtttgtgtagtcagtt

SEQ ID NO: 8388189 - DNA, 22 bp, Homo sapiens
acacattaaaacgtctacaatg

SEQ ID NO: 8388190 - DNA, 22 bp, Homo sapiens
acacattaaaacgtctacaatg

SEQ ID NO: 8388191 - DNA, 22 bp, Homo sapiens
acacattaacctttgaaattct

SEQ ID NO: 8388192 - DNA, 22 bp, Homo sapiens
acactgagaggtgacagcgtgc

SEQ ID NO: 8388193 - DNA, 22 bp, Homo sapiens
acactttagaaaaaagaatggt

SEQ ID NO: 8388194 - DNA, 22 bp, Homo sapiens
acacattatagagagtataata

SEQ ID NO: 8388195 - DNA, 22 bp, Homo sapiens
acacattataggcaatcaaaag

SEQ ID NO: 8388196 - DNA, 22 bp, Homo sapiens
acacattataggcaatcaaaag

SEQ ID NO: 8388197 - DNA, 22 bp, Homo sapiens
acacattaggcagtgcttaaat

SEQ ID NO: 8388198 - DNA, 22 bp, Homo sapiens
acacattataggcaatcaaaag

SEQ ID NO: 8388199 - DNA, 22 bp, Homo sapiens
acacccaggaataaggactggg

SEQ ID NO: 8388200 - DNA, 22 bp, Homo sapiens
acacccaggaataaggactggg

SEQ ID NO: 8388201 - DNA, 22 bp, Homo sapiens
acacccaggctggcgtgcagtg

SEQ ID NO: 8388202 - DNA, 22 bp, Homo sapiens
acactagtggaaattgatttgt

SEQ ID NO: 8388203 - DNA, 22 bp, Homo sapiens
acactctgtgaggcatgtaatg

SEQ ID NO: 8388204 - DNA, 22 bp, Homo sapiens
acactatacttccattgctggt

SEQ ID NO: 8388205 - DNA, 22 bp, Homo sapiens
acactctgtaatgtcacactcc

SEQ ID NO: 8388206 - DNA, 22 bp, Homo sapiens
acactctacagagcaatctacc

SEQ ID NO: 8388207 - DNA, 22 bp, Homo sapiens
agcagctggtgagcaagctcag

SEQ ID NO: 8388208 - DNA, 22 bp, Homo sapiens
agcagctggtgcaactctaaga

SEQ ID NO: 8388209 - DNA, 22 bp, Homo sapiens
agcagctggtaggagtggccac

SEQ ID NO: 8388210 - DNA, 22 bp, Homo sapiens
agcagctgggtccggcggagca

SEQ ID NO: 8388211 - DNA, 22 bp, Homo sapiens
acacagatgcattacacatcta

SEQ ID NO: 8388212 - DNA, 22 bp, Homo sapiens
acacagagtatcttttgcctag

SEQ ID NO: 8388213 - DNA, 22 bp, Homo sapiens
acacagagtatcttttgcctag

SEQ ID NO: 8388214 - DNA, 22 bp, Homo sapiens
acacagaggtggccactctttt

SEQ ID NO: 8388215 - DNA, 22 bp, Homo sapiens
acacagaggaaagtgtgaaggg

SEQ ID NO: 8388216 - DNA, 21 bp, Homo sapiens
acacagaggcatcatcacttt

SEQ ID NO: 8388217 - DNA, 22 bp, Homo sapiens
acacagagttattatgtgaact

SEQ ID NO: 8388218 - DNA, 22 bp, Homo sapiens
acacagagtttgacacatggga

SEQ ID NO: 8388219 - DNA, 22 bp, Homo sapiens
acacagagtccttactgaggta

SEQ ID NO: 8388220 - DNA, 22 bp, Homo sapiens
agcagagcccttccatggcctt

SEQ ID NO: 8388221 - DNA, 22 bp, Homo sapiens
agcagagcccttccatggcctt

SEQ ID NO: 8388222 - DNA, 18 bp, Homo sapiens
agcagagcccatgcattc

SEQ ID NO: 8388223 - DNA, 18 bp, Homo sapiens
agcagagcccatgcattc

SEQ ID NO: 8388224 - DNA, 22 bp, Homo sapiens
agcagagcctgggctaggggtg

SEQ ID NO: 8388225 - DNA, 22 bp, Homo sapiens
agcagataggacatttcattct

SEQ ID NO: 8388226 - DNA, 23 bp, Homo sapiens
agcagcaaaaatttatctttctg

SEQ ID NO: 8388227 - DNA, 22 bp, Homo sapiens
agcagcaaaagagaatagtttg

SEQ ID NO: 8388228 - DNA, 22 bp, Homo sapiens
agcagatgtgtctctgcactgt

SEQ ID NO: 8388229 - DNA, 22 bp, Homo sapiens
agcagatgttccctggtccctt

SEQ ID NO: 8388230 - DNA, 22 bp, Homo sapiens
agcagaaccacagcactgttga

SEQ ID NO: 8388231 - DNA, 22 bp, Homo sapiens
agcagaagaaagccacatgact

SEQ ID NO: 8388232 - DNA, 22 bp, Homo sapiens
agcagagaggaggtggccctgt

SEQ ID NO: 8388233 - DNA, 22 bp, Homo sapiens
agcagagcatggtgggaagggc

SEQ ID NO: 8388234 - DNA, 22 bp, Homo sapiens
agcagagcatggtgggaagggc

SEQ ID NO: 8388235 - DNA, 21 bp, Homo sapiens
agcagagccaccattacctgc

SEQ ID NO: 8388236 - DNA, 22 bp, Homo sapiens
agcagagccagaattggaccag

SEQ ID NO: 8388237 - DNA, 19 bp, Homo sapiens
agcagagcaaagtggctga

SEQ ID NO: 8388238 - DNA, 19 bp, Homo sapiens
agcagagcaaagtggctga

SEQ ID NO: 8388239 - DNA, 23 bp, Homo sapiens
aatgatttcatgatgatagcagc

SEQ ID NO: 8388240 - DNA, 22 bp, Homo sapiens
aatgatgagttctaatagaccc

SEQ ID NO: 8388241 - DNA, 22 bp, Homo sapiens
agaagcagaaggaagcagggcc

SEQ ID NO: 8388242 - DNA, 22 bp, Homo sapiens
agaagcagaaggaagcagggcc

SEQ ID NO: 8388243 - DNA, 22 bp, Homo sapiens
agaagcagaaggaagcagggcc

SEQ ID NO: 8388244 - DNA, 22 bp, Homo sapiens
agaaatgacacacatgagacat

SEQ ID NO: 8388245 - DNA, 22 bp, Homo sapiens
agaaattattagtgaatagtct

SEQ ID NO: 8388246 - DNA, 22 bp, Homo sapiens
agaaattattagtgaatagtct

SEQ ID NO: 8388247 - DNA, 22 bp, Homo sapiens
agaaattctaagcatcaatagc

SEQ ID NO: 8388248 - DNA, 22 bp, Homo sapiens
aatcagttgtccaaagttcaca

SEQ ID NO: 8388249 - DNA, 22 bp, Homo sapiens
aatcataattcaaataagctta

SEQ ID NO: 8388250 - DNA, 21 bp, Homo sapiens
aatcagtgttctcaggggcaa

SEQ ID NO: 8388251 - DNA, 22 bp, Homo sapiens
aatcagtgtgtaaagtggctgc

SEQ ID NO: 8388252 - DNA, 22 bp, Homo sapiens
agaaatgaagcaggagttatta

SEQ ID NO: 8388253 - DNA, 22 bp, Homo sapiens
agaaatgaagagagtcaaggtt

SEQ ID NO: 8388254 - DNA, 22 bp, Homo sapiens
agaaatgaaaccaaagcctaga

SEQ ID NO: 8388255 - DNA, 22 bp, Homo sapiens
aatcagatgaatcaatatatcc

SEQ ID NO: 8388256 - DNA, 22 bp, Homo sapiens
aatcagaacttctcagggtggg

SEQ ID NO: 8388257 - DNA, 22 bp, Homo sapiens
aatcagaacttctcagggtggg

SEQ ID NO: 8388258 - DNA, 22 bp, Homo sapiens
aatcagaaattgagggtctggt

SEQ ID NO: 8388259 - DNA, 22 bp, Homo sapiens
aatcagaatttattgaatcttt

SEQ ID NO: 8388260 - DNA, 22 bp, Homo sapiens
aatcaggaactcaagtgcattg

SEQ ID NO: 8388261 - DNA, 22 bp, Homo sapiens
aatcagctttgaaagagggtct

SEQ ID NO: 8388262 - DNA, 22 bp, Homo sapiens
aatcaggaaactatcaacacat

SEQ ID NO: 8388263 - DNA, 22 bp, Homo sapiens
aatcagctaaataaactagtca

SEQ ID NO: 8388264 - DNA, 22 bp, Homo sapiens
aatcaggatgactgtcatttca

SEQ ID NO: 8388265 - DNA, 22 bp, Homo sapiens
aatcaggatgactgtcatttca

SEQ ID NO: 8388266 - DNA, 22 bp, Homo sapiens
aatcaggatatgaacccaggta

SEQ ID NO: 8388267 - DNA, 22 bp, Homo sapiens
aatcaggatagaacctcacgtg

SEQ ID NO: 8388268 - DNA, 22 bp, Homo sapiens
aatcaggagtgtgcactttgat

SEQ ID NO: 8388269 - DNA, 22 bp, Homo sapiens
aatcaggaggaagccttgggca

SEQ ID NO: 8388270 - DNA, 22 bp, Homo sapiens
aatcaggagctgaggtttagcc

SEQ ID NO: 8388271 - DNA, 22 bp, Homo sapiens
aatcaggaggataagggggtcc

SEQ ID NO: 8388272 - DNA, 21 bp, Homo sapiens
aatcaggaagtgtgtgtcctg

SEQ ID NO: 8388273 - DNA, 22 bp, Homo sapiens
aatcaggacccactctacagtt

SEQ ID NO: 8388274 - DNA, 22 bp, Homo sapiens
aatcaggactgtgccaaaccta

SEQ ID NO: 8388275 - DNA, 22 bp, Homo sapiens
aatcaggagagctgcgaacgtt

SEQ ID NO: 8388276 - DNA, 19 bp, Homo sapiens
aatcaggagcctaattagg

SEQ ID NO: 8388277 - DNA, 22 bp, Homo sapiens
aatcaggagctagggggcaatg

SEQ ID NO: 8388278 - DNA, 22 bp, Homo sapiens
aatatagttctagaaatatttt

SEQ ID NO: 8388279 - DNA, 22 bp, Homo sapiens
aatatagttctagaaatatttt

SEQ ID NO: 8388280 - DNA, 22 bp, Homo sapiens
aatatagtgttagctcatttga

SEQ ID NO: 8388281 - DNA, 21 bp, Homo sapiens
actgttcatctgttcagaagc

SEQ ID NO: 8388282 - DNA, 22 bp, Homo sapiens
actgttcatctcttagaaagta

SEQ ID NO: 8388283 - DNA, 21 bp, Homo sapiens
actgttcatttgatgaactgg

SEQ ID NO: 8388284 - DNA, 22 bp, Homo sapiens
actgttcatattcttagaaatt

SEQ ID NO: 8388285 - DNA, 22 bp, Homo sapiens
actgttcacccagcactagcag

SEQ ID NO: 8388286 - DNA, 22 bp, Homo sapiens
actgttcaagcaaatgacattg

SEQ ID NO: 8388287 - DNA, 22 bp, Homo sapiens
actgttcacagattagtcgatg

SEQ ID NO: 8388288 - DNA, 22 bp, Homo sapiens
aatatagatttactcaagagaa

SEQ ID NO: 8388289 - DNA, 22 bp, Homo sapiens
aatatactatactactttctgg

SEQ ID NO: 8388290 - DNA, 19 bp, Homo sapiens
actgggcttgtcctcgtgg

SEQ ID NO: 8388291 - DNA, 22 bp, Homo sapiens
actgggcttcacttggcacatc

SEQ ID NO: 8388292 - DNA, 22 bp, Homo sapiens
actgggctgtggacacccagcg

SEQ ID NO: 8388293 - DNA, 22 bp, Homo sapiens
actgggctgcttgagtgccttc

SEQ ID NO: 8388294 - DNA, 22 bp, Homo sapiens
actgggctggggctcattctcc

SEQ ID NO: 8388295 - DNA, 22 bp, Homo sapiens
actgggctggggctcattctcc

SEQ ID NO: 8388296 - DNA, 22 bp, Homo sapiens
actgggctggttagttttacta

SEQ ID NO: 8388297 - DNA, 22 bp, Homo sapiens
actgggcttatgctgtggagta

SEQ ID NO: 8388298 - DNA, 22 bp, Homo sapiens
actgggcttatttcttgtgaac

SEQ ID NO: 8388299 - DNA, 22 bp, Homo sapiens
actgggcttatttcttgtgaac

SEQ ID NO: 8388300 - DNA, 22 bp, Homo sapiens
actgggcttcacttggcacatc

SEQ ID NO: 8388301 - DNA, 22 bp, Homo sapiens
actgggctgttttttgagtgga

SEQ ID NO: 8388302 - DNA, 23 bp, Homo sapiens
actgggcttatgaggaggcttgt

SEQ ID NO: 8388303 - DNA, 23 bp, Homo sapiens
actgggcttatgaggaggcttgt

SEQ ID NO: 8388304 - DNA, 22 bp, Homo sapiens
aatactgcctgtgaggtaactc

SEQ ID NO: 8388305 - DNA, 22 bp, Homo sapiens
aatactgcctgtgaggtaactc

SEQ ID NO: 8388306 - DNA, 22 bp, Homo sapiens
actgggctgcctggttcttcta

SEQ ID NO: 8388307 - DNA, 22 bp, Homo sapiens
aatactgaaagtattttcaaat

SEQ ID NO: 8388308 - DNA, 22 bp, Homo sapiens
aatactatgtagccaaaataat

SEQ ID NO: 8388309 - DNA, 22 bp, Homo sapiens
aatactagttaaatgaatgaat

SEQ ID NO: 8388310 - DNA, 22 bp, Homo sapiens
aatactagttaaatgaatgaat

SEQ ID NO: 8388311 - DNA, 22 bp, Homo sapiens
aatactagctgcatttaaaggt

SEQ ID NO: 8388312 - DNA, 20 bp, Homo sapiens
aatactaaacacaaagcagt

SEQ ID NO: 8388313 - DNA, 22 bp, Homo sapiens
actgttctcctttggctatatc

SEQ ID NO: 8388314 - DNA, 22 bp, Homo sapiens
actgttcttcccatttatattg

SEQ ID NO: 8388315 - DNA, 19 bp, Homo sapiens
actgttctgtatgttgatt

SEQ ID NO: 8388316 - DNA, 22 bp, Homo sapiens
actttaaaaagagccttctaac

SEQ ID NO: 8388317 - DNA, 22 bp, Homo sapiens
actttatgctaaactttactct

SEQ ID NO: 8388318 - DNA, 23 bp, Homo sapiens
actttattgaccccaggtcagtt

SEQ ID NO: 8388319 - DNA, 23 bp, Homo sapiens
actttattgaccccaggtcagtt

SEQ ID NO: 8388320 - DNA, 22 bp, Homo sapiens
actttatttcctattgcatcca

SEQ ID NO: 8388321 - DNA, 22 bp, Homo sapiens
actttcttaggctgtataaatg

SEQ ID NO: 8388322 - DNA, 22 bp, Homo sapiens
actttcttaggctgtataaatg

SEQ ID NO: 8388323 - DNA, 22 bp, Homo sapiens
actttctgtggttaccagggag

SEQ ID NO: 8388324 - DNA, 22 bp, Homo sapiens
actttcttatccatgatctcac

SEQ ID NO: 8388325 - DNA, 22 bp, Homo sapiens
actttcttggtcccatgtttga

SEQ ID NO: 8388326 - DNA, 22 bp, Homo sapiens
aatcagaaagaggtcatgttgc

SEQ ID NO: 8388327 - DNA, 22 bp, Homo sapiens
aatcagaaagatcttgatgaga

SEQ ID NO: 8388328 - DNA, 19 bp, Homo sapiens
aatcagaaatatcgaggcc

SEQ ID NO: 8388329 - DNA, 22 bp, Homo sapiens
actacagaagtcttattagaga

SEQ ID NO: 8388330 - DNA, 22 bp, Homo sapiens
actagtttgagtaattgtaatg

SEQ ID NO: 8388331 - DNA, 22 bp, Homo sapiens
actagttttcaggcatgtctgg

SEQ ID NO: 8388332 - DNA, 22 bp, Homo sapiens
actagtttttcctctgtcctgt

SEQ ID NO: 8388333 - DNA, 22 bp, Homo sapiens
actatacaccaaaatattaagg

SEQ ID NO: 8388334 - DNA, 22 bp, Homo sapiens
actcagaatgactgatgctgtg

SEQ ID NO: 8388335 - DNA, 22 bp, Homo sapiens
actcagaagatataatgactca

SEQ ID NO: 8388336 - DNA, 22 bp, Homo sapiens
actcaccacagagcagggaacc

SEQ ID NO: 8388337 - DNA, 20 bp, Homo sapiens
actctaactctttacaacag

SEQ ID NO: 8388338 - DNA, 22 bp, Homo sapiens
actccctccaaatctgcacagt

SEQ ID NO: 8388339 - DNA, 22 bp, Homo sapiens
actctacagaatgaatacctgt

SEQ ID NO: 8388340 - DNA, 22 bp, Homo sapiens
actcagagaatatctagaagga

SEQ ID NO: 8388341 - DNA, 22 bp, Homo sapiens
actctataaagatacctcaatt

SEQ ID NO: 8388342 - DNA, 22 bp, Homo sapiens
actctcagagggtggcagcaat

SEQ ID NO: 8388343 - DNA, 22 bp, Homo sapiens
actctccctgagagggaggcat

SEQ ID NO: 8388344 - DNA, 22 bp, Homo sapiens
acctagaatttaaaacattgct

SEQ ID NO: 8388345 - DNA, 23 bp, Homo sapiens
acctagaaatacgttttacatgg

SEQ ID NO: 8388346 - DNA, 22 bp, Homo sapiens
acctagaaactgacagaatatt

SEQ ID NO: 8388347 - DNA, 22 bp, Homo sapiens
acgtgcaggatctggttggcga

SEQ ID NO: 8388348 - DNA, 22 bp, Homo sapiens
acggtgctgggtattggggttc

SEQ ID NO: 8388349 - DNA, 22 bp, Homo sapiens
acggtgaccaagcatcaccgag

SEQ ID NO: 8388350 - DNA, 22 bp, Homo sapiens
acctttatgattcacaatgtat

SEQ ID NO: 8388351 - DNA, 22 bp, Homo sapiens
aagtctctcatggctgacagca

SEQ ID NO: 8388352 - DNA, 22 bp, Homo sapiens
aagtcctttctcatggaggaat

SEQ ID NO: 8388353 - DNA, 18 bp, Homo sapiens
acgtgctgtgccttttgc

SEQ ID NO: 8388354 - DNA, 22 bp, Homo sapiens
acgtgcatctttccatatgtgg

SEQ ID NO: 8388355 - DNA, 22 bp, Homo sapiens
actggccatgggatttatattt

SEQ ID NO: 8388356 - DNA, 22 bp, Homo sapiens
actggccaggcagcagtagctt

SEQ ID NO: 8388357 - DNA, 22 bp, Homo sapiens
actggccaggttcaaaatacag

SEQ ID NO: 8388358 - DNA, 22 bp, Homo sapiens
aataccttttcagtgcacaaaa

SEQ ID NO: 8388359 - DNA, 22 bp, Homo sapiens
actgctagtgagaaaataacca

SEQ ID NO: 8388360 - DNA, 22 bp, Homo sapiens
actgcactccagcctgggtgac

SEQ ID NO: 8388361 - DNA, 19 bp, Homo sapiens
actggagcctgatggagga

SEQ ID NO: 8388362 - DNA, 20 bp, Homo sapiens
actggagccatctcagccta

SEQ ID NO: 8388363 - DNA, 18 bp, Homo sapiens
actggagcattagcagct

SEQ ID NO: 8388364 - DNA, 22 bp, Homo sapiens
actggaggggaaaatggtagta

SEQ ID NO: 8388365 - DNA, 22 bp, Homo sapiens
actggagcttctaaggaggagt

SEQ ID NO: 8388366 - DNA, 22 bp, Homo sapiens
actggaggattcctggaaggcg

SEQ ID NO: 8388367 - DNA, 21 bp, Homo sapiens
actgatattaaccttataaca

SEQ ID NO: 8388368 - DNA, 22 bp, Homo sapiens
actgagtgggaggtttgtgtga

SEQ ID NO: 8388369 - DNA, 22 bp, Homo sapiens
actgatattaaacacaatttaa

SEQ ID NO: 8388370 - DNA, 22 bp, Homo sapiens
actgcactccagcctgggtaac

SEQ ID NO: 8388371 - DNA, 22 bp, Homo sapiens
actgcactccagcctgggtaac

SEQ ID NO: 8388372 - DNA, 22 bp, Homo sapiens
actgcactccaacctgggtgac

SEQ ID NO: 8388373 - DNA, 22 bp, Homo sapiens
actgcactccagcctcggggtc

SEQ ID NO: 8388374 - DNA, 22 bp, Homo sapiens
actgcactccagcccgagcaac

SEQ ID NO: 8388375 - DNA, 22 bp, Homo sapiens
aagcatttttgaaatggtagga

SEQ ID NO: 8388376 - DNA, 22 bp, Homo sapiens
aagccaaggttttggtcacagc

SEQ ID NO: 8388377 - DNA, 22 bp, Homo sapiens
aagccaagtgctggccatgggc

SEQ ID NO: 8388378 - DNA, 22 bp, Homo sapiens
aagccctgggatgttcagcagt

SEQ ID NO: 8388379 - DNA, 22 bp, Homo sapiens
aagcgccatggttcctgcgcag

SEQ ID NO: 8388380 - DNA, 22 bp, Homo sapiens
aagcgcagacacagagagtgga

SEQ ID NO: 8388381 - DNA, 22 bp, Homo sapiens
aagccctggggttgcacaaggc

SEQ ID NO: 8388382 - DNA, 19 bp, Homo sapiens
aagcgtttcccacttgctt

SEQ ID NO: 8388383 - DNA, 22 bp, Homo sapiens
aagctacaatgtgtttttgaaa

SEQ ID NO: 8388384 - DNA, 22 bp, Homo sapiens
aagctagataacttttatattt

SEQ ID NO: 8388385 - DNA, 22 bp, Homo sapiens
aagctacattaagcagatttac

SEQ ID NO: 8388386 - DNA, 22 bp, Homo sapiens
aagctagattggcattcatttc

SEQ ID NO: 8388387 - DNA, 21 bp, Homo sapiens
acagcctgtcatctcatggtc

SEQ ID NO: 8388388 - DNA, 21 bp, Homo sapiens
acagcctgtcatctcatggtc

SEQ ID NO: 8388389 - DNA, 22 bp, Homo sapiens
acagcctggcctgagttaaggc

SEQ ID NO: 8388390 - DNA, 19 bp, Homo sapiens
acagcctgttggtggggct

SEQ ID NO: 8388391 - DNA, 22 bp, Homo sapiens
acagcctgtgtaccagctggga

SEQ ID NO: 8388392 - DNA, 22 bp, Homo sapiens
acagcctgtttgatctggtgct

SEQ ID NO: 8388393 - DNA, 19 bp, Homo sapiens
acagcctgttggtggggct

SEQ ID NO: 8388394 - DNA, 22 bp, Homo sapiens
aagcattttagataaagcatca

SEQ ID NO: 8388395 - DNA, 22 bp, Homo sapiens
aagcatttttcacagcaacagc

SEQ ID NO: 8388396 - DNA, 22 bp, Homo sapiens
aagcatttttcacagcaacagc

SEQ ID NO: 8388397 - DNA, 22 bp, Homo sapiens
aagcatttttcacagcaacagc

SEQ ID NO: 8388398 - DNA, 22 bp, Homo sapiens
aagcattttgttttaagaatga

SEQ ID NO: 8388399 - DNA, 19 bp, Homo sapiens
acagggcagcaataggata

SEQ ID NO: 8388400 - DNA, 22 bp, Homo sapiens
aagctgcctagagttgaatgtc

SEQ ID NO: 8388401 - DNA, 22 bp, Homo sapiens
aagctgccttccatgtgaggaa

SEQ ID NO: 8388402 - DNA, 22 bp, Homo sapiens
acagggcagagggcagttggta

SEQ ID NO: 8388403 - DNA, 22 bp, Homo sapiens
acagggcagcaactttgtgcct

SEQ ID NO: 8388404 - DNA, 19 bp, Homo sapiens
acagggcagcaataggata

SEQ ID NO: 8388405 - DNA, 22 bp, Homo sapiens
acagggcagagaggcaggcttg

SEQ ID NO: 8388406 - DNA, 22 bp, Homo sapiens
acagggcagaaatgttgcatct

SEQ ID NO: 8388407 - DNA, 22 bp, Homo sapiens
acagggcagaaatgttgcatct

SEQ ID NO: 8388408 - DNA, 22 bp, Homo sapiens
aagctctgctcagcagactagg

SEQ ID NO: 8388409 - DNA, 17 bp, Homo sapiens
acagggcagaaacagct

SEQ ID NO: 8388410 - DNA, 22 bp, Homo sapiens
acagggaacaggaatatacaaa

SEQ ID NO: 8388411 - DNA, 18 bp, Homo sapiens
aagctcttaaatggttca

SEQ ID NO: 8388412 - DNA, 23 bp, Homo sapiens
acagggaaaagtcatcagtgtga

SEQ ID NO: 8388413 - DNA, 22 bp, Homo sapiens
acagggaaagggacagcagcag

SEQ ID NO: 8388414 - DNA, 22 bp, Homo sapiens
acagggaaagggacagcagcag

SEQ ID NO: 8388415 - DNA, 22 bp, Homo sapiens
aagctcagagtagctcagcgtc

SEQ ID NO: 8388416 - DNA, 22 bp, Homo sapiens
aagctcagagtctcggagggaa

SEQ ID NO: 8388417 - DNA, 22 bp, Homo sapiens
aagctctgaggtgagcaatcgg

SEQ ID NO: 8388418 - DNA, 22 bp, Homo sapiens
aagctcatgggtgctgtacttt

SEQ ID NO: 8388419 - DNA, 22 bp, Homo sapiens
aagctcattaattagaagctaa

SEQ ID NO: 8388420 - DNA, 22 bp, Homo sapiens
aagctcagtgatgcctccaggg

SEQ ID NO: 8388421 - DNA, 20 bp, Homo sapiens
aaggagaatgacacggctgc

SEQ ID NO: 8388422 - DNA, 22 bp, Homo sapiens
aaggagacttggcatcacttaa

SEQ ID NO: 8388423 - DNA, 22 bp, Homo sapiens
aaggagagagctttgctggaac

SEQ ID NO: 8388424 - DNA, 22 bp, Homo sapiens
aaggagagagctttgctggaac

SEQ ID NO: 8388425 - DNA, 22 bp, Homo sapiens
aaggagagtacaggagttggta

SEQ ID NO: 8388426 - DNA, 22 bp, Homo sapiens
aaggagaggttgtccgtgttgt

SEQ ID NO: 8388427 - DNA, 22 bp, Homo sapiens
aaggagattgttaaagctatat

SEQ ID NO: 8388428 - DNA, 22 bp, Homo sapiens
aaggagagtacaggagttggta

SEQ ID NO: 8388429 - DNA, 22 bp, Homo sapiens
aaggagctgggagggacacatg

SEQ ID NO: 8388430 - DNA, 22 bp, Homo sapiens
acagtctttcagtaataatact

SEQ ID NO: 8388431 - DNA, 22 bp, Homo sapiens
acagtctttaatttctttgtgg

SEQ ID NO: 8388432 - DNA, 17 bp, Homo sapiens
acagtgtctatgaaatg

SEQ ID NO: 8388433 - DNA, 22 bp, Homo sapiens
acagtgtctcactgctgaaatc

SEQ ID NO: 8388434 - DNA, 16 bp, Homo sapiens
acagtgtctcaagcac

SEQ ID NO: 8388435 - DNA, 22 bp, Homo sapiens
acagtcttcatgctagaatggc

SEQ ID NO: 8388436 - DNA, 22 bp, Homo sapiens
acagtcttgagcatcagccaga

SEQ ID NO: 8388437 - DNA, 22 bp, Homo sapiens
acagtcttcccttattccactc

SEQ ID NO: 8388438 - DNA, 22 bp, Homo sapiens
acagtcttgcacttctatcagc

SEQ ID NO: 8388439 - DNA, 22 bp, Homo sapiens
acagtcttgcacttctatcagc

SEQ ID NO: 8388440 - DNA, 19 bp, Homo sapiens
acagtcttacaaatgtcca

SEQ ID NO: 8388441 - DNA, 22 bp, Homo sapiens
acagtcttaatggataggagct

SEQ ID NO: 8388442 - DNA, 22 bp, Homo sapiens
acagtcttatgcatacactatt

SEQ ID NO: 8388443 - DNA, 22 bp, Homo sapiens
acagtcttatgcatacactatt

SEQ ID NO: 8388444 - DNA, 22 bp, Homo sapiens
acagtcttatgcatacactatt

SEQ ID NO: 8388445 - DNA, 22 bp, Homo sapiens
acagtcttatgcatacactatt

SEQ ID NO: 8388446 - DNA, 22 bp, Homo sapiens
aaggaggaatgtagccagctcc

SEQ ID NO: 8388447 - DNA, 22 bp, Homo sapiens
acagtgtttatgtacagattgt

SEQ ID NO: 8388448 - DNA, 22 bp, Homo sapiens
aaggaggaattctgagttcatg

SEQ ID NO: 8388449 - DNA, 22 bp, Homo sapiens
aaggaggaatttcagggtgaat

SEQ ID NO: 8388450 - DNA, 22 bp, Homo sapiens
acatatgcgatcataggatgca

SEQ ID NO: 8388451 - DNA, 22 bp, Homo sapiens
acatatgcgatcataggatgca

SEQ ID NO: 8388452 - DNA, 22 bp, Homo sapiens
aaggcagagtctatcttggaag

SEQ ID NO: 8388453 - DNA, 22 bp, Homo sapiens
aaggcagaggaaggtctagttt

SEQ ID NO: 8388454 - DNA, 22 bp, Homo sapiens
aaggcagagggctggatcagag

SEQ ID NO: 8388455 - DNA, 22 bp, Homo sapiens
acatatgtgttgtacatgcatg

SEQ ID NO: 8388456 - DNA, 22 bp, Homo sapiens
aaggcagagattagcagaatga

SEQ ID NO: 8388457 - DNA, 22 bp, Homo sapiens
aaggcagaggaaggtctagttt

SEQ ID NO: 8388458 - DNA, 21 bp, Homo sapiens
aaggctggagatgcaggtctg

SEQ ID NO: 8388459 - DNA, 22 bp, Homo sapiens
aaggctggagatggttggaatg

SEQ ID NO: 8388460 - DNA, 19 bp, Homo sapiens
aaggctggagaaggcctct

SEQ ID NO: 8388461 - DNA, 19 bp, Homo sapiens
aaggctggagaaggcctct

SEQ ID NO: 8388462 - DNA, 21 bp, Homo sapiens
aaggctggagatgcaggtctg

SEQ ID NO: 8388463 - DNA, 19 bp, Homo sapiens
acatttaaattcagatctc

SEQ ID NO: 8388464 - DNA, 22 bp, Homo sapiens
acatttaaatatgccttatatt

SEQ ID NO: 8388465 - DNA, 19 bp, Homo sapiens
aaggctggagaaggcctct

SEQ ID NO: 8388466 - DNA, 22 bp, Homo sapiens
aaggctggacctggatgaatct

SEQ ID NO: 8388467 - DNA, 22 bp, Homo sapiens
acatttaaatacctatgtttct

SEQ ID NO: 8388468 - DNA, 22 bp, Homo sapiens
acatttaaatacctatgtttct

SEQ ID NO: 8388469 - DNA, 22 bp, Homo sapiens
acatttaaatacctatgtttct

SEQ ID NO: 8388470 - DNA, 22 bp, Homo sapiens
acatttaaatacctatgtttct

SEQ ID NO: 8388471 - DNA, 22 bp, Homo sapiens
acattgtttgagaatacagatg

SEQ ID NO: 8388472 - DNA, 22 bp, Homo sapiens
acattgtttgagaatacagatg

SEQ ID NO: 8388473 - DNA, 22 bp, Homo sapiens
acattgttgagcctcttgttca

SEQ ID NO: 8388474 - DNA, 22 bp, Homo sapiens
acattgttctacttctagttag

SEQ ID NO: 8388475 - DNA, 22 bp, Homo sapiens
acattgttgcctagccatgagt

SEQ ID NO: 8388476 - DNA, 22 bp, Homo sapiens
acattgttgtgcaattatagtt

SEQ ID NO: 8388477 - DNA, 22 bp, Homo sapiens
acattgtttgagaatacagatg

SEQ ID NO: 8388478 - DNA, 22 bp, Homo sapiens
acatttctggagtttctcaaca

SEQ ID NO: 8388479 - DNA, 22 bp, Homo sapiens
acatttctggagtttctcaaca

SEQ ID NO: 8388480 - DNA, 22 bp, Homo sapiens
acatttcttcctaattatccct

SEQ ID NO: 8388481 - DNA, 22 bp, Homo sapiens
aaggctgggaaacatgcaggcc

SEQ ID NO: 8388482 - DNA, 22 bp, Homo sapiens
aaggctggcaatatatttgtta

SEQ ID NO: 8388483 - DNA, 22 bp, Homo sapiens
acatttctcttgatgtctctat

SEQ ID NO: 8388484 - DNA, 20 bp, Homo sapiens
aaggcagagtgggttggagc

SEQ ID NO: 8388485 - DNA, 22 bp, Homo sapiens
aaggccaggggctggcgcctcc

SEQ ID NO: 8388486 - DNA, 22 bp, Homo sapiens
aaggccagggatgccagctcgg

SEQ ID NO: 8388487 - DNA, 22 bp, Homo sapiens
aaggcagataagaattcagcaa

SEQ ID NO: 8388488 - DNA, 22 bp, Homo sapiens
aaggcagataagaattcagcaa

SEQ ID NO: 8388489 - DNA, 22 bp, Homo sapiens
aaggcctcaggtgaggctgccc

SEQ ID NO: 8388490 - DNA, 22 bp, Homo sapiens
aaggcccttggaaaatgcagta

SEQ ID NO: 8388491 - DNA, 22 bp, Homo sapiens
aaggcctccctgtgtgcaggtg

SEQ ID NO: 8388492 - DNA, 22 bp, Homo sapiens
aaggcctccctctttcatggga

SEQ ID NO: 8388493 - DNA, 22 bp, Homo sapiens
aaggcctccgccaatggcagag

SEQ ID NO: 8388494 - DNA, 22 bp, Homo sapiens
aaggcctcttctctctggagat

SEQ ID NO: 8388495 - DNA, 22 bp, Homo sapiens
aaggctcactgaaatgtaggca

SEQ ID NO: 8388496 - DNA, 22 bp, Homo sapiens
aaggctctgcaaaacctccaag

SEQ ID NO: 8388497 - DNA, 22 bp, Homo sapiens
aaggctctctgatggcagcagt

SEQ ID NO: 8388498 - DNA, 22 bp, Homo sapiens
aaggctctccaaatgatataat

SEQ ID NO: 8388499 - DNA, 22 bp, Homo sapiens
aaggctctgggtttcataggtg

SEQ ID NO: 8388500 - DNA, 22 bp, Homo sapiens
aaggctctgcaaaacctccaag

SEQ ID NO: 8388501 - DNA, 22 bp, Homo sapiens
acattttgaaagggaaattgtt

SEQ ID NO: 8388502 - DNA, 20 bp, Homo sapiens
acatttgtggatctgagaga

SEQ ID NO: 8388503 - DNA, 22 bp, Homo sapiens
acattttaatatgcttagtgtg

SEQ ID NO: 8388504 - DNA, 22 bp, Homo sapiens
acattttaatatgcttagtgtg

SEQ ID NO: 8388505 - DNA, 22 bp, Homo sapiens
acatttgtttctctagagtagg

SEQ ID NO: 8388506 - DNA, 21 bp, Homo sapiens
acattttctgttttaggaagt

SEQ ID NO: 8388507 - DNA, 22 bp, Homo sapiens
acattttaatatgcttagtgtg

SEQ ID NO: 8388508 - DNA, 22 bp, Homo sapiens
acattttacaccaagacttctt

SEQ ID NO: 8388509 - DNA, 22 bp, Homo sapiens
accatgttggccaagctggtct

SEQ ID NO: 8388510 - DNA, 22 bp, Homo sapiens
acccagagcccttagcacagac

SEQ ID NO: 8388511 - DNA, 22 bp, Homo sapiens
acccagagcccttagcacagac

SEQ ID NO: 8388512 - DNA, 22 bp, Homo sapiens
aagggcttaggattttgctgtg

SEQ ID NO: 8388513 - DNA, 22 bp, Homo sapiens
acccagagtcagacagccatgg

SEQ ID NO: 8388514 - DNA, 22 bp, Homo sapiens
acccagagtcagacagccatgg

SEQ ID NO: 8388515 - DNA, 22 bp, Homo sapiens
acccagagctgggcttggcaaa

SEQ ID NO: 8388516 - DNA, 22 bp, Homo sapiens
acccagaggcggaggttgcagt

SEQ ID NO: 8388517 - DNA, 22 bp, Homo sapiens
acccagaggtgtctagcaagct

SEQ ID NO: 8388518 - DNA, 22 bp, Homo sapiens
acccagagtaacagatggattc

SEQ ID NO: 8388519 - DNA, 22 bp, Homo sapiens
acccagaggtgtctagcaagct

SEQ ID NO: 8388520 - DNA, 22 bp, Homo sapiens
acccagaggtgtctagcaagct

SEQ ID NO: 8388521 - DNA, 22 bp, Homo sapiens
accccttctcctggctgttcca

SEQ ID NO: 8388522 - DNA, 22 bp, Homo sapiens
accctgaagcaggcactcagct

SEQ ID NO: 8388523 - DNA, 22 bp, Homo sapiens
accctgaagaaacttctaagtg

SEQ ID NO: 8388524 - DNA, 22 bp, Homo sapiens
accctgaaagcatcctcctgtc

SEQ ID NO: 8388525 - DNA, 22 bp, Homo sapiens
gtggcagaggttcctcagtgtg

SEQ ID NO: 8388526 - DNA, 22 bp, Homo sapiens
gtggcagagtgcggttctgacc

SEQ ID NO: 8388527 - DNA, 22 bp, Homo sapiens
gtggcagagtgcggttctgacc

SEQ ID NO: 8388528 - DNA, 22 bp, Homo sapiens
gtggcagattgctcaccatggt

SEQ ID NO: 8388529 - DNA, 22 bp, Homo sapiens
gtggcagagccttgcggctttg

SEQ ID NO: 8388530 - DNA, 22 bp, Homo sapiens
gtggcagagggtgagctggact

SEQ ID NO: 8388531 - DNA, 22 bp, Homo sapiens
gtggcagagggtgagctggact

SEQ ID NO: 8388532 - DNA, 22 bp, Homo sapiens
gtggcagagggtgagctggact

SEQ ID NO: 8388533 - DNA, 22 bp, Homo sapiens
gtggcagagccaggctttgaac

SEQ ID NO: 8388534 - DNA, 22 bp, Homo sapiens
gtggcacagggttgttggtcat

SEQ ID NO: 8388535 - DNA, 22 bp, Homo sapiens
gtggcacagagatggggcatga

SEQ ID NO: 8388536 - DNA, 22 bp, Homo sapiens
gtggatggagctggaagccatt

SEQ ID NO: 8388537 - DNA, 22 bp, Homo sapiens
gtggatggattgaggcagtggg

SEQ ID NO: 8388538 - DNA, 22 bp, Homo sapiens
gtggatggagcagtgacccagg

SEQ ID NO: 8388539 - DNA, 22 bp, Homo sapiens
gtggatggagcagtgacccagg

SEQ ID NO: 8388540 - DNA, 22 bp, Homo sapiens
gtggatggagctggaagccatt

SEQ ID NO: 8388541 - DNA, 22 bp, Homo sapiens
gtggatggccctgcacacaggt

SEQ ID NO: 8388542 - DNA, 22 bp, Homo sapiens
gtggatggattgaggcagtggg

SEQ ID NO: 8388543 - DNA, 22 bp, Homo sapiens
gtggatggattttgaggaatgg

SEQ ID NO: 8388544 - DNA, 22 bp, Homo sapiens
gtggattacaagacagttgaga

SEQ ID NO: 8388545 - DNA, 22 bp, Homo sapiens
gtggatggctagttgagaaggg

SEQ ID NO: 8388546 - DNA, 22 bp, Homo sapiens
gtggagagagataagcctggtc

SEQ ID NO: 8388547 - DNA, 22 bp, Homo sapiens
gtggacagcttctaggtgccag

SEQ ID NO: 8388548 - DNA, 22 bp, Homo sapiens
gtggacagcttctaggtgccag

SEQ ID NO: 8388549 - DNA, 22 bp, Homo sapiens
gtggacagcttctaggtgccag

SEQ ID NO: 8388550 - DNA, 22 bp, Homo sapiens
gtggacagagctagaaaatgtg

SEQ ID NO: 8388551 - DNA, 22 bp, Homo sapiens
gtggacagacataatcctaatt

SEQ ID NO: 8388552 - DNA, 22 bp, Homo sapiens
gtggacagagactaaatgttgt

SEQ ID NO: 8388553 - DNA, 22 bp, Homo sapiens
gtggagagagtgacagcatctt

SEQ ID NO: 8388554 - DNA, 22 bp, Homo sapiens
gtggatgcttaggcagcctggg

SEQ ID NO: 8388555 - DNA, 22 bp, Homo sapiens
gtggatggacatgggcaagagg

SEQ ID NO: 8388556 - DNA, 22 bp, Homo sapiens
gtggatctactgtatgggatag

SEQ ID NO: 8388557 - DNA, 22 bp, Homo sapiens
gtggagtggtgatggataggtt

SEQ ID NO: 8388558 - DNA, 22 bp, Homo sapiens
gtggagtgcaacggttggagtt

SEQ ID NO: 8388559 - DNA, 22 bp, Homo sapiens
gtggagtggcctggccctgaga

SEQ ID NO: 8388560 - DNA, 22 bp, Homo sapiens
gtggagggtttgcaatgtgcag

SEQ ID NO: 8388561 - DNA, 22 bp, Homo sapiens
gtggagggtgagctcatgtttg

SEQ ID NO: 8388562 - DNA, 22 bp, Homo sapiens
gtggagggaatgaatcttctct

SEQ ID NO: 8388563 - DNA, 22 bp, Homo sapiens
gtggagggtgattgccggctgt

SEQ ID NO: 8388564 - DNA, 18 bp, Homo sapiens
gtggagggttctcagaat

SEQ ID NO: 8388565 - DNA, 22 bp, Homo sapiens
gtgcctgcagcaatccatggca

SEQ ID NO: 8388566 - DNA, 22 bp, Homo sapiens
gtgcctggaactgggtaggctg

SEQ ID NO: 8388567 - DNA, 22 bp, Homo sapiens
gtgcctggaatgcgcctcggcg

SEQ ID NO: 8388568 - DNA, 22 bp, Homo sapiens
gtgaccagccagtgctgtctgt

SEQ ID NO: 8388569 - DNA, 22 bp, Homo sapiens
gtgacaggcccagtgggatgca

SEQ ID NO: 8388570 - DNA, 22 bp, Homo sapiens
gtgacagatttgctgcgcatgg

SEQ ID NO: 8388571 - DNA, 22 bp, Homo sapiens
gtgacagagttttagatctcat

SEQ ID NO: 8388572 - DNA, 22 bp, Homo sapiens
gtgacaaaaacactgattattt

SEQ ID NO: 8388573 - DNA, 22 bp, Homo sapiens
gtgaatttctgactaaaagtgc

SEQ ID NO: 8388574 - DNA, 20 bp, Homo sapiens
gtgaagggagtcaggtgtgc

SEQ ID NO: 8388575 - DNA, 22 bp, Homo sapiens
gtgaaggccagtagggtcctgg

SEQ ID NO: 8388576 - DNA, 22 bp, Homo sapiens
gtgctacagactgagtacactt

SEQ ID NO: 8388577 - DNA, 22 bp, Homo sapiens
gtgctaaatattgtgtttgtct

SEQ ID NO: 8388578 - DNA, 22 bp, Homo sapiens
gtgcgcaccctcccggcatccc

SEQ ID NO: 8388579 - DNA, 22 bp, Homo sapiens
gtgccttccccggtggtctgtt

SEQ ID NO: 8388580 - DNA, 23 bp, Homo sapiens
gtgcgccaggacaacctgacgga

SEQ ID NO: 8388581 - DNA, 23 bp, Homo sapiens
gtgcgccaggacaacctgacgga

SEQ ID NO: 8388582 - DNA, 20 bp, Homo sapiens
gtgcctggagaagaggctgt

SEQ ID NO: 8388583 - DNA, 20 bp, Homo sapiens
gtgcctggagaagaggctgt

SEQ ID NO: 8388584 - DNA, 22 bp, Homo sapiens
gtgcctggcacacagaaggcaa

SEQ ID NO: 8388585 - DNA, 22 bp, Homo sapiens
gtgcctggcagggtcagctgct

SEQ ID NO: 8388586 - DNA, 22 bp, Homo sapiens
gtgctttttataaggcagactg

SEQ ID NO: 8388587 - DNA, 22 bp, Homo sapiens
gtgctttttcaatcagaaggga

SEQ ID NO: 8388588 - DNA, 22 bp, Homo sapiens
gtgctttttcaatcagaaggga

SEQ ID NO: 8388589 - DNA, 22 bp, Homo sapiens
gtggaaggaagagatggcccca

SEQ ID NO: 8388590 - DNA, 22 bp, Homo sapiens
gtggaagggtcacagcccctac

SEQ ID NO: 8388591 - DNA, 22 bp, Homo sapiens
gtggaaggtgaaggagcagcga

SEQ ID NO: 8388592 - DNA, 22 bp, Homo sapiens
gtggaagggactgcctagagga

SEQ ID NO: 8388593 - DNA, 22 bp, Homo sapiens
gtggaatggccatgggatcctt

SEQ ID NO: 8388594 - DNA, 20 bp, Homo sapiens
gtggaatgcactctgtgctg

SEQ ID NO: 8388595 - DNA, 22 bp, Homo sapiens
gtggcctctgttggctcctagg

SEQ ID NO: 8388596 - DNA, 23 bp, Homo sapiens
gtggcctccccggaatgcctcgc

SEQ ID NO: 8388597 - DNA, 22 bp, Homo sapiens
gtggcctctgttggctcctagg

SEQ ID NO: 8388598 - DNA, 22 bp, Homo sapiens
gtggctcttgcatggggtctct

SEQ ID NO: 8388599 - DNA, 22 bp, Homo sapiens
gtggctctttatgtgttattgg

SEQ ID NO: 8388600 - DNA, 22 bp, Homo sapiens
gtggctcttgcatggggtctct

SEQ ID NO: 8388601 - DNA, 22 bp, Homo sapiens
gtggctctggctttccaggcgg

SEQ ID NO: 8388602 - DNA, 22 bp, Homo sapiens
gtggctctgtaaaatgcctgca

SEQ ID NO: 8388603 - DNA, 21 bp, Homo sapiens
gtggctctgccaggactgaaa

SEQ ID NO: 8388604 - DNA, 22 bp, Homo sapiens
gtggctctctggtcccctgcca

SEQ ID NO: 8388605 - DNA, 22 bp, Homo sapiens
gtggctctcgccagcctgcggg

SEQ ID NO: 8388606 - DNA, 22 bp, Homo sapiens
gtggctctccattgacatggaa

SEQ ID NO: 8388607 - DNA, 22 bp, Homo sapiens
gtggctctccattgacatggaa

SEQ ID NO: 8388608 - DNA, 22 bp, Homo sapiens
gtggctcagcggagctctgcac

SEQ ID NO: 8388609 - DNA, 22 bp, Homo sapiens
gtggctcagttaacttccatgt

SEQ ID NO: 8388610 - DNA, 22 bp, Homo sapiens
gtggctcatctttgggaagtaa

SEQ ID NO: 8388611 - DNA, 22 bp, Homo sapiens
gtggctcagttaacttccatgt

SEQ ID NO: 8388612 - DNA, 19 bp, Homo sapiens
gtggctcatgtagtgggcc

SEQ ID NO: 8388613 - DNA, 22 bp, Homo sapiens
gtggctctaggtgagcatggag

SEQ ID NO: 8388614 - DNA, 22 bp, Homo sapiens
gtggctctaggtgagcatggag

SEQ ID NO: 8388615 - DNA, 22 bp, Homo sapiens
gtggctccgcaggctccattct

SEQ ID NO: 8388616 - DNA, 22 bp, Homo sapiens
gtgggagccctcagggaggtgc

SEQ ID NO: 8388617 - DNA, 22 bp, Homo sapiens
gtgggagccctcagggaggtgc

SEQ ID NO: 8388618 - DNA, 22 bp, Homo sapiens
gtggcttcatgaacactgatga

SEQ ID NO: 8388619 - DNA, 22 bp, Homo sapiens
gtggcttccaagactaagtcac

SEQ ID NO: 8388620 - DNA, 22 bp, Homo sapiens
gtgggagaaattagctctagtt

SEQ ID NO: 8388621 - DNA, 22 bp, Homo sapiens
gtgggagtggggaagcagagtg

SEQ ID NO: 8388622 - DNA, 22 bp, Homo sapiens
gtgggagtggagctcagcatgt

SEQ ID NO: 8388623 - DNA, 22 bp, Homo sapiens
gtgggagctttggcatcaggct

SEQ ID NO: 8388624 - DNA, 22 bp, Homo sapiens
gtgggagctgcggaggcctggg

SEQ ID NO: 8388625 - DNA, 22 bp, Homo sapiens
gtgggagctgcggaggcctggg

SEQ ID NO: 8388626 - DNA, 22 bp, Homo sapiens
gtggccagcaagtgctgcctct

SEQ ID NO: 8388627 - DNA, 22 bp, Homo sapiens
gtggccagccagggtgctgatg

SEQ ID NO: 8388628 - DNA, 22 bp, Homo sapiens
gtggccagaggtcccatgtgtc

SEQ ID NO: 8388629 - DNA, 18 bp, Homo sapiens
gtggccagcctggtcttg

SEQ ID NO: 8388630 - DNA, 22 bp, Homo sapiens
gtggcccaggctggagtgcagt

SEQ ID NO: 8388631 - DNA, 22 bp, Homo sapiens
gtggcccaggcttggcgctggc

SEQ ID NO: 8388632 - DNA, 22 bp, Homo sapiens
gtggcccaggcaccctgatgac

SEQ ID NO: 8388633 - DNA, 22 bp, Homo sapiens
gtggcccatcacgtttcgcctt

SEQ ID NO: 8388634 - DNA, 22 bp, Homo sapiens
gtggcccaggttggagtgcagt

SEQ ID NO: 8388635 - DNA, 22 bp, Homo sapiens
gtggcccagccctacagaggac

SEQ ID NO: 8388636 - DNA, 22 bp, Homo sapiens
gtggcccacttacgtcatgtgt

SEQ ID NO: 8388637 - DNA, 22 bp, Homo sapiens
gtggccaggagaccttgggcat

SEQ ID NO: 8388638 - DNA, 22 bp, Homo sapiens
gtggcagggtgctcatcatgca

SEQ ID NO: 8388639 - DNA, 22 bp, Homo sapiens
gtggcagtgccgtttggttcag

SEQ ID NO: 8388640 - DNA, 20 bp, Homo sapiens
gtggcagtggtggcagcagt

SEQ ID NO: 8388641 - DNA, 20 bp, Homo sapiens
gtggcagtggtggcagcagt

SEQ ID NO: 8388642 - DNA, 22 bp, Homo sapiens
gtggcagtgtggagggaggagt

SEQ ID NO: 8388643 - DNA, 22 bp, Homo sapiens
gtggcatcgtctgaggtggggt

SEQ ID NO: 8388644 - DNA, 22 bp, Homo sapiens
gtggcatcagagctccctccag

SEQ ID NO: 8388645 - DNA, 22 bp, Homo sapiens
gtggcatcaagatttagattca

SEQ ID NO: 8388646 - DNA, 22 bp, Homo sapiens
gtggcagtgtggagggaggagt

SEQ ID NO: 8388647 - DNA, 22 bp, Homo sapiens
gtggcatctcagaggccaagaa

SEQ ID NO: 8388648 - DNA, 22 bp, Homo sapiens
gtggcatgacagtgaatgggca

SEQ ID NO: 8388649 - DNA, 22 bp, Homo sapiens
gtggcagggcaatgctccctct

SEQ ID NO: 8388650 - DNA, 20 bp, Homo sapiens
gtggcaggcagtgaaggagc

SEQ ID NO: 8388651 - DNA, 22 bp, Homo sapiens
ggtgtatacctacacatttttg

SEQ ID NO: 8388652 - DNA, 22 bp, Homo sapiens
ggtgtcaaattattgagtttca

SEQ ID NO: 8388653 - DNA, 22 bp, Homo sapiens
ggtgtcaaaataccatttcagg

SEQ ID NO: 8388654 - DNA, 22 bp, Homo sapiens
ggtgtcaatgctcccaccttgg

SEQ ID NO: 8388655 - DNA, 22 bp, Homo sapiens
ggtgtcacaggaggccgtgtgg

SEQ ID NO: 8388656 - DNA, 22 bp, Homo sapiens
ggtggcaggccctgagcatccc

SEQ ID NO: 8388657 - DNA, 22 bp, Homo sapiens
ggtggcaggctggcattggcaa

SEQ ID NO: 8388658 - DNA, 22 bp, Homo sapiens
ggtggcaggctggcattggcaa

SEQ ID NO: 8388659 - DNA, 23 bp, Homo sapiens
ggtggcaggagtggatgctgagc

SEQ ID NO: 8388660 - DNA, 19 bp, Homo sapiens
ggtggcaggaataaaggtc

SEQ ID NO: 8388661 - DNA, 22 bp, Homo sapiens
ggtggcagcgtctatctgacat

SEQ ID NO: 8388662 - DNA, 22 bp, Homo sapiens
ggtggcattcagaagagctggc

SEQ ID NO: 8388663 - DNA, 22 bp, Homo sapiens
ggtggcattcagtaagtatata

SEQ ID NO: 8388664 - DNA, 22 bp, Homo sapiens
ggtggcattgatccctcccagc

SEQ ID NO: 8388665 - DNA, 22 bp, Homo sapiens
ggtggcatttaaattaattaag

SEQ ID NO: 8388666 - DNA, 22 bp, Homo sapiens
ggtggcataagaacactaaaga

SEQ ID NO: 8388667 - DNA, 22 bp, Homo sapiens
ggtggcatacaacatagaggct

SEQ ID NO: 8388668 - DNA, 22 bp, Homo sapiens
ggtggcatggcagttgatgtaa

SEQ ID NO: 8388669 - DNA, 22 bp, Homo sapiens
ggtggcatggcaaagaaatagc

SEQ ID NO: 8388670 - DNA, 22 bp, Homo sapiens
ggtggcatctctttccagattt

SEQ ID NO: 8388671 - DNA, 22 bp, Homo sapiens
ggtggcatacatttctgtcttg

SEQ ID NO: 8388672 - DNA, 22 bp, Homo sapiens
ggtggcatcacagtactggggg

SEQ ID NO: 8388673 - DNA, 22 bp, Homo sapiens
ggtggcatctcagttcatgggc

SEQ ID NO: 8388674 - DNA, 22 bp, Homo sapiens
ggtgaggggagagtgaaagaaa

SEQ ID NO: 8388675 - DNA, 22 bp, Homo sapiens
ggtgagggtaaactaaaacatc

SEQ ID NO: 8388676 - DNA, 22 bp, Homo sapiens
gggtggggccaggcaatttgca

SEQ ID NO: 8388677 - DNA, 22 bp, Homo sapiens
gggtggggcccaggaaatctat

SEQ ID NO: 8388678 - DNA, 22 bp, Homo sapiens
gggtggggtgtatcggatccta

SEQ ID NO: 8388679 - DNA, 22 bp, Homo sapiens
gggtggggttcaggaatcttca

SEQ ID NO: 8388680 - DNA, 22 bp, Homo sapiens
ggtggcagaggtgcatcagccc

SEQ ID NO: 8388681 - DNA, 22 bp, Homo sapiens
ggtggcagagaggaggtagttt

SEQ ID NO: 8388682 - DNA, 22 bp, Homo sapiens
ggtgcaggcggtggggcaagta

SEQ ID NO: 8388683 - DNA, 22 bp, Homo sapiens
ggtgagtttcatggttgtttac

SEQ ID NO: 8388684 - DNA, 22 bp, Homo sapiens
ggtgcaggaatctgcaattgaa

SEQ ID NO: 8388685 - DNA, 22 bp, Homo sapiens
ggtgcaggacgaagtgggggtt

SEQ ID NO: 8388686 - DNA, 22 bp, Homo sapiens
gtatatatgtgtgaacatgtat

SEQ ID NO: 8388687 - DNA, 22 bp, Homo sapiens
gtatatgagctctatgtaatgg

SEQ ID NO: 8388688 - DNA, 22 bp, Homo sapiens
gtatatatcggcactattttaa

SEQ ID NO: 8388689 - DNA, 22 bp, Homo sapiens
gtatatatcggcactattttaa

SEQ ID NO: 8388690 - DNA, 22 bp, Homo sapiens
gtatacatagatgatgaacaag

SEQ ID NO: 8388691 - DNA, 22 bp, Homo sapiens
gtacatttactgatgaaaagta

SEQ ID NO: 8388692 - DNA, 22 bp, Homo sapiens
gtatacatgtggtaaaatgcac

SEQ ID NO: 8388693 - DNA, 22 bp, Homo sapiens
gtatacatgtggtaaaatgcac

SEQ ID NO: 8388694 - DNA, 22 bp, Homo sapiens
gtatacatttattacaggtctt

SEQ ID NO: 8388695 - DNA, 22 bp, Homo sapiens
gtacatattataaaatacagct

SEQ ID NO: 8388696 - DNA, 22 bp, Homo sapiens
gtacagaggttgctggaggctc

SEQ ID NO: 8388697 - DNA, 22 bp, Homo sapiens
gtacagaaggagctttggattc

SEQ ID NO: 8388698 - DNA, 22 bp, Homo sapiens
gtacagagaaggttacatatga

SEQ ID NO: 8388699 - DNA, 22 bp, Homo sapiens
gtaaagaagtttttgaatgcat

SEQ ID NO: 8388700 - DNA, 22 bp, Homo sapiens
gtaaagaagtttttgaatgcat

SEQ ID NO: 8388701 - DNA, 22 bp, Homo sapiens
gtaaagaaggcaacctggttat

SEQ ID NO: 8388702 - DNA, 22 bp, Homo sapiens
gtaaagaaggcaacctggttat

SEQ ID NO: 8388703 - DNA, 22 bp, Homo sapiens
gtaaacattactgtgctgtata

SEQ ID NO: 8388704 - DNA, 22 bp, Homo sapiens
gtaaaatagaataacgtggcta

SEQ ID NO: 8388705 - DNA, 22 bp, Homo sapiens
gtaaacatgctgtgtactcagc

SEQ ID NO: 8388706 - DNA, 22 bp, Homo sapiens
gtctgggctcctggcaggcagc

SEQ ID NO: 8388707 - DNA, 22 bp, Homo sapiens
gtctgggctcccagggtcggcg

SEQ ID NO: 8388708 - DNA, 22 bp, Homo sapiens
gtctgggcacctggcctgggaa

SEQ ID NO: 8388709 - DNA, 22 bp, Homo sapiens
gtctggctttcatggctctgca

SEQ ID NO: 8388710 - DNA, 21 bp, Homo sapiens
gtctgatgcttgatgcagttg

SEQ ID NO: 8388711 - DNA, 22 bp, Homo sapiens
gtctggcacataagaggagctc

SEQ ID NO: 8388712 - DNA, 22 bp, Homo sapiens
gtctggctgttcctgcctgtga

SEQ ID NO: 8388713 - DNA, 20 bp, Homo sapiens
gtctggcttcgtgattctgg

SEQ ID NO: 8388714 - DNA, 22 bp, Homo sapiens
gtctggctccgaggagtggcag

SEQ ID NO: 8388715 - DNA, 22 bp, Homo sapiens
gtctgagaatcttgcatatcat

SEQ ID NO: 8388716 - DNA, 22 bp, Homo sapiens
gtctgagactgggcacatacct

SEQ ID NO: 8388717 - DNA, 22 bp, Homo sapiens
gtctgagacccactcccagaga

SEQ ID NO: 8388718 - DNA, 22 bp, Homo sapiens
gtctgagaactactgaggataa

SEQ ID NO: 8388719 - DNA, 22 bp, Homo sapiens
gtctgagaaagaattctgggga

SEQ ID NO: 8388720 - DNA, 22 bp, Homo sapiens
gtctgagaggaggcagcctcgg

SEQ ID NO: 8388721 - DNA, 22 bp, Homo sapiens
gtctgagaggagccaagtattg

SEQ ID NO: 8388722 - DNA, 22 bp, Homo sapiens
gtccttgagtaagtcatggtgg

SEQ ID NO: 8388723 - DNA, 22 bp, Homo sapiens
gtccttgaagccatttcagggc

SEQ ID NO: 8388724 - DNA, 22 bp, Homo sapiens
gtccttgggatagaaagatgaa

SEQ ID NO: 8388725 - DNA, 22 bp, Homo sapiens
gtcctttcgagggtgagtgaaa

SEQ ID NO: 8388726 - DNA, 22 bp, Homo sapiens
gtcggccacgcaggtgcggtag

SEQ ID NO: 8388727 - DNA, 22 bp, Homo sapiens
gtcctttgaaggcaaaaggaga

SEQ ID NO: 8388728 - DNA, 22 bp, Homo sapiens
gtcaggcagtggaaattaaaaa

SEQ ID NO: 8388729 - DNA, 22 bp, Homo sapiens
gtcaggcatttaggatgagttc

SEQ ID NO: 8388730 - DNA, 18 bp, Homo sapiens
gtcaggcatgaatctggg

SEQ ID NO: 8388731 - DNA, 22 bp, Homo sapiens
gtcaggcagcctggagattcag

SEQ ID NO: 8388732 - DNA, 19 bp, Homo sapiens
gtcaggcacgtgagagcat

SEQ ID NO: 8388733 - DNA, 22 bp, Homo sapiens
gtcaggccctggcagccgtgac

SEQ ID NO: 8388734 - DNA, 19 bp, Homo sapiens
gtcaggaagtactttccgg

SEQ ID NO: 8388735 - DNA, 22 bp, Homo sapiens
gtcaggacaaggtggtctccag

SEQ ID NO: 8388736 - DNA, 22 bp, Homo sapiens
gtcaggagatagggcaagcttc

SEQ ID NO: 8388737 - DNA, 21 bp, Homo sapiens
gtcaggagccgtcttacattc

SEQ ID NO: 8388738 - DNA, 22 bp, Homo sapiens
gtcaggagaggccatcagcttt

SEQ ID NO: 8388739 - DNA, 22 bp, Homo sapiens
gtcaggagagacctgttctcct

SEQ ID NO: 8388740 - DNA, 22 bp, Homo sapiens
gtcagaggggcagctgccaggc

SEQ ID NO: 8388741 - DNA, 22 bp, Homo sapiens
gtcagctcagcaggtgggagtg

SEQ ID NO: 8388742 - DNA, 22 bp, Homo sapiens
gtcaggaaaaattgataatttt

SEQ ID NO: 8388743 - DNA, 22 bp, Homo sapiens
gtcaggaaaacccgggttgact

SEQ ID NO: 8388744 - DNA, 22 bp, Homo sapiens
gtattacaaataaatgttactg

SEQ ID NO: 8388745 - DNA, 22 bp, Homo sapiens
gtcagaggggcagctgccaggc

SEQ ID NO: 8388746 - DNA, 18 bp, Homo sapiens
gtcagaggatggggaaat

SEQ ID NO: 8388747 - DNA, 22 bp, Homo sapiens
gtccatccctatctgcattgct

SEQ ID NO: 8388748 - DNA, 22 bp, Homo sapiens
gtccatacaggcagtggctctg

SEQ ID NO: 8388749 - DNA, 22 bp, Homo sapiens
gtccaggtctggaccctgagcc

SEQ ID NO: 8388750 - DNA, 22 bp, Homo sapiens
gtccagggggcttaagcaaact

SEQ ID NO: 8388751 - DNA, 22 bp, Homo sapiens
gtcccagggaggttcagggctt

SEQ ID NO: 8388752 - DNA, 22 bp, Homo sapiens
gtccatctgtaggagggacaca

SEQ ID NO: 8388753 - DNA, 22 bp, Homo sapiens
gtccatctgtaggagggacaca

SEQ ID NO: 8388754 - DNA, 22 bp, Homo sapiens
gtccatctcttattgatcctaa

SEQ ID NO: 8388755 - DNA, 22 bp, Homo sapiens
gtccatctaagtatccagcctg

SEQ ID NO: 8388756 - DNA, 22 bp, Homo sapiens
gtccatctagaatttatttcta

SEQ ID NO: 8388757 - DNA, 22 bp, Homo sapiens
gtccatctccaccatctgggag

SEQ ID NO: 8388758 - DNA, 22 bp, Homo sapiens
gtccatctgtcacttatagtcg

SEQ ID NO: 8388759 - DNA, 22 bp, Homo sapiens
gtccatcttattacagagcttt

SEQ ID NO: 8388760 - DNA, 22 bp, Homo sapiens
gtccatcttcttggtgtagcat

SEQ ID NO: 8388761 - DNA, 22 bp, Homo sapiens
gtccatctttgatgaaaactta

SEQ ID NO: 8388762 - DNA, 22 bp, Homo sapiens
gtcccagggaggttcagggctt

SEQ ID NO: 8388763 - DNA, 22 bp, Homo sapiens
gtcccagggcaaggctgtttct

SEQ ID NO: 8388764 - DNA, 22 bp, Homo sapiens
gtcccagggccaccatatatag

SEQ ID NO: 8388765 - DNA, 22 bp, Homo sapiens
gtcccaggtgcccagtgggcag

SEQ ID NO: 8388766 - DNA, 22 bp, Homo sapiens
gtcccaggtgcccagtgggcag

SEQ ID NO: 8388767 - DNA, 22 bp, Homo sapiens
gtcctgggtccccgcaggtcag

SEQ ID NO: 8388768 - DNA, 22 bp, Homo sapiens
gtcctgtgtaagccaggacaat

SEQ ID NO: 8388769 - DNA, 22 bp, Homo sapiens
gtcctgtgtaagtacttgctca

SEQ ID NO: 8388770 - DNA, 22 bp, Homo sapiens
gtcctgtgtgttgccggctgaa

SEQ ID NO: 8388771 - DNA, 22 bp, Homo sapiens
gtcctgtgtgagtgcaccacct

SEQ ID NO: 8388772 - DNA, 22 bp, Homo sapiens
taaatccttatcttctttgaat

SEQ ID NO: 8388773 - DNA, 22 bp, Homo sapiens
taaatgaaagggtttaatttat

SEQ ID NO: 8388774 - DNA, 22 bp, Homo sapiens
taaatcttgtggcaatgcttct

SEQ ID NO: 8388775 - DNA, 22 bp, Homo sapiens
taacactggtatttcatttagt

SEQ ID NO: 8388776 - DNA, 22 bp, Homo sapiens
taagaaatttagttatagaatg

SEQ ID NO: 8388777 - DNA, 22 bp, Homo sapiens
taacactgtggtgttctttgtc

SEQ ID NO: 8388778 - DNA, 21 bp, Homo sapiens
taaagctcgttcaggaaagtc

SEQ ID NO: 8388779 - DNA, 22 bp, Homo sapiens
taaagctgttcagtgcagaaag

SEQ ID NO: 8388780 - DNA, 22 bp, Homo sapiens
taaaggaacagaggactcattt

SEQ ID NO: 8388781 - DNA, 22 bp, Homo sapiens
taaaggaactgctgctatggaa

SEQ ID NO: 8388782 - DNA, 22 bp, Homo sapiens
taaaggaactgctgctatggaa

SEQ ID NO: 8388783 - DNA, 22 bp, Homo sapiens
taaagcagcgtgggtggggcag

SEQ ID NO: 8388784 - DNA, 22 bp, Homo sapiens
taaaactagtggttgggactaa

SEQ ID NO: 8388785 - DNA, 22 bp, Homo sapiens
taaaacagcagggcagagaagt

SEQ ID NO: 8388786 - DNA, 22 bp, Homo sapiens
taaaggcagttctgattaggtc

SEQ ID NO: 8388787 - DNA, 22 bp, Homo sapiens
taaaggcagtaattcctgagtt

SEQ ID NO: 8388788 - DNA, 22 bp, Homo sapiens
taaaggcatgcaggtgaatgta

SEQ ID NO: 8388789 - DNA, 22 bp, Homo sapiens
taaatacttttactccactgat

SEQ ID NO: 8388790 - DNA, 22 bp, Homo sapiens
taaaggcaaatgtgtgtttgtg

SEQ ID NO: 8388791 - DNA, 22 bp, Homo sapiens
taaaggcacggagttgttatgg

SEQ ID NO: 8388792 - DNA, 22 bp, Homo sapiens
taaaggcagccactgagctcaa

SEQ ID NO: 8388793 - DNA, 18 bp, Homo sapiens
taaaggaagtgggagagg

SEQ ID NO: 8388794 - DNA, 22 bp, Homo sapiens
taaaggaatcagttttagagat

SEQ ID NO: 8388795 - DNA, 19 bp, Homo sapiens
taaaggaagaagggaggat

SEQ ID NO: 8388796 - DNA, 22 bp, Homo sapiens
taaaggaagaattctctgtgat

SEQ ID NO: 8388797 - DNA, 19 bp, Homo sapiens
taaaggaagaggaagggaa

SEQ ID NO: 8388798 - DNA, 22 bp, Homo sapiens
gtttttctttgtgtgaagacaa

SEQ ID NO: 8388799 - DNA, 22 bp, Homo sapiens
gtttttctttgtgtgaagacaa

SEQ ID NO: 8388800 - DNA, 20 bp, Homo sapiens
gtttttctctcttgccacta

SEQ ID NO: 8388801 - DNA, 19 bp, Homo sapiens
gttgtttttcttattatgg

SEQ ID NO: 8388802 - DNA, 22 bp, Homo sapiens
gttgtttttgaacggtggtggc

SEQ ID NO: 8388803 - DNA, 22 bp, Homo sapiens
gttgttttgctgtctgtcttag

SEQ ID NO: 8388804 - DNA, 22 bp, Homo sapiens
gttgttttgcaggatccttaca

SEQ ID NO: 8388805 - DNA, 22 bp, Homo sapiens
gttgttttcagcagtttatgac

SEQ ID NO: 8388806 - DNA, 22 bp, Homo sapiens
gttgtttttgttctctatagct

SEQ ID NO: 8388807 - DNA, 22 bp, Homo sapiens
gtttaacatctgtgaagctgct

SEQ ID NO: 8388808 - DNA, 22 bp, Homo sapiens
gtttttctagaaatctcctcct

SEQ ID NO: 8388809 - DNA, 22 bp, Homo sapiens
gtttaataatgttgaattacta

SEQ ID NO: 8388810 - DNA, 22 bp, Homo sapiens
gtgggcagcctgtccggagacc

SEQ ID NO: 8388811 - DNA, 22 bp, Homo sapiens
gtgggccagcttttctcctggg

SEQ ID NO: 8388812 - DNA, 22 bp, Homo sapiens
gtgggcagccccttcaaggcca

SEQ ID NO: 8388813 - DNA, 22 bp, Homo sapiens
gtgggcagacatgatagaagga

SEQ ID NO: 8388814 - DNA, 22 bp, Homo sapiens
gtgggcagaggagagaacatta

SEQ ID NO: 8388815 - DNA, 22 bp, Homo sapiens
gtgggctgcccttgaggtcagc

SEQ ID NO: 8388816 - DNA, 22 bp, Homo sapiens
gtgggctgcccttgaggtcagc

SEQ ID NO: 8388817 - DNA, 22 bp, Homo sapiens
gtgggctgcccttgaggtcagc

SEQ ID NO: 8388818 - DNA, 22 bp, Homo sapiens
gtgggcttgttttgatgagatc

SEQ ID NO: 8388819 - DNA, 22 bp, Homo sapiens
gtgggctcccctggcatgtcca

SEQ ID NO: 8388820 - DNA, 22 bp, Homo sapiens
gtgggctgaggggacaccaagg

SEQ ID NO: 8388821 - DNA, 22 bp, Homo sapiens
gtgggctgcatgtttactattc

SEQ ID NO: 8388822 - DNA, 22 bp, Homo sapiens
gtgggctcaggcctctgtgggg

SEQ ID NO: 8388823 - DNA, 22 bp, Homo sapiens
gtgggccttgcagggtgcaggg

SEQ ID NO: 8388824 - DNA, 22 bp, Homo sapiens
gtgggggctggaaatcttgcca

SEQ ID NO: 8388825 - DNA, 22 bp, Homo sapiens
gtgggggctggaaatcttgcca

SEQ ID NO: 8388826 - DNA, 22 bp, Homo sapiens
gtggggagcagccttagcccct

SEQ ID NO: 8388827 - DNA, 22 bp, Homo sapiens
gtggggaggcattcttctccct

SEQ ID NO: 8388828 - DNA, 22 bp, Homo sapiens
gtgtaaaaacatactatttcta

SEQ ID NO: 8388829 - DNA, 22 bp, Homo sapiens
gtggtttttagatttctacagt

SEQ ID NO: 8388830 - DNA, 22 bp, Homo sapiens
gtgtaagtatctttgtatcttt

SEQ ID NO: 8388831 - DNA, 22 bp, Homo sapiens
gtgtaagtatctttgtatcttt

SEQ ID NO: 8388832 - DNA, 22 bp, Homo sapiens
gtgtacaaaatgtctccatgga

SEQ ID NO: 8388833 - DNA, 22 bp, Homo sapiens
gtgtacaaaatgtctccatgga

SEQ ID NO: 8388834 - DNA, 17 bp, Homo sapiens
gtgtacaagcagaaggc

SEQ ID NO: 8388835 - DNA, 22 bp, Homo sapiens
gtgtcaataaatagcggtgtgg

SEQ ID NO: 8388836 - DNA, 19 bp, Homo sapiens
gtgtacagctcagtgaatt

SEQ ID NO: 8388837 - DNA, 22 bp, Homo sapiens
gtggttccgaatatttatttct

SEQ ID NO: 8388838 - DNA, 22 bp, Homo sapiens
gtggtgagttcaggctggggtg

SEQ ID NO: 8388839 - DNA, 22 bp, Homo sapiens
gtggtgcaggccagcaggggcg

SEQ ID NO: 8388840 - DNA, 22 bp, Homo sapiens
gtgggtggacggtgcttttgtt

SEQ ID NO: 8388841 - DNA, 22 bp, Homo sapiens
gtgggtgatgtactggaggcca

SEQ ID NO: 8388842 - DNA, 22 bp, Homo sapiens
gtggtcaggggctgaggtgccc

SEQ ID NO: 8388843 - DNA, 22 bp, Homo sapiens
gtggtcaggcagtgggagagaa

SEQ ID NO: 8388844 - DNA, 22 bp, Homo sapiens
gtggtcagcagcagtgggagtg

SEQ ID NO: 8388845 - DNA, 22 bp, Homo sapiens
gtggtcagagatgacagtgggt

SEQ ID NO: 8388846 - DNA, 22 bp, Homo sapiens
gtggggtagatctttctcagga

SEQ ID NO: 8388847 - DNA, 22 bp, Homo sapiens
gtgggggctggctcgtcctgtg

SEQ ID NO: 8388848 - DNA, 22 bp, Homo sapiens
gtgggggctggctcgtcctgtg

SEQ ID NO: 8388849 - DNA, 22 bp, Homo sapiens
gtggggggacgttggtcacttt

SEQ ID NO: 8388850 - DNA, 22 bp, Homo sapiens
gtggggtctgtcctcttctggg

SEQ ID NO: 8388851 - DNA, 22 bp, Homo sapiens
gtgtcccagcagcacattggct

SEQ ID NO: 8388852 - DNA, 22 bp, Homo sapiens
gtgtcctgcaggccaggaatgg

SEQ ID NO: 8388853 - DNA, 18 bp, Homo sapiens
gtgtcctttgcaagaaac

SEQ ID NO: 8388854 - DNA, 22 bp, Homo sapiens
gtgtccagttttttctctgctg

SEQ ID NO: 8388855 - DNA, 22 bp, Homo sapiens
gtgtcccaaagattagaaatca

SEQ ID NO: 8388856 - DNA, 22 bp, Homo sapiens
gtgtccagggctggaagtgagg

SEQ ID NO: 8388857 - DNA, 17 bp, Homo sapiens
gtgtccaggccgatggc

SEQ ID NO: 8388858 - DNA, 22 bp, Homo sapiens
gtgtccagtcatagcccagggc

SEQ ID NO: 8388859 - DNA, 22 bp, Homo sapiens
gtgtccagggggtatcccagct

SEQ ID NO: 8388860 - DNA, 22 bp, Homo sapiens
gtgtccagagaactgtgggagc

SEQ ID NO: 8388861 - DNA, 22 bp, Homo sapiens
gtgtccagcctgcacagggtgc

SEQ ID NO: 8388862 - DNA, 22 bp, Homo sapiens
gtgtccagatgaggagacgatg

SEQ ID NO: 8388863 - DNA, 22 bp, Homo sapiens
gtgtcactggaatactgtctgt

SEQ ID NO: 8388864 - DNA, 22 bp, Homo sapiens
gtgtgggaggaaggtgaacaga

SEQ ID NO: 8388865 - DNA, 22 bp, Homo sapiens
gtgtgggaggaaggtgaacaga

SEQ ID NO: 8388866 - DNA, 22 bp, Homo sapiens
gtgtggtgaggccccttaggct

SEQ ID NO: 8388867 - DNA, 22 bp, Homo sapiens
gtgtggtggccctccttcaggc

SEQ ID NO: 8388868 - DNA, 22 bp, Homo sapiens
gtgtgtcagagctcagagaagt

SEQ ID NO: 8388869 - DNA, 22 bp, Homo sapiens
gtgtgcaactttcattaatatt

SEQ ID NO: 8388870 - DNA, 22 bp, Homo sapiens
gtgtgcaactttcattaatatt

SEQ ID NO: 8388871 - DNA, 22 bp, Homo sapiens
gtgtgcagaagacacaagacat

SEQ ID NO: 8388872 - DNA, 22 bp, Homo sapiens
gtgtgcagcagagacaggactc

SEQ ID NO: 8388873 - DNA, 22 bp, Homo sapiens
gtgtgcagggggccagcgcagc

SEQ ID NO: 8388874 - DNA, 22 bp, Homo sapiens
gtgtgcagggggccagcgcagc

SEQ ID NO: 8388875 - DNA, 22 bp, Homo sapiens
gtgtgcaggccacaggccaggg

SEQ ID NO: 8388876 - DNA, 22 bp, Homo sapiens
gtgtgcaggcttgaggattagg

SEQ ID NO: 8388877 - DNA, 22 bp, Homo sapiens
gttctgacttctctgcatctgc

SEQ ID NO: 8388878 - DNA, 22 bp, Homo sapiens
gttctcagtggggagcagggtt

SEQ ID NO: 8388879 - DNA, 22 bp, Homo sapiens
gttctatttcagtaagcaggca

SEQ ID NO: 8388880 - DNA, 22 bp, Homo sapiens
gttgtttataaaaatatctagc

SEQ ID NO: 8388881 - DNA, 22 bp, Homo sapiens
gttgttttataggctcatgcct

SEQ ID NO: 8388882 - DNA, 22 bp, Homo sapiens
gttgttttattgtgagtcccat

SEQ ID NO: 8388883 - DNA, 22 bp, Homo sapiens
gttgttttcacaaacccatgat

SEQ ID NO: 8388884 - DNA, 22 bp, Homo sapiens
gttgttttataattgattgcaa

SEQ ID NO: 8388885 - DNA, 22 bp, Homo sapiens
gttgttttaaaatactccagaa

SEQ ID NO: 8388886 - DNA, 21 bp, Homo sapiens
gttctgagttagagttggcca

SEQ ID NO: 8388887 - DNA, 22 bp, Homo sapiens
gttctgagtcctcctttgaagg

SEQ ID NO: 8388888 - DNA, 22 bp, Homo sapiens
gttctgctcctgtggcaatcta

SEQ ID NO: 8388889 - DNA, 22 bp, Homo sapiens
gttctgcagggatccagctggg

SEQ ID NO: 8388890 - DNA, 22 bp, Homo sapiens
gttattttatctctgagaggtt

SEQ ID NO: 8388891 - DNA, 22 bp, Homo sapiens
gttattttatctctgagaggtt

SEQ ID NO: 8388892 - DNA, 22 bp, Homo sapiens
gttattttatctctgagaggtt

SEQ ID NO: 8388893 - DNA, 22 bp, Homo sapiens
gttattttcattggctcagact

SEQ ID NO: 8388894 - DNA, 22 bp, Homo sapiens
gttattttcattggctcagact

SEQ ID NO: 8388895 - DNA, 22 bp, Homo sapiens
gttattttcattggctcagact

SEQ ID NO: 8388896 - DNA, 21 bp, Homo sapiens
gttattttaagtgagctttgc

SEQ ID NO: 8388897 - DNA, 21 bp, Homo sapiens
gttattttaagtgagctttgc

SEQ ID NO: 8388898 - DNA, 22 bp, Homo sapiens
gttattttaacttctcagtaat

SEQ ID NO: 8388899 - DNA, 22 bp, Homo sapiens
gtgtgtcctcagtagtggcatg

SEQ ID NO: 8388900 - DNA, 22 bp, Homo sapiens
gttattttaacttctcagtaat

SEQ ID NO: 8388901 - DNA, 22 bp, Homo sapiens
gttattttaacttctcagtaat

SEQ ID NO: 8388902 - DNA, 22 bp, Homo sapiens
gtgtgtccaggcgggagtcaag

SEQ ID NO: 8388903 - DNA, 22 bp, Homo sapiens
gttcaagaccagcctggccaac

SEQ ID NO: 8388904 - DNA, 22 bp, Homo sapiens
gttctaggttagaaggacagat

SEQ ID NO: 8388905 - DNA, 22 bp, Homo sapiens
gttctaggctaggggagtaaga

SEQ ID NO: 8388906 - DNA, 22 bp, Homo sapiens
gttctagatgactgagcagctg

SEQ ID NO: 8388907 - DNA, 22 bp, Homo sapiens
gttctaggagccaagaatatag

SEQ ID NO: 8388908 - DNA, 21 bp, Homo sapiens
gttcaaatgggtagattcaca

SEQ ID NO: 8388909 - DNA, 22 bp, Homo sapiens
gttcaaatctcaggacttcaga

SEQ ID NO: 8388910 - DNA, 21 bp, Homo sapiens
gttcaaatcctgacactacac

SEQ ID NO: 8388911 - DNA, 22 bp, Homo sapiens
gttcaagaccagcctggccaac

SEQ ID NO: 8388912 - DNA, 22 bp, Homo sapiens
ggccagaggccacagctgtgtc

SEQ ID NO: 8388913 - DNA, 22 bp, Homo sapiens
ggccagagagcagccaggattc

SEQ ID NO: 8388914 - DNA, 22 bp, Homo sapiens
ggcaggtgctgggagcatctca

SEQ ID NO: 8388915 - DNA, 22 bp, Homo sapiens
ggcaggtgctctgtgggcctgg

SEQ ID NO: 8388916 - DNA, 22 bp, Homo sapiens
ggccagaagttggaaaagagcc

SEQ ID NO: 8388917 - DNA, 22 bp, Homo sapiens
ggccagaagttggaaaagagcc

SEQ ID NO: 8388918 - DNA, 22 bp, Homo sapiens
ggccccaggtagaagatataga

SEQ ID NO: 8388919 - DNA, 22 bp, Homo sapiens
ggccccagattctgggctgggt

SEQ ID NO: 8388920 - DNA, 22 bp, Homo sapiens
ggcccagcgaggccacctacag

SEQ ID NO: 8388921 - DNA, 22 bp, Homo sapiens
ggccccaaatgtcaatagtact

SEQ ID NO: 8388922 - DNA, 22 bp, Homo sapiens
ggccccaaatgtcaatagtact

SEQ ID NO: 8388923 - DNA, 22 bp, Homo sapiens
ggcccagcctcagacatgccct

SEQ ID NO: 8388924 - DNA, 22 bp, Homo sapiens
ggcccagcctggcaacaatgac

SEQ ID NO: 8388925 - DNA, 22 bp, Homo sapiens
ggcccagccttggggtttcttt

SEQ ID NO: 8388926 - DNA, 22 bp, Homo sapiens
ggcccctcagcatctgagtcag

SEQ ID NO: 8388927 - DNA, 22 bp, Homo sapiens
ggccccagttcactcctggccg

SEQ ID NO: 8388928 - DNA, 22 bp, Homo sapiens
ggccccagttcactcctggccg

SEQ ID NO: 8388929 - DNA, 22 bp, Homo sapiens
ggccccaggtctgaacacgctg

SEQ ID NO: 8388930 - DNA, 21 bp, Homo sapiens
ggccccgcagacccagcacgt

SEQ ID NO: 8388931 - DNA, 22 bp, Homo sapiens
ggcccccagggtgggtgtagac

SEQ ID NO: 8388932 - DNA, 22 bp, Homo sapiens
ggcccagccggcgagtctcgcg

SEQ ID NO: 8388933 - DNA, 22 bp, Homo sapiens
ggcccacactgacagctgagct

SEQ ID NO: 8388934 - DNA, 22 bp, Homo sapiens
ggccttggaaagatacccagct

SEQ ID NO: 8388935 - DNA, 20 bp, Homo sapiens
ggccttggaatagcacagct

SEQ ID NO: 8388936 - DNA, 22 bp, Homo sapiens
ggccttggagtcctccactgga

SEQ ID NO: 8388937 - DNA, 22 bp, Homo sapiens
ggccttccatctgcctctgttt

SEQ ID NO: 8388938 - DNA, 22 bp, Homo sapiens
ggccttccagggaagacagggc

SEQ ID NO: 8388939 - DNA, 22 bp, Homo sapiens
ggccttccttcccagcctactg

SEQ ID NO: 8388940 - DNA, 22 bp, Homo sapiens
ggccttccttcccagcctactg

SEQ ID NO: 8388941 - DNA, 21 bp, Homo sapiens
ggccttcccctgcagtctccg

SEQ ID NO: 8388942 - DNA, 22 bp, Homo sapiens
ggccttcctggcggctcagggt

SEQ ID NO: 8388943 - DNA, 22 bp, Homo sapiens
ggccctgaagtgattgtgagtt

SEQ ID NO: 8388944 - DNA, 22 bp, Homo sapiens
ggcctggctggttcagtaccct

SEQ ID NO: 8388945 - DNA, 22 bp, Homo sapiens
ggccctgcaaggtacccaggcc

SEQ ID NO: 8388946 - DNA, 22 bp, Homo sapiens
ggccttgggaggagggtcagaa

SEQ ID NO: 8388947 - DNA, 22 bp, Homo sapiens
ggccttggctcctgcagggagt

SEQ ID NO: 8388948 - DNA, 21 bp, Homo sapiens
ggccttggcgggggccgaatt

SEQ ID NO: 8388949 - DNA, 22 bp, Homo sapiens
ggccttggatccaagctgcggc

SEQ ID NO: 8388950 - DNA, 22 bp, Homo sapiens
ggccttggcctagccctccagg

SEQ ID NO: 8388951 - DNA, 22 bp, Homo sapiens
ggctcaggatgagccttctcat

SEQ ID NO: 8388952 - DNA, 22 bp, Homo sapiens
ggctcagcttggtgcgcagaaa

SEQ ID NO: 8388953 - DNA, 22 bp, Homo sapiens
ggctccaacactaaatgtgttt

SEQ ID NO: 8388954 - DNA, 23 bp, Homo sapiens
ggctcctgcttcatgtcccacct

SEQ ID NO: 8388955 - DNA, 22 bp, Homo sapiens
ggctcaggtttccttcccagct

SEQ ID NO: 8388956 - DNA, 22 bp, Homo sapiens
ggctcagtaagtcaggttcatt

SEQ ID NO: 8388957 - DNA, 22 bp, Homo sapiens
ggctccaaagggcagtgtgagg

SEQ ID NO: 8388958 - DNA, 19 bp, Homo sapiens
ggctcagtgacataggtgc

SEQ ID NO: 8388959 - DNA, 22 bp, Homo sapiens
ggctcagtgggaacaagctgag

SEQ ID NO: 8388960 - DNA, 22 bp, Homo sapiens
gggaacagcttgggctctgcca

SEQ ID NO: 8388961 - DNA, 22 bp, Homo sapiens
gggaaccacccctctgccctga

SEQ ID NO: 8388962 - DNA, 22 bp, Homo sapiens
gggaactgtttaacaggggttt

SEQ ID NO: 8388963 - DNA, 22 bp, Homo sapiens
gggaacctgccccaggcctctg

SEQ ID NO: 8388964 - DNA, 22 bp, Homo sapiens
gggaagaagacatggtgaaggc

SEQ ID NO: 8388965 - DNA, 22 bp, Homo sapiens
gggaagagaccgtaccctggcc

SEQ ID NO: 8388966 - DNA, 22 bp, Homo sapiens
gggaagagaggaggtggtttcg

SEQ ID NO: 8388967 - DNA, 22 bp, Homo sapiens
gggaagagatttccacatcatt

SEQ ID NO: 8388968 - DNA, 18 bp, Homo sapiens
gggaagaggatctggccc

SEQ ID NO: 8388969 - DNA, 18 bp, Homo sapiens
gggaagaggatctggccc

SEQ ID NO: 8388970 - DNA, 18 bp, Homo sapiens
gggaagaggatctggccc

SEQ ID NO: 8388971 - DNA, 23 bp, Homo sapiens
gggaccaggcccttcctggtttg

SEQ ID NO: 8388972 - DNA, 22 bp, Homo sapiens
gggaaattgtaacaagtctgtt

SEQ ID NO: 8388973 - DNA, 22 bp, Homo sapiens
gggaaatctcgtcctctattta

SEQ ID NO: 8388974 - DNA, 22 bp, Homo sapiens
gggaaaggatttacagtttgat

SEQ ID NO: 8388975 - DNA, 22 bp, Homo sapiens
ggctttgggattcagcatgaga

SEQ ID NO: 8388976 - DNA, 22 bp, Homo sapiens
ggcttccctttccgagaggaga

SEQ ID NO: 8388977 - DNA, 22 bp, Homo sapiens
ggcttcctggagaaggtctgag

SEQ ID NO: 8388978 - DNA, 22 bp, Homo sapiens
ggctggctccacctaggtagct

SEQ ID NO: 8388979 - DNA, 22 bp, Homo sapiens
ggctggctccacctaggtagct

SEQ ID NO: 8388980 - DNA, 22 bp, Homo sapiens
ggctggctcagggcttgagaga

SEQ ID NO: 8388981 - DNA, 22 bp, Homo sapiens
ggctggctatctgtggttgcct

SEQ ID NO: 8388982 - DNA, 22 bp, Homo sapiens
ggctggctatctgtggttgcct

SEQ ID NO: 8388983 - DNA, 22 bp, Homo sapiens
ggctggctgataaagggttgag

SEQ ID NO: 8388984 - DNA, 22 bp, Homo sapiens
ggctggctgataaagggttgag

SEQ ID NO: 8388985 - DNA, 22 bp, Homo sapiens
ggctggctggcttagcagagga

SEQ ID NO: 8388986 - DNA, 22 bp, Homo sapiens
ggctggctgtgccctgtactct

SEQ ID NO: 8388987 - DNA, 22 bp, Homo sapiens
ggctggctgtgccctgtactct

SEQ ID NO: 8388988 - DNA, 22 bp, Homo sapiens
ggctggctggctggtagacaag

SEQ ID NO: 8388989 - DNA, 22 bp, Homo sapiens
ggctgtggtggcatccctgagc

SEQ ID NO: 8388990 - DNA, 22 bp, Homo sapiens
ggctgtggtggcatccctgagc

SEQ ID NO: 8388991 - DNA, 19 bp, Homo sapiens
ggctgtggtggtgccttgc

SEQ ID NO: 8388992 - DNA, 19 bp, Homo sapiens
ggctgtggtggtgccttgc

SEQ ID NO: 8388993 - DNA, 22 bp, Homo sapiens
ggctggcttgccaagctcaggg

SEQ ID NO: 8388994 - DNA, 22 bp, Homo sapiens
ggctggcttgccaagctcaggg

SEQ ID NO: 8388995 - DNA, 22 bp, Homo sapiens
ggcttccccacagtcctgagct

SEQ ID NO: 8388996 - DNA, 22 bp, Homo sapiens
ggcttccccacaaagcacacaa

SEQ ID NO: 8388997 - DNA, 20 bp, Homo sapiens
ggcttccccgccatcttccg

SEQ ID NO: 8388998 - DNA, 22 bp, Homo sapiens
ggcttcccctccagtgctctgt

SEQ ID NO: 8388999 - DNA, 18 bp, Homo sapiens
ggcttccctactcacttc

SEQ ID NO: 8389000 - DNA, 22 bp, Homo sapiens
ggcttccctaaacctttccact

SEQ ID NO: 8389001 - DNA, 22 bp, Homo sapiens
ggcttccctgtttgctgtgcct

SEQ ID NO: 8389002 - DNA, 22 bp, Homo sapiens
ggcttccctgcctcacttattc

SEQ ID NO: 8389003 - DNA, 22 bp, Homo sapiens
ggcttcccaggcggtccccaca

SEQ ID NO: 8389004 - DNA, 22 bp, Homo sapiens
ggcttcccagtccctgctctca

SEQ ID NO: 8389005 - DNA, 22 bp, Homo sapiens
ggcttcccaaggagccaggatg

SEQ ID NO: 8389006 - DNA, 22 bp, Homo sapiens
ggcttcccagcagagggcgcac

SEQ ID NO: 8389007 - DNA, 22 bp, Homo sapiens
ggcttccagtgatgcctctttg

SEQ ID NO: 8389008 - DNA, 22 bp, Homo sapiens
ggcttccaaggtcctctccacc

SEQ ID NO: 8389009 - DNA, 22 bp, Homo sapiens
ggctgcaggaacgacggagggg

SEQ ID NO: 8389010 - DNA, 22 bp, Homo sapiens
ggctgccttcatagaccatggg

SEQ ID NO: 8389011 - DNA, 18 bp, Homo sapiens
ggctgcctgttcctgaag

SEQ ID NO: 8389012 - DNA, 22 bp, Homo sapiens
ggctgcctgtgcccaggcacac

SEQ ID NO: 8389013 - DNA, 22 bp, Homo sapiens
ggctgcctgtgcccaggcacac

SEQ ID NO: 8389014 - DNA, 22 bp, Homo sapiens
ggctgcctgtgcccaggcacac

SEQ ID NO: 8389015 - DNA, 22 bp, Homo sapiens
ggctgcctggtttcttgtaagg

SEQ ID NO: 8389016 - DNA, 21 bp, Homo sapiens
ggctgcctgggaagaagaaga

SEQ ID NO: 8389017 - DNA, 23 bp, Homo sapiens
ggctgctcttttcatgctgtttc

SEQ ID NO: 8389018 - DNA, 22 bp, Homo sapiens
ggctgctcggagcctcctgtga

SEQ ID NO: 8389019 - DNA, 22 bp, Homo sapiens
ggctgccttccctgagccccgg

SEQ ID NO: 8389020 - DNA, 22 bp, Homo sapiens
ggctgccttccctgagccccgg

SEQ ID NO: 8389021 - DNA, 19 bp, Homo sapiens
ggctgccttctgctcatct

SEQ ID NO: 8389022 - DNA, 22 bp, Homo sapiens
ggctgctctgagagtgggtttt

SEQ ID NO: 8389023 - DNA, 22 bp, Homo sapiens
ggctgctctgcacaggggctgg

SEQ ID NO: 8389024 - DNA, 22 bp, Homo sapiens
ggctgctctgcacaggggctgg

SEQ ID NO: 8389025 - DNA, 22 bp, Homo sapiens
ggctgctcggcagctcctgagc

SEQ ID NO: 8389026 - DNA, 22 bp, Homo sapiens
ggctgctcttcttggcgacctc

SEQ ID NO: 8389027 - DNA, 22 bp, Homo sapiens
ggctgctctgccttccagctgg

SEQ ID NO: 8389028 - DNA, 22 bp, Homo sapiens
ggctctcagggaaaggcctccc

SEQ ID NO: 8389029 - DNA, 22 bp, Homo sapiens
ggctcctgggcagctgctccct

SEQ ID NO: 8389030 - DNA, 22 bp, Homo sapiens
ggctgcagagctggtgccctgg

SEQ ID NO: 8389031 - DNA, 22 bp, Homo sapiens
gggggtcccaagctgggctgct

SEQ ID NO: 8389032 - DNA, 22 bp, Homo sapiens
ggggggtgacaagtagaggttg

SEQ ID NO: 8389033 - DNA, 22 bp, Homo sapiens
ggggggcagctgtcctggccat

SEQ ID NO: 8389034 - DNA, 22 bp, Homo sapiens
ggggggcagctgtcctggccat

SEQ ID NO: 8389035 - DNA, 22 bp, Homo sapiens
ggggggctgttctggacaggaa

SEQ ID NO: 8389036 - DNA, 22 bp, Homo sapiens
gggggggtcttcagacctcaga

SEQ ID NO: 8389037 - DNA, 22 bp, Homo sapiens
gggtccagggccagtggctgag

SEQ ID NO: 8389038 - DNA, 22 bp, Homo sapiens
gggggtggttctaagtcctata

SEQ ID NO: 8389039 - DNA, 23 bp, Homo sapiens
gggggctggttgactctctgcag

SEQ ID NO: 8389040 - DNA, 22 bp, Homo sapiens
gggggctggactttcccacaca

SEQ ID NO: 8389041 - DNA, 22 bp, Homo sapiens
gggggctggaatatccatcaac

SEQ ID NO: 8389042 - DNA, 22 bp, Homo sapiens
ggggactctgcttctgggatca

SEQ ID NO: 8389043 - DNA, 22 bp, Homo sapiens
ggggaccctcaggactgcgtct

SEQ ID NO: 8389044 - DNA, 19 bp, Homo sapiens
ggggagaactagagacagc

SEQ ID NO: 8389045 - DNA, 20 bp, Homo sapiens
gggtgagatgtaggagaggg

SEQ ID NO: 8389046 - DNA, 22 bp, Homo sapiens
gggtgaggagctgccagtcatg

SEQ ID NO: 8389047 - DNA, 22 bp, Homo sapiens
gggtgggatggcaggagccgct

SEQ ID NO: 8389048 - DNA, 22 bp, Homo sapiens
gggtgggaacaggatgccagga

SEQ ID NO: 8389049 - DNA, 22 bp, Homo sapiens
gggtgggcccagcccagagaag

SEQ ID NO: 8389050 - DNA, 22 bp, Homo sapiens
gggtctgctccacctgcagccc

SEQ ID NO: 8389051 - DNA, 22 bp, Homo sapiens
gggtctggacggctgcaggaag

SEQ ID NO: 8389052 - DNA, 23 bp, Homo sapiens
ggggacagttcccactggggtct

SEQ ID NO: 8389053 - DNA, 16 bp, Homo sapiens
ggggaaggcaagaggg

SEQ ID NO: 8389054 - DNA, 16 bp, Homo sapiens
ggggaaggcaagaggg

SEQ ID NO: 8389055 - DNA, 22 bp, Homo sapiens
ggggaagggagtccaagtgtta

SEQ ID NO: 8389056 - DNA, 22 bp, Homo sapiens
ggggaagggagtccaagtgtta

SEQ ID NO: 8389057 - DNA, 23 bp, Homo sapiens
ggggacagagggcagcccgcatc

SEQ ID NO: 8389058 - DNA, 23 bp, Homo sapiens
ggggacagagggcagcccgcatc

SEQ ID NO: 8389059 - DNA, 22 bp, Homo sapiens
gggctggagagtcccacgtggg

SEQ ID NO: 8389060 - DNA, 22 bp, Homo sapiens
gggctggcaggacctgggctga

SEQ ID NO: 8389061 - DNA, 22 bp, Homo sapiens
ggggaaggattgagttgaccca

SEQ ID NO: 8389062 - DNA, 22 bp, Homo sapiens
gggctggcatcggttgctgaga

SEQ ID NO: 8389063 - DNA, 22 bp, Homo sapiens
gggctggcatcagttgccgaga

SEQ ID NO: 8389064 - DNA, 22 bp, Homo sapiens
gggctggatgtttgatgacgaa

SEQ ID NO: 8389065 - DNA, 22 bp, Homo sapiens
gggctggattactgaactgagt

SEQ ID NO: 8389066 - DNA, 22 bp, Homo sapiens
gggctgcttgctggagacagac

SEQ ID NO: 8389067 - DNA, 22 bp, Homo sapiens
gggctgcttggaggaggcgctc

SEQ ID NO: 8389068 - DNA, 22 bp, Homo sapiens
gggctgagaagttgatcccaag

SEQ ID NO: 8389069 - DNA, 22 bp, Homo sapiens
gggctaggcttggccagcactg

SEQ ID NO: 8389070 - DNA, 22 bp, Homo sapiens
gggctctgtccattccttcata

SEQ ID NO: 8389071 - DNA, 22 bp, Homo sapiens
gggatggggagctggaaagggg

SEQ ID NO: 8389072 - DNA, 22 bp, Homo sapiens
gggatggggagctggaaagggg

SEQ ID NO: 8389073 - DNA, 22 bp, Homo sapiens
gggcagaggggcgcttccctct

SEQ ID NO: 8389074 - DNA, 22 bp, Homo sapiens
gggcagaggggcgcttccctct

SEQ ID NO: 8389075 - DNA, 22 bp, Homo sapiens
gggatggctcaaaggagtcagg

SEQ ID NO: 8389076 - DNA, 22 bp, Homo sapiens
gggatggatcttggctgaggct

SEQ ID NO: 8389077 - DNA, 22 bp, Homo sapiens
gggatggacttggggactccag

SEQ ID NO: 8389078 - DNA, 22 bp, Homo sapiens
gggatggagggtagagcaagtg

SEQ ID NO: 8389079 - DNA, 22 bp, Homo sapiens
gggagggaaagcttgatctgtc

SEQ ID NO: 8389080 - DNA, 22 bp, Homo sapiens
gggaggctggctctggccacag

SEQ ID NO: 8389081 - DNA, 22 bp, Homo sapiens
gggaggctggctctggccacag

SEQ ID NO: 8389082 - DNA, 22 bp, Homo sapiens
gggatccatccgtgcagcagag

SEQ ID NO: 8389083 - DNA, 22 bp, Homo sapiens
gggatggactgacggtagcgcg

SEQ ID NO: 8389084 - DNA, 22 bp, Homo sapiens
gggaggctctgctcagcccccg

SEQ ID NO: 8389085 - DNA, 22 bp, Homo sapiens
gggaggctgccatccttcagga

SEQ ID NO: 8389086 - DNA, 22 bp, Homo sapiens
gggaggctgccatccttcagga

SEQ ID NO: 8389087 - DNA, 22 bp, Homo sapiens
gggagaaggagctagttcttga

SEQ ID NO: 8389088 - DNA, 22 bp, Homo sapiens
gggacgtgagtgaagaaggtct

SEQ ID NO: 8389089 - DNA, 22 bp, Homo sapiens
gggaggagggtgctggctaaac

SEQ ID NO: 8389090 - DNA, 22 bp, Homo sapiens
gggaggaggaatgttttgtgta

SEQ ID NO: 8389091 - DNA, 22 bp, Homo sapiens
gggacccaggtaatcctgtgct

SEQ ID NO: 8389092 - DNA, 22 bp, Homo sapiens
gggacccacgaaaggctttgga

SEQ ID NO: 8389093 - DNA, 22 bp, Homo sapiens
gggaccaggtcagggctctgac

SEQ ID NO: 8389094 - DNA, 22 bp, Homo sapiens
gggaccaggtgggtgcattccg

SEQ ID NO: 8389095 - DNA, 22 bp, Homo sapiens
gggacgacaggctctgtggtag

SEQ ID NO: 8389096 - DNA, 22 bp, Homo sapiens
gggactccagggccactgggcc

SEQ ID NO: 8389097 - DNA, 22 bp, Homo sapiens
gggactccataagcacatggat

SEQ ID NO: 8389098 - DNA, 22 bp, Homo sapiens
gggagaaatgtctggcctgctg

SEQ ID NO: 8389099 - DNA, 22 bp, Homo sapiens
gggacgagccccaggctggagg

SEQ ID NO: 8389100 - DNA, 22 bp, Homo sapiens
gggacgagatcttggcagtgtg

SEQ ID NO: 8389101 - DNA, 22 bp, Homo sapiens
gggcggatcatttgaggtcagg

SEQ ID NO: 8389102 - DNA, 22 bp, Homo sapiens
gggcggatcacctgaggtcagg

SEQ ID NO: 8389103 - DNA, 22 bp, Homo sapiens
gggcggggcttccgtcctccac

SEQ ID NO: 8389104 - DNA, 22 bp, Homo sapiens
gggctacattgtgagagaagtt

SEQ ID NO: 8389105 - DNA, 22 bp, Homo sapiens
gggctaagtggatcagtcagga

SEQ ID NO: 8389106 - DNA, 22 bp, Homo sapiens
gggccagtgagtcgggagagct

SEQ ID NO: 8389107 - DNA, 23 bp, Homo sapiens
gggcccagcacaggacctggcag

SEQ ID NO: 8389108 - DNA, 22 bp, Homo sapiens
gggcccagcactggctgggatc

SEQ ID NO: 8389109 - DNA, 22 bp, Homo sapiens
gggcccagcactggctgggatc

SEQ ID NO: 8389110 - DNA, 22 bp, Homo sapiens
gggcccagcactggctgggatc

SEQ ID NO: 8389111 - DNA, 22 bp, Homo sapiens
gggcctgtctcactccctggtt

SEQ ID NO: 8389112 - DNA, 22 bp, Homo sapiens
gggcccagcgtggttccatctg

SEQ ID NO: 8389113 - DNA, 22 bp, Homo sapiens
gggcccagccctctgctcactg

SEQ ID NO: 8389114 - DNA, 19 bp, Homo sapiens
gggcccagcatggagggtt

SEQ ID NO: 8389115 - DNA, 19 bp, Homo sapiens
gggcccagcatggagggtt

SEQ ID NO: 8389116 - DNA, 19 bp, Homo sapiens
gggcccagcatggagggtt

SEQ ID NO: 8389117 - DNA, 20 bp, Homo sapiens
gggcagcctcgggagtgggt

SEQ ID NO: 8389118 - DNA, 22 bp, Homo sapiens
gggcagcagaattggacagaaa

SEQ ID NO: 8389119 - DNA, 18 bp, Homo sapiens
gggcagcacagcagcctc

SEQ ID NO: 8389120 - DNA, 22 bp, Homo sapiens
gggcagcaaatctgagtctggt

SEQ ID NO: 8389121 - DNA, 22 bp, Homo sapiens
gggcagatcacctgaggtcagg

SEQ ID NO: 8389122 - DNA, 22 bp, Homo sapiens
gggcagatggggcacaggctga

SEQ ID NO: 8389123 - DNA, 22 bp, Homo sapiens
gggcagatgtctggacacctca

SEQ ID NO: 8389124 - DNA, 22 bp, Homo sapiens
gggcagctcagccaccatgcag

SEQ ID NO: 8389125 - DNA, 22 bp, Homo sapiens
gggcagcctgctttctgatcca

SEQ ID NO: 8389126 - DNA, 22 bp, Homo sapiens
gggccacaggagaggctgtcag

SEQ ID NO: 8389127 - DNA, 22 bp, Homo sapiens
gggcagctcggaagtgggaaag

SEQ ID NO: 8389128 - DNA, 22 bp, Homo sapiens
gggcagctcctgtggaatccac

SEQ ID NO: 8389129 - DNA, 22 bp, Homo sapiens
gggccacattgaagggtgggta

SEQ ID NO: 8389130 - DNA, 22 bp, Homo sapiens
gggccacattgaagggtgggta

SEQ ID NO: 8389131 - DNA, 22 bp, Homo sapiens
gggccaggtatcgtctttagta

SEQ ID NO: 8389132 - DNA, 22 bp, Homo sapiens
gggccaggtcggtgaatggtca

SEQ ID NO: 8389133 - DNA, 22 bp, Homo sapiens
gggccaggtcggtgaatggtca

SEQ ID NO: 8389134 - DNA, 22 bp, Homo sapiens
gggccaggtggaccccagcctc

SEQ ID NO: 8389135 - DNA, 22 bp, Homo sapiens
ggaagtgaggaaatattttgtt

SEQ ID NO: 8389136 - DNA, 18 bp, Homo sapiens
ggaaggtgctggagtgca

SEQ ID NO: 8389137 - DNA, 22 bp, Homo sapiens
ggaataggatttacctctgtaa

SEQ ID NO: 8389138 - DNA, 22 bp, Homo sapiens
ggaataggatttacctctgtaa

SEQ ID NO: 8389139 - DNA, 22 bp, Homo sapiens
ggaatactaaaggaagcaattg

SEQ ID NO: 8389140 - DNA, 22 bp, Homo sapiens
ggagaggcttggcccagcctgg

SEQ ID NO: 8389141 - DNA, 22 bp, Homo sapiens
ggagaaggaagaaagctactat

SEQ ID NO: 8389142 - DNA, 22 bp, Homo sapiens
ggagaaggaagaaagctactat

SEQ ID NO: 8389143 - DNA, 22 bp, Homo sapiens
ggagaaggaatattggagtagg

SEQ ID NO: 8389144 - DNA, 22 bp, Homo sapiens
ggagaaggaatattggagtagg

SEQ ID NO: 8389145 - DNA, 22 bp, Homo sapiens
ggagcggcagatggagtgggag

SEQ ID NO: 8389146 - DNA, 22 bp, Homo sapiens
ggagaggtgagaggtacaagtt

SEQ ID NO: 8389147 - DNA, 22 bp, Homo sapiens
ggaggccatcagggagggcatt

SEQ ID NO: 8389148 - DNA, 22 bp, Homo sapiens
ggaggcagaatagagtgtgggt

SEQ ID NO: 8389149 - DNA, 22 bp, Homo sapiens
ggaggcagaatagagtgtgggt

SEQ ID NO: 8389150 - DNA, 22 bp, Homo sapiens
ggaggcagaatagagtgtgggt

SEQ ID NO: 8389151 - DNA, 22 bp, Homo sapiens
ggagctcaggcccagcaaggcc

SEQ ID NO: 8389152 - DNA, 22 bp, Homo sapiens
ggagctcagtggggggactgtg

SEQ ID NO: 8389153 - DNA, 22 bp, Homo sapiens
ggagctcagtggggggactgtg

SEQ ID NO: 8389154 - DNA, 22 bp, Homo sapiens
ggaggaaaggctccctccctct

SEQ ID NO: 8389155 - DNA, 22 bp, Homo sapiens
ggaggaaatccttagtaaggca

SEQ ID NO: 8389156 - DNA, 22 bp, Homo sapiens
ggagctgcacgctctgaagcct

SEQ ID NO: 8389157 - DNA, 22 bp, Homo sapiens
ggaggagcatgagagggtagtg

SEQ ID NO: 8389158 - DNA, 22 bp, Homo sapiens
ggaggacactggctctgccttc

SEQ ID NO: 8389159 - DNA, 22 bp, Homo sapiens
ggaggacaggggctgcagcaca

SEQ ID NO: 8389160 - DNA, 22 bp, Homo sapiens
ggaggaaatgaaaggagggttt

SEQ ID NO: 8389161 - DNA, 22 bp, Homo sapiens
ggaggaaatccttagtaaggca

SEQ ID NO: 8389162 - DNA, 22 bp, Homo sapiens
ggaggaagggcccaggctttat

SEQ ID NO: 8389163 - DNA, 22 bp, Homo sapiens
ggaggaagggcccaggctttat

SEQ ID NO: 8389164 - DNA, 22 bp, Homo sapiens
gcttattttcaccttctctcag

SEQ ID NO: 8389165 - DNA, 21 bp, Homo sapiens
gcttatagaaacatcaccaga

SEQ ID NO: 8389166 - DNA, 22 bp, Homo sapiens
gcttagaagttcctataaaatg

SEQ ID NO: 8389167 - DNA, 22 bp, Homo sapiens
gcttagagcagctcacaacatg

SEQ ID NO: 8389168 - DNA, 22 bp, Homo sapiens
gcttacaggtgaggcagcaaga

SEQ ID NO: 8389169 - DNA, 22 bp, Homo sapiens
gcttacaatcatttcagtttag

SEQ ID NO: 8389170 - DNA, 22 bp, Homo sapiens
gcttacaatcatttcagtttag

SEQ ID NO: 8389171 - DNA, 22 bp, Homo sapiens
gcttacaagggtaggaagtcta

SEQ ID NO: 8389172 - DNA, 22 bp, Homo sapiens
gcttacaagatcgtgctccagt

SEQ ID NO: 8389173 - DNA, 22 bp, Homo sapiens
gcttacaagccagctgtaccac

SEQ ID NO: 8389174 - DNA, 22 bp, Homo sapiens
gcttacaaacaacagaaattaa

SEQ ID NO: 8389175 - DNA, 22 bp, Homo sapiens
gcttacaaacaacagaaattaa

SEQ ID NO: 8389176 - DNA, 22 bp, Homo sapiens
gcttaatgagcagagaatctac

SEQ ID NO: 8389177 - DNA, 22 bp, Homo sapiens
gctgggctgcccaacctctgac

SEQ ID NO: 8389178 - DNA, 22 bp, Homo sapiens
gctgggcatgtgaccaacagaa

SEQ ID NO: 8389179 - DNA, 22 bp, Homo sapiens
gctgggctgagaagttaagcaa

SEQ ID NO: 8389180 - DNA, 22 bp, Homo sapiens
gctgggctgagctagacttggc

SEQ ID NO: 8389181 - DNA, 22 bp, Homo sapiens
gcttctgcagggtcctcgctgt

SEQ ID NO: 8389182 - DNA, 22 bp, Homo sapiens
gcttctgcagagccgtcctgag

SEQ ID NO: 8389183 - DNA, 22 bp, Homo sapiens
gcttctgcagccaaagaagccg

SEQ ID NO: 8389184 - DNA, 22 bp, Homo sapiens
gcttctgatgtcagacttctgg

SEQ ID NO: 8389185 - DNA, 22 bp, Homo sapiens
gcttctgcgcctagcctcaggt

SEQ ID NO: 8389186 - DNA, 22 bp, Homo sapiens
gcttctgctgttgaagccacca

SEQ ID NO: 8389187 - DNA, 23 bp, Homo sapiens
gcttctgccatttgctagctgtg

SEQ ID NO: 8389188 - DNA, 22 bp, Homo sapiens
gcttctgcgcacgcttcttccc

SEQ ID NO: 8389189 - DNA, 22 bp, Homo sapiens
gcttctgccttgcactttgtca

SEQ ID NO: 8389190 - DNA, 22 bp, Homo sapiens
gcttctcaattctcaccctcca

SEQ ID NO: 8389191 - DNA, 22 bp, Homo sapiens
gcttctcaattctcaccctcca

SEQ ID NO: 8389192 - DNA, 22 bp, Homo sapiens
gcttctacccacgagatgcaaa

SEQ ID NO: 8389193 - DNA, 22 bp, Homo sapiens
gcttctaattttttacagaata

SEQ ID NO: 8389194 - DNA, 22 bp, Homo sapiens
gcttcctgtaggcaggtccaag

SEQ ID NO: 8389195 - DNA, 22 bp, Homo sapiens
gcttccttctaccacatcatgc

SEQ ID NO: 8389196 - DNA, 22 bp, Homo sapiens
gcttccttgggaaaattagatg

SEQ ID NO: 8389197 - DNA, 22 bp, Homo sapiens
gcttcctgggacaggctatgtg

SEQ ID NO: 8389198 - DNA, 22 bp, Homo sapiens
gcttcctggagggagagagctg

SEQ ID NO: 8389199 - DNA, 22 bp, Homo sapiens
gcttcatacaatggtatatgca

SEQ ID NO: 8389200 - DNA, 22 bp, Homo sapiens
gcttcatagcattcattgcctg

SEQ ID NO: 8389201 - DNA, 22 bp, Homo sapiens
gcttcagacctgaaaggaaaaa

SEQ ID NO: 8389202 - DNA, 22 bp, Homo sapiens
gcttcagaagttgggctctgac

SEQ ID NO: 8389203 - DNA, 22 bp, Homo sapiens
gcttcagaaatgaacactgtct

SEQ ID NO: 8389204 - DNA, 20 bp, Homo sapiens
gcttcagaacctgggtgctg

SEQ ID NO: 8389205 - DNA, 22 bp, Homo sapiens
ggaaaccattcccgactctcct

SEQ ID NO: 8389206 - DNA, 22 bp, Homo sapiens
ggaaactgagtgacactccctc

SEQ ID NO: 8389207 - DNA, 22 bp, Homo sapiens
ggaaactagaagaatactagtc

SEQ ID NO: 8389208 - DNA, 22 bp, Homo sapiens
ggaaactgtagtttgctgacat

SEQ ID NO: 8389209 - DNA, 22 bp, Homo sapiens
ggaaactgcttacactagaggg

SEQ ID NO: 8389210 - DNA, 22 bp, Homo sapiens
ggaaagaaagtgtgaacaactt

SEQ ID NO: 8389211 - DNA, 20 bp, Homo sapiens
ggaaacatttttatttccat

SEQ ID NO: 8389212 - DNA, 22 bp, Homo sapiens
gcttctgggcacctgaacagga

SEQ ID NO: 8389213 - DNA, 22 bp, Homo sapiens
gcttctggggttctggcatgct

SEQ ID NO: 8389214 - DNA, 22 bp, Homo sapiens
gcttctggaggagctgggctga

SEQ ID NO: 8389215 - DNA, 22 bp, Homo sapiens
gcttctggagtcttcagaggaa

SEQ ID NO: 8389216 - DNA, 17 bp, Homo sapiens
gcttctggagcttctgt

SEQ ID NO: 8389217 - DNA, 22 bp, Homo sapiens
gcttctggaagctgcttctgcc

SEQ ID NO: 8389218 - DNA, 22 bp, Homo sapiens
ggaaaacaagagaatgatgttt

SEQ ID NO: 8389219 - DNA, 22 bp, Homo sapiens
ggaaaacagcgattggtatcat

SEQ ID NO: 8389220 - DNA, 22 bp, Homo sapiens
ggaaaacaagagaatgatgttt

SEQ ID NO: 8389221 - DNA, 22 bp, Homo sapiens
ggaaagaatagagactttatca

SEQ ID NO: 8389222 - DNA, 22 bp, Homo sapiens
ggaaagaatagagactttatca

SEQ ID NO: 8389223 - DNA, 21 bp, Homo sapiens
ggaaagaaggcaaggctcagg

SEQ ID NO: 8389224 - DNA, 21 bp, Homo sapiens
ggaaagaaggcaaggctcagg

SEQ ID NO: 8389225 - DNA, 22 bp, Homo sapiens
ggaaagaaccctggatggctgg

SEQ ID NO: 8389226 - DNA, 22 bp, Homo sapiens
ggaaagaaccctggatggctgg

SEQ ID NO: 8389227 - DNA, 22 bp, Homo sapiens
ggaaagaatcaagtgatcctgt

SEQ ID NO: 8389228 - DNA, 22 bp, Homo sapiens
ggaaagaatcaagtgatcctgt

SEQ ID NO: 8389229 - DNA, 23 bp, Homo sapiens
ggaaagagaggagttgtgcatag

SEQ ID NO: 8389230 - DNA, 22 bp, Homo sapiens
ggaaagagggacccagcttggt

SEQ ID NO: 8389231 - DNA, 22 bp, Homo sapiens
ggaactcctgctccaagcagct

SEQ ID NO: 8389232 - DNA, 22 bp, Homo sapiens
ggaactcctgctccaagcagct

SEQ ID NO: 8389233 - DNA, 22 bp, Homo sapiens
ggaagaaaggtggacaacaggt

SEQ ID NO: 8389234 - DNA, 22 bp, Homo sapiens
ggaagaaaggtggacaacaggt

SEQ ID NO: 8389235 - DNA, 22 bp, Homo sapiens
ggaagaaaggtggacaacaggt

SEQ ID NO: 8389236 - DNA, 22 bp, Homo sapiens
ggaagaaagtagaaaaccgtgg

SEQ ID NO: 8389237 - DNA, 22 bp, Homo sapiens
ggaagaaatctggttaagagat

SEQ ID NO: 8389238 - DNA, 22 bp, Homo sapiens
ggaagaaagtagaaaaccgtgg

SEQ ID NO: 8389239 - DNA, 22 bp, Homo sapiens
ggaagaaaatgggcaacaggtg

SEQ ID NO: 8389240 - DNA, 22 bp, Homo sapiens
ggaagaaaatgggcaacaggtg

SEQ ID NO: 8389241 - DNA, 22 bp, Homo sapiens
ggaagaaagacatttattttga

SEQ ID NO: 8389242 - DNA, 22 bp, Homo sapiens
ggaagaaagcacacaaacttga

SEQ ID NO: 8389243 - DNA, 17 bp, Homo sapiens
ggaagaaaaggatcatc

SEQ ID NO: 8389244 - DNA, 18 bp, Homo sapiens
ggaagaaaaggaactcag

SEQ ID NO: 8389245 - DNA, 22 bp, Homo sapiens
ggaagaaaagcttccagcgcct

SEQ ID NO: 8389246 - DNA, 22 bp, Homo sapiens
ggaagaaaagcttccagcgcct

SEQ ID NO: 8389247 - DNA, 22 bp, Homo sapiens
ggaacttatactgccagattct

SEQ ID NO: 8389248 - DNA, 22 bp, Homo sapiens
ggaactgagaagcagctatgcc

SEQ ID NO: 8389249 - DNA, 22 bp, Homo sapiens
ggaactgaatgtctcggtataa

SEQ ID NO: 8389250 - DNA, 22 bp, Homo sapiens
ggaactgattaagtcatgagaa

SEQ ID NO: 8389251 - DNA, 22 bp, Homo sapiens
ggaaggggttaggggtccctga

SEQ ID NO: 8389252 - DNA, 22 bp, Homo sapiens
ggaaggtgctccctggacagag

SEQ ID NO: 8389253 - DNA, 22 bp, Homo sapiens
ggaaggtgctccctggacagag

SEQ ID NO: 8389254 - DNA, 22 bp, Homo sapiens
ggaagaaatctggttaagagat

SEQ ID NO: 8389255 - DNA, 22 bp, Homo sapiens
ggaagaaatgctcttctatgcg

SEQ ID NO: 8389256 - DNA, 22 bp, Homo sapiens
ggagggcatcaatcaggcctgg

SEQ ID NO: 8389257 - DNA, 21 bp, Homo sapiens
ggagggcagcccagactggct

SEQ ID NO: 8389258 - DNA, 22 bp, Homo sapiens
ggagggcatcaatcaggcctgg

SEQ ID NO: 8389259 - DNA, 22 bp, Homo sapiens
ggagggaatgtctagcattctt

SEQ ID NO: 8389260 - DNA, 22 bp, Homo sapiens
ggagggaagtgagttctcagct

SEQ ID NO: 8389261 - DNA, 22 bp, Homo sapiens
ggagggcagagtcccctgctga

SEQ ID NO: 8389262 - DNA, 22 bp, Homo sapiens
ggagggctgccaggtggagcgg

SEQ ID NO: 8389263 - DNA, 22 bp, Homo sapiens
ggagggctgccaggtggagcgg

SEQ ID NO: 8389264 - DNA, 22 bp, Homo sapiens
ggagggctgtagaggagacctg

SEQ ID NO: 8389265 - DNA, 23 bp, Homo sapiens
ggagggcttcatcagacccccag

SEQ ID NO: 8389266 - DNA, 22 bp, Homo sapiens
ggaggggaactaatcccgtgac

SEQ ID NO: 8389267 - DNA, 22 bp, Homo sapiens
ggagggctgagactggggtctg

SEQ ID NO: 8389268 - DNA, 22 bp, Homo sapiens
ggagggctcaattgactcctga

SEQ ID NO: 8389269 - DNA, 22 bp, Homo sapiens
ggagggctccctgggagtggat

SEQ ID NO: 8389270 - DNA, 22 bp, Homo sapiens
ggagggctccctgggagtggat

SEQ ID NO: 8389271 - DNA, 22 bp, Homo sapiens
ggaggctcagtgaggaaatgga

SEQ ID NO: 8389272 - DNA, 22 bp, Homo sapiens
ggaggctccatgagctcctgca

SEQ ID NO: 8389273 - DNA, 22 bp, Homo sapiens
ggaggcctcctgggggaggttc

SEQ ID NO: 8389274 - DNA, 22 bp, Homo sapiens
ggaggcctagccagctccagtt

SEQ ID NO: 8389275 - DNA, 22 bp, Homo sapiens
ggaggctgagaagtccaagatc

SEQ ID NO: 8389276 - DNA, 22 bp, Homo sapiens
ggaggctgagaagtccaagatc

SEQ ID NO: 8389277 - DNA, 22 bp, Homo sapiens
ggaggctcttgagaggggagta

SEQ ID NO: 8389278 - DNA, 22 bp, Homo sapiens
ggaggctcccacgcagctcaca

SEQ ID NO: 8389279 - DNA, 22 bp, Homo sapiens
ggaggctcgctggtcgcacagc

SEQ ID NO: 8389280 - DNA, 22 bp, Homo sapiens
ggaggctgctgcctcacgtggg

SEQ ID NO: 8389281 - DNA, 22 bp, Homo sapiens
ggaggctgctgcctcacgtggg

SEQ ID NO: 8389282 - DNA, 22 bp, Homo sapiens
ggaggctgaggcccctcacagg

SEQ ID NO: 8389283 - DNA, 22 bp, Homo sapiens
ggaggctgaggcaggcggatca

SEQ ID NO: 8389284 - DNA, 22 bp, Homo sapiens
ggaggctgagaggtcgcagtgg

SEQ ID NO: 8389285 - DNA, 22 bp, Homo sapiens
ggaggctgaggcaggcggatca

SEQ ID NO: 8389286 - DNA, 22 bp, Homo sapiens
ggaggtggcagagggacattct

SEQ ID NO: 8389287 - DNA, 23 bp, Homo sapiens
ggaggtcagtgcctgagggtgag

SEQ ID NO: 8389288 - DNA, 22 bp, Homo sapiens
ggaggtcccaggcctggcagca

SEQ ID NO: 8389289 - DNA, 20 bp, Homo sapiens
ggaggtcaaatgatgagaag

SEQ ID NO: 8389290 - DNA, 22 bp, Homo sapiens
ggaggtagtctgagtcataggc

SEQ ID NO: 8389291 - DNA, 22 bp, Homo sapiens
ggaggtagcctcaaaagcagct

SEQ ID NO: 8389292 - DNA, 22 bp, Homo sapiens
ggaggtgggattaggacctaaa

SEQ ID NO: 8389293 - DNA, 22 bp, Homo sapiens
ggaggtgggagcctccagtggt

SEQ ID NO: 8389294 - DNA, 22 bp, Homo sapiens
ggagtaggccccgggagagagt

SEQ ID NO: 8389295 - DNA, 22 bp, Homo sapiens
ggaggtgggctaaggactctct

SEQ ID NO: 8389296 - DNA, 22 bp, Homo sapiens
ggaggtgggctaaggactctct

SEQ ID NO: 8389297 - DNA, 22 bp, Homo sapiens
ggaggtggtggcagtgacaatt

SEQ ID NO: 8389298 - DNA, 22 bp, Homo sapiens
ggagggtccatcttgtgaaaag

SEQ ID NO: 8389299 - DNA, 22 bp, Homo sapiens
ggagggtccccagcagcatgaa

SEQ ID NO: 8389300 - DNA, 22 bp, Homo sapiens
ggagggtctaagggagaactga

SEQ ID NO: 8389301 - DNA, 22 bp, Homo sapiens
ggagggtccactgtgaggcaga

SEQ ID NO: 8389302 - DNA, 22 bp, Homo sapiens
ggaggggtgagaatggctgcct

SEQ ID NO: 8389303 - DNA, 22 bp, Homo sapiens
ggaggggagatgtttgggctca

SEQ ID NO: 8389304 - DNA, 22 bp, Homo sapiens
ggaggggctgagcaactttcag

SEQ ID NO: 8389305 - DNA, 22 bp, Homo sapiens
ggagggggaattcagccccagc

SEQ ID NO: 8389306 - DNA, 20 bp, Homo sapiens
ggcagacctgctgagagccc

SEQ ID NO: 8389307 - DNA, 22 bp, Homo sapiens
ggcagactgtaataggagaatt

SEQ ID NO: 8389308 - DNA, 22 bp, Homo sapiens
ggcagactttttctctgaaggg

SEQ ID NO: 8389309 - DNA, 19 bp, Homo sapiens
ggcagacacagttgacatg

SEQ ID NO: 8389310 - DNA, 22 bp, Homo sapiens
ggcagacacctttatgtctaat

SEQ ID NO: 8389311 - DNA, 22 bp, Homo sapiens
ggcagacctctccagccccaca

SEQ ID NO: 8389312 - DNA, 22 bp, Homo sapiens
ggcagagactgggttggcagag

SEQ ID NO: 8389313 - DNA, 22 bp, Homo sapiens
ggcagacacaaaaacataaggt

SEQ ID NO: 8389314 - DNA, 22 bp, Homo sapiens
ggcagacacaaaaacataaggt

SEQ ID NO: 8389315 - DNA, 22 bp, Homo sapiens
ggcacagcacagtggacccagg

SEQ ID NO: 8389316 - DNA, 22 bp, Homo sapiens
ggcacagagttggcagagctgc

SEQ ID NO: 8389317 - DNA, 22 bp, Homo sapiens
ggcacagatagatcaagtgtct

SEQ ID NO: 8389318 - DNA, 22 bp, Homo sapiens
ggcacagaggttgcctccagat

SEQ ID NO: 8389319 - DNA, 22 bp, Homo sapiens
ggcacagagctccagccttggc

SEQ ID NO: 8389320 - DNA, 22 bp, Homo sapiens
ggcacacatagatctgcactgg

SEQ ID NO: 8389321 - DNA, 22 bp, Homo sapiens
ggcacagagcaggccactaatc

SEQ ID NO: 8389322 - DNA, 22 bp, Homo sapiens
ggcaagggacggccgtgagaca

SEQ ID NO: 8389323 - DNA, 22 bp, Homo sapiens
ggcacacagatggagcactagc

SEQ ID NO: 8389324 - DNA, 22 bp, Homo sapiens
ggagtgtgggatggagctcagg

SEQ ID NO: 8389325 - DNA, 22 bp, Homo sapiens
ggagttgattttggatatatta

SEQ ID NO: 8389326 - DNA, 22 bp, Homo sapiens
ggagttgattttggatatatta

SEQ ID NO: 8389327 - DNA, 22 bp, Homo sapiens
ggcaaggccaggcctccaagac

SEQ ID NO: 8389328 - DNA, 22 bp, Homo sapiens
ggagtggcaggccacagtgctg

SEQ ID NO: 8389329 - DNA, 22 bp, Homo sapiens
ggagtggcagctaggctgtcag

SEQ ID NO: 8389330 - DNA, 22 bp, Homo sapiens
ggagtgctttgaagccttcatt

SEQ ID NO: 8389331 - DNA, 22 bp, Homo sapiens
ggagtggcactctgaggcgggg

SEQ ID NO: 8389332 - DNA, 22 bp, Homo sapiens
ggagtgggaacaatgacatggt

SEQ ID NO: 8389333 - DNA, 22 bp, Homo sapiens
ggcaggctcttggccttatgag

SEQ ID NO: 8389334 - DNA, 22 bp, Homo sapiens
ggcaggctgcttgggtcatgtc

SEQ ID NO: 8389335 - DNA, 22 bp, Homo sapiens
ggcaggctccagagccctctcc

SEQ ID NO: 8389336 - DNA, 22 bp, Homo sapiens
ggcaggctccagagccctctcc

SEQ ID NO: 8389337 - DNA, 22 bp, Homo sapiens
ggcaggctcagcagccaaggag

SEQ ID NO: 8389338 - DNA, 22 bp, Homo sapiens
ggcaggctagcactgatgtcct

SEQ ID NO: 8389339 - DNA, 22 bp, Homo sapiens
ggcaggcgtggtggcctcagaa

SEQ ID NO: 8389340 - DNA, 22 bp, Homo sapiens
ggcaggcattgcaacatgtaca

SEQ ID NO: 8389341 - DNA, 22 bp, Homo sapiens
ggcaggcattgcaacatgtaca

SEQ ID NO: 8389342 - DNA, 22 bp, Homo sapiens
ggcaggcagcctccatccacag

SEQ ID NO: 8389343 - DNA, 17 bp, Homo sapiens
ggcaggtgcggggccgc

SEQ ID NO: 8389344 - DNA, 22 bp, Homo sapiens
ggcaggtgctaagagaggtaaa

SEQ ID NO: 8389345 - DNA, 22 bp, Homo sapiens
ggcaggtgcgcatgttgcatta

SEQ ID NO: 8389346 - DNA, 22 bp, Homo sapiens
ggcaggtgaggcatgtgcctgg

SEQ ID NO: 8389347 - DNA, 22 bp, Homo sapiens
ggcaggctgggagtcatcagag

SEQ ID NO: 8389348 - DNA, 22 bp, Homo sapiens
ggcaggctgggagtcatcagag

SEQ ID NO: 8389349 - DNA, 22 bp, Homo sapiens
ggcagctgtaagatgagtgaat

SEQ ID NO: 8389350 - DNA, 22 bp, Homo sapiens
ggcaggcagatggctgcaccaa

SEQ ID NO: 8389351 - DNA, 22 bp, Homo sapiens
ggcaggcagatggctgcaccaa

SEQ ID NO: 8389352 - DNA, 22 bp, Homo sapiens
ggcaggcagatggctgcaccaa

SEQ ID NO: 8389353 - DNA, 22 bp, Homo sapiens
ggcagctgtgaagtgcctcaca

SEQ ID NO: 8389354 - DNA, 22 bp, Homo sapiens
ggcagctgtctctgagttagca

SEQ ID NO: 8389355 - DNA, 22 bp, Homo sapiens
ggcagctggggcagtgccctgt

SEQ ID NO: 8389356 - DNA, 23 bp, Homo sapiens
ggcagctgggcagcactcatggg

SEQ ID NO: 8389357 - DNA, 22 bp, Homo sapiens
ggcagctgggttggccagaaac

SEQ ID NO: 8389358 - DNA, 23 bp, Homo sapiens
ggcagctgggcagcactcatggg

SEQ ID NO: 8389359 - DNA, 22 bp, Homo sapiens
ggcagaggaagctggaagtggg

SEQ ID NO: 8389360 - DNA, 22 bp, Homo sapiens
ggcagaggaagctggaagtggg

SEQ ID NO: 8389361 - DNA, 22 bp, Homo sapiens
ggcagaggaagctggaagtggg

SEQ ID NO: 8389362 - DNA, 22 bp, Homo sapiens
gagtggagcaaaagaggtagat

SEQ ID NO: 8389363 - DNA, 22 bp, Homo sapiens
gagtggcatagaagcatataga

SEQ ID NO: 8389364 - DNA, 22 bp, Homo sapiens
gagtggagatcgtgccactgca

SEQ ID NO: 8389365 - DNA, 22 bp, Homo sapiens
gagtggagatcgtgccactgca

SEQ ID NO: 8389366 - DNA, 21 bp, Homo sapiens
gagtgggacatgggagtggtt

SEQ ID NO: 8389367 - DNA, 22 bp, Homo sapiens
gagtggggctttaaaggctcag

SEQ ID NO: 8389368 - DNA, 22 bp, Homo sapiens
gagtgggcaaaagaaagtaggc

SEQ ID NO: 8389369 - DNA, 17 bp, Homo sapiens
gagtgctggtggagctc

SEQ ID NO: 8389370 - DNA, 22 bp, Homo sapiens
gagtgctggaggtgtgagtggg

SEQ ID NO: 8389371 - DNA, 22 bp, Homo sapiens
gagtgctgctaatgcaagggtg

SEQ ID NO: 8389372 - DNA, 22 bp, Homo sapiens
gagtgccaagagaagaggctgg

SEQ ID NO: 8389373 - DNA, 21 bp, Homo sapiens
gagtgctcagttaagtggaga

SEQ ID NO: 8389374 - DNA, 22 bp, Homo sapiens
gagtgctccgtcttggacaggg

SEQ ID NO: 8389375 - DNA, 22 bp, Homo sapiens
gagtgcagaaattcccttcctg

SEQ ID NO: 8389376 - DNA, 22 bp, Homo sapiens
gagtgagggcagcaggggctgc

SEQ ID NO: 8389377 - DNA, 22 bp, Homo sapiens
gagtgaggctggaatcatggct

SEQ ID NO: 8389378 - DNA, 22 bp, Homo sapiens
gagtgagggccaacatccagct

SEQ ID NO: 8389379 - DNA, 18 bp, Homo sapiens
gagtctttgttactgctg

SEQ ID NO: 8389380 - DNA, 22 bp, Homo sapiens
gagtctttggtaaagtctgctg

SEQ ID NO: 8389381 - DNA, 22 bp, Homo sapiens
gagtcttctacgctcacacaaa

SEQ ID NO: 8389382 - DNA, 22 bp, Homo sapiens
gagtctttctgggcttgttctt

SEQ ID NO: 8389383 - DNA, 22 bp, Homo sapiens
gagtctctggaggggtcagacc

SEQ ID NO: 8389384 - DNA, 22 bp, Homo sapiens
gagtctatctcactcccccagg

SEQ ID NO: 8389385 - DNA, 22 bp, Homo sapiens
gagtgtggtgaacaggagcacc

SEQ ID NO: 8389386 - DNA, 22 bp, Homo sapiens
gagtgtggtgaacaggagcacc

SEQ ID NO: 8389387 - DNA, 22 bp, Homo sapiens
gagtgtgggggtgctgaggaca

SEQ ID NO: 8389388 - DNA, 22 bp, Homo sapiens
gagtgtgggggtgctgaggaca

SEQ ID NO: 8389389 - DNA, 22 bp, Homo sapiens
gagtgtgggggtgctgaggaca

SEQ ID NO: 8389390 - DNA, 22 bp, Homo sapiens
gagtgtctgtggggcatggaca

SEQ ID NO: 8389391 - DNA, 22 bp, Homo sapiens
gagtgtggatcccagaagcaga

SEQ ID NO: 8389392 - DNA, 18 bp, Homo sapiens
gagtgtggcactgggccc

SEQ ID NO: 8389393 - DNA, 22 bp, Homo sapiens
gagttaaaaatgcctccatgga

SEQ ID NO: 8389394 - DNA, 22 bp, Homo sapiens
gagttaaaggaaaataacttta

SEQ ID NO: 8389395 - DNA, 22 bp, Homo sapiens
gagttctggtcagcagggcagc

SEQ ID NO: 8389396 - DNA, 22 bp, Homo sapiens
gagttctgtagggtgaaatagt

SEQ ID NO: 8389397 - DNA, 22 bp, Homo sapiens
gagtgggtgacagaaggaggta

SEQ ID NO: 8389398 - DNA, 21 bp, Homo sapiens
gagtgtcagcaagaggtttgg

SEQ ID NO: 8389399 - DNA, 22 bp, Homo sapiens
gagtgtcacagggtaattgttt

SEQ ID NO: 8389400 - DNA, 22 bp, Homo sapiens
gagtgtcaaggctctctttggc

SEQ ID NO: 8389401 - DNA, 22 bp, Homo sapiens
gagtgtcacttgatgcagggca

SEQ ID NO: 8389402 - DNA, 22 bp, Homo sapiens
gagtgtcagtgcttggggctac

SEQ ID NO: 8389403 - DNA, 22 bp, Homo sapiens
gagtgtcagtgcctggcttgtt

SEQ ID NO: 8389404 - DNA, 22 bp, Homo sapiens
gagtgtcagcagggcagagcac

SEQ ID NO: 8389405 - DNA, 22 bp, Homo sapiens
gagtgggtccacagaggtgaca

SEQ ID NO: 8389406 - DNA, 22 bp, Homo sapiens
gataaaattcttattttacccg

SEQ ID NO: 8389407 - DNA, 22 bp, Homo sapiens
gataaaataactatggaatact

SEQ ID NO: 8389408 - DNA, 22 bp, Homo sapiens
gataaaataactatggaatact

SEQ ID NO: 8389409 - DNA, 22 bp, Homo sapiens
gataacaatatgaagtagatat

SEQ ID NO: 8389410 - DNA, 22 bp, Homo sapiens
gataacatacttgcatgtgtat

SEQ ID NO: 8389411 - DNA, 22 bp, Homo sapiens
gataaagcaggtaggagaagat

SEQ ID NO: 8389412 - DNA, 23 bp, Homo sapiens
gagtttcttccaggagccctggg

SEQ ID NO: 8389413 - DNA, 22 bp, Homo sapiens
gataaaataactatggaatact

SEQ ID NO: 8389414 - DNA, 22 bp, Homo sapiens
gagtttctccagtgctagttgt

SEQ ID NO: 8389415 - DNA, 22 bp, Homo sapiens
gagtttctgattcagtctgtgt

SEQ ID NO: 8389416 - DNA, 22 bp, Homo sapiens
gagtttctgatttagtaggtct

SEQ ID NO: 8389417 - DNA, 22 bp, Homo sapiens
gagtttcttaacaggtggaagc

SEQ ID NO: 8389418 - DNA, 22 bp, Homo sapiens
gagtttcttcatggtgcagagg

SEQ ID NO: 8389419 - DNA, 22 bp, Homo sapiens
gagtttctgctctaggtctggt

SEQ ID NO: 8389420 - DNA, 22 bp, Homo sapiens
gagtttctaggatggaggtgag

SEQ ID NO: 8389421 - DNA, 22 bp, Homo sapiens
gagtttatgtctttcattgttc

SEQ ID NO: 8389422 - DNA, 22 bp, Homo sapiens
gatatacagagcattctttgat

SEQ ID NO: 8389423 - DNA, 22 bp, Homo sapiens
gatatacataggtttctatgca

SEQ ID NO: 8389424 - DNA, 22 bp, Homo sapiens
gatatttacattaagcacattg

SEQ ID NO: 8389425 - DNA, 22 bp, Homo sapiens
gatattttgagaaatcctatga

SEQ ID NO: 8389426 - DNA, 22 bp, Homo sapiens
gatatttttaggtgatgcaggc

SEQ ID NO: 8389427 - DNA, 22 bp, Homo sapiens
gatatttttaggtgatgcaggc

SEQ ID NO: 8389428 - DNA, 22 bp, Homo sapiens
gatattttcattcggatgctca

SEQ ID NO: 8389429 - DNA, 22 bp, Homo sapiens
gatattttcattcggatgctca

SEQ ID NO: 8389430 - DNA, 22 bp, Homo sapiens
gatattttcgcagggagaattc

SEQ ID NO: 8389431 - DNA, 22 bp, Homo sapiens
gatattttcgcagggagaattc

SEQ ID NO: 8389432 - DNA, 22 bp, Homo sapiens
gatattttcagtctcctttcaa

SEQ ID NO: 8389433 - DNA, 22 bp, Homo sapiens
gatatttttagtatttctgcct

SEQ ID NO: 8389434 - DNA, 22 bp, Homo sapiens
gatatttttgcagacacctggg

SEQ ID NO: 8389435 - DNA, 22 bp, Homo sapiens
gatcacataatttggaaacagc

SEQ ID NO: 8389436 - DNA, 20 bp, Homo sapiens
gatcaggaagcggcttggga

SEQ ID NO: 8389437 - DNA, 22 bp, Homo sapiens
gatcaggaatattggaaagtac

SEQ ID NO: 8389438 - DNA, 22 bp, Homo sapiens
gatcaggagatggcctcagacc

SEQ ID NO: 8389439 - DNA, 22 bp, Homo sapiens
gatcaggacatagctataggct

SEQ ID NO: 8389440 - DNA, 22 bp, Homo sapiens
gatcagtaagtgaataatgagt

SEQ ID NO: 8389441 - DNA, 18 bp, Homo sapiens
gatcaggatcaatcaccc

SEQ ID NO: 8389442 - DNA, 19 bp, Homo sapiens
gatcaggagccgacaactg

SEQ ID NO: 8389443 - DNA, 22 bp, Homo sapiens
gatcaggacatagctataggct

SEQ ID NO: 8389444 - DNA, 22 bp, Homo sapiens
gatataaattaatcaagtgcaa

SEQ ID NO: 8389445 - DNA, 22 bp, Homo sapiens
gatatacaatccacagttgatt

SEQ ID NO: 8389446 - DNA, 22 bp, Homo sapiens
gataggctgaaagactatggcg

SEQ ID NO: 8389447 - DNA, 22 bp, Homo sapiens
gataggctggccttgggcaaaa

SEQ ID NO: 8389448 - DNA, 23 bp, Homo sapiens
gataggctggttagtgtatctgt

SEQ ID NO: 8389449 - DNA, 22 bp, Homo sapiens
gatagctgctgggatattttta

SEQ ID NO: 8389450 - DNA, 19 bp, Homo sapiens
gatagctgatgaccatcat

SEQ ID NO: 8389451 - DNA, 22 bp, Homo sapiens
gatacccagcaaaatgcaggag

SEQ ID NO: 8389452 - DNA, 22 bp, Homo sapiens
gatacttgaggagatcaccaca

SEQ ID NO: 8389453 - DNA, 22 bp, Homo sapiens
gatactttccatccaaatgcat

SEQ ID NO: 8389454 - DNA, 22 bp, Homo sapiens
gatagagaaacacagataaatg

SEQ ID NO: 8389455 - DNA, 22 bp, Homo sapiens
gatagagactataatgctcttt

SEQ ID NO: 8389456 - DNA, 22 bp, Homo sapiens
gatacagtgtgttaacgagaaa

SEQ ID NO: 8389457 - DNA, 22 bp, Homo sapiens
gatacagtatttaaagagcaac

SEQ ID NO: 8389458 - DNA, 22 bp, Homo sapiens
gataagcactatataagtattt

SEQ ID NO: 8389459 - DNA, 22 bp, Homo sapiens
gataataagcacagcaggatgt

SEQ ID NO: 8389460 - DNA, 22 bp, Homo sapiens
gataatatctggtttattcacc

SEQ ID NO: 8389461 - DNA, 22 bp, Homo sapiens
gatgaacatttaaagcctcttg

SEQ ID NO: 8389462 - DNA, 22 bp, Homo sapiens
gatgaaatttgaaaatagtgtt

SEQ ID NO: 8389463 - DNA, 22 bp, Homo sapiens
gatgaaatttgggcaggttaaa

SEQ ID NO: 8389464 - DNA, 22 bp, Homo sapiens
gatgaacatattcctctccaga

SEQ ID NO: 8389465 - DNA, 18 bp, Homo sapiens
gatgaagctgctggggat

SEQ ID NO: 8389466 - DNA, 22 bp, Homo sapiens
gatgaagctatttggttggcac

SEQ ID NO: 8389467 - DNA, 22 bp, Homo sapiens
gatgaagctttgaagtctaatc

SEQ ID NO: 8389468 - DNA, 22 bp, Homo sapiens
gatgaagcctgacttctcggtg

SEQ ID NO: 8389469 - DNA, 22 bp, Homo sapiens
gatgaagctaaatctaaggttt

SEQ ID NO: 8389470 - DNA, 21 bp, Homo sapiens
gatgaagcaatctttctgttg

SEQ ID NO: 8389471 - DNA, 22 bp, Homo sapiens
gatgaagccccagtgtaagtaa

SEQ ID NO: 8389472 - DNA, 22 bp, Homo sapiens
gatgaatgagctgtgcacatta

SEQ ID NO: 8389473 - DNA, 22 bp, Homo sapiens
gatgagaaatggacaggagtgg

SEQ ID NO: 8389474 - DNA, 22 bp, Homo sapiens
gatgcatgtatggagtgagggt

SEQ ID NO: 8389475 - DNA, 22 bp, Homo sapiens
gatgcacggtcatgtcttttca

SEQ ID NO: 8389476 - DNA, 22 bp, Homo sapiens
gatcccttgggccaaggagttg

SEQ ID NO: 8389477 - DNA, 22 bp, Homo sapiens
gatctggtacaggcctgcagcc

SEQ ID NO: 8389478 - DNA, 22 bp, Homo sapiens
gatctttaaggcttaccctgga

SEQ ID NO: 8389479 - DNA, 22 bp, Homo sapiens
gatctttactactgccttctct

SEQ ID NO: 8389480 - DNA, 22 bp, Homo sapiens
gatccctgccctcagcctggac

SEQ ID NO: 8389481 - DNA, 22 bp, Homo sapiens
gatccacagggccctggcccag

SEQ ID NO: 8389482 - DNA, 22 bp, Homo sapiens
gatccacagtttgatgatcata

SEQ ID NO: 8389483 - DNA, 22 bp, Homo sapiens
gatcatttgcaggaaacattaa

SEQ ID NO: 8389484 - DNA, 22 bp, Homo sapiens
gatccacagcccgcttgggccc

SEQ ID NO: 8389485 - DNA, 22 bp, Homo sapiens
gatccacagctgcggtaggaga

SEQ ID NO: 8389486 - DNA, 22 bp, Homo sapiens
gatccacaggaaccaaaacgca

SEQ ID NO: 8389487 - DNA, 22 bp, Homo sapiens
gatgaaatagcaaaggcatttg

SEQ ID NO: 8389488 - DNA, 22 bp, Homo sapiens
gatgaaatagaattaatttagg

SEQ ID NO: 8389489 - DNA, 20 bp, Homo sapiens
gatgaaatcactgggcagcc

SEQ ID NO: 8389490 - DNA, 22 bp, Homo sapiens
gatgaaatccagatcacaggtg

SEQ ID NO: 8389491 - DNA, 17 bp, Homo sapiens
gatgaaatgatgcacac

SEQ ID NO: 8389492 - DNA, 22 bp, Homo sapiens
gatgaaattcagaattgagggg

SEQ ID NO: 8389493 - DNA, 22 bp, Homo sapiens
gatgaaattgttttgatacttt

SEQ ID NO: 8389494 - DNA, 22 bp, Homo sapiens
gatgaaatgtgaaagttctggg

SEQ ID NO: 8389495 - DNA, 17 bp, Homo sapiens
gatgaaatgatgcacac

SEQ ID NO: 8389496 - DNA, 22 bp, Homo sapiens
gatgaaatgctgagcctgagtt

SEQ ID NO: 8389497 - DNA, 22 bp, Homo sapiens
gatgaaaatcttgagatgtcga

SEQ ID NO: 8389498 - DNA, 22 bp, Homo sapiens
gatgaaaaattgctgtgtcata

SEQ ID NO: 8389499 - DNA, 22 bp, Homo sapiens
gaggctgggaagtccaagatca

SEQ ID NO: 8389500 - DNA, 22 bp, Homo sapiens
gaggctgggaagtccaagacca

SEQ ID NO: 8389501 - DNA, 22 bp, Homo sapiens
gaggctgggaagtccaagacca

SEQ ID NO: 8389502 - DNA, 22 bp, Homo sapiens
gaggctgggggctgccttcctc

SEQ ID NO: 8389503 - DNA, 22 bp, Homo sapiens
gaggctgggaagtccaatatca

SEQ ID NO: 8389504 - DNA, 22 bp, Homo sapiens
gagggcagagtctaatgatgca

SEQ ID NO: 8389505 - DNA, 16 bp, Homo sapiens
gagggcagaggcggaa

SEQ ID NO: 8389506 - DNA, 16 bp, Homo sapiens
gaggctggcagatgtc

SEQ ID NO: 8389507 - DNA, 22 bp, Homo sapiens
gaggctggcagaaaagcacagg

SEQ ID NO: 8389508 - DNA, 22 bp, Homo sapiens
gaggctggagatattccaatct

SEQ ID NO: 8389509 - DNA, 22 bp, Homo sapiens
gaggctggaggtcaaagatgaa

SEQ ID NO: 8389510 - DNA, 22 bp, Homo sapiens
gaggctggaatattagaaatgt

SEQ ID NO: 8389511 - DNA, 22 bp, Homo sapiens
gaggctggacgtgcatttctac

SEQ ID NO: 8389512 - DNA, 22 bp, Homo sapiens
gaggggcagaggtagagaacaa

SEQ ID NO: 8389513 - DNA, 22 bp, Homo sapiens
gaggggcagaatgtgatcaggg

SEQ ID NO: 8389514 - DNA, 22 bp, Homo sapiens
gaggggcacagtaaagggtccc

SEQ ID NO: 8389515 - DNA, 22 bp, Homo sapiens
gaggggcaagaagttggcctct

SEQ ID NO: 8389516 - DNA, 22 bp, Homo sapiens
gaggggcaatgagggaaagagt

SEQ ID NO: 8389517 - DNA, 22 bp, Homo sapiens
gaggggcaatgagggaaagagt

SEQ ID NO: 8389518 - DNA, 22 bp, Homo sapiens
gagggcagtagcctcgtaccct

SEQ ID NO: 8389519 - DNA, 22 bp, Homo sapiens
gagggcaggggtcttgcacggt

SEQ ID NO: 8389520 - DNA, 22 bp, Homo sapiens
gagggccaaagagcaagagcct

SEQ ID NO: 8389521 - DNA, 22 bp, Homo sapiens
gagggcagtgaattttgaagct

SEQ ID NO: 8389522 - DNA, 22 bp, Homo sapiens
gagggccaatggatttcaactg

SEQ ID NO: 8389523 - DNA, 22 bp, Homo sapiens
gaggggaaagtgtgaggctgcg

SEQ ID NO: 8389524 - DNA, 22 bp, Homo sapiens
gaggggaaagtgtgaggctgcg

SEQ ID NO: 8389525 - DNA, 22 bp, Homo sapiens
gaggtaacactgttcagtgggc

SEQ ID NO: 8389526 - DNA, 22 bp, Homo sapiens
gaggtaggtgtaggaggcctgc

SEQ ID NO: 8389527 - DNA, 22 bp, Homo sapiens
gaggtaggtgtaggaggcctgc

SEQ ID NO: 8389528 - DNA, 22 bp, Homo sapiens
gagggtgtgaacactggctgtg

SEQ ID NO: 8389529 - DNA, 22 bp, Homo sapiens
gaggtgggcggatcacaaggtc

SEQ ID NO: 8389530 - DNA, 22 bp, Homo sapiens
gaggtgggcggatcacaaggtc

SEQ ID NO: 8389531 - DNA, 22 bp, Homo sapiens
gaggtgggatgtgtgtgctact

SEQ ID NO: 8389532 - DNA, 22 bp, Homo sapiens
gaggtcccccatggctgtgact

SEQ ID NO: 8389533 - DNA, 22 bp, Homo sapiens
gagtcctcagatagaaagtgcg

SEQ ID NO: 8389534 - DNA, 22 bp, Homo sapiens
gagtcctcaacggggagaggcg

SEQ ID NO: 8389535 - DNA, 22 bp, Homo sapiens
gagtcccaggatatgtgctgtt

SEQ ID NO: 8389536 - DNA, 22 bp, Homo sapiens
gagtcagaagaaactatttaca

SEQ ID NO: 8389537 - DNA, 22 bp, Homo sapiens
gagtcagaattgtattttaaac

SEQ ID NO: 8389538 - DNA, 22 bp, Homo sapiens
gagtcagatgaagataaaaggg

SEQ ID NO: 8389539 - DNA, 22 bp, Homo sapiens
gagtcaggatgcaaggggatgg

SEQ ID NO: 8389540 - DNA, 22 bp, Homo sapiens
gagtcaggagtcctgtgtgaga

SEQ ID NO: 8389541 - DNA, 22 bp, Homo sapiens
gagtcaggctagaggtgagtct

SEQ ID NO: 8389542 - DNA, 22 bp, Homo sapiens
gagtcaggcatgaaggtaatta

SEQ ID NO: 8389543 - DNA, 22 bp, Homo sapiens
gagtcaggctagaggtgagtct

SEQ ID NO: 8389544 - DNA, 19 bp, Homo sapiens
gaggtgggtccccgcagcc

SEQ ID NO: 8389545 - DNA, 19 bp, Homo sapiens
gaggtgggtccccgcagcc

SEQ ID NO: 8389546 - DNA, 22 bp, Homo sapiens
gaggtgggtgtatcacaggtca

SEQ ID NO: 8389547 - DNA, 22 bp, Homo sapiens
gaggtgggtgtatcacaggtca

SEQ ID NO: 8389548 - DNA, 22 bp, Homo sapiens
gaggtgggtgtatcacaggtca

SEQ ID NO: 8389549 - DNA, 22 bp, Homo sapiens
gagtcagaaactcactctatag

SEQ ID NO: 8389550 - DNA, 22 bp, Homo sapiens
gaggcagcagaacatggaagag

SEQ ID NO: 8389551 - DNA, 22 bp, Homo sapiens
gaggcagagtgcaccccaggag

SEQ ID NO: 8389552 - DNA, 22 bp, Homo sapiens
gaggcagagtgcaccccaggag

SEQ ID NO: 8389553 - DNA, 22 bp, Homo sapiens
gaggcagagtcacaaagagtct

SEQ ID NO: 8389554 - DNA, 22 bp, Homo sapiens
gaggcagaggttgttgcagtga

SEQ ID NO: 8389555 - DNA, 22 bp, Homo sapiens
gaggcagaggttgcagtgagct

SEQ ID NO: 8389556 - DNA, 22 bp, Homo sapiens
gaggcagaggttgcagtgagct

SEQ ID NO: 8389557 - DNA, 22 bp, Homo sapiens
gaggagggttggccttaggtag

SEQ ID NO: 8389558 - DNA, 22 bp, Homo sapiens
gaggaggctgtttctctgcatt

SEQ ID NO: 8389559 - DNA, 22 bp, Homo sapiens
gaggaggcttccgggaggcacg

SEQ ID NO: 8389560 - DNA, 19 bp, Homo sapiens
gaggaggcttcagctttct

SEQ ID NO: 8389561 - DNA, 22 bp, Homo sapiens
gaggagggagctggaagctctt

SEQ ID NO: 8389562 - DNA, 22 bp, Homo sapiens
gaggagggagctggaagctctt

SEQ ID NO: 8389563 - DNA, 22 bp, Homo sapiens
gaggagggagctggaagctctt

SEQ ID NO: 8389564 - DNA, 22 bp, Homo sapiens
gaggcagctgaaggagtgacag

SEQ ID NO: 8389565 - DNA, 22 bp, Homo sapiens
gaggcagctgggctggtggttt

SEQ ID NO: 8389566 - DNA, 22 bp, Homo sapiens
gaggcagctgggatacaaggga

SEQ ID NO: 8389567 - DNA, 22 bp, Homo sapiens
gaggccctggtaggtcagagtg

SEQ ID NO: 8389568 - DNA, 22 bp, Homo sapiens
gaggccctgaagacagctgggg

SEQ ID NO: 8389569 - DNA, 20 bp, Homo sapiens
gaggcctcagcctcagctcc

SEQ ID NO: 8389570 - DNA, 20 bp, Homo sapiens
gaggcctcagcctcagctcc

SEQ ID NO: 8389571 - DNA, 19 bp, Homo sapiens
gaggcccatgagggtgctc

SEQ ID NO: 8389572 - DNA, 22 bp, Homo sapiens
gaggccctccagctgtcagctg

SEQ ID NO: 8389573 - DNA, 22 bp, Homo sapiens
gaggcctgaggctgcctggagc

SEQ ID NO: 8389574 - DNA, 22 bp, Homo sapiens
gaggcctcttctttgttaacct

SEQ ID NO: 8389575 - DNA, 22 bp, Homo sapiens
gaggcctctgtcccgccaggga

SEQ ID NO: 8389576 - DNA, 21 bp, Homo sapiens
gaggcctcagcctcagctcct

SEQ ID NO: 8389577 - DNA, 22 bp, Homo sapiens
gaggcctcaggaatgtcgtgtg

SEQ ID NO: 8389578 - DNA, 22 bp, Homo sapiens
gaggcctcaggcgtgggaaggg

SEQ ID NO: 8389579 - DNA, 22 bp, Homo sapiens
gaggcctcctctgagacatctg

SEQ ID NO: 8389580 - DNA, 22 bp, Homo sapiens
gaggcctctgtcccaccaggga

SEQ ID NO: 8389581 - DNA, 22 bp, Homo sapiens
gagatatgttggcagctggtat

SEQ ID NO: 8389582 - DNA, 22 bp, Homo sapiens
gagatatttattcatactgtca

SEQ ID NO: 8389583 - DNA, 22 bp, Homo sapiens
gagagtgtctggaggaagctaa

SEQ ID NO: 8389584 - DNA, 22 bp, Homo sapiens
gagctggccgcagagagggcag

SEQ ID NO: 8389585 - DNA, 22 bp, Homo sapiens
gaggacaaagcccaggtgctgg

SEQ ID NO: 8389586 - DNA, 23 bp, Homo sapiens
gaggacacagcccagacagccgt

SEQ ID NO: 8389587 - DNA, 22 bp, Homo sapiens
gaggaggctgaacaatgccctg

SEQ ID NO: 8389588 - DNA, 22 bp, Homo sapiens
gaggacagagccgcctggcaag

SEQ ID NO: 8389589 - DNA, 22 bp, Homo sapiens
gaggacacctcacagcctcaca

SEQ ID NO: 8389590 - DNA, 18 bp, Homo sapiens
gagctgggagaaggaagg

SEQ ID NO: 8389591 - DNA, 22 bp, Homo sapiens
gagctgggagttatagcatgtt

SEQ ID NO: 8389592 - DNA, 22 bp, Homo sapiens
gagctgggagctgggatttgga

SEQ ID NO: 8389593 - DNA, 22 bp, Homo sapiens
gaggaaggtcccatcagaattt

SEQ ID NO: 8389594 - DNA, 22 bp, Homo sapiens
cttgggccagcccagggggcat

SEQ ID NO: 8389595 - DNA, 22 bp, Homo sapiens
cttgggcccccacacgagctcg

SEQ ID NO: 8389596 - DNA, 22 bp, Homo sapiens
cttgggagtagaggcaggagca

SEQ ID NO: 8389597 - DNA, 22 bp, Homo sapiens
cttggggcagcccaggctgagc

SEQ ID NO: 8389598 - DNA, 22 bp, Homo sapiens
ctttacaaattagctctcggga

SEQ ID NO: 8389599 - DNA, 22 bp, Homo sapiens
cttggggacacagagcccaggg

SEQ ID NO: 8389600 - DNA, 22 bp, Homo sapiens
cttggggaagccactgatccct

SEQ ID NO: 8389601 - DNA, 22 bp, Homo sapiens
cttggggatgcaaagccagtgt

SEQ ID NO: 8389602 - DNA, 22 bp, Homo sapiens
cttggggaagccactgatccct

SEQ ID NO: 8389603 - DNA, 19 bp, Homo sapiens
cttggcttagcttcttagc

SEQ ID NO: 8389604 - DNA, 22 bp, Homo sapiens
cttggctttagaacatgggagc

SEQ ID NO: 8389605 - DNA, 22 bp, Homo sapiens
cttggctttctgacccttgtca

SEQ ID NO: 8389606 - DNA, 22 bp, Homo sapiens
cttggcttttgctcccagatca

SEQ ID NO: 8389607 - DNA, 22 bp, Homo sapiens
cttgggaatgctaacagatgac

SEQ ID NO: 8389608 - DNA, 22 bp, Homo sapiens
cttggctgaactccaggatgca

SEQ ID NO: 8389609 - DNA, 22 bp, Homo sapiens
cttgaagagtaaattggtacac

SEQ ID NO: 8389610 - DNA, 22 bp, Homo sapiens
cttgacaactggcagatatata

SEQ ID NO: 8389611 - DNA, 20 bp, Homo sapiens
ctttagttattaacagcact

SEQ ID NO: 8389612 - DNA, 22 bp, Homo sapiens
ctttagttgttatttcttcaca

SEQ ID NO: 8389613 - DNA, 22 bp, Homo sapiens
ctttagttgtatcagtcaagtt

SEQ ID NO: 8389614 - DNA, 22 bp, Homo sapiens
ctttagttatttagactacagt

SEQ ID NO: 8389615 - DNA, 22 bp, Homo sapiens
ctttagttctaatgcattgaaa

SEQ ID NO: 8389616 - DNA, 22 bp, Homo sapiens
ctttagtttaagaacatgatga

SEQ ID NO: 8389617 - DNA, 22 bp, Homo sapiens
ctttagtttaagaacatgatga

SEQ ID NO: 8389618 - DNA, 22 bp, Homo sapiens
ctttagaatttgatataatcaa

SEQ ID NO: 8389619 - DNA, 22 bp, Homo sapiens
ctttagatggcttaggaggccc

SEQ ID NO: 8389620 - DNA, 22 bp, Homo sapiens
ctttagatcctggtgtctctct

SEQ ID NO: 8389621 - DNA, 22 bp, Homo sapiens
ctttagaatttgatataatcaa

SEQ ID NO: 8389622 - DNA, 22 bp, Homo sapiens
ctttagaagggtaacggaatta

SEQ ID NO: 8389623 - DNA, 22 bp, Homo sapiens
ctttacaattcaagggaactct

SEQ ID NO: 8389624 - DNA, 22 bp, Homo sapiens
ctttacaacctaagttgaagct

SEQ ID NO: 8389625 - DNA, 22 bp, Homo sapiens
ctttacaacctaagttgaagct

SEQ ID NO: 8389626 - DNA, 22 bp, Homo sapiens
ctttacaacctaagttgaagct

SEQ ID NO: 8389627 - DNA, 21 bp, Homo sapiens
ctttggtttcctcctgccttc

SEQ ID NO: 8389628 - DNA, 22 bp, Homo sapiens
ctttggttctgtccttcccaga

SEQ ID NO: 8389629 - DNA, 22 bp, Homo sapiens
ctttgtatctaaatatcttgaa

SEQ ID NO: 8389630 - DNA, 19 bp, Homo sapiens
ctttgtcagaacatgcttc

SEQ ID NO: 8389631 - DNA, 22 bp, Homo sapiens
ctttatgactgagttgtcaatt

SEQ ID NO: 8389632 - DNA, 22 bp, Homo sapiens
ctttatgaaggaacaatgctcc

SEQ ID NO: 8389633 - DNA, 22 bp, Homo sapiens
ctttatatattcccaggctgcc

SEQ ID NO: 8389634 - DNA, 22 bp, Homo sapiens
cttctctgtcacagggttacgt

SEQ ID NO: 8389635 - DNA, 22 bp, Homo sapiens
cttctcttcctttgtcaactga

SEQ ID NO: 8389636 - DNA, 22 bp, Homo sapiens
cttctcttggtagttcttgttg

SEQ ID NO: 8389637 - DNA, 19 bp, Homo sapiens
cttcttgataaggttcttt

SEQ ID NO: 8389638 - DNA, 22 bp, Homo sapiens
cttctctctgcataggcatggg

SEQ ID NO: 8389639 - DNA, 22 bp, Homo sapiens
cttctctctgcataggcatggg

SEQ ID NO: 8389640 - DNA, 22 bp, Homo sapiens
cttctttgtgcctattggtgac

SEQ ID NO: 8389641 - DNA, 22 bp, Homo sapiens
cttctttgaaaaaggcagtcag

SEQ ID NO: 8389642 - DNA, 22 bp, Homo sapiens
cttctttcccaggcatgtttta

SEQ ID NO: 8389643 - DNA, 22 bp, Homo sapiens
cttgaaagcacttagtaaatta

SEQ ID NO: 8389644 - DNA, 22 bp, Homo sapiens
cttgaaatccagatttcagagg

SEQ ID NO: 8389645 - DNA, 22 bp, Homo sapiens
cttgaaatccagatttcagagg

SEQ ID NO: 8389646 - DNA, 22 bp, Homo sapiens
cttgaaatgacaggagcacatc

SEQ ID NO: 8389647 - DNA, 22 bp, Homo sapiens
cttgaaaataagaaagactttc

SEQ ID NO: 8389648 - DNA, 22 bp, Homo sapiens
ctggctgtgaaatggcagtgtc

SEQ ID NO: 8389649 - DNA, 22 bp, Homo sapiens
ctggctgtcttggaggaaggag

SEQ ID NO: 8389650 - DNA, 22 bp, Homo sapiens
ctggctgtcttctgggagctgt

SEQ ID NO: 8389651 - DNA, 22 bp, Homo sapiens
ctggctggttccctgctccagg

SEQ ID NO: 8389652 - DNA, 22 bp, Homo sapiens
ctggctgtgaaatggcagtgtc

SEQ ID NO: 8389653 - DNA, 22 bp, Homo sapiens
cttctccagccacgcccactcc

SEQ ID NO: 8389654 - DNA, 22 bp, Homo sapiens
cttctctccctggcactcagac

SEQ ID NO: 8389655 - DNA, 22 bp, Homo sapiens
cttctctcggtgcatccctcac

SEQ ID NO: 8389656 - DNA, 22 bp, Homo sapiens
cttctctcggtgcatccctcac

SEQ ID NO: 8389657 - DNA, 22 bp, Homo sapiens
ctggctggggtaccagttgaac

SEQ ID NO: 8389658 - DNA, 22 bp, Homo sapiens
ctggctgggcagacagaatgct

SEQ ID NO: 8389659 - DNA, 22 bp, Homo sapiens
gaactcaacgctttcttaggag

SEQ ID NO: 8389660 - DNA, 22 bp, Homo sapiens
gaactcaacacagtatttggta

SEQ ID NO: 8389661 - DNA, 22 bp, Homo sapiens
gaactcattagcctgctttcag

SEQ ID NO: 8389662 - DNA, 22 bp, Homo sapiens
gaactcagagcctgagctagga

SEQ ID NO: 8389663 - DNA, 22 bp, Homo sapiens
gaactccagatgactcaggaac

SEQ ID NO: 8389664 - DNA, 22 bp, Homo sapiens
gaactcattagcctgctttcag

SEQ ID NO: 8389665 - DNA, 19 bp, Homo sapiens
gaactgaggtctgaggctt

SEQ ID NO: 8389666 - DNA, 22 bp, Homo sapiens
gaactacagtgcattttcttaa

SEQ ID NO: 8389667 - DNA, 22 bp, Homo sapiens
gaacagatgggctcagatcctg

SEQ ID NO: 8389668 - DNA, 22 bp, Homo sapiens
gaacagaattaccgaagatctg

SEQ ID NO: 8389669 - DNA, 22 bp, Homo sapiens
gaaataagagtccatgccaggt

SEQ ID NO: 8389670 - DNA, 22 bp, Homo sapiens
gaaagtttgcctctctcttgag

SEQ ID NO: 8389671 - DNA, 22 bp, Homo sapiens
gaaagtttcttcattaagatgt

SEQ ID NO: 8389672 - DNA, 22 bp, Homo sapiens
gaaataatttagaaggtattcc

SEQ ID NO: 8389673 - DNA, 22 bp, Homo sapiens
gaaataatttagaaggtattcc

SEQ ID NO: 8389674 - DNA, 22 bp, Homo sapiens
gaaatacaaagccagccatttt

SEQ ID NO: 8389675 - DNA, 22 bp, Homo sapiens
gaaataattctgtgtctgaaca

SEQ ID NO: 8389676 - DNA, 22 bp, Homo sapiens
gaaataatacagtgctcttctc

SEQ ID NO: 8389677 - DNA, 22 bp, Homo sapiens
gaaataatacagtgctcttctc

SEQ ID NO: 8389678 - DNA, 22 bp, Homo sapiens
gaaatttattatctacatcatt

SEQ ID NO: 8389679 - DNA, 22 bp, Homo sapiens
gaaatttacaactttctcatgg

SEQ ID NO: 8389680 - DNA, 22 bp, Homo sapiens
gaacacagaagaatttctaaga

SEQ ID NO: 8389681 - DNA, 22 bp, Homo sapiens
gaacacagcagggataaccact

SEQ ID NO: 8389682 - DNA, 22 bp, Homo sapiens
gaacacagaagaatttctaaga

SEQ ID NO: 8389683 - DNA, 22 bp, Homo sapiens
gaacacaactcagaatgctggt

SEQ ID NO: 8389684 - DNA, 22 bp, Homo sapiens
gaaatttacaactttctcatgg

SEQ ID NO: 8389685 - DNA, 22 bp, Homo sapiens
gaacacaggtggcccggcaggg

SEQ ID NO: 8389686 - DNA, 22 bp, Homo sapiens
gaacacagcggggcttacccgg

SEQ ID NO: 8389687 - DNA, 22 bp, Homo sapiens
gaacacatcacattttacagtg

SEQ ID NO: 8389688 - DNA, 21 bp, Homo sapiens
gaaaggtcttaacttacagag

SEQ ID NO: 8389689 - DNA, 22 bp, Homo sapiens
gaaaggggcatgtagggatcac

SEQ ID NO: 8389690 - DNA, 22 bp, Homo sapiens
gaaaggggcatgtagggatcac

SEQ ID NO: 8389691 - DNA, 22 bp, Homo sapiens
gaaagtttataggttatataat

SEQ ID NO: 8389692 - DNA, 22 bp, Homo sapiens
gaaagttatatcatgattttag

SEQ ID NO: 8389693 - DNA, 22 bp, Homo sapiens
gaaaagtatgtttattttgact

SEQ ID NO: 8389694 - DNA, 21 bp, Homo sapiens
gaaaatacaatgagcttgacc

SEQ ID NO: 8389695 - DNA, 22 bp, Homo sapiens
gaaaatacaaatagccttgaaa

SEQ ID NO: 8389696 - DNA, 22 bp, Homo sapiens
gaaaggcagtacagctgagcct

SEQ ID NO: 8389697 - DNA, 22 bp, Homo sapiens
gaaagggagtgaagatggtata

SEQ ID NO: 8389698 - DNA, 22 bp, Homo sapiens
gaaaagggcaagagagagggca

SEQ ID NO: 8389699 - DNA, 22 bp, Homo sapiens
gaaaagggcaagagagagggca

SEQ ID NO: 8389700 - DNA, 21 bp, Homo sapiens
gaaaagcaagggagtagaaca

SEQ ID NO: 8389701 - DNA, 22 bp, Homo sapiens
gaaaacatccagagatagacct

SEQ ID NO: 8389702 - DNA, 22 bp, Homo sapiens
gaaaacatccagagatagacct

SEQ ID NO: 8389703 - DNA, 21 bp, Homo sapiens
gaaaagcaagggagtagaaca

SEQ ID NO: 8389704 - DNA, 22 bp, Homo sapiens
ctttgtctcctaagaactctca

SEQ ID NO: 8389705 - DNA, 22 bp, Homo sapiens
ctttgtgctttgaatgatagct

SEQ ID NO: 8389706 - DNA, 22 bp, Homo sapiens
ctttgtgcgtagtgagtggtca

SEQ ID NO: 8389707 - DNA, 22 bp, Homo sapiens
ctttgttaggggctcagggtgg

SEQ ID NO: 8389708 - DNA, 22 bp, Homo sapiens
ctttgttactgatttcagtggg

SEQ ID NO: 8389709 - DNA, 22 bp, Homo sapiens
ctttgttactgatttcagtggg

SEQ ID NO: 8389710 - DNA, 22 bp, Homo sapiens
cttttaatgggagcagtatttg

SEQ ID NO: 8389711 - DNA, 22 bp, Homo sapiens
gaactgtttttaagtcctaaga

SEQ ID NO: 8389712 - DNA, 22 bp, Homo sapiens
gaactgtttctggtgaaagagt

SEQ ID NO: 8389713 - DNA, 23 bp, Homo sapiens
gaactgttgatgaatagaatata

SEQ ID NO: 8389714 - DNA, 22 bp, Homo sapiens
gaactgttccctcacaggctgg

SEQ ID NO: 8389715 - DNA, 20 bp, Homo sapiens
gaaggaagggggcaaggtga

SEQ ID NO: 8389716 - DNA, 21 bp, Homo sapiens
gaaggagaaagcaagtgctgc

SEQ ID NO: 8389717 - DNA, 21 bp, Homo sapiens
gaaggagaaagcaagtgctgc

SEQ ID NO: 8389718 - DNA, 22 bp, Homo sapiens
gaaggcctcactctgcagcata

SEQ ID NO: 8389719 - DNA, 22 bp, Homo sapiens
gaaggccctgttttccctattt

SEQ ID NO: 8389720 - DNA, 22 bp, Homo sapiens
gaaggagagggtcaaggataat

SEQ ID NO: 8389721 - DNA, 22 bp, Homo sapiens
gaaggagagggtcaaggataat

SEQ ID NO: 8389722 - DNA, 22 bp, Homo sapiens
gaaggagaggattgtgaggctg

SEQ ID NO: 8389723 - DNA, 22 bp, Homo sapiens
gaaggctgcgaggggagtgccg

SEQ ID NO: 8389724 - DNA, 22 bp, Homo sapiens
gaaggcttattttctttgtaaa

SEQ ID NO: 8389725 - DNA, 22 bp, Homo sapiens
gaaggcttcaaaaggtgtaatt

SEQ ID NO: 8389726 - DNA, 22 bp, Homo sapiens
gaaggcttcccacctgatattt

SEQ ID NO: 8389727 - DNA, 22 bp, Homo sapiens
gaaggcttcctggaggaggtgg

SEQ ID NO: 8389728 - DNA, 22 bp, Homo sapiens
gaaggcttctccagggcttact

SEQ ID NO: 8389729 - DNA, 22 bp, Homo sapiens
gaaggcttcctgatgccaacca

SEQ ID NO: 8389730 - DNA, 21 bp, Homo sapiens
gaaggcttctgcctggaggag

SEQ ID NO: 8389731 - DNA, 22 bp, Homo sapiens
gaaggcttgattgaggaatgcc

SEQ ID NO: 8389732 - DNA, 22 bp, Homo sapiens
gaaggcttgccgggaagcggca

SEQ ID NO: 8389733 - DNA, 20 bp, Homo sapiens
gaaggcttggacagtgacag

SEQ ID NO: 8389734 - DNA, 22 bp, Homo sapiens
gaaggcttgcaagtggttcata

SEQ ID NO: 8389735 - DNA, 22 bp, Homo sapiens
gaaggcttgcagctctgtggca

SEQ ID NO: 8389736 - DNA, 22 bp, Homo sapiens
gaagggaaagtgacttacccga

SEQ ID NO: 8389737 - DNA, 22 bp, Homo sapiens
gaaggctttttgggtaattgta

SEQ ID NO: 8389738 - DNA, 19 bp, Homo sapiens
gaaggcttttggtatgttt

SEQ ID NO: 8389739 - DNA, 22 bp, Homo sapiens
gaaggcttggttttttcaacac

SEQ ID NO: 8389740 - DNA, 22 bp, Homo sapiens
gaaggctttagagagatataaa

SEQ ID NO: 8389741 - DNA, 22 bp, Homo sapiens
gaaggcttttctaccagatctt

SEQ ID NO: 8389742 - DNA, 22 bp, Homo sapiens
gaaggctgagtgggtacggagg

SEQ ID NO: 8389743 - DNA, 22 bp, Homo sapiens
gaaggctgcatggaggctgtgg

SEQ ID NO: 8389744 - DNA, 19 bp, Homo sapiens
gaaggctgaaatgaagcac

SEQ ID NO: 8389745 - DNA, 22 bp, Homo sapiens
gaagggaaggaaagaaccagca

SEQ ID NO: 8389746 - DNA, 22 bp, Homo sapiens
gaagggaactgggtctccttgt

SEQ ID NO: 8389747 - DNA, 22 bp, Homo sapiens
gaagggaaattcagatcttcag

SEQ ID NO: 8389748 - DNA, 18 bp, Homo sapiens
gaagtgaagtgactcaat

SEQ ID NO: 8389749 - DNA, 22 bp, Homo sapiens
gaagtgaaggttactctagatt

SEQ ID NO: 8389750 - DNA, 20 bp, Homo sapiens
gaagtgtggagttgggaagc

SEQ ID NO: 8389751 - DNA, 22 bp, Homo sapiens
gaagtgtgaaggtgatgtggag

SEQ ID NO: 8389752 - DNA, 22 bp, Homo sapiens
gaagtgtagtcttgagccccca

SEQ ID NO: 8389753 - DNA, 22 bp, Homo sapiens
gaattcttttctttctgaaagt

SEQ ID NO: 8389754 - DNA, 23 bp, Homo sapiens
gaattcttaaggtcactaaagtc

SEQ ID NO: 8389755 - DNA, 22 bp, Homo sapiens
gaattgggggttttgcaaggca

SEQ ID NO: 8389756 - DNA, 22 bp, Homo sapiens
gaatttaaaggccagacctgag

SEQ ID NO: 8389757 - DNA, 22 bp, Homo sapiens
gaatttaaatttaaatctacca

SEQ ID NO: 8389758 - DNA, 22 bp, Homo sapiens
gaatttaaggaccaagcatttt

SEQ ID NO: 8389759 - DNA, 22 bp, Homo sapiens
gaatttaagaggatgaatctgt

SEQ ID NO: 8389760 - DNA, 22 bp, Homo sapiens
gaatttaagaggatgaatctgt

SEQ ID NO: 8389761 - DNA, 22 bp, Homo sapiens
gaattcacttgtcttccatttt

SEQ ID NO: 8389762 - DNA, 19 bp, Homo sapiens
gaattatttttatgggatg

SEQ ID NO: 8389763 - DNA, 19 bp, Homo sapiens
gaattatttttatgggatg

SEQ ID NO: 8389764 - DNA, 22 bp, Homo sapiens
gacacagcttgatgagggcttt

SEQ ID NO: 8389765 - DNA, 22 bp, Homo sapiens
gacacagctttctgaagagcat

SEQ ID NO: 8389766 - DNA, 22 bp, Homo sapiens
gacacagatgatcaggtgtgga

SEQ ID NO: 8389767 - DNA, 22 bp, Homo sapiens
gacacagatgatcaggtgtgga

SEQ ID NO: 8389768 - DNA, 22 bp, Homo sapiens
gacacagagataggcctgtgtt

SEQ ID NO: 8389769 - DNA, 22 bp, Homo sapiens
gacacaggaatcaccttggatg

SEQ ID NO: 8389770 - DNA, 23 bp, Homo sapiens
gacacaggagcacccagctgagc

SEQ ID NO: 8389771 - DNA, 20 bp, Homo sapiens
gacacaggcagtcctcagag

SEQ ID NO: 8389772 - DNA, 22 bp, Homo sapiens
gacacagggggatgtgtggacg

SEQ ID NO: 8389773 - DNA, 19 bp, Homo sapiens
gacaggaaggctaccagta

SEQ ID NO: 8389774 - DNA, 22 bp, Homo sapiens
gacaggaacataaatgtaggag

SEQ ID NO: 8389775 - DNA, 22 bp, Homo sapiens
gacaggaacataaatgtaggag

SEQ ID NO: 8389776 - DNA, 22 bp, Homo sapiens
gacaggaagtctgaaggaggga

SEQ ID NO: 8389777 - DNA, 19 bp, Homo sapiens
gacaggaaggctaccagta

SEQ ID NO: 8389778 - DNA, 20 bp, Homo sapiens
gacaggagagttaggtaggt

SEQ ID NO: 8389779 - DNA, 20 bp, Homo sapiens
gacaggagagttaggtaggt

SEQ ID NO: 8389780 - DNA, 22 bp, Homo sapiens
gacaggaatgtgtggatgcgga

SEQ ID NO: 8389781 - DNA, 22 bp, Homo sapiens
gacaggaagtctgaaggaggga

SEQ ID NO: 8389782 - DNA, 22 bp, Homo sapiens
gacaggcaattaccagcgccca

SEQ ID NO: 8389783 - DNA, 21 bp, Homo sapiens
gacaggcaaggagtcacttag

SEQ ID NO: 8389784 - DNA, 22 bp, Homo sapiens
gacaggcagacctgtgccctgg

SEQ ID NO: 8389785 - DNA, 22 bp, Homo sapiens
gacaggcatgctttcaggacta

SEQ ID NO: 8389786 - DNA, 22 bp, Homo sapiens
gacaggcatgctttcaggacta

SEQ ID NO: 8389787 - DNA, 22 bp, Homo sapiens
gaccatcctggccaacgtggta

SEQ ID NO: 8389788 - DNA, 22 bp, Homo sapiens
gaccatcctggccaacgtggta

SEQ ID NO: 8389789 - DNA, 22 bp, Homo sapiens
gaccagtcattactcatgccct

SEQ ID NO: 8389790 - DNA, 18 bp, Homo sapiens
gacccaggaaagagtcct

SEQ ID NO: 8389791 - DNA, 22 bp, Homo sapiens
gacccaggctcgtgggacggct

SEQ ID NO: 8389792 - DNA, 22 bp, Homo sapiens
gactgtattacaattggcagca

SEQ ID NO: 8389793 - DNA, 22 bp, Homo sapiens
gacttcatgacattcaggtcag

SEQ ID NO: 8389794 - DNA, 21 bp, Homo sapiens
gacttcatgggtcaaccaatt

SEQ ID NO: 8389795 - DNA, 20 bp, Homo sapiens
gacttcccatatcttcttca

SEQ ID NO: 8389796 - DNA, 22 bp, Homo sapiens
gacttcatgtgcaagcgctttg

SEQ ID NO: 8389797 - DNA, 22 bp, Homo sapiens
gacttaaaggctgaatgtagga

SEQ ID NO: 8389798 - DNA, 21 bp, Homo sapiens
gacttatctatattctattta

SEQ ID NO: 8389799 - DNA, 22 bp, Homo sapiens
gacttgggtgtcggggcagtct

SEQ ID NO: 8389800 - DNA, 22 bp, Homo sapiens
gactttaaaagtttgtgcttgg

SEQ ID NO: 8389801 - DNA, 18 bp, Homo sapiens
gactttaaaacactgctc

SEQ ID NO: 8389802 - DNA, 18 bp, Homo sapiens
gactttaaaacactgctc

SEQ ID NO: 8389803 - DNA, 22 bp, Homo sapiens
gactttaaaatgctagaacagg

SEQ ID NO: 8389804 - DNA, 22 bp, Homo sapiens
gactttaaagcctgacatttta

SEQ ID NO: 8389805 - DNA, 22 bp, Homo sapiens
gactttaaaggttctgctgctt

SEQ ID NO: 8389806 - DNA, 19 bp, Homo sapiens
gacttctgatgtccagatg

SEQ ID NO: 8389807 - DNA, 22 bp, Homo sapiens
gacttcttcatgtcttttccac

SEQ ID NO: 8389808 - DNA, 22 bp, Homo sapiens
gagacacacattctggagagaa

SEQ ID NO: 8389809 - DNA, 22 bp, Homo sapiens
gagacacacccaaggttatgag

SEQ ID NO: 8389810 - DNA, 22 bp, Homo sapiens
gagacacacccaaggttatgag

SEQ ID NO: 8389811 - DNA, 22 bp, Homo sapiens
gagacacacccaaggttatgag

SEQ ID NO: 8389812 - DNA, 18 bp, Homo sapiens
gagacacaagggcctgga

SEQ ID NO: 8389813 - DNA, 22 bp, Homo sapiens
gagacacaatctcatttacatt

SEQ ID NO: 8389814 - DNA, 22 bp, Homo sapiens
gagacacaatttccccatccta

SEQ ID NO: 8389815 - DNA, 22 bp, Homo sapiens
gagacacaagacgcaactctgt

SEQ ID NO: 8389816 - DNA, 22 bp, Homo sapiens
gagacacaagaagacatgcaca

SEQ ID NO: 8389817 - DNA, 22 bp, Homo sapiens
gagacacagttatcaggcatac

SEQ ID NO: 8389818 - DNA, 22 bp, Homo sapiens
gagacacagttatcaggcatac

SEQ ID NO: 8389819 - DNA, 22 bp, Homo sapiens
gagacacaggtggttcctgtca

SEQ ID NO: 8389820 - DNA, 22 bp, Homo sapiens
gagacacaggcacagaagaggc

SEQ ID NO: 8389821 - DNA, 22 bp, Homo sapiens
gagacacaggcacagaagaggc

SEQ ID NO: 8389822 - DNA, 22 bp, Homo sapiens
gagacacagcagatattcaatc

SEQ ID NO: 8389823 - DNA, 22 bp, Homo sapiens
gagacacagagaggctgtgtga

SEQ ID NO: 8389824 - DNA, 22 bp, Homo sapiens
gagaaacaacacttgatgcctt

SEQ ID NO: 8389825 - DNA, 22 bp, Homo sapiens
gagacacaagaagacatgcaca

SEQ ID NO: 8389826 - DNA, 22 bp, Homo sapiens
gagaaaatgtcagacttggtcg

SEQ ID NO: 8389827 - DNA, 20 bp, Homo sapiens
gagagctggggatgaggctg

SEQ ID NO: 8389828 - DNA, 20 bp, Homo sapiens
gagagctggggatgaggctg

SEQ ID NO: 8389829 - DNA, 22 bp, Homo sapiens
gagagctgggttcaagtagctg

SEQ ID NO: 8389830 - DNA, 22 bp, Homo sapiens
gagagtctaggaacctcatata

SEQ ID NO: 8389831 - DNA, 22 bp, Homo sapiens
gagagctgaggggcctggcact

SEQ ID NO: 8389832 - DNA, 22 bp, Homo sapiens
gagagctgcagccgagaggggg

SEQ ID NO: 8389833 - DNA, 22 bp, Homo sapiens
gagagctgcaaggtagggcggg

SEQ ID NO: 8389834 - DNA, 22 bp, Homo sapiens
gagacagatctcggctccatgc

SEQ ID NO: 8389835 - DNA, 22 bp, Homo sapiens
gagagcccttaggtttagagtt

SEQ ID NO: 8389836 - DNA, 22 bp, Homo sapiens
gagagcctttgaagggaagtga

SEQ ID NO: 8389837 - DNA, 22 bp, Homo sapiens
gattagttgattaagagtcaga

SEQ ID NO: 8389838 - DNA, 22 bp, Homo sapiens
gattaggacatggatgtatgtt

SEQ ID NO: 8389839 - DNA, 22 bp, Homo sapiens
gattattttgtgcaataatcgg

SEQ ID NO: 8389840 - DNA, 23 bp, Homo sapiens
gattcacagggtggtttatgggg

SEQ ID NO: 8389841 - DNA, 22 bp, Homo sapiens
gattcacagaacttagtcaagc

SEQ ID NO: 8389842 - DNA, 22 bp, Homo sapiens
gattcacagaacttagtcaagc

SEQ ID NO: 8389843 - DNA, 22 bp, Homo sapiens
gattcacaactgccctgaaggg

SEQ ID NO: 8389844 - DNA, 22 bp, Homo sapiens
gattcacaactgccctgaaggg

SEQ ID NO: 8389845 - DNA, 22 bp, Homo sapiens
gattcacagtttaggctgggct

SEQ ID NO: 8389846 - DNA, 22 bp, Homo sapiens
gatgttttctggaaaatgaatg

SEQ ID NO: 8389847 - DNA, 22 bp, Homo sapiens
gatgttttaggtccctgtagct

SEQ ID NO: 8389848 - DNA, 22 bp, Homo sapiens
gatgtgtttccaggatttgttt

SEQ ID NO: 8389849 - DNA, 22 bp, Homo sapiens
gattacattctccttgtattag

SEQ ID NO: 8389850 - DNA, 22 bp, Homo sapiens
gattacattctccttgtattag

SEQ ID NO: 8389851 - DNA, 21 bp, Homo sapiens
gattaaatttaagctacatgc

SEQ ID NO: 8389852 - DNA, 21 bp, Homo sapiens
gattaaatttaagctacatgc

SEQ ID NO: 8389853 - DNA, 22 bp, Homo sapiens
gattgtaaaacagatcattatc

SEQ ID NO: 8389854 - DNA, 22 bp, Homo sapiens
gattgtaattctactttccgct

SEQ ID NO: 8389855 - DNA, 22 bp, Homo sapiens
gattgtaattttcaagaggtaa

SEQ ID NO: 8389856 - DNA, 22 bp, Homo sapiens
gattgtggaagtcagtggttct

SEQ ID NO: 8389857 - DNA, 22 bp, Homo sapiens
gattgtctttattttatggcta

SEQ ID NO: 8389858 - DNA, 22 bp, Homo sapiens
gattgtctgtgatcatgagcaa

SEQ ID NO: 8389859 - DNA, 22 bp, Homo sapiens
gatttagtggcccttggtacac

SEQ ID NO: 8389860 - DNA, 22 bp, Homo sapiens
gatttatttttaatcagcaggg

SEQ ID NO: 8389861 - DNA, 22 bp, Homo sapiens
gatttattgtccctgtcctgct

SEQ ID NO: 8389862 - DNA, 22 bp, Homo sapiens
gatgtacaatgtcactatgacc

SEQ ID NO: 8389863 - DNA, 22 bp, Homo sapiens
gatgtaatagatatagattgct

SEQ ID NO: 8389864 - DNA, 17 bp, Homo sapiens
gatggggctgacatcag

SEQ ID NO: 8389865 - DNA, 22 bp, Homo sapiens
gatgtcttactaactagccttt

SEQ ID NO: 8389866 - DNA, 22 bp, Homo sapiens
gatgtctgtctgagccgctgga

SEQ ID NO: 8389867 - DNA, 22 bp, Homo sapiens
gatgtctgtctgagccgctgga

SEQ ID NO: 8389868 - DNA, 22 bp, Homo sapiens
gatgtctggctaccactcgcac

SEQ ID NO: 8389869 - DNA, 22 bp, Homo sapiens
gatgtctgggtcttcctggctt

SEQ ID NO: 8389870 - DNA, 22 bp, Homo sapiens
gatgtagacacttggaggctta

SEQ ID NO: 8389871 - DNA, 22 bp, Homo sapiens
gatggaagaaaaatgcatgtct

SEQ ID NO: 8389872 - DNA, 22 bp, Homo sapiens
gatgcctccaaatgagggcaga

SEQ ID NO: 8389873 - DNA, 22 bp, Homo sapiens
gatgcctgcatttcaggagagt

SEQ ID NO: 8389874 - DNA, 22 bp, Homo sapiens
gatgccgtcttctatctgcctt

SEQ ID NO: 8389875 - DNA, 22 bp, Homo sapiens
gatgctccttggtgatagaata

SEQ ID NO: 8389876 - DNA, 22 bp, Homo sapiens
gatggcggtcgtcgacggtcct

SEQ ID NO: 8389877 - DNA, 22 bp, Homo sapiens
gatggcggtggccacctccttg

SEQ ID NO: 8389878 - DNA, 22 bp, Homo sapiens
gatggacagcctggaaggaaag

SEQ ID NO: 8389879 - DNA, 22 bp, Homo sapiens
gatggacagcctggaaggaaag

SEQ ID NO: 8389880 - DNA, 22 bp, Homo sapiens
gatggaggagatggcagggtgc

SEQ ID NO: 8389881 - DNA, 22 bp, Homo sapiens
gatgggcacggcagtctgagag

SEQ ID NO: 8389882 - DNA, 22 bp, Homo sapiens
gatggcttacagacagttagga

SEQ ID NO: 8389883 - DNA, 22 bp, Homo sapiens
gatggcttctgaatcagggcct

SEQ ID NO: 8389884 - DNA, 22 bp, Homo sapiens
gatggcttgcttagtgacagca

SEQ ID NO: 8389885 - DNA, 22 bp, Homo sapiens
gcacttttcaaagcttcctgtg

SEQ ID NO: 8389886 - DNA, 17 bp, Homo sapiens
gcagaaaagtcaaggga

SEQ ID NO: 8389887 - DNA, 22 bp, Homo sapiens
gcagaaaccacagtgtctttta

SEQ ID NO: 8389888 - DNA, 22 bp, Homo sapiens
gcagaaagctccttgcgatctg

SEQ ID NO: 8389889 - DNA, 21 bp, Homo sapiens
gcagaaaggaatcttaggtcc

SEQ ID NO: 8389890 - DNA, 22 bp, Homo sapiens
gcagaaagcttagagggtttgc

SEQ ID NO: 8389891 - DNA, 22 bp, Homo sapiens
gcagaagaccatggtggaaaga

SEQ ID NO: 8389892 - DNA, 22 bp, Homo sapiens
gcagaacatttcacagtatctt

SEQ ID NO: 8389893 - DNA, 22 bp, Homo sapiens
gcagaacagtctgtcggttcta

SEQ ID NO: 8389894 - DNA, 22 bp, Homo sapiens
gcagagccagaatggccaggac

SEQ ID NO: 8389895 - DNA, 22 bp, Homo sapiens
gcagagccagaatggccaggac

SEQ ID NO: 8389896 - DNA, 22 bp, Homo sapiens
gcagagccagaatggccaggac

SEQ ID NO: 8389897 - DNA, 22 bp, Homo sapiens
gcagagccaggagcccaggatc

SEQ ID NO: 8389898 - DNA, 22 bp, Homo sapiens
gcagagccaggagcccaggatc

SEQ ID NO: 8389899 - DNA, 22 bp, Homo sapiens
gcagagccaggctggggcaggt

SEQ ID NO: 8389900 - DNA, 22 bp, Homo sapiens
gcagagcccctcaagccagcct

SEQ ID NO: 8389901 - DNA, 22 bp, Homo sapiens
gcagagcccctcaagccagcct

SEQ ID NO: 8389902 - DNA, 22 bp, Homo sapiens
gcagagccaggctggggcaggt

SEQ ID NO: 8389903 - DNA, 22 bp, Homo sapiens
gcagagcagtgcttgcccagcg

SEQ ID NO: 8389904 - DNA, 22 bp, Homo sapiens
gcagagcagtgcttgcccagcg

SEQ ID NO: 8389905 - DNA, 22 bp, Homo sapiens
gcagagcagtactctcttgact

SEQ ID NO: 8389906 - DNA, 22 bp, Homo sapiens
gcagaaggatccgcaggtgcaa

SEQ ID NO: 8389907 - DNA, 22 bp, Homo sapiens
gcagaaggatccgcaggtgcaa

SEQ ID NO: 8389908 - DNA, 22 bp, Homo sapiens
gcagagcatgtcctcaggacag

SEQ ID NO: 8389909 - DNA, 22 bp, Homo sapiens
gcagagcatgtcctcaggacag

SEQ ID NO: 8389910 - DNA, 22 bp, Homo sapiens
gcaccctgtttatcctgagttc

SEQ ID NO: 8389911 - DNA, 19 bp, Homo sapiens
gcaccctgaggtcatggcc

SEQ ID NO: 8389912 - DNA, 19 bp, Homo sapiens
gcaccctgaggtcatggcc

SEQ ID NO: 8389913 - DNA, 22 bp, Homo sapiens
gcaccctctgagctccgctccg

SEQ ID NO: 8389914 - DNA, 22 bp, Homo sapiens
gcacccctcagcttgtttacta

SEQ ID NO: 8389915 - DNA, 22 bp, Homo sapiens
gcacccctgcgtgccttccctt

SEQ ID NO: 8389916 - DNA, 22 bp, Homo sapiens
gcacccctggacggtagggcca

SEQ ID NO: 8389917 - DNA, 22 bp, Homo sapiens
gcacctgctcacacatgtgact

SEQ ID NO: 8389918 - DNA, 22 bp, Homo sapiens
gcacctgctggaatcagtctgt

SEQ ID NO: 8389919 - DNA, 22 bp, Homo sapiens
gcaccgttcactctccgccaga

SEQ ID NO: 8389920 - DNA, 22 bp, Homo sapiens
gcacctgctgggtgtagaggct

SEQ ID NO: 8389921 - DNA, 22 bp, Homo sapiens
gcacctgctggggctgatgaga

SEQ ID NO: 8389922 - DNA, 22 bp, Homo sapiens
gcacccagggcaggaagtgagg

SEQ ID NO: 8389923 - DNA, 22 bp, Homo sapiens
gcacccagggcaggaagtgagg

SEQ ID NO: 8389924 - DNA, 22 bp, Homo sapiens
gcacccagggacttggctggcc

SEQ ID NO: 8389925 - DNA, 22 bp, Homo sapiens
gcacccaggcttgggcagcaac

SEQ ID NO: 8389926 - DNA, 22 bp, Homo sapiens
gcacccaggcttgggcagcaac

SEQ ID NO: 8389927 - DNA, 22 bp, Homo sapiens
gcacccaggccggcgactgcag

SEQ ID NO: 8389928 - DNA, 22 bp, Homo sapiens
gcaatgcaatcagatgattatt

SEQ ID NO: 8389929 - DNA, 22 bp, Homo sapiens
gcaatcaatttaaaatgaggtc

SEQ ID NO: 8389930 - DNA, 20 bp, Homo sapiens
gcaattaatttttggttaca

SEQ ID NO: 8389931 - DNA, 22 bp, Homo sapiens
gcacaaggagcagtgtatgaaa

SEQ ID NO: 8389932 - DNA, 22 bp, Homo sapiens
gcacaaggagaattcattagtg

SEQ ID NO: 8389933 - DNA, 22 bp, Homo sapiens
gcacaaggagcagtgtatgaaa

SEQ ID NO: 8389934 - DNA, 22 bp, Homo sapiens
gatttttatataaagtgagaaa

SEQ ID NO: 8389935 - DNA, 22 bp, Homo sapiens
gcaaaaaatgcttgttgcttag

SEQ ID NO: 8389936 - DNA, 22 bp, Homo sapiens
gcaaacaaggacatacatcctg

SEQ ID NO: 8389937 - DNA, 22 bp, Homo sapiens
gcaaacataatatgaagacact

SEQ ID NO: 8389938 - DNA, 22 bp, Homo sapiens
gcaaacattcaggagtacagga

SEQ ID NO: 8389939 - DNA, 22 bp, Homo sapiens
gcaaacatgctgagaaataaga

SEQ ID NO: 8389940 - DNA, 22 bp, Homo sapiens
gattttatatggcatactgtgg

SEQ ID NO: 8389941 - DNA, 22 bp, Homo sapiens
gattttatatggcatactgtgg

SEQ ID NO: 8389942 - DNA, 22 bp, Homo sapiens
gattttatagtcaggaaaaaga

SEQ ID NO: 8389943 - DNA, 22 bp, Homo sapiens
gatttgtttcaagttagcatct

SEQ ID NO: 8389944 - DNA, 22 bp, Homo sapiens
gatttgtctatattcaaatatg

SEQ ID NO: 8389945 - DNA, 21 bp, Homo sapiens
gattttaaagagactgccaca

SEQ ID NO: 8389946 - DNA, 22 bp, Homo sapiens
gattttatatggcatactgtgg

SEQ ID NO: 8389947 - DNA, 22 bp, Homo sapiens
gatttctgtggcttgtacatat

SEQ ID NO: 8389948 - DNA, 22 bp, Homo sapiens
gatttctgtggcttgtacatat

SEQ ID NO: 8389949 - DNA, 22 bp, Homo sapiens
gatttctgttgagaaacatggg

SEQ ID NO: 8389950 - DNA, 20 bp, Homo sapiens
gatttgctgaacttttatga

SEQ ID NO: 8389951 - DNA, 22 bp, Homo sapiens
gatttcttggcccactctcaga

SEQ ID NO: 8389952 - DNA, 22 bp, Homo sapiens
gcagggcagccacaggccccct

SEQ ID NO: 8389953 - DNA, 22 bp, Homo sapiens
gcaggggctactctgagcttcc

SEQ ID NO: 8389954 - DNA, 22 bp, Homo sapiens
gcagggcacaaggacgcacagg

SEQ ID NO: 8389955 - DNA, 22 bp, Homo sapiens
gcagggcaaatgtggaaaggag

SEQ ID NO: 8389956 - DNA, 20 bp, Homo sapiens
gcagggcaagggatatgaaa

SEQ ID NO: 8389957 - DNA, 22 bp, Homo sapiens
gcagggcacagacagtgccaag

SEQ ID NO: 8389958 - DNA, 22 bp, Homo sapiens
gcagggcagaaggtgctgagga

SEQ ID NO: 8389959 - DNA, 22 bp, Homo sapiens
gcagggcagagggagaatctct

SEQ ID NO: 8389960 - DNA, 22 bp, Homo sapiens
gcagggcagacctccagcctat

SEQ ID NO: 8389961 - DNA, 17 bp, Homo sapiens
gcaggcactgctgcctg

SEQ ID NO: 8389962 - DNA, 17 bp, Homo sapiens
gcaggcactgctgcctg

SEQ ID NO: 8389963 - DNA, 22 bp, Homo sapiens
gcaggcactcctaggaccatca

SEQ ID NO: 8389964 - DNA, 21 bp, Homo sapiens
gcaggcactctagaggagctg

SEQ ID NO: 8389965 - DNA, 17 bp, Homo sapiens
gcaggcactgctgcctg

SEQ ID NO: 8389966 - DNA, 22 bp, Homo sapiens
gcaggcagagaaggaacattta

SEQ ID NO: 8389967 - DNA, 22 bp, Homo sapiens
gcaggcagaggtggaggagaca

SEQ ID NO: 8389968 - DNA, 22 bp, Homo sapiens
gcaggcagaggtggaggagaca

SEQ ID NO: 8389969 - DNA, 22 bp, Homo sapiens
gcaggctgccaccttctgagtt

SEQ ID NO: 8389970 - DNA, 22 bp, Homo sapiens
gcaggctggaggctgttctggg

SEQ ID NO: 8389971 - DNA, 22 bp, Homo sapiens
gcaggctgctgagatccttagg

SEQ ID NO: 8389972 - DNA, 22 bp, Homo sapiens
gcaggcttcaagcacagctttt

SEQ ID NO: 8389973 - DNA, 21 bp, Homo sapiens
gcaggctggtcaaacctcagt

SEQ ID NO: 8389974 - DNA, 22 bp, Homo sapiens
gcaggctggtctgaccatccct

SEQ ID NO: 8389975 - DNA, 22 bp, Homo sapiens
gcagggaaacaggtgctaagga

SEQ ID NO: 8389976 - DNA, 22 bp, Homo sapiens
gcaggctttgacttggggcagc

SEQ ID NO: 8389977 - DNA, 22 bp, Homo sapiens
gcaggctttgacttggggcaac

SEQ ID NO: 8389978 - DNA, 22 bp, Homo sapiens
gcaggcttgggacgagctggag

SEQ ID NO: 8389979 - DNA, 19 bp, Homo sapiens
gcaggcttgggtctcccca

SEQ ID NO: 8389980 - DNA, 22 bp, Homo sapiens
gcagggacgccagggacagcaa

SEQ ID NO: 8389981 - DNA, 22 bp, Homo sapiens
gcagggacgccagggacagcaa

SEQ ID NO: 8389982 - DNA, 22 bp, Homo sapiens
gcagctcctggcacagtttttt

SEQ ID NO: 8389983 - DNA, 22 bp, Homo sapiens
gcagagcctgtgtctgagcaaa

SEQ ID NO: 8389984 - DNA, 21 bp, Homo sapiens
gcagagccggggcgagaaggc

SEQ ID NO: 8389985 - DNA, 16 bp, Homo sapiens
gcagagctcagggact

SEQ ID NO: 8389986 - DNA, 22 bp, Homo sapiens
gcagcctctgcagttcaggagg

SEQ ID NO: 8389987 - DNA, 22 bp, Homo sapiens
gcagcgtggggctgagtcagct

SEQ ID NO: 8389988 - DNA, 18 bp, Homo sapiens
gcagctagccaggggggc

SEQ ID NO: 8389989 - DNA, 22 bp, Homo sapiens
gcagcctctgcagttcaggagg

SEQ ID NO: 8389990 - DNA, 22 bp, Homo sapiens
gcaggcaattttggaaggtcag

SEQ ID NO: 8389991 - DNA, 22 bp, Homo sapiens
gcaggcaccgggttgctcccct

SEQ ID NO: 8389992 - DNA, 22 bp, Homo sapiens
gcaggcaccgggttgctcccct

SEQ ID NO: 8389993 - DNA, 22 bp, Homo sapiens
gcaggcaccgcggcggcaggtt

SEQ ID NO: 8389994 - DNA, 22 bp, Homo sapiens
gcaggcaccacggctcaggtct

SEQ ID NO: 8389995 - DNA, 22 bp, Homo sapiens
gcaggagctcgtttccaggctg

SEQ ID NO: 8389996 - DNA, 22 bp, Homo sapiens
gcaggagctcgtttccaggctg

SEQ ID NO: 8389997 - DNA, 22 bp, Homo sapiens
gcaggagctgctctcctgacga

SEQ ID NO: 8389998 - DNA, 22 bp, Homo sapiens
gcaggacaggcgttggtccagt

SEQ ID NO: 8389999 - DNA, 22 bp, Homo sapiens
gcaggacaggcgttggtccagt

SEQ ID NO: 8390000 - DNA, 22 bp, Homo sapiens
gcaggacattcagtgaatgggc

SEQ ID NO: 8390001 - DNA, 22 bp, Homo sapiens
gcaggactcaaatctgaaggca

SEQ ID NO: 8390002 - DNA, 22 bp, Homo sapiens
gcaggacagacccaagcagtct

SEQ ID NO: 8390003 - DNA, 22 bp, Homo sapiens
gcaggagaacaaagcaagctgc

SEQ ID NO: 8390004 - DNA, 22 bp, Homo sapiens
gcaggagagccagcaggcttcc

SEQ ID NO: 8390005 - DNA, 22 bp, Homo sapiens
gcaggtggtgggggagccgttc

SEQ ID NO: 8390006 - DNA, 22 bp, Homo sapiens
gcaggtggttaaggtcccatgt

SEQ ID NO: 8390007 - DNA, 22 bp, Homo sapiens
gcaggtggttaaggtcccatgt

SEQ ID NO: 8390008 - DNA, 23 bp, Homo sapiens
gcaggtggttcgaacagaagttt

SEQ ID NO: 8390009 - DNA, 22 bp, Homo sapiens
gcaggtggtggcgcgcgccctg

SEQ ID NO: 8390010 - DNA, 22 bp, Homo sapiens
gcaggtggtggggctatgatct

SEQ ID NO: 8390011 - DNA, 22 bp, Homo sapiens
gcaggtggtggggctatgatct

SEQ ID NO: 8390012 - DNA, 22 bp, Homo sapiens
gcaggtggtccccgtggagtgg

SEQ ID NO: 8390013 - DNA, 22 bp, Homo sapiens
gcaggtggtccccgtggagtgg

SEQ ID NO: 8390014 - DNA, 22 bp, Homo sapiens
gcaggtgggagccgctgcctga

SEQ ID NO: 8390015 - DNA, 16 bp, Homo sapiens
gcaggtggggcgcgca

SEQ ID NO: 8390016 - DNA, 22 bp, Homo sapiens
gcaggtggggctgctaccagaa

SEQ ID NO: 8390017 - DNA, 22 bp, Homo sapiens
gcaggtggggctgctaccagaa

SEQ ID NO: 8390018 - DNA, 22 bp, Homo sapiens
gcaggtgggggtcggtgcatct

SEQ ID NO: 8390019 - DNA, 22 bp, Homo sapiens
gcaggtgggggagaagttgtga

SEQ ID NO: 8390020 - DNA, 22 bp, Homo sapiens
gcaggtgggggtcggtgcatct

SEQ ID NO: 8390021 - DNA, 22 bp, Homo sapiens
gcaggtggtcactcatccccag

SEQ ID NO: 8390022 - DNA, 22 bp, Homo sapiens
gcaggtgggggtcggtgcatct

SEQ ID NO: 8390023 - DNA, 19 bp, Homo sapiens
gcagggtggcagagctctt

SEQ ID NO: 8390024 - DNA, 22 bp, Homo sapiens
gcaggtggaagcagcagactca

SEQ ID NO: 8390025 - DNA, 22 bp, Homo sapiens
gcagggtggatggcagggccag

SEQ ID NO: 8390026 - DNA, 22 bp, Homo sapiens
gcagggtgatagtgaggctcag

SEQ ID NO: 8390027 - DNA, 22 bp, Homo sapiens
gcaggtggcagaggtgggatct

SEQ ID NO: 8390028 - DNA, 22 bp, Homo sapiens
gcaggtggattatcagaagtgc

SEQ ID NO: 8390029 - DNA, 22 bp, Homo sapiens
gcaggtggcagaggtgggatct

SEQ ID NO: 8390030 - DNA, 19 bp, Homo sapiens
gcaggtggatgtggtcagc

SEQ ID NO: 8390031 - DNA, 22 bp, Homo sapiens
gcaggtggaagcagcagactca

SEQ ID NO: 8390032 - DNA, 19 bp, Homo sapiens
gcaggtggatgtggtcagc

SEQ ID NO: 8390033 - DNA, 22 bp, Homo sapiens
gcaggtggattatcagaagtgc

SEQ ID NO: 8390034 - DNA, 18 bp, Homo sapiens
gcagtaggcgcgcaggac

SEQ ID NO: 8390035 - DNA, 22 bp, Homo sapiens
gcagtaggagtttccagggtgg

SEQ ID NO: 8390036 - DNA, 22 bp, Homo sapiens
gcagtaggggctggagggctgt

SEQ ID NO: 8390037 - DNA, 22 bp, Homo sapiens
gcagtaggggctggagggctgt

SEQ ID NO: 8390038 - DNA, 22 bp, Homo sapiens
gcagtaggagtttccagggtgg

SEQ ID NO: 8390039 - DNA, 22 bp, Homo sapiens
gcagtaggagggacaactacct

SEQ ID NO: 8390040 - DNA, 22 bp, Homo sapiens
gcagtgggcaacaagagctgga

SEQ ID NO: 8390041 - DNA, 22 bp, Homo sapiens
gcagtgggcaacaagagctgga

SEQ ID NO: 8390042 - DNA, 22 bp, Homo sapiens
gcagtacacacatatgtattcg

SEQ ID NO: 8390043 - DNA, 22 bp, Homo sapiens
gcaggtgtcttcatggaactct

SEQ ID NO: 8390044 - DNA, 23 bp, Homo sapiens
gcaggtggttcgaacagaagttt

SEQ ID NO: 8390045 - DNA, 21 bp, Homo sapiens
gcagtgtcatggtttcaagtt

SEQ ID NO: 8390046 - DNA, 22 bp, Homo sapiens
gcagtgtccagggtggtctgca

SEQ ID NO: 8390047 - DNA, 22 bp, Homo sapiens
gcagtgtctttgacctccaccc

SEQ ID NO: 8390048 - DNA, 19 bp, Homo sapiens
gcagtgtcatggtaggagc

SEQ ID NO: 8390049 - DNA, 22 bp, Homo sapiens
gcagtgtcagtgcctgggtggt

SEQ ID NO: 8390050 - DNA, 22 bp, Homo sapiens
gcagtggtccagttcacaccca

SEQ ID NO: 8390051 - DNA, 22 bp, Homo sapiens
gcagtggtggagcttacatatc

SEQ ID NO: 8390052 - DNA, 22 bp, Homo sapiens
gcagtggtggtgtttcagtgac

SEQ ID NO: 8390053 - DNA, 22 bp, Homo sapiens
gcagtggtggtgtttcagtgac

SEQ ID NO: 8390054 - DNA, 22 bp, Homo sapiens
gcagtgttcagtgaagcaggag

SEQ ID NO: 8390055 - DNA, 22 bp, Homo sapiens
gcagtggggaatgctggggaga

SEQ ID NO: 8390056 - DNA, 22 bp, Homo sapiens
gcagtggtccagctaagatttg

SEQ ID NO: 8390057 - DNA, 22 bp, Homo sapiens
gcagtggtccttacttcccagc

SEQ ID NO: 8390058 - DNA, 22 bp, Homo sapiens
gcagtggggcgctgggagttgg

SEQ ID NO: 8390059 - DNA, 22 bp, Homo sapiens
gcagtgggcctgaggaagggtg

SEQ ID NO: 8390060 - DNA, 22 bp, Homo sapiens
gcagtggggaatgctggggaga

SEQ ID NO: 8390061 - DNA, 22 bp, Homo sapiens
gcagtgggcctgaggaagggtg

SEQ ID NO: 8390062 - DNA, 22 bp, Homo sapiens
gcagtgggcaacaagagctgga

SEQ ID NO: 8390063 - DNA, 22 bp, Homo sapiens
gcatgtaatcactctaggaagg

SEQ ID NO: 8390064 - DNA, 22 bp, Homo sapiens
gcatgggaggacagtctgggct

SEQ ID NO: 8390065 - DNA, 22 bp, Homo sapiens
gcatgtgtctccccagtggagg

SEQ ID NO: 8390066 - DNA, 22 bp, Homo sapiens
gcatgtgggaacacttaggcac

SEQ ID NO: 8390067 - DNA, 22 bp, Homo sapiens
gcatgtggccttcaggctggaa

SEQ ID NO: 8390068 - DNA, 22 bp, Homo sapiens
gcatgtggaatctctccatggt

SEQ ID NO: 8390069 - DNA, 22 bp, Homo sapiens
gcatgtggatatgttagggtga

SEQ ID NO: 8390070 - DNA, 22 bp, Homo sapiens
gcatgtggcccaaggaggctgt

SEQ ID NO: 8390071 - DNA, 22 bp, Homo sapiens
gcatgtggtgctgaggctgtcg

SEQ ID NO: 8390072 - DNA, 22 bp, Homo sapiens
gccacagcccgagcaccatgag

SEQ ID NO: 8390073 - DNA, 22 bp, Homo sapiens
gccacagcagggccctctcagg

SEQ ID NO: 8390074 - DNA, 22 bp, Homo sapiens
gccaatgacagtctcagttctg

SEQ ID NO: 8390075 - DNA, 22 bp, Homo sapiens
gccagcagggaagccttgggct

SEQ ID NO: 8390076 - DNA, 22 bp, Homo sapiens
gccagcagggaagccttgggct

SEQ ID NO: 8390077 - DNA, 22 bp, Homo sapiens
gccagcagcttcttctcatcct

SEQ ID NO: 8390078 - DNA, 22 bp, Homo sapiens
gccagcagcttcttctcatcct

SEQ ID NO: 8390079 - DNA, 22 bp, Homo sapiens
gccagcagggaagccttgggct

SEQ ID NO: 8390080 - DNA, 22 bp, Homo sapiens
gccagcagctgtggggtggcca

SEQ ID NO: 8390081 - DNA, 22 bp, Homo sapiens
gccagcagctgtggggtggcca

SEQ ID NO: 8390082 - DNA, 22 bp, Homo sapiens
gccagcagctgtggggtggcca

SEQ ID NO: 8390083 - DNA, 22 bp, Homo sapiens
gccagcagctgtggggtggcca

SEQ ID NO: 8390084 - DNA, 22 bp, Homo sapiens
gccagcagctcttgggcgggca

SEQ ID NO: 8390085 - DNA, 22 bp, Homo sapiens
gccagcagctcttgggcgggca

SEQ ID NO: 8390086 - DNA, 22 bp, Homo sapiens
gccagcagctcttgggcgggca

SEQ ID NO: 8390087 - DNA, 22 bp, Homo sapiens
gccagcagcccagaaggacttt

SEQ ID NO: 8390088 - DNA, 22 bp, Homo sapiens
gccagcagcccagaaggacttt

SEQ ID NO: 8390089 - DNA, 22 bp, Homo sapiens
gccagcagcgagagtttaacct

SEQ ID NO: 8390090 - DNA, 19 bp, Homo sapiens
gccagcagaatgatgaggc

SEQ ID NO: 8390091 - DNA, 19 bp, Homo sapiens
gccagcagaatgatgaggc

SEQ ID NO: 8390092 - DNA, 22 bp, Homo sapiens
gccagcagccacagaagtcact

SEQ ID NO: 8390093 - DNA, 22 bp, Homo sapiens
gccagcagccacagaagtcact

SEQ ID NO: 8390094 - DNA, 22 bp, Homo sapiens
gccacagctcacgttccccatt

SEQ ID NO: 8390095 - DNA, 22 bp, Homo sapiens
gccacagcggggccgctagagc

SEQ ID NO: 8390096 - DNA, 22 bp, Homo sapiens
gccagatgccgtaaagatgggc

SEQ ID NO: 8390097 - DNA, 20 bp, Homo sapiens
gccagaggccggcaggggct

SEQ ID NO: 8390098 - DNA, 20 bp, Homo sapiens
gccagaggccggcaggggct

SEQ ID NO: 8390099 - DNA, 22 bp, Homo sapiens
gctggagccttctgctctgttg

SEQ ID NO: 8390100 - DNA, 22 bp, Homo sapiens
gctggagatagaatggccactg

SEQ ID NO: 8390101 - DNA, 22 bp, Homo sapiens
gctggagaggggtcactctgag

SEQ ID NO: 8390102 - DNA, 22 bp, Homo sapiens
gctggagagtagtaagcagtta

SEQ ID NO: 8390103 - DNA, 22 bp, Homo sapiens
gctggcctgacctgaggctggg

SEQ ID NO: 8390104 - DNA, 22 bp, Homo sapiens
gctggcctcgcaggcaggatgt

SEQ ID NO: 8390105 - DNA, 22 bp, Homo sapiens
gctggcctttgaggaagctgcg

SEQ ID NO: 8390106 - DNA, 22 bp, Homo sapiens
gctgggatgcgtcttcccaggc

SEQ ID NO: 8390107 - DNA, 22 bp, Homo sapiens
gctgggatggagactgcagtga

SEQ ID NO: 8390108 - DNA, 22 bp, Homo sapiens
gctggcctgggcagaggctatg

SEQ ID NO: 8390109 - DNA, 22 bp, Homo sapiens
gctggcctgggcagcctgtcgg

SEQ ID NO: 8390110 - DNA, 22 bp, Homo sapiens
gctggccttgtgtctgaggaag

SEQ ID NO: 8390111 - DNA, 22 bp, Homo sapiens
gctggccttgtgtctgaggaag

SEQ ID NO: 8390112 - DNA, 22 bp, Homo sapiens
gctgggcagctgaggcctctca

SEQ ID NO: 8390113 - DNA, 22 bp, Homo sapiens
gctgggcaggcctcgtgagggc

SEQ ID NO: 8390114 - DNA, 22 bp, Homo sapiens
gctgggcagcctggccgctgcc

SEQ ID NO: 8390115 - DNA, 22 bp, Homo sapiens
gctgggcagcaggctctccggg

SEQ ID NO: 8390116 - DNA, 22 bp, Homo sapiens
gctgggcactgtcccataggct

SEQ ID NO: 8390117 - DNA, 22 bp, Homo sapiens
gctgggcaatgccagagaggag

SEQ ID NO: 8390118 - DNA, 22 bp, Homo sapiens
gctgggcaacgggcagaaagat

SEQ ID NO: 8390119 - DNA, 22 bp, Homo sapiens
gctgagctcccagcagtatctg

SEQ ID NO: 8390120 - DNA, 22 bp, Homo sapiens
gctgaggatatagcaggaacaa

SEQ ID NO: 8390121 - DNA, 22 bp, Homo sapiens
gctgagctagctatctcagtct

SEQ ID NO: 8390122 - DNA, 22 bp, Homo sapiens
gctgagccacaggcagtgcact

SEQ ID NO: 8390123 - DNA, 22 bp, Homo sapiens
gctgcctgatcatacaccaggg

SEQ ID NO: 8390124 - DNA, 20 bp, Homo sapiens
gctgaggattcctggcccct

SEQ ID NO: 8390125 - DNA, 22 bp, Homo sapiens
gctgcctggagaggcagggatg

SEQ ID NO: 8390126 - DNA, 22 bp, Homo sapiens
gctgcctgggcaggaggcgctg

SEQ ID NO: 8390127 - DNA, 22 bp, Homo sapiens
gctgcctggctttagtccactt

SEQ ID NO: 8390128 - DNA, 22 bp, Homo sapiens
gctgcctggctttagtccactt

SEQ ID NO: 8390129 - DNA, 22 bp, Homo sapiens
gctgcctggagctcagcctgcc

SEQ ID NO: 8390130 - DNA, 22 bp, Homo sapiens
gctgcctgatcatacaccaggg

SEQ ID NO: 8390131 - DNA, 22 bp, Homo sapiens
gctgcctgatgtccagcaggac

SEQ ID NO: 8390132 - DNA, 22 bp, Homo sapiens
gctgcctgatgtccagcaggac

SEQ ID NO: 8390133 - DNA, 22 bp, Homo sapiens
gctgcctgcttcatgtgggaga

SEQ ID NO: 8390134 - DNA, 22 bp, Homo sapiens
gctgcctggaataacggctggc

SEQ ID NO: 8390135 - DNA, 22 bp, Homo sapiens
gctgcctgctcggctcctggga

SEQ ID NO: 8390136 - DNA, 22 bp, Homo sapiens
gctgcctgctcggctcctggga

SEQ ID NO: 8390137 - DNA, 20 bp, Homo sapiens
gctgctctccacggtctgca

SEQ ID NO: 8390138 - DNA, 20 bp, Homo sapiens
gctgctctccacggtctgca

SEQ ID NO: 8390139 - DNA, 22 bp, Homo sapiens
gctgctctccaagcctccttga

SEQ ID NO: 8390140 - DNA, 22 bp, Homo sapiens
gctgctctcagagctcatgctg

SEQ ID NO: 8390141 - DNA, 22 bp, Homo sapiens
gctgctctacccatgcatctgt

SEQ ID NO: 8390142 - DNA, 22 bp, Homo sapiens
gctgcctggtttctcagctgca

SEQ ID NO: 8390143 - DNA, 22 bp, Homo sapiens
gctgcctggtttctcagctgca

SEQ ID NO: 8390144 - DNA, 22 bp, Homo sapiens
gctgctcttgaggggctcactg

SEQ ID NO: 8390145 - DNA, 22 bp, Homo sapiens
gctgctctgtgacagcctccgg

SEQ ID NO: 8390146 - DNA, 22 bp, Homo sapiens
gctgctgccgcggccgctggga

SEQ ID NO: 8390147 - DNA, 22 bp, Homo sapiens
gctgctcttgaggggctcactg

SEQ ID NO: 8390148 - DNA, 22 bp, Homo sapiens
gctgctgcttgaaggctcggag

SEQ ID NO: 8390149 - DNA, 22 bp, Homo sapiens
gctgctgctggtctggggccac

SEQ ID NO: 8390150 - DNA, 22 bp, Homo sapiens
gctcttccatttctcttgaact

SEQ ID NO: 8390151 - DNA, 22 bp, Homo sapiens
gctcttgaaactggggtttcca

SEQ ID NO: 8390152 - DNA, 22 bp, Homo sapiens
gctcttgaaaatcaaaagggaa

SEQ ID NO: 8390153 - DNA, 22 bp, Homo sapiens
gctcttgaaataatggctaatg

SEQ ID NO: 8390154 - DNA, 21 bp, Homo sapiens
gctctgttattttctatgcag

SEQ ID NO: 8390155 - DNA, 22 bp, Homo sapiens
gctctgcccaatgtccctacac

SEQ ID NO: 8390156 - DNA, 22 bp, Homo sapiens
gctctgcccaaagctgtggctg

SEQ ID NO: 8390157 - DNA, 17 bp, Homo sapiens
gctctgccaggaaagag

SEQ ID NO: 8390158 - DNA, 22 bp, Homo sapiens
gctctgccagacactgtggcca

SEQ ID NO: 8390159 - DNA, 22 bp, Homo sapiens
gctgagagtgggtgcagtgctt

SEQ ID NO: 8390160 - DNA, 22 bp, Homo sapiens
gctgagagtgggtgcagtgctt

SEQ ID NO: 8390161 - DNA, 22 bp, Homo sapiens
gctgagcacacctagggtagag

SEQ ID NO: 8390162 - DNA, 18 bp, Homo sapiens
gctgaaattctaaacaaa

SEQ ID NO: 8390163 - DNA, 22 bp, Homo sapiens
gctgaaatgccttgtaaatatt

SEQ ID NO: 8390164 - DNA, 22 bp, Homo sapiens
gctcttgatgttcattgacttg

SEQ ID NO: 8390165 - DNA, 22 bp, Homo sapiens
gctcttgatttccaggagctag

SEQ ID NO: 8390166 - DNA, 22 bp, Homo sapiens
gctcttgacagctacatctggc

SEQ ID NO: 8390167 - DNA, 22 bp, Homo sapiens
gctcttgaatatgggtttcatg

SEQ ID NO: 8390168 - DNA, 21 bp, Homo sapiens
gctcttgaataagcataataa

SEQ ID NO: 8390169 - DNA, 22 bp, Homo sapiens
gctcttgaagtactgggtgttg

SEQ ID NO: 8390170 - DNA, 22 bp, Homo sapiens
gctcttgaggaagtgcagggca

SEQ ID NO: 8390171 - DNA, 22 bp, Homo sapiens
gctcttgatacatcaagaactt

SEQ ID NO: 8390172 - DNA, 22 bp, Homo sapiens
gctcttgaccttggagaactcg

SEQ ID NO: 8390173 - DNA, 22 bp, Homo sapiens
gctcttgactcccagttctgtg

SEQ ID NO: 8390174 - DNA, 22 bp, Homo sapiens
gctcttgactcccagttctgtg

SEQ ID NO: 8390175 - DNA, 22 bp, Homo sapiens
gctcctggctctggccaaggga

SEQ ID NO: 8390176 - DNA, 22 bp, Homo sapiens
gctcctggcttcactgacatca

SEQ ID NO: 8390177 - DNA, 22 bp, Homo sapiens
gctcctggcttcactgacatca

SEQ ID NO: 8390178 - DNA, 22 bp, Homo sapiens
gctcctgggccctgggctaact

SEQ ID NO: 8390179 - DNA, 16 bp, Homo sapiens
gctcctgggccctcga

SEQ ID NO: 8390180 - DNA, 19 bp, Homo sapiens
gctcctgggcctcactcat

SEQ ID NO: 8390181 - DNA, 22 bp, Homo sapiens
gctcctgggtgtggctgcccct

SEQ ID NO: 8390182 - DNA, 22 bp, Homo sapiens
gctcctgggctctaccttgcta

SEQ ID NO: 8390183 - DNA, 22 bp, Homo sapiens
gctctgagcagggagaaacagg

SEQ ID NO: 8390184 - DNA, 22 bp, Homo sapiens
gctctgagcccccagaagcaga

SEQ ID NO: 8390185 - DNA, 22 bp, Homo sapiens
gctctgagtaaatgaaagcatt

SEQ ID NO: 8390186 - DNA, 18 bp, Homo sapiens
gctctgcagctgaggctt

SEQ ID NO: 8390187 - DNA, 21 bp, Homo sapiens
gctctgccacttaccagattt

SEQ ID NO: 8390188 - DNA, 22 bp, Homo sapiens
gctctgagtgattaaggagctt

SEQ ID NO: 8390189 - DNA, 18 bp, Homo sapiens
gctcatttggatgggctt

SEQ ID NO: 8390190 - DNA, 22 bp, Homo sapiens
gctcatttcttctttccacaat

SEQ ID NO: 8390191 - DNA, 22 bp, Homo sapiens
gctcattcagccagggcccggt

SEQ ID NO: 8390192 - DNA, 22 bp, Homo sapiens
gctccaggagagggaagcagat

SEQ ID NO: 8390193 - DNA, 22 bp, Homo sapiens
gctccagctcgtggctcccagc

SEQ ID NO: 8390194 - DNA, 22 bp, Homo sapiens
gctccagatgaatgcacttgtt

SEQ ID NO: 8390195 - DNA, 22 bp, Homo sapiens
gctccagctccggctccgaagc

SEQ ID NO: 8390196 - DNA, 22 bp, Homo sapiens
gctccaggagctcacagctcgc

SEQ ID NO: 8390197 - DNA, 22 bp, Homo sapiens
gctcctctgtcaaatgagagtg

SEQ ID NO: 8390198 - DNA, 22 bp, Homo sapiens
gctcctcttatttcatcagggc

SEQ ID NO: 8390199 - DNA, 22 bp, Homo sapiens
gctcctggcaggcagtgtgtgt

SEQ ID NO: 8390200 - DNA, 22 bp, Homo sapiens
gctcctggctccaggcagccaa

SEQ ID NO: 8390201 - DNA, 22 bp, Homo sapiens
gctcctggctctctgagggctg

SEQ ID NO: 8390202 - DNA, 22 bp, Homo sapiens
gctcctggccagcacagggccc

SEQ ID NO: 8390203 - DNA, 22 bp, Homo sapiens
gctcctggcatcctgcttttaa

SEQ ID NO: 8390204 - DNA, 22 bp, Homo sapiens
gctcctggcatcctgcttttaa

SEQ ID NO: 8390205 - DNA, 22 bp, Homo sapiens
gctcctggcaggcagtgtgtgt

SEQ ID NO: 8390206 - DNA, 19 bp, Homo sapiens
gctcagagccatgggggct

SEQ ID NO: 8390207 - DNA, 22 bp, Homo sapiens
gctcagagcccgaggcttgcat

SEQ ID NO: 8390208 - DNA, 22 bp, Homo sapiens
gctcatgactgtaatcccagca

SEQ ID NO: 8390209 - DNA, 23 bp, Homo sapiens
gctcatctagaatggtttcagct

SEQ ID NO: 8390210 - DNA, 22 bp, Homo sapiens
gctcatctcccttttgaagctg

SEQ ID NO: 8390211 - DNA, 22 bp, Homo sapiens
gctcatctgccccaggagatcc

SEQ ID NO: 8390212 - DNA, 22 bp, Homo sapiens
gctcatctgccatgatgagttt

SEQ ID NO: 8390213 - DNA, 22 bp, Homo sapiens
gctcatctgttttaactgtatt

SEQ ID NO: 8390214 - DNA, 22 bp, Homo sapiens
gctcatctgtaaaacaggatta

SEQ ID NO: 8390215 - DNA, 22 bp, Homo sapiens
gctcatctggggctttcagctt

SEQ ID NO: 8390216 - DNA, 22 bp, Homo sapiens
gctcagagatgtctgctgcctt

SEQ ID NO: 8390217 - DNA, 22 bp, Homo sapiens
gctcactggcctgaagaggacg

SEQ ID NO: 8390218 - DNA, 22 bp, Homo sapiens
gctcactgccattctctagatg

SEQ ID NO: 8390219 - DNA, 22 bp, Homo sapiens
gcctgtttgactggtctctgct

SEQ ID NO: 8390220 - DNA, 22 bp, Homo sapiens
gcctgtttgagaatagtcaggg

SEQ ID NO: 8390221 - DNA, 22 bp, Homo sapiens
gcctgtttctcctccttggccc

SEQ ID NO: 8390222 - DNA, 22 bp, Homo sapiens
gcctgtttactttgccgcagga

SEQ ID NO: 8390223 - DNA, 22 bp, Homo sapiens
gcctgtttatctatcatgaact

SEQ ID NO: 8390224 - DNA, 22 bp, Homo sapiens
gcctgtttgttatgtcatggta

SEQ ID NO: 8390225 - DNA, 22 bp, Homo sapiens
gcctgtttggcatcattggttg

SEQ ID NO: 8390226 - DNA, 21 bp, Homo sapiens
gcctgggatagtggcctccgg

SEQ ID NO: 8390227 - DNA, 22 bp, Homo sapiens
gcctgggatagaggcaatgcat

SEQ ID NO: 8390228 - DNA, 22 bp, Homo sapiens
gcctgggaagactaagtgggag

SEQ ID NO: 8390229 - DNA, 22 bp, Homo sapiens
gcctgtgggttggagcttggcc

SEQ ID NO: 8390230 - DNA, 22 bp, Homo sapiens
gcctgttctccagcatccaggt

SEQ ID NO: 8390231 - DNA, 22 bp, Homo sapiens
gcctgtggccgactgagagcct

SEQ ID NO: 8390232 - DNA, 22 bp, Homo sapiens
gcctggccgctccgagctccgc

SEQ ID NO: 8390233 - DNA, 22 bp, Homo sapiens
gcctggagtagcatggcaagcc

SEQ ID NO: 8390234 - DNA, 22 bp, Homo sapiens
gcctggagtagcatggcaagcc

SEQ ID NO: 8390235 - DNA, 22 bp, Homo sapiens
gcctggcaggcctcatgagggg

SEQ ID NO: 8390236 - DNA, 22 bp, Homo sapiens
gcctggcaggggcctgggagtg

SEQ ID NO: 8390237 - DNA, 22 bp, Homo sapiens
gcctggcagtggggccctggga

SEQ ID NO: 8390238 - DNA, 22 bp, Homo sapiens
gcctggacaccgcccttgcaga

SEQ ID NO: 8390239 - DNA, 22 bp, Homo sapiens
gcctggagggctctagagaggc

SEQ ID NO: 8390240 - DNA, 22 bp, Homo sapiens
gcctgctgttgagggaagagct

SEQ ID NO: 8390241 - DNA, 22 bp, Homo sapiens
gcctgctgttaactgcaggaat

SEQ ID NO: 8390242 - DNA, 22 bp, Homo sapiens
gcctgccttttggaggcacatt

SEQ ID NO: 8390243 - DNA, 22 bp, Homo sapiens
gcctgcctttgtgaggaagcgg

SEQ ID NO: 8390244 - DNA, 22 bp, Homo sapiens
gcctgccttttggaggcacatt

SEQ ID NO: 8390245 - DNA, 22 bp, Homo sapiens
gcctgctcagacctagcaggcc

SEQ ID NO: 8390246 - DNA, 22 bp, Homo sapiens
gcctgccagtgtttgaggattg

SEQ ID NO: 8390247 - DNA, 19 bp, Homo sapiens
gcctgccagatagtaatga

SEQ ID NO: 8390248 - DNA, 19 bp, Homo sapiens
gcctgccagcctgaatctg

SEQ ID NO: 8390249 - DNA, 20 bp, Homo sapiens
gcctctggagccaaggacca

SEQ ID NO: 8390250 - DNA, 22 bp, Homo sapiens
gcctctggaagaattacatcca

SEQ ID NO: 8390251 - DNA, 22 bp, Homo sapiens
gcctctggaagtgggaaggggt

SEQ ID NO: 8390252 - DNA, 22 bp, Homo sapiens
gcctgcctcaaaatcccagttc

SEQ ID NO: 8390253 - DNA, 20 bp, Homo sapiens
gcctgcctcagctagctgag

SEQ ID NO: 8390254 - DNA, 22 bp, Homo sapiens
gcctgcctgaaggctgtaccag

SEQ ID NO: 8390255 - DNA, 23 bp, Homo sapiens
gcctgcctgacctgtgcaaagtc

SEQ ID NO: 8390256 - DNA, 22 bp, Homo sapiens
gcctgccttcggtgcgcagcgg

SEQ ID NO: 8390257 - DNA, 22 bp, Homo sapiens
gcctgcctttgtatgaccctga

SEQ ID NO: 8390258 - DNA, 22 bp, Homo sapiens
gcctgcctgttggctgaggtgc

SEQ ID NO: 8390259 - DNA, 21 bp, Homo sapiens
gcctgcctgcgtgaccctctt

SEQ ID NO: 8390260 - DNA, 22 bp, Homo sapiens
gcctgcctgctgtcatctgcct

SEQ ID NO: 8390261 - DNA, 19 bp, Homo sapiens
gcctgcctgggtttctgag

SEQ ID NO: 8390262 - DNA, 22 bp, Homo sapiens
gcctgcctggagcttgaggtga

SEQ ID NO: 8390263 - DNA, 22 bp, Homo sapiens
gcctgcctgctgtgtgcaagtt

SEQ ID NO: 8390264 - DNA, 22 bp, Homo sapiens
gcctctgcggagctgtacatca

SEQ ID NO: 8390265 - DNA, 22 bp, Homo sapiens
gcctctgctcggactttgcctc

SEQ ID NO: 8390266 - DNA, 22 bp, Homo sapiens
gcctctgctctcaggtagcctc

SEQ ID NO: 8390267 - DNA, 22 bp, Homo sapiens
gcctctgctgacaagatggaca

SEQ ID NO: 8390268 - DNA, 19 bp, Homo sapiens
gcctctgctggggacaggc

SEQ ID NO: 8390269 - DNA, 22 bp, Homo sapiens
gcctctgccaagggggctgcgg

SEQ ID NO: 8390270 - DNA, 22 bp, Homo sapiens
gcctctgcccatccaccatcag

SEQ ID NO: 8390271 - DNA, 22 bp, Homo sapiens
gcctcctgttatgccatgtgcc

SEQ ID NO: 8390272 - DNA, 22 bp, Homo sapiens
gcctcctgttatgccatgtgcc

SEQ ID NO: 8390273 - DNA, 22 bp, Homo sapiens
gcctctgcactgtggcacacca

SEQ ID NO: 8390274 - DNA, 22 bp, Homo sapiens
gccgggaccaaggccacggagc

SEQ ID NO: 8390275 - DNA, 22 bp, Homo sapiens
gccggggctggggagagacatg

SEQ ID NO: 8390276 - DNA, 22 bp, Homo sapiens
gccggtggcttttgtctcccct

SEQ ID NO: 8390277 - DNA, 22 bp, Homo sapiens
gccgggttcaagccattctcct

SEQ ID NO: 8390278 - DNA, 22 bp, Homo sapiens
gccgttattctgctggccccgg

SEQ ID NO: 8390279 - DNA, 22 bp, Homo sapiens
gcctcctgtcccaggctgagga

SEQ ID NO: 8390280 - DNA, 22 bp, Homo sapiens
gcccttgacagtggcagaagca

SEQ ID NO: 8390281 - DNA, 22 bp, Homo sapiens
gcccttctgctgttaggtagcc

SEQ ID NO: 8390282 - DNA, 22 bp, Homo sapiens
gccctttcttcttctggactgg

SEQ ID NO: 8390283 - DNA, 22 bp, Homo sapiens
gccaggctggtgtcacaactct

SEQ ID NO: 8390284 - DNA, 22 bp, Homo sapiens
gccagcagggcccaaatgctgg

SEQ ID NO: 8390285 - DNA, 22 bp, Homo sapiens
gccagcagggcccaaatgctgg

SEQ ID NO: 8390286 - DNA, 22 bp, Homo sapiens
gccagtgggacccgctgtgggc

SEQ ID NO: 8390287 - DNA, 22 bp, Homo sapiens
gccagtttccacctaggcaatt

SEQ ID NO: 8390288 - DNA, 22 bp, Homo sapiens
gcccaggctggagtgcagtggc

SEQ ID NO: 8390289 - DNA, 22 bp, Homo sapiens
gcccaggctggagtgcagtagc

SEQ ID NO: 8390290 - DNA, 22 bp, Homo sapiens
gcccaggctggagtgcagtagc

SEQ ID NO: 8390291 - DNA, 22 bp, Homo sapiens
gcccaggattctttcttcctta

SEQ ID NO: 8390292 - DNA, 22 bp, Homo sapiens
gcccaggctagcgtagagtgca

SEQ ID NO: 8390293 - DNA, 22 bp, Homo sapiens
gcccaggataatgctgtccctg

SEQ ID NO: 8390294 - DNA, 22 bp, Homo sapiens
gcccaggataatgctgtccctg

SEQ ID NO: 8390295 - DNA, 20 bp, Homo sapiens
gcccaggatctctgaggcat

SEQ ID NO: 8390296 - DNA, 22 bp, Homo sapiens
gcccaggagttggtggctgcag

SEQ ID NO: 8390297 - DNA, 22 bp, Homo sapiens
gccatttaggaggtggaaagga

SEQ ID NO: 8390298 - DNA, 21 bp, Homo sapiens
gccatttcacacagacatttg

SEQ ID NO: 8390299 - DNA, 22 bp, Homo sapiens
gcccaggagttggaggctgcag

SEQ ID NO: 8390300 - DNA, 22 bp, Homo sapiens
gcccaggaggtcaagtagctat

SEQ ID NO: 8390301 - DNA, 21 bp, Homo sapiens
gccatgtttccttactaagag

SEQ ID NO: 8390302 - DNA, 22 bp, Homo sapiens
gccatgttcttgaatctgggtc

SEQ ID NO: 8390303 - DNA, 22 bp, Homo sapiens
gccatgtcctgggcatctgcca

SEQ ID NO: 8390304 - DNA, 22 bp, Homo sapiens
ctatttattgtgggtatccagg

SEQ ID NO: 8390305 - DNA, 22 bp, Homo sapiens
ctatttatgtgctattttgtat

SEQ ID NO: 8390306 - DNA, 22 bp, Homo sapiens
ctattccacttttggcaaagcc

SEQ ID NO: 8390307 - DNA, 22 bp, Homo sapiens
ctatttcatgttcctatggccg

SEQ ID NO: 8390308 - DNA, 22 bp, Homo sapiens
ctatttggccaagctgcccaca

SEQ ID NO: 8390309 - DNA, 22 bp, Homo sapiens
ctatttggggtagaagatggat

SEQ ID NO: 8390310 - DNA, 22 bp, Homo sapiens
ctatttggatgttagcctcagt

SEQ ID NO: 8390311 - DNA, 22 bp, Homo sapiens
ttctgtatctctgtgtttcttg

SEQ ID NO: 8390312 - DNA, 22 bp, Homo sapiens
ttctgtatctttcttcaagatt

SEQ ID NO: 8390313 - DNA, 22 bp, Homo sapiens
ttctgtatgtacatatgtgtat

SEQ ID NO: 8390314 - DNA, 22 bp, Homo sapiens
ttctgtatttcaatgtctttat

SEQ ID NO: 8390315 - DNA, 22 bp, Homo sapiens
ttctgtacttcaggggctctgt

SEQ ID NO: 8390316 - DNA, 22 bp, Homo sapiens
ctattttaacttgattacctct

SEQ ID NO: 8390317 - DNA, 22 bp, Homo sapiens
ttctgtcacagtgctggtatca

SEQ ID NO: 8390318 - DNA, 22 bp, Homo sapiens
ttcttggaaatacattcaataa

SEQ ID NO: 8390319 - DNA, 22 bp, Homo sapiens
ttcttggaaatacattcaataa

SEQ ID NO: 8390320 - DNA, 22 bp, Homo sapiens
ctaggcagctttgggtgtgaag

SEQ ID NO: 8390321 - DNA, 22 bp, Homo sapiens
ctaggcagggtgctgtgccatg

SEQ ID NO: 8390322 - DNA, 22 bp, Homo sapiens
ctaggccacttgctctcatgga

SEQ ID NO: 8390323 - DNA, 22 bp, Homo sapiens
ctaggctggagtgcagtggcac

SEQ ID NO: 8390324 - DNA, 22 bp, Homo sapiens
ctaggctggagtgcagtggcat

SEQ ID NO: 8390325 - DNA, 22 bp, Homo sapiens
ctaggctggagtgcattggcgt

SEQ ID NO: 8390326 - DNA, 22 bp, Homo sapiens
ctaggcttgcagggtggacatg

SEQ ID NO: 8390327 - DNA, 17 bp, Homo sapiens
ctaggcttggcagctcg

SEQ ID NO: 8390328 - DNA, 22 bp, Homo sapiens
ctagggagactcgcaggactca

SEQ ID NO: 8390329 - DNA, 22 bp, Homo sapiens
ctagggaatgagagactggatc

SEQ ID NO: 8390330 - DNA, 20 bp, Homo sapiens
ctaggcagcgagtgactgag

SEQ ID NO: 8390331 - DNA, 22 bp, Homo sapiens
ttccttttctcacggggatcca

SEQ ID NO: 8390332 - DNA, 22 bp, Homo sapiens
ttccttttcttaaacatatgtg

SEQ ID NO: 8390333 - DNA, 22 bp, Homo sapiens
ttccttttcttctaccacatgt

SEQ ID NO: 8390334 - DNA, 22 bp, Homo sapiens
ttccttttcttctaccacatgt

SEQ ID NO: 8390335 - DNA, 22 bp, Homo sapiens
ttcctttccctcacagcctcgg

SEQ ID NO: 8390336 - DNA, 22 bp, Homo sapiens
ttcctttcacgttttaatgcac

SEQ ID NO: 8390337 - DNA, 22 bp, Homo sapiens
ttcctttccctcacagcctcgg

SEQ ID NO: 8390338 - DNA, 22 bp, Homo sapiens
ttccttttatttgtccaggctt

SEQ ID NO: 8390339 - DNA, 22 bp, Homo sapiens
ttgaggagtacaaagcatgctt

SEQ ID NO: 8390340 - DNA, 22 bp, Homo sapiens
ttgaggaggacagaaacattta

SEQ ID NO: 8390341 - DNA, 22 bp, Homo sapiens
ttgataaaatgatgaaatcact

SEQ ID NO: 8390342 - DNA, 22 bp, Homo sapiens
ttgataaaatgatgaaatcact

SEQ ID NO: 8390343 - DNA, 22 bp, Homo sapiens
ttgagaaacatctaatctttgt

SEQ ID NO: 8390344 - DNA, 22 bp, Homo sapiens
ttgagaaacatctaatctttgt

SEQ ID NO: 8390345 - DNA, 22 bp, Homo sapiens
ttgacttttcttggtcacatga

SEQ ID NO: 8390346 - DNA, 17 bp, Homo sapiens
ctattttggagattaaa

SEQ ID NO: 8390347 - DNA, 17 bp, Homo sapiens
ctattttggagattaaa

SEQ ID NO: 8390348 - DNA, 19 bp, Homo sapiens
ctcagcacttttacacagg

SEQ ID NO: 8390349 - DNA, 22 bp, Homo sapiens
ctcagagggaggactgggctgg

SEQ ID NO: 8390350 - DNA, 22 bp, Homo sapiens
ctattttaagaggccattaggt

SEQ ID NO: 8390351 - DNA, 22 bp, Homo sapiens
ctattttaacttgattacctct

SEQ ID NO: 8390352 - DNA, 22 bp, Homo sapiens
ctacaaagtaccacagactggg

SEQ ID NO: 8390353 - DNA, 22 bp, Homo sapiens
ttccttccagcttgtgacagtc

SEQ ID NO: 8390354 - DNA, 20 bp, Homo sapiens
ctaatattctactctaagga

SEQ ID NO: 8390355 - DNA, 22 bp, Homo sapiens
ctaatactcatttctgtaactc

SEQ ID NO: 8390356 - DNA, 22 bp, Homo sapiens
ctaatcacctcatccctcagcg

SEQ ID NO: 8390357 - DNA, 22 bp, Homo sapiens
ctaaggcaggtccattccagga

SEQ ID NO: 8390358 - DNA, 22 bp, Homo sapiens
ctacaaaagtaattgtggtttt

SEQ ID NO: 8390359 - DNA, 22 bp, Homo sapiens
ctaatttttgttctgcattgaa

SEQ ID NO: 8390360 - DNA, 22 bp, Homo sapiens
ctaattttcccaaggccttcta

SEQ ID NO: 8390361 - DNA, 22 bp, Homo sapiens
ctaatttaatgaatgagtctta

SEQ ID NO: 8390362 - DNA, 22 bp, Homo sapiens
ctaaggcaccgaggcaggagcg

SEQ ID NO: 8390363 - DNA, 22 bp, Homo sapiens
ttccgagggctcggcggccgcc

SEQ ID NO: 8390364 - DNA, 21 bp, Homo sapiens
ttcccttctggttttgagaga

SEQ ID NO: 8390365 - DNA, 22 bp, Homo sapiens
ttcccttaaattatggcatcta

SEQ ID NO: 8390366 - DNA, 22 bp, Homo sapiens
ttcccttcctcactctacttgt

SEQ ID NO: 8390367 - DNA, 22 bp, Homo sapiens
ttcccttaaattatggcatcta

SEQ ID NO: 8390368 - DNA, 22 bp, Homo sapiens
ttccaaaggctgcaccttgccc

SEQ ID NO: 8390369 - DNA, 22 bp, Homo sapiens
ttccaaagaaattgaccaagac

SEQ ID NO: 8390370 - DNA, 22 bp, Homo sapiens
ttccaaagttagttattagaaa

SEQ ID NO: 8390371 - DNA, 22 bp, Homo sapiens
ttccaaagttattcaagcagta

SEQ ID NO: 8390372 - DNA, 22 bp, Homo sapiens
ttccaaatgagttccatcgaat

SEQ ID NO: 8390373 - DNA, 22 bp, Homo sapiens
ttccaaagtgctggaattacat

SEQ ID NO: 8390374 - DNA, 22 bp, Homo sapiens
ttccaaagtgctggaattacat

SEQ ID NO: 8390375 - DNA, 22 bp, Homo sapiens
ttcccaagtctccaatgtggga

SEQ ID NO: 8390376 - DNA, 22 bp, Homo sapiens
ttcccaaaatataacagttaac

SEQ ID NO: 8390377 - DNA, 22 bp, Homo sapiens
ttccatttggcacttcactgag

SEQ ID NO: 8390378 - DNA, 22 bp, Homo sapiens
cggcatccccacttcctcctgc

SEQ ID NO: 8390379 - DNA, 22 bp, Homo sapiens
cggacaggctcctggagctcct

SEQ ID NO: 8390380 - DNA, 22 bp, Homo sapiens
cggacaggctcctggagctcct

SEQ ID NO: 8390381 - DNA, 22 bp, Homo sapiens
ttcacatgttggacatagagga

SEQ ID NO: 8390382 - DNA, 22 bp, Homo sapiens
ttcacagtggtagtgcatttag

SEQ ID NO: 8390383 - DNA, 22 bp, Homo sapiens
ttcacagtgtttctcacggtta

SEQ ID NO: 8390384 - DNA, 22 bp, Homo sapiens
ttcacagtgttgtgccttttgt

SEQ ID NO: 8390385 - DNA, 22 bp, Homo sapiens
ttcacagtgtgatctatgggca

SEQ ID NO: 8390386 - DNA, 22 bp, Homo sapiens
ttcacagtggcttaggctatgg

SEQ ID NO: 8390387 - DNA, 22 bp, Homo sapiens
ttcacagtggtaagggttgtga

SEQ ID NO: 8390388 - DNA, 22 bp, Homo sapiens
ttcacataaatagatcacatca

SEQ ID NO: 8390389 - DNA, 22 bp, Homo sapiens
ttcacagtttgctgggacagga

SEQ ID NO: 8390390 - DNA, 22 bp, Homo sapiens
ttcacataaaagctccaaagaa

SEQ ID NO: 8390391 - DNA, 22 bp, Homo sapiens
ttcacagttgggcaggttgtgt

SEQ ID NO: 8390392 - DNA, 22 bp, Homo sapiens
ttcacagttcctgggaaaacag

SEQ ID NO: 8390393 - DNA, 22 bp, Homo sapiens
ttcacagtttaatggcaaggat

SEQ ID NO: 8390394 - DNA, 22 bp, Homo sapiens
ttcacataaatagatcacatca

SEQ ID NO: 8390395 - DNA, 22 bp, Homo sapiens
ttcacataatctgcagcaagcg

SEQ ID NO: 8390396 - DNA, 22 bp, Homo sapiens
ttcacataatgatacaaagctt

SEQ ID NO: 8390397 - DNA, 22 bp, Homo sapiens
ttcacatgaaagtaggaaagga

SEQ ID NO: 8390398 - DNA, 22 bp, Homo sapiens
ttcacatgacagggtgaagcat

SEQ ID NO: 8390399 - DNA, 22 bp, Homo sapiens
ttcacatggcaatagagaggga

SEQ ID NO: 8390400 - DNA, 22 bp, Homo sapiens
ttcagaaacatcagtggatgga

SEQ ID NO: 8390401 - DNA, 22 bp, Homo sapiens
ttcagaaaaagaccattgcaat

SEQ ID NO: 8390402 - DNA, 22 bp, Homo sapiens
ttcagaaaaagaccattgcaat

SEQ ID NO: 8390403 - DNA, 22 bp, Homo sapiens
ttcagaaaggttaatctggatt

SEQ ID NO: 8390404 - DNA, 22 bp, Homo sapiens
ttcatgaggtacctgtgatcat

SEQ ID NO: 8390405 - DNA, 22 bp, Homo sapiens
ttcagaaaggataattggaagg

SEQ ID NO: 8390406 - DNA, 22 bp, Homo sapiens
ttcagaaaggtaaatggatttc

SEQ ID NO: 8390407 - DNA, 19 bp, Homo sapiens
ttcattctcttattgttgt

SEQ ID NO: 8390408 - DNA, 19 bp, Homo sapiens
ttcattctcttattgttgt

SEQ ID NO: 8390409 - DNA, 22 bp, Homo sapiens
ttcattctcttagcatagtcct

SEQ ID NO: 8390410 - DNA, 22 bp, Homo sapiens
ttcattctcttagcatagtcct

SEQ ID NO: 8390411 - DNA, 22 bp, Homo sapiens
ttcattctgcagttctcagctc

SEQ ID NO: 8390412 - DNA, 22 bp, Homo sapiens
ttcattctgggctctaaggaac

SEQ ID NO: 8390413 - DNA, 22 bp, Homo sapiens
ttcattctgtttggaaaggtgg

SEQ ID NO: 8390414 - DNA, 22 bp, Homo sapiens
ttcattcttgggatcagagagt

SEQ ID NO: 8390415 - DNA, 22 bp, Homo sapiens
ttcattcttatttgtgatctgg

SEQ ID NO: 8390416 - DNA, 22 bp, Homo sapiens
ttcattcttcagagctgcgctt

SEQ ID NO: 8390417 - DNA, 22 bp, Homo sapiens
ttccaaaatgccttgatatgat

SEQ ID NO: 8390418 - DNA, 22 bp, Homo sapiens
ttgctttgtggtggttcttcca

SEQ ID NO: 8390419 - DNA, 22 bp, Homo sapiens
ttgcttttaatctttgtacatc

SEQ ID NO: 8390420 - DNA, 22 bp, Homo sapiens
ttgcttttgggaaaacatgcct

SEQ ID NO: 8390421 - DNA, 22 bp, Homo sapiens
ttgcttttaattaatcattgct

SEQ ID NO: 8390422 - DNA, 22 bp, Homo sapiens
ttgctttttaattaggaggcag

SEQ ID NO: 8390423 - DNA, 22 bp, Homo sapiens
ctcagtttgtgtgatattgtct

SEQ ID NO: 8390424 - DNA, 22 bp, Homo sapiens
ctcagtttctgacattaaaatc

SEQ ID NO: 8390425 - DNA, 22 bp, Homo sapiens
ctcagtttttttaagagccatg

SEQ ID NO: 8390426 - DNA, 22 bp, Homo sapiens
ttgatattagagtatttgtttg

SEQ ID NO: 8390427 - DNA, 22 bp, Homo sapiens
ttgggcagatgtttcctgtgga

SEQ ID NO: 8390428 - DNA, 22 bp, Homo sapiens
ttgggagtaataaaaaattcca

SEQ ID NO: 8390429 - DNA, 22 bp, Homo sapiens
ttgggaggtaatggagccaagt

SEQ ID NO: 8390430 - DNA, 22 bp, Homo sapiens
ttgggaggtcataaatctgttc

SEQ ID NO: 8390431 - DNA, 22 bp, Homo sapiens
ctcatctcccacctgcgtgcag

SEQ ID NO: 8390432 - DNA, 22 bp, Homo sapiens
ctcatctcccacctgcgtgcag

SEQ ID NO: 8390433 - DNA, 22 bp, Homo sapiens
ctcatctggcttcagtaacagt

SEQ ID NO: 8390434 - DNA, 22 bp, Homo sapiens
ctcatctgctcttattatctta

SEQ ID NO: 8390435 - DNA, 22 bp, Homo sapiens
ctcataaacattattcattatt

SEQ ID NO: 8390436 - DNA, 22 bp, Homo sapiens
ctcataatgtgactgtatttga

SEQ ID NO: 8390437 - DNA, 22 bp, Homo sapiens
ctcatattcagtcactgatgca

SEQ ID NO: 8390438 - DNA, 22 bp, Homo sapiens
ctcatccaccctcaacaaagat

SEQ ID NO: 8390439 - DNA, 22 bp, Homo sapiens
ttggccagagaccagagcaggg

SEQ ID NO: 8390440 - DNA, 22 bp, Homo sapiens
ttggccagactgaggtgctggg

SEQ ID NO: 8390441 - DNA, 22 bp, Homo sapiens
ttggccagaggtttctctcatg

SEQ ID NO: 8390442 - DNA, 22 bp, Homo sapiens
ttggccagaggtttctctcatg

SEQ ID NO: 8390443 - DNA, 22 bp, Homo sapiens
ttggccagaatcttcctagtga

SEQ ID NO: 8390444 - DNA, 22 bp, Homo sapiens
ttgtttcagctgtatgctatgt

SEQ ID NO: 8390445 - DNA, 22 bp, Homo sapiens
ttgtttcatggggatgtttatt

SEQ ID NO: 8390446 - DNA, 22 bp, Homo sapiens
tttaaaaaactagtctgagtct

SEQ ID NO: 8390447 - DNA, 22 bp, Homo sapiens
tttaaaaaactagtctgagtct

SEQ ID NO: 8390448 - DNA, 22 bp, Homo sapiens
tttaaaaaactagtctgagtct

SEQ ID NO: 8390449 - DNA, 22 bp, Homo sapiens
tttaaaaaactagtctgagtct

SEQ ID NO: 8390450 - DNA, 22 bp, Homo sapiens
ttgtattttgttatgctactgc

SEQ ID NO: 8390451 - DNA, 22 bp, Homo sapiens
ttgtattttgttatgctactgc

SEQ ID NO: 8390452 - DNA, 22 bp, Homo sapiens
ttgttaaaaatagatttccagg

SEQ ID NO: 8390453 - DNA, 22 bp, Homo sapiens
ttgttaaaaatagatttccagg

SEQ ID NO: 8390454 - DNA, 22 bp, Homo sapiens
ttgttaaaactccattggtttg

SEQ ID NO: 8390455 - DNA, 22 bp, Homo sapiens
ttgttaaaatgaggtcattctg

SEQ ID NO: 8390456 - DNA, 22 bp, Homo sapiens
ttgttaaaatgaggtcattctg

SEQ ID NO: 8390457 - DNA, 22 bp, Homo sapiens
ttgttaaaatattggagaaagg

SEQ ID NO: 8390458 - DNA, 22 bp, Homo sapiens
ttgttaaaatgcatattctggt

SEQ ID NO: 8390459 - DNA, 22 bp, Homo sapiens
ttgttaaaatgcatattctggt

SEQ ID NO: 8390460 - DNA, 22 bp, Homo sapiens
ttgttaaaattggagccgagag

SEQ ID NO: 8390461 - DNA, 22 bp, Homo sapiens
ttgttacagatcacatttctgc

SEQ ID NO: 8390462 - DNA, 22 bp, Homo sapiens
ttgttacacataataacatttt

SEQ ID NO: 8390463 - DNA, 22 bp, Homo sapiens
ttgttacagcagcaatagaaaa

SEQ ID NO: 8390464 - DNA, 22 bp, Homo sapiens
ttgttaaaggcaaaacaagcac

SEQ ID NO: 8390465 - DNA, 22 bp, Homo sapiens
ttgttaaatggatgcagaataa

SEQ ID NO: 8390466 - DNA, 22 bp, Homo sapiens
ttgttaaatggatgcagaataa

SEQ ID NO: 8390467 - DNA, 22 bp, Homo sapiens
ttgttaaatggatgcagaataa

SEQ ID NO: 8390468 - DNA, 22 bp, Homo sapiens
ttgttaaaggcaaaacaagcac

SEQ ID NO: 8390469 - DNA, 22 bp, Homo sapiens
ttgttaaagatgcagattccat

SEQ ID NO: 8390470 - DNA, 22 bp, Homo sapiens
ttggtattttacaatgtcagtg

SEQ ID NO: 8390471 - DNA, 22 bp, Homo sapiens
ttggtaattgtgtttattaaat

SEQ ID NO: 8390472 - DNA, 22 bp, Homo sapiens
ttgtatttctccactttctgtt

SEQ ID NO: 8390473 - DNA, 22 bp, Homo sapiens
ttgtatttgggtagtatagaga

SEQ ID NO: 8390474 - DNA, 22 bp, Homo sapiens
ctccagggatgagacagagtag

SEQ ID NO: 8390475 - DNA, 22 bp, Homo sapiens
tttaaaaccaaagaaagcctct

SEQ ID NO: 8390476 - DNA, 22 bp, Homo sapiens
tttaaaaaactagtctgagtct

SEQ ID NO: 8390477 - DNA, 22 bp, Homo sapiens
tttaaaaaactagtctgagtct

SEQ ID NO: 8390478 - DNA, 22 bp, Homo sapiens
tttaaaaaactagtctgagtct

SEQ ID NO: 8390479 - DNA, 22 bp, Homo sapiens
tttaaaaaactagtctgagtct

SEQ ID NO: 8390480 - DNA, 22 bp, Homo sapiens
tttaaattatagttaatgtctg

SEQ ID NO: 8390481 - DNA, 22 bp, Homo sapiens
tttaaatttagaagaaacactg

SEQ ID NO: 8390482 - DNA, 22 bp, Homo sapiens
tttaaattatagttaatgtctg

SEQ ID NO: 8390483 - DNA, 22 bp, Homo sapiens
tttaaattctgtctgccgctta

SEQ ID NO: 8390484 - DNA, 22 bp, Homo sapiens
tttaaatttagaagaaacactg

SEQ ID NO: 8390485 - DNA, 22 bp, Homo sapiens
tttaaatttgtgtttagagggt

SEQ ID NO: 8390486 - DNA, 22 bp, Homo sapiens
tttaaatttagaagaaacactg

SEQ ID NO: 8390487 - DNA, 22 bp, Homo sapiens
tttacattgcattaggtattat

SEQ ID NO: 8390488 - DNA, 17 bp, Homo sapiens
tttagaatacaatgttt

SEQ ID NO: 8390489 - DNA, 22 bp, Homo sapiens
tttacagttaagaaatgttacc

SEQ ID NO: 8390490 - DNA, 22 bp, Homo sapiens
tttacatgagtagcagatgttc

SEQ ID NO: 8390491 - DNA, 22 bp, Homo sapiens
tttacacatacctctttaaagt

SEQ ID NO: 8390492 - DNA, 22 bp, Homo sapiens
tttacacatacctctttaaagt

SEQ ID NO: 8390493 - DNA, 22 bp, Homo sapiens
ctcctctttggggatttacaca

SEQ ID NO: 8390494 - DNA, 22 bp, Homo sapiens
ctcctctgggtcctggtggcca

SEQ ID NO: 8390495 - DNA, 22 bp, Homo sapiens
ctcctctgggtcctggtggcca

SEQ ID NO: 8390496 - DNA, 22 bp, Homo sapiens
ctcctctgtattgattgggact

SEQ ID NO: 8390497 - DNA, 22 bp, Homo sapiens
ctcctctgtctggccctgagcc

SEQ ID NO: 8390498 - DNA, 22 bp, Homo sapiens
ctcctctgtctaccacgagggt

SEQ ID NO: 8390499 - DNA, 22 bp, Homo sapiens
tttagacaggggcaaaataagg

SEQ ID NO: 8390500 - DNA, 22 bp, Homo sapiens
tttagacatagctgaaatcatt

SEQ ID NO: 8390501 - DNA, 22 bp, Homo sapiens
tttagacacactttgtatattt

SEQ ID NO: 8390502 - DNA, 17 bp, Homo sapiens
tttagaatacaatgttt

SEQ ID NO: 8390503 - DNA, 22 bp, Homo sapiens
ctcctctccatcagcgccaccc

SEQ ID NO: 8390504 - DNA, 22 bp, Homo sapiens
ctcctctggcttcctggaggca

SEQ ID NO: 8390505 - DNA, 22 bp, Homo sapiens
ctcctctggcttcctggaggca

SEQ ID NO: 8390506 - DNA, 15 bp, Homo sapiens
ctcctctggcctccc

SEQ ID NO: 8390507 - DNA, 22 bp, Homo sapiens
ctcctctggaaattcctctgcc

SEQ ID NO: 8390508 - DNA, 22 bp, Homo sapiens
ctcctctgcccaaatttgtata

SEQ ID NO: 8390509 - DNA, 22 bp, Homo sapiens
ctcctgggctcaagtgatcctc

SEQ ID NO: 8390510 - DNA, 22 bp, Homo sapiens
ctcctgggaggatgcggacccg

SEQ ID NO: 8390511 - DNA, 22 bp, Homo sapiens
ctcctgggagctgtggcagagc

SEQ ID NO: 8390512 - DNA, 22 bp, Homo sapiens
ctcctgggagcagggatggatg

SEQ ID NO: 8390513 - DNA, 22 bp, Homo sapiens
ctctccactcagcgtcatgtcc

SEQ ID NO: 8390514 - DNA, 22 bp, Homo sapiens
ctctcagaagcttccagtatgg

SEQ ID NO: 8390515 - DNA, 22 bp, Homo sapiens
ctctcagaagtagcacgtgggc

SEQ ID NO: 8390516 - DNA, 19 bp, Homo sapiens
ctctcactcgccacatcct

SEQ ID NO: 8390517 - DNA, 22 bp, Homo sapiens
ctcctgggctgggaactcagcc

SEQ ID NO: 8390518 - DNA, 22 bp, Homo sapiens
ctcctgggctgtcggcgctctg

SEQ ID NO: 8390519 - DNA, 19 bp, Homo sapiens
ctctccagctccagtagct

SEQ ID NO: 8390520 - DNA, 22 bp, Homo sapiens
ctctccagcctttagcccacgc

SEQ ID NO: 8390521 - DNA, 23 bp, Homo sapiens
ctctccccctttgatgttagctc

SEQ ID NO: 8390522 - DNA, 22 bp, Homo sapiens
ctctccccggtacgagcggccg

SEQ ID NO: 8390523 - DNA, 22 bp, Homo sapiens
ctctcccccacagcagccttct

SEQ ID NO: 8390524 - DNA, 22 bp, Homo sapiens
ctctccctatgcctcccaggag

SEQ ID NO: 8390525 - DNA, 22 bp, Homo sapiens
tttcagttgttttagctctgtg

SEQ ID NO: 8390526 - DNA, 22 bp, Homo sapiens
tttcagttgtcctgttaatagc

SEQ ID NO: 8390527 - DNA, 22 bp, Homo sapiens
tttcagttgtcctgttaatagc

SEQ ID NO: 8390528 - DNA, 22 bp, Homo sapiens
tttcagttctgtacaagtccag

SEQ ID NO: 8390529 - DNA, 23 bp, Homo sapiens
tttcagttccagaaaaggggagc

SEQ ID NO: 8390530 - DNA, 22 bp, Homo sapiens
tttcagttgccaagctaattct

SEQ ID NO: 8390531 - DNA, 20 bp, Homo sapiens
tttcagttggttaatggcat

SEQ ID NO: 8390532 - DNA, 22 bp, Homo sapiens
tttcagttgcagtggttgtcta

SEQ ID NO: 8390533 - DNA, 22 bp, Homo sapiens
tttcagttgattgcttgggtta

SEQ ID NO: 8390534 - DNA, 23 bp, Homo sapiens
tttcagttgagaatgcacggacc

SEQ ID NO: 8390535 - DNA, 22 bp, Homo sapiens
ctctccaggagagcactttgag

SEQ ID NO: 8390536 - DNA, 22 bp, Homo sapiens
ctctccaggactttggcccaat

SEQ ID NO: 8390537 - DNA, 22 bp, Homo sapiens
tttcagttaagtggctagtccc

SEQ ID NO: 8390538 - DNA, 22 bp, Homo sapiens
tttcagttactgctatatcatt

SEQ ID NO: 8390539 - DNA, 22 bp, Homo sapiens
ctggctctaagtgtcagctccc

SEQ ID NO: 8390540 - DNA, 22 bp, Homo sapiens
ctggctctctgatttcacattc

SEQ ID NO: 8390541 - DNA, 22 bp, Homo sapiens
ctggctctattccctaaggatg

SEQ ID NO: 8390542 - DNA, 22 bp, Homo sapiens
ctggctctatctccaaggctgg

SEQ ID NO: 8390543 - DNA, 22 bp, Homo sapiens
ctggctctgtgggacctggcct

SEQ ID NO: 8390544 - DNA, 22 bp, Homo sapiens
ctggctctgtggcttccttcat

SEQ ID NO: 8390545 - DNA, 22 bp, Homo sapiens
ctggctctgtcaccctttctcc

SEQ ID NO: 8390546 - DNA, 22 bp, Homo sapiens
ctggctctgggcctcagacact

SEQ ID NO: 8390547 - DNA, 22 bp, Homo sapiens
ctggctctgcaacccccacaca

SEQ ID NO: 8390548 - DNA, 22 bp, Homo sapiens
ctggctctgagtggtatcttga

SEQ ID NO: 8390549 - DNA, 22 bp, Homo sapiens
ctggctccctcgctgaggtgct

SEQ ID NO: 8390550 - DNA, 22 bp, Homo sapiens
ctggctcctccaaggcctggag

SEQ ID NO: 8390551 - DNA, 22 bp, Homo sapiens
ctggctccctggacatggggcc

SEQ ID NO: 8390552 - DNA, 22 bp, Homo sapiens
ctggctccctggacatggggcc

SEQ ID NO: 8390553 - DNA, 22 bp, Homo sapiens
ctggcctggggcctcagctgct

SEQ ID NO: 8390554 - DNA, 22 bp, Homo sapiens
ctggcctggcgcagtggctcac

SEQ ID NO: 8390555 - DNA, 22 bp, Homo sapiens
ctggcctgagcacagcggctgc

SEQ ID NO: 8390556 - DNA, 22 bp, Homo sapiens
ctggcctgaggccgccttcaga

SEQ ID NO: 8390557 - DNA, 22 bp, Homo sapiens
ctggcctggagcctctgggtgg

SEQ ID NO: 8390558 - DNA, 22 bp, Homo sapiens
ctggcctggcagggagggcatg

SEQ ID NO: 8390559 - DNA, 22 bp, Homo sapiens
ctggcctgaggtcggctgtagg

SEQ ID NO: 8390560 - DNA, 22 bp, Homo sapiens
ctggcctgcagatcccagggtc

SEQ ID NO: 8390561 - DNA, 22 bp, Homo sapiens
ctggcccagagctctggccttt

SEQ ID NO: 8390562 - DNA, 22 bp, Homo sapiens
ctggcccaggaagacgtgtccc

SEQ ID NO: 8390563 - DNA, 22 bp, Homo sapiens
ctggcccaggagagcaggcatt

SEQ ID NO: 8390564 - DNA, 20 bp, Homo sapiens
ctggcccaggatgatggcgc

SEQ ID NO: 8390565 - DNA, 22 bp, Homo sapiens
ctggcccaggctcctggggcac

SEQ ID NO: 8390566 - DNA, 23 bp, Homo sapiens
ctggcccaggtgagaggttggtg

SEQ ID NO: 8390567 - DNA, 21 bp, Homo sapiens
ctggcccagggatctgcattt

SEQ ID NO: 8390568 - DNA, 22 bp, Homo sapiens
ctggcccagagagcagagctta

SEQ ID NO: 8390569 - DNA, 22 bp, Homo sapiens
ctggccagttgtcctggcttgg

SEQ ID NO: 8390570 - DNA, 22 bp, Homo sapiens
ctggccagttgtcctggcttgg

SEQ ID NO: 8390571 - DNA, 22 bp, Homo sapiens
ctggccagtgtggctctgatct

SEQ ID NO: 8390572 - DNA, 22 bp, Homo sapiens
ctggccagttactgctattggc

SEQ ID NO: 8390573 - DNA, 22 bp, Homo sapiens
ctggcagcattaacagagagca

SEQ ID NO: 8390574 - DNA, 22 bp, Homo sapiens
ctggcagcattaacagagagca

SEQ ID NO: 8390575 - DNA, 22 bp, Homo sapiens
ctggcagcatggagcctgtgct

SEQ ID NO: 8390576 - DNA, 22 bp, Homo sapiens
ctggcagggtgggctttgcttt

SEQ ID NO: 8390577 - DNA, 22 bp, Homo sapiens
ctggcagtgacattgcaggtgc

SEQ ID NO: 8390578 - DNA, 22 bp, Homo sapiens
ctggcagtgagctggccactca

SEQ ID NO: 8390579 - DNA, 22 bp, Homo sapiens
ctggccaggctctcacgtggtc

SEQ ID NO: 8390580 - DNA, 22 bp, Homo sapiens
ctggccaacatctggggcacat

SEQ ID NO: 8390581 - DNA, 22 bp, Homo sapiens
ctggcagaggatggggacccag

SEQ ID NO: 8390582 - DNA, 22 bp, Homo sapiens
ctggcagagtctgctgtctgca

SEQ ID NO: 8390583 - DNA, 22 bp, Homo sapiens
ctggcagagttgggtctcaaat

SEQ ID NO: 8390584 - DNA, 22 bp, Homo sapiens
ctggcagatagccacgcctgtc

SEQ ID NO: 8390585 - DNA, 22 bp, Homo sapiens
ctggcagatagtaagtgatcaa

SEQ ID NO: 8390586 - DNA, 22 bp, Homo sapiens
ctggcagcagcttctggatcga

SEQ ID NO: 8390587 - DNA, 22 bp, Homo sapiens
ctggcagcagagctcaacatag

SEQ ID NO: 8390588 - DNA, 22 bp, Homo sapiens
ctggcagattggggtcagcagt

SEQ ID NO: 8390589 - DNA, 22 bp, Homo sapiens
ctggcacatgtgagccacatca

SEQ ID NO: 8390590 - DNA, 22 bp, Homo sapiens
ctggcacatagtcagcactcaa

SEQ ID NO: 8390591 - DNA, 22 bp, Homo sapiens
ctggatggtcccatgagcagct

SEQ ID NO: 8390592 - DNA, 22 bp, Homo sapiens
ctggataagagttttacttcct

SEQ ID NO: 8390593 - DNA, 22 bp, Homo sapiens
ctggataaatgtttgctttaga

SEQ ID NO: 8390594 - DNA, 22 bp, Homo sapiens
ctggcaagaaatatatatctta

SEQ ID NO: 8390595 - DNA, 22 bp, Homo sapiens
ctggcaagaaatatatatctta

SEQ ID NO: 8390596 - DNA, 22 bp, Homo sapiens
ctggattaagtaaaatagagga

SEQ ID NO: 8390597 - DNA, 18 bp, Homo sapiens
ctggattaagacagtgct

SEQ ID NO: 8390598 - DNA, 21 bp, Homo sapiens
ctggagggtagagttgggctg

SEQ ID NO: 8390599 - DNA, 22 bp, Homo sapiens
ctggagggtgagcctcatctct

SEQ ID NO: 8390600 - DNA, 22 bp, Homo sapiens
ctggagggggaaatgttcattg

SEQ ID NO: 8390601 - DNA, 22 bp, Homo sapiens
ctggagggtggagagaagtctc

SEQ ID NO: 8390602 - DNA, 22 bp, Homo sapiens
ctggaggggctggcatggtagc

SEQ ID NO: 8390603 - DNA, 22 bp, Homo sapiens
ctggaggggccatccacagtct

SEQ ID NO: 8390604 - DNA, 22 bp, Homo sapiens
ctggagggcttctgcaggttac

SEQ ID NO: 8390605 - DNA, 22 bp, Homo sapiens
ctggagggctggactaaggaaa

SEQ ID NO: 8390606 - DNA, 22 bp, Homo sapiens
ctggagggactttctcacggat

SEQ ID NO: 8390607 - DNA, 22 bp, Homo sapiens
ctggagtcagcaaggacgaggc

SEQ ID NO: 8390608 - DNA, 18 bp, Homo sapiens
ctggagtcacagtgggga

SEQ ID NO: 8390609 - DNA, 20 bp, Homo sapiens
ctggagtgtagcagtggctg

SEQ ID NO: 8390610 - DNA, 22 bp, Homo sapiens
ctggagtgtaaagagcatagaa

SEQ ID NO: 8390611 - DNA, 22 bp, Homo sapiens
ctggagtggccggtgctgtggc

SEQ ID NO: 8390612 - DNA, 22 bp, Homo sapiens
ctggagggacaaggtatgcatt

SEQ ID NO: 8390613 - DNA, 22 bp, Homo sapiens
ctggaggcagttgccccagtca

SEQ ID NO: 8390614 - DNA, 21 bp, Homo sapiens
ctggaggcaggtggtgccagg

SEQ ID NO: 8390615 - DNA, 22 bp, Homo sapiens
ctggaggaataatggcatcttg

SEQ ID NO: 8390616 - DNA, 22 bp, Homo sapiens
ctggagctcttctgagtgtgct

SEQ ID NO: 8390617 - DNA, 22 bp, Homo sapiens
ctggactcactatggcttcaga

SEQ ID NO: 8390618 - DNA, 22 bp, Homo sapiens
ctggacagtgggcagaggagac

SEQ ID NO: 8390619 - DNA, 22 bp, Homo sapiens
ctggactttggcccatctgcca

SEQ ID NO: 8390620 - DNA, 22 bp, Homo sapiens
ctggacttaggcaggcaccccg

SEQ ID NO: 8390621 - DNA, 22 bp, Homo sapiens
ctggaaagagatggcagggttt

SEQ ID NO: 8390622 - DNA, 22 bp, Homo sapiens
ctggaaagatttacacggggaa

SEQ ID NO: 8390623 - DNA, 22 bp, Homo sapiens
ctggaaagacagagggcatggg

SEQ ID NO: 8390624 - DNA, 20 bp, Homo sapiens
ctggaaaccctgctgatggt

SEQ ID NO: 8390625 - DNA, 22 bp, Homo sapiens
ctggaaaatgaagaagcagagg

SEQ ID NO: 8390626 - DNA, 22 bp, Homo sapiens
ctggaaaccaggcagttaagag

SEQ ID NO: 8390627 - DNA, 22 bp, Homo sapiens
ctggaaaatgaagaagcagagg

SEQ ID NO: 8390628 - DNA, 22 bp, Homo sapiens
ctggacagtgctgcttgagatg

SEQ ID NO: 8390629 - DNA, 22 bp, Homo sapiens
ctggacaggaagaattgggagc

SEQ ID NO: 8390630 - DNA, 22 bp, Homo sapiens
ctggacagccctcactgtgtgc

SEQ ID NO: 8390631 - DNA, 22 bp, Homo sapiens
ctggacagccctcactgtgtgc

SEQ ID NO: 8390632 - DNA, 22 bp, Homo sapiens
ctggacagaagtggctgggcag

SEQ ID NO: 8390633 - DNA, 22 bp, Homo sapiens
ctggaattgcataatatgtcct

SEQ ID NO: 8390634 - DNA, 22 bp, Homo sapiens
ctggaatgttctccagcatggc

SEQ ID NO: 8390635 - DNA, 22 bp, Homo sapiens
ctggacagaaaaggccactgga

SEQ ID NO: 8390636 - DNA, 22 bp, Homo sapiens
ctggacaaccacaaggccaata

SEQ ID NO: 8390637 - DNA, 22 bp, Homo sapiens
ctgcttctaagaacctgcagct

SEQ ID NO: 8390638 - DNA, 22 bp, Homo sapiens
ctgcctgggccggccaccctct

SEQ ID NO: 8390639 - DNA, 23 bp, Homo sapiens
ctgcttccttgcttcattgctgg

SEQ ID NO: 8390640 - DNA, 22 bp, Homo sapiens
ctgcctggcccagggatgggcc

SEQ ID NO: 8390641 - DNA, 22 bp, Homo sapiens
ctgcctggaccggcagccctcc

SEQ ID NO: 8390642 - DNA, 22 bp, Homo sapiens
ctgcctggacagctcttacctt

SEQ ID NO: 8390643 - DNA, 22 bp, Homo sapiens
ctgcctggaaggagcaagggga

SEQ ID NO: 8390644 - DNA, 22 bp, Homo sapiens
ctgcctggatgaatggcgcctt

SEQ ID NO: 8390645 - DNA, 22 bp, Homo sapiens
ctgcctggatgaatggcgcctt

SEQ ID NO: 8390646 - DNA, 17 bp, Homo sapiens
ctgcctggagtcccatc

SEQ ID NO: 8390647 - DNA, 17 bp, Homo sapiens
ctgcctggagtcccatc

SEQ ID NO: 8390648 - DNA, 22 bp, Homo sapiens
ctgcctggccacaacccagggt

SEQ ID NO: 8390649 - DNA, 22 bp, Homo sapiens
ctgcctggccacaacccagggt

SEQ ID NO: 8390650 - DNA, 22 bp, Homo sapiens
ctgcctggcatagtctggtcga

SEQ ID NO: 8390651 - DNA, 22 bp, Homo sapiens
ctgcctggcatagtctggtcga

SEQ ID NO: 8390652 - DNA, 22 bp, Homo sapiens
ctctgggcaggaccagtggacc

SEQ ID NO: 8390653 - DNA, 22 bp, Homo sapiens
ctctgggcaggacgccaggcct

SEQ ID NO: 8390654 - DNA, 22 bp, Homo sapiens
ctctgggcaggacgccaggcct

SEQ ID NO: 8390655 - DNA, 22 bp, Homo sapiens
ctctgggccaccgctggtgtat

SEQ ID NO: 8390656 - DNA, 22 bp, Homo sapiens
ctctgggcaccaaagagcagct

SEQ ID NO: 8390657 - DNA, 17 bp, Homo sapiens
ctctgggcagcctgggg

SEQ ID NO: 8390658 - DNA, 18 bp, Homo sapiens
ctctgggagaggcataca

SEQ ID NO: 8390659 - DNA, 22 bp, Homo sapiens
ctctgggcaaagatgcctcatc

SEQ ID NO: 8390660 - DNA, 22 bp, Homo sapiens
ctctgggcaagtttcttcatga

SEQ ID NO: 8390661 - DNA, 22 bp, Homo sapiens
ttttagttgtagttggtgagga

SEQ ID NO: 8390662 - DNA, 22 bp, Homo sapiens
ctctgggctccttcagcccttt

SEQ ID NO: 8390663 - DNA, 22 bp, Homo sapiens
ctctgggctgaatggctgaacc

SEQ ID NO: 8390664 - DNA, 22 bp, Homo sapiens
ttttattctcaagacaatggga

SEQ ID NO: 8390665 - DNA, 22 bp, Homo sapiens
ttttattcatagggatggagag

SEQ ID NO: 8390666 - DNA, 22 bp, Homo sapiens
ttttattctcagctccagagag

SEQ ID NO: 8390667 - DNA, 19 bp, Homo sapiens
ctctggcttccaaagcatc

SEQ ID NO: 8390668 - DNA, 22 bp, Homo sapiens
ctctggcttctaccttgcagtt

SEQ ID NO: 8390669 - DNA, 19 bp, Homo sapiens
ctctggcttccaaagcatc

SEQ ID NO: 8390670 - DNA, 22 bp, Homo sapiens
ctctggctgtttgcagctcaag

SEQ ID NO: 8390671 - DNA, 22 bp, Homo sapiens
ctctggcttagtatgctccaaa

SEQ ID NO: 8390672 - DNA, 22 bp, Homo sapiens
ctctggcttagtatgctccaaa

SEQ ID NO: 8390673 - DNA, 22 bp, Homo sapiens
ctctggctggcacctgatctga

SEQ ID NO: 8390674 - DNA, 22 bp, Homo sapiens
ctctggctggcattgctggact

SEQ ID NO: 8390675 - DNA, 22 bp, Homo sapiens
ctctggctggctgggcctcagt

SEQ ID NO: 8390676 - DNA, 22 bp, Homo sapiens
ctctggctgtcccgatgagcag

SEQ ID NO: 8390677 - DNA, 22 bp, Homo sapiens
ctctggctgtcccgatgagcag

SEQ ID NO: 8390678 - DNA, 22 bp, Homo sapiens
tttgtgaataggttggcttcca

SEQ ID NO: 8390679 - DNA, 20 bp, Homo sapiens
ctctggctccgcgtgaccgc

SEQ ID NO: 8390680 - DNA, 19 bp, Homo sapiens
ctctggctcctgggctgcc

SEQ ID NO: 8390681 - DNA, 22 bp, Homo sapiens
ctctggctgcctctcaggcctg

SEQ ID NO: 8390682 - DNA, 22 bp, Homo sapiens
ctctggctcttgggaaacaggt

SEQ ID NO: 8390683 - DNA, 22 bp, Homo sapiens
ctctggctcttgggaaacaggt

SEQ ID NO: 8390684 - DNA, 22 bp, Homo sapiens
ctctggctctgttgagatttgt

SEQ ID NO: 8390685 - DNA, 22 bp, Homo sapiens
ctctggctctgacagttgatcc

SEQ ID NO: 8390686 - DNA, 22 bp, Homo sapiens
ctctggctggcacctgatctga

SEQ ID NO: 8390687 - DNA, 22 bp, Homo sapiens
ctctggctggcacctgatctga

SEQ ID NO: 8390688 - DNA, 22 bp, Homo sapiens
ctctggctgcggggcgcgtgga

SEQ ID NO: 8390689 - DNA, 22 bp, Homo sapiens
ctctggctgcctctcaggcctg

SEQ ID NO: 8390690 - DNA, 22 bp, Homo sapiens
tttgtgaataggttggcttcca

SEQ ID NO: 8390691 - DNA, 22 bp, Homo sapiens
tttgtctttcccctcctcattg

SEQ ID NO: 8390692 - DNA, 22 bp, Homo sapiens
tttgtcttgtaagttaaattca

SEQ ID NO: 8390693 - DNA, 22 bp, Homo sapiens
tttgtctttcccctcctcattg

SEQ ID NO: 8390694 - DNA, 22 bp, Homo sapiens
ctgaagatgtctgagatgctca

SEQ ID NO: 8390695 - DNA, 22 bp, Homo sapiens
ctgaagatgctggagcatgggt

SEQ ID NO: 8390696 - DNA, 22 bp, Homo sapiens
ctgaagatgatgatactaagga

SEQ ID NO: 8390697 - DNA, 17 bp, Homo sapiens
ctgaagataatggcaac

SEQ ID NO: 8390698 - DNA, 22 bp, Homo sapiens
ctgaagatagtgtctgatcatg

SEQ ID NO: 8390699 - DNA, 22 bp, Homo sapiens
ctgagaaattctttctttcact

SEQ ID NO: 8390700 - DNA, 22 bp, Homo sapiens
ctgagaagcactgtctgcaaga

SEQ ID NO: 8390701 - DNA, 22 bp, Homo sapiens
ctgagaagcactgtctgcaaga

SEQ ID NO: 8390702 - DNA, 22 bp, Homo sapiens
ctgagaaggaagcctccactct

SEQ ID NO: 8390703 - DNA, 22 bp, Homo sapiens
ctgagaaatacccaagtctggt

SEQ ID NO: 8390704 - DNA, 22 bp, Homo sapiens
ctgagaaatacccaagtctggt

SEQ ID NO: 8390705 - DNA, 22 bp, Homo sapiens
ctgagaaatgcatttttccagc

SEQ ID NO: 8390706 - DNA, 22 bp, Homo sapiens
ctgagaaattctttctttcact

SEQ ID NO: 8390707 - DNA, 22 bp, Homo sapiens
ctgagaaagtttatgtttattt

SEQ ID NO: 8390708 - DNA, 22 bp, Homo sapiens
ctgacttcagggataaaaagta

SEQ ID NO: 8390709 - DNA, 22 bp, Homo sapiens
ctgagaaagtgagggttaaaca

SEQ ID NO: 8390710 - DNA, 22 bp, Homo sapiens
ctgaacttattgagtgcttgct

SEQ ID NO: 8390711 - DNA, 22 bp, Homo sapiens
ctgaaagcaaatacatgaatct

SEQ ID NO: 8390712 - DNA, 22 bp, Homo sapiens
ctctggtcctttatggtttcca

SEQ ID NO: 8390713 - DNA, 22 bp, Homo sapiens
ctctttggcccccgatgattca

SEQ ID NO: 8390714 - DNA, 22 bp, Homo sapiens
ctctttggcccccgatgattca

SEQ ID NO: 8390715 - DNA, 22 bp, Homo sapiens
ctctgggttctggcctgcaccc

SEQ ID NO: 8390716 - DNA, 22 bp, Homo sapiens
ctcttttcaaacctgtttatgg

SEQ ID NO: 8390717 - DNA, 17 bp, Homo sapiens
ctcttttgtcttcttcc

SEQ ID NO: 8390718 - DNA, 19 bp, Homo sapiens
ctgaaaaacattctcagga

SEQ ID NO: 8390719 - DNA, 22 bp, Homo sapiens
tttttaagagtctggaaatagt

SEQ ID NO: 8390720 - DNA, 22 bp, Homo sapiens
tttttaagctcctttgatgtca

SEQ ID NO: 8390721 - DNA, 22 bp, Homo sapiens
tttttaagctcctttgatgtca

SEQ ID NO: 8390722 - DNA, 22 bp, Homo sapiens
tttttaatgcagtctgagacat

SEQ ID NO: 8390723 - DNA, 22 bp, Homo sapiens
ttttgtttgtgtccactgcagt

SEQ ID NO: 8390724 - DNA, 22 bp, Homo sapiens
ctgaggagtgggtgggcagtga

SEQ ID NO: 8390725 - DNA, 22 bp, Homo sapiens
ctgaggaggggcctgagtgaga

SEQ ID NO: 8390726 - DNA, 22 bp, Homo sapiens
ctgaggagttggtgaataagcc

SEQ ID NO: 8390727 - DNA, 22 bp, Homo sapiens
ctgaggcactaacaaggacaag

SEQ ID NO: 8390728 - DNA, 22 bp, Homo sapiens
ctgaggcacctacagtctcggg

SEQ ID NO: 8390729 - DNA, 22 bp, Homo sapiens
ctgaggcactggtaatgggcat

SEQ ID NO: 8390730 - DNA, 22 bp, Homo sapiens
ctgaggcactgtcagctgaggc

SEQ ID NO: 8390731 - DNA, 22 bp, Homo sapiens
ctgaggcactgtcagctgaggc

SEQ ID NO: 8390732 - DNA, 22 bp, Homo sapiens
ctgaggcagaaaaagcaagggt

SEQ ID NO: 8390733 - DNA, 22 bp, Homo sapiens
ctgaggagaacaatgagatcaa

SEQ ID NO: 8390734 - DNA, 22 bp, Homo sapiens
ctgaggagaaatgggatggttc

SEQ ID NO: 8390735 - DNA, 22 bp, Homo sapiens
ctgaggagaaagatggtccaag

SEQ ID NO: 8390736 - DNA, 22 bp, Homo sapiens
ctgaggagaaagatggtccaag

SEQ ID NO: 8390737 - DNA, 22 bp, Homo sapiens
ctgagagagtaaagtagaatta

SEQ ID NO: 8390738 - DNA, 22 bp, Homo sapiens
ctgagacatggtttgactggca

SEQ ID NO: 8390739 - DNA, 22 bp, Homo sapiens
ctgagacatggtttgactggca

SEQ ID NO: 8390740 - DNA, 22 bp, Homo sapiens
ctgagacaggagaatggcgtga

SEQ ID NO: 8390741 - DNA, 22 bp, Homo sapiens
ctgagacacggagaggctgtgt

SEQ ID NO: 8390742 - DNA, 22 bp, Homo sapiens
ctgagagaaacatgactcagga

SEQ ID NO: 8390743 - DNA, 22 bp, Homo sapiens
ctgattctcctcaagactttcg

SEQ ID NO: 8390744 - DNA, 17 bp, Homo sapiens
ctgatttattagcagac

SEQ ID NO: 8390745 - DNA, 22 bp, Homo sapiens
ctgcagagctaggctgagtgaa

SEQ ID NO: 8390746 - DNA, 22 bp, Homo sapiens
ctgcagagcataaatctgaata

SEQ ID NO: 8390747 - DNA, 22 bp, Homo sapiens
ctgcagagcatgaggaggtctg

SEQ ID NO: 8390748 - DNA, 22 bp, Homo sapiens
ctgatgcccctggacctgtgac

SEQ ID NO: 8390749 - DNA, 22 bp, Homo sapiens
ctgatgcaaccagcatatggaa

SEQ ID NO: 8390750 - DNA, 22 bp, Homo sapiens
ctgagtaagtgtatgatgctgg

SEQ ID NO: 8390751 - DNA, 22 bp, Homo sapiens
ctgaggcagaaaaagcaagggt

SEQ ID NO: 8390752 - DNA, 22 bp, Homo sapiens
ctgatctgtcctcctcagagcc

SEQ ID NO: 8390753 - DNA, 22 bp, Homo sapiens
ctgatgaccttggcaagtcaca

SEQ ID NO: 8390754 - DNA, 22 bp, Homo sapiens
ctgagtccttgggcttagagtg

SEQ ID NO: 8390755 - DNA, 22 bp, Homo sapiens
ctgcagcaggaggctcctgcag

SEQ ID NO: 8390756 - DNA, 22 bp, Homo sapiens
ctgcagcagcctccagccttgg

SEQ ID NO: 8390757 - DNA, 22 bp, Homo sapiens
ctgcagcagcctccagccttgg

SEQ ID NO: 8390758 - DNA, 22 bp, Homo sapiens
ctgcagcagaataatctgctca

SEQ ID NO: 8390759 - DNA, 21 bp, Homo sapiens
ctgcagcaaaactttgctcct

SEQ ID NO: 8390760 - DNA, 22 bp, Homo sapiens
ctgcagcaaatgttaagtgact

SEQ ID NO: 8390761 - DNA, 22 bp, Homo sapiens
ctgcagagggtttgagcatcct

SEQ ID NO: 8390762 - DNA, 22 bp, Homo sapiens
ctgccaggcgatggattggctg

SEQ ID NO: 8390763 - DNA, 22 bp, Homo sapiens
ctgccaggctgtcccaggtccg

SEQ ID NO: 8390764 - DNA, 22 bp, Homo sapiens
ctgccagggaggctgggaagtt

SEQ ID NO: 8390765 - DNA, 22 bp, Homo sapiens
ctgccagggccctactcagttt

SEQ ID NO: 8390766 - DNA, 22 bp, Homo sapiens
ctgccagggcatcctgtggtgg

SEQ ID NO: 8390767 - DNA, 22 bp, Homo sapiens
ctgccagggcatcctgtggtgg

SEQ ID NO: 8390768 - DNA, 22 bp, Homo sapiens
ctgccaggggcctcacaggcca

SEQ ID NO: 8390769 - DNA, 22 bp, Homo sapiens
ctgccaggcctggggtgctgtc

SEQ ID NO: 8390770 - DNA, 22 bp, Homo sapiens
ctgccaggcctggggtgctgtc

SEQ ID NO: 8390771 - DNA, 22 bp, Homo sapiens
ctgccaggcctccgctgtcccc

SEQ ID NO: 8390772 - DNA, 22 bp, Homo sapiens
ctgccaggcctccgctgtcccc

SEQ ID NO: 8390773 - DNA, 23 bp, Homo sapiens
ctgcagccgcgtggggacgtgga

SEQ ID NO: 8390774 - DNA, 22 bp, Homo sapiens
ctgcagcatcctagggtctgtg

SEQ ID NO: 8390775 - DNA, 22 bp, Homo sapiens
ctgcagcagtgtgtctcatttt

SEQ ID NO: 8390776 - DNA, 22 bp, Homo sapiens
ctgcctccaggctcaccttgac

SEQ ID NO: 8390777 - DNA, 22 bp, Homo sapiens
ctgcctcatgctgcctgcagcc

SEQ ID NO: 8390778 - DNA, 22 bp, Homo sapiens
ctgcctctataggagtccacca

SEQ ID NO: 8390779 - DNA, 22 bp, Homo sapiens
ctgcctctataggagtccacca

SEQ ID NO: 8390780 - DNA, 22 bp, Homo sapiens
ctgcctcctgccgtgcagcttc

SEQ ID NO: 8390781 - DNA, 22 bp, Homo sapiens
ctgccgtgtttttcatgttaaa

SEQ ID NO: 8390782 - DNA, 22 bp, Homo sapiens
ctgccatgctcaagaagtcttt

SEQ ID NO: 8390783 - DNA, 22 bp, Homo sapiens
ctgccctggggggcctccttgc

SEQ ID NO: 8390784 - DNA, 22 bp, Homo sapiens
ctgccatctgagggtccagcct

SEQ ID NO: 8390785 - DNA, 22 bp, Homo sapiens
ctgccatcctcaccagagcagc

SEQ ID NO: 8390786 - DNA, 22 bp, Homo sapiens
ctgccatcctcaccagagcagc

SEQ ID NO: 8390787 - DNA, 22 bp, Homo sapiens
ctgccaggtgagctccaggcct

SEQ ID NO: 8390788 - DNA, 22 bp, Homo sapiens
ctgccaggtgccagggcgcggc

SEQ ID NO: 8390789 - DNA, 22 bp, Homo sapiens
tgtctcttgagtttgttttaat

SEQ ID NO: 8390790 - DNA, 22 bp, Homo sapiens
tgtctcttgagctgcctgatgc

SEQ ID NO: 8390791 - DNA, 22 bp, Homo sapiens
tgtctcttggctctatcactta

SEQ ID NO: 8390792 - DNA, 22 bp, Homo sapiens
tgtctcttggctctatcactta

SEQ ID NO: 8390793 - DNA, 22 bp, Homo sapiens
tgtctcttctgcctccagctgt

SEQ ID NO: 8390794 - DNA, 22 bp, Homo sapiens
tgtctcttcagcccatggcttc

SEQ ID NO: 8390795 - DNA, 22 bp, Homo sapiens
tgtctctgtgagatctgacgat

SEQ ID NO: 8390796 - DNA, 22 bp, Homo sapiens
tgtctctgtgcatttgtgcttc

SEQ ID NO: 8390797 - DNA, 22 bp, Homo sapiens
tgtctctgtgagatctgacgat

SEQ ID NO: 8390798 - DNA, 22 bp, Homo sapiens
tgtctctgtgcatttgtgcttc

SEQ ID NO: 8390799 - DNA, 22 bp, Homo sapiens
tgtctctgtgcatttgtgcttc

SEQ ID NO: 8390800 - DNA, 22 bp, Homo sapiens
tgtctcttactttgattcttgg

SEQ ID NO: 8390801 - DNA, 22 bp, Homo sapiens
tgtctctggcccatgagcagag

SEQ ID NO: 8390802 - DNA, 22 bp, Homo sapiens
tgtctctgggtgattcagtcct

SEQ ID NO: 8390803 - DNA, 22 bp, Homo sapiens
tgtctctgtgactccttccgcc

SEQ ID NO: 8390804 - DNA, 22 bp, Homo sapiens
tgtctcaggcccaagccagtaa

SEQ ID NO: 8390805 - DNA, 22 bp, Homo sapiens
tgtctcagagtgttgtattaga

SEQ ID NO: 8390806 - DNA, 23 bp, Homo sapiens
tgtctcagactgaggggtttccc

SEQ ID NO: 8390807 - DNA, 22 bp, Homo sapiens
tgtctattaattccacataaaa

SEQ ID NO: 8390808 - DNA, 22 bp, Homo sapiens
tgtctatttgaattatcctaat

SEQ ID NO: 8390809 - DNA, 22 bp, Homo sapiens
tgtctatttgaattatcctaat

SEQ ID NO: 8390810 - DNA, 22 bp, Homo sapiens
tgtcctctgttaggggatagcg

SEQ ID NO: 8390811 - DNA, 22 bp, Homo sapiens
tgtcctggagtgcttgggggaa

SEQ ID NO: 8390812 - DNA, 22 bp, Homo sapiens
tgtcctggatcatgcctctgaa

SEQ ID NO: 8390813 - DNA, 22 bp, Homo sapiens
tgtcctggagacacaaggtggt

SEQ ID NO: 8390814 - DNA, 19 bp, Homo sapiens
cctggccctgctgcgcggg

SEQ ID NO: 8390815 - DNA, 22 bp, Homo sapiens
cctggcctcctggccttctcat

SEQ ID NO: 8390816 - DNA, 22 bp, Homo sapiens
cctggcctggcactccctctgc

SEQ ID NO: 8390817 - DNA, 22 bp, Homo sapiens
cctggcctctccgagtaacctg

SEQ ID NO: 8390818 - DNA, 22 bp, Homo sapiens
cctggcctgtgaatctgagagc

SEQ ID NO: 8390819 - DNA, 22 bp, Homo sapiens
cctggctccagctgcctgtcct

SEQ ID NO: 8390820 - DNA, 22 bp, Homo sapiens
cctggctcccggaacagggtct

SEQ ID NO: 8390821 - DNA, 22 bp, Homo sapiens
cctggctccggttcaagggaaa

SEQ ID NO: 8390822 - DNA, 22 bp, Homo sapiens
cctggctccgtgtcacgtgccc

SEQ ID NO: 8390823 - DNA, 22 bp, Homo sapiens
cctggctccctgcacagggctc

SEQ ID NO: 8390824 - DNA, 22 bp, Homo sapiens
cctggctccctgcacagggctc

SEQ ID NO: 8390825 - DNA, 22 bp, Homo sapiens
cctggctcctgcctctgcaggg

SEQ ID NO: 8390826 - DNA, 22 bp, Homo sapiens
cctggctctagaggccactcct

SEQ ID NO: 8390827 - DNA, 22 bp, Homo sapiens
cctggctctgaagtccacatca

SEQ ID NO: 8390828 - DNA, 22 bp, Homo sapiens
cctggctctagaggccactcct

SEQ ID NO: 8390829 - DNA, 22 bp, Homo sapiens
cctggctcgctgacctcagggg

SEQ ID NO: 8390830 - DNA, 22 bp, Homo sapiens
cctggctcgctgacctcagggg

SEQ ID NO: 8390831 - DNA, 22 bp, Homo sapiens
cctggcagtcaggggagtcctt

SEQ ID NO: 8390832 - DNA, 22 bp, Homo sapiens
cctggcaggtggaggttgcagt

SEQ ID NO: 8390833 - DNA, 22 bp, Homo sapiens
cctggcaggtggcgccctcggc

SEQ ID NO: 8390834 - DNA, 22 bp, Homo sapiens
cctggcaggtagcattgaggag

SEQ ID NO: 8390835 - DNA, 22 bp, Homo sapiens
cctggcaggtagcattgaggag

SEQ ID NO: 8390836 - DNA, 22 bp, Homo sapiens
cctggcaggctggggacagtgc

SEQ ID NO: 8390837 - DNA, 20 bp, Homo sapiens
cctggcaggcgggttactta

SEQ ID NO: 8390838 - DNA, 20 bp, Homo sapiens
cctggcaggcgggttactta

SEQ ID NO: 8390839 - DNA, 22 bp, Homo sapiens
cctggcaggctggggacagtgc

SEQ ID NO: 8390840 - DNA, 22 bp, Homo sapiens
cctggcaggctggggacagtgc

SEQ ID NO: 8390841 - DNA, 22 bp, Homo sapiens
cctggcaggcaagaggaaggga

SEQ ID NO: 8390842 - DNA, 22 bp, Homo sapiens
cctggcaggactgttgtaagaa

SEQ ID NO: 8390843 - DNA, 22 bp, Homo sapiens
cctggcaggactgttgtaagaa

SEQ ID NO: 8390844 - DNA, 22 bp, Homo sapiens
cctggcaggcaagaggaaggga

SEQ ID NO: 8390845 - DNA, 22 bp, Homo sapiens
cctggcaggcaagaggaaggga

SEQ ID NO: 8390846 - DNA, 18 bp, Homo sapiens
cctggcagccatgcgcgc

SEQ ID NO: 8390847 - DNA, 22 bp, Homo sapiens
cctggcagcaggtgggcccgtg

SEQ ID NO: 8390848 - DNA, 22 bp, Homo sapiens
cctggcagactgtgagggcagg

SEQ ID NO: 8390849 - DNA, 22 bp, Homo sapiens
cctggcagactgtgagggcagg

SEQ ID NO: 8390850 - DNA, 23 bp, Homo sapiens
cctggcagcaaacgaggaggtta

SEQ ID NO: 8390851 - DNA, 23 bp, Homo sapiens
cctggcagcaaacgaggaggtta

SEQ ID NO: 8390852 - DNA, 23 bp, Homo sapiens
cctggcagcaaacgaggaggtta

SEQ ID NO: 8390853 - DNA, 22 bp, Homo sapiens
tgtcattaaaatgcttctcaaa

SEQ ID NO: 8390854 - DNA, 22 bp, Homo sapiens
tgtcattatttgcctactgact

SEQ ID NO: 8390855 - DNA, 22 bp, Homo sapiens
tgtcattatgaggattacaata

SEQ ID NO: 8390856 - DNA, 22 bp, Homo sapiens
tgtcattagtttcagccattct

SEQ ID NO: 8390857 - DNA, 21 bp, Homo sapiens
tgtcattaatcgctatagaag

SEQ ID NO: 8390858 - DNA, 22 bp, Homo sapiens
tgtcccagcactttgggagtct

SEQ ID NO: 8390859 - DNA, 19 bp, Homo sapiens
tgtcccagactccgtgtct

SEQ ID NO: 8390860 - DNA, 22 bp, Homo sapiens
tgtccatggatagagctgctcg

SEQ ID NO: 8390861 - DNA, 22 bp, Homo sapiens
tgtccatgcgtatccagggagc

SEQ ID NO: 8390862 - DNA, 22 bp, Homo sapiens
tgtccatgggcgtcaggcagga

SEQ ID NO: 8390863 - DNA, 22 bp, Homo sapiens
tgtccatggggaaggggaagtg

SEQ ID NO: 8390864 - DNA, 18 bp, Homo sapiens
tgtccatgttgttcctga

SEQ ID NO: 8390865 - DNA, 22 bp, Homo sapiens
tgtcccaaccctgagaagattc

SEQ ID NO: 8390866 - DNA, 22 bp, Homo sapiens
cctggccatagggcccaggaaa

SEQ ID NO: 8390867 - DNA, 22 bp, Homo sapiens
cctggccagtttccaggccctg

SEQ ID NO: 8390868 - DNA, 22 bp, Homo sapiens
cctggccagggtctgggctgct

SEQ ID NO: 8390869 - DNA, 22 bp, Homo sapiens
cctggccaggctccaagtactg

SEQ ID NO: 8390870 - DNA, 22 bp, Homo sapiens
cctggcagtggtgaagaagagg

SEQ ID NO: 8390871 - DNA, 22 bp, Homo sapiens
cctggcagttcatcaaatggca

SEQ ID NO: 8390872 - DNA, 22 bp, Homo sapiens
tggtgctgataatggcaggatt

SEQ ID NO: 8390873 - DNA, 22 bp, Homo sapiens
tggtgctgacagttctgagtgc

SEQ ID NO: 8390874 - DNA, 22 bp, Homo sapiens
tggtgctgagatgaagtgctcc

SEQ ID NO: 8390875 - DNA, 22 bp, Homo sapiens
tggtctttgtccctccttgatc

SEQ ID NO: 8390876 - DNA, 17 bp, Homo sapiens
cctgcccagagacagat

SEQ ID NO: 8390877 - DNA, 22 bp, Homo sapiens
tggtccgctcctattcgccgca

SEQ ID NO: 8390878 - DNA, 22 bp, Homo sapiens
cctgcccacagagagggtgcat

SEQ ID NO: 8390879 - DNA, 22 bp, Homo sapiens
cctgccatgccagcatgcccgt

SEQ ID NO: 8390880 - DNA, 22 bp, Homo sapiens
tggtcccattgttctgcccagg

SEQ ID NO: 8390881 - DNA, 19 bp, Homo sapiens
tggtcccatactgctggcc

SEQ ID NO: 8390882 - DNA, 23 bp, Homo sapiens
tggtccctgagagctggggaggg

SEQ ID NO: 8390883 - DNA, 22 bp, Homo sapiens
tggtccctaggaaagcagtgtt

SEQ ID NO: 8390884 - DNA, 22 bp, Homo sapiens
tggtccctaggaaagcagtgtt

SEQ ID NO: 8390885 - DNA, 22 bp, Homo sapiens
tggtccctagcacagctgtcct

SEQ ID NO: 8390886 - DNA, 17 bp, Homo sapiens
tggtccaggtggagcca

SEQ ID NO: 8390887 - DNA, 18 bp, Homo sapiens
tggtccagttcagatata

SEQ ID NO: 8390888 - DNA, 22 bp, Homo sapiens
tggtccagtaagggtggagaga

SEQ ID NO: 8390889 - DNA, 22 bp, Homo sapiens
tggtccagtcgttcctttcctt

SEQ ID NO: 8390890 - DNA, 22 bp, Homo sapiens
tggtgctgccacctcctctgct

SEQ ID NO: 8390891 - DNA, 22 bp, Homo sapiens
tggtgctgccaggctcctgcca

SEQ ID NO: 8390892 - DNA, 22 bp, Homo sapiens
tggtgctgccacctcctctgct

SEQ ID NO: 8390893 - DNA, 22 bp, Homo sapiens
tggtgctgtgatacgaggcact

SEQ ID NO: 8390894 - DNA, 22 bp, Homo sapiens
tggtggcttctgaggatggcga

SEQ ID NO: 8390895 - DNA, 17 bp, Homo sapiens
tggtggctggagtcagg

SEQ ID NO: 8390896 - DNA, 17 bp, Homo sapiens
tggtggctggagtcagg

SEQ ID NO: 8390897 - DNA, 22 bp, Homo sapiens
tggtggctaccaggtcctgggg

SEQ ID NO: 8390898 - DNA, 22 bp, Homo sapiens
cctggacttgatattctctttc

SEQ ID NO: 8390899 - DNA, 22 bp, Homo sapiens
cctggactttcaggactactgt

SEQ ID NO: 8390900 - DNA, 22 bp, Homo sapiens
cctggactttcatttccccttg

SEQ ID NO: 8390901 - DNA, 23 bp, Homo sapiens
tggtggcttgtggtggccaccag

SEQ ID NO: 8390902 - DNA, 21 bp, Homo sapiens
cctggactgggagcagcactg

SEQ ID NO: 8390903 - DNA, 22 bp, Homo sapiens
cctggagagctcgggccaggca

SEQ ID NO: 8390904 - DNA, 22 bp, Homo sapiens
tgtaaacagtaggactaaagag

SEQ ID NO: 8390905 - DNA, 22 bp, Homo sapiens
cctggagacgaggctggaccat

SEQ ID NO: 8390906 - DNA, 22 bp, Homo sapiens
cctggagcacatggcaggaggc

SEQ ID NO: 8390907 - DNA, 22 bp, Homo sapiens
cctggcacatagcaacccctcc

SEQ ID NO: 8390908 - DNA, 22 bp, Homo sapiens
cctggcacatagtgggcatgca

SEQ ID NO: 8390909 - DNA, 22 bp, Homo sapiens
cctggagcacatggcaggaggc

SEQ ID NO: 8390910 - DNA, 22 bp, Homo sapiens
cctggagaggcgctgcagagga

SEQ ID NO: 8390911 - DNA, 22 bp, Homo sapiens
cctggagaggcgctgcagagga

SEQ ID NO: 8390912 - DNA, 22 bp, Homo sapiens
cctggagattatttggtccaat

SEQ ID NO: 8390913 - DNA, 22 bp, Homo sapiens
tgtagtagcattcacgaagtgt

SEQ ID NO: 8390914 - DNA, 22 bp, Homo sapiens
tgtagtcacaaaaactgtaagc

SEQ ID NO: 8390915 - DNA, 22 bp, Homo sapiens
tgtaaacatatgtatgtatgta

SEQ ID NO: 8390916 - DNA, 22 bp, Homo sapiens
tgtaaagaaatagcatttgtag

SEQ ID NO: 8390917 - DNA, 23 bp, Homo sapiens
tgtaccaggagtttcagcagact

SEQ ID NO: 8390918 - DNA, 20 bp, Homo sapiens
tgtaggtgtacagtaaggag

SEQ ID NO: 8390919 - DNA, 23 bp, Homo sapiens
tgtaggcagtacagttgtaaatg

SEQ ID NO: 8390920 - DNA, 22 bp, Homo sapiens
tgtaggcacatgtatatatccc

SEQ ID NO: 8390921 - DNA, 22 bp, Homo sapiens
tgtaggcatcactttctcttgg

SEQ ID NO: 8390922 - DNA, 22 bp, Homo sapiens
tgtaggcatattcatagagttg

SEQ ID NO: 8390923 - DNA, 22 bp, Homo sapiens
tgtcatgccaccgtttcccaga

SEQ ID NO: 8390924 - DNA, 20 bp, Homo sapiens
tgtcatgcattagatgaaga

SEQ ID NO: 8390925 - DNA, 22 bp, Homo sapiens
tgtcatgtctgtaaatacacca

SEQ ID NO: 8390926 - DNA, 22 bp, Homo sapiens
tgtattcagggacatatatgta

SEQ ID NO: 8390927 - DNA, 22 bp, Homo sapiens
tgtattaacattaataaaatgg

SEQ ID NO: 8390928 - DNA, 22 bp, Homo sapiens
tgtattaacattaataaaatgg

SEQ ID NO: 8390929 - DNA, 22 bp, Homo sapiens
cctggcactgaccaggcactga

SEQ ID NO: 8390930 - DNA, 22 bp, Homo sapiens
cctggcacatgcagtactcaag

SEQ ID NO: 8390931 - DNA, 22 bp, Homo sapiens
cctggcacgaagggctgaggtt

SEQ ID NO: 8390932 - DNA, 22 bp, Homo sapiens
cctggcagacagcactgaagct

SEQ ID NO: 8390933 - DNA, 22 bp, Homo sapiens
cctggcagacagcactgaagct

SEQ ID NO: 8390934 - DNA, 22 bp, Homo sapiens
cctggcagaatattaaagtgca

SEQ ID NO: 8390935 - DNA, 22 bp, Homo sapiens
cctggcagaatattaaagtgca

SEQ ID NO: 8390936 - DNA, 22 bp, Homo sapiens
tgtggaaaaaccacaagtttgg

SEQ ID NO: 8390937 - DNA, 20 bp, Homo sapiens
tgtggcaggatgagggcgga

SEQ ID NO: 8390938 - DNA, 22 bp, Homo sapiens
tgtgctttggttttacaggatg

SEQ ID NO: 8390939 - DNA, 22 bp, Homo sapiens
tgtgctttcaaagttaagtaaa

SEQ ID NO: 8390940 - DNA, 22 bp, Homo sapiens
tgtggcaggatgcggaagatgc

SEQ ID NO: 8390941 - DNA, 20 bp, Homo sapiens
tgtggcaggatgagggcgga

SEQ ID NO: 8390942 - DNA, 20 bp, Homo sapiens
tgtggcaggatgagggcgga

SEQ ID NO: 8390943 - DNA, 22 bp, Homo sapiens
tgtggcaggcaagatgtacaga

SEQ ID NO: 8390944 - DNA, 22 bp, Homo sapiens
tgtggcaggcattctgaggctg

SEQ ID NO: 8390945 - DNA, 22 bp, Homo sapiens
tgtggcaggcattctgaggctg

SEQ ID NO: 8390946 - DNA, 18 bp, Homo sapiens
tgtggcaggggtgggaga

SEQ ID NO: 8390947 - DNA, 18 bp, Homo sapiens
tgtggcaggggtgggaga

SEQ ID NO: 8390948 - DNA, 22 bp, Homo sapiens
tgtggcagggatactgaggcag

SEQ ID NO: 8390949 - DNA, 22 bp, Homo sapiens
tgtggcagggatactgaggcag

SEQ ID NO: 8390950 - DNA, 22 bp, Homo sapiens
tgtgggaaatgggagtggaaga

SEQ ID NO: 8390951 - DNA, 22 bp, Homo sapiens
cctgggagctgtggaaaggctg

SEQ ID NO: 8390952 - DNA, 19 bp, Homo sapiens
cctgggaggcggaggttgc

SEQ ID NO: 8390953 - DNA, 22 bp, Homo sapiens
cctgggcatcaacaagcagaga

SEQ ID NO: 8390954 - DNA, 22 bp, Homo sapiens
cctgggcctcacccagctcttg

SEQ ID NO: 8390955 - DNA, 22 bp, Homo sapiens
cctgggtccctgagagatgatt

SEQ ID NO: 8390956 - DNA, 22 bp, Homo sapiens
cctgggtctgtattggtaggta

SEQ ID NO: 8390957 - DNA, 22 bp, Homo sapiens
cctgggtgatgtgctgccctcg

SEQ ID NO: 8390958 - DNA, 23 bp, Homo sapiens
tgtgttctcacacagatgcagta

SEQ ID NO: 8390959 - DNA, 22 bp, Homo sapiens
cctggggctccagagcagcgga

SEQ ID NO: 8390960 - DNA, 22 bp, Homo sapiens
cctggggacctgcctcagccct

SEQ ID NO: 8390961 - DNA, 22 bp, Homo sapiens
tgtgttcaatccctagtctcag

SEQ ID NO: 8390962 - DNA, 22 bp, Homo sapiens
tgtgtgtcatttagggtggagc

SEQ ID NO: 8390963 - DNA, 22 bp, Homo sapiens
cctgggcctctcaaagtgctgg

SEQ ID NO: 8390964 - DNA, 22 bp, Homo sapiens
tgtgtgtataataatgtctgca

SEQ ID NO: 8390965 - DNA, 21 bp, Homo sapiens
tgtgtgtatgcacacacatgc

SEQ ID NO: 8390966 - DNA, 22 bp, Homo sapiens
cctggggaatcttgcaggggaa

SEQ ID NO: 8390967 - DNA, 22 bp, Homo sapiens
cctggggaatagagtcaagggg

SEQ ID NO: 8390968 - DNA, 20 bp, Homo sapiens
cctgggctcaaagcatcctc

SEQ ID NO: 8390969 - DNA, 20 bp, Homo sapiens
cctgggctcaaagcatcctc

SEQ ID NO: 8390970 - DNA, 20 bp, Homo sapiens
cctgggctcaaagcatcctc

SEQ ID NO: 8390971 - DNA, 22 bp, Homo sapiens
cctgggccttgacctcgtgggc

SEQ ID NO: 8390972 - DNA, 22 bp, Homo sapiens
cctgggctttgctggcaaggcc

SEQ ID NO: 8390973 - DNA, 22 bp, Homo sapiens
cctggctgcattttgctggatg

SEQ ID NO: 8390974 - DNA, 22 bp, Homo sapiens
cctggctgccgagtgtgcagcg

SEQ ID NO: 8390975 - DNA, 22 bp, Homo sapiens
cctggctgtgcattgccggccc

SEQ ID NO: 8390976 - DNA, 22 bp, Homo sapiens
cctggctgtttgagcggggaat

SEQ ID NO: 8390977 - DNA, 22 bp, Homo sapiens
cctggcttccatatggcacata

SEQ ID NO: 8390978 - DNA, 22 bp, Homo sapiens
cctggctgtgtgaccttggcaa

SEQ ID NO: 8390979 - DNA, 22 bp, Homo sapiens
cctggctgtttatttcggggct

SEQ ID NO: 8390980 - DNA, 22 bp, Homo sapiens
cctggcttctgggtctgtgaga

SEQ ID NO: 8390981 - DNA, 22 bp, Homo sapiens
cctggcttctataccaccaggt

SEQ ID NO: 8390982 - DNA, 22 bp, Homo sapiens
tgtgccagcctctggctgtgtc

SEQ ID NO: 8390983 - DNA, 22 bp, Homo sapiens
cctgggaagcccatagcagctt

SEQ ID NO: 8390984 - DNA, 22 bp, Homo sapiens
cctgggaagaccggcagtgggg

SEQ ID NO: 8390985 - DNA, 22 bp, Homo sapiens
cctgggagagctgcccgggtga

SEQ ID NO: 8390986 - DNA, 20 bp, Homo sapiens
tgtgcccagcagaggctgcc

SEQ ID NO: 8390987 - DNA, 20 bp, Homo sapiens
tgtgcccagcagaggctgcc

SEQ ID NO: 8390988 - DNA, 22 bp, Homo sapiens
tgtgcccagactgcctcagtga

SEQ ID NO: 8390989 - DNA, 22 bp, Homo sapiens
tgtgcccatccctctggagtgt

SEQ ID NO: 8390990 - DNA, 22 bp, Homo sapiens
tgtgctggggtccagctgagcc

SEQ ID NO: 8390991 - DNA, 22 bp, Homo sapiens
tgtgcttactttgaattatata

SEQ ID NO: 8390992 - DNA, 19 bp, Homo sapiens
tgtgcttatgtttagatat

SEQ ID NO: 8390993 - DNA, 22 bp, Homo sapiens
tgtgcttctcacatcactgttg

SEQ ID NO: 8390994 - DNA, 22 bp, Homo sapiens
tgtgcttcttgcagctcctgta

SEQ ID NO: 8390995 - DNA, 22 bp, Homo sapiens
tgtgaaggagatgaagggagtg

SEQ ID NO: 8390996 - DNA, 22 bp, Homo sapiens
tgtgaagatttggcatgcagaa

SEQ ID NO: 8390997 - DNA, 22 bp, Homo sapiens
tgtctttagttttactgtctgg

SEQ ID NO: 8390998 - DNA, 22 bp, Homo sapiens
tgtctttatatatttggaaaat

SEQ ID NO: 8390999 - DNA, 22 bp, Homo sapiens
tgtctttatgcacactgacttg

SEQ ID NO: 8391000 - DNA, 22 bp, Homo sapiens
tgtgaggagtaggctgagggtg

SEQ ID NO: 8391001 - DNA, 22 bp, Homo sapiens
tgtgaggagtaggctgagggtg

SEQ ID NO: 8391002 - DNA, 22 bp, Homo sapiens
cctggctgcagtttttgcagaa

SEQ ID NO: 8391003 - DNA, 19 bp, Homo sapiens
cctggctctgagcccagcc

SEQ ID NO: 8391004 - DNA, 19 bp, Homo sapiens
cctggctctgagcccagcc

SEQ ID NO: 8391005 - DNA, 22 bp, Homo sapiens
cctggctcttcagaggttccta

SEQ ID NO: 8391006 - DNA, 22 bp, Homo sapiens
cctggctcttctgtgtcagccc

SEQ ID NO: 8391007 - DNA, 21 bp, Homo sapiens
cctggctgcacagttgctggt

SEQ ID NO: 8391008 - DNA, 22 bp, Homo sapiens
tgtctggtgggttgacaggcag

SEQ ID NO: 8391009 - DNA, 22 bp, Homo sapiens
tgtctttacttagaagttcagg

SEQ ID NO: 8391010 - DNA, 22 bp, Homo sapiens
tgtctttacttaataaatatac

SEQ ID NO: 8391011 - DNA, 22 bp, Homo sapiens
tgtctttagttttactgtctgg

SEQ ID NO: 8391012 - DNA, 22 bp, Homo sapiens
tgtctttagttgcttagatttg

SEQ ID NO: 8391013 - DNA, 22 bp, Homo sapiens
tgtctttagccagcagtcttct

SEQ ID NO: 8391014 - DNA, 22 bp, Homo sapiens
cccaggcagggacgtgctctgg

SEQ ID NO: 8391015 - DNA, 22 bp, Homo sapiens
cccaggcagggacgtgctctgg

SEQ ID NO: 8391016 - DNA, 22 bp, Homo sapiens
cccaggcagtgctgatccctca

SEQ ID NO: 8391017 - DNA, 22 bp, Homo sapiens
cccaggcagtgtgtgcatgcgt

SEQ ID NO: 8391018 - DNA, 22 bp, Homo sapiens
cccaggcagtgtgtgcatgcgt

SEQ ID NO: 8391019 - DNA, 22 bp, Homo sapiens
cccaggcagcccttctgacgca

SEQ ID NO: 8391020 - DNA, 22 bp, Homo sapiens
cccaggcagccccagaagcttg

SEQ ID NO: 8391021 - DNA, 20 bp, Homo sapiens
cccaggcagagctagcggca

SEQ ID NO: 8391022 - DNA, 22 bp, Homo sapiens
cccaggcagccccagaagcttg

SEQ ID NO: 8391023 - DNA, 22 bp, Homo sapiens
cccaggcagcggggtctccttg

SEQ ID NO: 8391024 - DNA, 22 bp, Homo sapiens
cccaggcagcctgcagggaagg

SEQ ID NO: 8391025 - DNA, 22 bp, Homo sapiens
cccaggatgtcgaggctgcagt

SEQ ID NO: 8391026 - DNA, 22 bp, Homo sapiens
cccaggatgtcgaggctgcagt

SEQ ID NO: 8391027 - DNA, 22 bp, Homo sapiens
cccaggagttcgaggctgtagt

SEQ ID NO: 8391028 - DNA, 22 bp, Homo sapiens
cccaggcagaattagtgtttca

SEQ ID NO: 8391029 - DNA, 22 bp, Homo sapiens
cccaggcacatccactctgtga

SEQ ID NO: 8391030 - DNA, 22 bp, Homo sapiens
cccaggcacagattatcccaat

SEQ ID NO: 8391031 - DNA, 22 bp, Homo sapiens
cccaggcacactgaagtgacat

SEQ ID NO: 8391032 - DNA, 22 bp, Homo sapiens
cccaggcacactgaagtgacat

SEQ ID NO: 8391033 - DNA, 22 bp, Homo sapiens
cccaggaggtggaggttgcggt

SEQ ID NO: 8391034 - DNA, 22 bp, Homo sapiens
cccaggaggtgtagctgcgtgg

SEQ ID NO: 8391035 - DNA, 22 bp, Homo sapiens
tgccacagagcaattctgctga

SEQ ID NO: 8391036 - DNA, 22 bp, Homo sapiens
cccaggaggtggaggctgcagt

SEQ ID NO: 8391037 - DNA, 22 bp, Homo sapiens
tgccacagacaggacagaacag

SEQ ID NO: 8391038 - DNA, 22 bp, Homo sapiens
tgccacagacaggacagaacag

SEQ ID NO: 8391039 - DNA, 22 bp, Homo sapiens
tgccacagagactttcattgta

SEQ ID NO: 8391040 - DNA, 22 bp, Homo sapiens
tgccaagggtatgggcaagata

SEQ ID NO: 8391041 - DNA, 22 bp, Homo sapiens
tgcattcaatgtgccagggaaa

SEQ ID NO: 8391042 - DNA, 22 bp, Homo sapiens
tgcattcagttggtcagctttt

SEQ ID NO: 8391043 - DNA, 17 bp, Homo sapiens
cccagctggcagtgccg

SEQ ID NO: 8391044 - DNA, 17 bp, Homo sapiens
cccagctggcagtgccg

SEQ ID NO: 8391045 - DNA, 23 bp, Homo sapiens
cccagctgagacttcctgaactc

SEQ ID NO: 8391046 - DNA, 22 bp, Homo sapiens
cccagctgaacttgcattccaa

SEQ ID NO: 8391047 - DNA, 22 bp, Homo sapiens
cccagctgatttttgcagagat

SEQ ID NO: 8391048 - DNA, 22 bp, Homo sapiens
cccaggaaacccgaaggcgacc

SEQ ID NO: 8391049 - DNA, 22 bp, Homo sapiens
cccaggaaaagcagtgccagca

SEQ ID NO: 8391050 - DNA, 22 bp, Homo sapiens
tgcattaaggccattgaaattt

SEQ ID NO: 8391051 - DNA, 22 bp, Homo sapiens
cccagcctactctgccatagca

SEQ ID NO: 8391052 - DNA, 22 bp, Homo sapiens
cccagcctgtctttcccaatga

SEQ ID NO: 8391053 - DNA, 22 bp, Homo sapiens
cccagcctttgcttcctggttc

SEQ ID NO: 8391054 - DNA, 22 bp, Homo sapiens
cccagctcttcaagtcaccccc

SEQ ID NO: 8391055 - DNA, 22 bp, Homo sapiens
cccagctccgagctccgagccg

SEQ ID NO: 8391056 - DNA, 22 bp, Homo sapiens
tgcagggaggccccgcagccct

SEQ ID NO: 8391057 - DNA, 22 bp, Homo sapiens
cccagctacctctgctaggaga

SEQ ID NO: 8391058 - DNA, 22 bp, Homo sapiens
cccagcgagtttgccggtgaac

SEQ ID NO: 8391059 - DNA, 22 bp, Homo sapiens
cccccaggggctccgcctcgtg

SEQ ID NO: 8391060 - DNA, 22 bp, Homo sapiens
cccccaggctctgacacaggag

SEQ ID NO: 8391061 - DNA, 22 bp, Homo sapiens
cccccaccgtgttcctgctcgg

SEQ ID NO: 8391062 - DNA, 22 bp, Homo sapiens
cccccaccgtgttcctgctcgg

SEQ ID NO: 8391063 - DNA, 22 bp, Homo sapiens
cccctcctggccacactgtcag

SEQ ID NO: 8391064 - DNA, 22 bp, Homo sapiens
cccctcctggccacactgtcag

SEQ ID NO: 8391065 - DNA, 22 bp, Homo sapiens
cccctcctggccacactgtcag

SEQ ID NO: 8391066 - DNA, 22 bp, Homo sapiens
cccctcctggccacactgtcag

SEQ ID NO: 8391067 - DNA, 22 bp, Homo sapiens
cccctcctggccacactgtcag

SEQ ID NO: 8391068 - DNA, 22 bp, Homo sapiens
ccctcaggagatgtcagctgga

SEQ ID NO: 8391069 - DNA, 22 bp, Homo sapiens
ccctaggaattctatggccaag

SEQ ID NO: 8391070 - DNA, 22 bp, Homo sapiens
ccccagcagcacctggggcagt

SEQ ID NO: 8391071 - DNA, 22 bp, Homo sapiens
ccccagccagcttgtagtagaa

SEQ ID NO: 8391072 - DNA, 22 bp, Homo sapiens
ccccagccagcaggacctctga

SEQ ID NO: 8391073 - DNA, 22 bp, Homo sapiens
ccccagcccacaagcatattaa

SEQ ID NO: 8391074 - DNA, 22 bp, Homo sapiens
ccccagccttccatgggaattg

SEQ ID NO: 8391075 - DNA, 22 bp, Homo sapiens
tgctcagtagcagtgtgctgct

SEQ ID NO: 8391076 - DNA, 22 bp, Homo sapiens
tgctccatgcgctcggccggcg

SEQ ID NO: 8391077 - DNA, 22 bp, Homo sapiens
cccaggctcctgctgtgttgac

SEQ ID NO: 8391078 - DNA, 22 bp, Homo sapiens
cccaggctcctgactcattcta

SEQ ID NO: 8391079 - DNA, 22 bp, Homo sapiens
tgcctgggctcaccgcctcttt

SEQ ID NO: 8391080 - DNA, 22 bp, Homo sapiens
tgcctgggatctgtgccctttg

SEQ ID NO: 8391081 - DNA, 22 bp, Homo sapiens
tgctcccagctgtaggaatgtt

SEQ ID NO: 8391082 - DNA, 20 bp, Homo sapiens
cccagggacctgagctccat

SEQ ID NO: 8391083 - DNA, 22 bp, Homo sapiens
cccagggagcttggagaacggg

SEQ ID NO: 8391084 - DNA, 22 bp, Homo sapiens
cccagggaggcccaggctctgc

SEQ ID NO: 8391085 - DNA, 22 bp, Homo sapiens
tgctctggagtggcttgtgcac

SEQ ID NO: 8391086 - DNA, 22 bp, Homo sapiens
tgctgaagtccatctgtttgac

SEQ ID NO: 8391087 - DNA, 22 bp, Homo sapiens
tgctctggagtggcttgtgcac

SEQ ID NO: 8391088 - DNA, 22 bp, Homo sapiens
cccagggaggtagcaggagaaa

SEQ ID NO: 8391089 - DNA, 22 bp, Homo sapiens
cccagggaggtagcaggagaaa

SEQ ID NO: 8391090 - DNA, 22 bp, Homo sapiens
cccagggaggtagcaggagaaa

SEQ ID NO: 8391091 - DNA, 22 bp, Homo sapiens
cccagggatgtggcagatgtta

SEQ ID NO: 8391092 - DNA, 22 bp, Homo sapiens
cccagggatgtggcagatgtta

SEQ ID NO: 8391093 - DNA, 22 bp, Homo sapiens
tgctgagacagtggataggggc

SEQ ID NO: 8391094 - DNA, 22 bp, Homo sapiens
tgctgagaggaaggtgcactgg

SEQ ID NO: 8391095 - DNA, 22 bp, Homo sapiens
tgctgagataagctatgaccag

SEQ ID NO: 8391096 - DNA, 22 bp, Homo sapiens
tgctgaccttgttctgtgagga

SEQ ID NO: 8391097 - DNA, 22 bp, Homo sapiens
tgctgcacttatggctctgagg

SEQ ID NO: 8391098 - DNA, 22 bp, Homo sapiens
tgctgagatagctgactaggca

SEQ ID NO: 8391099 - DNA, 21 bp, Homo sapiens
tgctgacatcaggtctgctat

SEQ ID NO: 8391100 - DNA, 22 bp, Homo sapiens
tggcagctggctctgcgcaggc

SEQ ID NO: 8391101 - DNA, 22 bp, Homo sapiens
tggcagcactaggtactgagct

SEQ ID NO: 8391102 - DNA, 22 bp, Homo sapiens
tggcagcacggcatccactctc

SEQ ID NO: 8391103 - DNA, 22 bp, Homo sapiens
tggcagcacggcatccactctc

SEQ ID NO: 8391104 - DNA, 22 bp, Homo sapiens
tggcagatgagccgcgctccaa

SEQ ID NO: 8391105 - DNA, 22 bp, Homo sapiens
tggcagatggcctggaaccaaa

SEQ ID NO: 8391106 - DNA, 22 bp, Homo sapiens
tggcagatgtatatcacagctt

SEQ ID NO: 8391107 - DNA, 22 bp, Homo sapiens
tggcagattttctctggaggag

SEQ ID NO: 8391108 - DNA, 22 bp, Homo sapiens
tggcagatttaacattggaact

SEQ ID NO: 8391109 - DNA, 22 bp, Homo sapiens
tggcagcaaaaccagaatcaga

SEQ ID NO: 8391110 - DNA, 22 bp, Homo sapiens
tggcagcaaaaccagaatcaga

SEQ ID NO: 8391111 - DNA, 22 bp, Homo sapiens
tggcagcaagttcttgggaggt

SEQ ID NO: 8391112 - DNA, 22 bp, Homo sapiens
tggcaagggattgtggagaact

SEQ ID NO: 8391113 - DNA, 22 bp, Homo sapiens
tggcaaggccacaggtgcagtt

SEQ ID NO: 8391114 - DNA, 23 bp, Homo sapiens
tggcaaggaatgggatggagact

SEQ ID NO: 8391115 - DNA, 22 bp, Homo sapiens
tggcacaggcggtaagggtgtg

SEQ ID NO: 8391116 - DNA, 22 bp, Homo sapiens
tggcacaggagcactgccctgg

SEQ ID NO: 8391117 - DNA, 22 bp, Homo sapiens
tggcacaggagcactgccctgg

SEQ ID NO: 8391118 - DNA, 22 bp, Homo sapiens
tggcacagtcctgggtgcctgc

SEQ ID NO: 8391119 - DNA, 22 bp, Homo sapiens
tggcagaggtaattcaaatccc

SEQ ID NO: 8391120 - DNA, 22 bp, Homo sapiens
tggcacagggcttggtcgctca

SEQ ID NO: 8391121 - DNA, 22 bp, Homo sapiens
tggccacacccacctagaggag

SEQ ID NO: 8391122 - DNA, 22 bp, Homo sapiens
tggccagctgtaggttgtgcag

SEQ ID NO: 8391123 - DNA, 21 bp, Homo sapiens
tggccagctggagtctccaca

SEQ ID NO: 8391124 - DNA, 22 bp, Homo sapiens
tggcagcttgaatgcagtcttt

SEQ ID NO: 8391125 - DNA, 22 bp, Homo sapiens
tggccagctttgactgtaaacc

SEQ ID NO: 8391126 - DNA, 22 bp, Homo sapiens
tggccagctttttgtagtgctc

SEQ ID NO: 8391127 - DNA, 22 bp, Homo sapiens
tggccagctttttgtagtgctc

SEQ ID NO: 8391128 - DNA, 22 bp, Homo sapiens
tggccaggaggctgcttctgac

SEQ ID NO: 8391129 - DNA, 22 bp, Homo sapiens
tggcagcttgaatgcagtcttt

SEQ ID NO: 8391130 - DNA, 22 bp, Homo sapiens
tggcagcttcctgctcatagga

SEQ ID NO: 8391131 - DNA, 22 bp, Homo sapiens
tggcagctgtgcttcattcttt

SEQ ID NO: 8391132 - DNA, 22 bp, Homo sapiens
tggcagctgtctgtggggtctc

SEQ ID NO: 8391133 - DNA, 22 bp, Homo sapiens
tggcagctgtctgtggggtctc

SEQ ID NO: 8391134 - DNA, 22 bp, Homo sapiens
tggcagctgtctgtggggtctc

SEQ ID NO: 8391135 - DNA, 22 bp, Homo sapiens
tggcagctgtctgtggggtctc

SEQ ID NO: 8391136 - DNA, 22 bp, Homo sapiens
tggcagctgtctgtggggtctc

SEQ ID NO: 8391137 - DNA, 22 bp, Homo sapiens
tggcagctggtacagtgggtct

SEQ ID NO: 8391138 - DNA, 22 bp, Homo sapiens
tggcagctggtacagtgggtct

SEQ ID NO: 8391139 - DNA, 22 bp, Homo sapiens
tggcagctggtacagtgggtct

SEQ ID NO: 8391140 - DNA, 22 bp, Homo sapiens
cctagttttcattcagcagcct

SEQ ID NO: 8391141 - DNA, 22 bp, Homo sapiens
cctagttttcattcagcagcct

SEQ ID NO: 8391142 - DNA, 22 bp, Homo sapiens
ccctggcctacaggcccagaga

SEQ ID NO: 8391143 - DNA, 22 bp, Homo sapiens
ccctggcctacaggcccagaga

SEQ ID NO: 8391144 - DNA, 22 bp, Homo sapiens
ccctggcctccaggcagtcctg

SEQ ID NO: 8391145 - DNA, 22 bp, Homo sapiens
ccctggctcttcaccacctgcc

SEQ ID NO: 8391146 - DNA, 22 bp, Homo sapiens
ccctggctcttcaccacctgcc

SEQ ID NO: 8391147 - DNA, 22 bp, Homo sapiens
ccctggctgccagtcaccagac

SEQ ID NO: 8391148 - DNA, 22 bp, Homo sapiens
ccctggctctgcctcagagccc

SEQ ID NO: 8391149 - DNA, 22 bp, Homo sapiens
ccctggctctgcctcagagccc

SEQ ID NO: 8391150 - DNA, 17 bp, Homo sapiens
ccctggctctaggtgga

SEQ ID NO: 8391151 - DNA, 17 bp, Homo sapiens
ccctggctctaggtgga

SEQ ID NO: 8391152 - DNA, 22 bp, Homo sapiens
tggcaaggaaattagttctcct

SEQ ID NO: 8391153 - DNA, 17 bp, Homo sapiens
tggcaagacagctcagg

SEQ ID NO: 8391154 - DNA, 22 bp, Homo sapiens
tggatgaacagttttggagaga

SEQ ID NO: 8391155 - DNA, 22 bp, Homo sapiens
tggatctatctccaggggtcct

SEQ ID NO: 8391156 - DNA, 22 bp, Homo sapiens
tggatctggttccctgagcctt

SEQ ID NO: 8391157 - DNA, 20 bp, Homo sapiens
ccctggagagaagctccacg

SEQ ID NO: 8391158 - DNA, 19 bp, Homo sapiens
ccctcattcacttattctc

SEQ ID NO: 8391159 - DNA, 22 bp, Homo sapiens
ccctgctgatgccttgattttg

SEQ ID NO: 8391160 - DNA, 22 bp, Homo sapiens
ccctgctgacaacttgattttg

SEQ ID NO: 8391161 - DNA, 22 bp, Homo sapiens
ccctccagggagccatgctggg

SEQ ID NO: 8391162 - DNA, 22 bp, Homo sapiens
tggcccgacctctgctcatgca

SEQ ID NO: 8391163 - DNA, 22 bp, Homo sapiens
tggccctgctatgatcctgcaa

SEQ ID NO: 8391164 - DNA, 22 bp, Homo sapiens
tggccccatcaagggatgagtt

SEQ ID NO: 8391165 - DNA, 22 bp, Homo sapiens
tggccccattttacagatgaaa

SEQ ID NO: 8391166 - DNA, 20 bp, Homo sapiens
tggcccagtggggcagggtg

SEQ ID NO: 8391167 - DNA, 20 bp, Homo sapiens
tggcccagtggggcagggtg

SEQ ID NO: 8391168 - DNA, 22 bp, Homo sapiens
tggcccagtgcttatgctctga

SEQ ID NO: 8391169 - DNA, 22 bp, Homo sapiens
tggcccagtgcttatgctctga

SEQ ID NO: 8391170 - DNA, 22 bp, Homo sapiens
tggcccagtgcttatgctctga

SEQ ID NO: 8391171 - DNA, 22 bp, Homo sapiens
tggctcagctgtcacagcctgg

SEQ ID NO: 8391172 - DNA, 22 bp, Homo sapiens
tggctcagtttagcagctcagt

SEQ ID NO: 8391173 - DNA, 22 bp, Homo sapiens
tggctcagtttctgcccagctg

SEQ ID NO: 8391174 - DNA, 20 bp, Homo sapiens
tggctcatcctttctgcgcc

SEQ ID NO: 8391175 - DNA, 22 bp, Homo sapiens
tggctcatattgagtgatttct

SEQ ID NO: 8391176 - DNA, 22 bp, Homo sapiens
tggctcatgcctgtaatcttag

SEQ ID NO: 8391177 - DNA, 22 bp, Homo sapiens
tggctcatgcatcttttctaca

SEQ ID NO: 8391178 - DNA, 22 bp, Homo sapiens
tggctcatctttttagacttat

SEQ ID NO: 8391179 - DNA, 22 bp, Homo sapiens
cctccacaggagctgcagtgct

SEQ ID NO: 8391180 - DNA, 22 bp, Homo sapiens
cctccacaggagctgcagtgct

SEQ ID NO: 8391181 - DNA, 22 bp, Homo sapiens
tggctcatgcatcttttctaca

SEQ ID NO: 8391182 - DNA, 22 bp, Homo sapiens
cctcctggtccagcatctcttt

SEQ ID NO: 8391183 - DNA, 22 bp, Homo sapiens
cctccctgggtgacgggctcct

SEQ ID NO: 8391184 - DNA, 22 bp, Homo sapiens
tggctgaggtctggggcttctg

SEQ ID NO: 8391185 - DNA, 22 bp, Homo sapiens
cctctgtccccagtgcaggcct

SEQ ID NO: 8391186 - DNA, 22 bp, Homo sapiens
cctctggtcccagctctgctgc

SEQ ID NO: 8391187 - DNA, 22 bp, Homo sapiens
cctctgagaccagctctgcacc

SEQ ID NO: 8391188 - DNA, 22 bp, Homo sapiens
cctctctgtcacaccagtggcc

SEQ ID NO: 8391189 - DNA, 20 bp, Homo sapiens
cctctctgccctgcaaggcc

SEQ ID NO: 8391190 - DNA, 20 bp, Homo sapiens
cctctctgcatgctccctga

SEQ ID NO: 8391191 - DNA, 20 bp, Homo sapiens
cctctctgaagaggtcatct

SEQ ID NO: 8391192 - DNA, 22 bp, Homo sapiens
tggctgcctgatcgagcaggtg

SEQ ID NO: 8391193 - DNA, 22 bp, Homo sapiens
tggctgccttccctgctggagg

SEQ ID NO: 8391194 - DNA, 22 bp, Homo sapiens
cctctcagccggactgtcaggc

SEQ ID NO: 8391195 - DNA, 22 bp, Homo sapiens
cctctcagccggactgtcaggc

SEQ ID NO: 8391196 - DNA, 22 bp, Homo sapiens
cctctacagggcatagcccaaa

SEQ ID NO: 8391197 - DNA, 22 bp, Homo sapiens
cctctacttaccactcagccag

SEQ ID NO: 8391198 - DNA, 22 bp, Homo sapiens
cctctcagtattgaactttata

SEQ ID NO: 8391199 - DNA, 22 bp, Homo sapiens
cctctcagcgattcctcttgga

SEQ ID NO: 8391200 - DNA, 23 bp, Homo sapiens
cctctccagacactgggccttgt

SEQ ID NO: 8391201 - DNA, 22 bp, Homo sapiens
cctctccagcggcctcagggcc

SEQ ID NO: 8391202 - DNA, 22 bp, Homo sapiens
taagacacattggagtagatga

SEQ ID NO: 8391203 - DNA, 22 bp, Homo sapiens
taagatgtacaaccacttctct

SEQ ID NO: 8391204 - DNA, 22 bp, Homo sapiens
taagatttttaaaatgtcctca

SEQ ID NO: 8391205 - DNA, 22 bp, Homo sapiens
taagatgtcatccacatagagt

SEQ ID NO: 8391206 - DNA, 22 bp, Homo sapiens
caggcagaaagtattctgtgta

SEQ ID NO: 8391207 - DNA, 22 bp, Homo sapiens
caggcagaaattttgtttcatt

SEQ ID NO: 8391208 - DNA, 22 bp, Homo sapiens
caggcagaaagtattctgtgta

SEQ ID NO: 8391209 - DNA, 22 bp, Homo sapiens
taaggcagaggtaccactaggc

SEQ ID NO: 8391210 - DNA, 22 bp, Homo sapiens
taaggcagatgtggaatcaatt

SEQ ID NO: 8391211 - DNA, 22 bp, Homo sapiens
taaggcagccgctcagagaggt

SEQ ID NO: 8391212 - DNA, 22 bp, Homo sapiens
taaggcagcataattaggccac

SEQ ID NO: 8391213 - DNA, 19 bp, Homo sapiens
taaggcagcagtgacaggc

SEQ ID NO: 8391214 - DNA, 22 bp, Homo sapiens
taaggcagaaatatgagcaggg

SEQ ID NO: 8391215 - DNA, 22 bp, Homo sapiens
taaggcacacagttgctgcatg

SEQ ID NO: 8391216 - DNA, 22 bp, Homo sapiens
caggcaaggaggcactgaggga

SEQ ID NO: 8391217 - DNA, 22 bp, Homo sapiens
caggcaaggaggcactgaggga

SEQ ID NO: 8391218 - DNA, 22 bp, Homo sapiens
caggcaaggaggcactgaggga

SEQ ID NO: 8391219 - DNA, 22 bp, Homo sapiens
caggcacaaatttctagataag

SEQ ID NO: 8391220 - DNA, 22 bp, Homo sapiens
caggcaaggagctggctcaagt

SEQ ID NO: 8391221 - DNA, 22 bp, Homo sapiens
caggcaagattagagatgagca

SEQ ID NO: 8391222 - DNA, 22 bp, Homo sapiens
caggcaagatccagaggctgct

SEQ ID NO: 8391223 - DNA, 22 bp, Homo sapiens
caggcaagattagagatgagca

SEQ ID NO: 8391224 - DNA, 22 bp, Homo sapiens
caggatggtgtgagtgtgagga

SEQ ID NO: 8391225 - DNA, 22 bp, Homo sapiens
caggcacagctaagactggcca

SEQ ID NO: 8391226 - DNA, 22 bp, Homo sapiens
caggcacagctgggcaattgcg

SEQ ID NO: 8391227 - DNA, 22 bp, Homo sapiens
caggcacactgtctacactgag

SEQ ID NO: 8391228 - DNA, 22 bp, Homo sapiens
caggcacaagatcggctagata

SEQ ID NO: 8391229 - DNA, 22 bp, Homo sapiens
caggcacaagatcggctagata

SEQ ID NO: 8391230 - DNA, 22 bp, Homo sapiens
caggcacaagaagcaaatgtta

SEQ ID NO: 8391231 - DNA, 22 bp, Homo sapiens
caggcacaagaagcaaatgtta

SEQ ID NO: 8391232 - DNA, 22 bp, Homo sapiens
caggcacaagaagcaaatgtta

SEQ ID NO: 8391233 - DNA, 22 bp, Homo sapiens
caggcacagtgttgctgttcaa

SEQ ID NO: 8391234 - DNA, 22 bp, Homo sapiens
caggcacagttccaagcatttt

SEQ ID NO: 8391235 - DNA, 22 bp, Homo sapiens
caggcacagtggggtcctctct

SEQ ID NO: 8391236 - DNA, 22 bp, Homo sapiens
caggcacatgggagctcatcat

SEQ ID NO: 8391237 - DNA, 17 bp, Homo sapiens
caggcacatgaagccag

SEQ ID NO: 8391238 - DNA, 17 bp, Homo sapiens
caggcacatgaagccag

SEQ ID NO: 8391239 - DNA, 22 bp, Homo sapiens
caggcacatgggagctcatcat

SEQ ID NO: 8391240 - DNA, 22 bp, Homo sapiens
caggcaccaacttcctggggag

SEQ ID NO: 8391241 - DNA, 22 bp, Homo sapiens
caggcacatgggagctcatcat

SEQ ID NO: 8391242 - DNA, 22 bp, Homo sapiens
taagacaattcttcagtcacaa

SEQ ID NO: 8391243 - DNA, 22 bp, Homo sapiens
caggatggtggcatgatcagaa

SEQ ID NO: 8391244 - DNA, 22 bp, Homo sapiens
caggatggtctcgatctcctga

SEQ ID NO: 8391245 - DNA, 22 bp, Homo sapiens
taagaaacatttttatgacagt

SEQ ID NO: 8391246 - DNA, 22 bp, Homo sapiens
taagaaacatttttatgacagt

SEQ ID NO: 8391247 - DNA, 22 bp, Homo sapiens
taagaaacatttttatgacagt

SEQ ID NO: 8391248 - DNA, 22 bp, Homo sapiens
taagaaacatttttatgacagt

SEQ ID NO: 8391249 - DNA, 22 bp, Homo sapiens
caggatctgcccaggcctttgg

SEQ ID NO: 8391250 - DNA, 22 bp, Homo sapiens
caggatctgcccaggcctttgg

SEQ ID NO: 8391251 - DNA, 22 bp, Homo sapiens
caggatctgttaagttgttcca

SEQ ID NO: 8391252 - DNA, 22 bp, Homo sapiens
caggatcttttaatgtctccag

SEQ ID NO: 8391253 - DNA, 22 bp, Homo sapiens
taacatttgctgtctcctatgt

SEQ ID NO: 8391254 - DNA, 22 bp, Homo sapiens
taacatttcggtgacagtggga

SEQ ID NO: 8391255 - DNA, 22 bp, Homo sapiens
taacatttagaaagtgtccatt

SEQ ID NO: 8391256 - DNA, 22 bp, Homo sapiens
taacatttaaatttttcacata

SEQ ID NO: 8391257 - DNA, 22 bp, Homo sapiens
taacatttaaatttttcacata

SEQ ID NO: 8391258 - DNA, 22 bp, Homo sapiens
taacatttaaatttttcacata

SEQ ID NO: 8391259 - DNA, 22 bp, Homo sapiens
taacatttgctgtctcctatgt

SEQ ID NO: 8391260 - DNA, 16 bp, Homo sapiens
taacatttttaaaagg

SEQ ID NO: 8391261 - DNA, 16 bp, Homo sapiens
taacatttttaaaagg

SEQ ID NO: 8391262 - DNA, 22 bp, Homo sapiens
taagaaacatgatacttttcct

SEQ ID NO: 8391263 - DNA, 22 bp, Homo sapiens
taagaaacatgattaatggcag

SEQ ID NO: 8391264 - DNA, 22 bp, Homo sapiens
taagaaacatgatacttttcct

SEQ ID NO: 8391265 - DNA, 22 bp, Homo sapiens
taagaaacatgattaatggcag

SEQ ID NO: 8391266 - DNA, 22 bp, Homo sapiens
taactttaggaataggtaatct

SEQ ID NO: 8391267 - DNA, 22 bp, Homo sapiens
taacattaggtagacataagcc

SEQ ID NO: 8391268 - DNA, 22 bp, Homo sapiens
taacattacggacatctgtcag

SEQ ID NO: 8391269 - DNA, 22 bp, Homo sapiens
taacattcttaacttagaaaca

SEQ ID NO: 8391270 - DNA, 22 bp, Homo sapiens
taacattgttatgaatcaggtc

SEQ ID NO: 8391271 - DNA, 22 bp, Homo sapiens
taacattgtcagttcaactgct

SEQ ID NO: 8391272 - DNA, 22 bp, Homo sapiens
taacattgagtccactaaacag

SEQ ID NO: 8391273 - DNA, 22 bp, Homo sapiens
taacagaagatgaaacttcttt

SEQ ID NO: 8391274 - DNA, 22 bp, Homo sapiens
taacaacatgcaatttaacctt

SEQ ID NO: 8391275 - DNA, 22 bp, Homo sapiens
taacaagtcattttaaattatg

SEQ ID NO: 8391276 - DNA, 20 bp, Homo sapiens
taacacttgctttttgactt

SEQ ID NO: 8391277 - DNA, 22 bp, Homo sapiens
taacacttcagatgattttgtt

SEQ ID NO: 8391278 - DNA, 22 bp, Homo sapiens
caggcagaatgaccgacctcgc

SEQ ID NO: 8391279 - DNA, 17 bp, Homo sapiens
caggcagacatgtaagc

SEQ ID NO: 8391280 - DNA, 22 bp, Homo sapiens
caggcagaatgagattacttca

SEQ ID NO: 8391281 - DNA, 22 bp, Homo sapiens
caggcagaatgagattacttca

SEQ ID NO: 8391282 - DNA, 22 bp, Homo sapiens
caggcagaaggaagtaccaggc

SEQ ID NO: 8391283 - DNA, 22 bp, Homo sapiens
caggcagaaggaagtaccaggc

SEQ ID NO: 8391284 - DNA, 22 bp, Homo sapiens
caggcagaagaagtggaaggac

SEQ ID NO: 8391285 - DNA, 22 bp, Homo sapiens
caggcagagaggagcatttaat

SEQ ID NO: 8391286 - DNA, 22 bp, Homo sapiens
caggcagagaccctctcctaaa

SEQ ID NO: 8391287 - DNA, 22 bp, Homo sapiens
caggcagagacgtcagtgtagg

SEQ ID NO: 8391288 - DNA, 22 bp, Homo sapiens
caggcagagacgtcagtgtagg

SEQ ID NO: 8391289 - DNA, 22 bp, Homo sapiens
caggcagacatttttgacatag

SEQ ID NO: 8391290 - DNA, 22 bp, Homo sapiens
caggcagactttgagaatgatg

SEQ ID NO: 8391291 - DNA, 22 bp, Homo sapiens
caggcagagaactcatccgtga

SEQ ID NO: 8391292 - DNA, 22 bp, Homo sapiens
caggcagagaactcatccgtga

SEQ ID NO: 8391293 - DNA, 22 bp, Homo sapiens
caggcagagaccctctcctaaa

SEQ ID NO: 8391294 - DNA, 22 bp, Homo sapiens
taatttaatccaagtgttacat

SEQ ID NO: 8391295 - DNA, 22 bp, Homo sapiens
taattgttttcaatgttaatga

SEQ ID NO: 8391296 - DNA, 22 bp, Homo sapiens
taattgttttcaatgttaatga

SEQ ID NO: 8391297 - DNA, 22 bp, Homo sapiens
taatttaattccatggattcta

SEQ ID NO: 8391298 - DNA, 22 bp, Homo sapiens
taatttaatttcatgccagcct

SEQ ID NO: 8391299 - DNA, 22 bp, Homo sapiens
taatgttagtatgtaatcttat

SEQ ID NO: 8391300 - DNA, 22 bp, Homo sapiens
caggcagagcaactggtccaga

SEQ ID NO: 8391301 - DNA, 22 bp, Homo sapiens
taattgtaaagtagtagtacag

SEQ ID NO: 8391302 - DNA, 22 bp, Homo sapiens
taattgtacgatgttaaatcag

SEQ ID NO: 8391303 - DNA, 22 bp, Homo sapiens
taattgtacgatgttaaatcag

SEQ ID NO: 8391304 - DNA, 22 bp, Homo sapiens
taattggatgttctctggaagc

SEQ ID NO: 8391305 - DNA, 22 bp, Homo sapiens
caggcagccaggggacctgtcc

SEQ ID NO: 8391306 - DNA, 22 bp, Homo sapiens
caggcagctgactgtcagatat

SEQ ID NO: 8391307 - DNA, 22 bp, Homo sapiens
caggcagctctgcttttcctaa

SEQ ID NO: 8391308 - DNA, 22 bp, Homo sapiens
caggcagctgactgtcagatat

SEQ ID NO: 8391309 - DNA, 22 bp, Homo sapiens
caggcagctctaatggaaagtg

SEQ ID NO: 8391310 - DNA, 22 bp, Homo sapiens
caggcagctgggtcaccgtccc

SEQ ID NO: 8391311 - DNA, 22 bp, Homo sapiens
caggcaggagacatttggttgg

SEQ ID NO: 8391312 - DNA, 22 bp, Homo sapiens
caggcagctgcgacaagagagc

SEQ ID NO: 8391313 - DNA, 22 bp, Homo sapiens
caggcagctgaggactttgcta

SEQ ID NO: 8391314 - DNA, 22 bp, Homo sapiens
caggcagctgctgggttcagcc

SEQ ID NO: 8391315 - DNA, 22 bp, Homo sapiens
caggcaggagacatttggttgg

SEQ ID NO: 8391316 - DNA, 22 bp, Homo sapiens
caggcaggctgctttttgttca

SEQ ID NO: 8391317 - DNA, 22 bp, Homo sapiens
tacatcatggcttcatgctgca

SEQ ID NO: 8391318 - DNA, 22 bp, Homo sapiens
tacatcatgaaagcatacatca

SEQ ID NO: 8391319 - DNA, 22 bp, Homo sapiens
tacatcataataatacttagaa

SEQ ID NO: 8391320 - DNA, 22 bp, Homo sapiens
tacatcatgaaagcatacatca

SEQ ID NO: 8391321 - DNA, 22 bp, Homo sapiens
tacatcaagataaaaactgtca

SEQ ID NO: 8391322 - DNA, 22 bp, Homo sapiens
tacatatttgtctttgtactgt

SEQ ID NO: 8391323 - DNA, 22 bp, Homo sapiens
tacatatttgtctttgtactgt

SEQ ID NO: 8391324 - DNA, 22 bp, Homo sapiens
tacatattcaacgttcagtatt

SEQ ID NO: 8391325 - DNA, 22 bp, Homo sapiens
tacatattctacccctttttct

SEQ ID NO: 8391326 - DNA, 18 bp, Homo sapiens
caggccctgtctggcctc

SEQ ID NO: 8391327 - DNA, 18 bp, Homo sapiens
caggccctgtctggcctc

SEQ ID NO: 8391328 - DNA, 22 bp, Homo sapiens
caggccctgggcaggcacagag

SEQ ID NO: 8391329 - DNA, 22 bp, Homo sapiens
tacaggtggtaaaaatattgtt

SEQ ID NO: 8391330 - DNA, 22 bp, Homo sapiens
caggcagggagctggaaaggat

SEQ ID NO: 8391331 - DNA, 22 bp, Homo sapiens
tacaaatgagttgtatgaacca

SEQ ID NO: 8391332 - DNA, 22 bp, Homo sapiens
tacaaatgaaccaactttgatg

SEQ ID NO: 8391333 - DNA, 20 bp, Homo sapiens
tacaaattttccatgtttcc

SEQ ID NO: 8391334 - DNA, 20 bp, Homo sapiens
tacaaattttccatgtttcc

SEQ ID NO: 8391335 - DNA, 22 bp, Homo sapiens
tacaaattaatgggcatgttta

SEQ ID NO: 8391336 - DNA, 22 bp, Homo sapiens
tacaaattaatgggcatgttta

SEQ ID NO: 8391337 - DNA, 22 bp, Homo sapiens
tacaaattaatgggcatgttta

SEQ ID NO: 8391338 - DNA, 22 bp, Homo sapiens
tacaaatgcctgacacacagat

SEQ ID NO: 8391339 - DNA, 22 bp, Homo sapiens
tacaaatgcctgacacacagat

SEQ ID NO: 8391340 - DNA, 22 bp, Homo sapiens
tacaaatgggttaaaatatagt

SEQ ID NO: 8391341 - DNA, 22 bp, Homo sapiens
tacaagtatggaatgattctca

SEQ ID NO: 8391342 - DNA, 22 bp, Homo sapiens
tacaagtactgtggctttgaat

SEQ ID NO: 8391343 - DNA, 22 bp, Homo sapiens
tacaagtaaattgtagatacca

SEQ ID NO: 8391344 - DNA, 20 bp, Homo sapiens
tacaagtacattatagttat

SEQ ID NO: 8391345 - DNA, 22 bp, Homo sapiens
tacaaggcaaatccatgatgtc

SEQ ID NO: 8391346 - DNA, 22 bp, Homo sapiens
tacaagtccgtaaagggcagat

SEQ ID NO: 8391347 - DNA, 22 bp, Homo sapiens
tacagggtattcaagggtagtt

SEQ ID NO: 8391348 - DNA, 22 bp, Homo sapiens
tacagggattcctgccgctcgc

SEQ ID NO: 8391349 - DNA, 22 bp, Homo sapiens
gttttctaccagggaagagagt

SEQ ID NO: 8391350 - DNA, 22 bp, Homo sapiens
gttttctcaggatggtgtgtac

SEQ ID NO: 8391351 - DNA, 22 bp, Homo sapiens
gttttccttctcagccattgcc

SEQ ID NO: 8391352 - DNA, 22 bp, Homo sapiens
gttttcctgttgagtagtattc

SEQ ID NO: 8391353 - DNA, 22 bp, Homo sapiens
gttttcctgagcccagagatgc

SEQ ID NO: 8391354 - DNA, 22 bp, Homo sapiens
gttttcctactgtatcatcaaa

SEQ ID NO: 8391355 - DNA, 22 bp, Homo sapiens
gttttcctgaaactgatggtgt

SEQ ID NO: 8391356 - DNA, 22 bp, Homo sapiens
gttttcctgagcccagagatgc

SEQ ID NO: 8391357 - DNA, 22 bp, Homo sapiens
gttttcctgagcccagagatgc

SEQ ID NO: 8391358 - DNA, 19 bp, Homo sapiens
taaaaactgaaggaagcag

SEQ ID NO: 8391359 - DNA, 22 bp, Homo sapiens
gttttcttcctgcaattggcat

SEQ ID NO: 8391360 - DNA, 22 bp, Homo sapiens
taaaaatcttatgaatggcaag

SEQ ID NO: 8391361 - DNA, 22 bp, Homo sapiens
taaaatcagccgaccatggtgg

SEQ ID NO: 8391362 - DNA, 22 bp, Homo sapiens
taaaatcattctggtgtcagta

SEQ ID NO: 8391363 - DNA, 22 bp, Homo sapiens
taaaatgacttcctccaacatc

SEQ ID NO: 8391364 - DNA, 22 bp, Homo sapiens
caggagactatggcccaaggcc

SEQ ID NO: 8391365 - DNA, 22 bp, Homo sapiens
caggacccaacctccctgctct

SEQ ID NO: 8391366 - DNA, 22 bp, Homo sapiens
caggacccatcagccaggcact

SEQ ID NO: 8391367 - DNA, 22 bp, Homo sapiens
caggacattgatccattggcac

SEQ ID NO: 8391368 - DNA, 22 bp, Homo sapiens
caggacagtttgctttgccctg

SEQ ID NO: 8391369 - DNA, 22 bp, Homo sapiens
caggacagtgcaggtccatcct

SEQ ID NO: 8391370 - DNA, 22 bp, Homo sapiens
caggacagttggcatctgctgc

SEQ ID NO: 8391371 - DNA, 22 bp, Homo sapiens
caggacagtgcaggtccatcct

SEQ ID NO: 8391372 - DNA, 22 bp, Homo sapiens
taaactgcttctctcagtctgt

SEQ ID NO: 8391373 - DNA, 22 bp, Homo sapiens
taaacatttgttattcttgttt

SEQ ID NO: 8391374 - DNA, 22 bp, Homo sapiens
taaacatttgttattcttgttt

SEQ ID NO: 8391375 - DNA, 22 bp, Homo sapiens
taaacatttgttattcttgttt

SEQ ID NO: 8391376 - DNA, 22 bp, Homo sapiens
taaacatttgttattcttgttt

SEQ ID NO: 8391377 - DNA, 22 bp, Homo sapiens
taaacatttgttattcttgttt

SEQ ID NO: 8391378 - DNA, 22 bp, Homo sapiens
taaaatgatctctcatgttctt

SEQ ID NO: 8391379 - DNA, 22 bp, Homo sapiens
caggacaattttgagccacctg

SEQ ID NO: 8391380 - DNA, 22 bp, Homo sapiens
caggacacagaataaggcagtt

SEQ ID NO: 8391381 - DNA, 22 bp, Homo sapiens
caggacacagaataaggcagtt

SEQ ID NO: 8391382 - DNA, 22 bp, Homo sapiens
caggacactaaaaagccaagct

SEQ ID NO: 8391383 - DNA, 22 bp, Homo sapiens
caggacacagggtgtggctgat

SEQ ID NO: 8391384 - DNA, 22 bp, Homo sapiens
caggaatgactgcagatggggc

SEQ ID NO: 8391385 - DNA, 22 bp, Homo sapiens
caggaatgatattcgaggagat

SEQ ID NO: 8391386 - DNA, 22 bp, Homo sapiens
gttttcctactgtatcatcaaa

SEQ ID NO: 8391387 - DNA, 22 bp, Homo sapiens
caggacaggtgttctagatcag

SEQ ID NO: 8391388 - DNA, 22 bp, Homo sapiens
caggacaggtgttctagatcag

SEQ ID NO: 8391389 - DNA, 22 bp, Homo sapiens
caggacagtataggctttagga

SEQ ID NO: 8391390 - DNA, 22 bp, Homo sapiens
caggacactacagatgggaggg

SEQ ID NO: 8391391 - DNA, 22 bp, Homo sapiens
caggacagctcaacacctcctc

SEQ ID NO: 8391392 - DNA, 22 bp, Homo sapiens
caggacagctgggccaccacca

SEQ ID NO: 8391393 - DNA, 22 bp, Homo sapiens
caggacaggccctgtggggtct

SEQ ID NO: 8391394 - DNA, 22 bp, Homo sapiens
caggacaggagtggggtcaaag

SEQ ID NO: 8391395 - DNA, 22 bp, Homo sapiens
caggaatccagagtgagcctcc

SEQ ID NO: 8391396 - DNA, 22 bp, Homo sapiens
caggaatccagagtgagcctcc

SEQ ID NO: 8391397 - DNA, 22 bp, Homo sapiens
gtttggcagagcatggggatga

SEQ ID NO: 8391398 - DNA, 22 bp, Homo sapiens
gtttggaatgagtcctgccatt

SEQ ID NO: 8391399 - DNA, 21 bp, Homo sapiens
gtttggaacagaccctgggga

SEQ ID NO: 8391400 - DNA, 22 bp, Homo sapiens
gtttggaagttaagtgcagcag

SEQ ID NO: 8391401 - DNA, 22 bp, Homo sapiens
gtttggaatagcagtaaacatt

SEQ ID NO: 8391402 - DNA, 22 bp, Homo sapiens
gtttggaatagcagtaaacatt

SEQ ID NO: 8391403 - DNA, 22 bp, Homo sapiens
caggaagccttccttgtctgct

SEQ ID NO: 8391404 - DNA, 22 bp, Homo sapiens
caggaagccttccttgtctgct

SEQ ID NO: 8391405 - DNA, 22 bp, Homo sapiens
taaatgctttctatgaaagagg

SEQ ID NO: 8391406 - DNA, 22 bp, Homo sapiens
taaatatcagtccagctcttcc

SEQ ID NO: 8391407 - DNA, 22 bp, Homo sapiens
taaatatcagtccagctcttcc

SEQ ID NO: 8391408 - DNA, 22 bp, Homo sapiens
taaagtgcaggctactcagaag

SEQ ID NO: 8391409 - DNA, 22 bp, Homo sapiens
taaagtgagtacaaaatgaggg

SEQ ID NO: 8391410 - DNA, 22 bp, Homo sapiens
taaagccaatatacctagcata

SEQ ID NO: 8391411 - DNA, 22 bp, Homo sapiens
taaagccacgctggaaatcagg

SEQ ID NO: 8391412 - DNA, 22 bp, Homo sapiens
taaagcatttttgaaattatga

SEQ ID NO: 8391413 - DNA, 22 bp, Homo sapiens
taaagcatgtactgtgtgctag

SEQ ID NO: 8391414 - DNA, 17 bp, Homo sapiens
taaagccagtcaagtca

SEQ ID NO: 8391415 - DNA, 22 bp, Homo sapiens
taaagccacgctggaaatcagg

SEQ ID NO: 8391416 - DNA, 22 bp, Homo sapiens
taaagtcatctttaaacatgcc

SEQ ID NO: 8391417 - DNA, 22 bp, Homo sapiens
caggagatgacagggaagaacc

SEQ ID NO: 8391418 - DNA, 22 bp, Homo sapiens
caggagatgacagggaagaacc

SEQ ID NO: 8391419 - DNA, 22 bp, Homo sapiens
caggagatgacagggaagaacc

SEQ ID NO: 8391420 - DNA, 22 bp, Homo sapiens
caggagaggctgtacgtttctc

SEQ ID NO: 8391421 - DNA, 22 bp, Homo sapiens
caggagagatatgagtccccac

SEQ ID NO: 8391422 - DNA, 22 bp, Homo sapiens
caggagagatatgagtccccac

SEQ ID NO: 8391423 - DNA, 19 bp, Homo sapiens
caggagagcatgcactttg

SEQ ID NO: 8391424 - DNA, 19 bp, Homo sapiens
caggagagcatgcactttg

SEQ ID NO: 8391425 - DNA, 22 bp, Homo sapiens
caggagactcagcatccaggat

SEQ ID NO: 8391426 - DNA, 22 bp, Homo sapiens
caggagagatatgagtccccac

SEQ ID NO: 8391427 - DNA, 22 bp, Homo sapiens
caggagagatatgagtccccac

SEQ ID NO: 8391428 - DNA, 22 bp, Homo sapiens
caggagagcccgggtccgggct

SEQ ID NO: 8391429 - DNA, 22 bp, Homo sapiens
caggagaggaggctacttctta

SEQ ID NO: 8391430 - DNA, 15 bp, Homo sapiens
caggagaggaaggtt

SEQ ID NO: 8391431 - DNA, 22 bp, Homo sapiens
caggagaggaggctacttctta

SEQ ID NO: 8391432 - DNA, 22 bp, Homo sapiens
caggagaggaggctacttctta

SEQ ID NO: 8391433 - DNA, 22 bp, Homo sapiens
caggagagcccgggtccgggct

SEQ ID NO: 8391434 - DNA, 22 bp, Homo sapiens
caggagccctggtgggtggaca

SEQ ID NO: 8391435 - DNA, 22 bp, Homo sapiens
caggagccgccaggcacgttgg

SEQ ID NO: 8391436 - DNA, 22 bp, Homo sapiens
caggagctggataggaccacaa

SEQ ID NO: 8391437 - DNA, 22 bp, Homo sapiens
caggagctcttaaggatgtgat

SEQ ID NO: 8391438 - DNA, 22 bp, Homo sapiens
caggagctctcatcgtcagggc

SEQ ID NO: 8391439 - DNA, 22 bp, Homo sapiens
taaagcataatgaatatctaga

SEQ ID NO: 8391440 - DNA, 22 bp, Homo sapiens
taaagcataatgaatatctaga

SEQ ID NO: 8391441 - DNA, 22 bp, Homo sapiens
taacaaaggttgccaaactaag

SEQ ID NO: 8391442 - DNA, 22 bp, Homo sapiens
taacaaagtaccatagactgga

SEQ ID NO: 8391443 - DNA, 22 bp, Homo sapiens
caggataaatagtaaatgtaag

SEQ ID NO: 8391444 - DNA, 22 bp, Homo sapiens
caggatagaaaggccatggagt

SEQ ID NO: 8391445 - DNA, 22 bp, Homo sapiens
caggagtgttgattgctcagga

SEQ ID NO: 8391446 - DNA, 22 bp, Homo sapiens
caggagtggtgtgagggactcc

SEQ ID NO: 8391447 - DNA, 22 bp, Homo sapiens
caggagtgagttggggtctaca

SEQ ID NO: 8391448 - DNA, 22 bp, Homo sapiens
caggagtgaaatgaggcccagg

SEQ ID NO: 8391449 - DNA, 22 bp, Homo sapiens
caggagtgcaggtggtgaggca

SEQ ID NO: 8391450 - DNA, 22 bp, Homo sapiens
caggaggcgtcttcagtttgtt

SEQ ID NO: 8391451 - DNA, 22 bp, Homo sapiens
caggaggcgtcttcagtttgtt

SEQ ID NO: 8391452 - DNA, 22 bp, Homo sapiens
caggagggggtggagtttcgcc

SEQ ID NO: 8391453 - DNA, 22 bp, Homo sapiens
caggagggcccgagactcttcc

SEQ ID NO: 8391454 - DNA, 20 bp, Homo sapiens
caggagggacatttcagcat

SEQ ID NO: 8391455 - DNA, 23 bp, Homo sapiens
caggagggaatgaagttagacaa

SEQ ID NO: 8391456 - DNA, 22 bp, Homo sapiens
caggaggcccggccacagccca

SEQ ID NO: 8391457 - DNA, 22 bp, Homo sapiens
caggaggcccggccacagccca

SEQ ID NO: 8391458 - DNA, 22 bp, Homo sapiens
caggaggcccacaggcccctgc

SEQ ID NO: 8391459 - DNA, 22 bp, Homo sapiens
caggaggcccacaggcccctgc

SEQ ID NO: 8391460 - DNA, 22 bp, Homo sapiens
caggaggcccaaagggcgcaga

SEQ ID NO: 8391461 - DNA, 22 bp, Homo sapiens
caggaggcatcatggagcggac

SEQ ID NO: 8391462 - DNA, 22 bp, Homo sapiens
caggaggccaactgtgggactt

SEQ ID NO: 8391463 - DNA, 22 bp, Homo sapiens
caggaggccaactgtgggactt

SEQ ID NO: 8391464 - DNA, 22 bp, Homo sapiens
caggagctgggtctggaagcag

SEQ ID NO: 8391465 - DNA, 22 bp, Homo sapiens
taaatgtgaccttcattttata

SEQ ID NO: 8391466 - DNA, 22 bp, Homo sapiens
caggaggaaactggattcactt

SEQ ID NO: 8391467 - DNA, 22 bp, Homo sapiens
caggagcttctgcccatggcca

SEQ ID NO: 8391468 - DNA, 22 bp, Homo sapiens
taaatgtaccttctgccttact

SEQ ID NO: 8391469 - DNA, 22 bp, Homo sapiens
taaatgtactgaggcaacagga

SEQ ID NO: 8391470 - DNA, 22 bp, Homo sapiens
caggaggcagaggttgcagcga

SEQ ID NO: 8391471 - DNA, 22 bp, Homo sapiens
caggaggcagaggatgcccagt

SEQ ID NO: 8391472 - DNA, 22 bp, Homo sapiens
caggaggcagaggttgcagtga

SEQ ID NO: 8391473 - DNA, 22 bp, Homo sapiens
caggaggcagaggttgcagtga

SEQ ID NO: 8391474 - DNA, 22 bp, Homo sapiens
caggaggcagaggttgcagtga

SEQ ID NO: 8391475 - DNA, 22 bp, Homo sapiens
caggaggcagtgggtgttgtct

SEQ ID NO: 8391476 - DNA, 22 bp, Homo sapiens
caggaggcagtttcagaagtca

SEQ ID NO: 8391477 - DNA, 22 bp, Homo sapiens
caggaggcagcgctctcaggac

SEQ ID NO: 8391478 - DNA, 22 bp, Homo sapiens
caggaggcagcgctctcaggac

SEQ ID NO: 8391479 - DNA, 22 bp, Homo sapiens
caggaggattgcttgaggccag

SEQ ID NO: 8391480 - DNA, 20 bp, Homo sapiens
caggaggcaaggtcaaggtc

SEQ ID NO: 8391481 - DNA, 22 bp, Homo sapiens
caggaggaaatgtgaccctgct

SEQ ID NO: 8391482 - DNA, 22 bp, Homo sapiens
caggaggaaagttccactcaac

SEQ ID NO: 8391483 - DNA, 22 bp, Homo sapiens
caggaggaacaagaggttctgg

SEQ ID NO: 8391484 - DNA, 22 bp, Homo sapiens
caggaggaaatgtgaccctgct

SEQ ID NO: 8391485 - DNA, 22 bp, Homo sapiens
caggaaaatgtcaatggaaagc

SEQ ID NO: 8391486 - DNA, 22 bp, Homo sapiens
caggaaaatggaatcacctgta

SEQ ID NO: 8391487 - DNA, 22 bp, Homo sapiens
cagctttccccgtgcctcagcc

SEQ ID NO: 8391488 - DNA, 22 bp, Homo sapiens
cagcttgtgcaaaggtcctggg

SEQ ID NO: 8391489 - DNA, 22 bp, Homo sapiens
cagcttgtgtcattcatcttgt

SEQ ID NO: 8391490 - DNA, 22 bp, Homo sapiens
cagcttgttaccgagggagggt

SEQ ID NO: 8391491 - DNA, 22 bp, Homo sapiens
cagcttgttaccaagggtggct

SEQ ID NO: 8391492 - DNA, 22 bp, Homo sapiens
cagcttgtattgaagctatacc

SEQ ID NO: 8391493 - DNA, 22 bp, Homo sapiens
cagcttgtgaaatgtcaccact

SEQ ID NO: 8391494 - DNA, 22 bp, Homo sapiens
cagcttgtttacatgcttattc

SEQ ID NO: 8391495 - DNA, 22 bp, Homo sapiens
cagcttgttttatttggggacc

SEQ ID NO: 8391496 - DNA, 22 bp, Homo sapiens
caggaaagaaatgagaacacca

SEQ ID NO: 8391497 - DNA, 22 bp, Homo sapiens
caggaaagaaatgagaacacca

SEQ ID NO: 8391498 - DNA, 22 bp, Homo sapiens
caggaaagaaatgagaacacca

SEQ ID NO: 8391499 - DNA, 22 bp, Homo sapiens
caggaaagagctgccaggcagg

SEQ ID NO: 8391500 - DNA, 22 bp, Homo sapiens
caggaaacggctattcttttgt

SEQ ID NO: 8391501 - DNA, 22 bp, Homo sapiens
gttcacagaaattgtgtacctc

SEQ ID NO: 8391502 - DNA, 22 bp, Homo sapiens
gttcacagctgggacaagactg

SEQ ID NO: 8391503 - DNA, 22 bp, Homo sapiens
gttcacagctgggacaagactg

SEQ ID NO: 8391504 - DNA, 22 bp, Homo sapiens
gttcacagcttcttaggtcata

SEQ ID NO: 8391505 - DNA, 22 bp, Homo sapiens
gttcacagaaggccagatggta

SEQ ID NO: 8391506 - DNA, 22 bp, Homo sapiens
gttcacagcaaacctatgaact

SEQ ID NO: 8391507 - DNA, 22 bp, Homo sapiens
gttcacagatccttgaagccag

SEQ ID NO: 8391508 - DNA, 22 bp, Homo sapiens
caggaaagagctgccaggcagg

SEQ ID NO: 8391509 - DNA, 22 bp, Homo sapiens
caggaaagagctgccaggcagg

SEQ ID NO: 8391510 - DNA, 22 bp, Homo sapiens
caggaaagccgagtgccatagg

SEQ ID NO: 8391511 - DNA, 20 bp, Homo sapiens
cagcttggatgagaggctga

SEQ ID NO: 8391512 - DNA, 20 bp, Homo sapiens
cagcttggatgagaggctga

SEQ ID NO: 8391513 - DNA, 22 bp, Homo sapiens
cagcttgctaactggtaggggt

SEQ ID NO: 8391514 - DNA, 22 bp, Homo sapiens
cagcttgggggcgctggcctca

SEQ ID NO: 8391515 - DNA, 22 bp, Homo sapiens
cagcttctcgggagcgcatgtg

SEQ ID NO: 8391516 - DNA, 21 bp, Homo sapiens
cagcttctgaaggtgtaggaa

SEQ ID NO: 8391517 - DNA, 22 bp, Homo sapiens
cagcttctccagatgaccctca

SEQ ID NO: 8391518 - DNA, 22 bp, Homo sapiens
cagcttctcagaaagctgaggt

SEQ ID NO: 8391519 - DNA, 22 bp, Homo sapiens
gttattctacagtcattgaagt

SEQ ID NO: 8391520 - DNA, 22 bp, Homo sapiens
gttattctaccactatgtacag

SEQ ID NO: 8391521 - DNA, 22 bp, Homo sapiens
gttattcttggtggccctgctg

SEQ ID NO: 8391522 - DNA, 22 bp, Homo sapiens
gttattctgccaaacttccaca

SEQ ID NO: 8391523 - DNA, 22 bp, Homo sapiens
gttattaaagtatttgatgtta

SEQ ID NO: 8391524 - DNA, 22 bp, Homo sapiens
gttatgtattgggaaatccaag

SEQ ID NO: 8391525 - DNA, 22 bp, Homo sapiens
gttattaaagtatttgatgtta

SEQ ID NO: 8391526 - DNA, 22 bp, Homo sapiens
gttacattaaaaacattcactg

SEQ ID NO: 8391527 - DNA, 22 bp, Homo sapiens
gttacattacttgtgcagttgt

SEQ ID NO: 8391528 - DNA, 22 bp, Homo sapiens
gttacattaggataatttgctg

SEQ ID NO: 8391529 - DNA, 22 bp, Homo sapiens
gttacatttattagaggtctct

SEQ ID NO: 8391530 - DNA, 22 bp, Homo sapiens
gttacatttggtgatttggtgc

SEQ ID NO: 8391531 - DNA, 23 bp, Homo sapiens
gttaccttacttctgtgatcttc

SEQ ID NO: 8391532 - DNA, 22 bp, Homo sapiens
cagcttcagaagaagccgtgag

SEQ ID NO: 8391533 - DNA, 22 bp, Homo sapiens
cagcttcagaagaagccgtgag

SEQ ID NO: 8391534 - DNA, 22 bp, Homo sapiens
cagcttcagcgtgacaccagtg

SEQ ID NO: 8391535 - DNA, 22 bp, Homo sapiens
cagcttcatgacaaacagtttt

SEQ ID NO: 8391536 - DNA, 22 bp, Homo sapiens
cagctgtttgggcatggccaga

SEQ ID NO: 8391537 - DNA, 22 bp, Homo sapiens
cagcttcaactgcacagtcaac

SEQ ID NO: 8391538 - DNA, 22 bp, Homo sapiens
cagcttcaactgcacagtcaac

SEQ ID NO: 8391539 - DNA, 22 bp, Homo sapiens
cagctgtgattcctgctgtcca

SEQ ID NO: 8391540 - DNA, 22 bp, Homo sapiens
cagctgtgctgattgctcagta

SEQ ID NO: 8391541 - DNA, 22 bp, Homo sapiens
cagctgtgtaaacacatgtgta

SEQ ID NO: 8391542 - DNA, 22 bp, Homo sapiens
cagctgtggctgccactgctcc

SEQ ID NO: 8391543 - DNA, 22 bp, Homo sapiens
gttacaaatgtaaattctgggg

SEQ ID NO: 8391544 - DNA, 22 bp, Homo sapiens
gttacaaatgccaaagctgaga

SEQ ID NO: 8391545 - DNA, 22 bp, Homo sapiens
gttacaaatgtaaattctgggg

SEQ ID NO: 8391546 - DNA, 22 bp, Homo sapiens
gttacaaatgtaaattctgggg

SEQ ID NO: 8391547 - DNA, 22 bp, Homo sapiens
gttaaacagttacatgtgctgg

SEQ ID NO: 8391548 - DNA, 22 bp, Homo sapiens
gttaaagtgatcttgtcaggtt

SEQ ID NO: 8391549 - DNA, 22 bp, Homo sapiens
gttacaaatgccaaagctgaga

SEQ ID NO: 8391550 - DNA, 22 bp, Homo sapiens
gttaaacaataactggcacaca

SEQ ID NO: 8391551 - DNA, 22 bp, Homo sapiens
gtgttttattggtgcagtcaga

SEQ ID NO: 8391552 - DNA, 22 bp, Homo sapiens
gtgttttattggtgcagtcaga

SEQ ID NO: 8391553 - DNA, 23 bp, Homo sapiens
gtgtgtggaaagtgcatgggcct

SEQ ID NO: 8391554 - DNA, 22 bp, Homo sapiens
gtgtgtgctccccaggagagct

SEQ ID NO: 8391555 - DNA, 22 bp, Homo sapiens
gtgtgtggggccttcgggtcct

SEQ ID NO: 8391556 - DNA, 22 bp, Homo sapiens
gtgtgtgccaactttatgtgca

SEQ ID NO: 8391557 - DNA, 20 bp, Homo sapiens
gtgtgtgctccatgcatgct

SEQ ID NO: 8391558 - DNA, 22 bp, Homo sapiens
gtgtgtgcaagaggtttattga

SEQ ID NO: 8391559 - DNA, 22 bp, Homo sapiens
gtgttttatcagacaaagtata

SEQ ID NO: 8391560 - DNA, 22 bp, Homo sapiens
gtgttttatggagtcataacgt

SEQ ID NO: 8391561 - DNA, 22 bp, Homo sapiens
gtgttttagtgctgctgagctg

SEQ ID NO: 8391562 - DNA, 22 bp, Homo sapiens
gtgttttaagaaagaagctcag

SEQ ID NO: 8391563 - DNA, 22 bp, Homo sapiens
gtgtttgtgagctaggtgacat

SEQ ID NO: 8391564 - DNA, 22 bp, Homo sapiens
caggaaaggtgtgtcatgatgg

SEQ ID NO: 8391565 - DNA, 22 bp, Homo sapiens
caggaaaggtgtgtcatgatgg

SEQ ID NO: 8391566 - DNA, 22 bp, Homo sapiens
caggaaaggtagtcacaatgta

SEQ ID NO: 8391567 - DNA, 22 bp, Homo sapiens
caggaaagtctgtaaaggaacc

SEQ ID NO: 8391568 - DNA, 22 bp, Homo sapiens
caggaaagtctgtaaaggaacc

SEQ ID NO: 8391569 - DNA, 22 bp, Homo sapiens
caggaaaggtagtcacaatgta

SEQ ID NO: 8391570 - DNA, 22 bp, Homo sapiens
caggaaagccgagtgccatagg

SEQ ID NO: 8391571 - DNA, 22 bp, Homo sapiens
caggaaagggatgggctgccac

SEQ ID NO: 8391572 - DNA, 22 bp, Homo sapiens
gttggctcattttatagacagc

SEQ ID NO: 8391573 - DNA, 22 bp, Homo sapiens
caggaaattgcaacagtctgag

SEQ ID NO: 8391574 - DNA, 22 bp, Homo sapiens
caggaaattgcaacagtctgag

SEQ ID NO: 8391575 - DNA, 22 bp, Homo sapiens
caggaaattctttttaacagaa

SEQ ID NO: 8391576 - DNA, 22 bp, Homo sapiens
caggaaattcttttgtttgtgc

SEQ ID NO: 8391577 - DNA, 22 bp, Homo sapiens
caggaaatttaagagtgtacaa

SEQ ID NO: 8391578 - DNA, 22 bp, Homo sapiens
caggaaatttaagagtgtacaa

SEQ ID NO: 8391579 - DNA, 22 bp, Homo sapiens
caggaaattggctatttgggat

SEQ ID NO: 8391580 - DNA, 22 bp, Homo sapiens
caggaaattggctatttgggat

SEQ ID NO: 8391581 - DNA, 22 bp, Homo sapiens
caggaaatttaagagtgtacaa

SEQ ID NO: 8391582 - DNA, 22 bp, Homo sapiens
caggaaatttaagagtgtacaa

SEQ ID NO: 8391583 - DNA, 22 bp, Homo sapiens
caggaaatttatgttctactta

SEQ ID NO: 8391584 - DNA, 22 bp, Homo sapiens
caggaaattttgtgatctgttc

SEQ ID NO: 8391585 - DNA, 22 bp, Homo sapiens
caggaaattttgtgatctgttc

SEQ ID NO: 8391586 - DNA, 22 bp, Homo sapiens
caggaacaatatctgtcctggt

SEQ ID NO: 8391587 - DNA, 22 bp, Homo sapiens
caggaaatggctgaataaattc

SEQ ID NO: 8391588 - DNA, 22 bp, Homo sapiens
caggaaatggctgaataaattc

SEQ ID NO: 8391589 - DNA, 22 bp, Homo sapiens
caggaaatggggtttagttatt

SEQ ID NO: 8391590 - DNA, 22 bp, Homo sapiens
caggaaataggcgtttgtcctc

SEQ ID NO: 8391591 - DNA, 22 bp, Homo sapiens
caggaaatagttcagtcaaact

SEQ ID NO: 8391592 - DNA, 22 bp, Homo sapiens
caggaaatagttcagtcaaact

SEQ ID NO: 8391593 - DNA, 22 bp, Homo sapiens
caggaaataaaaagtatcttct

SEQ ID NO: 8391594 - DNA, 22 bp, Homo sapiens
caggaaatagacactgtatgat

SEQ ID NO: 8391595 - DNA, 22 bp, Homo sapiens
caggaaataaatggtaatgcat

SEQ ID NO: 8391596 - DNA, 22 bp, Homo sapiens
caggaaattcaagagaggctgc

SEQ ID NO: 8391597 - DNA, 22 bp, Homo sapiens
caggaaattcaagagaggctgc

SEQ ID NO: 8391598 - DNA, 22 bp, Homo sapiens
caggaaattcccagaaggactg

SEQ ID NO: 8391599 - DNA, 23 bp, Homo sapiens
caggaaatgttcttgaagcctga

SEQ ID NO: 8391600 - DNA, 22 bp, Homo sapiens
caggaaattagtctctctgttg

SEQ ID NO: 8391601 - DNA, 22 bp, Homo sapiens
caggaaatggggtttagttatt

SEQ ID NO: 8391602 - DNA, 22 bp, Homo sapiens
caggaaatgtataattttataa

SEQ ID NO: 8391603 - DNA, 22 bp, Homo sapiens
caggaaatgggtcgttttataa

SEQ ID NO: 8391604 - DNA, 22 bp, Homo sapiens
gttcacagtgttttctttgcat

SEQ ID NO: 8391605 - DNA, 22 bp, Homo sapiens
gttcacagttaggacaactgct

SEQ ID NO: 8391606 - DNA, 22 bp, Homo sapiens
gttcacagtgttttctttgcat

SEQ ID NO: 8391607 - DNA, 22 bp, Homo sapiens
gttcacagttaggacaactgct

SEQ ID NO: 8391608 - DNA, 22 bp, Homo sapiens
gttcacagttttatacctgaga

SEQ ID NO: 8391609 - DNA, 22 bp, Homo sapiens
gttcacagtttctaatcccagc

SEQ ID NO: 8391610 - DNA, 22 bp, Homo sapiens
gttcacagttcagcctgtaaca

SEQ ID NO: 8391611 - DNA, 20 bp, Homo sapiens
gttcacaggcttcctttcag

SEQ ID NO: 8391612 - DNA, 20 bp, Homo sapiens
gttcacaggcttcctttcag

SEQ ID NO: 8391613 - DNA, 22 bp, Homo sapiens
gttcacagggatccttgttgaa

SEQ ID NO: 8391614 - DNA, 22 bp, Homo sapiens
gttcacagggttaggaatcact

SEQ ID NO: 8391615 - DNA, 22 bp, Homo sapiens
gttcacagcttgtgttttctct

SEQ ID NO: 8391616 - DNA, 22 bp, Homo sapiens
gttcacagcttcttaggtcata

SEQ ID NO: 8391617 - DNA, 22 bp, Homo sapiens
gttcacaggttctctttctaag

SEQ ID NO: 8391618 - DNA, 22 bp, Homo sapiens
gttcacaggttctctttctaag

SEQ ID NO: 8391619 - DNA, 22 bp, Homo sapiens
gttcacagtctacatagtaaag

SEQ ID NO: 8391620 - DNA, 22 bp, Homo sapiens
gttcacagtctacatagtaaag

SEQ ID NO: 8391621 - DNA, 22 bp, Homo sapiens
gttcttaagaccacaataaaaa

SEQ ID NO: 8391622 - DNA, 22 bp, Homo sapiens
gttctgtctgagcaccacagga

SEQ ID NO: 8391623 - DNA, 19 bp, Homo sapiens
gttctgtgtcctggaggaa

SEQ ID NO: 8391624 - DNA, 22 bp, Homo sapiens
gttgctgcaaaggagtgtaggt

SEQ ID NO: 8391625 - DNA, 22 bp, Homo sapiens
gttgcttttctccatcacatgg

SEQ ID NO: 8391626 - DNA, 20 bp, Homo sapiens
gttgctttagtctggtttgg

SEQ ID NO: 8391627 - DNA, 22 bp, Homo sapiens
gttgctttacagctggtgacag

SEQ ID NO: 8391628 - DNA, 22 bp, Homo sapiens
gttggaaatgcagagtctcaga

SEQ ID NO: 8391629 - DNA, 22 bp, Homo sapiens
gttgcttttttgataggtggaa

SEQ ID NO: 8391630 - DNA, 22 bp, Homo sapiens
caggaagaggtatcaccgagca

SEQ ID NO: 8391631 - DNA, 22 bp, Homo sapiens
caggaagaggtatcaccgagca

SEQ ID NO: 8391632 - DNA, 22 bp, Homo sapiens
caggaagaggacaggcttcccc

SEQ ID NO: 8391633 - DNA, 22 bp, Homo sapiens
caggaacattgtagaattgaaa

SEQ ID NO: 8391634 - DNA, 22 bp, Homo sapiens
caggaacatgttggaaagaaat

SEQ ID NO: 8391635 - DNA, 22 bp, Homo sapiens
caggaacagctgacctgacaat

SEQ ID NO: 8391636 - DNA, 22 bp, Homo sapiens
caggaacagcaccaggagctag

SEQ ID NO: 8391637 - DNA, 22 bp, Homo sapiens
caggaacagcaccaggagctag

SEQ ID NO: 8391638 - DNA, 22 bp, Homo sapiens
caggaacaatgtaagtctcatt

SEQ ID NO: 8391639 - DNA, 22 bp, Homo sapiens
caggaacacaatgagtctcaaa

SEQ ID NO: 8391640 - DNA, 22 bp, Homo sapiens
caggaagattagaccaagagct

SEQ ID NO: 8391641 - DNA, 22 bp, Homo sapiens
caggaagattagaccaagagct

SEQ ID NO: 8391642 - DNA, 22 bp, Homo sapiens
caggaagcaccagcccggcccc

SEQ ID NO: 8391643 - DNA, 22 bp, Homo sapiens
gtttacagtactcacttgcatt

SEQ ID NO: 8391644 - DNA, 22 bp, Homo sapiens
gtttcctgtttctcagcagccc

SEQ ID NO: 8391645 - DNA, 22 bp, Homo sapiens
gtttcctatgtccattgaggga

SEQ ID NO: 8391646 - DNA, 22 bp, Homo sapiens
gtttcctaggcttatacagctg

SEQ ID NO: 8391647 - DNA, 22 bp, Homo sapiens
gtttcctatggctgctgcagga

SEQ ID NO: 8391648 - DNA, 22 bp, Homo sapiens
gtttcctataactcaggcacca

SEQ ID NO: 8391649 - DNA, 20 bp, Homo sapiens
gtttcctatttacctcctca

SEQ ID NO: 8391650 - DNA, 22 bp, Homo sapiens
gtttcaaaatgatgctgtaact

SEQ ID NO: 8391651 - DNA, 22 bp, Homo sapiens
gtttcaaaagtcaggctattct

SEQ ID NO: 8391652 - DNA, 22 bp, Homo sapiens
gtttattgataaaagctggaca

SEQ ID NO: 8391653 - DNA, 22 bp, Homo sapiens
gtttattattcaacttcatgtt

SEQ ID NO: 8391654 - DNA, 22 bp, Homo sapiens
gtttattccagcaatctgctta

SEQ ID NO: 8391655 - DNA, 22 bp, Homo sapiens
gtttattattcaacttcatgtt

SEQ ID NO: 8391656 - DNA, 18 bp, Homo sapiens
gtttacattactgaatag

SEQ ID NO: 8391657 - DNA, 22 bp, Homo sapiens
gtttattattcaacttcatgtt

SEQ ID NO: 8391658 - DNA, 22 bp, Homo sapiens
gtttattattcaacttcatgtt

SEQ ID NO: 8391659 - DNA, 22 bp, Homo sapiens
gtttacattaagtattagcatc

SEQ ID NO: 8391660 - DNA, 22 bp, Homo sapiens
cagctgaggaatactagatgta

SEQ ID NO: 8391661 - DNA, 22 bp, Homo sapiens
cagctgagctcccaggccatca

SEQ ID NO: 8391662 - DNA, 22 bp, Homo sapiens
cagctgagtggaccctagaggc

SEQ ID NO: 8391663 - DNA, 22 bp, Homo sapiens
cagctcttagagggagacagac

SEQ ID NO: 8391664 - DNA, 22 bp, Homo sapiens
cagctcttattttctctcctaa

SEQ ID NO: 8391665 - DNA, 22 bp, Homo sapiens
cagctctttttcacacaacatg

SEQ ID NO: 8391666 - DNA, 22 bp, Homo sapiens
cagctcttttttgcagcagctg

SEQ ID NO: 8391667 - DNA, 22 bp, Homo sapiens
cagctctttttcacacaacatg

SEQ ID NO: 8391668 - DNA, 22 bp, Homo sapiens
cagctcttcctcccaccggaca

SEQ ID NO: 8391669 - DNA, 22 bp, Homo sapiens
cagctcttcctagccatgccac

SEQ ID NO: 8391670 - DNA, 22 bp, Homo sapiens
gtgggcaggccccaaagcaggg

SEQ ID NO: 8391671 - DNA, 22 bp, Homo sapiens
gtgggactcttctttggcagtg

SEQ ID NO: 8391672 - DNA, 22 bp, Homo sapiens
gtgggaagtctctcggaggaag

SEQ ID NO: 8391673 - DNA, 22 bp, Homo sapiens
gtgggacaaggatgaagatatt

SEQ ID NO: 8391674 - DNA, 22 bp, Homo sapiens
gtggcttctggctgggcctcag

SEQ ID NO: 8391675 - DNA, 22 bp, Homo sapiens
gtggcttcttctgccagaagga

SEQ ID NO: 8391676 - DNA, 22 bp, Homo sapiens
gtggctcacgtctgtcatctca

SEQ ID NO: 8391677 - DNA, 22 bp, Homo sapiens
gtggctcacacctgtaatccca

SEQ ID NO: 8391678 - DNA, 22 bp, Homo sapiens
gtggctcacgcctgtaatccca

SEQ ID NO: 8391679 - DNA, 22 bp, Homo sapiens
gtggctcacagcaatgtttcct

SEQ ID NO: 8391680 - DNA, 22 bp, Homo sapiens
cagctctggctttggggagctt

SEQ ID NO: 8391681 - DNA, 22 bp, Homo sapiens
cagctctggctattgaggacca

SEQ ID NO: 8391682 - DNA, 22 bp, Homo sapiens
cagctctgtgcaggcctgggga

SEQ ID NO: 8391683 - DNA, 22 bp, Homo sapiens
cagctctgtctgtagaaacttc

SEQ ID NO: 8391684 - DNA, 22 bp, Homo sapiens
cagctctgtgcaggcctgggga

SEQ ID NO: 8391685 - DNA, 22 bp, Homo sapiens
cagctctgctggtggtgccagg

SEQ ID NO: 8391686 - DNA, 22 bp, Homo sapiens
gtggcccacacagacagcatct

SEQ ID NO: 8391687 - DNA, 19 bp, Homo sapiens
gtggccagggcaggggctg

SEQ ID NO: 8391688 - DNA, 22 bp, Homo sapiens
gtggcagtgaggcaggagcagt

SEQ ID NO: 8391689 - DNA, 22 bp, Homo sapiens
gtggcagtcggaagtcaggaga

SEQ ID NO: 8391690 - DNA, 22 bp, Homo sapiens
gtggcagtcatcaaggacagat

SEQ ID NO: 8391691 - DNA, 22 bp, Homo sapiens
gtggcagtcggaagtcaggaga

SEQ ID NO: 8391692 - DNA, 22 bp, Homo sapiens
gtggcagtagacagtgcatcta

SEQ ID NO: 8391693 - DNA, 22 bp, Homo sapiens
gtggccagtcccgatgcttgtt

SEQ ID NO: 8391694 - DNA, 22 bp, Homo sapiens
gtggcagagccaaggctggagc

SEQ ID NO: 8391695 - DNA, 22 bp, Homo sapiens
gtggcagaaatgggactttgag

SEQ ID NO: 8391696 - DNA, 22 bp, Homo sapiens
gtggcagaagagtaggatgggc

SEQ ID NO: 8391697 - DNA, 22 bp, Homo sapiens
gtggcagaactatgtgattgct

SEQ ID NO: 8391698 - DNA, 22 bp, Homo sapiens
gtggcagagaacaaggagaggt

SEQ ID NO: 8391699 - DNA, 22 bp, Homo sapiens
gtggcagagaacaaggagaggt

SEQ ID NO: 8391700 - DNA, 22 bp, Homo sapiens
gtggcagagaacaaggagaggt

SEQ ID NO: 8391701 - DNA, 22 bp, Homo sapiens
gtggcagagagcaagtgtctga

SEQ ID NO: 8391702 - DNA, 22 bp, Homo sapiens
gtggcagagcaggagacaggac

SEQ ID NO: 8391703 - DNA, 22 bp, Homo sapiens
cagcccaggccgacagttcctc

SEQ ID NO: 8391704 - DNA, 22 bp, Homo sapiens
gtggcactgtttcccacggaag

SEQ ID NO: 8391705 - DNA, 22 bp, Homo sapiens
gtggcagaaactggcagaggag

SEQ ID NO: 8391706 - DNA, 22 bp, Homo sapiens
gtggcagaaactggcagaggag

SEQ ID NO: 8391707 - DNA, 22 bp, Homo sapiens
cagcccagccgagggcctggct

SEQ ID NO: 8391708 - DNA, 22 bp, Homo sapiens
cagcccagcgcaaacaactggc

SEQ ID NO: 8391709 - DNA, 22 bp, Homo sapiens
cagcccaggactgcaggtgttt

SEQ ID NO: 8391710 - DNA, 22 bp, Homo sapiens
cagctgctgttcagttttgttt

SEQ ID NO: 8391711 - DNA, 22 bp, Homo sapiens
cagctgctgttcagttttgttt

SEQ ID NO: 8391712 - DNA, 22 bp, Homo sapiens
cagctgctgttcagttttgttt

SEQ ID NO: 8391713 - DNA, 22 bp, Homo sapiens
cagctgcttctcctccagagct

SEQ ID NO: 8391714 - DNA, 22 bp, Homo sapiens
cagctgctgatggcctgacaga

SEQ ID NO: 8391715 - DNA, 22 bp, Homo sapiens
cagctgctgagaagcctccctt

SEQ ID NO: 8391716 - DNA, 22 bp, Homo sapiens
cagctgctctggtggtctctcc

SEQ ID NO: 8391717 - DNA, 22 bp, Homo sapiens
cagctgcctgtctggaggcaat

SEQ ID NO: 8391718 - DNA, 22 bp, Homo sapiens
gtgggtggatcacctgaggtca

SEQ ID NO: 8391719 - DNA, 22 bp, Homo sapiens
cagctggctgcggtgaggggac

SEQ ID NO: 8391720 - DNA, 22 bp, Homo sapiens
cagctggctccacctctgggct

SEQ ID NO: 8391721 - DNA, 22 bp, Homo sapiens
cagctggccccacagtagaggc

SEQ ID NO: 8391722 - DNA, 22 bp, Homo sapiens
cagctggccctttggtagcctt

SEQ ID NO: 8391723 - DNA, 22 bp, Homo sapiens
cagctggcctgagcggtggcgg

SEQ ID NO: 8391724 - DNA, 22 bp, Homo sapiens
cagctggcctgatccctgtggc

SEQ ID NO: 8391725 - DNA, 22 bp, Homo sapiens
cagctggcgtggagtgattgca

SEQ ID NO: 8391726 - DNA, 22 bp, Homo sapiens
cagctggctccacctctgggct

SEQ ID NO: 8391727 - DNA, 22 bp, Homo sapiens
cagctggcgggcagagccgcca

SEQ ID NO: 8391728 - DNA, 22 bp, Homo sapiens
cagctggcgactctcctcgatg

SEQ ID NO: 8391729 - DNA, 22 bp, Homo sapiens
cagctggcgactctcctcgatg

SEQ ID NO: 8391730 - DNA, 22 bp, Homo sapiens
cagctggcgcctggggaccaga

SEQ ID NO: 8391731 - DNA, 18 bp, Homo sapiens
cagctgcaggctcaggac

SEQ ID NO: 8391732 - DNA, 22 bp, Homo sapiens
cagctgccaagaatcttttcta

SEQ ID NO: 8391733 - DNA, 22 bp, Homo sapiens
cagctgcatgtctgtggtggtc

SEQ ID NO: 8391734 - DNA, 22 bp, Homo sapiens
cagctgcctgcaacacaagctt

SEQ ID NO: 8391735 - DNA, 22 bp, Homo sapiens
gtggggctgcttaggctgcgca

SEQ ID NO: 8391736 - DNA, 22 bp, Homo sapiens
cagctgatggttttgctgagac

SEQ ID NO: 8391737 - DNA, 22 bp, Homo sapiens
cagctgcaggagaaacagaggc

SEQ ID NO: 8391738 - DNA, 22 bp, Homo sapiens
cagctgcagaaagcaagcaggt

SEQ ID NO: 8391739 - DNA, 22 bp, Homo sapiens
gtgtacatattgagtctgctga

SEQ ID NO: 8391740 - DNA, 22 bp, Homo sapiens
gtgtacatagaattgtgctttg

SEQ ID NO: 8391741 - DNA, 22 bp, Homo sapiens
gtgtacagtaagtgaatctagg

SEQ ID NO: 8391742 - DNA, 22 bp, Homo sapiens
gtgtacaggatgactgtactta

SEQ ID NO: 8391743 - DNA, 22 bp, Homo sapiens
gtgggtggggagctctctggag

SEQ ID NO: 8391744 - DNA, 22 bp, Homo sapiens
gtgtcttagggttgcacagagt

SEQ ID NO: 8391745 - DNA, 22 bp, Homo sapiens
gtgtctttattcctctatgttt

SEQ ID NO: 8391746 - DNA, 18 bp, Homo sapiens
gtgtcttattacagtggg

SEQ ID NO: 8391747 - DNA, 22 bp, Homo sapiens
gtgtgagagcaaaactgcagga

SEQ ID NO: 8391748 - DNA, 22 bp, Homo sapiens
gtgtgagagactgaagaaagcc

SEQ ID NO: 8391749 - DNA, 22 bp, Homo sapiens
gtgtgagagaagctgccatgga

SEQ ID NO: 8391750 - DNA, 22 bp, Homo sapiens
gtgtgagaagggaatgtaaagc

SEQ ID NO: 8391751 - DNA, 22 bp, Homo sapiens
gtgtatgttctacttaatatta

SEQ ID NO: 8391752 - DNA, 22 bp, Homo sapiens
gtgtcaaatccactcctctttt

SEQ ID NO: 8391753 - DNA, 22 bp, Homo sapiens
gtgtctgcaagatagccaagtc

SEQ ID NO: 8391754 - DNA, 22 bp, Homo sapiens
gtgtctggaacgggtggtactc

SEQ ID NO: 8391755 - DNA, 22 bp, Homo sapiens
gtgtctgctgcaccctcacacc

SEQ ID NO: 8391756 - DNA, 20 bp, Homo sapiens
gtgtctggagtactagagag

SEQ ID NO: 8391757 - DNA, 22 bp, Homo sapiens
gtgtctggcttatgggaactgg

SEQ ID NO: 8391758 - DNA, 22 bp, Homo sapiens
gtgtcttagaaagactgaatgc

SEQ ID NO: 8391759 - DNA, 17 bp, Homo sapiens
gtgtgctactatcattt

SEQ ID NO: 8391760 - DNA, 22 bp, Homo sapiens
gtgtgctgcccaactcgcagat

SEQ ID NO: 8391761 - DNA, 22 bp, Homo sapiens
cagctggctgcggtgaggggac

SEQ ID NO: 8391762 - DNA, 22 bp, Homo sapiens
cagctggctgcggtgaggggac

SEQ ID NO: 8391763 - DNA, 22 bp, Homo sapiens
cagctgggtgatcttgggcagg

SEQ ID NO: 8391764 - DNA, 22 bp, Homo sapiens
cagctgggcctcctgagccctg

SEQ ID NO: 8391765 - DNA, 22 bp, Homo sapiens
cagctgggctaagagtagaggc

SEQ ID NO: 8391766 - DNA, 22 bp, Homo sapiens
cagctgtctcagggaggtgatc

SEQ ID NO: 8391767 - DNA, 22 bp, Homo sapiens
cagctgtctggggagtgctcgc

SEQ ID NO: 8391768 - DNA, 22 bp, Homo sapiens
cagctgtctttgcacagtttag

SEQ ID NO: 8391769 - DNA, 22 bp, Homo sapiens
cagctgtcttttctaaatatta

SEQ ID NO: 8391770 - DNA, 22 bp, Homo sapiens
cagctgtctgaagcaggagtcc

SEQ ID NO: 8391771 - DNA, 22 bp, Homo sapiens
cagctgtgagagtgcattgaag

SEQ ID NO: 8391772 - DNA, 18 bp, Homo sapiens
ccacagcagagttcttac

SEQ ID NO: 8391773 - DNA, 18 bp, Homo sapiens
ccacagcagagttcttac

SEQ ID NO: 8391774 - DNA, 22 bp, Homo sapiens
ccacagcatgcaggcctgacac

SEQ ID NO: 8391775 - DNA, 22 bp, Homo sapiens
ccacagcacctgcagccagttg

SEQ ID NO: 8391776 - DNA, 22 bp, Homo sapiens
ccacagctagggcaatctgatt

SEQ ID NO: 8391777 - DNA, 22 bp, Homo sapiens
ccacagccattccagggaggct

SEQ ID NO: 8391778 - DNA, 22 bp, Homo sapiens
tcctggggagggttctggctcc

SEQ ID NO: 8391779 - DNA, 22 bp, Homo sapiens
ccacagctcctcagcctctttc

SEQ ID NO: 8391780 - DNA, 23 bp, Homo sapiens
ccacagctatagggtagtgcagt

SEQ ID NO: 8391781 - DNA, 22 bp, Homo sapiens
ccacagagtcttccttctcttc

SEQ ID NO: 8391782 - DNA, 19 bp, Homo sapiens
tcctgcccaccagccaggg

SEQ ID NO: 8391783 - DNA, 22 bp, Homo sapiens
ccacagaatcgctagtggagca

SEQ ID NO: 8391784 - DNA, 22 bp, Homo sapiens
ccacagaatcgctagtggagca

SEQ ID NO: 8391785 - DNA, 22 bp, Homo sapiens
ccacagaatgatgacacttcag

SEQ ID NO: 8391786 - DNA, 20 bp, Homo sapiens
tcctgcagttcctaggaggg

SEQ ID NO: 8391787 - DNA, 22 bp, Homo sapiens
tcctcccacataggacaatggg

SEQ ID NO: 8391788 - DNA, 22 bp, Homo sapiens
tcctccccaaagcccagcctgg

SEQ ID NO: 8391789 - DNA, 22 bp, Homo sapiens
tcctccccaaagcccagcctgg

SEQ ID NO: 8391790 - DNA, 22 bp, Homo sapiens
ccaaatgtgcctgtttcaacaa

SEQ ID NO: 8391791 - DNA, 23 bp, Homo sapiens
tcctcccaaatttcagcctcatt

SEQ ID NO: 8391792 - DNA, 22 bp, Homo sapiens
ccaaagtgctggggttacaggc

SEQ ID NO: 8391793 - DNA, 22 bp, Homo sapiens
ccacacagataagtgttttcta

SEQ ID NO: 8391794 - DNA, 22 bp, Homo sapiens
tcctgcagtgtgtctcctgcac

SEQ ID NO: 8391795 - DNA, 22 bp, Homo sapiens
tcctgcagtgtgtctcctgcac

SEQ ID NO: 8391796 - DNA, 22 bp, Homo sapiens
ccacaagatgcaaactctaaca

SEQ ID NO: 8391797 - DNA, 22 bp, Homo sapiens
ccacaagatgcaaactctaaca

SEQ ID NO: 8391798 - DNA, 22 bp, Homo sapiens
ccacaagactctgtcagcataa

SEQ ID NO: 8391799 - DNA, 22 bp, Homo sapiens
ccaattttattcttctgcaagt

SEQ ID NO: 8391800 - DNA, 23 bp, Homo sapiens
ccaattcatggcagatttgaaga

SEQ ID NO: 8391801 - DNA, 22 bp, Homo sapiens
ccaattcatcctctggggcttc

SEQ ID NO: 8391802 - DNA, 22 bp, Homo sapiens
catttgcttcctgggtcttgaa

SEQ ID NO: 8391803 - DNA, 22 bp, Homo sapiens
catttggaaagagactagagaa

SEQ ID NO: 8391804 - DNA, 22 bp, Homo sapiens
catttgcttgcctcccccaggt

SEQ ID NO: 8391805 - DNA, 22 bp, Homo sapiens
catttgctgtaatgacaataag

SEQ ID NO: 8391806 - DNA, 22 bp, Homo sapiens
catttgctgtattttcagattc

SEQ ID NO: 8391807 - DNA, 17 bp, Homo sapiens
catttgctggttggctc

SEQ ID NO: 8391808 - DNA, 22 bp, Homo sapiens
tccctgcctgacagcacccacc

SEQ ID NO: 8391809 - DNA, 22 bp, Homo sapiens
tccctgcctgacagcacccacc

SEQ ID NO: 8391810 - DNA, 22 bp, Homo sapiens
catttgctcttcatccccaact

SEQ ID NO: 8391811 - DNA, 22 bp, Homo sapiens
catttgctgaggccttcagagg

SEQ ID NO: 8391812 - DNA, 22 bp, Homo sapiens
catttgctggagatggaccaca

SEQ ID NO: 8391813 - DNA, 22 bp, Homo sapiens
catttgctggggtcttgggagt

SEQ ID NO: 8391814 - DNA, 22 bp, Homo sapiens
catttgctctgtgtcagtggca

SEQ ID NO: 8391815 - DNA, 22 bp, Homo sapiens
catttgctagcaggccttttat

SEQ ID NO: 8391816 - DNA, 22 bp, Homo sapiens
catttgctctggttccttctgg

SEQ ID NO: 8391817 - DNA, 22 bp, Homo sapiens
catttgcaaaccaacaagatga

SEQ ID NO: 8391818 - DNA, 22 bp, Homo sapiens
catttgcaagagataaatgttt

SEQ ID NO: 8391819 - DNA, 22 bp, Homo sapiens
catttgaacctggatgttctta

SEQ ID NO: 8391820 - DNA, 22 bp, Homo sapiens
catttctcataatattagcact

SEQ ID NO: 8391821 - DNA, 22 bp, Homo sapiens
catttgaaattcttagaacaaa

SEQ ID NO: 8391822 - DNA, 22 bp, Homo sapiens
tccctgctaattggaatgtata

SEQ ID NO: 8391823 - DNA, 22 bp, Homo sapiens
tccctgctcagctcacctggca

SEQ ID NO: 8391824 - DNA, 22 bp, Homo sapiens
tccctgctcagctcacctggca

SEQ ID NO: 8391825 - DNA, 22 bp, Homo sapiens
tccctgctgagagtgctctccc

SEQ ID NO: 8391826 - DNA, 22 bp, Homo sapiens
tccctgcttggaatgaccctta

SEQ ID NO: 8391827 - DNA, 22 bp, Homo sapiens
tccctgctgggagatgacctta

SEQ ID NO: 8391828 - DNA, 22 bp, Homo sapiens
tccctgctgcactcacacctac

SEQ ID NO: 8391829 - DNA, 15 bp, Homo sapiens
tccctgctggtcaaa

SEQ ID NO: 8391830 - DNA, 22 bp, Homo sapiens
tccctgcttgctctcagccctt

SEQ ID NO: 8391831 - DNA, 21 bp, Homo sapiens
tccctgctttctggcccagtc

SEQ ID NO: 8391832 - DNA, 22 bp, Homo sapiens
tcccagggctctagagtgctgg

SEQ ID NO: 8391833 - DNA, 22 bp, Homo sapiens
tcccagggtcagtggtgaggcc

SEQ ID NO: 8391834 - DNA, 22 bp, Homo sapiens
catttatataaaatgtccagaa

SEQ ID NO: 8391835 - DNA, 22 bp, Homo sapiens
tcccagggccgcaaacgagttt

SEQ ID NO: 8391836 - DNA, 22 bp, Homo sapiens
catttacttaaatctttacaag

SEQ ID NO: 8391837 - DNA, 17 bp, Homo sapiens
tccaggcagcaactgag

SEQ ID NO: 8391838 - DNA, 22 bp, Homo sapiens
catttagttatactaaaacatt

SEQ ID NO: 8391839 - DNA, 22 bp, Homo sapiens
ccactgaaggtcaacatagagc

SEQ ID NO: 8391840 - DNA, 22 bp, Homo sapiens
ccactctgctgtgctccatgat

SEQ ID NO: 8391841 - DNA, 21 bp, Homo sapiens
ccactctgagtgttgaacaga

SEQ ID NO: 8391842 - DNA, 23 bp, Homo sapiens
ccactctcccaccatatctgtat

SEQ ID NO: 8391843 - DNA, 22 bp, Homo sapiens
ccactctgatttcaagggagat

SEQ ID NO: 8391844 - DNA, 22 bp, Homo sapiens
ccactctgattggtcacctctg

SEQ ID NO: 8391845 - DNA, 22 bp, Homo sapiens
ccacagtgaaatcttgatggag

SEQ ID NO: 8391846 - DNA, 22 bp, Homo sapiens
ccacagtctatgcaacaaggtc

SEQ ID NO: 8391847 - DNA, 22 bp, Homo sapiens
ccacagtccgggctggcaggac

SEQ ID NO: 8391848 - DNA, 22 bp, Homo sapiens
ccacagtgacacgggctggccc

SEQ ID NO: 8391849 - DNA, 22 bp, Homo sapiens
ccacagtgagttagattgacca

SEQ ID NO: 8391850 - DNA, 22 bp, Homo sapiens
ccacagtgaaatcttgatggag

SEQ ID NO: 8391851 - DNA, 16 bp, Homo sapiens
ccacctgcagctctca

SEQ ID NO: 8391852 - DNA, 22 bp, Homo sapiens
ccacagtgagttagattgacca

SEQ ID NO: 8391853 - DNA, 22 bp, Homo sapiens
ccacagtaaatggattcagacc

SEQ ID NO: 8391854 - DNA, 20 bp, Homo sapiens
tcctggtcatgtggctgggc

SEQ ID NO: 8391855 - DNA, 22 bp, Homo sapiens
ccagaagatggctcaaaccatg

SEQ ID NO: 8391856 - DNA, 20 bp, Homo sapiens
ccagaagagatgatcatcca

SEQ ID NO: 8391857 - DNA, 22 bp, Homo sapiens
ccagaagaggacacagtgtgga

SEQ ID NO: 8391858 - DNA, 22 bp, Homo sapiens
ccagaagagatcacagttcttg

SEQ ID NO: 8391859 - DNA, 22 bp, Homo sapiens
ccagaagagatcacagttcttg

SEQ ID NO: 8391860 - DNA, 22 bp, Homo sapiens
ccactgcctctccagggccatc

SEQ ID NO: 8391861 - DNA, 22 bp, Homo sapiens
ccactgcctatttgcagggccc

SEQ ID NO: 8391862 - DNA, 22 bp, Homo sapiens
ccactgccagctttgtcctccc

SEQ ID NO: 8391863 - DNA, 22 bp, Homo sapiens
ccactgccatgggctaggcatg

SEQ ID NO: 8391864 - DNA, 22 bp, Homo sapiens
ccagacaggaacacacatctcc

SEQ ID NO: 8391865 - DNA, 22 bp, Homo sapiens
ccagacaggaacacacatctcc

SEQ ID NO: 8391866 - DNA, 22 bp, Homo sapiens
ccagagcctgctgagccccatt

SEQ ID NO: 8391867 - DNA, 20 bp, Homo sapiens
ccagacagcacctgcctggt

SEQ ID NO: 8391868 - DNA, 22 bp, Homo sapiens
ccagaggaaaaatatctcccta

SEQ ID NO: 8391869 - DNA, 22 bp, Homo sapiens
tctctaaatctggttcacttgc

SEQ ID NO: 8391870 - DNA, 22 bp, Homo sapiens
tctctaaatgattgtgtactcc

SEQ ID NO: 8391871 - DNA, 19 bp, Homo sapiens
tctctaaatggtctttcac

SEQ ID NO: 8391872 - DNA, 22 bp, Homo sapiens
tctctaaatgctctcccatccc

SEQ ID NO: 8391873 - DNA, 22 bp, Homo sapiens
tctctaaatgttgggggaaatg

SEQ ID NO: 8391874 - DNA, 22 bp, Homo sapiens
tctctaaataacacttattgaa

SEQ ID NO: 8391875 - DNA, 22 bp, Homo sapiens
tctctaaatacagatgtcatgg

SEQ ID NO: 8391876 - DNA, 22 bp, Homo sapiens
tctctaaagtagaaaagacccc

SEQ ID NO: 8391877 - DNA, 22 bp, Homo sapiens
tctctaaagcactttaaccaca

SEQ ID NO: 8391878 - DNA, 20 bp, Homo sapiens
tctctaaagcacctggacta

SEQ ID NO: 8391879 - DNA, 22 bp, Homo sapiens
tctctaaagcctggaagaggag

SEQ ID NO: 8391880 - DNA, 22 bp, Homo sapiens
tctcctgggaggacaaggaagg

SEQ ID NO: 8391881 - DNA, 22 bp, Homo sapiens
tctcccaagggcacattcaagg

SEQ ID NO: 8391882 - DNA, 22 bp, Homo sapiens
tctcccaaggcacagaaagagt

SEQ ID NO: 8391883 - DNA, 22 bp, Homo sapiens
tctccagtctcaagacattgag

SEQ ID NO: 8391884 - DNA, 22 bp, Homo sapiens
tctccataggcagttcataaca

SEQ ID NO: 8391885 - DNA, 19 bp, Homo sapiens
tctccagttgctttcaggg

SEQ ID NO: 8391886 - DNA, 22 bp, Homo sapiens
ccagaggtgccacagaaagagc

SEQ ID NO: 8391887 - DNA, 22 bp, Homo sapiens
ccagaggtgctgggagaggtct

SEQ ID NO: 8391888 - DNA, 22 bp, Homo sapiens
ccagatagggatgagagtgcta

SEQ ID NO: 8391889 - DNA, 17 bp, Homo sapiens
ccagatcccagtcctta

SEQ ID NO: 8391890 - DNA, 20 bp, Homo sapiens
tctctctggttggaggagct

SEQ ID NO: 8391891 - DNA, 17 bp, Homo sapiens
ccagatgccctgtctcc

SEQ ID NO: 8391892 - DNA, 22 bp, Homo sapiens
tctctaggttgatataaattat

SEQ ID NO: 8391893 - DNA, 22 bp, Homo sapiens
tctctagtataatatagcaaaa

SEQ ID NO: 8391894 - DNA, 22 bp, Homo sapiens
tctctaggcagtgtcagaatca

SEQ ID NO: 8391895 - DNA, 22 bp, Homo sapiens
tctctacataacctcaatactc

SEQ ID NO: 8391896 - DNA, 22 bp, Homo sapiens
tctctacctgctccatagccat

SEQ ID NO: 8391897 - DNA, 21 bp, Homo sapiens
tctctacactttcactaggct

SEQ ID NO: 8391898 - DNA, 22 bp, Homo sapiens
tctctacagacactgttgactt

SEQ ID NO: 8391899 - DNA, 22 bp, Homo sapiens
tctctacagatcctatatagaa

SEQ ID NO: 8391900 - DNA, 22 bp, Homo sapiens
tctctacagatcctatatagaa

SEQ ID NO: 8391901 - DNA, 22 bp, Homo sapiens
tctctacaaaaattagcatgca

SEQ ID NO: 8391902 - DNA, 22 bp, Homo sapiens
tctctaagataggaatacagtt

SEQ ID NO: 8391903 - DNA, 22 bp, Homo sapiens
tctctacacaggattcacatga

SEQ ID NO: 8391904 - DNA, 22 bp, Homo sapiens
ccagaggagatgcctcctctgt

SEQ ID NO: 8391905 - DNA, 22 bp, Homo sapiens
ccagaggacttgggggctgaat

SEQ ID NO: 8391906 - DNA, 22 bp, Homo sapiens
ccagaggacttgggggctgaat

SEQ ID NO: 8391907 - DNA, 22 bp, Homo sapiens
ccagaggagttgaggctttggg

SEQ ID NO: 8391908 - DNA, 22 bp, Homo sapiens
ccagaggaggggggtctttctg

SEQ ID NO: 8391909 - DNA, 22 bp, Homo sapiens
ccagaggagggctctgatgagg

SEQ ID NO: 8391910 - DNA, 22 bp, Homo sapiens
tctgaggcaaacagaggagtgt

SEQ ID NO: 8391911 - DNA, 22 bp, Homo sapiens
tctgaggcagcttgccactcta

SEQ ID NO: 8391912 - DNA, 22 bp, Homo sapiens
tctgaggagttgggccagtgct

SEQ ID NO: 8391913 - DNA, 22 bp, Homo sapiens
tctgaggcccctgggcaggatg

SEQ ID NO: 8391914 - DNA, 22 bp, Homo sapiens
tctgaggcatacccaggccccc

SEQ ID NO: 8391915 - DNA, 22 bp, Homo sapiens
tctgaggcatacccaggccccc

SEQ ID NO: 8391916 - DNA, 22 bp, Homo sapiens
ccagcccgaatccctaaagcaa

SEQ ID NO: 8391917 - DNA, 22 bp, Homo sapiens
ccagcccctatcctcgctccac

SEQ ID NO: 8391918 - DNA, 22 bp, Homo sapiens
tctcttgggaggaaagagagaa

SEQ ID NO: 8391919 - DNA, 22 bp, Homo sapiens
tctcttggaggttcttcctgtt

SEQ ID NO: 8391920 - DNA, 22 bp, Homo sapiens
tctcttggacatgtggctctgc

SEQ ID NO: 8391921 - DNA, 22 bp, Homo sapiens
tctcttggaaagcttgcccact

SEQ ID NO: 8391922 - DNA, 22 bp, Homo sapiens
tctcttgatatattacatagag

SEQ ID NO: 8391923 - DNA, 22 bp, Homo sapiens
tctcttgatgttcccagacagc

SEQ ID NO: 8391924 - DNA, 22 bp, Homo sapiens
tctcttgaagattgaagacaaa

SEQ ID NO: 8391925 - DNA, 19 bp, Homo sapiens
tctcttgaataggtcaaac

SEQ ID NO: 8391926 - DNA, 22 bp, Homo sapiens
tctcttgactgctaaaattaga

SEQ ID NO: 8391927 - DNA, 22 bp, Homo sapiens
tctcttgactgctaaaattaga

SEQ ID NO: 8391928 - DNA, 22 bp, Homo sapiens
tctcttgaagattgaagacaaa

SEQ ID NO: 8391929 - DNA, 19 bp, Homo sapiens
tctcttgaataggtcaaac

SEQ ID NO: 8391930 - DNA, 22 bp, Homo sapiens
tctcttgagctcagttctgatg

SEQ ID NO: 8391931 - DNA, 22 bp, Homo sapiens
tctcttgactgctaaaattaga

SEQ ID NO: 8391932 - DNA, 22 bp, Homo sapiens
tctcttgatatattacatagag

SEQ ID NO: 8391933 - DNA, 23 bp, Homo sapiens
tctctcttagctatgcttatggc

SEQ ID NO: 8391934 - DNA, 22 bp, Homo sapiens
tctctcttgtcaccccatctgc

SEQ ID NO: 8391935 - DNA, 22 bp, Homo sapiens
tctctcttgaagtattagctag

SEQ ID NO: 8391936 - DNA, 22 bp, Homo sapiens
tctgaaataggaaagcaaatgg

SEQ ID NO: 8391937 - DNA, 22 bp, Homo sapiens
tctcttggtgacttaaaatgtt

SEQ ID NO: 8391938 - DNA, 22 bp, Homo sapiens
tctgaaatattggtaatacttt

SEQ ID NO: 8391939 - DNA, 22 bp, Homo sapiens
tctgaaatattggtaatacttt

SEQ ID NO: 8391940 - DNA, 22 bp, Homo sapiens
ccagccactgggccactgccag

SEQ ID NO: 8391941 - DNA, 22 bp, Homo sapiens
ccagccacgaagctcccttcat

SEQ ID NO: 8391942 - DNA, 22 bp, Homo sapiens
ccagccttctgggactctcatc

SEQ ID NO: 8391943 - DNA, 22 bp, Homo sapiens
ccagccttctgagctgcctgga

SEQ ID NO: 8391944 - DNA, 22 bp, Homo sapiens
ccagccttggctttcctagccc

SEQ ID NO: 8391945 - DNA, 19 bp, Homo sapiens
ccagcctttccagtgattg

SEQ ID NO: 8391946 - DNA, 22 bp, Homo sapiens
ccagccttgggggatccaggac

SEQ ID NO: 8391947 - DNA, 22 bp, Homo sapiens
ccagcctttctattggtttctc

SEQ ID NO: 8391948 - DNA, 22 bp, Homo sapiens
ccagcctggttcagaattggct

SEQ ID NO: 8391949 - DNA, 22 bp, Homo sapiens
ccagctccagcatagccaccat

SEQ ID NO: 8391950 - DNA, 22 bp, Homo sapiens
ccagctccaagtttgggcatca

SEQ ID NO: 8391951 - DNA, 22 bp, Homo sapiens
ccagctcatctcagtgaaatgc

SEQ ID NO: 8391952 - DNA, 22 bp, Homo sapiens
ccagctcagggtcacatggcac

SEQ ID NO: 8391953 - DNA, 22 bp, Homo sapiens
ccagctagtaagcacctgcatc

SEQ ID NO: 8391954 - DNA, 22 bp, Homo sapiens
ccagcctcatcatattcctgct

SEQ ID NO: 8391955 - DNA, 22 bp, Homo sapiens
ccagcctggggaggcagcttct

SEQ ID NO: 8391956 - DNA, 22 bp, Homo sapiens
ccagcctggggaggcagcttct

SEQ ID NO: 8391957 - DNA, 22 bp, Homo sapiens
ccagcctggggaggcagcttct

SEQ ID NO: 8391958 - DNA, 22 bp, Homo sapiens
ccagctcctcttcccagtgtca

SEQ ID NO: 8391959 - DNA, 22 bp, Homo sapiens
ccagctcctcttcccagtgtca

SEQ ID NO: 8391960 - DNA, 22 bp, Homo sapiens
ccagctcctcttcccagtgtca

SEQ ID NO: 8391961 - DNA, 19 bp, Homo sapiens
tctgcctctggtcaggctc

SEQ ID NO: 8391962 - DNA, 22 bp, Homo sapiens
tctgcctcgctaacagcagcca

SEQ ID NO: 8391963 - DNA, 22 bp, Homo sapiens
tctgcctcgctaacagcagcca

SEQ ID NO: 8391964 - DNA, 21 bp, Homo sapiens
tctgccagctgaagaggtgga

SEQ ID NO: 8391965 - DNA, 22 bp, Homo sapiens
tctgccagcttctggtggttgc

SEQ ID NO: 8391966 - DNA, 21 bp, Homo sapiens
tctgccagctgaagaggtgga

SEQ ID NO: 8391967 - DNA, 22 bp, Homo sapiens
tctgcctagtgggacagcagcc

SEQ ID NO: 8391968 - DNA, 22 bp, Homo sapiens
tctgcctcctgcttgtcccgac

SEQ ID NO: 8391969 - DNA, 22 bp, Homo sapiens
tctgccaggagccatgagcaag

SEQ ID NO: 8391970 - DNA, 22 bp, Homo sapiens
tctgccaggcattgtgctgctc

SEQ ID NO: 8391971 - DNA, 22 bp, Homo sapiens
tctgccacttttgcttactggg

SEQ ID NO: 8391972 - DNA, 22 bp, Homo sapiens
tctgccagaagccagggtctgg

SEQ ID NO: 8391973 - DNA, 20 bp, Homo sapiens
tctgccactgcactctgccc

SEQ ID NO: 8391974 - DNA, 20 bp, Homo sapiens
tctgccactgcactctgccc

SEQ ID NO: 8391975 - DNA, 22 bp, Homo sapiens
tctgccagctctgtgggtctcg

SEQ ID NO: 8391976 - DNA, 22 bp, Homo sapiens
tctgccagaagttctgagagta

SEQ ID NO: 8391977 - DNA, 22 bp, Homo sapiens
tctgcgctgccttgatccttgg

SEQ ID NO: 8391978 - DNA, 22 bp, Homo sapiens
tctgcgcgctgctggtaccgaa

SEQ ID NO: 8391979 - DNA, 22 bp, Homo sapiens
tctgccttttcactgccactaa

SEQ ID NO: 8391980 - DNA, 22 bp, Homo sapiens
tctgcctgagaagtggggtgcc

SEQ ID NO: 8391981 - DNA, 19 bp, Homo sapiens
tctgcctctggtcaggctc

SEQ ID NO: 8391982 - DNA, 22 bp, Homo sapiens
tctgcctctttcaggcctggca

SEQ ID NO: 8391983 - DNA, 22 bp, Homo sapiens
ccagctggggaagtggggcata

SEQ ID NO: 8391984 - DNA, 22 bp, Homo sapiens
ccagctgggtccctgctggggc

SEQ ID NO: 8391985 - DNA, 22 bp, Homo sapiens
ccagctggggaagtggggcata

SEQ ID NO: 8391986 - DNA, 22 bp, Homo sapiens
ccagctgcttgggaaaatgtct

SEQ ID NO: 8391987 - DNA, 22 bp, Homo sapiens
ccagctgctttttgtcacatgg

SEQ ID NO: 8391988 - DNA, 22 bp, Homo sapiens
tctgctaaggcatttgcttgga

SEQ ID NO: 8391989 - DNA, 22 bp, Homo sapiens
ccagctggtgggtctttctctg

SEQ ID NO: 8391990 - DNA, 22 bp, Homo sapiens
ccagctggtgacatccccaacc

SEQ ID NO: 8391991 - DNA, 22 bp, Homo sapiens
ccagctggtctgtgctcatgtt

SEQ ID NO: 8391992 - DNA, 22 bp, Homo sapiens
tctggagcttgaagctttggtt

SEQ ID NO: 8391993 - DNA, 22 bp, Homo sapiens
tctggagcttgtttcagatggt

SEQ ID NO: 8391994 - DNA, 22 bp, Homo sapiens
tctggagcttgaagctttggtt

SEQ ID NO: 8391995 - DNA, 22 bp, Homo sapiens
tctggcttcccactctgccggg

SEQ ID NO: 8391996 - DNA, 22 bp, Homo sapiens
tctggcttccctacttactatg

SEQ ID NO: 8391997 - DNA, 22 bp, Homo sapiens
tctggcttcagtagggttcact

SEQ ID NO: 8391998 - DNA, 23 bp, Homo sapiens
tctggcttccagtgggttcaacc

SEQ ID NO: 8391999 - DNA, 22 bp, Homo sapiens
tctggcttcgcagctcccagcc

SEQ ID NO: 8392000 - DNA, 22 bp, Homo sapiens
tctggcttctgcaggattacta

SEQ ID NO: 8392001 - DNA, 22 bp, Homo sapiens
tctggcttctcctagagcaatg

SEQ ID NO: 8392002 - DNA, 22 bp, Homo sapiens
tctggctttattttcatcatct

SEQ ID NO: 8392003 - DNA, 22 bp, Homo sapiens
ccagctggtttatattccccac

SEQ ID NO: 8392004 - DNA, 22 bp, Homo sapiens
tctggcttgtgtccttccttgc

SEQ ID NO: 8392005 - DNA, 22 bp, Homo sapiens
tctggctttattccttcactga

SEQ ID NO: 8392006 - DNA, 22 bp, Homo sapiens
ccagctgtcagtgtgaaaataa

SEQ ID NO: 8392007 - DNA, 23 bp, Homo sapiens
tctggctttcacgggtattctta

SEQ ID NO: 8392008 - DNA, 22 bp, Homo sapiens
ccagctgtaggcagggggttta

SEQ ID NO: 8392009 - DNA, 22 bp, Homo sapiens
tctggcttggctggcatctctg

SEQ ID NO: 8392010 - DNA, 22 bp, Homo sapiens
tctggcttggcgctgccctctg

SEQ ID NO: 8392011 - DNA, 22 bp, Homo sapiens
tctggcttgtctcagggtctga

SEQ ID NO: 8392012 - DNA, 22 bp, Homo sapiens
tctggcttgagcttcgaccagt

SEQ ID NO: 8392013 - DNA, 22 bp, Homo sapiens
tctggcttgctggcttggtccc

SEQ ID NO: 8392014 - DNA, 22 bp, Homo sapiens
ccagctgtttctgatgctaggc

SEQ ID NO: 8392015 - DNA, 22 bp, Homo sapiens
ccagctgtttctgatgctaggc

SEQ ID NO: 8392016 - DNA, 22 bp, Homo sapiens
ccagctgtgctgttggcttgtc

SEQ ID NO: 8392017 - DNA, 22 bp, Homo sapiens
ccagctgtgctgttggcttgtc

SEQ ID NO: 8392018 - DNA, 21 bp, Homo sapiens
ccagctgttcctcgtccgatg

SEQ ID NO: 8392019 - DNA, 22 bp, Homo sapiens
ccagctgtgcctaggagcaggg

SEQ ID NO: 8392020 - DNA, 22 bp, Homo sapiens
ccagctgtgcctaggagcaggg

SEQ ID NO: 8392021 - DNA, 22 bp, Homo sapiens
ccagctgtgccggggacctggg

SEQ ID NO: 8392022 - DNA, 22 bp, Homo sapiens
ccagctgtgccggggacctggg

SEQ ID NO: 8392023 - DNA, 18 bp, Homo sapiens
ccagctgtgcagcatctg

SEQ ID NO: 8392024 - DNA, 18 bp, Homo sapiens
ccagctgtgcagcatctg

SEQ ID NO: 8392025 - DNA, 22 bp, Homo sapiens
ccagctgtcttgagaggaggca

SEQ ID NO: 8392026 - DNA, 22 bp, Homo sapiens
ccagctgtcttgagaggaggca

SEQ ID NO: 8392027 - DNA, 22 bp, Homo sapiens
ccagctgtctggttccagagcc

SEQ ID NO: 8392028 - DNA, 22 bp, Homo sapiens
ccagctgtctggttccagagcc

SEQ ID NO: 8392029 - DNA, 19 bp, Homo sapiens
tctgtggcacctgggaggg

SEQ ID NO: 8392030 - DNA, 21 bp, Homo sapiens
tctgtggcagcatgatgaggt

SEQ ID NO: 8392031 - DNA, 22 bp, Homo sapiens
tctgtcttctgtagctaataat

SEQ ID NO: 8392032 - DNA, 22 bp, Homo sapiens
tctgtcttcatcagcatgtgat

SEQ ID NO: 8392033 - DNA, 22 bp, Homo sapiens
tctgtcatcaaatatgctttct

SEQ ID NO: 8392034 - DNA, 22 bp, Homo sapiens
tctgtcataagtgctgaagtat

SEQ ID NO: 8392035 - DNA, 22 bp, Homo sapiens
tctgtcatccaggctggaatat

SEQ ID NO: 8392036 - DNA, 22 bp, Homo sapiens
ccaggaggcggaaggtacagtg

SEQ ID NO: 8392037 - DNA, 22 bp, Homo sapiens
ccaggaggcggaaggtacagtg

SEQ ID NO: 8392038 - DNA, 22 bp, Homo sapiens
ccaggaggcagaggttacagtg

SEQ ID NO: 8392039 - DNA, 22 bp, Homo sapiens
ccaggaggcagaggttacagtg

SEQ ID NO: 8392040 - DNA, 22 bp, Homo sapiens
ccaggaggcggaggttgcagcg

SEQ ID NO: 8392041 - DNA, 22 bp, Homo sapiens
ccaggaggcggaggttgcagcg

SEQ ID NO: 8392042 - DNA, 22 bp, Homo sapiens
tctgtcacttaagaattgccta

SEQ ID NO: 8392043 - DNA, 22 bp, Homo sapiens
ccaggaggcagaagttgcagtg

SEQ ID NO: 8392044 - DNA, 22 bp, Homo sapiens
ccaggaggcagaagttgcagtg

SEQ ID NO: 8392045 - DNA, 22 bp, Homo sapiens
ccaggaagctctgctccacggg

SEQ ID NO: 8392046 - DNA, 22 bp, Homo sapiens
ccaggaaaataccaagctttaa

SEQ ID NO: 8392047 - DNA, 22 bp, Homo sapiens
ccaggaaagaggaagaacgcat

SEQ ID NO: 8392048 - DNA, 22 bp, Homo sapiens
ccaggaaagaggaagaacgcat

SEQ ID NO: 8392049 - DNA, 22 bp, Homo sapiens
ccaggaaacctgcgccatccag

SEQ ID NO: 8392050 - DNA, 22 bp, Homo sapiens
ccaggaaatagtgctgtgatct

SEQ ID NO: 8392051 - DNA, 22 bp, Homo sapiens
ccaggaaaaagagaaacatggt

SEQ ID NO: 8392052 - DNA, 22 bp, Homo sapiens
ccaggaaaaagagaaacatggt

SEQ ID NO: 8392053 - DNA, 22 bp, Homo sapiens
ccaggaaaaagagaaacatggt

SEQ ID NO: 8392054 - DNA, 22 bp, Homo sapiens
ccaggaaatggcttgcttcttt

SEQ ID NO: 8392055 - DNA, 22 bp, Homo sapiens
ccaggaaatagtgctgtgatct

SEQ ID NO: 8392056 - DNA, 22 bp, Homo sapiens
ccaggaaatagtgctgtgatct

SEQ ID NO: 8392057 - DNA, 22 bp, Homo sapiens
ccaggaagacacatgctcatcc

SEQ ID NO: 8392058 - DNA, 22 bp, Homo sapiens
ccaggaagcctcagatgctgag

SEQ ID NO: 8392059 - DNA, 22 bp, Homo sapiens
ccaggaagcctcagatgctgag

SEQ ID NO: 8392060 - DNA, 22 bp, Homo sapiens
cagtttctgggcgttcacaggt

SEQ ID NO: 8392061 - DNA, 22 bp, Homo sapiens
cagtttctgtggtctcttttca

SEQ ID NO: 8392062 - DNA, 22 bp, Homo sapiens
cagtttctgtctgttcttatcc

SEQ ID NO: 8392063 - DNA, 15 bp, Homo sapiens
cagtttctgatcatc

SEQ ID NO: 8392064 - DNA, 22 bp, Homo sapiens
cagtttctgaggttccaggttt

SEQ ID NO: 8392065 - DNA, 22 bp, Homo sapiens
cagtttctgccaggatgtgtta

SEQ ID NO: 8392066 - DNA, 15 bp, Homo sapiens
cagtttctgcttgaa

SEQ ID NO: 8392067 - DNA, 22 bp, Homo sapiens
cagtttctgggaggaaaggaag

SEQ ID NO: 8392068 - DNA, 22 bp, Homo sapiens
cagtttctgagccctgtcattt

SEQ ID NO: 8392069 - DNA, 22 bp, Homo sapiens
cagtttctctcatacatatttg

SEQ ID NO: 8392070 - DNA, 19 bp, Homo sapiens
cagtttgtccagaggggac

SEQ ID NO: 8392071 - DNA, 22 bp, Homo sapiens
tcagcagtggctctcatgcagt

SEQ ID NO: 8392072 - DNA, 22 bp, Homo sapiens
tcagcagtgggtcctgagggtg

SEQ ID NO: 8392073 - DNA, 22 bp, Homo sapiens
cagtttcttctattttgaacta

SEQ ID NO: 8392074 - DNA, 22 bp, Homo sapiens
cagtttcttggatgccaatttc

SEQ ID NO: 8392075 - DNA, 22 bp, Homo sapiens
cagtttctttccattgttacct

SEQ ID NO: 8392076 - DNA, 22 bp, Homo sapiens
cagtttgtatttattactcata

SEQ ID NO: 8392077 - DNA, 22 bp, Homo sapiens
cagtttggcagcaacatggcga

SEQ ID NO: 8392078 - DNA, 22 bp, Homo sapiens
cagtttcttcaattcagacact

SEQ ID NO: 8392079 - DNA, 22 bp, Homo sapiens
cagtttcttcatcagttaagca

SEQ ID NO: 8392080 - DNA, 17 bp, Homo sapiens
cagtttcttccccctct

SEQ ID NO: 8392081 - DNA, 22 bp, Homo sapiens
cagtttcttcatctgcagaatc

SEQ ID NO: 8392082 - DNA, 22 bp, Homo sapiens
cagtttcttcctcccccagaga

SEQ ID NO: 8392083 - DNA, 22 bp, Homo sapiens
cagtttcttagtgacacaaatc

SEQ ID NO: 8392084 - DNA, 22 bp, Homo sapiens
cagtttcttatcttcaaaattg

SEQ ID NO: 8392085 - DNA, 22 bp, Homo sapiens
cagtttcttatcttcaaaattg

SEQ ID NO: 8392086 - DNA, 22 bp, Homo sapiens
cagtttctgttttaaatagcag

SEQ ID NO: 8392087 - DNA, 22 bp, Homo sapiens
cagtttcttaagactgagatct

SEQ ID NO: 8392088 - DNA, 20 bp, Homo sapiens
tcagccctgagtccaggctg

SEQ ID NO: 8392089 - DNA, 22 bp, Homo sapiens
tcagccctggcactgtctccca

SEQ ID NO: 8392090 - DNA, 22 bp, Homo sapiens
tcagccctagaaagtctaagca

SEQ ID NO: 8392091 - DNA, 22 bp, Homo sapiens
tcagccctgggcttcctcatgg

SEQ ID NO: 8392092 - DNA, 22 bp, Homo sapiens
tcagccctgggcttcctcatgg

SEQ ID NO: 8392093 - DNA, 22 bp, Homo sapiens
tcagctctgtgtacagttagca

SEQ ID NO: 8392094 - DNA, 22 bp, Homo sapiens
tcagctgcactgttctgaccca

SEQ ID NO: 8392095 - DNA, 20 bp, Homo sapiens
tcagctcttagaggtcgctt

SEQ ID NO: 8392096 - DNA, 22 bp, Homo sapiens
tcagctgcagtttcacaagcac

SEQ ID NO: 8392097 - DNA, 22 bp, Homo sapiens
tcagctgcagtttcacaagcac

SEQ ID NO: 8392098 - DNA, 22 bp, Homo sapiens
catacatttatacacatctatg

SEQ ID NO: 8392099 - DNA, 22 bp, Homo sapiens
catacattgctcattcagtatc

SEQ ID NO: 8392100 - DNA, 22 bp, Homo sapiens
cataatttttttaagtcagaac

SEQ ID NO: 8392101 - DNA, 22 bp, Homo sapiens
catactttgggataagagtgga

SEQ ID NO: 8392102 - DNA, 22 bp, Homo sapiens
catacttttgccctgacattct

SEQ ID NO: 8392103 - DNA, 22 bp, Homo sapiens
catactttttagatctgccttc

SEQ ID NO: 8392104 - DNA, 22 bp, Homo sapiens
catactcactgttgtatcttcg

SEQ ID NO: 8392105 - DNA, 20 bp, Homo sapiens
tcagggcatgggacagcccc

SEQ ID NO: 8392106 - DNA, 22 bp, Homo sapiens
tcagggcattcaagaggcctgg

SEQ ID NO: 8392107 - DNA, 22 bp, Homo sapiens
tcagggcatgtatgtttcttta

SEQ ID NO: 8392108 - DNA, 20 bp, Homo sapiens
tcagggcatgggacagcccc

SEQ ID NO: 8392109 - DNA, 22 bp, Homo sapiens
catcacagatgttgtgtggagt

SEQ ID NO: 8392110 - DNA, 22 bp, Homo sapiens
catcacatcaaacctactctca

SEQ ID NO: 8392111 - DNA, 22 bp, Homo sapiens
catcacaggtcctgatgacatt

SEQ ID NO: 8392112 - DNA, 22 bp, Homo sapiens
catcacaggcattttgagtgtc

SEQ ID NO: 8392113 - DNA, 19 bp, Homo sapiens
catcacatggtctgatgaa

SEQ ID NO: 8392114 - DNA, 22 bp, Homo sapiens
catcacatgcctatcatgagct

SEQ ID NO: 8392115 - DNA, 22 bp, Homo sapiens
catccagggcagccatggcctg

SEQ ID NO: 8392116 - DNA, 22 bp, Homo sapiens
catccaatgtcctattaagact

SEQ ID NO: 8392117 - DNA, 22 bp, Homo sapiens
catcatcttgaatgactgtgat

SEQ ID NO: 8392118 - DNA, 22 bp, Homo sapiens
catccagagtccaaggctgggc

SEQ ID NO: 8392119 - DNA, 22 bp, Homo sapiens
catccagaccgtgccatgctgc

SEQ ID NO: 8392120 - DNA, 22 bp, Homo sapiens
catccagaccgtgccatgctgc

SEQ ID NO: 8392121 - DNA, 22 bp, Homo sapiens
catatcttctgacatgatcagg

SEQ ID NO: 8392122 - DNA, 22 bp, Homo sapiens
catatcttctgacatgatcagg

SEQ ID NO: 8392123 - DNA, 22 bp, Homo sapiens
catatgaagttcaacagagatg

SEQ ID NO: 8392124 - DNA, 22 bp, Homo sapiens
catatactgcatacatatgtgt

SEQ ID NO: 8392125 - DNA, 22 bp, Homo sapiens
catatactgcatacatatgtgt

SEQ ID NO: 8392126 - DNA, 22 bp, Homo sapiens
catagacaaagatcagaagagt

SEQ ID NO: 8392127 - DNA, 19 bp, Homo sapiens
tcaggaagttgatgaggtg

SEQ ID NO: 8392128 - DNA, 22 bp, Homo sapiens
catataatgtttgaagatgtgg

SEQ ID NO: 8392129 - DNA, 22 bp, Homo sapiens
catataaatacaacatgtgtta

SEQ ID NO: 8392130 - DNA, 22 bp, Homo sapiens
catatacacttccacctctgtg

SEQ ID NO: 8392131 - DNA, 22 bp, Homo sapiens
tcaggaagtgctgaggctgctt

SEQ ID NO: 8392132 - DNA, 22 bp, Homo sapiens
tcaggaagtgctgaggctgctt

SEQ ID NO: 8392133 - DNA, 22 bp, Homo sapiens
tcaggaagtgcctaggctggcc

SEQ ID NO: 8392134 - DNA, 22 bp, Homo sapiens
tcaggaagtggtaaaggatgtt

SEQ ID NO: 8392135 - DNA, 22 bp, Homo sapiens
tcaggaagtggtaaaggatgtt

SEQ ID NO: 8392136 - DNA, 22 bp, Homo sapiens
catccccagagcagttccacta

SEQ ID NO: 8392137 - DNA, 22 bp, Homo sapiens
catctttaaaggggagacaccc

SEQ ID NO: 8392138 - DNA, 22 bp, Homo sapiens
catctttaacaatttacaatgt

SEQ ID NO: 8392139 - DNA, 22 bp, Homo sapiens
catctttaacaatttacaatgt

SEQ ID NO: 8392140 - DNA, 21 bp, Homo sapiens
catcttaattgaaagcagaga

SEQ ID NO: 8392141 - DNA, 22 bp, Homo sapiens
catcttaataaatctcctccct

SEQ ID NO: 8392142 - DNA, 22 bp, Homo sapiens
catcttaacaggtctctgaggg

SEQ ID NO: 8392143 - DNA, 22 bp, Homo sapiens
catcttaaattaaagcttaagg

SEQ ID NO: 8392144 - DNA, 22 bp, Homo sapiens
catctttgaactctgtataaac

SEQ ID NO: 8392145 - DNA, 22 bp, Homo sapiens
catctttgagacagcattaccc

SEQ ID NO: 8392146 - DNA, 22 bp, Homo sapiens
catctttatttatatagacagg

SEQ ID NO: 8392147 - DNA, 22 bp, Homo sapiens
catctttatttatatagacagg

SEQ ID NO: 8392148 - DNA, 22 bp, Homo sapiens
catctttagggaccattattct

SEQ ID NO: 8392149 - DNA, 22 bp, Homo sapiens
catctttagggaccattattct

SEQ ID NO: 8392150 - DNA, 22 bp, Homo sapiens
catctttagggaccattattct

SEQ ID NO: 8392151 - DNA, 22 bp, Homo sapiens
catctttaatttgtgacaacta

SEQ ID NO: 8392152 - DNA, 22 bp, Homo sapiens
catctttagttattgaatatag

SEQ ID NO: 8392153 - DNA, 22 bp, Homo sapiens
catctttagtaggttctggaga

SEQ ID NO: 8392154 - DNA, 22 bp, Homo sapiens
tcagttctgctagaaaaacagt

SEQ ID NO: 8392155 - DNA, 22 bp, Homo sapiens
tcagttctaagtgctttacatg

SEQ ID NO: 8392156 - DNA, 22 bp, Homo sapiens
tcagttctaacagtttagaaca

SEQ ID NO: 8392157 - DNA, 22 bp, Homo sapiens
tcagttctttatttcacagtga

SEQ ID NO: 8392158 - DNA, 22 bp, Homo sapiens
tcagttcttagtaatgcagtct

SEQ ID NO: 8392159 - DNA, 22 bp, Homo sapiens
tcagttcttattttcatgaata

SEQ ID NO: 8392160 - DNA, 22 bp, Homo sapiens
tcatttcaagttctgacagcta

SEQ ID NO: 8392161 - DNA, 22 bp, Homo sapiens
tcatttgttgaactttagtgcg

SEQ ID NO: 8392162 - DNA, 22 bp, Homo sapiens
tcatgtcagctgttgatgtgca

SEQ ID NO: 8392163 - DNA, 19 bp, Homo sapiens
tcatgtctctcatctgtga

SEQ ID NO: 8392164 - DNA, 22 bp, Homo sapiens
tcatgtctctatgtgcctatta

SEQ ID NO: 8392165 - DNA, 22 bp, Homo sapiens
tcatgtacatgtaagtcagaaa

SEQ ID NO: 8392166 - DNA, 22 bp, Homo sapiens
tcatgtacatgtaagtcagaaa

SEQ ID NO: 8392167 - DNA, 22 bp, Homo sapiens
tcatgtattgaaaagcatttta

SEQ ID NO: 8392168 - DNA, 22 bp, Homo sapiens
tcatggtatatttcactcttta

SEQ ID NO: 8392169 - DNA, 22 bp, Homo sapiens
catgatttactaaaatttgttt

SEQ ID NO: 8392170 - DNA, 22 bp, Homo sapiens
tcatgggaacaccagtattctc

SEQ ID NO: 8392171 - DNA, 22 bp, Homo sapiens
catgagaaggttttggcatata

SEQ ID NO: 8392172 - DNA, 22 bp, Homo sapiens
tcagtttaatacccagatgcct

SEQ ID NO: 8392173 - DNA, 22 bp, Homo sapiens
tcagtttaagatgactaacaat

SEQ ID NO: 8392174 - DNA, 22 bp, Homo sapiens
tcagtttataaattgtatttag

SEQ ID NO: 8392175 - DNA, 22 bp, Homo sapiens
tcagtttatggtctagttcatg

SEQ ID NO: 8392176 - DNA, 22 bp, Homo sapiens
catgataacttcattacacaat

SEQ ID NO: 8392177 - DNA, 21 bp, Homo sapiens
catgataatgaaggtgttatt

SEQ ID NO: 8392178 - DNA, 22 bp, Homo sapiens
catgataacttcattacacaat

SEQ ID NO: 8392179 - DNA, 22 bp, Homo sapiens
catgatcaccacttgacagccc

SEQ ID NO: 8392180 - DNA, 22 bp, Homo sapiens
catgatggttcttacaaaggtg

SEQ ID NO: 8392181 - DNA, 22 bp, Homo sapiens
catgatcagaaagagaagctag

SEQ ID NO: 8392182 - DNA, 22 bp, Homo sapiens
catgtgaattccaaagctaggt

SEQ ID NO: 8392183 - DNA, 22 bp, Homo sapiens
catgtctttcaaaccacacagt

SEQ ID NO: 8392184 - DNA, 22 bp, Homo sapiens
catgtgcagactctgacaggct

SEQ ID NO: 8392185 - DNA, 22 bp, Homo sapiens
catgtgagaaacagtgatgtcg

SEQ ID NO: 8392186 - DNA, 19 bp, Homo sapiens
catgtgcatgagcacagga

SEQ ID NO: 8392187 - DNA, 22 bp, Homo sapiens
tccaggcaaagtgctgggctgc

SEQ ID NO: 8392188 - DNA, 22 bp, Homo sapiens
tccaggcaaagtgctgggctgc

SEQ ID NO: 8392189 - DNA, 22 bp, Homo sapiens
catgtacatgcctactatcaat

SEQ ID NO: 8392190 - DNA, 22 bp, Homo sapiens
catgtctgccaatttggaagga

SEQ ID NO: 8392191 - DNA, 22 bp, Homo sapiens
catgtacatgcctactatcaat

SEQ ID NO: 8392192 - DNA, 22 bp, Homo sapiens
catgtacatgcctactatcaat

SEQ ID NO: 8392193 - DNA, 21 bp, Homo sapiens
tccagccagtaaatgctcagc

SEQ ID NO: 8392194 - DNA, 22 bp, Homo sapiens
tcattttgcctgccatttgagt

SEQ ID NO: 8392195 - DNA, 22 bp, Homo sapiens
tcattttggccatgatacagac

SEQ ID NO: 8392196 - DNA, 22 bp, Homo sapiens
catgattttgtcttgtgttaat

SEQ ID NO: 8392197 - DNA, 22 bp, Homo sapiens
tcatttttagcgcgcaaaagtt

SEQ ID NO: 8392198 - DNA, 22 bp, Homo sapiens
catgatttactaaaatttgttt

SEQ ID NO: 8392199 - DNA, 22 bp, Homo sapiens
catgcaaaggtcaagatcagga

SEQ ID NO: 8392200 - DNA, 22 bp, Homo sapiens
catgcaaaggtcaagatcagga

SEQ ID NO: 8392201 - DNA, 22 bp, Homo sapiens
catggcttgcaagcataggaga

SEQ ID NO: 8392202 - DNA, 22 bp, Homo sapiens
catggcttgctagtggcccaag

SEQ ID NO: 8392203 - DNA, 22 bp, Homo sapiens
catggcttggagcaggatgaga

SEQ ID NO: 8392204 - DNA, 22 bp, Homo sapiens
catggcttgtcttgtcttctga

SEQ ID NO: 8392205 - DNA, 22 bp, Homo sapiens
catggcttaccccaggagcagc

SEQ ID NO: 8392206 - DNA, 22 bp, Homo sapiens
catggcttagaagttccagccc

SEQ ID NO: 8392207 - DNA, 22 bp, Homo sapiens
catggctggtgcacctctggga

SEQ ID NO: 8392208 - DNA, 22 bp, Homo sapiens
catggctggcacacagcaacca

SEQ ID NO: 8392209 - DNA, 22 bp, Homo sapiens
catggccagccctgaggttcag

SEQ ID NO: 8392210 - DNA, 22 bp, Homo sapiens
catgcacaaaggtaagatgcgt

SEQ ID NO: 8392211 - DNA, 19 bp, Homo sapiens
cagtgcccaccctagcaca

SEQ ID NO: 8392212 - DNA, 22 bp, Homo sapiens
cagtgcagaggccagggaggat

SEQ ID NO: 8392213 - DNA, 22 bp, Homo sapiens
cagtgcagaggccagggaggat

SEQ ID NO: 8392214 - DNA, 22 bp, Homo sapiens
tcaccagggctccagccagcct

SEQ ID NO: 8392215 - DNA, 22 bp, Homo sapiens
tcaccagggctccagccagcct

SEQ ID NO: 8392216 - DNA, 22 bp, Homo sapiens
cagtgctgtgtttgctgcctgg

SEQ ID NO: 8392217 - DNA, 18 bp, Homo sapiens
cagtgctgttaacagtga

SEQ ID NO: 8392218 - DNA, 22 bp, Homo sapiens
tcacttccctcttcagctccca

SEQ ID NO: 8392219 - DNA, 22 bp, Homo sapiens
tcagaaagtgaactgttgacat

SEQ ID NO: 8392220 - DNA, 22 bp, Homo sapiens
tcactcaggttcatgtctttgt

SEQ ID NO: 8392221 - DNA, 22 bp, Homo sapiens
tcactcagtttttggcctctgc

SEQ ID NO: 8392222 - DNA, 22 bp, Homo sapiens
tcactcaggctggagtgcagtg

SEQ ID NO: 8392223 - DNA, 22 bp, Homo sapiens
tcacccagaaaagacagcagat

SEQ ID NO: 8392224 - DNA, 22 bp, Homo sapiens
tcactcagagatagcctcattt

SEQ ID NO: 8392225 - DNA, 22 bp, Homo sapiens
tcactcagcattcactgggcct

SEQ ID NO: 8392226 - DNA, 22 bp, Homo sapiens
tcactcagctagcttcaggagc

SEQ ID NO: 8392227 - DNA, 22 bp, Homo sapiens
tcagaaatacaaaacacttact

SEQ ID NO: 8392228 - DNA, 22 bp, Homo sapiens
tcagaaatactatcagcttttg

SEQ ID NO: 8392229 - DNA, 22 bp, Homo sapiens
tcagaaatagtctttaaaatga

SEQ ID NO: 8392230 - DNA, 22 bp, Homo sapiens
tcagaaatgatcgttattcatt

SEQ ID NO: 8392231 - DNA, 22 bp, Homo sapiens
tcagaaatgatcgttattcatt

SEQ ID NO: 8392232 - DNA, 22 bp, Homo sapiens
tcagaaatgtaagctgatgact

SEQ ID NO: 8392233 - DNA, 22 bp, Homo sapiens
tcagaaatgatcgttattcatt

SEQ ID NO: 8392234 - DNA, 22 bp, Homo sapiens
tcagaagctgggtctcagaagc

SEQ ID NO: 8392235 - DNA, 22 bp, Homo sapiens
tcagaaggatgtgcaggtggca

SEQ ID NO: 8392236 - DNA, 22 bp, Homo sapiens
cagtgcagacgtggagggggca

SEQ ID NO: 8392237 - DNA, 17 bp, Homo sapiens
cagtgcagagccctttc

SEQ ID NO: 8392238 - DNA, 22 bp, Homo sapiens
cagtgcagaacacatggaaaat

SEQ ID NO: 8392239 - DNA, 22 bp, Homo sapiens
cagtgattaaaacatgacagcc

SEQ ID NO: 8392240 - DNA, 17 bp, Homo sapiens
cagtgatcattacatta

SEQ ID NO: 8392241 - DNA, 22 bp, Homo sapiens
cagtgaggtggatggatggcct

SEQ ID NO: 8392242 - DNA, 22 bp, Homo sapiens
cagtgaggtggatggatggcct

SEQ ID NO: 8392243 - DNA, 22 bp, Homo sapiens
cagtgaggtggatggatggcct

SEQ ID NO: 8392244 - DNA, 22 bp, Homo sapiens
cagtgaggtagacagctttttc

SEQ ID NO: 8392245 - DNA, 21 bp, Homo sapiens
cagtgaggtccccagcctagg

SEQ ID NO: 8392246 - DNA, 22 bp, Homo sapiens
cagtgaggtgcccagcctgccc

SEQ ID NO: 8392247 - DNA, 22 bp, Homo sapiens
cagtgaggtgcccagcctgccc

SEQ ID NO: 8392248 - DNA, 22 bp, Homo sapiens
cagtctcaccctggaggcccca

SEQ ID NO: 8392249 - DNA, 20 bp, Homo sapiens
cagtgaggaggtgctggggg

SEQ ID NO: 8392250 - DNA, 20 bp, Homo sapiens
cagtgaggaggtgctggggg

SEQ ID NO: 8392251 - DNA, 22 bp, Homo sapiens
tatttagttatctttcataaaa

SEQ ID NO: 8392252 - DNA, 22 bp, Homo sapiens
tatttagttatctttcataaaa

SEQ ID NO: 8392253 - DNA, 22 bp, Homo sapiens
tatttagatgcatttggattgc

SEQ ID NO: 8392254 - DNA, 22 bp, Homo sapiens
tatttagatgcatttggattgc

SEQ ID NO: 8392255 - DNA, 22 bp, Homo sapiens
tatttacttttaaattgagaac

SEQ ID NO: 8392256 - DNA, 22 bp, Homo sapiens
tatttacttttaaattgagaac

SEQ ID NO: 8392257 - DNA, 22 bp, Homo sapiens
tatttactgtatttgaagttga

SEQ ID NO: 8392258 - DNA, 20 bp, Homo sapiens
tatttacaacttagagcctc

SEQ ID NO: 8392259 - DNA, 22 bp, Homo sapiens
tattggaaggcattagtgaata

SEQ ID NO: 8392260 - DNA, 22 bp, Homo sapiens
tattggaatgcactgggagaga

SEQ ID NO: 8392261 - DNA, 22 bp, Homo sapiens
cagtcctctctgtgtctgcacc

SEQ ID NO: 8392262 - DNA, 22 bp, Homo sapiens
cagtcctgggtgcagcaggaaa

SEQ ID NO: 8392263 - DNA, 20 bp, Homo sapiens
cagtcctgtccctgctgccc

SEQ ID NO: 8392264 - DNA, 22 bp, Homo sapiens
cagtccttgatccaatagtggg

SEQ ID NO: 8392265 - DNA, 22 bp, Homo sapiens
tatgtttttaagagaatgcatt

SEQ ID NO: 8392266 - DNA, 22 bp, Homo sapiens
tatgtgtattgagcattgttac

SEQ ID NO: 8392267 - DNA, 22 bp, Homo sapiens
tatgtactaactttcattctag

SEQ ID NO: 8392268 - DNA, 22 bp, Homo sapiens
tatgtgtaatcaaacacatgct

SEQ ID NO: 8392269 - DNA, 22 bp, Homo sapiens
tattaaagagagaatcatcatc

SEQ ID NO: 8392270 - DNA, 22 bp, Homo sapiens
tattaaagagagaatcatcatc

SEQ ID NO: 8392271 - DNA, 22 bp, Homo sapiens
tattaaagggaagttatgcatg

SEQ ID NO: 8392272 - DNA, 22 bp, Homo sapiens
tattaaatatatctgttagttg

SEQ ID NO: 8392273 - DNA, 22 bp, Homo sapiens
tattaaatatatctgttagttg

SEQ ID NO: 8392274 - DNA, 22 bp, Homo sapiens
tatgcacagttacaagaatatc

SEQ ID NO: 8392275 - DNA, 22 bp, Homo sapiens
tatggataggtttcaagaatgc

SEQ ID NO: 8392276 - DNA, 22 bp, Homo sapiens
tatgcacagaagtttgctgaat

SEQ ID NO: 8392277 - DNA, 22 bp, Homo sapiens
tatctctagcgcacagaagaaa

SEQ ID NO: 8392278 - DNA, 22 bp, Homo sapiens
tatctctttattgacaataaaa

SEQ ID NO: 8392279 - DNA, 22 bp, Homo sapiens
caggtctgtttccatcagtgct

SEQ ID NO: 8392280 - DNA, 22 bp, Homo sapiens
caggtctgtattaacagagggt

SEQ ID NO: 8392281 - DNA, 22 bp, Homo sapiens
caggtctgtttccatcagtgct

SEQ ID NO: 8392282 - DNA, 18 bp, Homo sapiens
caggtctgtctgcctccc

SEQ ID NO: 8392283 - DNA, 22 bp, Homo sapiens
tatgtacatgttaaagggcaaa

SEQ ID NO: 8392284 - DNA, 22 bp, Homo sapiens
caggtctgttttcaaggtcagt

SEQ ID NO: 8392285 - DNA, 22 bp, Homo sapiens
caggtctttgttgcagcatgga

SEQ ID NO: 8392286 - DNA, 23 bp, Homo sapiens
tatggcttacagtgctttaggta

SEQ ID NO: 8392287 - DNA, 22 bp, Homo sapiens
tatggcttatgctgaacacctg

SEQ ID NO: 8392288 - DNA, 22 bp, Homo sapiens
caggtctggtgagagaacagtt

SEQ ID NO: 8392289 - DNA, 22 bp, Homo sapiens
caggtctggtgagagaacagtt

SEQ ID NO: 8392290 - DNA, 22 bp, Homo sapiens
tatacagttaagtttcttcagt

SEQ ID NO: 8392291 - DNA, 22 bp, Homo sapiens
tatacagtttgagttcttgcat

SEQ ID NO: 8392292 - DNA, 22 bp, Homo sapiens
caggtctgaagagtcacatgcc

SEQ ID NO: 8392293 - DNA, 17 bp, Homo sapiens
caggtctgaggccaggc

SEQ ID NO: 8392294 - DNA, 22 bp, Homo sapiens
caggtctgcagacagggccatg

SEQ ID NO: 8392295 - DNA, 22 bp, Homo sapiens
caggtctgcaggctggagtcca

SEQ ID NO: 8392296 - DNA, 22 bp, Homo sapiens
caggtctggcatcagctgtgtg

SEQ ID NO: 8392297 - DNA, 22 bp, Homo sapiens
cagggtggcacatcacagcatt

SEQ ID NO: 8392298 - DNA, 22 bp, Homo sapiens
cagggtggcacatcacagcatt

SEQ ID NO: 8392299 - DNA, 22 bp, Homo sapiens
cagggtggcacatcacagcatt

SEQ ID NO: 8392300 - DNA, 22 bp, Homo sapiens
cagggtggaagctgtagagtgg

SEQ ID NO: 8392301 - DNA, 22 bp, Homo sapiens
cagggtggcactcagcgcatct

SEQ ID NO: 8392302 - DNA, 22 bp, Homo sapiens
tatacagtatcttttgaaggca

SEQ ID NO: 8392303 - DNA, 23 bp, Homo sapiens
tatacagtctccaggcagtcctt

SEQ ID NO: 8392304 - DNA, 22 bp, Homo sapiens
tatacagtcttttgctatattc

SEQ ID NO: 8392305 - DNA, 20 bp, Homo sapiens
tatacagtcttttgggaaaa

SEQ ID NO: 8392306 - DNA, 22 bp, Homo sapiens
tatacagtcttttgctatattc

SEQ ID NO: 8392307 - DNA, 22 bp, Homo sapiens
tatacagttaagtttcttcagt

SEQ ID NO: 8392308 - DNA, 22 bp, Homo sapiens
tatacagtgcctcttccattag

SEQ ID NO: 8392309 - DNA, 22 bp, Homo sapiens
tatacagctatggcaagacaaa

SEQ ID NO: 8392310 - DNA, 21 bp, Homo sapiens
tatacagtaattaagtggtat

SEQ ID NO: 8392311 - DNA, 22 bp, Homo sapiens
tataatcctgcttcacattgaa

SEQ ID NO: 8392312 - DNA, 22 bp, Homo sapiens
tataatattccttgttgtaggt

SEQ ID NO: 8392313 - DNA, 22 bp, Homo sapiens
tataatattccttgttgtaggt

SEQ ID NO: 8392314 - DNA, 22 bp, Homo sapiens
caggggcaagaatgctgtcagc

SEQ ID NO: 8392315 - DNA, 22 bp, Homo sapiens
tataatatgaggcaggagtgat

SEQ ID NO: 8392316 - DNA, 22 bp, Homo sapiens
tataatatgaggcaggagtgat

SEQ ID NO: 8392317 - DNA, 22 bp, Homo sapiens
tacatgtggtagggagggcagt

SEQ ID NO: 8392318 - DNA, 22 bp, Homo sapiens
tataagaagtgaagaagagtta

SEQ ID NO: 8392319 - DNA, 22 bp, Homo sapiens
tataagaatgcttgtttggggt

SEQ ID NO: 8392320 - DNA, 22 bp, Homo sapiens
tataagaaattgccaacctgtt

SEQ ID NO: 8392321 - DNA, 22 bp, Homo sapiens
tagttttagtcccattttacag

SEQ ID NO: 8392322 - DNA, 22 bp, Homo sapiens
tataagaaacaaggcaaatttt

SEQ ID NO: 8392323 - DNA, 22 bp, Homo sapiens
cagggtggaacaggcaatactt

SEQ ID NO: 8392324 - DNA, 22 bp, Homo sapiens
cagggtggaagctgtagagtgg

SEQ ID NO: 8392325 - DNA, 22 bp, Homo sapiens
caggggcctggctgtctaggaa

SEQ ID NO: 8392326 - DNA, 22 bp, Homo sapiens
ttagaacatagcaacagaatta

SEQ ID NO: 8392327 - DNA, 22 bp, Homo sapiens
ttagaacatagcaacagaatta

SEQ ID NO: 8392328 - DNA, 22 bp, Homo sapiens
ttagaacatagcaacagaatta

SEQ ID NO: 8392329 - DNA, 22 bp, Homo sapiens
ttagataacagtagaatatcaa

SEQ ID NO: 8392330 - DNA, 22 bp, Homo sapiens
ttagataatgtagagatatgag

SEQ ID NO: 8392331 - DNA, 22 bp, Homo sapiens
ttagaaagctttccatagtcaa

SEQ ID NO: 8392332 - DNA, 22 bp, Homo sapiens
ttacattttgcacagatgtccc

SEQ ID NO: 8392333 - DNA, 22 bp, Homo sapiens
ttagaaagctttccatagtcaa

SEQ ID NO: 8392334 - DNA, 22 bp, Homo sapiens
ttagaaaggttttgctctgaaa

SEQ ID NO: 8392335 - DNA, 22 bp, Homo sapiens
ttagaaagggtgtctgaatctg

SEQ ID NO: 8392336 - DNA, 22 bp, Homo sapiens
ttagaaatacaagtgaggttga

SEQ ID NO: 8392337 - DNA, 22 bp, Homo sapiens
ttagaaatacaagtgaggttga

SEQ ID NO: 8392338 - DNA, 22 bp, Homo sapiens
ttagaaatatggtgctgccgcc

SEQ ID NO: 8392339 - DNA, 22 bp, Homo sapiens
ttagaaaggggtgaatcaatgg

SEQ ID NO: 8392340 - DNA, 22 bp, Homo sapiens
ttagaaaggggtgaatcaatgg

SEQ ID NO: 8392341 - DNA, 22 bp, Homo sapiens
ttagaaatgatttcacctcttt

SEQ ID NO: 8392342 - DNA, 22 bp, Homo sapiens
ttagaaatcacctctgaagatc

SEQ ID NO: 8392343 - DNA, 22 bp, Homo sapiens
ttagaaatctgctgccatgcaa

SEQ ID NO: 8392344 - DNA, 22 bp, Homo sapiens
ttagaaatgcacccaagaccta

SEQ ID NO: 8392345 - DNA, 22 bp, Homo sapiens
ttagaaatgcacccaagaccta

SEQ ID NO: 8392346 - DNA, 22 bp, Homo sapiens
ttagaaatctgctgccatgcaa

SEQ ID NO: 8392347 - DNA, 22 bp, Homo sapiens
ttagaaatcacctctgaagatc

SEQ ID NO: 8392348 - DNA, 22 bp, Homo sapiens
ttagaaatgtcacagatctgat

SEQ ID NO: 8392349 - DNA, 22 bp, Homo sapiens
ttagaaatgtcacagatctgat

SEQ ID NO: 8392350 - DNA, 22 bp, Homo sapiens
ttagaaatgtcacagatctgat

SEQ ID NO: 8392351 - DNA, 22 bp, Homo sapiens
ttagcaggtttctggctcttgg

SEQ ID NO: 8392352 - DNA, 22 bp, Homo sapiens
ttagcatagccattgaaatatg

SEQ ID NO: 8392353 - DNA, 22 bp, Homo sapiens
ttagcactgtctggttatcttg

SEQ ID NO: 8392354 - DNA, 22 bp, Homo sapiens
ttagcactttgattcatgcaga

SEQ ID NO: 8392355 - DNA, 22 bp, Homo sapiens
ttagcaaacctggactacagat

SEQ ID NO: 8392356 - DNA, 22 bp, Homo sapiens
ttagatgtgcaggacttttatc

SEQ ID NO: 8392357 - DNA, 22 bp, Homo sapiens
ttagatttacaagcactgttta

SEQ ID NO: 8392358 - DNA, 22 bp, Homo sapiens
ttagcaaaaatatctcatatta

SEQ ID NO: 8392359 - DNA, 22 bp, Homo sapiens
ttagcaaacctggactacagat

SEQ ID NO: 8392360 - DNA, 22 bp, Homo sapiens
ttagcaaacaaatgaaatggtt

SEQ ID NO: 8392361 - DNA, 22 bp, Homo sapiens
ttagggttacaccagcctcctg

SEQ ID NO: 8392362 - DNA, 22 bp, Homo sapiens
ttagcatttctggaatcacaag

SEQ ID NO: 8392363 - DNA, 22 bp, Homo sapiens
ttagcatttcagtacacatgtt

SEQ ID NO: 8392364 - DNA, 22 bp, Homo sapiens
ttaggaagaaggaggcagtatt

SEQ ID NO: 8392365 - DNA, 22 bp, Homo sapiens
ttaggaagaaggaggcagtatt

SEQ ID NO: 8392366 - DNA, 22 bp, Homo sapiens
ttattcttggatctgagtctct

SEQ ID NO: 8392367 - DNA, 22 bp, Homo sapiens
ttatttatggcactgttggtgg

SEQ ID NO: 8392368 - DNA, 22 bp, Homo sapiens
ttatttatggccctcacctgat

SEQ ID NO: 8392369 - DNA, 22 bp, Homo sapiens
ttattcatcagtgcattaattt

SEQ ID NO: 8392370 - DNA, 22 bp, Homo sapiens
ttagtctccagcttagggtttg

SEQ ID NO: 8392371 - DNA, 22 bp, Homo sapiens
ttatctgtttaacaaagtatct

SEQ ID NO: 8392372 - DNA, 22 bp, Homo sapiens
ttatatgtatgcttataaacca

SEQ ID NO: 8392373 - DNA, 22 bp, Homo sapiens
ttatctgaaaacctcaaaatat

SEQ ID NO: 8392374 - DNA, 22 bp, Homo sapiens
ttatgacaggaaaatcacagaa

SEQ ID NO: 8392375 - DNA, 22 bp, Homo sapiens
ttatgacagaaatgaaaagctg

SEQ ID NO: 8392376 - DNA, 22 bp, Homo sapiens
ttatgacagaaatgaaaagctg

SEQ ID NO: 8392377 - DNA, 22 bp, Homo sapiens
ttatgaaagacatttctgttgg

SEQ ID NO: 8392378 - DNA, 22 bp, Homo sapiens
ttatgaacaatttctaggaatg

SEQ ID NO: 8392379 - DNA, 22 bp, Homo sapiens
ttatgacatatgagtacaagta

SEQ ID NO: 8392380 - DNA, 22 bp, Homo sapiens
ttatgatttgccacagattggt

SEQ ID NO: 8392381 - DNA, 22 bp, Homo sapiens
ttattattgattcgctctcaaa

SEQ ID NO: 8392382 - DNA, 22 bp, Homo sapiens
ttattattccccaagtcattat

SEQ ID NO: 8392383 - DNA, 22 bp, Homo sapiens
ttatgcaacaggtgagcagaca

SEQ ID NO: 8392384 - DNA, 22 bp, Homo sapiens
ttacaagataacggagaaagca

SEQ ID NO: 8392385 - DNA, 22 bp, Homo sapiens
ttacaagacagtgtggtaaata

SEQ ID NO: 8392386 - DNA, 22 bp, Homo sapiens
ttacaattgagtctattgtatg

SEQ ID NO: 8392387 - DNA, 22 bp, Homo sapiens
ttacaattgagtctattgtatg

SEQ ID NO: 8392388 - DNA, 22 bp, Homo sapiens
ttacaattgagtctattgtatg

SEQ ID NO: 8392389 - DNA, 22 bp, Homo sapiens
ttacaattgagtctattgtatg

SEQ ID NO: 8392390 - DNA, 22 bp, Homo sapiens
ttacaattacttgatctcagct

SEQ ID NO: 8392391 - DNA, 22 bp, Homo sapiens
ttacagatacatttcttttgtt

SEQ ID NO: 8392392 - DNA, 22 bp, Homo sapiens
ttacacaaaaataagatatggc

SEQ ID NO: 8392393 - DNA, 22 bp, Homo sapiens
ttacacaaaaataagatatggc

SEQ ID NO: 8392394 - DNA, 22 bp, Homo sapiens
ttacacaaacacattccagata

SEQ ID NO: 8392395 - DNA, 22 bp, Homo sapiens
ttacagaatgtgccatttggtc

SEQ ID NO: 8392396 - DNA, 22 bp, Homo sapiens
ttacattttagttaacctgtga

SEQ ID NO: 8392397 - DNA, 22 bp, Homo sapiens
ttacatttggctatgtcctcta

SEQ ID NO: 8392398 - DNA, 22 bp, Homo sapiens
ttacattttagttaacctgtga

SEQ ID NO: 8392399 - DNA, 22 bp, Homo sapiens
ttacattttgcacagatgtccc

SEQ ID NO: 8392400 - DNA, 22 bp, Homo sapiens
ttacatttcccccttggaggct

SEQ ID NO: 8392401 - DNA, 22 bp, Homo sapiens
ttacatttggctatgtcctcta

SEQ ID NO: 8392402 - DNA, 22 bp, Homo sapiens
ttacattcattgaagtgattca

SEQ ID NO: 8392403 - DNA, 22 bp, Homo sapiens
ttacattcccagtgtgcagcat

SEQ ID NO: 8392404 - DNA, 22 bp, Homo sapiens
ttacattcttggaatcttgttt

SEQ ID NO: 8392405 - DNA, 22 bp, Homo sapiens
ttacattcttatctcagttatt

SEQ ID NO: 8392406 - DNA, 22 bp, Homo sapiens
ttacattcaatttctagaggta

SEQ ID NO: 8392407 - DNA, 21 bp, Homo sapiens
ttacattcagaggagtggaag

SEQ ID NO: 8392408 - DNA, 22 bp, Homo sapiens
ttacattcagaaagatttgagt

SEQ ID NO: 8392409 - DNA, 22 bp, Homo sapiens
ttacattcaaggaactcattct

SEQ ID NO: 8392410 - DNA, 22 bp, Homo sapiens
ttacatgactgcccttgtcagg

SEQ ID NO: 8392411 - DNA, 22 bp, Homo sapiens
ttacagcatttaatgagatctg

SEQ ID NO: 8392412 - DNA, 22 bp, Homo sapiens
ttacagcagcagggacagacta

SEQ ID NO: 8392413 - DNA, 22 bp, Homo sapiens
ttacagatggatctagcaaaat

SEQ ID NO: 8392414 - DNA, 21 bp, Homo sapiens
ttacagcaatgttagcaggaa

SEQ ID NO: 8392415 - DNA, 22 bp, Homo sapiens
ttacaactggtgaattttatgg

SEQ ID NO: 8392416 - DNA, 22 bp, Homo sapiens
ttacaacttgcagaggatgttg

SEQ ID NO: 8392417 - DNA, 22 bp, Homo sapiens
ttacaactctgaactacagagg

SEQ ID NO: 8392418 - DNA, 22 bp, Homo sapiens
ttacaacatatgataggagtct

SEQ ID NO: 8392419 - DNA, 22 bp, Homo sapiens
ttacaacatatttagcttgatt

SEQ ID NO: 8392420 - DNA, 21 bp, Homo sapiens
ttacaacatttgtgttctatg

SEQ ID NO: 8392421 - DNA, 21 bp, Homo sapiens
ttacaacatttgtgttctatg

SEQ ID NO: 8392422 - DNA, 22 bp, Homo sapiens
ttacaacatatttagcttgatt

SEQ ID NO: 8392423 - DNA, 21 bp, Homo sapiens
ttacaacatttgtgttctatg

SEQ ID NO: 8392424 - DNA, 22 bp, Homo sapiens
ttacaacactacttatccttga

SEQ ID NO: 8392425 - DNA, 22 bp, Homo sapiens
ttacaacactacttatccttga

SEQ ID NO: 8392426 - DNA, 22 bp, Homo sapiens
ttacaacagacacatattctaa

SEQ ID NO: 8392427 - DNA, 22 bp, Homo sapiens
ttacaacagacacatattctaa

SEQ ID NO: 8392428 - DNA, 22 bp, Homo sapiens
ttacaacagacacatattctaa

SEQ ID NO: 8392429 - DNA, 22 bp, Homo sapiens
ttacaacagacacatattctaa

SEQ ID NO: 8392430 - DNA, 23 bp, Homo sapiens
ttacaacagtgtccatatttgta

SEQ ID NO: 8392431 - DNA, 22 bp, Homo sapiens
ttacaacagcgatttacctgtc

SEQ ID NO: 8392432 - DNA, 22 bp, Homo sapiens
ttacaacaccaggcagtatcct

SEQ ID NO: 8392433 - DNA, 22 bp, Homo sapiens
ttacaacaccaggcagtatcct

SEQ ID NO: 8392434 - DNA, 22 bp, Homo sapiens
ttacaacaccaggcagtatcct

SEQ ID NO: 8392435 - DNA, 17 bp, Homo sapiens
ttacaacaattcatgag

SEQ ID NO: 8392436 - DNA, 22 bp, Homo sapiens
ttacaacaaaggcacgtgcatg

SEQ ID NO: 8392437 - DNA, 17 bp, Homo sapiens
ttacaacaattcatgag

SEQ ID NO: 8392438 - DNA, 22 bp, Homo sapiens
ttacaaagttctgagttcaaac

SEQ ID NO: 8392439 - DNA, 22 bp, Homo sapiens
ttacaaagtttaaggtggcact

SEQ ID NO: 8392440 - DNA, 22 bp, Homo sapiens
ttacaaagtgttatgataaaca

SEQ ID NO: 8392441 - DNA, 22 bp, Homo sapiens
ttacaaagttctgagttcaaac

SEQ ID NO: 8392442 - DNA, 22 bp, Homo sapiens
ttacaaaggtagttttgtctat

SEQ ID NO: 8392443 - DNA, 22 bp, Homo sapiens
ttacaaagtgctgcaccatttt

SEQ ID NO: 8392444 - DNA, 22 bp, Homo sapiens
ttacaaagtgttatgataaaca

SEQ ID NO: 8392445 - DNA, 20 bp, Homo sapiens
ttacaaagaggcatcgcttt

SEQ ID NO: 8392446 - DNA, 21 bp, Homo sapiens
ttacaaagctacagatgttgc

SEQ ID NO: 8392447 - DNA, 21 bp, Homo sapiens
ttacaaagctacagatgttgc

SEQ ID NO: 8392448 - DNA, 21 bp, Homo sapiens
ttacaaagctacagatgttgc

SEQ ID NO: 8392449 - DNA, 22 bp, Homo sapiens
ttaattaagagatactgcagta

SEQ ID NO: 8392450 - DNA, 22 bp, Homo sapiens
ttaattaactagccaaccacta

SEQ ID NO: 8392451 - DNA, 22 bp, Homo sapiens
ttaatgttttaagttatagaga

SEQ ID NO: 8392452 - DNA, 22 bp, Homo sapiens
ttaattaaattcatgagcattg

SEQ ID NO: 8392453 - DNA, 22 bp, Homo sapiens
ttaatgttttaagttatagaga

SEQ ID NO: 8392454 - DNA, 22 bp, Homo sapiens
ttacaaagaaaattaggcattt

SEQ ID NO: 8392455 - DNA, 22 bp, Homo sapiens
ttaaagaatagtgcccctattg

SEQ ID NO: 8392456 - DNA, 22 bp, Homo sapiens
ttaaagagaaagtgtttgtctt

SEQ ID NO: 8392457 - DNA, 23 bp, Homo sapiens
ttaaacttcagtgcagaacactc

SEQ ID NO: 8392458 - DNA, 22 bp, Homo sapiens
ttaaactgcttgaattgggttt

SEQ ID NO: 8392459 - DNA, 22 bp, Homo sapiens
ttaaactgcagactcagtgttc

SEQ ID NO: 8392460 - DNA, 22 bp, Homo sapiens
ttaaacctcagagtctttttca

SEQ ID NO: 8392461 - DNA, 22 bp, Homo sapiens
ttaaaccatagtttaacataag

SEQ ID NO: 8392462 - DNA, 22 bp, Homo sapiens
ttaaactgcagactcagtgttc

SEQ ID NO: 8392463 - DNA, 22 bp, Homo sapiens
ttaaagaggcatgggaatgtat

SEQ ID NO: 8392464 - DNA, 22 bp, Homo sapiens
ttaaagaggtagttaggtttaa

SEQ ID NO: 8392465 - DNA, 22 bp, Homo sapiens
ttaaagagggaaagacttcaga

SEQ ID NO: 8392466 - DNA, 22 bp, Homo sapiens
ttaaagagtaatcataggtcaa

SEQ ID NO: 8392467 - DNA, 22 bp, Homo sapiens
ttaaagagtaatcataggtcaa

SEQ ID NO: 8392468 - DNA, 22 bp, Homo sapiens
ttaaagagtctactgcacatcc

SEQ ID NO: 8392469 - DNA, 22 bp, Homo sapiens
ttaataaagtatgaattggaaa

SEQ ID NO: 8392470 - DNA, 22 bp, Homo sapiens
ttaaagcaaaaactaggatgga

SEQ ID NO: 8392471 - DNA, 22 bp, Homo sapiens
ttaaagatgcagctttagagaa

SEQ ID NO: 8392472 - DNA, 22 bp, Homo sapiens
ttaaagagtttattacttgtaa

SEQ ID NO: 8392473 - DNA, 22 bp, Homo sapiens
ttaaagagtctactgcacatcc

SEQ ID NO: 8392474 - DNA, 22 bp, Homo sapiens
ttaaagagtttattacttgtaa

SEQ ID NO: 8392475 - DNA, 22 bp, Homo sapiens
ttaatggcagggcagaatatta

SEQ ID NO: 8392476 - DNA, 22 bp, Homo sapiens
ttaatacagtctccagaagtaa

SEQ ID NO: 8392477 - DNA, 22 bp, Homo sapiens
ttaataaagtatgaattggaaa

SEQ ID NO: 8392478 - DNA, 22 bp, Homo sapiens
ttaataataatgagcccatttt

SEQ ID NO: 8392479 - DNA, 22 bp, Homo sapiens
ttaatacaactgttgtcactgg

SEQ ID NO: 8392480 - DNA, 22 bp, Homo sapiens
ttccagcagggtacttgtaatt

SEQ ID NO: 8392481 - DNA, 22 bp, Homo sapiens
ttccagctaactcacatccctt

SEQ ID NO: 8392482 - DNA, 22 bp, Homo sapiens
ttccagagtcagccactgggag

SEQ ID NO: 8392483 - DNA, 22 bp, Homo sapiens
ttcattcttgtctttgtatagt

SEQ ID NO: 8392484 - DNA, 22 bp, Homo sapiens
ttcattcttgtctttgtatagt

SEQ ID NO: 8392485 - DNA, 22 bp, Homo sapiens
ttcattctttgaatctgaggta

SEQ ID NO: 8392486 - DNA, 19 bp, Homo sapiens
ttcattctttctacttacc

SEQ ID NO: 8392487 - DNA, 19 bp, Homo sapiens
ttcattctttctacttacc

SEQ ID NO: 8392488 - DNA, 22 bp, Homo sapiens
ttcattcttttacatgtgaata

SEQ ID NO: 8392489 - DNA, 22 bp, Homo sapiens
ttcattcttttacatgtgaata

SEQ ID NO: 8392490 - DNA, 22 bp, Homo sapiens
ttcattgaaatacagtcttgac

SEQ ID NO: 8392491 - DNA, 22 bp, Homo sapiens
ttcattcatctctaaaatgcct

SEQ ID NO: 8392492 - DNA, 22 bp, Homo sapiens
ttcattcatcacatgcagctgg

SEQ ID NO: 8392493 - DNA, 22 bp, Homo sapiens
ttcattcaggtgtatttatggg

SEQ ID NO: 8392494 - DNA, 22 bp, Homo sapiens
ttcattcaaggggttcctgatt

SEQ ID NO: 8392495 - DNA, 23 bp, Homo sapiens
ttcattcaaaaggaaaagtcatg

SEQ ID NO: 8392496 - DNA, 22 bp, Homo sapiens
ttcattaattcattcagtgact

SEQ ID NO: 8392497 - DNA, 22 bp, Homo sapiens
ttcattaagtataaaatgtggt

SEQ ID NO: 8392498 - DNA, 22 bp, Homo sapiens
ttcattactgaattctcactac

SEQ ID NO: 8392499 - DNA, 22 bp, Homo sapiens
ttcaggaatcaaccaagtcatt

SEQ ID NO: 8392500 - DNA, 22 bp, Homo sapiens
ttcaggaatataggcattgaca

SEQ ID NO: 8392501 - DNA, 22 bp, Homo sapiens
ttcatgtttgtaggactgaggc

SEQ ID NO: 8392502 - DNA, 22 bp, Homo sapiens
ttcagccagtcatcagtcttgt

SEQ ID NO: 8392503 - DNA, 22 bp, Homo sapiens
ttcagcattggtatgaaaaccc

SEQ ID NO: 8392504 - DNA, 22 bp, Homo sapiens
ttcagcttgcttagtctccttc

SEQ ID NO: 8392505 - DNA, 23 bp, Homo sapiens
ttcaggaaatgaatacagacaca

SEQ ID NO: 8392506 - DNA, 23 bp, Homo sapiens
ttcaggaaatgaatacagacaca

SEQ ID NO: 8392507 - DNA, 23 bp, Homo sapiens
ttcaggaaatgaatacagacaca

SEQ ID NO: 8392508 - DNA, 20 bp, Homo sapiens
ttcaggaataagatagcagc

SEQ ID NO: 8392509 - DNA, 22 bp, Homo sapiens
ttcaggaataattatcatatga

SEQ ID NO: 8392510 - DNA, 22 bp, Homo sapiens
ttcaggaaggtcctatagcaga

SEQ ID NO: 8392511 - DNA, 22 bp, Homo sapiens
ttcaggaaatgtctgcctacca

SEQ ID NO: 8392512 - DNA, 22 bp, Homo sapiens
ttcagcagcttttagtacattg

SEQ ID NO: 8392513 - DNA, 21 bp, Homo sapiens
ttcagcagtcctctagagata

SEQ ID NO: 8392514 - DNA, 21 bp, Homo sapiens
ttcagcagtcctctagagata

SEQ ID NO: 8392515 - DNA, 19 bp, Homo sapiens
ttcagcagtgtctgctctt

SEQ ID NO: 8392516 - DNA, 22 bp, Homo sapiens
ttcagcagtttctgagaagcaa

SEQ ID NO: 8392517 - DNA, 22 bp, Homo sapiens
ttcagcagtcgtccaggaaaag

SEQ ID NO: 8392518 - DNA, 22 bp, Homo sapiens
ttcagcagtgcagacacccagt

SEQ ID NO: 8392519 - DNA, 22 bp, Homo sapiens
ttcaccatttcccactaaacca

SEQ ID NO: 8392520 - DNA, 22 bp, Homo sapiens
ttcaccattacatacaaagatg

SEQ ID NO: 8392521 - DNA, 22 bp, Homo sapiens
ttcaccctggaccagaaattgg

SEQ ID NO: 8392522 - DNA, 22 bp, Homo sapiens
ttcactatgcttggaaacttct

SEQ ID NO: 8392523 - DNA, 22 bp, Homo sapiens
ttcactatgcttggaaacttct

SEQ ID NO: 8392524 - DNA, 22 bp, Homo sapiens
ttcactgaattaaaaagagtat

SEQ ID NO: 8392525 - DNA, 22 bp, Homo sapiens
ttatttcttgtctatgtagcca

SEQ ID NO: 8392526 - DNA, 22 bp, Homo sapiens
ttatttcttgtctatgtagcca

SEQ ID NO: 8392527 - DNA, 22 bp, Homo sapiens
ttatttctactattttgcctga

SEQ ID NO: 8392528 - DNA, 22 bp, Homo sapiens
ttatttctactattttgcctga

SEQ ID NO: 8392529 - DNA, 22 bp, Homo sapiens
ttatttgtgaatcatttatcta

SEQ ID NO: 8392530 - DNA, 22 bp, Homo sapiens
ttcacatttcataccacagctt

SEQ ID NO: 8392531 - DNA, 22 bp, Homo sapiens
ttcacattgttttaatgtgaat

SEQ ID NO: 8392532 - DNA, 22 bp, Homo sapiens
ttcacattgtgcagattatggt

SEQ ID NO: 8392533 - DNA, 22 bp, Homo sapiens
ttcaccatgggatgacaacagt

SEQ ID NO: 8392534 - DNA, 22 bp, Homo sapiens
ttcaccataatgcaaagtggga

SEQ ID NO: 8392535 - DNA, 22 bp, Homo sapiens
ttcacatttgaaaggaaagata

SEQ ID NO: 8392536 - DNA, 22 bp, Homo sapiens
tgtctaggtctaggttggcaat

SEQ ID NO: 8392537 - DNA, 22 bp, Homo sapiens
tgtctccacaggtgtcagctca

SEQ ID NO: 8392538 - DNA, 22 bp, Homo sapiens
tgtctaatgaattaattaatta

SEQ ID NO: 8392539 - DNA, 22 bp, Homo sapiens
tgtctaaatgcaatggatttcc

SEQ ID NO: 8392540 - DNA, 19 bp, Homo sapiens
tgtctagctgcacagctga

SEQ ID NO: 8392541 - DNA, 22 bp, Homo sapiens
tgtctagaaatgctgagtctca

SEQ ID NO: 8392542 - DNA, 22 bp, Homo sapiens
tgtctctagggcaatgtgaact

SEQ ID NO: 8392543 - DNA, 22 bp, Homo sapiens
tgtctcctgagagctggacaga

SEQ ID NO: 8392544 - DNA, 22 bp, Homo sapiens
tgtctcctgggtcccttccacc

SEQ ID NO: 8392545 - DNA, 21 bp, Homo sapiens
tgtctcctgttggcacatggc

SEQ ID NO: 8392546 - DNA, 22 bp, Homo sapiens
tgtctcccaggtgtgcccagtg

SEQ ID NO: 8392547 - DNA, 19 bp, Homo sapiens
tgtctcctcatgcaagtgt

SEQ ID NO: 8392548 - DNA, 22 bp, Homo sapiens
tgtctcctatttcctgctaagg

SEQ ID NO: 8392549 - DNA, 22 bp, Homo sapiens
tgtctgcagaagatggcatggg

SEQ ID NO: 8392550 - DNA, 22 bp, Homo sapiens
tgtctgcaaagtccagcacagg

SEQ ID NO: 8392551 - DNA, 22 bp, Homo sapiens
tgtctgctaaattactattaca

SEQ ID NO: 8392552 - DNA, 22 bp, Homo sapiens
tgtctcttgttaatgattacta

SEQ ID NO: 8392553 - DNA, 22 bp, Homo sapiens
tgtctcttggctctatcactta

SEQ ID NO: 8392554 - DNA, 22 bp, Homo sapiens
tgtctcttgttaatgattacta

SEQ ID NO: 8392555 - DNA, 22 bp, Homo sapiens
tgtctctgctgcaccttctggg

SEQ ID NO: 8392556 - DNA, 22 bp, Homo sapiens
tgtctctgctttccttgcaggg

SEQ ID NO: 8392557 - DNA, 22 bp, Homo sapiens
tgtctctttgggttcctcttgg

SEQ ID NO: 8392558 - DNA, 22 bp, Homo sapiens
tgtctctgaggtgagggtcagc

SEQ ID NO: 8392559 - DNA, 22 bp, Homo sapiens
tgtctctgaaatatgtggctcc

SEQ ID NO: 8392560 - DNA, 22 bp, Homo sapiens
tgtctctgaaatatgtggctcc

SEQ ID NO: 8392561 - DNA, 22 bp, Homo sapiens
tgtcttttataactgacatata

SEQ ID NO: 8392562 - DNA, 22 bp, Homo sapiens
tgtcttttacctaatgagctgg

SEQ ID NO: 8392563 - DNA, 22 bp, Homo sapiens
tgtcttttctactgtaagcata

SEQ ID NO: 8392564 - DNA, 22 bp, Homo sapiens
tgtcttttgccaaagatcagtt

SEQ ID NO: 8392565 - DNA, 22 bp, Homo sapiens
tgtcttttgccaaagatcagtt

SEQ ID NO: 8392566 - DNA, 22 bp, Homo sapiens
tgtcttttgccaaagatcagtt

SEQ ID NO: 8392567 - DNA, 22 bp, Homo sapiens
tgtcttttacctaatgagctgg

SEQ ID NO: 8392568 - DNA, 22 bp, Homo sapiens
tgtctttgttattgtggacagg

SEQ ID NO: 8392569 - DNA, 22 bp, Homo sapiens
tgtcttttacctaatgagctgg

SEQ ID NO: 8392570 - DNA, 22 bp, Homo sapiens
tgtctttaattctacatatctc

SEQ ID NO: 8392571 - DNA, 22 bp, Homo sapiens
tgtcttttggagcatctttctt

SEQ ID NO: 8392572 - DNA, 22 bp, Homo sapiens
tgtcttttggagcatctttctt

SEQ ID NO: 8392573 - DNA, 22 bp, Homo sapiens
tgtcttttggagcatctttctt

SEQ ID NO: 8392574 - DNA, 22 bp, Homo sapiens
tgtgaaaaaagttctagaagga

SEQ ID NO: 8392575 - DNA, 22 bp, Homo sapiens
tgtcttcatgcctgaaagaaga

SEQ ID NO: 8392576 - DNA, 22 bp, Homo sapiens
tgtcttcatggcggaacaactt

SEQ ID NO: 8392577 - DNA, 22 bp, Homo sapiens
tgtcttcatctcagacacagtt

SEQ ID NO: 8392578 - DNA, 22 bp, Homo sapiens
tgtcttcagtaaaatacactat

SEQ ID NO: 8392579 - DNA, 22 bp, Homo sapiens
tgtctttaaaattaaacacatc

SEQ ID NO: 8392580 - DNA, 22 bp, Homo sapiens
tgtcttctaccttgacagcatt

SEQ ID NO: 8392581 - DNA, 22 bp, Homo sapiens
tgtcttctgtattcaagtctat

SEQ ID NO: 8392582 - DNA, 17 bp, Homo sapiens
tgtcttctgaagagagc

SEQ ID NO: 8392583 - DNA, 22 bp, Homo sapiens
tgtctggatgtctggagcatcg

SEQ ID NO: 8392584 - DNA, 22 bp, Homo sapiens
tgtcttaatatgtgcattctgt

SEQ ID NO: 8392585 - DNA, 22 bp, Homo sapiens
tgtcttaatttccctttgtcat

SEQ ID NO: 8392586 - DNA, 22 bp, Homo sapiens
tgtcttaagtagattacagcct

SEQ ID NO: 8392587 - DNA, 22 bp, Homo sapiens
tgtcttcaggagtaaatatcat

SEQ ID NO: 8392588 - DNA, 22 bp, Homo sapiens
tgtcttcagataggcattcttc

SEQ ID NO: 8392589 - DNA, 22 bp, Homo sapiens
tgtcttcacatgataagccatt

SEQ ID NO: 8392590 - DNA, 22 bp, Homo sapiens
tgtcttcaaatattgaaatcct

SEQ ID NO: 8392591 - DNA, 22 bp, Homo sapiens
tgtcttattccttctgttcagc

SEQ ID NO: 8392592 - DNA, 22 bp, Homo sapiens
tgtcttattaagaccagtgact

SEQ ID NO: 8392593 - DNA, 17 bp, Homo sapiens
tgtcttatctgtcctgt

SEQ ID NO: 8392594 - DNA, 22 bp, Homo sapiens
tgtcttacatgagtcaccccaa

SEQ ID NO: 8392595 - DNA, 22 bp, Homo sapiens
tgtcttatgctgcatagactat

SEQ ID NO: 8392596 - DNA, 22 bp, Homo sapiens
tgtcttatggcatgtccactgg

SEQ ID NO: 8392597 - DNA, 22 bp, Homo sapiens
tgtgcgtcctgtgcgcacactg

SEQ ID NO: 8392598 - DNA, 22 bp, Homo sapiens
tgtgctaagtattttcttattt

SEQ ID NO: 8392599 - DNA, 22 bp, Homo sapiens
tgtgctattacacatttattta

SEQ ID NO: 8392600 - DNA, 22 bp, Homo sapiens
tgtgctcactctaaattaagat

SEQ ID NO: 8392601 - DNA, 22 bp, Homo sapiens
tgtgctctgcaatcagttcttt

SEQ ID NO: 8392602 - DNA, 22 bp, Homo sapiens
tgtgctctgactttctcctggt

SEQ ID NO: 8392603 - DNA, 22 bp, Homo sapiens
tgtgctctgaagagtgcatgtc

SEQ ID NO: 8392604 - DNA, 22 bp, Homo sapiens
tgtgctctggagttgccttcac

SEQ ID NO: 8392605 - DNA, 22 bp, Homo sapiens
tgtgctcttgtctgtgactaac

SEQ ID NO: 8392606 - DNA, 22 bp, Homo sapiens
tgtgctcttctgttacttgtag

SEQ ID NO: 8392607 - DNA, 22 bp, Homo sapiens
tgtgctgagcaaatccatctgt

SEQ ID NO: 8392608 - DNA, 22 bp, Homo sapiens
tgtggaaagtcaagttccagga

SEQ ID NO: 8392609 - DNA, 22 bp, Homo sapiens
tgtggaaaagccccacaggact

SEQ ID NO: 8392610 - DNA, 22 bp, Homo sapiens
tgtgccctcctgccaggggctg

SEQ ID NO: 8392611 - DNA, 22 bp, Homo sapiens
tgtgcctactgatagagccaag

SEQ ID NO: 8392612 - DNA, 22 bp, Homo sapiens
tgtgcctaatgtttccattttc
